United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 117

SEQ ID NO: 4143872 - RNA, 21 nt, Yersinia pestis
accgggggcguauuaucggau

SEQ ID NO: 4143873 - RNA, 18 nt, Yersinia pestis
accgggguucgcaaugaa

SEQ ID NO: 4143874 - RNA, 21 nt, Yersinia pestis
accgguaacauauaaaccagc

SEQ ID NO: 4143875 - RNA, 16 nt, Yersinia pestis
accgguacugaggcau

SEQ ID NO: 4143876 - RNA, 23 nt, Yersinia pestis
accggucgcguaccuucacauuu

SEQ ID NO: 4143877 - RNA, 18 nt, Yersinia pestis
accggugacguuggaucc

SEQ ID NO: 4143878 - RNA, 15 nt, Yersinia pestis
accgguuaaacuucu

SEQ ID NO: 4143879 - RNA, 20 nt, Yersinia pestis
accgguuuacccugcgccug

SEQ ID NO: 4143880 - RNA, 15 nt, Yersinia pestis
accguagauaauuca

SEQ ID NO: 4143881 - RNA, 19 nt, Yersinia pestis
accguauacgcugaaugau

SEQ ID NO: 4143882 - RNA, 13 nt, Yersinia pestis
accguaucagccc

SEQ ID NO: 4143883 - RNA, 18 nt, Yersinia pestis
accguaugcuuucaucuu

SEQ ID NO: 4143884 - RNA, 22 nt, Yersinia pestis
accgucaagacaacaaacagua

SEQ ID NO: 4143885 - RNA, 21 nt, Yersinia pestis
accgucaggggguucacgccu

SEQ ID NO: 4143886 - RNA, 22 nt, Yersinia pestis
accgugaacgauaacggcggua

SEQ ID NO: 4143887 - RNA, 19 nt, Yersinia pestis
accgugauguucaauucac

SEQ ID NO: 4143888 - RNA, 21 nt, Yersinia pestis
accgugcuggguaauucauua

SEQ ID NO: 4143889 - RNA, 13 nt, Yersinia pestis
accgugugcuucc

SEQ ID NO: 4143890 - RNA, 16 nt, Yersinia pestis
accguuagcaauguga

SEQ ID NO: 4143891 - RNA, 20 nt, Yersinia pestis
accguucaagaucgcgucau

SEQ ID NO: 4143892 - RNA, 18 nt, Yersinia pestis
accguuguauguggcugu

SEQ ID NO: 4143893 - RNA, 14 nt, Yersinia pestis
accguuguguauca

SEQ ID NO: 4143894 - RNA, 18 nt, Yersinia pestis
accuaaaacauaccaucc

SEQ ID NO: 4143895 - RNA, 21 nt, Yersinia pestis
accuaaaaugacgaucacugc

SEQ ID NO: 4143896 - RNA, 16 nt, Yersinia pestis
accuaaaccuucacuu

SEQ ID NO: 4143897 - RNA, 15 nt, Yersinia pestis
accuaaccaaacauu

SEQ ID NO: 4143898 - RNA, 16 nt, Yersinia pestis
accuaacgccaaaaug

SEQ ID NO: 4143899 - RNA, 20 nt, Yersinia pestis
accuaauaacgcucaucacg

SEQ ID NO: 4143900 - RNA, 16 nt, Yersinia pestis
accuaauacagcacca

SEQ ID NO: 4143901 - RNA, 15 nt, Yersinia pestis
accuaaugcaauggc

SEQ ID NO: 4143902 - RNA, 18 nt, Yersinia pestis
accuacaaccuaccaccu

SEQ ID NO: 4143903 - RNA, 19 nt, Yersinia pestis
accuacaaccuaccaccua

SEQ ID NO: 4143904 - RNA, 19 nt, Yersinia pestis
accuaccaccuaccaccua

SEQ ID NO: 4143905 - RNA, 19 nt, Yersinia pestis
accuaccgcaccaaugccg

SEQ ID NO: 4143906 - RNA, 14 nt, Yersinia pestis
accuacugacauuu

SEQ ID NO: 4143907 - RNA, 15 nt, Yersinia pestis
accuacugacauuuc

SEQ ID NO: 4143908 - RNA, 21 nt, Yersinia pestis
accuaucgccgccgccagccc

SEQ ID NO: 4143909 - RNA, 17 nt, Yersinia pestis
accuauuaucccaguuu

SEQ ID NO: 4143910 - RNA, 13 nt, Yersinia pestis
accuauugauaaa

SEQ ID NO: 4143911 - RNA, 17 nt, Yersinia pestis
accuauugauaaaacca

SEQ ID NO: 4143912 - RNA, 14 nt, Yersinia pestis
accuauuuuauccc

SEQ ID NO: 4143913 - RNA, 16 nt, Yersinia pestis
accucagccucauuca

SEQ ID NO: 4143914 - RNA, 15 nt, Yersinia pestis
accucagucaucgcc

SEQ ID NO: 4143915 - RNA, 17 nt, Yersinia pestis
accucauuggcgguuau

SEQ ID NO: 4143916 - RNA, 23 nt, Yersinia pestis
accucauuggcgguuauuauuua

SEQ ID NO: 4143917 - RNA, 21 nt, Yersinia pestis
accucauuggucgcugggccu

SEQ ID NO: 4143918 - RNA, 15 nt, Yersinia pestis
accuccauauccugg

SEQ ID NO: 4143919 - RNA, 18 nt, Yersinia pestis
accuccggcuaugccgga

SEQ ID NO: 4143920 - RNA, 22 nt, Yersinia pestis
accuccggcuaugccggaggau

SEQ ID NO: 4143921 - RNA, 19 nt, Yersinia pestis
accuccggggccugcggcc

SEQ ID NO: 4143922 - RNA, 16 nt, Yersinia pestis
accucgaaaucauccg

SEQ ID NO: 4143923 - RNA, 21 nt, Yersinia pestis
accucgaagggauaucucacc

SEQ ID NO: 4143924 - RNA, 16 nt, Yersinia pestis
accucgcccuuucuug

SEQ ID NO: 4143925 - RNA, 18 nt, Yersinia pestis
accucgcccuuucuuguu

SEQ ID NO: 4143926 - RNA, 18 nt, Yersinia pestis
accucggaaggccagagu

SEQ ID NO: 4143927 - RNA, 16 nt, Yersinia pestis
accucguaguaaugac

SEQ ID NO: 4143928 - RNA, 14 nt, Yersinia pestis
accucguuggcuac

SEQ ID NO: 4143929 - RNA, 13 nt, Yersinia pestis
accucucgccggu

SEQ ID NO: 4143930 - RNA, 19 nt, Yersinia pestis
accucugcaaugcccagag

SEQ ID NO: 4143931 - RNA, 14 nt, Yersinia pestis
accucugcugaugu

SEQ ID NO: 4143932 - RNA, 15 nt, Yersinia pestis
accucuucagguaag

SEQ ID NO: 4143933 - RNA, 24 nt, Yersinia pestis
accucuuccucgccguagcauuca

SEQ ID NO: 4143934 - RNA, 17 nt, Yersinia pestis
accucuuguaaaccagc

SEQ ID NO: 4143935 - RNA, 13 nt, Yersinia pestis
accugaaccugac

SEQ ID NO: 4143936 - RNA, 16 nt, Yersinia pestis
accugaaccugacgca

SEQ ID NO: 4143937 - RNA, 20 nt, Yersinia pestis
accugaaucaacucauuuau

SEQ ID NO: 4143938 - RNA, 21 nt, Yersinia pestis
accugaaugcgccgcggcccu

SEQ ID NO: 4143939 - RNA, 14 nt, Yersinia pestis
accugacuguggcu

SEQ ID NO: 4143940 - RNA, 20 nt, Yersinia pestis
accugacuguggcugcucug

SEQ ID NO: 4143941 - RNA, 13 nt, Yersinia pestis
accugagccaauc

SEQ ID NO: 4143942 - RNA, 15 nt, Yersinia pestis
accugaguaauauua

SEQ ID NO: 4143943 - RNA, 22 nt, Yersinia pestis
accugauccaguuucaguggcu

SEQ ID NO: 4143944 - RNA, 16 nt, Yersinia pestis
accugaucgugccauu

SEQ ID NO: 4143945 - RNA, 20 nt, Yersinia pestis
accugauuuaccgucuuuuu

SEQ ID NO: 4143946 - RNA, 22 nt, Yersinia pestis
accugcaacguuaaagaugaag

SEQ ID NO: 4143947 - RNA, 14 nt, Yersinia pestis
accugcaucaagcc

SEQ ID NO: 4143948 - RNA, 14 nt, Yersinia pestis
accugcaucaucac

SEQ ID NO: 4143949 - RNA, 16 nt, Yersinia pestis
accugcccgucacuca

SEQ ID NO: 4143950 - RNA, 17 nt, Yersinia pestis
accugccugcugcugug

SEQ ID NO: 4143951 - RNA, 12 nt, Yersinia pestis
accugccuucag

SEQ ID NO: 4143952 - RNA, 19 nt, Yersinia pestis
accugcgaccaauugauua

SEQ ID NO: 4143953 - RNA, 20 nt, Yersinia pestis
accugcgguugcuguggcag

SEQ ID NO: 4143954 - RNA, 18 nt, Yersinia pestis
accugcuaucaugauaaa

SEQ ID NO: 4143955 - RNA, 10 nt, Yersinia pestis
accugcucaa

SEQ ID NO: 4143956 - RNA, 15 nt, Yersinia pestis
accugcucaacugcu

SEQ ID NO: 4143957 - RNA, 16 nt, Yersinia pestis
accugcuggcgcaacu

SEQ ID NO: 4143958 - RNA, 15 nt, Yersinia pestis
accuggaacagugca

SEQ ID NO: 4143959 - RNA, 17 nt, Yersinia pestis
accugguuaucggccau

SEQ ID NO: 4143960 - RNA, 17 nt, Yersinia pestis
accuguacuuugauuca

SEQ ID NO: 4143961 - RNA, 16 nt, Yersinia pestis
accuguagcucauacu

SEQ ID NO: 4143962 - RNA, 17 nt, Yersinia pestis
accuguagcuuuuuaaa

SEQ ID NO: 4143963 - RNA, 18 nt, Yersinia pestis
accugucaccuaccaccu

SEQ ID NO: 4143964 - RNA, 19 nt, Yersinia pestis
accugucaccuaccaccua

SEQ ID NO: 4143965 - RNA, 13 nt, Yersinia pestis
accugucaccugu

SEQ ID NO: 4143966 - RNA, 22 nt, Yersinia pestis
accuguucccguucagccucug

SEQ ID NO: 4143967 - RNA, 21 nt, Yersinia pestis
accuguuucaacaucgcaccg

SEQ ID NO: 4143968 - RNA, 20 nt, Yersinia pestis
accuguuuuuguuguucuug

SEQ ID NO: 4143969 - RNA, 12 nt, Yersinia pestis
accuuaaaacag

SEQ ID NO: 4143970 - RNA, 16 nt, Yersinia pestis
accuuaaccaacauga

SEQ ID NO: 4143971 - RNA, 23 nt, Yersinia pestis
accuuaacugcauagcuaaccuu

SEQ ID NO: 4143972 - RNA, 17 nt, Yersinia pestis
accuuaaguaaguuuaa

SEQ ID NO: 4143973 - RNA, 17 nt, Yersinia pestis
accuuacagugauaauc

SEQ ID NO: 4143974 - RNA, 16 nt, Yersinia pestis
accuuacgucacccgc

SEQ ID NO: 4143975 - RNA, 14 nt, Yersinia pestis
accuuacugcauca

SEQ ID NO: 4143976 - RNA, 22 nt, Yersinia pestis
accuuacuucaaaacuaauauu

SEQ ID NO: 4143977 - RNA, 12 nt, Yersinia pestis
accuuaucacuc

SEQ ID NO: 4143978 - RNA, 21 nt, Yersinia pestis
accuucacgcaucacaucuug

SEQ ID NO: 4143979 - RNA, 16 nt, Yersinia pestis
accuucacgcucuugc

SEQ ID NO: 4143980 - RNA, 20 nt, Yersinia pestis
accuucacgcucuugcucuu

SEQ ID NO: 4143981 - RNA, 22 nt, Yersinia pestis
accuucagacugacgcagagcu

SEQ ID NO: 4143982 - RNA, 15 nt, Yersinia pestis
accuucagcaaagag

SEQ ID NO: 4143983 - RNA, 18 nt, Yersinia pestis
accuucaguuuauuuaag

SEQ ID NO: 4143984 - RNA, 19 nt, Yersinia pestis
accuucaguuuauuuaagc

SEQ ID NO: 4143985 - RNA, 19 nt, Yersinia pestis
accuuccauaacucaccuu

SEQ ID NO: 4143986 - RNA, 15 nt, Yersinia pestis
accuucccauccuag

SEQ ID NO: 4143987 - RNA, 20 nt, Yersinia pestis
accuuccgucccaagaaaag

SEQ ID NO: 4143988 - RNA, 16 nt, Yersinia pestis
accuucugauuuuuug

SEQ ID NO: 4143989 - RNA, 13 nt, Yersinia pestis
accuucuuaauga

SEQ ID NO: 4143990 - RNA, 13 nt, Yersinia pestis
accuugaauauca

SEQ ID NO: 4143991 - RNA, 22 nt, Yersinia pestis
accuugauuaauaacaguaaua

SEQ ID NO: 4143992 - RNA, 17 nt, Yersinia pestis
accuugcgccaaguccu

SEQ ID NO: 4143993 - RNA, 17 nt, Yersinia pestis
accuuggaaaacagcaa

SEQ ID NO: 4143994 - RNA, 23 nt, Yersinia pestis
accuugguaucuguuuuugccac

SEQ ID NO: 4143995 - RNA, 16 nt, Yersinia pestis
accuugugucaccaug

SEQ ID NO: 4143996 - RNA, 14 nt, Yersinia pestis
accuuguucccgca

SEQ ID NO: 4143997 - RNA, 15 nt, Yersinia pestis
accuuguuuguuacu

SEQ ID NO: 4143998 - RNA, 19 nt, Yersinia pestis
accuuuacaauuacacacc

SEQ ID NO: 4143999 - RNA, 23 nt, Yersinia pestis
accuuuaccagcgucaaaccauu

SEQ ID NO: 4144000 - RNA, 18 nt, Yersinia pestis
accuuucagacaagccag

SEQ ID NO: 4144001 - RNA, 20 nt, Yersinia pestis
accuuucgguugcaucagaa

SEQ ID NO: 4144002 - RNA, 18 nt, Yersinia pestis
accuuugaucauggcuug

SEQ ID NO: 4144003 - RNA, 20 nt, Yersinia pestis
accuuuguguugaacuuuau

SEQ ID NO: 4144004 - RNA, 17 nt, Yersinia pestis
accuuuugcugcacugc

SEQ ID NO: 4144005 - RNA, 14 nt, Yersinia pestis
acgaaaaccuaaua

SEQ ID NO: 4144006 - RNA, 13 nt, Yersinia pestis
acgaaaagcagca

SEQ ID NO: 4144007 - RNA, 14 nt, Yersinia pestis
acgaaaagcagcag

SEQ ID NO: 4144008 - RNA, 13 nt, Yersinia pestis
acgaaauacuuau

SEQ ID NO: 4144009 - RNA, 18 nt, Yersinia pestis
acgaaauagcgccugccc

SEQ ID NO: 4144010 - RNA, 12 nt, Yersinia pestis
acgaaaugccgc

SEQ ID NO: 4144011 - RNA, 23 nt, Yersinia pestis
acgaaaugucgaaagauagcaaa

SEQ ID NO: 4144012 - RNA, 16 nt, Yersinia pestis
acgaaauuuaagaaau

SEQ ID NO: 4144013 - RNA, 23 nt, Yersinia pestis
acgaacagugccaacagcgagau

SEQ ID NO: 4144014 - RNA, 20 nt, Yersinia pestis
acgaagcgugaaagcauccc

SEQ ID NO: 4144015 - RNA, 21 nt, Yersinia pestis
acgaauaacucucaucuaucg

SEQ ID NO: 4144016 - RNA, 17 nt, Yersinia pestis
acgaauaguaucugggg

SEQ ID NO: 4144017 - RNA, 18 nt, Yersinia pestis
acgaauaucuagcaacac

SEQ ID NO: 4144018 - RNA, 22 nt, Yersinia pestis
acgaaugagcaguaauagcaaa

SEQ ID NO: 4144019 - RNA, 19 nt, Yersinia pestis
acgaaugaguuuuguccug

SEQ ID NO: 4144020 - RNA, 13 nt, Yersinia pestis
acgacaacaucaa

SEQ ID NO: 4144021 - RNA, 21 nt, Yersinia pestis
acgacauguguaguaugcgau

SEQ ID NO: 4144022 - RNA, 22 nt, Yersinia pestis
acgacccacucguucucaacca

SEQ ID NO: 4144023 - RNA, 14 nt, Yersinia pestis
acgaccuugccaag

SEQ ID NO: 4144024 - RNA, 17 nt, Yersinia pestis
acgacgaaauagcgccu

SEQ ID NO: 4144025 - RNA, 16 nt, Yersinia pestis
acgacgcccccgccag

SEQ ID NO: 4144026 - RNA, 14 nt, Yersinia pestis
acgacgcccgcaga

SEQ ID NO: 4144027 - RNA, 23 nt, Yersinia pestis
acgacuagccuaacuggcgguua

SEQ ID NO: 4144028 - RNA, 18 nt, Yersinia pestis
acgacugcggugaucgac

SEQ ID NO: 4144029 - RNA, 18 nt, Yersinia pestis
acgacuucgucaucguaa

SEQ ID NO: 4144030 - RNA, 14 nt, Yersinia pestis
acgacuuuuccaca

SEQ ID NO: 4144031 - RNA, 17 nt, Yersinia pestis
acgagagaucguaggcu

SEQ ID NO: 4144032 - RNA, 23 nt, Yersinia pestis
acgagcuucaccuuuguguugaa

SEQ ID NO: 4144033 - RNA, 20 nt, Yersinia pestis
acgaguaaaaagauggccuc

SEQ ID NO: 4144034 - RNA, 13 nt, Yersinia pestis
acgaguaaauaca

SEQ ID NO: 4144035 - RNA, 16 nt, Yersinia pestis
acgaguaaauagcaaa

SEQ ID NO: 4144036 - RNA, 14 nt, Yersinia pestis
acgaguaaugaaau

SEQ ID NO: 4144037 - RNA, 20 nt, Yersinia pestis
acgaguuaacacgggcauga

SEQ ID NO: 4144038 - RNA, 19 nt, Yersinia pestis
acgaguuuucccugcgcca

SEQ ID NO: 4144039 - RNA, 14 nt, Yersinia pestis
acgauaaaggcggu

SEQ ID NO: 4144040 - RNA, 12 nt, Yersinia pestis
acgauaaaucgc

SEQ ID NO: 4144041 - RNA, 19 nt, Yersinia pestis
acgauaacgcucuuguagc

SEQ ID NO: 4144042 - RNA, 15 nt, Yersinia pestis
acgauaacuuuuggc

SEQ ID NO: 4144043 - RNA, 16 nt, Yersinia pestis
acgauaagaauauuua

SEQ ID NO: 4144044 - RNA, 15 nt, Yersinia pestis
acgauaccaccacca

SEQ ID NO: 4144045 - RNA, 16 nt, Yersinia pestis
acgauacgacuucuua

SEQ ID NO: 4144046 - RNA, 18 nt, Yersinia pestis
acgauacgacuucuuauu

SEQ ID NO: 4144047 - RNA, 17 nt, Yersinia pestis
acgauaguauaaauacc

SEQ ID NO: 4144048 - RNA, 19 nt, Yersinia pestis
acgauauaccucaguuauc

SEQ ID NO: 4144049 - RNA, 19 nt, Yersinia pestis
acgauauagagcucagcuu

SEQ ID NO: 4144050 - RNA, 16 nt, Yersinia pestis
acgauaucaauaaaga

SEQ ID NO: 4144051 - RNA, 13 nt, Yersinia pestis
acgauaucaccag

SEQ ID NO: 4144052 - RNA, 15 nt, Yersinia pestis
acgaucaaccauggc

SEQ ID NO: 4144053 - RNA, 19 nt, Yersinia pestis
acgaucaacccccugugga

SEQ ID NO: 4144054 - RNA, 14 nt, Yersinia pestis
acgaucacugcuuu

SEQ ID NO: 4144055 - RNA, 19 nt, Yersinia pestis
acgaucagugaagagauaa

SEQ ID NO: 4144056 - RNA, 14 nt, Yersinia pestis
acgaucauuauaua

SEQ ID NO: 4144057 - RNA, 21 nt, Yersinia pestis
acgaucccucggugauaaguu

SEQ ID NO: 4144058 - RNA, 20 nt, Yersinia pestis
acgauccgcuauuuucucug

SEQ ID NO: 4144059 - RNA, 19 nt, Yersinia pestis
acgaucuggucugccagaa

SEQ ID NO: 4144060 - RNA, 17 nt, Yersinia pestis
acgaucuuguucaccaa

SEQ ID NO: 4144061 - RNA, 23 nt, Yersinia pestis
acgaugcagcuuagaguaaguaa

SEQ ID NO: 4144062 - RNA, 20 nt, Yersinia pestis
acgauggaguggucaugcuc

SEQ ID NO: 4144063 - RNA, 13 nt, Yersinia pestis
acgaugucggcag

SEQ ID NO: 4144064 - RNA, 17 nt, Yersinia pestis
acgauuacccaccaccu

SEQ ID NO: 4144065 - RNA, 17 nt, Yersinia pestis
acgauuaccugcauauc

SEQ ID NO: 4144066 - RNA, 20 nt, Yersinia pestis
acgauuaccugcauauccuc

SEQ ID NO: 4144067 - RNA, 22 nt, Yersinia pestis
acgauuaucucuuacauaaaga

SEQ ID NO: 4144068 - RNA, 15 nt, Yersinia pestis
acgcaaaccccgaac

SEQ ID NO: 4144069 - RNA, 16 nt, Yersinia pestis
acgcaaacggguggcc

SEQ ID NO: 4144070 - RNA, 17 nt, Yersinia pestis
acgcaaagggcaacaau

SEQ ID NO: 4144071 - RNA, 22 nt, Yersinia pestis
acgcaacacagucgcacugaua

SEQ ID NO: 4144072 - RNA, 17 nt, Yersinia pestis
acgcaagcgggccaagg

SEQ ID NO: 4144073 - RNA, 17 nt, Yersinia pestis
acgcaaggucgcaacca

SEQ ID NO: 4144074 - RNA, 11 nt, Yersinia pestis
acgcaaguaaa

SEQ ID NO: 4144075 - RNA, 16 nt, Yersinia pestis
acgcaaguaaaaguca

SEQ ID NO: 4144076 - RNA, 14 nt, Yersinia pestis
acgcaauuuuaugg

SEQ ID NO: 4144077 - RNA, 21 nt, Yersinia pestis
acgcacacgaaucaggcggcu

SEQ ID NO: 4144078 - RNA, 15 nt, Yersinia pestis
acgcaccauccagca

SEQ ID NO: 4144079 - RNA, 16 nt, Yersinia pestis
acgcacucgaaucacu

SEQ ID NO: 4144080 - RNA, 17 nt, Yersinia pestis
acgcacucgaaucacuu

SEQ ID NO: 4144081 - RNA, 23 nt, Yersinia pestis
acgcacugagagcauaaccccaa

SEQ ID NO: 4144082 - RNA, 20 nt, Yersinia pestis
acgcagacaugauuaaauca

SEQ ID NO: 4144083 - RNA, 14 nt, Yersinia pestis
acgcagagaugaau

SEQ ID NO: 4144084 - RNA, 21 nt, Yersinia pestis
acgcagcaggcguagcgugug

SEQ ID NO: 4144085 - RNA, 19 nt, Yersinia pestis
acgcaggcacugcagaaaa

SEQ ID NO: 4144086 - RNA, 15 nt, Yersinia pestis
acgcaguacgugacg

SEQ ID NO: 4144087 - RNA, 15 nt, Yersinia pestis
acgcaucaauaauaa

SEQ ID NO: 4144088 - RNA, 23 nt, Yersinia pestis
acgcauucauaucguccaaaggg

SEQ ID NO: 4144089 - RNA, 17 nt, Yersinia pestis
acgccaaguaugcaggc

SEQ ID NO: 4144090 - RNA, 17 nt, Yersinia pestis
acgccaccagcgccaug

SEQ ID NO: 4144091 - RNA, 16 nt, Yersinia pestis
acgccagccucugcgc

SEQ ID NO: 4144092 - RNA, 22 nt, Yersinia pestis
acgccaguaaacagccagcauc

SEQ ID NO: 4144093 - RNA, 13 nt, Yersinia pestis
acgccauaucaua

SEQ ID NO: 4144094 - RNA, 15 nt, Yersinia pestis
acgccauaucauauc

SEQ ID NO: 4144095 - RNA, 13 nt, Yersinia pestis
acgccauccacuc

SEQ ID NO: 4144096 - RNA, 17 nt, Yersinia pestis
acgccauucauuuauca

SEQ ID NO: 4144097 - RNA, 19 nt, Yersinia pestis
acgccauuguugaauacca

SEQ ID NO: 4144098 - RNA, 14 nt, Yersinia pestis
acgccgaugaaggu

SEQ ID NO: 4144099 - RNA, 16 nt, Yersinia pestis
acgccggcuucccugu

SEQ ID NO: 4144100 - RNA, 16 nt, Yersinia pestis
acgccguaaauacauc

SEQ ID NO: 4144101 - RNA, 19 nt, Yersinia pestis
acgccguaaauacauccau

SEQ ID NO: 4144102 - RNA, 20 nt, Yersinia pestis
acgccguaaauacauccaug

SEQ ID NO: 4144103 - RNA, 17 nt, Yersinia pestis
acgccguggugaaaaau

SEQ ID NO: 4144104 - RNA, 13 nt, Yersinia pestis
acgccuacggcuu

SEQ ID NO: 4144105 - RNA, 13 nt, Yersinia pestis
acgccuauccuca

SEQ ID NO: 4144106 - RNA, 14 nt, Yersinia pestis
acgccugggaucca

SEQ ID NO: 4144107 - RNA, 13 nt, Yersinia pestis
acgccuucagcga

SEQ ID NO: 4144108 - RNA, 14 nt, Yersinia pestis
acgccuucauguug

SEQ ID NO: 4144109 - RNA, 19 nt, Yersinia pestis
acgccuucauguugcaaca

SEQ ID NO: 4144110 - RNA, 18 nt, Yersinia pestis
acgccuuggcguuucuga

SEQ ID NO: 4144111 - RNA, 22 nt, Yersinia pestis
acgcgaucuugaacggugagga

SEQ ID NO: 4144112 - RNA, 17 nt, Yersinia pestis
acgcgccgcagcagugc

SEQ ID NO: 4144113 - RNA, 22 nt, Yersinia pestis
acgcgccuccaguuuuccagag

SEQ ID NO: 4144114 - RNA, 17 nt, Yersinia pestis
acgcgcgguucacuggu

SEQ ID NO: 4144115 - RNA, 18 nt, Yersinia pestis
acgcggcuuuuaucuucc

SEQ ID NO: 4144116 - RNA, 22 nt, Yersinia pestis
acgcgguuaacgacgcauuaau

SEQ ID NO: 4144117 - RNA, 19 nt, Yersinia pestis
acgcgguugggcuucgguc

SEQ ID NO: 4144118 - RNA, 13 nt, Yersinia pestis
acgcguagagccu

SEQ ID NO: 4144119 - RNA, 14 nt, Yersinia pestis
acgcguagagccuu

SEQ ID NO: 4144120 - RNA, 15 nt, Yersinia pestis
acgcgucacuggcca

SEQ ID NO: 4144121 - RNA, 15 nt, Yersinia pestis
acgcuaaccaccguc

SEQ ID NO: 4144122 - RNA, 18 nt, Yersinia pestis
acgcuaaccaccgucacc

SEQ ID NO: 4144123 - RNA, 12 nt, Yersinia pestis
acgcuaauuaaa

SEQ ID NO: 4144124 - RNA, 20 nt, Yersinia pestis
acgcuaccaugagugaaaau

SEQ ID NO: 4144125 - RNA, 16 nt, Yersinia pestis
acgcuauauagacgaa

SEQ ID NO: 4144126 - RNA, 17 nt, Yersinia pestis
acgcucaaacaauguga

SEQ ID NO: 4144127 - RNA, 19 nt, Yersinia pestis
acgcucauccaacguaaac

SEQ ID NO: 4144128 - RNA, 13 nt, Yersinia pestis
acgcuccacaccc

SEQ ID NO: 4144129 - RNA, 15 nt, Yersinia pestis
acgcuccacacccgc

SEQ ID NO: 4144130 - RNA, 11 nt, Yersinia pestis
acgcucccucc

SEQ ID NO: 4144131 - RNA, 22 nt, Yersinia pestis
acgcuccgguuuucacccccac

SEQ ID NO: 4144132 - RNA, 21 nt, Yersinia pestis
acgcuccuggcgauccaguga

SEQ ID NO: 4144133 - RNA, 21 nt, Yersinia pestis
acgcucgguuguucagcacca

SEQ ID NO: 4144134 - RNA, 19 nt, Yersinia pestis
acgcucuaacgucagauaa

SEQ ID NO: 4144135 - RNA, 16 nt, Yersinia pestis
acgcugaaaaaucuuu

SEQ ID NO: 4144136 - RNA, 15 nt, Yersinia pestis
acgcugauagccaau

SEQ ID NO: 4144137 - RNA, 20 nt, Yersinia pestis
acgcugcuugccgcacgacg

SEQ ID NO: 4144138 - RNA, 15 nt, Yersinia pestis
acgcugggcgaucau

SEQ ID NO: 4144139 - RNA, 17 nt, Yersinia pestis
acgcugguuaucacagc

SEQ ID NO: 4144140 - RNA, 20 nt, Yersinia pestis
acgcugguuaucacagcaaa

SEQ ID NO: 4144141 - RNA, 15 nt, Yersinia pestis
acgcuguuggguugu

SEQ ID NO: 4144142 - RNA, 19 nt, Yersinia pestis
acgcuugauggccacacug

SEQ ID NO: 4144143 - RNA, 20 nt, Yersinia pestis
acgcuugauggccacacugu

SEQ ID NO: 4144144 - RNA, 22 nt, Yersinia pestis
acgcuuuaaaacuguggcugaa

SEQ ID NO: 4144145 - RNA, 23 nt, Yersinia pestis
acgcuuuacuccucugccuaucc

SEQ ID NO: 4144146 - RNA, 23 nt, Yersinia pestis
acgcuuucagggaguaacuugac

SEQ ID NO: 4144147 - RNA, 15 nt, Yersinia pestis
acgcuuuugcugcaa

SEQ ID NO: 4144148 - RNA, 13 nt, Yersinia pestis
acggagaagagga

SEQ ID NO: 4144149 - RNA, 18 nt, Yersinia pestis
acggagcguacacgcagu

SEQ ID NO: 4144150 - RNA, 20 nt, Yersinia pestis
acggaugaaaagugauccac

SEQ ID NO: 4144151 - RNA, 22 nt, Yersinia pestis
acggaugaaaagugauccacuu

SEQ ID NO: 4144152 - RNA, 15 nt, Yersinia pestis
acggaugauauccac

SEQ ID NO: 4144153 - RNA, 14 nt, Yersinia pestis
acggcaaugaccau

SEQ ID NO: 4144154 - RNA, 22 nt, Yersinia pestis
acggcaccggguauugaccacu

SEQ ID NO: 4144155 - RNA, 16 nt, Yersinia pestis
acggcagcgagcacug

SEQ ID NO: 4144156 - RNA, 19 nt, Yersinia pestis
acggcagcgagcacugccc

SEQ ID NO: 4144157 - RNA, 21 nt, Yersinia pestis
acggcagugaucgcacuucaa

SEQ ID NO: 4144158 - RNA, 17 nt, Yersinia pestis
acggcaucgcugcaaua

SEQ ID NO: 4144159 - RNA, 15 nt, Yersinia pestis
acggcauuagugaau

SEQ ID NO: 4144160 - RNA, 18 nt, Yersinia pestis
acggccaacugcuggcca

SEQ ID NO: 4144161 - RNA, 19 nt, Yersinia pestis
acggccaacugcuggccaa

SEQ ID NO: 4144162 - RNA, 14 nt, Yersinia pestis
acggccaauuucag

SEQ ID NO: 4144163 - RNA, 16 nt, Yersinia pestis
acggccaauuucagua

SEQ ID NO: 4144164 - RNA, 14 nt, Yersinia pestis
acggccagaaucaa

SEQ ID NO: 4144165 - RNA, 21 nt, Yersinia pestis
acggccaucaauaaagcuggc

SEQ ID NO: 4144166 - RNA, 21 nt, Yersinia pestis
acggccauuucuuagaccacc

SEQ ID NO: 4144167 - RNA, 14 nt, Yersinia pestis
acggcgaacuucgc

SEQ ID NO: 4144168 - RNA, 20 nt, Yersinia pestis
acggcgcagggcgauaucca

SEQ ID NO: 4144169 - RNA, 16 nt, Yersinia pestis
acggcggcgagcacug

SEQ ID NO: 4144170 - RNA, 19 nt, Yersinia pestis
acggcggcgagcacugccc

SEQ ID NO: 4144171 - RNA, 22 nt, Yersinia pestis
acggcgguuaaucggaugguca

SEQ ID NO: 4144172 - RNA, 14 nt, Yersinia pestis
acggcgucuuuacg

SEQ ID NO: 4144173 - RNA, 15 nt, Yersinia pestis
acggcgucuuuacga

SEQ ID NO: 4144174 - RNA, 22 nt, Yersinia pestis
acggcgucuuuacgaucugccu

SEQ ID NO: 4144175 - RNA, 13 nt, Yersinia pestis
acggcucacacac

SEQ ID NO: 4144176 - RNA, 14 nt, Yersinia pestis
acggcucaggugcu

SEQ ID NO: 4144177 - RNA, 17 nt, Yersinia pestis
acggcucuauuucauga

SEQ ID NO: 4144178 - RNA, 18 nt, Yersinia pestis
acggcuucucgaccaccg

SEQ ID NO: 4144179 - RNA, 21 nt, Yersinia pestis
acgggaucgagaguugcucac

SEQ ID NO: 4144180 - RNA, 19 nt, Yersinia pestis
acgggccgcauucaccacc

SEQ ID NO: 4144181 - RNA, 18 nt, Yersinia pestis
acgggcggaauacgccag

SEQ ID NO: 4144182 - RNA, 19 nt, Yersinia pestis
acggguauauugcccggua

SEQ ID NO: 4144183 - RNA, 13 nt, Yersinia pestis
acgggucagcuga

SEQ ID NO: 4144184 - RNA, 14 nt, Yersinia pestis
acgggucagcugac

SEQ ID NO: 4144185 - RNA, 23 nt, Yersinia pestis
acgguaaacgcaucccaggcauc

SEQ ID NO: 4144186 - RNA, 14 nt, Yersinia pestis
acgguaaucugaga

SEQ ID NO: 4144187 - RNA, 20 nt, Yersinia pestis
acgguaggcgguuuggcuug

SEQ ID NO: 4144188 - RNA, 22 nt, Yersinia pestis
acgguagugacucaucaaaaca

SEQ ID NO: 4144189 - RNA, 18 nt, Yersinia pestis
acgguaucugcuuuauca

SEQ ID NO: 4144190 - RNA, 22 nt, Yersinia pestis
acgguauuggagcugaaaauag

SEQ ID NO: 4144191 - RNA, 17 nt, Yersinia pestis
acggucagagauauaaa

SEQ ID NO: 4144192 - RNA, 23 nt, Yersinia pestis
acggucauucacuguggcggcca

SEQ ID NO: 4144193 - RNA, 13 nt, Yersinia pestis
acggucucuuucg

SEQ ID NO: 4144194 - RNA, 15 nt, Yersinia pestis
acggugaauaaaccc

SEQ ID NO: 4144195 - RNA, 11 nt, Yersinia pestis
acggugagaau

SEQ ID NO: 4144196 - RNA, 13 nt, Yersinia pestis
acggugaggauag

SEQ ID NO: 4144197 - RNA, 15 nt, Yersinia pestis
acggugaggauaggc

SEQ ID NO: 4144198 - RNA, 16 nt, Yersinia pestis
acggugccagcagcaa

SEQ ID NO: 4144199 - RNA, 15 nt, Yersinia pestis
acggugugcaaugca

SEQ ID NO: 4144200 - RNA, 21 nt, Yersinia pestis
acgguguggcaccaugcugcu

SEQ ID NO: 4144201 - RNA, 21 nt, Yersinia pestis
acgguguuuggugaagaaacc

SEQ ID NO: 4144202 - RNA, 23 nt, Yersinia pestis
acgguucagugcucccugaacgc

SEQ ID NO: 4144203 - RNA, 13 nt, Yersinia pestis
acgguucaucauu

SEQ ID NO: 4144204 - RNA, 17 nt, Yersinia pestis
acgguucccaugacgau

SEQ ID NO: 4144205 - RNA, 13 nt, Yersinia pestis
acgguugcccguu

SEQ ID NO: 4144206 - RNA, 16 nt, Yersinia pestis
acgguuucaacuucaa

SEQ ID NO: 4144207 - RNA, 17 nt, Yersinia pestis
acgguuucaacuucaac

SEQ ID NO: 4144208 - RNA, 18 nt, Yersinia pestis
acgguuuuaaucuccugg

SEQ ID NO: 4144209 - RNA, 20 nt, Yersinia pestis
acguaacgaauucagcagcg

SEQ ID NO: 4144210 - RNA, 13 nt, Yersinia pestis
acguaauaccacu

SEQ ID NO: 4144211 - RNA, 13 nt, Yersinia pestis
acguaauacccuc

SEQ ID NO: 4144212 - RNA, 16 nt, Yersinia pestis
acguaauguggugccg

SEQ ID NO: 4144213 - RNA, 15 nt, Yersinia pestis
acguagacauaaauu

SEQ ID NO: 4144214 - RNA, 15 nt, Yersinia pestis
acguagcgauaacag

SEQ ID NO: 4144215 - RNA, 17 nt, Yersinia pestis
acguagcugaauugcuu

SEQ ID NO: 4144216 - RNA, 13 nt, Yersinia pestis
acguaucaucagu

SEQ ID NO: 4144217 - RNA, 16 nt, Yersinia pestis
acguaucgcaguuaaa

SEQ ID NO: 4144218 - RNA, 13 nt, Yersinia pestis
acguauggcauga

SEQ ID NO: 4144219 - RNA, 21 nt, Yersinia pestis
acguauucgucaccaucaaua

SEQ ID NO: 4144220 - RNA, 19 nt, Yersinia pestis
acguauugccucggcaagu

SEQ ID NO: 4144221 - RNA, 21 nt, Yersinia pestis
acguauugguaacgcagaaau

SEQ ID NO: 4144222 - RNA, 19 nt, Yersinia pestis
acguauuuucauuuuaaca

SEQ ID NO: 4144223 - RNA, 15 nt, Yersinia pestis
acgucaccacgcagu

SEQ ID NO: 4144224 - RNA, 20 nt, Yersinia pestis
acgucacccaaccgaccaaa

SEQ ID NO: 4144225 - RNA, 17 nt, Yersinia pestis
acgucaccgccaaaaua

SEQ ID NO: 4144226 - RNA, 15 nt, Yersinia pestis
acgucaccuuucuug

SEQ ID NO: 4144227 - RNA, 22 nt, Yersinia pestis
acgucagauaaaaaaggguaau

SEQ ID NO: 4144228 - RNA, 18 nt, Yersinia pestis
acgucagauaaacaaaca

SEQ ID NO: 4144229 - RNA, 17 nt, Yersinia pestis
acgucaguaaugagggu

SEQ ID NO: 4144230 - RNA, 18 nt, Yersinia pestis
acgucauaauugccaaac

SEQ ID NO: 4144231 - RNA, 22 nt, Yersinia pestis
acgucauugguguuacagcaag

SEQ ID NO: 4144232 - RNA, 14 nt, Yersinia pestis
acguccccugagcg

SEQ ID NO: 4144233 - RNA, 16 nt, Yersinia pestis
acgucuccauuucaac

SEQ ID NO: 4144234 - RNA, 13 nt, Yersinia pestis
acgucugaaaaac

SEQ ID NO: 4144235 - RNA, 17 nt, Yersinia pestis
acgucugcaauagcuca

SEQ ID NO: 4144236 - RNA, 20 nt, Yersinia pestis
acgugaaagcacgauaaaug

SEQ ID NO: 4144237 - RNA, 16 nt, Yersinia pestis
acgugagaauugcugc

SEQ ID NO: 4144238 - RNA, 21 nt, Yersinia pestis
acgugagcguucaaaaucaaa

SEQ ID NO: 4144239 - RNA, 14 nt, Yersinia pestis
acgugaucaucuuu

SEQ ID NO: 4144240 - RNA, 23 nt, Yersinia pestis
acgugaucgccgcuaauuuuccc

SEQ ID NO: 4144241 - RNA, 20 nt, Yersinia pestis
acgugcagcgcgcagccaac

SEQ ID NO: 4144242 - RNA, 22 nt, Yersinia pestis
acgugcguuuuugaaauaccac

SEQ ID NO: 4144243 - RNA, 13 nt, Yersinia pestis
acguggaccauuu

SEQ ID NO: 4144244 - RNA, 19 nt, Yersinia pestis
acguggagccugugcagcc

SEQ ID NO: 4144245 - RNA, 19 nt, Yersinia pestis
acguggccugccagccaua

SEQ ID NO: 4144246 - RNA, 14 nt, Yersinia pestis
acguggucaagaau

SEQ ID NO: 4144247 - RNA, 20 nt, Yersinia pestis
acguggucaagaauauaaua

SEQ ID NO: 4144248 - RNA, 14 nt, Yersinia pestis
acguguaaaaccuu

SEQ ID NO: 4144249 - RNA, 22 nt, Yersinia pestis
acguguacucauauuguccaaa

SEQ ID NO: 4144250 - RNA, 20 nt, Yersinia pestis
acgugucagacugcugacaa

SEQ ID NO: 4144251 - RNA, 19 nt, Yersinia pestis
acguguuggcuaagcaugc

SEQ ID NO: 4144252 - RNA, 16 nt, Yersinia pestis
acguuaaguucaagaa

SEQ ID NO: 4144253 - RNA, 15 nt, Yersinia pestis
acguuauaacucaag

SEQ ID NO: 4144254 - RNA, 23 nt, Yersinia pestis
acguuaugaauaaaccagcaagc

SEQ ID NO: 4144255 - RNA, 13 nt, Yersinia pestis
acguucaaaugau

SEQ ID NO: 4144256 - RNA, 18 nt, Yersinia pestis
acguucaacgaccucauc

SEQ ID NO: 4144257 - RNA, 15 nt, Yersinia pestis
acguucagcacugcu

SEQ ID NO: 4144258 - RNA, 17 nt, Yersinia pestis
acguucagcacugcuuu

SEQ ID NO: 4144259 - RNA, 18 nt, Yersinia pestis
acguucgacgauauugau

SEQ ID NO: 4144260 - RNA, 12 nt, Yersinia pestis
acguucugccaa

SEQ ID NO: 4144261 - RNA, 12 nt, Yersinia pestis
acguugaguaau

SEQ ID NO: 4144262 - RNA, 15 nt, Yersinia pestis
acguugcacccugcu

SEQ ID NO: 4144263 - RNA, 21 nt, Yersinia pestis
acguuggccuuucaccgguuc

SEQ ID NO: 4144264 - RNA, 21 nt, Yersinia pestis
acguuggcggcuccaggcauu

SEQ ID NO: 4144265 - RNA, 15 nt, Yersinia pestis
acguuggcuucaccu

SEQ ID NO: 4144266 - RNA, 19 nt, Yersinia pestis
acguugggcggucaucagc

SEQ ID NO: 4144267 - RNA, 21 nt, Yersinia pestis
acguuguuaucaucaccaccc

SEQ ID NO: 4144268 - RNA, 21 nt, Yersinia pestis
acguuguuuucccucagccaa

SEQ ID NO: 4144269 - RNA, 15 nt, Yersinia pestis
acguuuaucgcuacc

SEQ ID NO: 4144270 - RNA, 21 nt, Yersinia pestis
acguuuauuuauaagaacaac

SEQ ID NO: 4144271 - RNA, 15 nt, Yersinia pestis
acguuuccaaaacuc

SEQ ID NO: 4144272 - RNA, 18 nt, Yersinia pestis
acguuuccccuucauuug

SEQ ID NO: 4144273 - RNA, 19 nt, Yersinia pestis
acguuuuaaugccaauuga

SEQ ID NO: 4144274 - RNA, 13 nt, Yersinia pestis
acguuuuauucac

SEQ ID NO: 4144275 - RNA, 17 nt, Yersinia pestis
acuaaaauucaaacaaa

SEQ ID NO: 4144276 - RNA, 16 nt, Yersinia pestis
acuaaacagaucaccc

SEQ ID NO: 4144277 - RNA, 18 nt, Yersinia pestis
acuaaauuagaaaacaag

SEQ ID NO: 4144278 - RNA, 18 nt, Yersinia pestis
acuaacacgacuuuuggc

SEQ ID NO: 4144279 - RNA, 16 nt, Yersinia pestis
acuaacagaauauuga

SEQ ID NO: 4144280 - RNA, 14 nt, Yersinia pestis
acuaacaucagcga

SEQ ID NO: 4144281 - RNA, 22 nt, Yersinia pestis
acuaacaucagcgauucauuga

SEQ ID NO: 4144282 - RNA, 15 nt, Yersinia pestis
acuaacgucccauuc

SEQ ID NO: 4144283 - RNA, 22 nt, Yersinia pestis
acuaacguuuuguaaucaacac

SEQ ID NO: 4144284 - RNA, 17 nt, Yersinia pestis
acuaagagucacagcau

SEQ ID NO: 4144285 - RNA, 17 nt, Yersinia pestis
acuaagauucaaacagu

SEQ ID NO: 4144286 - RNA, 21 nt, Yersinia pestis
acuaauaauaauuaaucuuaa

SEQ ID NO: 4144287 - RNA, 22 nt, Yersinia pestis
acuaauacucuguuaccaaugg

SEQ ID NO: 4144288 - RNA, 17 nt, Yersinia pestis
acuaauagcauuuuucg

SEQ ID NO: 4144289 - RNA, 21 nt, Yersinia pestis
acuaaugccucacggcuacca

SEQ ID NO: 4144290 - RNA, 22 nt, Yersinia pestis
acuaauggguuagcgguuaaaa

SEQ ID NO: 4144291 - RNA, 13 nt, Yersinia pestis
acuaauguuuguu

SEQ ID NO: 4144292 - RNA, 22 nt, Yersinia pestis
acuaccaaauaaauauccuccg

SEQ ID NO: 4144293 - RNA, 15 nt, Yersinia pestis
acuaccgaucaucag

SEQ ID NO: 4144294 - RNA, 18 nt, Yersinia pestis
acuaccgaucaucaggca

SEQ ID NO: 4144295 - RNA, 22 nt, Yersinia pestis
acuacguuguuaucaucaccac

SEQ ID NO: 4144296 - RNA, 13 nt, Yersinia pestis
acuagcaucaccc

SEQ ID NO: 4144297 - RNA, 17 nt, Yersinia pestis
acuagccauuuggugau

SEQ ID NO: 4144298 - RNA, 15 nt, Yersinia pestis
acuagccuaacuggc

SEQ ID NO: 4144299 - RNA, 21 nt, Yersinia pestis
acuauacccaaguuacuucaa

SEQ ID NO: 4144300 - RNA, 17 nt, Yersinia pestis
acuauaggcuauuuuac

SEQ ID NO: 4144301 - RNA, 22 nt, Yersinia pestis
acuauaggcuauuuuacuugcc

SEQ ID NO: 4144302 - RNA, 21 nt, Yersinia pestis
acuauauucucauugcccccu

SEQ ID NO: 4144303 - RNA, 16 nt, Yersinia pestis
acuaucuauuauuaaa

SEQ ID NO: 4144304 - RNA, 17 nt, Yersinia pestis
acuaucuuuauugcucc

SEQ ID NO: 4144305 - RNA, 17 nt, Yersinia pestis
acuaugggggauuaucg

SEQ ID NO: 4144306 - RNA, 18 nt, Yersinia pestis
acuauucaucccuaaaau

SEQ ID NO: 4144307 - RNA, 18 nt, Yersinia pestis
acuauuccgucgauaucu

SEQ ID NO: 4144308 - RNA, 19 nt, Yersinia pestis
acuauucugccuauccuca

SEQ ID NO: 4144309 - RNA, 12 nt, Yersinia pestis
acuauucugcuu

SEQ ID NO: 4144310 - RNA, 17 nt, Yersinia pestis
acuauugcaucuuuaau

SEQ ID NO: 4144311 - RNA, 22 nt, Yersinia pestis
acuauuuacauaauaaccauuu

SEQ ID NO: 4144312 - RNA, 21 nt, Yersinia pestis
acuauuucguguauaucacua

SEQ ID NO: 4144313 - RNA, 18 nt, Yersinia pestis
acuauuuucauuguucuu

SEQ ID NO: 4144314 - RNA, 17 nt, Yersinia pestis
acuauuuuugacuuuaa

SEQ ID NO: 4144315 - RNA, 22 nt, Yersinia pestis
acuauuuuugacuuuaauuaaa

SEQ ID NO: 4144316 - RNA, 23 nt, Yersinia pestis
acuauuuuugacuuuaauuaaaa

SEQ ID NO: 4144317 - RNA, 16 nt, Yersinia pestis
acucaaaaaaaauaca

SEQ ID NO: 4144318 - RNA, 12 nt, Yersinia pestis
acucaaaacaau

SEQ ID NO: 4144319 - RNA, 19 nt, Yersinia pestis
acucaaguaugcaggguua

SEQ ID NO: 4144320 - RNA, 21 nt, Yersinia pestis
acucaauguaagcaucuuuuc

SEQ ID NO: 4144321 - RNA, 23 nt, Yersinia pestis
acucaauguaagcaucuuuucau

SEQ ID NO: 4144322 - RNA, 16 nt, Yersinia pestis
acucaaugucaugcaa

SEQ ID NO: 4144323 - RNA, 14 nt, Yersinia pestis
acucacaacccgcu

SEQ ID NO: 4144324 - RNA, 12 nt, Yersinia pestis
acucaccccacu

SEQ ID NO: 4144325 - RNA, 18 nt, Yersinia pestis
acucaccccacuuuccac

SEQ ID NO: 4144326 - RNA, 15 nt, Yersinia pestis
acucaccuaaaucaa

SEQ ID NO: 4144327 - RNA, 18 nt, Yersinia pestis
acucaccuucuugguuag

SEQ ID NO: 4144328 - RNA, 20 nt, Yersinia pestis
acucacgguuucuaaaaaau

SEQ ID NO: 4144329 - RNA, 16 nt, Yersinia pestis
acucacguauuuucau

SEQ ID NO: 4144330 - RNA, 23 nt, Yersinia pestis
acucacucucaucugaacuauug

SEQ ID NO: 4144331 - RNA, 22 nt, Yersinia pestis
acucagaaaacagccaccagcc

SEQ ID NO: 4144332 - RNA, 23 nt, Yersinia pestis
acucagaaaacagccaccagcca

SEQ ID NO: 4144333 - RNA, 21 nt, Yersinia pestis
acucagacuucuuccaucuua

SEQ ID NO: 4144334 - RNA, 12 nt, Yersinia pestis
acucagaucacc

SEQ ID NO: 4144335 - RNA, 15 nt, Yersinia pestis
acucagcauccuccu

SEQ ID NO: 4144336 - RNA, 21 nt, Yersinia pestis
acucagcauccuccugaucuu

SEQ ID NO: 4144337 - RNA, 14 nt, Yersinia pestis
acucagccaaucca

SEQ ID NO: 4144338 - RNA, 17 nt, Yersinia pestis
acucagccaauccagca

SEQ ID NO: 4144339 - RNA, 23 nt, Yersinia pestis
acucagcuugguaaugcgcacca

SEQ ID NO: 4144340 - RNA, 17 nt, Yersinia pestis
acucaggcgugucauuu

SEQ ID NO: 4144341 - RNA, 16 nt, Yersinia pestis
acucaguucagccccc

SEQ ID NO: 4144342 - RNA, 19 nt, Yersinia pestis
acucauauuguccaaagga

SEQ ID NO: 4144343 - RNA, 15 nt, Yersinia pestis
acucaucaaaacaau

SEQ ID NO: 4144344 - RNA, 16 nt, Yersinia pestis
acucaugacaucccag

SEQ ID NO: 4144345 - RNA, 19 nt, Yersinia pestis
acucaugccggucugcugg

SEQ ID NO: 4144346 - RNA, 21 nt, Yersinia pestis
acucaugcucuucauaagcca

SEQ ID NO: 4144347 - RNA, 22 nt, Yersinia pestis
acucauguccagggcaaucagg

SEQ ID NO: 4144348 - RNA, 19 nt, Yersinia pestis
acucauuccgccuguuuuc

SEQ ID NO: 4144349 - RNA, 18 nt, Yersinia pestis
acucauugcgucagguaa

SEQ ID NO: 4144350 - RNA, 17 nt, Yersinia pestis
acuccacuuccucauuc

SEQ ID NO: 4144351 - RNA, 15 nt, Yersinia pestis
acuccauuaauuuau

SEQ ID NO: 4144352 - RNA, 16 nt, Yersinia pestis
acuccauuuuuuugau

SEQ ID NO: 4144353 - RNA, 18 nt, Yersinia pestis
acuccccgucagcaucau

SEQ ID NO: 4144354 - RNA, 14 nt, Yersinia pestis
acuccccuggcagg

SEQ ID NO: 4144355 - RNA, 13 nt, Yersinia pestis
acuccccuggcgg

SEQ ID NO: 4144356 - RNA, 16 nt, Yersinia pestis
acucccggcagcacug

SEQ ID NO: 4144357 - RNA, 18 nt, Yersinia pestis
acucccuucaaucaauga

SEQ ID NO: 4144358 - RNA, 18 nt, Yersinia pestis
acucccuuguugccuuuc

SEQ ID NO: 4144359 - RNA, 16 nt, Yersinia pestis
acuccggcaggaugau

SEQ ID NO: 4144360 - RNA, 15 nt, Yersinia pestis
acuccgguggcuuac

SEQ ID NO: 4144361 - RNA, 19 nt, Yersinia pestis
acuccucugccuauccuca

SEQ ID NO: 4144362 - RNA, 13 nt, Yersinia pestis
acuccucuucuuc

SEQ ID NO: 4144363 - RNA, 21 nt, Yersinia pestis
acuccucuucuucgauuuuag

SEQ ID NO: 4144364 - RNA, 16 nt, Yersinia pestis
acuccucuuucuuaau

SEQ ID NO: 4144365 - RNA, 18 nt, Yersinia pestis
acuccucuuucuuaauaa

SEQ ID NO: 4144366 - RNA, 19 nt, Yersinia pestis
acuccucuuucuuaauaau

SEQ ID NO: 4144367 - RNA, 23 nt, Yersinia pestis
acuccuucucgaugccuucuuuc

SEQ ID NO: 4144368 - RNA, 21 nt, Yersinia pestis
acuccuuuguuauuucuggga

SEQ ID NO: 4144369 - RNA, 14 nt, Yersinia pestis
acucgauagaaaaa

SEQ ID NO: 4144370 - RNA, 15 nt, Yersinia pestis
acucgauagaaaaag

SEQ ID NO: 4144371 - RNA, 12 nt, Yersinia pestis
acucgauaguga

SEQ ID NO: 4144372 - RNA, 16 nt, Yersinia pestis
acucgaucuugaacgg

SEQ ID NO: 4144373 - RNA, 22 nt, Yersinia pestis
acucgcaauaccaaugucuuau

SEQ ID NO: 4144374 - RNA, 22 nt, Yersinia pestis
acucgccaacagagugaaucgc

SEQ ID NO: 4144375 - RNA, 22 nt, Yersinia pestis
acucgcgauaacgguaucaguc

SEQ ID NO: 4144376 - RNA, 23 nt, Yersinia pestis
acucggccaaacaaaguuaugcc

SEQ ID NO: 4144377 - RNA, 19 nt, Yersinia pestis
acucgggucagugaaaaau

SEQ ID NO: 4144378 - RNA, 18 nt, Yersinia pestis
acucgguacaaucucugg

SEQ ID NO: 4144379 - RNA, 19 nt, Yersinia pestis
acucggucgccaaggaugc

SEQ ID NO: 4144380 - RNA, 19 nt, Yersinia pestis
acucgucauucaccaccac

SEQ ID NO: 4144381 - RNA, 20 nt, Yersinia pestis
acucguucucaaccaaauag

SEQ ID NO: 4144382 - RNA, 12 nt, Yersinia pestis
acucguuuuaca

SEQ ID NO: 4144383 - RNA, 16 nt, Yersinia pestis
acucguuuuacauuga

SEQ ID NO: 4144384 - RNA, 23 nt, Yersinia pestis
acucuaaggguaaaauccccauu

SEQ ID NO: 4144385 - RNA, 18 nt, Yersinia pestis
acucuagcgccagcaauu

SEQ ID NO: 4144386 - RNA, 20 nt, Yersinia pestis
acucuaucagcgcccuacug

SEQ ID NO: 4144387 - RNA, 21 nt, Yersinia pestis
acucuaucagcgcccuacugc

SEQ ID NO: 4144388 - RNA, 15 nt, Yersinia pestis
acucucccucaguga

SEQ ID NO: 4144389 - RNA, 22 nt, Yersinia pestis
acucucccuuuuccaucacccc

SEQ ID NO: 4144390 - RNA, 16 nt, Yersinia pestis
acucucgccaaacaaa

SEQ ID NO: 4144391 - RNA, 18 nt, Yersinia pestis
acucugccagauagucau

SEQ ID NO: 4144392 - RNA, 23 nt, Yersinia pestis
acucugcgcucauacucagucau

SEQ ID NO: 4144393 - RNA, 21 nt, Yersinia pestis
acucugcggcaggcugaucuu

SEQ ID NO: 4144394 - RNA, 15 nt, Yersinia pestis
acucugcuaccagga

SEQ ID NO: 4144395 - RNA, 18 nt, Yersinia pestis
acucuggaauuaaaguau

SEQ ID NO: 4144396 - RNA, 13 nt, Yersinia pestis
acucuggcacugg

SEQ ID NO: 4144397 - RNA, 19 nt, Yersinia pestis
acucuguaaaaaucaccuc

SEQ ID NO: 4144398 - RNA, 14 nt, Yersinia pestis
acucuguaccgccc

SEQ ID NO: 4144399 - RNA, 21 nt, Yersinia pestis
acucugucugcuguugccaca

SEQ ID NO: 4144400 - RNA, 15 nt, Yersinia pestis
acucugucuggugcu

SEQ ID NO: 4144401 - RNA, 18 nt, Yersinia pestis
acucuucagccuauccuc

SEQ ID NO: 4144402 - RNA, 19 nt, Yersinia pestis
acucuucagccuauccuca

SEQ ID NO: 4144403 - RNA, 21 nt, Yersinia pestis
acucuucagccuauccucacc

SEQ ID NO: 4144404 - RNA, 23 nt, Yersinia pestis
acucuucgugcuuauuuugcuug

SEQ ID NO: 4144405 - RNA, 19 nt, Yersinia pestis
acucuucugccuacacuca

SEQ ID NO: 4144406 - RNA, 15 nt, Yersinia pestis
acucuugagaaauga

SEQ ID NO: 4144407 - RNA, 16 nt, Yersinia pestis
acucuugagaaaugaa

SEQ ID NO: 4144408 - RNA, 21 nt, Yersinia pestis
acucuugcacuuuuacugguu

SEQ ID NO: 4144409 - RNA, 18 nt, Yersinia pestis
acucuuguuaucaccugu

SEQ ID NO: 4144410 - RNA, 20 nt, Yersinia pestis
acucuuucaucccauaugcu

SEQ ID NO: 4144411 - RNA, 12 nt, Yersinia pestis
acucuuuguuac

SEQ ID NO: 4144412 - RNA, 17 nt, Yersinia pestis
acugaaaagaggcacac

SEQ ID NO: 4144413 - RNA, 18 nt, Yersinia pestis
acugaaaguagaaauaaa

SEQ ID NO: 4144414 - RNA, 19 nt, Yersinia pestis
acugaaaguagaaauaaaa

SEQ ID NO: 4144415 - RNA, 12 nt, Yersinia pestis
acugaaauaaac

SEQ ID NO: 4144416 - RNA, 21 nt, Yersinia pestis
acugaaauaaacaagccauuc

SEQ ID NO: 4144417 - RNA, 18 nt, Yersinia pestis
acugaacgauaaauugcu

SEQ ID NO: 4144418 - RNA, 15 nt, Yersinia pestis
acugaagcaucaaua

SEQ ID NO: 4144419 - RNA, 12 nt, Yersinia pestis
acugaaguuauu

SEQ ID NO: 4144420 - RNA, 18 nt, Yersinia pestis
acugaaucacuggugagu

SEQ ID NO: 4144421 - RNA, 17 nt, Yersinia pestis
acugaaucccagaaccu

SEQ ID NO: 4144422 - RNA, 20 nt, Yersinia pestis
acugaaucccagaaccucaa

SEQ ID NO: 4144423 - RNA, 22 nt, Yersinia pestis
acugaaugcacgauaccaccac

SEQ ID NO: 4144424 - RNA, 22 nt, Yersinia pestis
acugaauggaucacaucacagu

SEQ ID NO: 4144425 - RNA, 12 nt, Yersinia pestis
acugaaugugaa

SEQ ID NO: 4144426 - RNA, 14 nt, Yersinia pestis
acugacaacaucaa

SEQ ID NO: 4144427 - RNA, 19 nt, Yersinia pestis
acugacaacaucaaaugaa

SEQ ID NO: 4144428 - RNA, 17 nt, Yersinia pestis
acugacaaguuuuuaag

SEQ ID NO: 4144429 - RNA, 17 nt, Yersinia pestis
acugaccauaaaaggau

SEQ ID NO: 4144430 - RNA, 20 nt, Yersinia pestis
acugaccgggaacaacgaaa

SEQ ID NO: 4144431 - RNA, 12 nt, Yersinia pestis
acugaccuauug

SEQ ID NO: 4144432 - RNA, 14 nt, Yersinia pestis
acugaccuauugau

SEQ ID NO: 4144433 - RNA, 20 nt, Yersinia pestis
acugacgauuguccaggcua

SEQ ID NO: 4144434 - RNA, 18 nt, Yersinia pestis
acugacggcagacaacca

SEQ ID NO: 4144435 - RNA, 16 nt, Yersinia pestis
acugacucacgucagu

SEQ ID NO: 4144436 - RNA, 18 nt, Yersinia pestis
acugacucacgucaguaa

SEQ ID NO: 4144437 - RNA, 14 nt, Yersinia pestis
acugacugauguaa

SEQ ID NO: 4144438 - RNA, 20 nt, Yersinia pestis
acugacugauguaagcucau

SEQ ID NO: 4144439 - RNA, 12 nt, Yersinia pestis
acugacugccau

SEQ ID NO: 4144440 - RNA, 21 nt, Yersinia pestis
acugacuuggggcaacucccc

SEQ ID NO: 4144441 - RNA, 22 nt, Yersinia pestis
acugacuuggggcaacucccca

SEQ ID NO: 4144442 - RNA, 20 nt, Yersinia pestis
acugagaccuuccauaacuc

SEQ ID NO: 4144443 - RNA, 11 nt, Yersinia pestis
acugagcaccg

SEQ ID NO: 4144444 - RNA, 22 nt, Yersinia pestis
acugagcgugguaucggugagu

SEQ ID NO: 4144445 - RNA, 19 nt, Yersinia pestis
acugaggcaacauuuguug

SEQ ID NO: 4144446 - RNA, 13 nt, Yersinia pestis
acugaguaugagc

SEQ ID NO: 4144447 - RNA, 16 nt, Yersinia pestis
acugaguucugcugcc

SEQ ID NO: 4144448 - RNA, 17 nt, Yersinia pestis
acugaguucugcugcca

SEQ ID NO: 4144449 - RNA, 16 nt, Yersinia pestis
acugauagcggcucug

SEQ ID NO: 4144450 - RNA, 18 nt, Yersinia pestis
acugauaggucauauaca

SEQ ID NO: 4144451 - RNA, 16 nt, Yersinia pestis
acugauauaaagcauu

SEQ ID NO: 4144452 - RNA, 17 nt, Yersinia pestis
acugauaucuucacuca

SEQ ID NO: 4144453 - RNA, 19 nt, Yersinia pestis
acugauaugggaacgucug

SEQ ID NO: 4144454 - RNA, 13 nt, Yersinia pestis
acugaucaucaac

SEQ ID NO: 4144455 - RNA, 12 nt, Yersinia pestis
acugaucauuau

SEQ ID NO: 4144456 - RNA, 16 nt, Yersinia pestis
acugaugagcuggcaa

SEQ ID NO: 4144457 - RNA, 14 nt, Yersinia pestis
acugaugcgguagu

SEQ ID NO: 4144458 - RNA, 20 nt, Yersinia pestis
acugaugcgguagugaugca

SEQ ID NO: 4144459 - RNA, 18 nt, Yersinia pestis
acugaugguuuccugaau

SEQ ID NO: 4144460 - RNA, 20 nt, Yersinia pestis
acugauuauuuggugaguaa

SEQ ID NO: 4144461 - RNA, 16 nt, Yersinia pestis
acugauucagaaaggu

SEQ ID NO: 4144462 - RNA, 13 nt, Yersinia pestis
acugauugaccau

SEQ ID NO: 4144463 - RNA, 20 nt, Yersinia pestis
acugauuggauaaaauauua

SEQ ID NO: 4144464 - RNA, 21 nt, Yersinia pestis
acugcaagccguaauucagau

SEQ ID NO: 4144465 - RNA, 21 nt, Yersinia pestis
acugcagaaaaugcggcggcu

SEQ ID NO: 4144466 - RNA, 18 nt, Yersinia pestis
acugcagaaucacuggca

SEQ ID NO: 4144467 - RNA, 21 nt, Yersinia pestis
acugcauagcuaaccuuaacu

SEQ ID NO: 4144468 - RNA, 12 nt, Yersinia pestis
acugcaucaaua

SEQ ID NO: 4144469 - RNA, 19 nt, Yersinia pestis
acugcauugagacccguua

SEQ ID NO: 4144470 - RNA, 15 nt, Yersinia pestis
acugccaauauugac

SEQ ID NO: 4144471 - RNA, 13 nt, Yersinia pestis
acugccaaucgcu

SEQ ID NO: 4144472 - RNA, 14 nt, Yersinia pestis
acugccauaaucca

SEQ ID NO: 4144473 - RNA, 13 nt, Yersinia pestis
acugccauacauc

SEQ ID NO: 4144474 - RNA, 19 nt, Yersinia pestis
acugcccagguucaaaaua

SEQ ID NO: 4144475 - RNA, 15 nt, Yersinia pestis
acugccccgaagcuc

SEQ ID NO: 4144476 - RNA, 18 nt, Yersinia pestis
acugccccgaagcucaag

SEQ ID NO: 4144477 - RNA, 18 nt, Yersinia pestis
acugccccuucaaagccg

SEQ ID NO: 4144478 - RNA, 13 nt, Yersinia pestis
acugcccgccugc

SEQ ID NO: 4144479 - RNA, 13 nt, Yersinia pestis
acugccgggauca

SEQ ID NO: 4144480 - RNA, 16 nt, Yersinia pestis
acugccgucaaugccu

SEQ ID NO: 4144481 - RNA, 14 nt, Yersinia pestis
acugccugaugcua

SEQ ID NO: 4144482 - RNA, 13 nt, Yersinia pestis
acugccugcagca

SEQ ID NO: 4144483 - RNA, 18 nt, Yersinia pestis
acugcgaccaaaagccac

SEQ ID NO: 4144484 - RNA, 22 nt, Yersinia pestis
acugcgaccaaaagccaccgca

SEQ ID NO: 4144485 - RNA, 22 nt, Yersinia pestis
acugcgcgaucccagaauggca

SEQ ID NO: 4144486 - RNA, 14 nt, Yersinia pestis
acugcguacucacc

SEQ ID NO: 4144487 - RNA, 18 nt, Yersinia pestis
acugcuaauaccaccacc

SEQ ID NO: 4144488 - RNA, 19 nt, Yersinia pestis
acugcucaacugcucaacu

SEQ ID NO: 4144489 - RNA, 20 nt, Yersinia pestis
acugcucaacugcucaacug

SEQ ID NO: 4144490 - RNA, 12 nt, Yersinia pestis
acugcucacugg

SEQ ID NO: 4144491 - RNA, 20 nt, Yersinia pestis
acugcucgcccaagcggcug

SEQ ID NO: 4144492 - RNA, 21 nt, Yersinia pestis
acugcucgcccaagcggcugg

SEQ ID NO: 4144493 - RNA, 12 nt, Yersinia pestis
acugcugacaaa

SEQ ID NO: 4144494 - RNA, 15 nt, Yersinia pestis
acugcugacaacccc

SEQ ID NO: 4144495 - RNA, 15 nt, Yersinia pestis
acugcugauuuugua

SEQ ID NO: 4144496 - RNA, 16 nt, Yersinia pestis
acugcugcaacucauu

SEQ ID NO: 4144497 - RNA, 12 nt, Yersinia pestis
acugcugggcug

SEQ ID NO: 4144498 - RNA, 12 nt, Yersinia pestis
acugcugugcau

SEQ ID NO: 4144499 - RNA, 15 nt, Yersinia pestis
acugcuuuucacauu

SEQ ID NO: 4144500 - RNA, 12 nt, Yersinia pestis
acugcuuuucua

SEQ ID NO: 4144501 - RNA, 17 nt, Yersinia pestis
acugcuuuuuacacucg

SEQ ID NO: 4144502 - RNA, 22 nt, Yersinia pestis
acugcuuuuuauugucucuacu

SEQ ID NO: 4144503 - RNA, 15 nt, Yersinia pestis
acuggauauuuuccc

SEQ ID NO: 4144504 - RNA, 18 nt, Yersinia pestis
acuggaucacaaugcaaa

SEQ ID NO: 4144505 - RNA, 17 nt, Yersinia pestis
acuggaugagccgcagc

SEQ ID NO: 4144506 - RNA, 12 nt, Yersinia pestis
acuggcaccgcu

SEQ ID NO: 4144507 - RNA, 15 nt, Yersinia pestis
acuggcaggaaaucu

SEQ ID NO: 4144508 - RNA, 14 nt, Yersinia pestis
acuggccgcaggcg

SEQ ID NO: 4144509 - RNA, 21 nt, Yersinia pestis
acuggcgaccaguguuuguag

SEQ ID NO: 4144510 - RNA, 18 nt, Yersinia pestis
acuggcgcgggaaaaacc

SEQ ID NO: 4144511 - RNA, 21 nt, Yersinia pestis
acuggcggggcaaauaggccg

SEQ ID NO: 4144512 - RNA, 20 nt, Yersinia pestis
acuggcuagauagccauaau

SEQ ID NO: 4144513 - RNA, 23 nt, Yersinia pestis
acuggcuagauagccauaauaau

SEQ ID NO: 4144514 - RNA, 13 nt, Yersinia pestis
acuggcugaaguu

SEQ ID NO: 4144515 - RNA, 15 nt, Yersinia pestis
acugggauauucugg

SEQ ID NO: 4144516 - RNA, 17 nt, Yersinia pestis
acugggauauucuggac

SEQ ID NO: 4144517 - RNA, 22 nt, Yersinia pestis
acugggaugaagaaauaccuga

SEQ ID NO: 4144518 - RNA, 14 nt, Yersinia pestis
acuggggugaauca

SEQ ID NO: 4144519 - RNA, 18 nt, Yersinia pestis
acuggguuacauccugaa

SEQ ID NO: 4144520 - RNA, 17 nt, Yersinia pestis
acuggguuuaaaggugg

SEQ ID NO: 4144521 - RNA, 18 nt, Yersinia pestis
acugguaauaaugcuguc

SEQ ID NO: 4144522 - RNA, 16 nt, Yersinia pestis
acugguaccaaacaac

SEQ ID NO: 4144523 - RNA, 21 nt, Yersinia pestis
acugguacggcgcaucgccau

SEQ ID NO: 4144524 - RNA, 23 nt, Yersinia pestis
acugguagcagccacaugguuuc

SEQ ID NO: 4144525 - RNA, 22 nt, Yersinia pestis
acuggugcugcccaaaaucaaa

SEQ ID NO: 4144526 - RNA, 14 nt, Yersinia pestis
acugguugaaaccu

SEQ ID NO: 4144527 - RNA, 15 nt, Yersinia pestis
acugguugaaaccuc

SEQ ID NO: 4144528 - RNA, 15 nt, Yersinia pestis
acuguaguaaagcag

SEQ ID NO: 4144529 - RNA, 12 nt, Yersinia pestis
acuguaucaaua

SEQ ID NO: 4144530 - RNA, 16 nt, Yersinia pestis
acuguaucaauaccuu

SEQ ID NO: 4144531 - RNA, 17 nt, Yersinia pestis
acuguaucaauaccuua

SEQ ID NO: 4144532 - RNA, 21 nt, Yersinia pestis
acuguaucaauaccuuacugc

SEQ ID NO: 4144533 - RNA, 14 nt, Yersinia pestis
acugucaaaaagca

SEQ ID NO: 4144534 - RNA, 14 nt, Yersinia pestis
acugucaaaauccg

SEQ ID NO: 4144535 - RNA, 17 nt, Yersinia pestis
acugucaaaauccggau

SEQ ID NO: 4144536 - RNA, 23 nt, Yersinia pestis
acugucaccuagauaaucaagua

SEQ ID NO: 4144537 - RNA, 13 nt, Yersinia pestis
acugucauugcug

SEQ ID NO: 4144538 - RNA, 14 nt, Yersinia pestis
acugucauugcugu

SEQ ID NO: 4144539 - RNA, 15 nt, Yersinia pestis
acugucauugcuguu

SEQ ID NO: 4144540 - RNA, 18 nt, Yersinia pestis
acugucauugcuguuguu

SEQ ID NO: 4144541 - RNA, 13 nt, Yersinia pestis
acugucauuuccu

SEQ ID NO: 4144542 - RNA, 14 nt, Yersinia pestis
acuguccaagaagc

SEQ ID NO: 4144543 - RNA, 14 nt, Yersinia pestis
acuguccuuuaacu

SEQ ID NO: 4144544 - RNA, 17 nt, Yersinia pestis
acugucgcauaagacaa

SEQ ID NO: 4144545 - RNA, 20 nt, Yersinia pestis
acugucuauuuuuauaauca

SEQ ID NO: 4144546 - RNA, 19 nt, Yersinia pestis
acuguggcugcucugcucc

SEQ ID NO: 4144547 - RNA, 17 nt, Yersinia pestis
acuguguuuauaccaaa

SEQ ID NO: 4144548 - RNA, 22 nt, Yersinia pestis
acuguuaacucgccaacagagu

SEQ ID NO: 4144549 - RNA, 15 nt, Yersinia pestis
acuguucaccgccuu

SEQ ID NO: 4144550 - RNA, 18 nt, Yersinia pestis
acuguugaugcagaugac

SEQ ID NO: 4144551 - RNA, 17 nt, Yersinia pestis
acuguugcaaccagcaa

SEQ ID NO: 4144552 - RNA, 20 nt, Yersinia pestis
acuguuggcaauuucacgcu

SEQ ID NO: 4144553 - RNA, 16 nt, Yersinia pestis
acuguuuuauuauaua

SEQ ID NO: 4144554 - RNA, 15 nt, Yersinia pestis
acuuaacuacugcaa

SEQ ID NO: 4144555 - RNA, 17 nt, Yersinia pestis
acuuaagucaaauuuaa

SEQ ID NO: 4144556 - RNA, 18 nt, Yersinia pestis
acuuaaucgauagugcuu

SEQ ID NO: 4144557 - RNA, 20 nt, Yersinia pestis
acuuaaucuuauuuguaaau

SEQ ID NO: 4144558 - RNA, 16 nt, Yersinia pestis
acuuaauugguuuaua

SEQ ID NO: 4144559 - RNA, 19 nt, Yersinia pestis
acuuacaggcugccugccu

SEQ ID NO: 4144560 - RNA, 20 nt, Yersinia pestis
acuuacaggcugccugccug

SEQ ID NO: 4144561 - RNA, 17 nt, Yersinia pestis
acuuacccgaaucacuu

SEQ ID NO: 4144562 - RNA, 18 nt, Yersinia pestis
acuuacccgaaucacuua

SEQ ID NO: 4144563 - RNA, 18 nt, Yersinia pestis
acuuaccuugauccgcca

SEQ ID NO: 4144564 - RNA, 16 nt, Yersinia pestis
acuuacgagcuaaugc

SEQ ID NO: 4144565 - RNA, 20 nt, Yersinia pestis
acuuagcacggcaucgcugc

SEQ ID NO: 4144566 - RNA, 19 nt, Yersinia pestis
acuuagcccuucagcggug

SEQ ID NO: 4144567 - RNA, 22 nt, Yersinia pestis
acuuagguucaaucggcagugc

SEQ ID NO: 4144568 - RNA, 19 nt, Yersinia pestis
acuuagugcuggccuaggc

SEQ ID NO: 4144569 - RNA, 17 nt, Yersinia pestis
acuuauaucuccaccaa

SEQ ID NO: 4144570 - RNA, 21 nt, Yersinia pestis
acuuaucgaccaacuggcaau

SEQ ID NO: 4144571 - RNA, 14 nt, Yersinia pestis
acuuaucuaaaaaa

SEQ ID NO: 4144572 - RNA, 15 nt, Yersinia pestis
acuuaucuaaaaaac

SEQ ID NO: 4144573 - RNA, 14 nt, Yersinia pestis
acuuauggguuuuu

SEQ ID NO: 4144574 - RNA, 20 nt, Yersinia pestis
acuuauuacaccuuaaaaca

SEQ ID NO: 4144575 - RNA, 20 nt, Yersinia pestis
acuuauucccacuuauuaua

SEQ ID NO: 4144576 - RNA, 16 nt, Yersinia pestis
acuuauugauuauaug

SEQ ID NO: 4144577 - RNA, 16 nt, Yersinia pestis
acuuauuggaaguacu

SEQ ID NO: 4144578 - RNA, 15 nt, Yersinia pestis
acuuauuugaaacac

SEQ ID NO: 4144579 - RNA, 16 nt, Yersinia pestis
acuuauuugaaacacu

SEQ ID NO: 4144580 - RNA, 16 nt, Yersinia pestis
acuucaaaacuaauau

SEQ ID NO: 4144581 - RNA, 15 nt, Yersinia pestis
acuucaaacugcgug

SEQ ID NO: 4144582 - RNA, 15 nt, Yersinia pestis
acuucaaaucgccaa

SEQ ID NO: 4144583 - RNA, 22 nt, Yersinia pestis
acuucaaaugacauucuuuggu

SEQ ID NO: 4144584 - RNA, 13 nt, Yersinia pestis
acuucaauaccaa

SEQ ID NO: 4144585 - RNA, 19 nt, Yersinia pestis
acuucaauaccaaauuuac

SEQ ID NO: 4144586 - RNA, 15 nt, Yersinia pestis
acuucaaucacuuua

SEQ ID NO: 4144587 - RNA, 17 nt, Yersinia pestis
acuucaaucacuuuaua

SEQ ID NO: 4144588 - RNA, 20 nt, Yersinia pestis
acuucaauguuuuuauccaa

SEQ ID NO: 4144589 - RNA, 23 nt, Yersinia pestis
acuucaauuuggccauuaaccua

SEQ ID NO: 4144590 - RNA, 18 nt, Yersinia pestis
acuucaauuugguaauuu

SEQ ID NO: 4144591 - RNA, 17 nt, Yersinia pestis
acuucacaaugcacagu

SEQ ID NO: 4144592 - RNA, 23 nt, Yersinia pestis
acuucagcucccgccgcaacagu

SEQ ID NO: 4144593 - RNA, 12 nt, Yersinia pestis
acuucaggccaa

SEQ ID NO: 4144594 - RNA, 16 nt, Yersinia pestis
acuucaguuacucacu

SEQ ID NO: 4144595 - RNA, 12 nt, Yersinia pestis
acuucauaaaua

SEQ ID NO: 4144596 - RNA, 21 nt, Yersinia pestis
acuucauaauucagcaaacuc

SEQ ID NO: 4144597 - RNA, 21 nt, Yersinia pestis
acuucaucauucauuuuaaaa

SEQ ID NO: 4144598 - RNA, 17 nt, Yersinia pestis
acuucaucuuuuuuaau

SEQ ID NO: 4144599 - RNA, 19 nt, Yersinia pestis
acuucaugacuaccuugcu

SEQ ID NO: 4144600 - RNA, 13 nt, Yersinia pestis
acuucauuuucuc

SEQ ID NO: 4144601 - RNA, 14 nt, Yersinia pestis
acuucauuuuucuc

SEQ ID NO: 4144602 - RNA, 21 nt, Yersinia pestis
acuuccaauaagucacuuucc

SEQ ID NO: 4144603 - RNA, 14 nt, Yersinia pestis
acuuccacggccag

SEQ ID NO: 4144604 - RNA, 18 nt, Yersinia pestis
acuuccacggccagccug

SEQ ID NO: 4144605 - RNA, 12 nt, Yersinia pestis
acuuccagcacc

SEQ ID NO: 4144606 - RNA, 13 nt, Yersinia pestis
acuuccgccgcca

SEQ ID NO: 4144607 - RNA, 13 nt, Yersinia pestis
acuucgaaagaaa

SEQ ID NO: 4144608 - RNA, 16 nt, Yersinia pestis
acuucgaaagaaauaa

SEQ ID NO: 4144609 - RNA, 17 nt, Yersinia pestis
acuucgaaagaaauaaa

SEQ ID NO: 4144610 - RNA, 22 nt, Yersinia pestis
acuucgaaagaaauaaaagaaa

SEQ ID NO: 4144611 - RNA, 19 nt, Yersinia pestis
acuucgauacuacaaucau

SEQ ID NO: 4144612 - RNA, 15 nt, Yersinia pestis
acuucgauucaucau

SEQ ID NO: 4144613 - RNA, 13 nt, Yersinia pestis
acuucgcacgccc

SEQ ID NO: 4144614 - RNA, 23 nt, Yersinia pestis
acuucgcacgcccaucaaggccu

SEQ ID NO: 4144615 - RNA, 21 nt, Yersinia pestis
acuucgccaggucaggaagag

SEQ ID NO: 4144616 - RNA, 21 nt, Yersinia pestis
acuucgccgggucaggaagag

SEQ ID NO: 4144617 - RNA, 16 nt, Yersinia pestis
acuucgcgaacacaau

SEQ ID NO: 4144618 - RNA, 20 nt, Yersinia pestis
acuucggggcguaaaugaug

SEQ ID NO: 4144619 - RNA, 13 nt, Yersinia pestis
acuucggucaaga

SEQ ID NO: 4144620 - RNA, 18 nt, Yersinia pestis
acuucguagggcacuuuc

SEQ ID NO: 4144621 - RNA, 13 nt, Yersinia pestis
acuucgucugccc

SEQ ID NO: 4144622 - RNA, 15 nt, Yersinia pestis
acuucuacauagaaa

SEQ ID NO: 4144623 - RNA, 14 nt, Yersinia pestis
acuucucugacaca

SEQ ID NO: 4144624 - RNA, 14 nt, Yersinia pestis
acuucuuauuaauc

SEQ ID NO: 4144625 - RNA, 19 nt, Yersinia pestis
acuucuuauuaaucaagau

SEQ ID NO: 4144626 - RNA, 21 nt, Yersinia pestis
acuucuuucacuaaugaggaa

SEQ ID NO: 4144627 - RNA, 15 nt, Yersinia pestis
acuugagagaaacuu

SEQ ID NO: 4144628 - RNA, 22 nt, Yersinia pestis
acuugcaauucauguugccaau

SEQ ID NO: 4144629 - RNA, 15 nt, Yersinia pestis
acuugccagagcaau

SEQ ID NO: 4144630 - RNA, 23 nt, Yersinia pestis
acuugccauuuugggcuugagca

SEQ ID NO: 4144631 - RNA, 18 nt, Yersinia pestis
acuugccguaaaauuuaa

SEQ ID NO: 4144632 - RNA, 13 nt, Yersinia pestis
acuugccguggcu

SEQ ID NO: 4144633 - RNA, 15 nt, Yersinia pestis
acuugcugaugccca

SEQ ID NO: 4144634 - RNA, 18 nt, Yersinia pestis
acuugcuggaggcuggca

SEQ ID NO: 4144635 - RNA, 23 nt, Yersinia pestis
acuuggcuuuuucuuccagcagg

SEQ ID NO: 4144636 - RNA, 16 nt, Yersinia pestis
acuugguuuaaauucu

SEQ ID NO: 4144637 - RNA, 18 nt, Yersinia pestis
acuuguaccugugccagu

SEQ ID NO: 4144638 - RNA, 13 nt, Yersinia pestis
acuuguggaacaa

SEQ ID NO: 4144639 - RNA, 14 nt, Yersinia pestis
acuuguucauccug

SEQ ID NO: 4144640 - RNA, 18 nt, Yersinia pestis
acuuguucauccuguacc

SEQ ID NO: 4144641 - RNA, 21 nt, Yersinia pestis
acuuguuguugaccucaaaau

SEQ ID NO: 4144642 - RNA, 22 nt, Yersinia pestis
acuuguuguugaccucaaaaua

SEQ ID NO: 4144643 - RNA, 23 nt, Yersinia pestis
acuuuaaaaaaauuaucaucaau

SEQ ID NO: 4144644 - RNA, 17 nt, Yersinia pestis
acuuuaaagccaaauug

SEQ ID NO: 4144645 - RNA, 15 nt, Yersinia pestis
acuuuaaauccaucg

SEQ ID NO: 4144646 - RNA, 18 nt, Yersinia pestis
acuuuaacugcaccuaac

SEQ ID NO: 4144647 - RNA, 21 nt, Yersinia pestis
acuuuaacugcaccuaacaaa

SEQ ID NO: 4144648 - RNA, 15 nt, Yersinia pestis
acuuuaagcugcaga

SEQ ID NO: 4144649 - RNA, 14 nt, Yersinia pestis
acuuuaauuaaaaa

SEQ ID NO: 4144650 - RNA, 16 nt, Yersinia pestis
acuuuaauuaaaaaua

SEQ ID NO: 4144651 - RNA, 16 nt, Yersinia pestis
acuuuaccgauuucag

SEQ ID NO: 4144652 - RNA, 13 nt, Yersinia pestis
acuuuacucuuca

SEQ ID NO: 4144653 - RNA, 13 nt, Yersinia pestis
acuuuacuuuaau

SEQ ID NO: 4144654 - RNA, 14 nt, Yersinia pestis
acuuuaucugccaa

SEQ ID NO: 4144655 - RNA, 15 nt, Yersinia pestis
acuuuaucugccaaa

SEQ ID NO: 4144656 - RNA, 16 nt, Yersinia pestis
acuuuauugagaauca

SEQ ID NO: 4144657 - RNA, 16 nt, Yersinia pestis
acuuuccccagaugaa

SEQ ID NO: 4144658 - RNA, 13 nt, Yersinia pestis
acuuuccuuccuc

SEQ ID NO: 4144659 - RNA, 16 nt, Yersinia pestis
acuuucggguaucugu

SEQ ID NO: 4144660 - RNA, 22 nt, Yersinia pestis
acuuugauucaaaaugccaguc

SEQ ID NO: 4144661 - RNA, 21 nt, Yersinia pestis
acuuugcuaaccuauagcaau

SEQ ID NO: 4144662 - RNA, 18 nt, Yersinia pestis
acuuugggucugaauacc

SEQ ID NO: 4144663 - RNA, 20 nt, Yersinia pestis
acuuuguauuuugcacaaag

SEQ ID NO: 4144664 - RNA, 19 nt, Yersinia pestis
acuuugucaauaaccucag

SEQ ID NO: 4144665 - RNA, 22 nt, Yersinia pestis
acuuugucaauaaccucagccu

SEQ ID NO: 4144666 - RNA, 22 nt, Yersinia pestis
acuuugucacccgucaggaugc

SEQ ID NO: 4144667 - RNA, 20 nt, Yersinia pestis
acuuuuauaccgcagcauaa

SEQ ID NO: 4144668 - RNA, 16 nt, Yersinia pestis
acuuuuauauccgcca

SEQ ID NO: 4144669 - RNA, 23 nt, Yersinia pestis
acuuuuauauccgccauccuuca

SEQ ID NO: 4144670 - RNA, 12 nt, Yersinia pestis
acuuuuauuaua

SEQ ID NO: 4144671 - RNA, 13 nt, Yersinia pestis
acuuuucagauag

SEQ ID NO: 4144672 - RNA, 20 nt, Yersinia pestis
acuuuuuauuucuuuuaaau

SEQ ID NO: 4144673 - RNA, 15 nt, Yersinia pestis
acuuuuucucuccua

SEQ ID NO: 4144674 - RNA, 17 nt, Yersinia pestis
acuuuuuucacauuacg

SEQ ID NO: 4144675 - RNA, 14 nt, Yersinia pestis
agaaaaaauaaaua

SEQ ID NO: 4144676 - RNA, 18 nt, Yersinia pestis
agaaaaaauaaauauccu

SEQ ID NO: 4144677 - RNA, 15 nt, Yersinia pestis
agaaaaacacuggca

SEQ ID NO: 4144678 - RNA, 17 nt, Yersinia pestis
agaaaaacacuggcagc

SEQ ID NO: 4144679 - RNA, 18 nt, Yersinia pestis
agaaaacaaucuggcagc

SEQ ID NO: 4144680 - RNA, 22 nt, Yersinia pestis
agaaaacaguuacuccuacacc

SEQ ID NO: 4144681 - RNA, 18 nt, Yersinia pestis
agaaaaccuucagcaaag

SEQ ID NO: 4144682 - RNA, 20 nt, Yersinia pestis
agaaaaccuucagcaaagag

SEQ ID NO: 4144683 - RNA, 19 nt, Yersinia pestis
agaaaaccuugacucuuca

SEQ ID NO: 4144684 - RNA, 20 nt, Yersinia pestis
agaaaaucguuguauuagcc

SEQ ID NO: 4144685 - RNA, 19 nt, Yersinia pestis
agaaaaugcccgccaguaa

SEQ ID NO: 4144686 - RNA, 12 nt, Yersinia pestis
agaaacaaaacc

SEQ ID NO: 4144687 - RNA, 20 nt, Yersinia pestis
agaaacaucuucauuuggcu

SEQ ID NO: 4144688 - RNA, 16 nt, Yersinia pestis
agaaacauuaaaccca

SEQ ID NO: 4144689 - RNA, 21 nt, Yersinia pestis
agaaaccagcggcagcgccug

SEQ ID NO: 4144690 - RNA, 20 nt, Yersinia pestis
agaaacgccccgauaaacca

SEQ ID NO: 4144691 - RNA, 23 nt, Yersinia pestis
agaaacuaagaguccuuaaaaac

SEQ ID NO: 4144692 - RNA, 15 nt, Yersinia pestis
agaaacuucauuuca

SEQ ID NO: 4144693 - RNA, 15 nt, Yersinia pestis
agaaagaaaaauaga

SEQ ID NO: 4144694 - RNA, 12 nt, Yersinia pestis
agaaagccggaa

SEQ ID NO: 4144695 - RNA, 16 nt, Yersinia pestis
agaaagccggaaaaga

SEQ ID NO: 4144696 - RNA, 23 nt, Yersinia pestis
agaaaggacaguaauauuuucau

SEQ ID NO: 4144697 - RNA, 23 nt, Yersinia pestis
agaaagguaugugccaaaaaaag

SEQ ID NO: 4144698 - RNA, 15 nt, Yersinia pestis
agaaagugacacauu

SEQ ID NO: 4144699 - RNA, 20 nt, Yersinia pestis
agaaaguugauccuggguuu

SEQ ID NO: 4144700 - RNA, 13 nt, Yersinia pestis
agaaauaaaaacc

SEQ ID NO: 4144701 - RNA, 13 nt, Yersinia pestis
agaaauaaauuca

SEQ ID NO: 4144702 - RNA, 15 nt, Yersinia pestis
agaaauaaguugaac

SEQ ID NO: 4144703 - RNA, 17 nt, Yersinia pestis
agaaauaaguugaacca

SEQ ID NO: 4144704 - RNA, 13 nt, Yersinia pestis
agaaauagcacca

SEQ ID NO: 4144705 - RNA, 16 nt, Yersinia pestis
agaaauauaacugcga

SEQ ID NO: 4144706 - RNA, 14 nt, Yersinia pestis
agaaaucaucagca

SEQ ID NO: 4144707 - RNA, 20 nt, Yersinia pestis
agaaaucgcuauaugacaua

SEQ ID NO: 4144708 - RNA, 14 nt, Yersinia pestis
agaaaugaauauua

SEQ ID NO: 4144709 - RNA, 18 nt, Yersinia pestis
agaaaugcucaucaagua

SEQ ID NO: 4144710 - RNA, 22 nt, Yersinia pestis
agaaauucaacuugccugaaau

SEQ ID NO: 4144711 - RNA, 23 nt, Yersinia pestis
agaaauucauaccuuaauuaacu

SEQ ID NO: 4144712 - RNA, 14 nt, Yersinia pestis
agaaauuuuuagaa

SEQ ID NO: 4144713 - RNA, 15 nt, Yersinia pestis
agaaauuuuuagaaa

SEQ ID NO: 4144714 - RNA, 13 nt, Yersinia pestis
agaacaacgcugc

SEQ ID NO: 4144715 - RNA, 21 nt, Yersinia pestis
agaacaccaacaccacacuga

SEQ ID NO: 4144716 - RNA, 22 nt, Yersinia pestis
agaacaccagagaugauagcaa

SEQ ID NO: 4144717 - RNA, 12 nt, Yersinia pestis
agaacacuguua

SEQ ID NO: 4144718 - RNA, 12 nt, Yersinia pestis
agaacaggcaga

SEQ ID NO: 4144719 - RNA, 21 nt, Yersinia pestis
agaacagguuuuuuccccaug

SEQ ID NO: 4144720 - RNA, 16 nt, Yersinia pestis
agaacaucugccaggc

SEQ ID NO: 4144721 - RNA, 22 nt, Yersinia pestis
agaaccccccaccaucaacaua

SEQ ID NO: 4144722 - RNA, 21 nt, Yersinia pestis
agaacccccgcgaacagcaga

SEQ ID NO: 4144723 - RNA, 22 nt, Yersinia pestis
agaacccccgcgaacagcagaa

SEQ ID NO: 4144724 - RNA, 14 nt, Yersinia pestis
agaaccugucgcag

SEQ ID NO: 4144725 - RNA, 13 nt, Yersinia pestis
agaacggagagaa

SEQ ID NO: 4144726 - RNA, 16 nt, Yersinia pestis
agaacgugcugcgcug

SEQ ID NO: 4144727 - RNA, 15 nt, Yersinia pestis
agaacugauuucagg

SEQ ID NO: 4144728 - RNA, 12 nt, Yersinia pestis
agaacuggcugg

SEQ ID NO: 4144729 - RNA, 18 nt, Yersinia pestis
agaagaaaucauuuaggc

SEQ ID NO: 4144730 - RNA, 22 nt, Yersinia pestis
agaagaauaucugccgggagga

SEQ ID NO: 4144731 - RNA, 21 nt, Yersinia pestis
agaagaauccacauaaaaaga

SEQ ID NO: 4144732 - RNA, 21 nt, Yersinia pestis
agaagaauugcagauaccaca

SEQ ID NO: 4144733 - RNA, 18 nt, Yersinia pestis
agaagacauaucuugaac

SEQ ID NO: 4144734 - RNA, 23 nt, Yersinia pestis
agaagacgaauagaaccggcuga

SEQ ID NO: 4144735 - RNA, 19 nt, Yersinia pestis
agaagacgaguaaugaaau

SEQ ID NO: 4144736 - RNA, 22 nt, Yersinia pestis
agaagccauuagccccaaaugc

SEQ ID NO: 4144737 - RNA, 15 nt, Yersinia pestis
agaagccucaugaau

SEQ ID NO: 4144738 - RNA, 18 nt, Yersinia pestis
agaagccucaugaaugag

SEQ ID NO: 4144739 - RNA, 16 nt, Yersinia pestis
agaagcgcacaucggu

SEQ ID NO: 4144740 - RNA, 16 nt, Yersinia pestis
agaagcguaaagcacc

SEQ ID NO: 4144741 - RNA, 21 nt, Yersinia pestis
agaagcguaaagcacccacac

SEQ ID NO: 4144742 - RNA, 14 nt, Yersinia pestis
agaaggaauuucac

SEQ ID NO: 4144743 - RNA, 15 nt, Yersinia pestis
agaaggauugaccaa

SEQ ID NO: 4144744 - RNA, 21 nt, Yersinia pestis
agaaggauugaccaauaaaau

SEQ ID NO: 4144745 - RNA, 18 nt, Yersinia pestis
agaaggcgaguuucucug

SEQ ID NO: 4144746 - RNA, 15 nt, Yersinia pestis
agaaggcuagucugu

SEQ ID NO: 4144747 - RNA, 23 nt, Yersinia pestis
agaagggcggccagcaagagcag

SEQ ID NO: 4144748 - RNA, 20 nt, Yersinia pestis
agaaggguauugaagauacc

SEQ ID NO: 4144749 - RNA, 14 nt, Yersinia pestis
agaagguaagccag

SEQ ID NO: 4144750 - RNA, 14 nt, Yersinia pestis
agaagguuaaauuu

SEQ ID NO: 4144751 - RNA, 16 nt, Yersinia pestis
agaagguuuaguuggc

SEQ ID NO: 4144752 - RNA, 15 nt, Yersinia pestis
agaaguagaaugaga

SEQ ID NO: 4144753 - RNA, 11 nt, Yersinia pestis
agaagugaaaa

SEQ ID NO: 4144754 - RNA, 13 nt, Yersinia pestis
agaauaaaaauga

SEQ ID NO: 4144755 - RNA, 15 nt, Yersinia pestis
agaauaaacgagaau

SEQ ID NO: 4144756 - RNA, 21 nt, Yersinia pestis
agaauaaauaauaucaaugau

SEQ ID NO: 4144757 - RNA, 23 nt, Yersinia pestis
agaauaaggguagguucaauaau

SEQ ID NO: 4144758 - RNA, 14 nt, Yersinia pestis
agaauaaucacagg

SEQ ID NO: 4144759 - RNA, 23 nt, Yersinia pestis
agaauaauccccacggccagagc

SEQ ID NO: 4144760 - RNA, 23 nt, Yersinia pestis
agaauacggugcggguuagcggc

SEQ ID NO: 4144761 - RNA, 19 nt, Yersinia pestis
agaauagagaaaucaaagu

SEQ ID NO: 4144762 - RNA, 16 nt, Yersinia pestis
agaauaucuucaacug

SEQ ID NO: 4144763 - RNA, 16 nt, Yersinia pestis
agaauauuuacgguga

SEQ ID NO: 4144764 - RNA, 14 nt, Yersinia pestis
agaaucaaucaauu

SEQ ID NO: 4144765 - RNA, 19 nt, Yersinia pestis
agaaucacugucaaaaagc

SEQ ID NO: 4144766 - RNA, 14 nt, Yersinia pestis
agaaucaguagguu

SEQ ID NO: 4144767 - RNA, 22 nt, Yersinia pestis
agaauccaacccguacucugac

SEQ ID NO: 4144768 - RNA, 20 nt, Yersinia pestis
agaauccacauaaaaagaaa

SEQ ID NO: 4144769 - RNA, 21 nt, Yersinia pestis
agaauccucugaauaaaaaau

SEQ ID NO: 4144770 - RNA, 15 nt, Yersinia pestis
agaaucucuccagug

SEQ ID NO: 4144771 - RNA, 11 nt, Yersinia pestis
agaaucugcug

SEQ ID NO: 4144772 - RNA, 15 nt, Yersinia pestis
agaaugcgacauguu

SEQ ID NO: 4144773 - RNA, 16 nt, Yersinia pestis
agaauguguaguugaa

SEQ ID NO: 4144774 - RNA, 20 nt, Yersinia pestis
agaauguuauugcuccgaca

SEQ ID NO: 4144775 - RNA, 21 nt, Yersinia pestis
agaauguuguuuaugaaaucu

SEQ ID NO: 4144776 - RNA, 18 nt, Yersinia pestis
agaauuaaggaaacucau

SEQ ID NO: 4144777 - RNA, 12 nt, Yersinia pestis
agaauuauuuau

SEQ ID NO: 4144778 - RNA, 14 nt, Yersinia pestis
agaauugcagauac

SEQ ID NO: 4144779 - RNA, 16 nt, Yersinia pestis
agaauuuaccuccaua

SEQ ID NO: 4144780 - RNA, 20 nt, Yersinia pestis
agaauuuaccuccauauccu

SEQ ID NO: 4144781 - RNA, 13 nt, Yersinia pestis
agaauuucauugu

SEQ ID NO: 4144782 - RNA, 23 nt, Yersinia pestis
agaauuuucucauuaauaaugau

SEQ ID NO: 4144783 - RNA, 14 nt, Yersinia pestis
agacaaacaaccua

SEQ ID NO: 4144784 - RNA, 22 nt, Yersinia pestis
agacaacgcuuggcaucacaga

SEQ ID NO: 4144785 - RNA, 14 nt, Yersinia pestis
agacaacucuucua

SEQ ID NO: 4144786 - RNA, 17 nt, Yersinia pestis
agacaauuaacacuuau

SEQ ID NO: 4144787 - RNA, 16 nt, Yersinia pestis
agacacaagauaaaua

SEQ ID NO: 4144788 - RNA, 23 nt, Yersinia pestis
agacacuaaccagacgcaaccaa

SEQ ID NO: 4144789 - RNA, 17 nt, Yersinia pestis
agacacugacaucauca

SEQ ID NO: 4144790 - RNA, 21 nt, Yersinia pestis
agacacuuugguuugcagcga

SEQ ID NO: 4144791 - RNA, 22 nt, Yersinia pestis
agacagcaguuaaugcuuaaga

SEQ ID NO: 4144792 - RNA, 20 nt, Yersinia pestis
agacagggggauaaaaaccc

SEQ ID NO: 4144793 - RNA, 19 nt, Yersinia pestis
agacaguaaauccugauga

SEQ ID NO: 4144794 - RNA, 16 nt, Yersinia pestis
agacaguaacuaaagc

SEQ ID NO: 4144795 - RNA, 21 nt, Yersinia pestis
agacauaaugccggcggccca

SEQ ID NO: 4144796 - RNA, 20 nt, Yersinia pestis
agacauagagagaacagcga

SEQ ID NO: 4144797 - RNA, 20 nt, Yersinia pestis
agacauauuguccaacaucu

SEQ ID NO: 4144798 - RNA, 14 nt, Yersinia pestis
agaccacagauaaa

SEQ ID NO: 4144799 - RNA, 15 nt, Yersinia pestis
agaccacagauaaau

SEQ ID NO: 4144800 - RNA, 12 nt, Yersinia pestis
agaccagauaau

SEQ ID NO: 4144801 - RNA, 16 nt, Yersinia pestis
agaccagauaaucgcc

SEQ ID NO: 4144802 - RNA, 21 nt, Yersinia pestis
agaccagauaaucgccaauaa

SEQ ID NO: 4144803 - RNA, 16 nt, Yersinia pestis
agacccuaauaucaug

SEQ ID NO: 4144804 - RNA, 21 nt, Yersinia pestis
agacccuaauaucauguucuu

SEQ ID NO: 4144805 - RNA, 22 nt, Yersinia pestis
agaccgcguuaauaccuuguuc

SEQ ID NO: 4144806 - RNA, 15 nt, Yersinia pestis
agaccguagaaacca

SEQ ID NO: 4144807 - RNA, 14 nt, Yersinia pestis
agaccugccaauuc

SEQ ID NO: 4144808 - RNA, 20 nt, Yersinia pestis
agacgacgugcagcgcgcag

SEQ ID NO: 4144809 - RNA, 20 nt, Yersinia pestis
agacgccguaaauacaucca

SEQ ID NO: 4144810 - RNA, 16 nt, Yersinia pestis
agacgcgcuagcuuca

SEQ ID NO: 4144811 - RNA, 22 nt, Yersinia pestis
agacguaucgcaguuaaagaca

SEQ ID NO: 4144812 - RNA, 15 nt, Yersinia pestis
agacuaaccucugca

SEQ ID NO: 4144813 - RNA, 15 nt, Yersinia pestis
agacuccaaauuagc

SEQ ID NO: 4144814 - RNA, 15 nt, Yersinia pestis
agacucugcuaccag

SEQ ID NO: 4144815 - RNA, 20 nt, Yersinia pestis
agacugaaaguagaaauaaa

SEQ ID NO: 4144816 - RNA, 22 nt, Yersinia pestis
agacugaaguuuaccgcaugaa

SEQ ID NO: 4144817 - RNA, 20 nt, Yersinia pestis
agacugacgcagagcuaaau

SEQ ID NO: 4144818 - RNA, 22 nt, Yersinia pestis
agacugacgcagagcuaaaugu

SEQ ID NO: 4144819 - RNA, 13 nt, Yersinia pestis
agacugcugacaa

SEQ ID NO: 4144820 - RNA, 22 nt, Yersinia pestis
agacuucagcccauggcugaaa

SEQ ID NO: 4144821 - RNA, 19 nt, Yersinia pestis
agacuuggguaaccaauca

SEQ ID NO: 4144822 - RNA, 20 nt, Yersinia pestis
agacuuuauucacagcagaa

SEQ ID NO: 4144823 - RNA, 12 nt, Yersinia pestis
agacuuuuccaa

SEQ ID NO: 4144824 - RNA, 18 nt, Yersinia pestis
agagaaaacagauauuuu

SEQ ID NO: 4144825 - RNA, 13 nt, Yersinia pestis
agagaaauaaccc

SEQ ID NO: 4144826 - RNA, 12 nt, Yersinia pestis
agagaaaucaaa

SEQ ID NO: 4144827 - RNA, 16 nt, Yersinia pestis
agagaaaugcucauca

SEQ ID NO: 4144828 - RNA, 18 nt, Yersinia pestis
agagaaccauuauuaccu

SEQ ID NO: 4144829 - RNA, 23 nt, Yersinia pestis
agagaacccuuguuuaucuucua

SEQ ID NO: 4144830 - RNA, 17 nt, Yersinia pestis
agagaacgggcaaccug

SEQ ID NO: 4144831 - RNA, 20 nt, Yersinia pestis
agagaauuauuucucguggc

SEQ ID NO: 4144832 - RNA, 20 nt, Yersinia pestis
agagacaaaaauagaaggcc

SEQ ID NO: 4144833 - RNA, 21 nt, Yersinia pestis
agagacuauucucgaaaaaga

SEQ ID NO: 4144834 - RNA, 14 nt, Yersinia pestis
agagagagugaaga

SEQ ID NO: 4144835 - RNA, 19 nt, Yersinia pestis
agagauaaaucggcggcca

SEQ ID NO: 4144836 - RNA, 21 nt, Yersinia pestis
agagauaaaucggcggccaug

SEQ ID NO: 4144837 - RNA, 18 nt, Yersinia pestis
agagauaacggcguucua

SEQ ID NO: 4144838 - RNA, 22 nt, Yersinia pestis
agagaucauguaguacuuaccu

SEQ ID NO: 4144839 - RNA, 18 nt, Yersinia pestis
agagaucccgugccagau

SEQ ID NO: 4144840 - RNA, 19 nt, Yersinia pestis
agagaucccgugccagauc

SEQ ID NO: 4144841 - RNA, 23 nt, Yersinia pestis
agagaucguaggcuuuuuacuuu

SEQ ID NO: 4144842 - RNA, 21 nt, Yersinia pestis
agagaugacccaaagucauug

SEQ ID NO: 4144843 - RNA, 22 nt, Yersinia pestis
agagauugccggauuccaccug

SEQ ID NO: 4144844 - RNA, 20 nt, Yersinia pestis
agagcaaagucccggcuagg

SEQ ID NO: 4144845 - RNA, 18 nt, Yersinia pestis
agagcacaacggaaggcc

SEQ ID NO: 4144846 - RNA, 16 nt, Yersinia pestis
agagcagaaagcagca

SEQ ID NO: 4144847 - RNA, 12 nt, Yersinia pestis
agagcauaaccc

SEQ ID NO: 4144848 - RNA, 20 nt, Yersinia pestis
agagcauagacgaaggcacg

SEQ ID NO: 4144849 - RNA, 17 nt, Yersinia pestis
agagccgcuauaaccuu

SEQ ID NO: 4144850 - RNA, 18 nt, Yersinia pestis
agagccugaaucugaaug

SEQ ID NO: 4144851 - RNA, 16 nt, Yersinia pestis
agagccuuauaggcgc

SEQ ID NO: 4144852 - RNA, 23 nt, Yersinia pestis
agagccuuauaggcgcauaugaa

SEQ ID NO: 4144853 - RNA, 17 nt, Yersinia pestis
agagcgaauggcaaugg

SEQ ID NO: 4144854 - RNA, 18 nt, Yersinia pestis
agagcgauugacugaaug

SEQ ID NO: 4144855 - RNA, 19 nt, Yersinia pestis
agagcgcaaaagaccaagu

SEQ ID NO: 4144856 - RNA, 23 nt, Yersinia pestis
agagcgcaaugcuccagcaacug

SEQ ID NO: 4144857 - RNA, 20 nt, Yersinia pestis
agagcgcggcuucagcaccu

SEQ ID NO: 4144858 - RNA, 22 nt, Yersinia pestis
agagcggucgacaaaaugugaa

SEQ ID NO: 4144859 - RNA, 17 nt, Yersinia pestis
agagcgguuuauauuuu

SEQ ID NO: 4144860 - RNA, 20 nt, Yersinia pestis
agagcgguuuauauuuuugg

SEQ ID NO: 4144861 - RNA, 23 nt, Yersinia pestis
agagcguuucaguauuguauaca

SEQ ID NO: 4144862 - RNA, 21 nt, Yersinia pestis
agagcuaccggaaugaguugc

SEQ ID NO: 4144863 - RNA, 13 nt, Yersinia pestis
agaggaaagagag

SEQ ID NO: 4144864 - RNA, 14 nt, Yersinia pestis
agaggaguaaagcg

SEQ ID NO: 4144865 - RNA, 14 nt, Yersinia pestis
agaggcaaugauuu

SEQ ID NO: 4144866 - RNA, 18 nt, Yersinia pestis
agagguagacguaucaug

SEQ ID NO: 4144867 - RNA, 14 nt, Yersinia pestis
agagguuaaauugu

SEQ ID NO: 4144868 - RNA, 13 nt, Yersinia pestis
agagguuacgaug

SEQ ID NO: 4144869 - RNA, 15 nt, Yersinia pestis
agagguuauugacaa

SEQ ID NO: 4144870 - RNA, 15 nt, Yersinia pestis
agagguuguugacaa

SEQ ID NO: 4144871 - RNA, 15 nt, Yersinia pestis
agaguaaguaaaaag

SEQ ID NO: 4144872 - RNA, 15 nt, Yersinia pestis
agaguacguaacgaa

SEQ ID NO: 4144873 - RNA, 14 nt, Yersinia pestis
agagucacagagga

SEQ ID NO: 4144874 - RNA, 12 nt, Yersinia pestis
agagucacagca

SEQ ID NO: 4144875 - RNA, 16 nt, Yersinia pestis
agagucacagcauuca

SEQ ID NO: 4144876 - RNA, 18 nt, Yersinia pestis
agagucacagcauucaga

SEQ ID NO: 4144877 - RNA, 14 nt, Yersinia pestis
agaguccagcacug

SEQ ID NO: 4144878 - RNA, 14 nt, Yersinia pestis
agaguccuuaaaaa

SEQ ID NO: 4144879 - RNA, 20 nt, Yersinia pestis
agagucgagcggggcaaaaa

SEQ ID NO: 4144880 - RNA, 17 nt, Yersinia pestis
agagucgcaaaaaauau

SEQ ID NO: 4144881 - RNA, 13 nt, Yersinia pestis
agagucgcuuugg

SEQ ID NO: 4144882 - RNA, 14 nt, Yersinia pestis
agagugaagauuuu

SEQ ID NO: 4144883 - RNA, 16 nt, Yersinia pestis
agagugaccaaagcag

SEQ ID NO: 4144884 - RNA, 17 nt, Yersinia pestis
agaguguucauaaauua

SEQ ID NO: 4144885 - RNA, 14 nt, Yersinia pestis
agauaaaaauaauc

SEQ ID NO: 4144886 - RNA, 20 nt, Yersinia pestis
agauaaaaauaaucaaugac

SEQ ID NO: 4144887 - RNA, 17 nt, Yersinia pestis
agauaaacaaacaucau

SEQ ID NO: 4144888 - RNA, 15 nt, Yersinia pestis
agauaacauacacca

SEQ ID NO: 4144889 - RNA, 21 nt, Yersinia pestis
agauaaccggcuggaaauuca

SEQ ID NO: 4144890 - RNA, 21 nt, Yersinia pestis
agauaacgauaacuccagggu

SEQ ID NO: 4144891 - RNA, 17 nt, Yersinia pestis
agauaacgcaaaacgcc

SEQ ID NO: 4144892 - RNA, 20 nt, Yersinia pestis
agauaacuuuuuauuucuuu

SEQ ID NO: 4144893 - RNA, 16 nt, Yersinia pestis
agauaagaucucagca

SEQ ID NO: 4144894 - RNA, 19 nt, Yersinia pestis
agauaaggggauugcugcc

SEQ ID NO: 4144895 - RNA, 13 nt, Yersinia pestis
agauaaucgccaa

SEQ ID NO: 4144896 - RNA, 23 nt, Yersinia pestis
agauaauguucguuuuuuggguu

SEQ ID NO: 4144897 - RNA, 15 nt, Yersinia pestis
agauaauguugaucu

SEQ ID NO: 4144898 - RNA, 14 nt, Yersinia pestis
agauaauuauccau

SEQ ID NO: 4144899 - RNA, 19 nt, Yersinia pestis
agauaauuauccauuuucu

SEQ ID NO: 4144900 - RNA, 20 nt, Yersinia pestis
agauaauuauccauuuucug

SEQ ID NO: 4144901 - RNA, 22 nt, Yersinia pestis
agauaauuggcaauaaugucac

SEQ ID NO: 4144902 - RNA, 17 nt, Yersinia pestis
agauaauuuagcaaagc

SEQ ID NO: 4144903 - RNA, 23 nt, Yersinia pestis
agauacaaggucacgaccaagac

SEQ ID NO: 4144904 - RNA, 15 nt, Yersinia pestis
agauaccacaucaaa

SEQ ID NO: 4144905 - RNA, 19 nt, Yersinia pestis
agauacccgccauaaauaa

SEQ ID NO: 4144906 - RNA, 18 nt, Yersinia pestis
agauacccuucucuuuau

SEQ ID NO: 4144907 - RNA, 17 nt, Yersinia pestis
agauaccgaguucucac

SEQ ID NO: 4144908 - RNA, 16 nt, Yersinia pestis
agauaccgcaaccauu

SEQ ID NO: 4144909 - RNA, 20 nt, Yersinia pestis
agauaccgccccucacuucg

SEQ ID NO: 4144910 - RNA, 19 nt, Yersinia pestis
agauacuugcguucacccc

SEQ ID NO: 4144911 - RNA, 22 nt, Yersinia pestis
agauagaaaucacugaugagcu

SEQ ID NO: 4144912 - RNA, 22 nt, Yersinia pestis
agauagaccccuucuuccagca

SEQ ID NO: 4144913 - RNA, 14 nt, Yersinia pestis
agauagcaucaucc

SEQ ID NO: 4144914 - RNA, 22 nt, Yersinia pestis
agauagcgaaucacaucauuca

SEQ ID NO: 4144915 - RNA, 21 nt, Yersinia pestis
agauaggagaagguuccccuu

SEQ ID NO: 4144916 - RNA, 15 nt, Yersinia pestis
agauagucauuuuau

SEQ ID NO: 4144917 - RNA, 13 nt, Yersinia pestis
agauaguuaccca

SEQ ID NO: 4144918 - RNA, 18 nt, Yersinia pestis
agauaguuaucucccauu

SEQ ID NO: 4144919 - RNA, 12 nt, Yersinia pestis
agauauaauggu

SEQ ID NO: 4144920 - RNA, 15 nt, Yersinia pestis
agauaucuaauuuau

SEQ ID NO: 4144921 - RNA, 20 nt, Yersinia pestis
agauaucuaauuuauaaccu

SEQ ID NO: 4144922 - RNA, 15 nt, Yersinia pestis
agauaugaucaaaaa

SEQ ID NO: 4144923 - RNA, 22 nt, Yersinia pestis
agauaugcauuauugauguuau

SEQ ID NO: 4144924 - RNA, 22 nt, Yersinia pestis
agauaugccaggcaucaucugc

SEQ ID NO: 4144925 - RNA, 15 nt, Yersinia pestis
agauauuacuucuuu

SEQ ID NO: 4144926 - RNA, 15 nt, Yersinia pestis
agauauuugcugccu

SEQ ID NO: 4144927 - RNA, 18 nt, Yersinia pestis
agaucaaaagcagagaau

SEQ ID NO: 4144928 - RNA, 20 nt, Yersinia pestis
agaucaauguuaucgccaac

SEQ ID NO: 4144929 - RNA, 20 nt, Yersinia pestis
agaucagcacggaaccccug

SEQ ID NO: 4144930 - RNA, 12 nt, Yersinia pestis
agaucagugcca

SEQ ID NO: 4144931 - RNA, 14 nt, Yersinia pestis
agaucagugccagu

SEQ ID NO: 4144932 - RNA, 17 nt, Yersinia pestis
agaucagugccaguaau

SEQ ID NO: 4144933 - RNA, 15 nt, Yersinia pestis
agaucaguucaguau

SEQ ID NO: 4144934 - RNA, 22 nt, Yersinia pestis
agaucauguaguacuuaccuuc

SEQ ID NO: 4144935 - RNA, 17 nt, Yersinia pestis
agaucauuuuuuuccac

SEQ ID NO: 4144936 - RNA, 17 nt, Yersinia pestis
agauccaguucagucca

SEQ ID NO: 4144937 - RNA, 16 nt, Yersinia pestis
agaucccccugcugcc

SEQ ID NO: 4144938 - RNA, 20 nt, Yersinia pestis
agaucccgugugauuuccau

SEQ ID NO: 4144939 - RNA, 15 nt, Yersinia pestis
agaucccuaacgccg

SEQ ID NO: 4144940 - RNA, 22 nt, Yersinia pestis
agauccguuuuuuuuaucagcc

SEQ ID NO: 4144941 - RNA, 20 nt, Yersinia pestis
agauccuccauauccucaag

SEQ ID NO: 4144942 - RNA, 23 nt, Yersinia pestis
agauccugccgccucugcuccgg

SEQ ID NO: 4144943 - RNA, 19 nt, Yersinia pestis
agaucgcgaugcgccuguu

SEQ ID NO: 4144944 - RNA, 21 nt, Yersinia pestis
agaucgcgaugcgccuguuag

SEQ ID NO: 4144945 - RNA, 15 nt, Yersinia pestis
agaucgcgucaucgg

SEQ ID NO: 4144946 - RNA, 22 nt, Yersinia pestis
agaucggcauuauuaucuugau

SEQ ID NO: 4144947 - RNA, 20 nt, Yersinia pestis
agaucgggucagguuucagu

SEQ ID NO: 4144948 - RNA, 13 nt, Yersinia pestis
agaucguaggcuu

SEQ ID NO: 4144949 - RNA, 16 nt, Yersinia pestis
agaucucagaauuuuu

SEQ ID NO: 4144950 - RNA, 19 nt, Yersinia pestis
agaucucugcgacaucagc

SEQ ID NO: 4144951 - RNA, 16 nt, Yersinia pestis
agaucuuuuucauucu

SEQ ID NO: 4144952 - RNA, 23 nt, Yersinia pestis
agaucuuuuucauucugagcgua

SEQ ID NO: 4144953 - RNA, 12 nt, Yersinia pestis
agaugaacacag

SEQ ID NO: 4144954 - RNA, 16 nt, Yersinia pestis
agaugaacacagaaac

SEQ ID NO: 4144955 - RNA, 15 nt, Yersinia pestis
agaugaauacgcuuu

SEQ ID NO: 4144956 - RNA, 20 nt, Yersinia pestis
agaugagaaucucuccagug

SEQ ID NO: 4144957 - RNA, 22 nt, Yersinia pestis
agaugauuuuuaacgucagaua

SEQ ID NO: 4144958 - RNA, 18 nt, Yersinia pestis
agaugcaaaugucagauc

SEQ ID NO: 4144959 - RNA, 18 nt, Yersinia pestis
agaugcagagaugcagug

SEQ ID NO: 4144960 - RNA, 18 nt, Yersinia pestis
agaugccaaucaaaaaac

SEQ ID NO: 4144961 - RNA, 20 nt, Yersinia pestis
agaugccuauuugcagaaag

SEQ ID NO: 4144962 - RNA, 21 nt, Yersinia pestis
agauggccagauucaccagua

SEQ ID NO: 4144963 - RNA, 21 nt, Yersinia pestis
agauggcggucgcacugugag

SEQ ID NO: 4144964 - RNA, 18 nt, Yersinia pestis
agauggcuuuggugauca

SEQ ID NO: 4144965 - RNA, 20 nt, Yersinia pestis
agaugggaagacagauccug

SEQ ID NO: 4144966 - RNA, 23 nt, Yersinia pestis
agauggucauaaauaggugcgcc

SEQ ID NO: 4144967 - RNA, 17 nt, Yersinia pestis
agauguagguaggcagc

SEQ ID NO: 4144968 - RNA, 13 nt, Yersinia pestis
agaugucagauua

SEQ ID NO: 4144969 - RNA, 22 nt, Yersinia pestis
agaugucgcccgucuggcaggg

SEQ ID NO: 4144970 - RNA, 19 nt, Yersinia pestis
agauguucgcagaaaagag

SEQ ID NO: 4144971 - RNA, 23 nt, Yersinia pestis
agauuagucuuagacgucagauu

SEQ ID NO: 4144972 - RNA, 23 nt, Yersinia pestis
agauuaguuuuagacgucagauu

SEQ ID NO: 4144973 - RNA, 14 nt, Yersinia pestis
agauuauuauuacu

SEQ ID NO: 4144974 - RNA, 15 nt, Yersinia pestis
agauuauuauuacua

SEQ ID NO: 4144975 - RNA, 23 nt, Yersinia pestis
agauuauuggcgauuuaauguau

SEQ ID NO: 4144976 - RNA, 16 nt, Yersinia pestis
agauuauuucagcuuc

SEQ ID NO: 4144977 - RNA, 14 nt, Yersinia pestis
agauucaaguugca

SEQ ID NO: 4144978 - RNA, 16 nt, Yersinia pestis
agauucaucaccaguc

SEQ ID NO: 4144979 - RNA, 16 nt, Yersinia pestis
agauucgcaaagcggg

SEQ ID NO: 4144980 - RNA, 12 nt, Yersinia pestis
agauucuagcau

SEQ ID NO: 4144981 - RNA, 16 nt, Yersinia pestis
agauucuagcaucgcc

SEQ ID NO: 4144982 - RNA, 22 nt, Yersinia pestis
agauugagugcggacagcgcgc

SEQ ID NO: 4144983 - RNA, 16 nt, Yersinia pestis
agauugaucaguggcu

SEQ ID NO: 4144984 - RNA, 20 nt, Yersinia pestis
agauuggcagcguaaagguu

SEQ ID NO: 4144985 - RNA, 20 nt, Yersinia pestis
agauuguuuuccacauggcu

SEQ ID NO: 4144986 - RNA, 13 nt, Yersinia pestis
agauuuaaauaac

SEQ ID NO: 4144987 - RNA, 17 nt, Yersinia pestis
agauuuaaccccaauuc

SEQ ID NO: 4144988 - RNA, 18 nt, Yersinia pestis
agauuuaaccccaauucu

SEQ ID NO: 4144989 - RNA, 12 nt, Yersinia pestis
agauuuaccaug

SEQ ID NO: 4144990 - RNA, 14 nt, Yersinia pestis
agauuuacccaaag

SEQ ID NO: 4144991 - RNA, 13 nt, Yersinia pestis
agauuucacuuuc

SEQ ID NO: 4144992 - RNA, 21 nt, Yersinia pestis
agauuucaucggcaaaaacag

SEQ ID NO: 4144993 - RNA, 20 nt, Yersinia pestis
agauuucgguuaauauugaa

SEQ ID NO: 4144994 - RNA, 16 nt, Yersinia pestis
agauuugguauuacgc

SEQ ID NO: 4144995 - RNA, 15 nt, Yersinia pestis
agauuuuaugaauua

SEQ ID NO: 4144996 - RNA, 17 nt, Yersinia pestis
agauuuuccauccccug

SEQ ID NO: 4144997 - RNA, 18 nt, Yersinia pestis
agauuuucuuucaggcug

SEQ ID NO: 4144998 - RNA, 17 nt, Yersinia pestis
agcaaaaaaaaagccug

SEQ ID NO: 4144999 - RNA, 16 nt, Yersinia pestis
agcaaaaggauuaaua

SEQ ID NO: 4145000 - RNA, 14 nt, Yersinia pestis
agcaaacgaacgaa

SEQ ID NO: 4145001 - RNA, 15 nt, Yersinia pestis
agcaaacgaacgaau

SEQ ID NO: 4145002 - RNA, 16 nt, Yersinia pestis
agcaaacgucccgcuu

SEQ ID NO: 4145003 - RNA, 20 nt, Yersinia pestis
agcaaacucagccaauccag

SEQ ID NO: 4145004 - RNA, 17 nt, Yersinia pestis
agcaaagccaaaaccau

SEQ ID NO: 4145005 - RNA, 12 nt, Yersinia pestis
agcaaaggccac

SEQ ID NO: 4145006 - RNA, 23 nt, Yersinia pestis
agcaaagucccggcuaggaggcc

SEQ ID NO: 4145007 - RNA, 14 nt, Yersinia pestis
agcaaaucaaacaa

SEQ ID NO: 4145008 - RNA, 13 nt, Yersinia pestis
agcaaaucacauu

SEQ ID NO: 4145009 - RNA, 14 nt, Yersinia pestis
agcaaauugcugaa

SEQ ID NO: 4145010 - RNA, 20 nt, Yersinia pestis
agcaaauugcugaaaaaaaa

SEQ ID NO: 4145011 - RNA, 14 nt, Yersinia pestis
agcaacaaacagcc

SEQ ID NO: 4145012 - RNA, 14 nt, Yersinia pestis
agcaacaauaacuu

SEQ ID NO: 4145013 - RNA, 19 nt, Yersinia pestis
agcaacacaucuuccagua

SEQ ID NO: 4145014 - RNA, 22 nt, Yersinia pestis
agcaacaugguuaagagauccc

SEQ ID NO: 4145015 - RNA, 17 nt, Yersinia pestis
agcaaccaaccuugauc

SEQ ID NO: 4145016 - RNA, 22 nt, Yersinia pestis
agcaaccauuuuauugccagag

SEQ ID NO: 4145017 - RNA, 23 nt, Yersinia pestis
agcaacgaaaugucgaaagauag

SEQ ID NO: 4145018 - RNA, 22 nt, Yersinia pestis
agcaacgguuuguaucgaugau

SEQ ID NO: 4145019 - RNA, 21 nt, Yersinia pestis
agcaacuaucuccggccugcc

SEQ ID NO: 4145020 - RNA, 15 nt, Yersinia pestis
agcaacucacugaau

SEQ ID NO: 4145021 - RNA, 21 nt, Yersinia pestis
agcaacucacugaauauccgu

SEQ ID NO: 4145022 - RNA, 21 nt, Yersinia pestis
agcaagcggcagcgcuggugc

SEQ ID NO: 4145023 - RNA, 14 nt, Yersinia pestis
agcaaggauucccc

SEQ ID NO: 4145024 - RNA, 23 nt, Yersinia pestis
agcaaggauuccccccagucacu

SEQ ID NO: 4145025 - RNA, 20 nt, Yersinia pestis
agcaaggcggcaagcaagca

SEQ ID NO: 4145026 - RNA, 12 nt, Yersinia pestis
agcaaguuaacg

SEQ ID NO: 4145027 - RNA, 21 nt, Yersinia pestis
agcaaguuagcgauaucugcg

SEQ ID NO: 4145028 - RNA, 14 nt, Yersinia pestis
agcaauaaacucau

SEQ ID NO: 4145029 - RNA, 21 nt, Yersinia pestis
agcaauaaggugccacacaga

SEQ ID NO: 4145030 - RNA, 13 nt, Yersinia pestis
agcaauacgccag

SEQ ID NO: 4145031 - RNA, 19 nt, Yersinia pestis
agcaauauaauaaucuaua

SEQ ID NO: 4145032 - RNA, 14 nt, Yersinia pestis
agcaauauccuuaa

SEQ ID NO: 4145033 - RNA, 22 nt, Yersinia pestis
agcaaucaaaagggaucaccag

SEQ ID NO: 4145034 - RNA, 11 nt, Yersinia pestis
agcaaucuggc

SEQ ID NO: 4145035 - RNA, 23 nt, Yersinia pestis
agcaaugaccuuacagugauaau

SEQ ID NO: 4145036 - RNA, 19 nt, Yersinia pestis
agcaaugcaccgacaaaga

SEQ ID NO: 4145037 - RNA, 17 nt, Yersinia pestis
agcaauggcgaugagaa

SEQ ID NO: 4145038 - RNA, 23 nt, Yersinia pestis
agcaauggcgaugagaaugccga

SEQ ID NO: 4145039 - RNA, 19 nt, Yersinia pestis
agcaauguucaaaucugcu

SEQ ID NO: 4145040 - RNA, 12 nt, Yersinia pestis
agcacaaaaaga

SEQ ID NO: 4145041 - RNA, 13 nt, Yersinia pestis
agcacaacgcucu

SEQ ID NO: 4145042 - RNA, 22 nt, Yersinia pestis
agcacaacgcucuaacgucaga

SEQ ID NO: 4145043 - RNA, 15 nt, Yersinia pestis
agcacacacagccua

SEQ ID NO: 4145044 - RNA, 21 nt, Yersinia pestis
agcacacucagaugaaaaacu

SEQ ID NO: 4145045 - RNA, 20 nt, Yersinia pestis
agcacagccugccgggauga

SEQ ID NO: 4145046 - RNA, 15 nt, Yersinia pestis
agcaccaauaucaau

SEQ ID NO: 4145047 - RNA, 16 nt, Yersinia pestis
agcaccacaauggcag

SEQ ID NO: 4145048 - RNA, 18 nt, Yersinia pestis
agcaccagaaaguuguuc

SEQ ID NO: 4145049 - RNA, 13 nt, Yersinia pestis
agcaccagcacca

SEQ ID NO: 4145050 - RNA, 15 nt, Yersinia pestis
agcaccagcaccaac

SEQ ID NO: 4145051 - RNA, 18 nt, Yersinia pestis
agcaccagcaccaacaau

SEQ ID NO: 4145052 - RNA, 16 nt, Yersinia pestis
agcaccauuaucuucc

SEQ ID NO: 4145053 - RNA, 13 nt, Yersinia pestis
agcaccuaucgcc

SEQ ID NO: 4145054 - RNA, 20 nt, Yersinia pestis
agcaccuaucgccgccgcca

SEQ ID NO: 4145055 - RNA, 22 nt, Yersinia pestis
agcacgaauuuuauucagcaag

SEQ ID NO: 4145056 - RNA, 19 nt, Yersinia pestis
agcacgaccuugccaaggu

SEQ ID NO: 4145057 - RNA, 22 nt, Yersinia pestis
agcacgcuugauggccacacug

SEQ ID NO: 4145058 - RNA, 18 nt, Yersinia pestis
agcacggacagcagcacg

SEQ ID NO: 4145059 - RNA, 19 nt, Yersinia pestis
agcacggcugaacgguagc

SEQ ID NO: 4145060 - RNA, 16 nt, Yersinia pestis
agcacguaaaucgguu

SEQ ID NO: 4145061 - RNA, 21 nt, Yersinia pestis
agcacguuuuucagcuucuuc

SEQ ID NO: 4145062 - RNA, 14 nt, Yersinia pestis
agcacuaagauuca

SEQ ID NO: 4145063 - RNA, 22 nt, Yersinia pestis
agcacuaucacaucaaauuuuu

SEQ ID NO: 4145064 - RNA, 15 nt, Yersinia pestis
agcacucaguacagu

SEQ ID NO: 4145065 - RNA, 15 nt, Yersinia pestis
agcacucauaaugcu

SEQ ID NO: 4145066 - RNA, 16 nt, Yersinia pestis
agcacuccccgcccgu

SEQ ID NO: 4145067 - RNA, 19 nt, Yersinia pestis
agcacucgguggcauaaac

SEQ ID NO: 4145068 - RNA, 11 nt, Yersinia pestis
agcacugcccc

SEQ ID NO: 4145069 - RNA, 12 nt, Yersinia pestis
agcacugccccg

SEQ ID NO: 4145070 - RNA, 17 nt, Yersinia pestis
agcacugccccgaagcu

SEQ ID NO: 4145071 - RNA, 21 nt, Yersinia pestis
agcacugccccgaagcucaag

SEQ ID NO: 4145072 - RNA, 18 nt, Yersinia pestis
agcacugcgcgaucccag

SEQ ID NO: 4145073 - RNA, 22 nt, Yersinia pestis
agcacugcgcgaucccagaaug

SEQ ID NO: 4145074 - RNA, 16 nt, Yersinia pestis
agcacugguagcauca

SEQ ID NO: 4145075 - RNA, 14 nt, Yersinia pestis
agcacuucagcgua

SEQ ID NO: 4145076 - RNA, 19 nt, Yersinia pestis
agcacuuuacgauuucgcu

SEQ ID NO: 4145077 - RNA, 20 nt, Yersinia pestis
agcagaaaagcgaaggggcg

SEQ ID NO: 4145078 - RNA, 16 nt, Yersinia pestis
agcagaacaaaacaag

SEQ ID NO: 4145079 - RNA, 13 nt, Yersinia pestis
agcagacuugaac

SEQ ID NO: 4145080 - RNA, 12 nt, Yersinia pestis
agcagagaauga

SEQ ID NO: 4145081 - RNA, 14 nt, Yersinia pestis
agcagauaauaaau

SEQ ID NO: 4145082 - RNA, 14 nt, Yersinia pestis
agcagcaaacgccu

SEQ ID NO: 4145083 - RNA, 17 nt, Yersinia pestis
agcagcaccaauaucaa

SEQ ID NO: 4145084 - RNA, 15 nt, Yersinia pestis
agcagcauccugaac

SEQ ID NO: 4145085 - RNA, 20 nt, Yersinia pestis
agcagcauccugaacuuccu

SEQ ID NO: 4145086 - RNA, 17 nt, Yersinia pestis
agcagccaacacaccug

SEQ ID NO: 4145087 - RNA, 18 nt, Yersinia pestis
agcagccucuaacauacu

SEQ ID NO: 4145088 - RNA, 15 nt, Yersinia pestis
agcagcgcccaacag

SEQ ID NO: 4145089 - RNA, 19 nt, Yersinia pestis
agcagcgcccaacaggugc

SEQ ID NO: 4145090 - RNA, 14 nt, Yersinia pestis
agcagcucaaaauc

SEQ ID NO: 4145091 - RNA, 21 nt, Yersinia pestis
agcaggaaacaugcugaagcc

SEQ ID NO: 4145092 - RNA, 16 nt, Yersinia pestis
agcaggcagagcaagg

SEQ ID NO: 4145093 - RNA, 16 nt, Yersinia pestis
agcagggccgcccaga

SEQ ID NO: 4145094 - RNA, 22 nt, Yersinia pestis
agcagggccgcccagauaaaga

SEQ ID NO: 4145095 - RNA, 16 nt, Yersinia pestis
agcaggggcaaccucu

SEQ ID NO: 4145096 - RNA, 19 nt, Yersinia pestis
agcaguaacguccaacuga

SEQ ID NO: 4145097 - RNA, 20 nt, Yersinia pestis
agcaguaacguccaacugac

SEQ ID NO: 4145098 - RNA, 17 nt, Yersinia pestis
agcaguaauagcaaaaa

SEQ ID NO: 4145099 - RNA, 11 nt, Yersinia pestis
agcaguagcca

SEQ ID NO: 4145100 - RNA, 16 nt, Yersinia pestis
agcagucaaaaugaaa

SEQ ID NO: 4145101 - RNA, 13 nt, Yersinia pestis
agcagucagcaug

SEQ ID NO: 4145102 - RNA, 20 nt, Yersinia pestis
agcagucugagggccacuuc

SEQ ID NO: 4145103 - RNA, 21 nt, Yersinia pestis
agcagucugaggggcguuuaa

SEQ ID NO: 4145104 - RNA, 14 nt, Yersinia pestis
agcagucugaggug

SEQ ID NO: 4145105 - RNA, 18 nt, Yersinia pestis
agcagugauuucaguguc

SEQ ID NO: 4145106 - RNA, 16 nt, Yersinia pestis
agcagugcugaacgua

SEQ ID NO: 4145107 - RNA, 21 nt, Yersinia pestis
agcagugucagggcaauaaca

SEQ ID NO: 4145108 - RNA, 20 nt, Yersinia pestis
agcauaacgguuguauacaa

SEQ ID NO: 4145109 - RNA, 23 nt, Yersinia pestis
agcauaccgguuugggcaucaac

SEQ ID NO: 4145110 - RNA, 19 nt, Yersinia pestis
agcauacguugccagccau

SEQ ID NO: 4145111 - RNA, 19 nt, Yersinia pestis
agcauacuguuggcaauuu

SEQ ID NO: 4145112 - RNA, 18 nt, Yersinia pestis
agcauagacgaaggcacg

SEQ ID NO: 4145113 - RNA, 13 nt, Yersinia pestis
agcauauuaccca

SEQ ID NO: 4145114 - RNA, 18 nt, Yersinia pestis
agcauauuacccaguacu

SEQ ID NO: 4145115 - RNA, 18 nt, Yersinia pestis
agcauauucaguaacaac

SEQ ID NO: 4145116 - RNA, 15 nt, Yersinia pestis
agcaucaaauuauuu

SEQ ID NO: 4145117 - RNA, 13 nt, Yersinia pestis
agcaucaauaacg

SEQ ID NO: 4145118 - RNA, 17 nt, Yersinia pestis
agcaucaauaucgccac

SEQ ID NO: 4145119 - RNA, 14 nt, Yersinia pestis
agcaucacccgccc

SEQ ID NO: 4145120 - RNA, 16 nt, Yersinia pestis
agcaucacugucuauu

SEQ ID NO: 4145121 - RNA, 20 nt, Yersinia pestis
agcaucacugucuauuuuua

SEQ ID NO: 4145122 - RNA, 14 nt, Yersinia pestis
agcaucacuucaua

SEQ ID NO: 4145123 - RNA, 22 nt, Yersinia pestis
agcaucaguaacuucucucccg

SEQ ID NO: 4145124 - RNA, 18 nt, Yersinia pestis
agcaucaguaauuuuuug

SEQ ID NO: 4145125 - RNA, 15 nt, Yersinia pestis
agcaucauccagcuc

SEQ ID NO: 4145126 - RNA, 17 nt, Yersinia pestis
agcauccaauaccacca

SEQ ID NO: 4145127 - RNA, 23 nt, Yersinia pestis
agcauccagcucauauaaucaua

SEQ ID NO: 4145128 - RNA, 19 nt, Yersinia pestis
agcauccaguucauggcca

SEQ ID NO: 4145129 - RNA, 14 nt, Yersinia pestis
agcaucccagccac

SEQ ID NO: 4145130 - RNA, 19 nt, Yersinia pestis
agcaucgccgggucuugca

SEQ ID NO: 4145131 - RNA, 17 nt, Yersinia pestis
agcaucgcggaaccuuu

SEQ ID NO: 4145132 - RNA, 20 nt, Yersinia pestis
agcaucuccgcgaccacaug

SEQ ID NO: 4145133 - RNA, 15 nt, Yersinia pestis
agcaugaaugaaaua

SEQ ID NO: 4145134 - RNA, 13 nt, Yersinia pestis
agcaugcauccau

SEQ ID NO: 4145135 - RNA, 15 nt, Yersinia pestis
agcaugcccagccuc

SEQ ID NO: 4145136 - RNA, 22 nt, Yersinia pestis
agcaugcuaacuuguucagaaa

SEQ ID NO: 4145137 - RNA, 15 nt, Yersinia pestis
agcauggaagauauc

SEQ ID NO: 4145138 - RNA, 22 nt, Yersinia pestis
agcauggcuuuaugaccaauag

SEQ ID NO: 4145139 - RNA, 17 nt, Yersinia pestis
agcauucagcuuucucu

SEQ ID NO: 4145140 - RNA, 21 nt, Yersinia pestis
agcauucaggcuuuuuucuag

SEQ ID NO: 4145141 - RNA, 15 nt, Yersinia pestis
agcauugagcgccac

SEQ ID NO: 4145142 - RNA, 17 nt, Yersinia pestis
agcauugauggccuuga

SEQ ID NO: 4145143 - RNA, 20 nt, Yersinia pestis
agcauuuugcggaucacaua

SEQ ID NO: 4145144 - RNA, 19 nt, Yersinia pestis
agcauuuuucggugaacca

SEQ ID NO: 4145145 - RNA, 14 nt, Yersinia pestis
agccaaaacagccu

SEQ ID NO: 4145146 - RNA, 21 nt, Yersinia pestis
agccaaaaccauuggaaaggg

SEQ ID NO: 4145147 - RNA, 21 nt, Yersinia pestis
agccaaaauaaucaccagaca

SEQ ID NO: 4145148 - RNA, 21 nt, Yersinia pestis
agccaaacaaaugaacccuuu

SEQ ID NO: 4145149 - RNA, 21 nt, Yersinia pestis
agccaaaucaguaccaccacc

SEQ ID NO: 4145150 - RNA, 22 nt, Yersinia pestis
agccaaaucaguaccaccacca

SEQ ID NO: 4145151 - RNA, 11 nt, Yersinia pestis
agccaaaugag

SEQ ID NO: 4145152 - RNA, 15 nt, Yersinia pestis
agccaaauugugagu

SEQ ID NO: 4145153 - RNA, 16 nt, Yersinia pestis
agccaacagcugacua

SEQ ID NO: 4145154 - RNA, 15 nt, Yersinia pestis
agccaacgauaauga

SEQ ID NO: 4145155 - RNA, 13 nt, Yersinia pestis
agccaacggagcg

SEQ ID NO: 4145156 - RNA, 15 nt, Yersinia pestis
agccaacuuucgguu

SEQ ID NO: 4145157 - RNA, 22 nt, Yersinia pestis
agccaagacuuuccacaacaga

SEQ ID NO: 4145158 - RNA, 16 nt, Yersinia pestis
agccaagaucccaagc

SEQ ID NO: 4145159 - RNA, 15 nt, Yersinia pestis
agccaagcuucaauu

SEQ ID NO: 4145160 - RNA, 14 nt, Yersinia pestis
agccaauacacacg

SEQ ID NO: 4145161 - RNA, 20 nt, Yersinia pestis
agccaauccagcaaacgcau

SEQ ID NO: 4145162 - RNA, 17 nt, Yersinia pestis
agccaauccccagaagc

SEQ ID NO: 4145163 - RNA, 13 nt, Yersinia pestis
agccaaucucuug

SEQ ID NO: 4145164 - RNA, 16 nt, Yersinia pestis
agccaauggccacugc

SEQ ID NO: 4145165 - RNA, 23 nt, Yersinia pestis
agccacaaaaguucacaugauga

SEQ ID NO: 4145166 - RNA, 11 nt, Yersinia pestis
agccacacacu

SEQ ID NO: 4145167 - RNA, 15 nt, Yersinia pestis
agccacacauucagu

SEQ ID NO: 4145168 - RNA, 18 nt, Yersinia pestis
agccaccaccacggccag

SEQ ID NO: 4145169 - RNA, 22 nt, Yersinia pestis
agccaccaccacggccagaauc

SEQ ID NO: 4145170 - RNA, 14 nt, Yersinia pestis
agccaccagccaac

SEQ ID NO: 4145171 - RNA, 17 nt, Yersinia pestis
agccaccaguuuauuuu

SEQ ID NO: 4145172 - RNA, 21 nt, Yersinia pestis
agccaccauggguacgauggg

SEQ ID NO: 4145173 - RNA, 15 nt, Yersinia pestis
agccaccccguggca

SEQ ID NO: 4145174 - RNA, 14 nt, Yersinia pestis
agccaccgcacacu

SEQ ID NO: 4145175 - RNA, 16 nt, Yersinia pestis
agccaccgcacacuga

SEQ ID NO: 4145176 - RNA, 15 nt, Yersinia pestis
agccaccgcaucaau

SEQ ID NO: 4145177 - RNA, 14 nt, Yersinia pestis
agccacgaguuuuc

SEQ ID NO: 4145178 - RNA, 16 nt, Yersinia pestis
agccacgaucaacagu

SEQ ID NO: 4145179 - RNA, 13 nt, Yersinia pestis
agccacucacaua

SEQ ID NO: 4145180 - RNA, 18 nt, Yersinia pestis
agccacucggguucuaaa

SEQ ID NO: 4145181 - RNA, 13 nt, Yersinia pestis
agccagaagccag

SEQ ID NO: 4145182 - RNA, 12 nt, Yersinia pestis
agccagauaaaa

SEQ ID NO: 4145183 - RNA, 16 nt, Yersinia pestis
agccagcacacagaug

SEQ ID NO: 4145184 - RNA, 15 nt, Yersinia pestis
agccagccaauggcc

SEQ ID NO: 4145185 - RNA, 16 nt, Yersinia pestis
agccagccuuaacugc

SEQ ID NO: 4145186 - RNA, 17 nt, Yersinia pestis
agccagccuuaacugca

SEQ ID NO: 4145187 - RNA, 18 nt, Yersinia pestis
agccagcgccgugccaga

SEQ ID NO: 4145188 - RNA, 22 nt, Yersinia pestis
agccagcgccgugccagaaaca

SEQ ID NO: 4145189 - RNA, 22 nt, Yersinia pestis
agccagugaugcugcacaucaa

SEQ ID NO: 4145190 - RNA, 17 nt, Yersinia pestis
agccagugcgggagagu

SEQ ID NO: 4145191 - RNA, 18 nt, Yersinia pestis
agccagugucaggaugau

SEQ ID NO: 4145192 - RNA, 12 nt, Yersinia pestis
agccauaacuuc

SEQ ID NO: 4145193 - RNA, 17 nt, Yersinia pestis
agccauacccaaaccaa

SEQ ID NO: 4145194 - RNA, 16 nt, Yersinia pestis
agccauauccaaagau

SEQ ID NO: 4145195 - RNA, 14 nt, Yersinia pestis
agccauauuuuaaa

SEQ ID NO: 4145196 - RNA, 12 nt, Yersinia pestis
agccaucgccau

SEQ ID NO: 4145197 - RNA, 13 nt, Yersinia pestis
agccaucgccauc

SEQ ID NO: 4145198 - RNA, 23 nt, Yersinia pestis
agccauggcuuuagguugagaau

SEQ ID NO: 4145199 - RNA, 15 nt, Yersinia pestis
agccaugggcugaag

SEQ ID NO: 4145200 - RNA, 16 nt, Yersinia pestis
agccauguguuuguuu

SEQ ID NO: 4145201 - RNA, 14 nt, Yersinia pestis
agccauucagcagc

SEQ ID NO: 4145202 - RNA, 15 nt, Yersinia pestis
agccauucagcagca

SEQ ID NO: 4145203 - RNA, 17 nt, Yersinia pestis
agccauucagcagcaag

SEQ ID NO: 4145204 - RNA, 22 nt, Yersinia pestis
agccauugagcgaagaagagau

SEQ ID NO: 4145205 - RNA, 16 nt, Yersinia pestis
agccauuucaaaacgc

SEQ ID NO: 4145206 - RNA, 13 nt, Yersinia pestis
agcccaacacuuu

SEQ ID NO: 4145207 - RNA, 21 nt, Yersinia pestis
agcccaauucguauuccucaa

SEQ ID NO: 4145208 - RNA, 13 nt, Yersinia pestis
agcccagcguucu

SEQ ID NO: 4145209 - RNA, 15 nt, Yersinia pestis
agcccaguaaagcaa

SEQ ID NO: 4145210 - RNA, 16 nt, Yersinia pestis
agcccaguauugcaga

SEQ ID NO: 4145211 - RNA, 15 nt, Yersinia pestis
agcccauccuguuca

SEQ ID NO: 4145212 - RNA, 20 nt, Yersinia pestis
agccccaaaugccagcgaaa

SEQ ID NO: 4145213 - RNA, 15 nt, Yersinia pestis
agcccccucaauacc

SEQ ID NO: 4145214 - RNA, 20 nt, Yersinia pestis
agccccuaaauccugcaaug

SEQ ID NO: 4145215 - RNA, 16 nt, Yersinia pestis
agccccuaacagcagu

SEQ ID NO: 4145216 - RNA, 17 nt, Yersinia pestis
agccccucgaaaauaac

SEQ ID NO: 4145217 - RNA, 15 nt, Yersinia pestis
agccccuuugaacug

SEQ ID NO: 4145218 - RNA, 18 nt, Yersinia pestis
agcccgauggcaaaggau

SEQ ID NO: 4145219 - RNA, 19 nt, Yersinia pestis
agcccgcaacgggagagaa

SEQ ID NO: 4145220 - RNA, 23 nt, Yersinia pestis
agcccgcuuaaauacgguuaugu

SEQ ID NO: 4145221 - RNA, 22 nt, Yersinia pestis
agcccggcucauccgccaagau

SEQ ID NO: 4145222 - RNA, 21 nt, Yersinia pestis
agcccgugauaaaucuuauuu

SEQ ID NO: 4145223 - RNA, 14 nt, Yersinia pestis
agcccugaucgcug

SEQ ID NO: 4145224 - RNA, 17 nt, Yersinia pestis
agcccuguugcccagca

SEQ ID NO: 4145225 - RNA, 20 nt, Yersinia pestis
agcccuucgcaccgccgcca

SEQ ID NO: 4145226 - RNA, 20 nt, Yersinia pestis
agcccuuugaccauuuguuu

SEQ ID NO: 4145227 - RNA, 19 nt, Yersinia pestis
agccgaccauuaagccgga

SEQ ID NO: 4145228 - RNA, 14 nt, Yersinia pestis
agccgauaaucaau

SEQ ID NO: 4145229 - RNA, 20 nt, Yersinia pestis
agccgaugcuacaccaucca

SEQ ID NO: 4145230 - RNA, 22 nt, Yersinia pestis
agccgauuaacggcuacggaag

SEQ ID NO: 4145231 - RNA, 14 nt, Yersinia pestis
agccgccgcccuga

SEQ ID NO: 4145232 - RNA, 17 nt, Yersinia pestis
agccgcgaaaaaccaug

SEQ ID NO: 4145233 - RNA, 13 nt, Yersinia pestis
agccgcgccaucc

SEQ ID NO: 4145234 - RNA, 19 nt, Yersinia pestis
agccgcgccauccuuggcg

SEQ ID NO: 4145235 - RNA, 13 nt, Yersinia pestis
agccgcgcccucc

SEQ ID NO: 4145236 - RNA, 19 nt, Yersinia pestis
agccgcuauaaccuugucg

SEQ ID NO: 4145237 - RNA, 17 nt, Yersinia pestis
agccggacucaaaauac

SEQ ID NO: 4145238 - RNA, 17 nt, Yersinia pestis
agccgguuaggccaguu

SEQ ID NO: 4145239 - RNA, 23 nt, Yersinia pestis
agccguguaaauguacagucauu

SEQ ID NO: 4145240 - RNA, 18 nt, Yersinia pestis
agccuaacuggcgguuau

SEQ ID NO: 4145241 - RNA, 19 nt, Yersinia pestis
agccuaacuggcgguuauu

SEQ ID NO: 4145242 - RNA, 19 nt, Yersinia pestis
agccuauggcgguuccaaa

SEQ ID NO: 4145243 - RNA, 23 nt, Yersinia pestis
agccucauacaagccgugaccaa

SEQ ID NO: 4145244 - RNA, 15 nt, Yersinia pestis
agccucauucaugag

SEQ ID NO: 4145245 - RNA, 15 nt, Yersinia pestis
agccucugaucauuc

SEQ ID NO: 4145246 - RNA, 16 nt, Yersinia pestis
agccucuguagccgca

SEQ ID NO: 4145247 - RNA, 19 nt, Yersinia pestis
agccucuuguguaauuaua

SEQ ID NO: 4145248 - RNA, 23 nt, Yersinia pestis
agccucuuguguaauuauauuua

SEQ ID NO: 4145249 - RNA, 17 nt, Yersinia pestis
agccugagcaauauguu

SEQ ID NO: 4145250 - RNA, 12 nt, Yersinia pestis
agccugauacac

SEQ ID NO: 4145251 - RNA, 15 nt, Yersinia pestis
agccugcaccucauc

SEQ ID NO: 4145252 - RNA, 17 nt, Yersinia pestis
agccugcacggcucagg

SEQ ID NO: 4145253 - RNA, 15 nt, Yersinia pestis
agccugcccccgacg

SEQ ID NO: 4145254 - RNA, 13 nt, Yersinia pestis
agccugccgggau

SEQ ID NO: 4145255 - RNA, 20 nt, Yersinia pestis
agccugcguuaaaaccaccu

SEQ ID NO: 4145256 - RNA, 17 nt, Yersinia pestis
agccuggaagcaaaagc

SEQ ID NO: 4145257 - RNA, 19 nt, Yersinia pestis
agccuggaagcaaaagccc

SEQ ID NO: 4145258 - RNA, 21 nt, Yersinia pestis
agccugguuuuuuaaaaaagu

SEQ ID NO: 4145259 - RNA, 16 nt, Yersinia pestis
agccuguacauaaauu

SEQ ID NO: 4145260 - RNA, 15 nt, Yersinia pestis
agccugucuuaggug

SEQ ID NO: 4145261 - RNA, 21 nt, Yersinia pestis
agccuguuauuuuucuucuuu

SEQ ID NO: 4145262 - RNA, 17 nt, Yersinia pestis
agccuucaacuaauauu

SEQ ID NO: 4145263 - RNA, 12 nt, Yersinia pestis
agccuucccugg

SEQ ID NO: 4145264 - RNA, 15 nt, Yersinia pestis
agccuucuaauauua

SEQ ID NO: 4145265 - RNA, 21 nt, Yersinia pestis
agccuuguugaaucagauacg

SEQ ID NO: 4145266 - RNA, 21 nt, Yersinia pestis
agccuuuuuugcuuaaaacag

SEQ ID NO: 4145267 - RNA, 22 nt, Yersinia pestis
agccuuuuuugcuuaaaacagg

SEQ ID NO: 4145268 - RNA, 12 nt, Yersinia pestis
agcgaaggggcg

SEQ ID NO: 4145269 - RNA, 12 nt, Yersinia pestis
agcgaauaaaua

SEQ ID NO: 4145270 - RNA, 15 nt, Yersinia pestis
agcgaaucacaucau

SEQ ID NO: 4145271 - RNA, 17 nt, Yersinia pestis
agcgaauggcaauggcc

SEQ ID NO: 4145272 - RNA, 17 nt, Yersinia pestis
agcgacaaaagugucau

SEQ ID NO: 4145273 - RNA, 14 nt, Yersinia pestis
agcgacaaccugua

SEQ ID NO: 4145274 - RNA, 16 nt, Yersinia pestis
agcgacaaccuguagc

SEQ ID NO: 4145275 - RNA, 17 nt, Yersinia pestis
agcgacauggcgcaaug

SEQ ID NO: 4145276 - RNA, 18 nt, Yersinia pestis
agcgaccaaauggacgaa

SEQ ID NO: 4145277 - RNA, 22 nt, Yersinia pestis
agcgaccaaauggacgaacagc

SEQ ID NO: 4145278 - RNA, 15 nt, Yersinia pestis
agcgaccaucaugaa

SEQ ID NO: 4145279 - RNA, 12 nt, Yersinia pestis
agcgacgcuaaa

SEQ ID NO: 4145280 - RNA, 22 nt, Yersinia pestis
agcgacgucccuaaagccaucg

SEQ ID NO: 4145281 - RNA, 22 nt, Yersinia pestis
agcgagaggaggccugcuuaac

SEQ ID NO: 4145282 - RNA, 11 nt, Yersinia pestis
agcgaggauaa

SEQ ID NO: 4145283 - RNA, 20 nt, Yersinia pestis
agcgauagaguugauaaaca

SEQ ID NO: 4145284 - RNA, 21 nt, Yersinia pestis
agcgauagaguugauaaacaa

SEQ ID NO: 4145285 - RNA, 14 nt, Yersinia pestis
agcgauagccugau

SEQ ID NO: 4145286 - RNA, 12 nt, Yersinia pestis
agcgauauccuu

SEQ ID NO: 4145287 - RNA, 17 nt, Yersinia pestis
agcgauaucguuaucaa

SEQ ID NO: 4145288 - RNA, 21 nt, Yersinia pestis
agcgaucaccucuugcauacu

SEQ ID NO: 4145289 - RNA, 14 nt, Yersinia pestis
agcgaucagcaacg

SEQ ID NO: 4145290 - RNA, 14 nt, Yersinia pestis
agcgaucagcaaua

SEQ ID NO: 4145291 - RNA, 18 nt, Yersinia pestis
agcgaugaggcucuucug

SEQ ID NO: 4145292 - RNA, 18 nt, Yersinia pestis
agcgauguucgcuccccc

SEQ ID NO: 4145293 - RNA, 19 nt, Yersinia pestis
agcgauugacugaauguga

SEQ ID NO: 4145294 - RNA, 20 nt, Yersinia pestis
agcgcagggucagaauacgu

SEQ ID NO: 4145295 - RNA, 22 nt, Yersinia pestis
agcgcagguuaugcagcucaau

SEQ ID NO: 4145296 - RNA, 14 nt, Yersinia pestis
agcgcagugcucau

SEQ ID NO: 4145297 - RNA, 17 nt, Yersinia pestis
agcgcaucggaaaucug

SEQ ID NO: 4145298 - RNA, 20 nt, Yersinia pestis
agcgcauuugggcaauguug

SEQ ID NO: 4145299 - RNA, 15 nt, Yersinia pestis
agcgccacagucgcc

SEQ ID NO: 4145300 - RNA, 17 nt, Yersinia pestis
agcgccaugcgcuuuca

SEQ ID NO: 4145301 - RNA, 17 nt, Yersinia pestis
agcgcccgcaguuuauc

SEQ ID NO: 4145302 - RNA, 20 nt, Yersinia pestis
agcgcccggcugaccuguug

SEQ ID NO: 4145303 - RNA, 18 nt, Yersinia pestis
agcgccgacacccagcca

SEQ ID NO: 4145304 - RNA, 22 nt, Yersinia pestis
agcgccgauauacaccccauca

SEQ ID NO: 4145305 - RNA, 23 nt, Yersinia pestis
agcgccgauauacaccccaucag

SEQ ID NO: 4145306 - RNA, 18 nt, Yersinia pestis
agcgccgcaucaaagcgc

SEQ ID NO: 4145307 - RNA, 18 nt, Yersinia pestis
agcgccgugcauaaugga

SEQ ID NO: 4145308 - RNA, 11 nt, Yersinia pestis
agcgccugccc

SEQ ID NO: 4145309 - RNA, 17 nt, Yersinia pestis
agcgccugugggcggcu

SEQ ID NO: 4145310 - RNA, 23 nt, Yersinia pestis
agcgccuguuccaacgagugcag

SEQ ID NO: 4145311 - RNA, 19 nt, Yersinia pestis
agcgcgacgguacugauca

SEQ ID NO: 4145312 - RNA, 21 nt, Yersinia pestis
agcgcguaucguccagcagca

SEQ ID NO: 4145313 - RNA, 22 nt, Yersinia pestis
agcgcuaagcccgugauaaauc

SEQ ID NO: 4145314 - RNA, 17 nt, Yersinia pestis
agcgcucauagcaaaac

SEQ ID NO: 4145315 - RNA, 15 nt, Yersinia pestis
agcgcugcaucagca

SEQ ID NO: 4145316 - RNA, 15 nt, Yersinia pestis
agcgcuuccacugcg

SEQ ID NO: 4145317 - RNA, 15 nt, Yersinia pestis
agcgcuuggcucugg

SEQ ID NO: 4145318 - RNA, 20 nt, Yersinia pestis
agcgcuuggugaugcugcug

SEQ ID NO: 4145319 - RNA, 19 nt, Yersinia pestis
agcgcuuuuucgggaaaaa

SEQ ID NO: 4145320 - RNA, 14 nt, Yersinia pestis
agcggccagcuugc

SEQ ID NO: 4145321 - RNA, 15 nt, Yersinia pestis
agcggcgaccgggga

SEQ ID NO: 4145322 - RNA, 14 nt, Yersinia pestis
agcggcgauuaucg

SEQ ID NO: 4145323 - RNA, 17 nt, Yersinia pestis
agcggcguucagcaaua

SEQ ID NO: 4145324 - RNA, 18 nt, Yersinia pestis
agcggcguuguucucugg

SEQ ID NO: 4145325 - RNA, 14 nt, Yersinia pestis
agcggcuagcagca

SEQ ID NO: 4145326 - RNA, 16 nt, Yersinia pestis
agcgggccagcaacca

SEQ ID NO: 4145327 - RNA, 13 nt, Yersinia pestis
agcgggcggcaau

SEQ ID NO: 4145328 - RNA, 15 nt, Yersinia pestis
agcggguuaccagua

SEQ ID NO: 4145329 - RNA, 14 nt, Yersinia pestis
agcggugacagacc

SEQ ID NO: 4145330 - RNA, 20 nt, Yersinia pestis
agcgguugggcuaaccagug

SEQ ID NO: 4145331 - RNA, 15 nt, Yersinia pestis
agcgguuuauauuuu

SEQ ID NO: 4145332 - RNA, 22 nt, Yersinia pestis
agcgguuuuuucuuucuucagc

SEQ ID NO: 4145333 - RNA, 18 nt, Yersinia pestis
agcguaaagaggccagcu

SEQ ID NO: 4145334 - RNA, 22 nt, Yersinia pestis
agcguaacuccuuuguuauuuc

SEQ ID NO: 4145335 - RNA, 15 nt, Yersinia pestis
agcguaauaccacua

SEQ ID NO: 4145336 - RNA, 16 nt, Yersinia pestis
agcguacaucagggug

SEQ ID NO: 4145337 - RNA, 18 nt, Yersinia pestis
agcguagccguuaaauau

SEQ ID NO: 4145338 - RNA, 20 nt, Yersinia pestis
agcguauucaguaaaaacug

SEQ ID NO: 4145339 - RNA, 18 nt, Yersinia pestis
agcguauuuugucaugaa

SEQ ID NO: 4145340 - RNA, 16 nt, Yersinia pestis
agcgucacggaaagca

SEQ ID NO: 4145341 - RNA, 17 nt, Yersinia pestis
agcguccauguaucccg

SEQ ID NO: 4145342 - RNA, 21 nt, Yersinia pestis
agcgucuucugugauuuguca

SEQ ID NO: 4145343 - RNA, 14 nt, Yersinia pestis
agcgugaaagcauc

SEQ ID NO: 4145344 - RNA, 19 nt, Yersinia pestis
agcgugagaauaauaauca

SEQ ID NO: 4145345 - RNA, 17 nt, Yersinia pestis
agcgugauuuuuauauu

SEQ ID NO: 4145346 - RNA, 19 nt, Yersinia pestis
agcgugauuuuuauauuuu

SEQ ID NO: 4145347 - RNA, 20 nt, Yersinia pestis
agcgugguauaaauggcacu

SEQ ID NO: 4145348 - RNA, 22 nt, Yersinia pestis
agcgugguauaaauggcacugg

SEQ ID NO: 4145349 - RNA, 20 nt, Yersinia pestis
agcguuaauuauagugaaaa

SEQ ID NO: 4145350 - RNA, 23 nt, Yersinia pestis
agcguucaaaucugcucccggca

SEQ ID NO: 4145351 - RNA, 14 nt, Yersinia pestis
agcguuggccacgu

SEQ ID NO: 4145352 - RNA, 20 nt, Yersinia pestis
agcguuuauuggcuuggaca

SEQ ID NO: 4145353 - RNA, 23 nt, Yersinia pestis
agcguuucuacaauggccuuagc

SEQ ID NO: 4145354 - RNA, 16 nt, Yersinia pestis
agcuaaccuuaacugc

SEQ ID NO: 4145355 - RNA, 13 nt, Yersinia pestis
agcuaagcucuuc

SEQ ID NO: 4145356 - RNA, 16 nt, Yersinia pestis
agcuaaugcuauccac

SEQ ID NO: 4145357 - RNA, 17 nt, Yersinia pestis
agcuaaugcucgcucau

SEQ ID NO: 4145358 - RNA, 19 nt, Yersinia pestis
agcuaauguuggcaacuau

SEQ ID NO: 4145359 - RNA, 24 nt, Yersinia pestis
agcuaauuuucauugauacaaaua

SEQ ID NO: 4145360 - RNA, 13 nt, Yersinia pestis
agcuacagcucag

SEQ ID NO: 4145361 - RNA, 17 nt, Yersinia pestis
agcuacgccaagagggc

SEQ ID NO: 4145362 - RNA, 21 nt, Yersinia pestis
agcuacggccuguaccaccac

SEQ ID NO: 4145363 - RNA, 19 nt, Yersinia pestis
agcuagauggaaaucacac

SEQ ID NO: 4145364 - RNA, 13 nt, Yersinia pestis
agcuagccugccc

SEQ ID NO: 4145365 - RNA, 13 nt, Yersinia pestis
agcuaucauuaaa

SEQ ID NO: 4145366 - RNA, 13 nt, Yersinia pestis
agcuaucuugccu

SEQ ID NO: 4145367 - RNA, 12 nt, Yersinia pestis
agcuaugcaguu

SEQ ID NO: 4145368 - RNA, 19 nt, Yersinia pestis
agcuaugcaguuaagguua

SEQ ID NO: 4145369 - RNA, 16 nt, Yersinia pestis
agcuauguucacguaa

SEQ ID NO: 4145370 - RNA, 19 nt, Yersinia pestis
agcuauucucaaacucguu

SEQ ID NO: 4145371 - RNA, 17 nt, Yersinia pestis
agcuauuggcugauuca

SEQ ID NO: 4145372 - RNA, 13 nt, Yersinia pestis
agcucaagcuggu

SEQ ID NO: 4145373 - RNA, 17 nt, Yersinia pestis
agcucaagggcacaguu

SEQ ID NO: 4145374 - RNA, 19 nt, Yersinia pestis
agcucaauacgguaaucug

SEQ ID NO: 4145375 - RNA, 16 nt, Yersinia pestis
agcucacgccaauuca

SEQ ID NO: 4145376 - RNA, 14 nt, Yersinia pestis
agcucauauaauca

SEQ ID NO: 4145377 - RNA, 19 nt, Yersinia pestis
agcucccccacucgcccca

SEQ ID NO: 4145378 - RNA, 20 nt, Yersinia pestis
agcucccccacucgccccac

SEQ ID NO: 4145379 - RNA, 15 nt, Yersinia pestis
agcuccgcagcuaau

SEQ ID NO: 4145380 - RNA, 17 nt, Yersinia pestis
agcucgccaucgcacca

SEQ ID NO: 4145381 - RNA, 17 nt, Yersinia pestis
agcucgcuguggcuacc

SEQ ID NO: 4145382 - RNA, 18 nt, Yersinia pestis
agcucgugccauuuugcg

SEQ ID NO: 4145383 - RNA, 15 nt, Yersinia pestis
agcucuggccagauu

SEQ ID NO: 4145384 - RNA, 22 nt, Yersinia pestis
agcucuucaauuuccaucugca

SEQ ID NO: 4145385 - RNA, 24 nt, Yersinia pestis
agcugaauugcuuauccagccgcu

SEQ ID NO: 4145386 - RNA, 15 nt, Yersinia pestis
agcugacgcacauua

SEQ ID NO: 4145387 - RNA, 13 nt, Yersinia pestis
agcugacgcagca

SEQ ID NO: 4145388 - RNA, 14 nt, Yersinia pestis
agcugauaugaaaa

SEQ ID NO: 4145389 - RNA, 16 nt, Yersinia pestis
agcugauaugaaaaau

SEQ ID NO: 4145390 - RNA, 17 nt, Yersinia pestis
agcugaugauuggcuuc

SEQ ID NO: 4145391 - RNA, 14 nt, Yersinia pestis
agcugcaauugccg

SEQ ID NO: 4145392 - RNA, 15 nt, Yersinia pestis
agcugcaauugccgc

SEQ ID NO: 4145393 - RNA, 19 nt, Yersinia pestis
agcugccaggcaauuucuu

SEQ ID NO: 4145394 - RNA, 21 nt, Yersinia pestis
agcugcuuuaucguagccaau

SEQ ID NO: 4145395 - RNA, 22 nt, Yersinia pestis
agcugcuuuugcugaugcaccg

SEQ ID NO: 4145396 - RNA, 17 nt, Yersinia pestis
agcuggcgcacucaucc

SEQ ID NO: 4145397 - RNA, 16 nt, Yersinia pestis
agcuggcuucuuuuuc

SEQ ID NO: 4145398 - RNA, 18 nt, Yersinia pestis
agcuguaaaggcaaagaa

SEQ ID NO: 4145399 - RNA, 19 nt, Yersinia pestis
agcuguguuagcggcgcuu

SEQ ID NO: 4145400 - RNA, 21 nt, Yersinia pestis
agcuuaacauccgaauuuuua

SEQ ID NO: 4145401 - RNA, 21 nt, Yersinia pestis
agcuuacaccauguucuucaa

SEQ ID NO: 4145402 - RNA, 17 nt, Yersinia pestis
agcuuaccgcggugaag

SEQ ID NO: 4145403 - RNA, 14 nt, Yersinia pestis
agcuuacuguucac

SEQ ID NO: 4145404 - RNA, 19 nt, Yersinia pestis
agcuuaucagcguagauuu

SEQ ID NO: 4145405 - RNA, 12 nt, Yersinia pestis
agcuuauccauu

SEQ ID NO: 4145406 - RNA, 17 nt, Yersinia pestis
agcuuauccauuacagc

SEQ ID NO: 4145407 - RNA, 23 nt, Yersinia pestis
agcuucaagguacugauaaugga

SEQ ID NO: 4145408 - RNA, 17 nt, Yersinia pestis
agcuuccaacugauaaa

SEQ ID NO: 4145409 - RNA, 18 nt, Yersinia pestis
agcuuccaacugauaaac

SEQ ID NO: 4145410 - RNA, 11 nt, Yersinia pestis
agcuucccugg

SEQ ID NO: 4145411 - RNA, 14 nt, Yersinia pestis
agcuucucgcacca

SEQ ID NO: 4145412 - RNA, 17 nt, Yersinia pestis
agcuucuggcugauugc

SEQ ID NO: 4145413 - RNA, 16 nt, Yersinia pestis
agcuucuucaaaagca

SEQ ID NO: 4145414 - RNA, 19 nt, Yersinia pestis
agcuucuucaaaagcaagu

SEQ ID NO: 4145415 - RNA, 24 nt, Yersinia pestis
agcuugacgaccaauaucauaaua

SEQ ID NO: 4145416 - RNA, 20 nt, Yersinia pestis
agcuugauagggcugaagac

SEQ ID NO: 4145417 - RNA, 13 nt, Yersinia pestis
agcuugcaacaaa

SEQ ID NO: 4145418 - RNA, 21 nt, Yersinia pestis
agcuugcaacaaaauggccuu

SEQ ID NO: 4145419 - RNA, 12 nt, Yersinia pestis
agcuugcugcug

SEQ ID NO: 4145420 - RNA, 23 nt, Yersinia pestis
agcuuguugauaucaaucucuug

SEQ ID NO: 4145421 - RNA, 14 nt, Yersinia pestis
agcuuuaagaucca

SEQ ID NO: 4145422 - RNA, 17 nt, Yersinia pestis
agcuuuagcauugcaga

SEQ ID NO: 4145423 - RNA, 22 nt, Yersinia pestis
agcuuuagcauugcagauuucu

SEQ ID NO: 4145424 - RNA, 20 nt, Yersinia pestis
agcuuucuccuuugauuuga

SEQ ID NO: 4145425 - RNA, 18 nt, Yersinia pestis
agcuuugccuaacggcau

SEQ ID NO: 4145426 - RNA, 18 nt, Yersinia pestis
agcuuuuuacgcaacaag

SEQ ID NO: 4145427 - RNA, 17 nt, Yersinia pestis
aggaaaauggaauagug

SEQ ID NO: 4145428 - RNA, 15 nt, Yersinia pestis
aggaaacguauggcu

SEQ ID NO: 4145429 - RNA, 12 nt, Yersinia pestis
aggaaacucaug

SEQ ID NO: 4145430 - RNA, 15 nt, Yersinia pestis
aggaaacuccaguca

SEQ ID NO: 4145431 - RNA, 19 nt, Yersinia pestis
aggaaaggccggauguaaa

SEQ ID NO: 4145432 - RNA, 22 nt, Yersinia pestis
aggaaauacaggcuauauugcu

SEQ ID NO: 4145433 - RNA, 22 nt, Yersinia pestis
aggaacccauuugcacagcauu

SEQ ID NO: 4145434 - RNA, 14 nt, Yersinia pestis
aggaagagaaaagc

SEQ ID NO: 4145435 - RNA, 15 nt, Yersinia pestis
aggaagagaaaagca

SEQ ID NO: 4145436 - RNA, 14 nt, Yersinia pestis
aggaagauaucgcu

SEQ ID NO: 4145437 - RNA, 16 nt, Yersinia pestis
aggaagcaaugaaaua

SEQ ID NO: 4145438 - RNA, 21 nt, Yersinia pestis
aggaaggcgguuaucuggaau

SEQ ID NO: 4145439 - RNA, 20 nt, Yersinia pestis
aggaaguccaguaauaccuu

SEQ ID NO: 4145440 - RNA, 23 nt, Yersinia pestis
aggaauaaacagcaguucaucuu

SEQ ID NO: 4145441 - RNA, 17 nt, Yersinia pestis
aggaaugcgcccuuuuc

SEQ ID NO: 4145442 - RNA, 23 nt, Yersinia pestis
aggaaugcgcccuuuuccgucag

SEQ ID NO: 4145443 - RNA, 17 nt, Yersinia pestis
aggaauggcgugauauc

SEQ ID NO: 4145444 - RNA, 17 nt, Yersinia pestis
aggacaaauagauuuaa

SEQ ID NO: 4145445 - RNA, 21 nt, Yersinia pestis
aggacauccagcgguguuacc

SEQ ID NO: 4145446 - RNA, 15 nt, Yersinia pestis
aggacggaugguaaa

SEQ ID NO: 4145447 - RNA, 22 nt, Yersinia pestis
aggacuauucaaugacuccuga

SEQ ID NO: 4145448 - RNA, 17 nt, Yersinia pestis
aggacuuauggguuuuu

SEQ ID NO: 4145449 - RNA, 19 nt, Yersinia pestis
aggagaaacauuaaaccca

SEQ ID NO: 4145450 - RNA, 21 nt, Yersinia pestis
aggagacagggggauaaaaac

SEQ ID NO: 4145451 - RNA, 20 nt, Yersinia pestis
aggagauagccucaccgcca

SEQ ID NO: 4145452 - RNA, 21 nt, Yersinia pestis
aggagaucgauaaagccgagc

SEQ ID NO: 4145453 - RNA, 19 nt, Yersinia pestis
aggagauuucagacugcug

SEQ ID NO: 4145454 - RNA, 22 nt, Yersinia pestis
aggagcaaaaggccccguaauc

SEQ ID NO: 4145455 - RNA, 15 nt, Yersinia pestis
aggagcccucuguca

SEQ ID NO: 4145456 - RNA, 20 nt, Yersinia pestis
aggagguggugauuguuuua

SEQ ID NO: 4145457 - RNA, 19 nt, Yersinia pestis
aggagugaauuucuucccu

SEQ ID NO: 4145458 - RNA, 16 nt, Yersinia pestis
aggauaaagcugaaua

SEQ ID NO: 4145459 - RNA, 15 nt, Yersinia pestis
aggauaggcagaaua

SEQ ID NO: 4145460 - RNA, 21 nt, Yersinia pestis
aggauaggcagaggaguaaag

SEQ ID NO: 4145461 - RNA, 18 nt, Yersinia pestis
aggauaggcugaagagua

SEQ ID NO: 4145462 - RNA, 15 nt, Yersinia pestis
aggauauuagggcug

SEQ ID NO: 4145463 - RNA, 16 nt, Yersinia pestis
aggauauuuauuugau

SEQ ID NO: 4145464 - RNA, 14 nt, Yersinia pestis
aggauggcccaagc

SEQ ID NO: 4145465 - RNA, 16 nt, Yersinia pestis
aggauggcccaagcca

SEQ ID NO: 4145466 - RNA, 18 nt, Yersinia pestis
aggauggcccaagccauc

SEQ ID NO: 4145467 - RNA, 16 nt, Yersinia pestis
aggauuucauaccgcu

SEQ ID NO: 4145468 - RNA, 21 nt, Yersinia pestis
aggauuuuccgcagcucaccu

SEQ ID NO: 4145469 - RNA, 17 nt, Yersinia pestis
aggcaaaaagagucagu

SEQ ID NO: 4145470 - RNA, 16 nt, Yersinia pestis
aggcaacaacacccga

SEQ ID NO: 4145471 - RNA, 14 nt, Yersinia pestis
aggcaacauuuguu

SEQ ID NO: 4145472 - RNA, 15 nt, Yersinia pestis
aggcaaccaucagga

SEQ ID NO: 4145473 - RNA, 23 nt, Yersinia pestis
aggcaaccuuggugaagaucaau

SEQ ID NO: 4145474 - RNA, 19 nt, Yersinia pestis
aggcaacgaccuuuaucac

SEQ ID NO: 4145475 - RNA, 15 nt, Yersinia pestis
aggcaagcaaccgca

SEQ ID NO: 4145476 - RNA, 20 nt, Yersinia pestis
aggcaauacaccgccaguau

SEQ ID NO: 4145477 - RNA, 15 nt, Yersinia pestis
aggcaauaccaauau

SEQ ID NO: 4145478 - RNA, 13 nt, Yersinia pestis
aggcaccaccaug

SEQ ID NO: 4145479 - RNA, 11 nt, Yersinia pestis
aggcaccagcg

SEQ ID NO: 4145480 - RNA, 16 nt, Yersinia pestis
aggcacgagcggugga

SEQ ID NO: 4145481 - RNA, 16 nt, Yersinia pestis
aggcacgugccgcugg

SEQ ID NO: 4145482 - RNA, 17 nt, Yersinia pestis
aggcacgugccgcuggg

SEQ ID NO: 4145483 - RNA, 15 nt, Yersinia pestis
aggcacugcagaaaa

SEQ ID NO: 4145484 - RNA, 13 nt, Yersinia pestis
aggcagaaauaau

SEQ ID NO: 4145485 - RNA, 14 nt, Yersinia pestis
aggcagaaauaaua

SEQ ID NO: 4145486 - RNA, 14 nt, Yersinia pestis
aggcagaggaagua

SEQ ID NO: 4145487 - RNA, 20 nt, Yersinia pestis
aggcagaggaguaaagcguc

SEQ ID NO: 4145488 - RNA, 23 nt, Yersinia pestis
aggcagauugagugcggacagcg

SEQ ID NO: 4145489 - RNA, 21 nt, Yersinia pestis
aggcagguggguacugauaaa

SEQ ID NO: 4145490 - RNA, 19 nt, Yersinia pestis
aggcauccacaucuugcgc

SEQ ID NO: 4145491 - RNA, 18 nt, Yersinia pestis
aggcaucucacgaugccu

SEQ ID NO: 4145492 - RNA, 13 nt, Yersinia pestis
aggcaucugccac

SEQ ID NO: 4145493 - RNA, 22 nt, Yersinia pestis
aggcaucugccacacugaauuu

SEQ ID NO: 4145494 - RNA, 18 nt, Yersinia pestis
aggcaugauaagcaggaa

SEQ ID NO: 4145495 - RNA, 15 nt, Yersinia pestis
aggcaugguaagaau

SEQ ID NO: 4145496 - RNA, 13 nt, Yersinia pestis
aggcauuaucuga

SEQ ID NO: 4145497 - RNA, 22 nt, Yersinia pestis
aggcauuggcgcucagguggcu

SEQ ID NO: 4145498 - RNA, 13 nt, Yersinia pestis
aggccaacacuca

SEQ ID NO: 4145499 - RNA, 18 nt, Yersinia pestis
aggccaauagcccaaaua

SEQ ID NO: 4145500 - RNA, 11 nt, Yersinia pestis
aggccaaugga

SEQ ID NO: 4145501 - RNA, 16 nt, Yersinia pestis
aggccaccucuuccuc

SEQ ID NO: 4145502 - RNA, 15 nt, Yersinia pestis
aggccacuugggcug

SEQ ID NO: 4145503 - RNA, 14 nt, Yersinia pestis
aggccagcaaugac

SEQ ID NO: 4145504 - RNA, 17 nt, Yersinia pestis
aggccagcgccccauca

SEQ ID NO: 4145505 - RNA, 12 nt, Yersinia pestis
aggccauuggca

SEQ ID NO: 4145506 - RNA, 14 nt, Yersinia pestis
aggcccacugcaac

SEQ ID NO: 4145507 - RNA, 16 nt, Yersinia pestis
aggccccucggggccu

SEQ ID NO: 4145508 - RNA, 20 nt, Yersinia pestis
aggccccuuaaauaugaugu

SEQ ID NO: 4145509 - RNA, 22 nt, Yersinia pestis
aggcccgcuucccuacauaaaa

SEQ ID NO: 4145510 - RNA, 20 nt, Yersinia pestis
aggcccugagauucaaccca

SEQ ID NO: 4145511 - RNA, 12 nt, Yersinia pestis
aggcccuuucac

SEQ ID NO: 4145512 - RNA, 17 nt, Yersinia pestis
aggccgaguaacuccau

SEQ ID NO: 4145513 - RNA, 18 nt, Yersinia pestis
aggccgugggcaauaaca

SEQ ID NO: 4145514 - RNA, 17 nt, Yersinia pestis
aggccguucacccuuug

SEQ ID NO: 4145515 - RNA, 13 nt, Yersinia pestis
aggccuaaacccc

SEQ ID NO: 4145516 - RNA, 22 nt, Yersinia pestis
aggccuuuuucuguaggaaaau

SEQ ID NO: 4145517 - RNA, 17 nt, Yersinia pestis
aggcgaauaugauuaau

SEQ ID NO: 4145518 - RNA, 13 nt, Yersinia pestis
aggcgaccaaugg

SEQ ID NO: 4145519 - RNA, 15 nt, Yersinia pestis
aggcgaguuucccuu

SEQ ID NO: 4145520 - RNA, 22 nt, Yersinia pestis
aggcgaguuucccuuuuccauc

SEQ ID NO: 4145521 - RNA, 15 nt, Yersinia pestis
aggcgaucugggcug

SEQ ID NO: 4145522 - RNA, 17 nt, Yersinia pestis
aggcgaugcaaggaagu

SEQ ID NO: 4145523 - RNA, 17 nt, Yersinia pestis
aggcgcauaugaaaaac

SEQ ID NO: 4145524 - RNA, 19 nt, Yersinia pestis
aggcgcauaugaaaaaccu

SEQ ID NO: 4145525 - RNA, 14 nt, Yersinia pestis
aggcgcaucgcgau

SEQ ID NO: 4145526 - RNA, 13 nt, Yersinia pestis
aggcgcuccccug

SEQ ID NO: 4145527 - RNA, 22 nt, Yersinia pestis
aggcggcaucacuaugggggau

SEQ ID NO: 4145528 - RNA, 20 nt, Yersinia pestis
aggcggguaacugugcagga

SEQ ID NO: 4145529 - RNA, 14 nt, Yersinia pestis
aggcggugaacagu

SEQ ID NO: 4145530 - RNA, 16 nt, Yersinia pestis
aggcggugagggaguc

SEQ ID NO: 4145531 - RNA, 15 nt, Yersinia pestis
aggcgguuaucugga

SEQ ID NO: 4145532 - RNA, 15 nt, Yersinia pestis
aggcgguuuggcuug

SEQ ID NO: 4145533 - RNA, 21 nt, Yersinia pestis
aggcguagguuucagccucug

SEQ ID NO: 4145534 - RNA, 22 nt, Yersinia pestis
aggcgugucauuugcgcaauac

SEQ ID NO: 4145535 - RNA, 18 nt, Yersinia pestis
aggcguuuccccuugcug

SEQ ID NO: 4145536 - RNA, 19 nt, Yersinia pestis
aggcuaaaccggcacaggc

SEQ ID NO: 4145537 - RNA, 23 nt, Yersinia pestis
aggcuaaagacuucagcccaugg

SEQ ID NO: 4145538 - RNA, 17 nt, Yersinia pestis
aggcuaauuuaggugaa

SEQ ID NO: 4145539 - RNA, 12 nt, Yersinia pestis
aggcuaccaagg

SEQ ID NO: 4145540 - RNA, 21 nt, Yersinia pestis
aggcuaccgucauccagcacu

SEQ ID NO: 4145541 - RNA, 16 nt, Yersinia pestis
aggcuauuuuacuugc

SEQ ID NO: 4145542 - RNA, 20 nt, Yersinia pestis
aggcuauuuuacuugccauu

SEQ ID NO: 4145543 - RNA, 21 nt, Yersinia pestis
aggcucaaugcgaaaaaauau

SEQ ID NO: 4145544 - RNA, 17 nt, Yersinia pestis
aggcucagcacaaacau

SEQ ID NO: 4145545 - RNA, 18 nt, Yersinia pestis
aggcucagcacaaacaug

SEQ ID NO: 4145546 - RNA, 17 nt, Yersinia pestis
aggcucagcauggaaga

SEQ ID NO: 4145547 - RNA, 24 nt, Yersinia pestis
aggcucagcgguacuuuuugugau

SEQ ID NO: 4145548 - RNA, 18 nt, Yersinia pestis
aggcucaucaccuuccaa

SEQ ID NO: 4145549 - RNA, 19 nt, Yersinia pestis
aggcucaucaccuuccaaa

SEQ ID NO: 4145550 - RNA, 15 nt, Yersinia pestis
aggcucauuaauccc

SEQ ID NO: 4145551 - RNA, 18 nt, Yersinia pestis
aggcucccagacuuugcu

SEQ ID NO: 4145552 - RNA, 20 nt, Yersinia pestis
aggcucgaaccgcgccaucc

SEQ ID NO: 4145553 - RNA, 20 nt, Yersinia pestis
aggcucgagccgcgccaucc

SEQ ID NO: 4145554 - RNA, 19 nt, Yersinia pestis
aggcucuggcaauggcuag

SEQ ID NO: 4145555 - RNA, 13 nt, Yersinia pestis
aggcucuguuacc

SEQ ID NO: 4145556 - RNA, 16 nt, Yersinia pestis
aggcugagguugauga

SEQ ID NO: 4145557 - RNA, 20 nt, Yersinia pestis
aggcugcgcauuucacccuc

SEQ ID NO: 4145558 - RNA, 21 nt, Yersinia pestis
aggcugcgcauuucacccucu

SEQ ID NO: 4145559 - RNA, 11 nt, Yersinia pestis
aggcuggcagg

SEQ ID NO: 4145560 - RNA, 17 nt, Yersinia pestis
aggcuggccacuuccac

SEQ ID NO: 4145561 - RNA, 13 nt, Yersinia pestis
aggcugucaggaa

SEQ ID NO: 4145562 - RNA, 21 nt, Yersinia pestis
aggcuuauauuuaugcuugau

SEQ ID NO: 4145563 - RNA, 23 nt, Yersinia pestis
aggcuucuuaauucccagccacu

SEQ ID NO: 4145564 - RNA, 19 nt, Yersinia pestis
aggcuuuaaccugcacuuu

SEQ ID NO: 4145565 - RNA, 22 nt, Yersinia pestis
aggcuuuauugagcgaugacaa

SEQ ID NO: 4145566 - RNA, 15 nt, Yersinia pestis
aggcuuugccugccc

SEQ ID NO: 4145567 - RNA, 21 nt, Yersinia pestis
aggcuuuugggucaggguaag

SEQ ID NO: 4145568 - RNA, 23 nt, Yersinia pestis
agggaaagguagaucggggacag

SEQ ID NO: 4145569 - RNA, 17 nt, Yersinia pestis
agggacacaauuagcug

SEQ ID NO: 4145570 - RNA, 18 nt, Yersinia pestis
agggacgcgaaucccccc

SEQ ID NO: 4145571 - RNA, 22 nt, Yersinia pestis
agggagccgcccugcauucugg

SEQ ID NO: 4145572 - RNA, 15 nt, Yersinia pestis
agggaguucaucaaa

SEQ ID NO: 4145573 - RNA, 19 nt, Yersinia pestis
agggauucugucagagcua

SEQ ID NO: 4145574 - RNA, 15 nt, Yersinia pestis
agggcagccaauuac

SEQ ID NO: 4145575 - RNA, 16 nt, Yersinia pestis
agggcagcuaaccccu

SEQ ID NO: 4145576 - RNA, 20 nt, Yersinia pestis
agggccacuucgguggcccu

SEQ ID NO: 4145577 - RNA, 16 nt, Yersinia pestis
agggccuacguucagg

SEQ ID NO: 4145578 - RNA, 23 nt, Yersinia pestis
agggccugcaaacggcucaucac

SEQ ID NO: 4145579 - RNA, 18 nt, Yersinia pestis
agggcgauagacuuucac

SEQ ID NO: 4145580 - RNA, 16 nt, Yersinia pestis
agggcgcauccccauc

SEQ ID NO: 4145581 - RNA, 20 nt, Yersinia pestis
agggcgcauguaaauuaaua

SEQ ID NO: 4145582 - RNA, 13 nt, Yersinia pestis
agggcgcggcugg

SEQ ID NO: 4145583 - RNA, 14 nt, Yersinia pestis
agggcgcggcuggu

SEQ ID NO: 4145584 - RNA, 16 nt, Yersinia pestis
agggcgcggcugguaa

SEQ ID NO: 4145585 - RNA, 17 nt, Yersinia pestis
agggcguuaccgaggcu

SEQ ID NO: 4145586 - RNA, 19 nt, Yersinia pestis
agggcguucugucacaauc

SEQ ID NO: 4145587 - RNA, 21 nt, Yersinia pestis
agggcguuuaccauccagugc

SEQ ID NO: 4145588 - RNA, 20 nt, Yersinia pestis
agggcucgguuucacccucu

SEQ ID NO: 4145589 - RNA, 19 nt, Yersinia pestis
agggcugauccguuaucua

SEQ ID NO: 4145590 - RNA, 15 nt, Yersinia pestis
agggcugucagccac

SEQ ID NO: 4145591 - RNA, 16 nt, Yersinia pestis
agggcuguuauccggg

SEQ ID NO: 4145592 - RNA, 19 nt, Yersinia pestis
aggggagccgaagcgcccc

SEQ ID NO: 4145593 - RNA, 14 nt, Yersinia pestis
aggggauagggggc

SEQ ID NO: 4145594 - RNA, 18 nt, Yersinia pestis
aggggcguuuaaugcccc

SEQ ID NO: 4145595 - RNA, 19 nt, Yersinia pestis
aggggcguuuaaugccccu

SEQ ID NO: 4145596 - RNA, 20 nt, Yersinia pestis
aggggcguuuaaugccccug

SEQ ID NO: 4145597 - RNA, 20 nt, Yersinia pestis
aggggcguuuaaugccccuu

SEQ ID NO: 4145598 - RNA, 14 nt, Yersinia pestis
aggggcucacccgu

SEQ ID NO: 4145599 - RNA, 15 nt, Yersinia pestis
agggggacuacaucc

SEQ ID NO: 4145600 - RNA, 19 nt, Yersinia pestis
agggggcaauugaaaaugg

SEQ ID NO: 4145601 - RNA, 16 nt, Yersinia pestis
aggggggaaagcaaua

SEQ ID NO: 4145602 - RNA, 16 nt, Yersinia pestis
agggguacagcaggga

SEQ ID NO: 4145603 - RNA, 23 nt, Yersinia pestis
aggggugcuguuccaaccaaccu

SEQ ID NO: 4145604 - RNA, 23 nt, Yersinia pestis
agggguugcaggcugucaggaac

SEQ ID NO: 4145605 - RNA, 21 nt, Yersinia pestis
aggguacagucuagugcgcug

SEQ ID NO: 4145606 - RNA, 22 nt, Yersinia pestis
aggguacuguugaugcagauga

SEQ ID NO: 4145607 - RNA, 13 nt, Yersinia pestis
aggguauaugccu

SEQ ID NO: 4145608 - RNA, 12 nt, Yersinia pestis
aggguauaugga

SEQ ID NO: 4145609 - RNA, 14 nt, Yersinia pestis
aggguauugaagau

SEQ ID NO: 4145610 - RNA, 23 nt, Yersinia pestis
aggguauuggcuaacuggcgcug

SEQ ID NO: 4145611 - RNA, 19 nt, Yersinia pestis
agggucaucaacaaaguaa

SEQ ID NO: 4145612 - RNA, 14 nt, Yersinia pestis
aggguccaacaugu

SEQ ID NO: 4145613 - RNA, 16 nt, Yersinia pestis
aggguggagagaaagg

SEQ ID NO: 4145614 - RNA, 19 nt, Yersinia pestis
aggguggucaacugugcca

SEQ ID NO: 4145615 - RNA, 21 nt, Yersinia pestis
aggguugcgggccucuucuuu

SEQ ID NO: 4145616 - RNA, 17 nt, Yersinia pestis
aggguuucuccacagug

SEQ ID NO: 4145617 - RNA, 14 nt, Yersinia pestis
agguaaaaaagaau

SEQ ID NO: 4145618 - RNA, 15 nt, Yersinia pestis
agguaaauagccaaa

SEQ ID NO: 4145619 - RNA, 20 nt, Yersinia pestis
agguaacgggagauuaauac

SEQ ID NO: 4145620 - RNA, 15 nt, Yersinia pestis
agguaagaaagagau

SEQ ID NO: 4145621 - RNA, 19 nt, Yersinia pestis
agguaagccuuucuccaca

SEQ ID NO: 4145622 - RNA, 14 nt, Yersinia pestis
agguaauaccaaug

SEQ ID NO: 4145623 - RNA, 19 nt, Yersinia pestis
agguaauacucauccagau

SEQ ID NO: 4145624 - RNA, 18 nt, Yersinia pestis
agguaaucagacugcuga

SEQ ID NO: 4145625 - RNA, 20 nt, Yersinia pestis
agguaaucagacugcugaca

SEQ ID NO: 4145626 - RNA, 17 nt, Yersinia pestis
agguaaugguaaaaaau

SEQ ID NO: 4145627 - RNA, 12 nt, Yersinia pestis
agguaauuaaac

SEQ ID NO: 4145628 - RNA, 13 nt, Yersinia pestis
agguaauuuauag

SEQ ID NO: 4145629 - RNA, 17 nt, Yersinia pestis
agguacggccagcaaug

SEQ ID NO: 4145630 - RNA, 18 nt, Yersinia pestis
agguaguuacagcaaaua

SEQ ID NO: 4145631 - RNA, 19 nt, Yersinia pestis
agguaucauuuuccugcau

SEQ ID NO: 4145632 - RNA, 18 nt, Yersinia pestis
agguauuacaggccccuu

SEQ ID NO: 4145633 - RNA, 23 nt, Yersinia pestis
agguauuucuccauugcgguuca

SEQ ID NO: 4145634 - RNA, 16 nt, Yersinia pestis
aggucaaucuuauuga

SEQ ID NO: 4145635 - RNA, 15 nt, Yersinia pestis
aggucaggaagagaa

SEQ ID NO: 4145636 - RNA, 20 nt, Yersinia pestis
aggucaucaaggugccauaa

SEQ ID NO: 4145637 - RNA, 16 nt, Yersinia pestis
agguccagauuucgcc

SEQ ID NO: 4145638 - RNA, 18 nt, Yersinia pestis
aggucgggcgcugagcgg

SEQ ID NO: 4145639 - RNA, 17 nt, Yersinia pestis
aggucuuucgcccacaa

SEQ ID NO: 4145640 - RNA, 20 nt, Yersinia pestis
aggucuuucgcccacaacca

SEQ ID NO: 4145641 - RNA, 14 nt, Yersinia pestis
aggugaaaauaaua

SEQ ID NO: 4145642 - RNA, 16 nt, Yersinia pestis
aggugaagaaaagcuu

SEQ ID NO: 4145643 - RNA, 16 nt, Yersinia pestis
aggugacaggcaaaga

SEQ ID NO: 4145644 - RNA, 19 nt, Yersinia pestis
aggugacaggcaaagacua

SEQ ID NO: 4145645 - RNA, 20 nt, Yersinia pestis
aggugauacaucaaaucaga

SEQ ID NO: 4145646 - RNA, 16 nt, Yersinia pestis
aggugaugucagccgu

SEQ ID NO: 4145647 - RNA, 13 nt, Yersinia pestis
aggugauuucaaa

SEQ ID NO: 4145648 - RNA, 23 nt, Yersinia pestis
aggugccacacagaaucaccaac

SEQ ID NO: 4145649 - RNA, 22 nt, Yersinia pestis
aggugccuuuuaacguuagagc

SEQ ID NO: 4145650 - RNA, 20 nt, Yersinia pestis
aggugcuuauuuauuuuuaa

SEQ ID NO: 4145651 - RNA, 19 nt, Yersinia pestis
agguggccauuacgccacc

SEQ ID NO: 4145652 - RNA, 17 nt, Yersinia pestis
agguggguacugauaaa

SEQ ID NO: 4145653 - RNA, 17 nt, Yersinia pestis
agguguacucucccuuu

SEQ ID NO: 4145654 - RNA, 18 nt, Yersinia pestis
aggugugcggauggcugc

SEQ ID NO: 4145655 - RNA, 22 nt, Yersinia pestis
agguguuaacgcgccggaauua

SEQ ID NO: 4145656 - RNA, 22 nt, Yersinia pestis
agguguucuugaaaaaauaaau

SEQ ID NO: 4145657 - RNA, 18 nt, Yersinia pestis
agguuaaaguugauaaag

SEQ ID NO: 4145658 - RNA, 19 nt, Yersinia pestis
agguuaaauucacuuuccc

SEQ ID NO: 4145659 - RNA, 21 nt, Yersinia pestis
agguuaacagccccgucucaa

SEQ ID NO: 4145660 - RNA, 15 nt, Yersinia pestis
agguuaacugcagug

SEQ ID NO: 4145661 - RNA, 16 nt, Yersinia pestis
agguuaacugcaguga

SEQ ID NO: 4145662 - RNA, 14 nt, Yersinia pestis
agguuacugcccug

SEQ ID NO: 4145663 - RNA, 15 nt, Yersinia pestis
agguuagcuaugcag

SEQ ID NO: 4145664 - RNA, 12 nt, Yersinia pestis
agguuaucagcc

SEQ ID NO: 4145665 - RNA, 21 nt, Yersinia pestis
agguuauugacaaagugccug

SEQ ID NO: 4145666 - RNA, 13 nt, Yersinia pestis
agguucaauuccc

SEQ ID NO: 4145667 - RNA, 14 nt, Yersinia pestis
agguucaauucccg

SEQ ID NO: 4145668 - RNA, 18 nt, Yersinia pestis
agguucggcgcaaucaua

SEQ ID NO: 4145669 - RNA, 14 nt, Yersinia pestis
agguugaaauaaau

SEQ ID NO: 4145670 - RNA, 15 nt, Yersinia pestis
agguugaaauaaaua

SEQ ID NO: 4145671 - RNA, 17 nt, Yersinia pestis
agguuguccgaagagaa

SEQ ID NO: 4145672 - RNA, 13 nt, Yersinia pestis
agguuucacccgg

SEQ ID NO: 4145673 - RNA, 15 nt, Yersinia pestis
agguuugcuccaccg

SEQ ID NO: 4145674 - RNA, 16 nt, Yersinia pestis
agguuuggccuaacaa

SEQ ID NO: 4145675 - RNA, 19 nt, Yersinia pestis
agguuuucccuuagggcaa

SEQ ID NO: 4145676 - RNA, 12 nt, Yersinia pestis
agguuuucugcg

SEQ ID NO: 4145677 - RNA, 23 nt, Yersinia pestis
agguuuuucauaugcgccuauaa

SEQ ID NO: 4145678 - RNA, 22 nt, Yersinia pestis
aguaaaaauauuaacugcagug

SEQ ID NO: 4145679 - RNA, 17 nt, Yersinia pestis
aguaaaagucagcaaau

SEQ ID NO: 4145680 - RNA, 14 nt, Yersinia pestis
aguaaacaccuuca

SEQ ID NO: 4145681 - RNA, 22 nt, Yersinia pestis
aguaaaccaauuuuaaugguuu

SEQ ID NO: 4145682 - RNA, 14 nt, Yersinia pestis
aguaaacugcgcuu

SEQ ID NO: 4145683 - RNA, 20 nt, Yersinia pestis
aguaaagcaaauucccacca

SEQ ID NO: 4145684 - RNA, 14 nt, Yersinia pestis
aguaaauagcaaaa

SEQ ID NO: 4145685 - RNA, 18 nt, Yersinia pestis
aguaaauauaauuucaaa

SEQ ID NO: 4145686 - RNA, 19 nt, Yersinia pestis
aguaaaucuacuuuauuca

SEQ ID NO: 4145687 - RNA, 23 nt, Yersinia pestis
aguaaauucgggcuuuaauacaa

SEQ ID NO: 4145688 - RNA, 22 nt, Yersinia pestis
aguaacaaaaugcgguggcacu

SEQ ID NO: 4145689 - RNA, 17 nt, Yersinia pestis
aguaacaccagcauccu

SEQ ID NO: 4145690 - RNA, 20 nt, Yersinia pestis
aguaacaccagcauccugca

SEQ ID NO: 4145691 - RNA, 23 nt, Yersinia pestis
aguaacaccagcauccugcaaau

SEQ ID NO: 4145692 - RNA, 23 nt, Yersinia pestis
aguaacccagccccuaacagcag

SEQ ID NO: 4145693 - RNA, 22 nt, Yersinia pestis
aguaaccccuucgagcaccgcg

SEQ ID NO: 4145694 - RNA, 19 nt, Yersinia pestis
aguaacgccauaaucgcuu

SEQ ID NO: 4145695 - RNA, 23 nt, Yersinia pestis
aguaacuauuuacauaauaacca

SEQ ID NO: 4145696 - RNA, 15 nt, Yersinia pestis
aguaacugaucaaua

SEQ ID NO: 4145697 - RNA, 16 nt, Yersinia pestis
aguaacuguaaggcca

SEQ ID NO: 4145698 - RNA, 18 nt, Yersinia pestis
aguaagcaugaaacacag

SEQ ID NO: 4145699 - RNA, 22 nt, Yersinia pestis
aguaagcaugaaacacagugga

SEQ ID NO: 4145700 - RNA, 21 nt, Yersinia pestis
aguaagcgcggucauauccua

SEQ ID NO: 4145701 - RNA, 12 nt, Yersinia pestis
aguaagguuuua

SEQ ID NO: 4145702 - RNA, 19 nt, Yersinia pestis
aguaauagcaaaaaaaaag

SEQ ID NO: 4145703 - RNA, 17 nt, Yersinia pestis
aguaauauuauucaauu

SEQ ID NO: 4145704 - RNA, 11 nt, Yersinia pestis
aguaaucagag

SEQ ID NO: 4145705 - RNA, 17 nt, Yersinia pestis
aguaaucagaguaacua

SEQ ID NO: 4145706 - RNA, 23 nt, Yersinia pestis
aguaaugaggcuaccugcaccaa

SEQ ID NO: 4145707 - RNA, 16 nt, Yersinia pestis
aguaaugccgcugccg

SEQ ID NO: 4145708 - RNA, 13 nt, Yersinia pestis
aguaauucacccu

SEQ ID NO: 4145709 - RNA, 15 nt, Yersinia pestis
aguacaaaaaacaaa

SEQ ID NO: 4145710 - RNA, 21 nt, Yersinia pestis
aguacaaaaaacaaaccgggg

SEQ ID NO: 4145711 - RNA, 15 nt, Yersinia pestis
aguacagaauuucau

SEQ ID NO: 4145712 - RNA, 18 nt, Yersinia pestis
aguacagcacucaguaca

SEQ ID NO: 4145713 - RNA, 17 nt, Yersinia pestis
aguacagcgcaucggau

SEQ ID NO: 4145714 - RNA, 18 nt, Yersinia pestis
aguacauaaaccgugugc

SEQ ID NO: 4145715 - RNA, 15 nt, Yersinia pestis
aguaccaccaccaca

SEQ ID NO: 4145716 - RNA, 18 nt, Yersinia pestis
aguacggugccagcagca

SEQ ID NO: 4145717 - RNA, 15 nt, Yersinia pestis
aguacuaucuauuau

SEQ ID NO: 4145718 - RNA, 20 nt, Yersinia pestis
aguacuggaucacaaugcaa

SEQ ID NO: 4145719 - RNA, 23 nt, Yersinia pestis
aguacuggaucacaaugcaaaua

SEQ ID NO: 4145720 - RNA, 16 nt, Yersinia pestis
aguacuuaccuuccca

SEQ ID NO: 4145721 - RNA, 16 nt, Yersinia pestis
aguacuuagcaauaau

SEQ ID NO: 4145722 - RNA, 18 nt, Yersinia pestis
aguacuuauuugaaacac

SEQ ID NO: 4145723 - RNA, 14 nt, Yersinia pestis
aguacuucagguaa

SEQ ID NO: 4145724 - RNA, 19 nt, Yersinia pestis
aguagaacuggccuuaugc

SEQ ID NO: 4145725 - RNA, 20 nt, Yersinia pestis
aguagacgacacaaaugcug

SEQ ID NO: 4145726 - RNA, 22 nt, Yersinia pestis
aguagacgacacaaaugcugug

SEQ ID NO: 4145727 - RNA, 11 nt, Yersinia pestis
aguagcccagc

SEQ ID NO: 4145728 - RNA, 23 nt, Yersinia pestis
aguagcccagccggaacauguac

SEQ ID NO: 4145729 - RNA, 18 nt, Yersinia pestis
aguagcuaauaaaauggc

SEQ ID NO: 4145730 - RNA, 23 nt, Yersinia pestis
aguaguaaaaccuagcugcugca

SEQ ID NO: 4145731 - RNA, 19 nt, Yersinia pestis
aguaguggaaaaacugaaa

SEQ ID NO: 4145732 - RNA, 14 nt, Yersinia pestis
aguauaaauaccug

SEQ ID NO: 4145733 - RNA, 17 nt, Yersinia pestis
aguauacggucaaaagc

SEQ ID NO: 4145734 - RNA, 19 nt, Yersinia pestis
aguauacggucaaaagcug

SEQ ID NO: 4145735 - RNA, 17 nt, Yersinia pestis
aguaucagaaacagcag

SEQ ID NO: 4145736 - RNA, 21 nt, Yersinia pestis
aguauccgcgccagacuggcc

SEQ ID NO: 4145737 - RNA, 18 nt, Yersinia pestis
aguaucugggugagaggu

SEQ ID NO: 4145738 - RNA, 19 nt, Yersinia pestis
aguaucugggugagagguu

SEQ ID NO: 4145739 - RNA, 17 nt, Yersinia pestis
aguaugagcgucaguag

SEQ ID NO: 4145740 - RNA, 16 nt, Yersinia pestis
aguaugcgaaacaccu

SEQ ID NO: 4145741 - RNA, 16 nt, Yersinia pestis
aguaugguuaaucuac

SEQ ID NO: 4145742 - RNA, 15 nt, Yersinia pestis
aguauguauccaucu

SEQ ID NO: 4145743 - RNA, 16 nt, Yersinia pestis
aguauguuugauuaag

SEQ ID NO: 4145744 - RNA, 19 nt, Yersinia pestis
aguauguuugauuaagccg

SEQ ID NO: 4145745 - RNA, 13 nt, Yersinia pestis
aguauuccccacu

SEQ ID NO: 4145746 - RNA, 23 nt, Yersinia pestis
aguauucuuaucaaucaaaaaau

SEQ ID NO: 4145747 - RNA, 22 nt, Yersinia pestis
aguauugcugaguaaauuaaau

SEQ ID NO: 4145748 - RNA, 20 nt, Yersinia pestis
aguauuuauuccacagagua

SEQ ID NO: 4145749 - RNA, 13 nt, Yersinia pestis
aguauuuguagug

SEQ ID NO: 4145750 - RNA, 14 nt, Yersinia pestis
aguauuuguaguga

SEQ ID NO: 4145751 - RNA, 14 nt, Yersinia pestis
agucaaaacaauau

SEQ ID NO: 4145752 - RNA, 14 nt, Yersinia pestis
agucaaaaugaaau

SEQ ID NO: 4145753 - RNA, 15 nt, Yersinia pestis
agucaaaaugaaauu

SEQ ID NO: 4145754 - RNA, 20 nt, Yersinia pestis
agucaaucauuuuuuuauua

SEQ ID NO: 4145755 - RNA, 22 nt, Yersinia pestis
agucaaucggaacucagacuuc

SEQ ID NO: 4145756 - RNA, 21 nt, Yersinia pestis
agucaaugagccugcggcacg

SEQ ID NO: 4145757 - RNA, 18 nt, Yersinia pestis
agucaaugcauuguaaaa

SEQ ID NO: 4145758 - RNA, 14 nt, Yersinia pestis
agucaauugagaau

SEQ ID NO: 4145759 - RNA, 19 nt, Yersinia pestis
agucacaucgcgcuuuuua

SEQ ID NO: 4145760 - RNA, 14 nt, Yersinia pestis
agucacauuuuuaa

SEQ ID NO: 4145761 - RNA, 15 nt, Yersinia pestis
agucacauuuuuaau

SEQ ID NO: 4145762 - RNA, 15 nt, Yersinia pestis
agucaccgcuguaaa

SEQ ID NO: 4145763 - RNA, 16 nt, Yersinia pestis
agucacgucuucacca

SEQ ID NO: 4145764 - RNA, 17 nt, Yersinia pestis
agucacgucuucaccaa

SEQ ID NO: 4145765 - RNA, 19 nt, Yersinia pestis
agucacgucuucaccaaug

SEQ ID NO: 4145766 - RNA, 13 nt, Yersinia pestis
agucacuaaacca

SEQ ID NO: 4145767 - RNA, 20 nt, Yersinia pestis
agucacuaaaccauucagcc

SEQ ID NO: 4145768 - RNA, 23 nt, Yersinia pestis
agucacuggggugaaucaaaacc

SEQ ID NO: 4145769 - RNA, 16 nt, Yersinia pestis
agucacuuugggcuga

SEQ ID NO: 4145770 - RNA, 16 nt, Yersinia pestis
agucagauugucagac

SEQ ID NO: 4145771 - RNA, 14 nt, Yersinia pestis
agucagcaaaucaa

SEQ ID NO: 4145772 - RNA, 16 nt, Yersinia pestis
agucagcaaaucaaac

SEQ ID NO: 4145773 - RNA, 17 nt, Yersinia pestis
agucagcuagccugccc

SEQ ID NO: 4145774 - RNA, 15 nt, Yersinia pestis
agucagggagucagg

SEQ ID NO: 4145775 - RNA, 17 nt, Yersinia pestis
agucagggagucaggga

SEQ ID NO: 4145776 - RNA, 13 nt, Yersinia pestis
agucagucagggu

SEQ ID NO: 4145777 - RNA, 12 nt, Yersinia pestis
agucagugcuau

SEQ ID NO: 4145778 - RNA, 15 nt, Yersinia pestis
agucaguucauuaca

SEQ ID NO: 4145779 - RNA, 15 nt, Yersinia pestis
agucauacaaaauga

SEQ ID NO: 4145780 - RNA, 13 nt, Yersinia pestis
agucauauauuuu

SEQ ID NO: 4145781 - RNA, 24 nt, Yersinia pestis
agucauauauuuuucuuucucgau

SEQ ID NO: 4145782 - RNA, 23 nt, Yersinia pestis
agucaucgccuucuggcaaaccg

SEQ ID NO: 4145783 - RNA, 22 nt, Yersinia pestis
agucaugguacaacugcggcgu

SEQ ID NO: 4145784 - RNA, 17 nt, Yersinia pestis
agucauugggguaauuu

SEQ ID NO: 4145785 - RNA, 21 nt, Yersinia pestis
agucauugguguuacagcaag

SEQ ID NO: 4145786 - RNA, 17 nt, Yersinia pestis
aguccaaaaaacugcgg

SEQ ID NO: 4145787 - RNA, 17 nt, Yersinia pestis
aguccaagaagauaacu

SEQ ID NO: 4145788 - RNA, 23 nt, Yersinia pestis
aguccaagacagaacuuaagaua

SEQ ID NO: 4145789 - RNA, 21 nt, Yersinia pestis
aguccacccagcguuucagua

SEQ ID NO: 4145790 - RNA, 22 nt, Yersinia pestis
aguccacccagcguuucaguaa

SEQ ID NO: 4145791 - RNA, 20 nt, Yersinia pestis
aguccagccaccccguggca

SEQ ID NO: 4145792 - RNA, 20 nt, Yersinia pestis
agucccauugacgaauuaaa

SEQ ID NO: 4145793 - RNA, 21 nt, Yersinia pestis
agucccauugacgaauuaaaa

SEQ ID NO: 4145794 - RNA, 17 nt, Yersinia pestis
agucccucccuucgcac

SEQ ID NO: 4145795 - RNA, 19 nt, Yersinia pestis
agucccugugcgcccacgc

SEQ ID NO: 4145796 - RNA, 15 nt, Yersinia pestis
aguccguuaaaaaau

SEQ ID NO: 4145797 - RNA, 22 nt, Yersinia pestis
aguccguuaaaaaauucaucuu

SEQ ID NO: 4145798 - RNA, 18 nt, Yersinia pestis
aguccuccuugagauccu

SEQ ID NO: 4145799 - RNA, 15 nt, Yersinia pestis
aguccuuaaaaaccc

SEQ ID NO: 4145800 - RNA, 16 nt, Yersinia pestis
aguccuuaaaaaccca

SEQ ID NO: 4145801 - RNA, 20 nt, Yersinia pestis
agucgaucacggaaaucugc

SEQ ID NO: 4145802 - RNA, 17 nt, Yersinia pestis
agucgcauguaggcagc

SEQ ID NO: 4145803 - RNA, 12 nt, Yersinia pestis
agucgccuuaaa

SEQ ID NO: 4145804 - RNA, 19 nt, Yersinia pestis
agucgcgaaauaagaauaa

SEQ ID NO: 4145805 - RNA, 23 nt, Yersinia pestis
agucgcgauaaaauucagccacu

SEQ ID NO: 4145806 - RNA, 20 nt, Yersinia pestis
agucgcgaugcgcugcucuu

SEQ ID NO: 4145807 - RNA, 20 nt, Yersinia pestis
agucgcuucauccgcgcuga

SEQ ID NO: 4145808 - RNA, 19 nt, Yersinia pestis
agucgucgaauccaugaug

SEQ ID NO: 4145809 - RNA, 22 nt, Yersinia pestis
agucuaaacgccgcgucaauaa

SEQ ID NO: 4145810 - RNA, 17 nt, Yersinia pestis
agucuacgcucuacauu

SEQ ID NO: 4145811 - RNA, 20 nt, Yersinia pestis
agucuacgcucuacauuugg

SEQ ID NO: 4145812 - RNA, 14 nt, Yersinia pestis
agucucacaaaaua

SEQ ID NO: 4145813 - RNA, 15 nt, Yersinia pestis
agucucacaaaauaa

SEQ ID NO: 4145814 - RNA, 15 nt, Yersinia pestis
agucucaucaaggaa

SEQ ID NO: 4145815 - RNA, 14 nt, Yersinia pestis
agucugaaaugauc

SEQ ID NO: 4145816 - RNA, 16 nt, Yersinia pestis
agucugaaaugaucac

SEQ ID NO: 4145817 - RNA, 15 nt, Yersinia pestis
agucugaagccuacg

SEQ ID NO: 4145818 - RNA, 17 nt, Yersinia pestis
agucugagccucaugaa

SEQ ID NO: 4145819 - RNA, 18 nt, Yersinia pestis
agucugagccucaugaau

SEQ ID NO: 4145820 - RNA, 23 nt, Yersinia pestis
agucugagccucaugaaugaggc

SEQ ID NO: 4145821 - RNA, 17 nt, Yersinia pestis
agucugagguggccauu

SEQ ID NO: 4145822 - RNA, 20 nt, Yersinia pestis
agucugagguggccauuacg

SEQ ID NO: 4145823 - RNA, 19 nt, Yersinia pestis
agucugucguacuuuccuu

SEQ ID NO: 4145824 - RNA, 20 nt, Yersinia pestis
agucugucguacuuuccuuc

SEQ ID NO: 4145825 - RNA, 23 nt, Yersinia pestis
agucugucguacuuuccuuccuc

SEQ ID NO: 4145826 - RNA, 20 nt, Yersinia pestis
agucuguuaugcccaacugc

SEQ ID NO: 4145827 - RNA, 13 nt, Yersinia pestis
agucuguuucauu

SEQ ID NO: 4145828 - RNA, 18 nt, Yersinia pestis
agucuguuucauucuggu

SEQ ID NO: 4145829 - RNA, 21 nt, Yersinia pestis
agucuguuugucacggcggcc

SEQ ID NO: 4145830 - RNA, 14 nt, Yersinia pestis
agucuuagacguca

SEQ ID NO: 4145831 - RNA, 16 nt, Yersinia pestis
agucuuaugaugcugg

SEQ ID NO: 4145832 - RNA, 21 nt, Yersinia pestis
agucuucaucauccauaaaga

SEQ ID NO: 4145833 - RNA, 19 nt, Yersinia pestis
agucuuuuuaauaugugac

SEQ ID NO: 4145834 - RNA, 13 nt, Yersinia pestis
agugaaaaaugag

SEQ ID NO: 4145835 - RNA, 20 nt, Yersinia pestis
agugaaaacguuaacugcag

SEQ ID NO: 4145836 - RNA, 18 nt, Yersinia pestis
agugaaaagguuaacugc

SEQ ID NO: 4145837 - RNA, 19 nt, Yersinia pestis
agugaaaaugguuuccagc

SEQ ID NO: 4145838 - RNA, 21 nt, Yersinia pestis
agugaaacccgcgcagccuaa

SEQ ID NO: 4145839 - RNA, 13 nt, Yersinia pestis
agugaaagggaag

SEQ ID NO: 4145840 - RNA, 18 nt, Yersinia pestis
agugaaaucaucacaccu

SEQ ID NO: 4145841 - RNA, 14 nt, Yersinia pestis
agugaacaugauga

SEQ ID NO: 4145842 - RNA, 15 nt, Yersinia pestis
agugaaccaucaagg

SEQ ID NO: 4145843 - RNA, 16 nt, Yersinia pestis
agugaacccacgacua

SEQ ID NO: 4145844 - RNA, 17 nt, Yersinia pestis
agugaacguagccucaa

SEQ ID NO: 4145845 - RNA, 15 nt, Yersinia pestis
agugaagauuuuuga

SEQ ID NO: 4145846 - RNA, 15 nt, Yersinia pestis
agugaaguaucacca

SEQ ID NO: 4145847 - RNA, 15 nt, Yersinia pestis
agugaauaacgcuga

SEQ ID NO: 4145848 - RNA, 11 nt, Yersinia pestis
agugaaucagc

SEQ ID NO: 4145849 - RNA, 13 nt, Yersinia pestis
agugaaucagcca

SEQ ID NO: 4145850 - RNA, 16 nt, Yersinia pestis
agugaaucaucaauac

SEQ ID NO: 4145851 - RNA, 18 nt, Yersinia pestis
agugaaugacaguauuug

SEQ ID NO: 4145852 - RNA, 16 nt, Yersinia pestis
agugaaugcugcgugu

SEQ ID NO: 4145853 - RNA, 19 nt, Yersinia pestis
agugacccaagaugaccac

SEQ ID NO: 4145854 - RNA, 23 nt, Yersinia pestis
agugacguaaaaaggcagugaca

SEQ ID NO: 4145855 - RNA, 15 nt, Yersinia pestis
agugacguugauucu

SEQ ID NO: 4145856 - RNA, 18 nt, Yersinia pestis
agugacucaucaaaacaa

SEQ ID NO: 4145857 - RNA, 13 nt, Yersinia pestis
agugacucugccc

SEQ ID NO: 4145858 - RNA, 14 nt, Yersinia pestis
agugacugggguga

SEQ ID NO: 4145859 - RNA, 16 nt, Yersinia pestis
agugagacaauuaaca

SEQ ID NO: 4145860 - RNA, 17 nt, Yersinia pestis
agugagcgcggguaaug

SEQ ID NO: 4145861 - RNA, 17 nt, Yersinia pestis
agugagcgcgggucaug

SEQ ID NO: 4145862 - RNA, 15 nt, Yersinia pestis
agugauaacaacccu

SEQ ID NO: 4145863 - RNA, 15 nt, Yersinia pestis
agugauagcgggccu

SEQ ID NO: 4145864 - RNA, 16 nt, Yersinia pestis
agugaugagaaugccu

SEQ ID NO: 4145865 - RNA, 16 nt, Yersinia pestis
agugaugcaguaaaua

SEQ ID NO: 4145866 - RNA, 18 nt, Yersinia pestis
agugauucgagugcguga

SEQ ID NO: 4145867 - RNA, 22 nt, Yersinia pestis
agugauucgggugagugagcgc

SEQ ID NO: 4145868 - RNA, 13 nt, Yersinia pestis
agugauuucagug

SEQ ID NO: 4145869 - RNA, 16 nt, Yersinia pestis
agugcaacauuaaaaa

SEQ ID NO: 4145870 - RNA, 21 nt, Yersinia pestis
agugcaacauuaaaaauacaa

SEQ ID NO: 4145871 - RNA, 17 nt, Yersinia pestis
agugcaauaaauucaaa

SEQ ID NO: 4145872 - RNA, 17 nt, Yersinia pestis
agugcaaucacggcagg

SEQ ID NO: 4145873 - RNA, 22 nt, Yersinia pestis
agugcacagauaggagaagguu

SEQ ID NO: 4145874 - RNA, 17 nt, Yersinia pestis
agugcacagucacucaa

SEQ ID NO: 4145875 - RNA, 16 nt, Yersinia pestis
agugcacggcagugau

SEQ ID NO: 4145876 - RNA, 12 nt, Yersinia pestis
agugcacugaac

SEQ ID NO: 4145877 - RNA, 17 nt, Yersinia pestis
agugccaaaauaucuuc

SEQ ID NO: 4145878 - RNA, 15 nt, Yersinia pestis
agugccaauccccac

SEQ ID NO: 4145879 - RNA, 21 nt, Yersinia pestis
agugcccgcgacggagagaac

SEQ ID NO: 4145880 - RNA, 21 nt, Yersinia pestis
agugccgucaauuaucaaaaa

SEQ ID NO: 4145881 - RNA, 16 nt, Yersinia pestis
agugcuacagcagcag

SEQ ID NO: 4145882 - RNA, 20 nt, Yersinia pestis
agugcucaccuaggcuuuca

SEQ ID NO: 4145883 - RNA, 19 nt, Yersinia pestis
agugcugaacguaaaacaa

SEQ ID NO: 4145884 - RNA, 15 nt, Yersinia pestis
agugcuucaaauccu

SEQ ID NO: 4145885 - RNA, 14 nt, Yersinia pestis
aguggacacgccgu

SEQ ID NO: 4145886 - RNA, 16 nt, Yersinia pestis
aguggacacgccguuu

SEQ ID NO: 4145887 - RNA, 13 nt, Yersinia pestis
aguggaucugggg

SEQ ID NO: 4145888 - RNA, 17 nt, Yersinia pestis
aguggcauaaccaauca

SEQ ID NO: 4145889 - RNA, 16 nt, Yersinia pestis
aguggcgguaucacuu

SEQ ID NO: 4145890 - RNA, 14 nt, Yersinia pestis
aguggcuaucugaa

SEQ ID NO: 4145891 - RNA, 14 nt, Yersinia pestis
agugggauaucugc

SEQ ID NO: 4145892 - RNA, 22 nt, Yersinia pestis
aguggucggccauuuacccguc

SEQ ID NO: 4145893 - RNA, 22 nt, Yersinia pestis
aguguaaaaaccaucugaugca

SEQ ID NO: 4145894 - RNA, 21 nt, Yersinia pestis
aguguaaaaagcagugcugaa

SEQ ID NO: 4145895 - RNA, 14 nt, Yersinia pestis
aguguaaaaagcga

SEQ ID NO: 4145896 - RNA, 19 nt, Yersinia pestis
aguguacuguuaacucaug

SEQ ID NO: 4145897 - RNA, 18 nt, Yersinia pestis
aguguaucaauaggauuu

SEQ ID NO: 4145898 - RNA, 20 nt, Yersinia pestis
aguguaucaauaggauuuuc

SEQ ID NO: 4145899 - RNA, 23 nt, Yersinia pestis
aguguaugaguaucaauauugug

SEQ ID NO: 4145900 - RNA, 20 nt, Yersinia pestis
aguguauucgcaucuuccaa

SEQ ID NO: 4145901 - RNA, 18 nt, Yersinia pestis
agugucagggcaauaaca

SEQ ID NO: 4145902 - RNA, 18 nt, Yersinia pestis
agugucuggcaauccagc

SEQ ID NO: 4145903 - RNA, 14 nt, Yersinia pestis
agugugcaaauaaa

SEQ ID NO: 4145904 - RNA, 15 nt, Yersinia pestis
agugugcaaauaaac

SEQ ID NO: 4145905 - RNA, 17 nt, Yersinia pestis
agugugcaggauagaga

SEQ ID NO: 4145906 - RNA, 16 nt, Yersinia pestis
agugugcgcaucagcc

SEQ ID NO: 4145907 - RNA, 20 nt, Yersinia pestis
agugugugugcgcugaguga

SEQ ID NO: 4145908 - RNA, 15 nt, Yersinia pestis
aguguucauaaauua

SEQ ID NO: 4145909 - RNA, 22 nt, Yersinia pestis
aguguucauaaauuaaaacuga

SEQ ID NO: 4145910 - RNA, 22 nt, Yersinia pestis
aguguucggggguugucagcag

SEQ ID NO: 4145911 - RNA, 18 nt, Yersinia pestis
aguguuucucagcgugaa

SEQ ID NO: 4145912 - RNA, 14 nt, Yersinia pestis
aguguuuucuccac

SEQ ID NO: 4145913 - RNA, 22 nt, Yersinia pestis
aguuaaagguaaaaggcccgcu

SEQ ID NO: 4145914 - RNA, 17 nt, Yersinia pestis
aguuaaaucccugugcu

SEQ ID NO: 4145915 - RNA, 19 nt, Yersinia pestis
aguuaaaucccugugcuga

SEQ ID NO: 4145916 - RNA, 13 nt, Yersinia pestis
aguuaaaugaagg

SEQ ID NO: 4145917 - RNA, 14 nt, Yersinia pestis
aguuaaaugaagga

SEQ ID NO: 4145918 - RNA, 12 nt, Yersinia pestis
aguuaacaccau

SEQ ID NO: 4145919 - RNA, 20 nt, Yersinia pestis
aguuaacgaguguacagcgu

SEQ ID NO: 4145920 - RNA, 20 nt, Yersinia pestis
aguuaagacaauuauagcca

SEQ ID NO: 4145921 - RNA, 18 nt, Yersinia pestis
aguuaagguuagcuaugc

SEQ ID NO: 4145922 - RNA, 15 nt, Yersinia pestis
aguuaaguagucagc

SEQ ID NO: 4145923 - RNA, 16 nt, Yersinia pestis
aguuaaguagucagca

SEQ ID NO: 4145924 - RNA, 22 nt, Yersinia pestis
aguuaaguagucagcaacgcga

SEQ ID NO: 4145925 - RNA, 12 nt, Yersinia pestis
aguuaaucaagc

SEQ ID NO: 4145926 - RNA, 15 nt, Yersinia pestis
aguuaaucgcagcag

SEQ ID NO: 4145927 - RNA, 23 nt, Yersinia pestis
aguuaauguguuuuugucauuua

SEQ ID NO: 4145928 - RNA, 12 nt, Yersinia pestis
aguuaauguuua

SEQ ID NO: 4145929 - RNA, 19 nt, Yersinia pestis
aguuaauguuuauauugau

SEQ ID NO: 4145930 - RNA, 14 nt, Yersinia pestis
aguuaauuuucacc

SEQ ID NO: 4145931 - RNA, 15 nt, Yersinia pestis
aguuacacagaauua

SEQ ID NO: 4145932 - RNA, 16 nt, Yersinia pestis
aguuacacagaauuau

SEQ ID NO: 4145933 - RNA, 14 nt, Yersinia pestis
aguuacagcaaaua

SEQ ID NO: 4145934 - RNA, 18 nt, Yersinia pestis
aguuacgucagaaauaaa

SEQ ID NO: 4145935 - RNA, 21 nt, Yersinia pestis
aguuacgucaggaauaaagua

SEQ ID NO: 4145936 - RNA, 14 nt, Yersinia pestis
aguuacucagcauc

SEQ ID NO: 4145937 - RNA, 16 nt, Yersinia pestis
aguuagcaggcagcac

SEQ ID NO: 4145938 - RNA, 12 nt, Yersinia pestis
aguuagcgugag

SEQ ID NO: 4145939 - RNA, 19 nt, Yersinia pestis
aguuagcgugagaauaaua

SEQ ID NO: 4145940 - RNA, 16 nt, Yersinia pestis
aguuaggguucaguaa

SEQ ID NO: 4145941 - RNA, 16 nt, Yersinia pestis
aguuaguggcuuuaag

SEQ ID NO: 4145942 - RNA, 23 nt, Yersinia pestis
aguuagugguguuauccacuugc

SEQ ID NO: 4145943 - RNA, 18 nt, Yersinia pestis
aguuauacccauacaaau

SEQ ID NO: 4145944 - RNA, 13 nt, Yersinia pestis
aguuaucaaucag

SEQ ID NO: 4145945 - RNA, 17 nt, Yersinia pestis
aguuauccucgcucaca

SEQ ID NO: 4145946 - RNA, 19 nt, Yersinia pestis
aguuaucuguuucaaauaa

SEQ ID NO: 4145947 - RNA, 15 nt, Yersinia pestis
aguucaagcagguuc

SEQ ID NO: 4145948 - RNA, 21 nt, Yersinia pestis
aguucacaccguauagcaucg

SEQ ID NO: 4145949 - RNA, 15 nt, Yersinia pestis
aguucacaugaugaa

SEQ ID NO: 4145950 - RNA, 21 nt, Yersinia pestis
aguucaccagcuugggugaag

SEQ ID NO: 4145951 - RNA, 18 nt, Yersinia pestis
aguucacccaacaaugaa

SEQ ID NO: 4145952 - RNA, 23 nt, Yersinia pestis
aguucacgauggaaaaaauacag

SEQ ID NO: 4145953 - RNA, 22 nt, Yersinia pestis
aguucacucuguuuuaaaaaaa

SEQ ID NO: 4145954 - RNA, 14 nt, Yersinia pestis
aguucagaucgcau

SEQ ID NO: 4145955 - RNA, 14 nt, Yersinia pestis
aguucagcauccca

SEQ ID NO: 4145956 - RNA, 18 nt, Yersinia pestis
aguucagcaucccagcca

SEQ ID NO: 4145957 - RNA, 19 nt, Yersinia pestis
aguucagcccccucaauac

SEQ ID NO: 4145958 - RNA, 11 nt, Yersinia pestis
aguucaucaaa

SEQ ID NO: 4145959 - RNA, 14 nt, Yersinia pestis
aguucauggccaug

SEQ ID NO: 4145960 - RNA, 16 nt, Yersinia pestis
aguucauggccaugaa

SEQ ID NO: 4145961 - RNA, 20 nt, Yersinia pestis
aguucauuuugaccagcaua

SEQ ID NO: 4145962 - RNA, 13 nt, Yersinia pestis
aguuccagcccca

SEQ ID NO: 4145963 - RNA, 20 nt, Yersinia pestis
aguuccagccccaaacacuu

SEQ ID NO: 4145964 - RNA, 21 nt, Yersinia pestis
aguuccagccccaaacacuua

SEQ ID NO: 4145965 - RNA, 16 nt, Yersinia pestis
aguucgacaccuucaa

SEQ ID NO: 4145966 - RNA, 21 nt, Yersinia pestis
aguucgacaccuucaaucauu

SEQ ID NO: 4145967 - RNA, 19 nt, Yersinia pestis
aguucgauauuauucucua

SEQ ID NO: 4145968 - RNA, 16 nt, Yersinia pestis
aguucggucuauaaaa

SEQ ID NO: 4145969 - RNA, 19 nt, Yersinia pestis
aguucggucuauaaaaccg

SEQ ID NO: 4145970 - RNA, 23 nt, Yersinia pestis
aguucugcgguaauauccacauu

SEQ ID NO: 4145971 - RNA, 22 nt, Yersinia pestis
aguucuggaucggcauacucca

SEQ ID NO: 4145972 - RNA, 22 nt, Yersinia pestis
aguucugguagcugcucacgau

SEQ ID NO: 4145973 - RNA, 14 nt, Yersinia pestis
aguucuuuauccac

SEQ ID NO: 4145974 - RNA, 14 nt, Yersinia pestis
aguugaaccaauga

SEQ ID NO: 4145975 - RNA, 23 nt, Yersinia pestis
aguugaacucgccuucagguaau

SEQ ID NO: 4145976 - RNA, 13 nt, Yersinia pestis
aguugacuuuuuu

SEQ ID NO: 4145977 - RNA, 19 nt, Yersinia pestis
aguugacuuuuuuuaacca

SEQ ID NO: 4145978 - RNA, 16 nt, Yersinia pestis
aguugaguauuucuuu

SEQ ID NO: 4145979 - RNA, 14 nt, Yersinia pestis
aguugauaaagcug

SEQ ID NO: 4145980 - RNA, 14 nt, Yersinia pestis
aguugaucacccgc

SEQ ID NO: 4145981 - RNA, 15 nt, Yersinia pestis
aguugcaguucauca

SEQ ID NO: 4145982 - RNA, 17 nt, Yersinia pestis
aguugcaguucaucaau

SEQ ID NO: 4145983 - RNA, 17 nt, Yersinia pestis
aguugcccuaaacagca

SEQ ID NO: 4145984 - RNA, 21 nt, Yersinia pestis
aguugccguuugaugcgcuga

SEQ ID NO: 4145985 - RNA, 23 nt, Yersinia pestis
aguugcugagauaucaaaugaac

SEQ ID NO: 4145986 - RNA, 22 nt, Yersinia pestis
aguugcuuaaguugaauaagau

SEQ ID NO: 4145987 - RNA, 16 nt, Yersinia pestis
aguuggaaaugacaaa

SEQ ID NO: 4145988 - RNA, 16 nt, Yersinia pestis
aguuggcauucuaguu

SEQ ID NO: 4145989 - RNA, 22 nt, Yersinia pestis
aguugggaaucgguuucagcuu

SEQ ID NO: 4145990 - RNA, 17 nt, Yersinia pestis
aguugguaaaauauuuu

SEQ ID NO: 4145991 - RNA, 17 nt, Yersinia pestis
aguuggugcuuuggaac

SEQ ID NO: 4145992 - RNA, 18 nt, Yersinia pestis
aguuguaaugaauucaga

SEQ ID NO: 4145993 - RNA, 20 nt, Yersinia pestis
aguuguauuaccgauaaagg

SEQ ID NO: 4145994 - RNA, 17 nt, Yersinia pestis
aguugucuauuuucauu

SEQ ID NO: 4145995 - RNA, 18 nt, Yersinia pestis
aguugucuauuuucauua

SEQ ID NO: 4145996 - RNA, 19 nt, Yersinia pestis
aguugucuauuuucauuau

SEQ ID NO: 4145997 - RNA, 20 nt, Yersinia pestis
aguugucuauuuucauuauu

SEQ ID NO: 4145998 - RNA, 14 nt, Yersinia pestis
aguuuaagucugcc

SEQ ID NO: 4145999 - RNA, 21 nt, Yersinia pestis
aguuuaaugccguuuugcaga

SEQ ID NO: 4146000 - RNA, 13 nt, Yersinia pestis
aguuuauaugcuu

SEQ ID NO: 4146001 - RNA, 21 nt, Yersinia pestis
aguuuauggaaauuauuuaga

SEQ ID NO: 4146002 - RNA, 19 nt, Yersinia pestis
aguuuauuuucccuuucuc

SEQ ID NO: 4146003 - RNA, 18 nt, Yersinia pestis
aguuucaauaugcucugc

SEQ ID NO: 4146004 - RNA, 16 nt, Yersinia pestis
aguuucacccucugcg

SEQ ID NO: 4146005 - RNA, 16 nt, Yersinia pestis
aguuucacuuucaacu

SEQ ID NO: 4146006 - RNA, 15 nt, Yersinia pestis
aguuucagguuguua

SEQ ID NO: 4146007 - RNA, 15 nt, Yersinia pestis
aguuucccuuuucca

SEQ ID NO: 4146008 - RNA, 15 nt, Yersinia pestis
aguuugacgcuguau

SEQ ID NO: 4146009 - RNA, 17 nt, Yersinia pestis
aguuugaucgcuaaucg

SEQ ID NO: 4146010 - RNA, 17 nt, Yersinia pestis
aguuugauguagcagau

SEQ ID NO: 4146011 - RNA, 20 nt, Yersinia pestis
aguuugguaauacugagacc

SEQ ID NO: 4146012 - RNA, 20 nt, Yersinia pestis
aguuuggugaucaguucauu

SEQ ID NO: 4146013 - RNA, 18 nt, Yersinia pestis
aguuuuaaacgucagauu

SEQ ID NO: 4146014 - RNA, 21 nt, Yersinia pestis
aguuuuaaacgucagauuagu

SEQ ID NO: 4146015 - RNA, 18 nt, Yersinia pestis
aguuuuagcccaaaauag

SEQ ID NO: 4146016 - RNA, 21 nt, Yersinia pestis
aguuuuauacccguuauaccu

SEQ ID NO: 4146017 - RNA, 19 nt, Yersinia pestis
aguuuuauuguauaaaaca

SEQ ID NO: 4146018 - RNA, 20 nt, Yersinia pestis
aguuuuuccguaaccuccac

SEQ ID NO: 4146019 - RNA, 21 nt, Yersinia pestis
auaaaaaagcccggucacuca

SEQ ID NO: 4146020 - RNA, 11 nt, Yersinia pestis
auaaaaacccc

SEQ ID NO: 4146021 - RNA, 22 nt, Yersinia pestis
auaaaaaccccugucuuauuuu

SEQ ID NO: 4146022 - RNA, 12 nt, Yersinia pestis
auaaaaacuauc

SEQ ID NO: 4146023 - RNA, 15 nt, Yersinia pestis
auaaaaacuucagag

SEQ ID NO: 4146024 - RNA, 11 nt, Yersinia pestis
auaaaaaguca

SEQ ID NO: 4146025 - RNA, 17 nt, Yersinia pestis
auaaaaauaaucaauga

SEQ ID NO: 4146026 - RNA, 22 nt, Yersinia pestis
auaaaaauauccagcaacgaau

SEQ ID NO: 4146027 - RNA, 19 nt, Yersinia pestis
auaaaaaucccggcauauu

SEQ ID NO: 4146028 - RNA, 22 nt, Yersinia pestis
auaaaaaugcacugaacaaugc

SEQ ID NO: 4146029 - RNA, 15 nt, Yersinia pestis
auaaaacagaacccc

SEQ ID NO: 4146030 - RNA, 20 nt, Yersinia pestis
auaaaacagcuugauagggc

SEQ ID NO: 4146031 - RNA, 21 nt, Yersinia pestis
auaaaacagcuugauagggcu

SEQ ID NO: 4146032 - RNA, 15 nt, Yersinia pestis
auaaaaccacugacc

SEQ ID NO: 4146033 - RNA, 19 nt, Yersinia pestis
auaaaaccacugaccuauu

SEQ ID NO: 4146034 - RNA, 12 nt, Yersinia pestis
auaaaaccaucu

SEQ ID NO: 4146035 - RNA, 18 nt, Yersinia pestis
auaaaaccgcuuaucccu

SEQ ID NO: 4146036 - RNA, 18 nt, Yersinia pestis
auaaaaccuuuacaauua

SEQ ID NO: 4146037 - RNA, 23 nt, Yersinia pestis
auaaaaccuuuacaauuacacac

SEQ ID NO: 4146038 - RNA, 22 nt, Yersinia pestis
auaaaaccuuuauguaacacau

SEQ ID NO: 4146039 - RNA, 21 nt, Yersinia pestis
auaaaacuauucugcuuggac

SEQ ID NO: 4146040 - RNA, 14 nt, Yersinia pestis
auaaaacuggcgau

SEQ ID NO: 4146041 - RNA, 21 nt, Yersinia pestis
auaaaagcacagacaaacaac

SEQ ID NO: 4146042 - RNA, 16 nt, Yersinia pestis
auaaaaggauggccca

SEQ ID NO: 4146043 - RNA, 23 nt, Yersinia pestis
auaaaaggauggcccaagccauc

SEQ ID NO: 4146044 - RNA, 17 nt, Yersinia pestis
auaaaaggcuauuuaaa

SEQ ID NO: 4146045 - RNA, 13 nt, Yersinia pestis
auaaaaguaauuu

SEQ ID NO: 4146046 - RNA, 11 nt, Yersinia pestis
auaaaauagcc

SEQ ID NO: 4146047 - RNA, 22 nt, Yersinia pestis
auaaaauagcccagugcggaag

SEQ ID NO: 4146048 - RNA, 21 nt, Yersinia pestis
auaaaauagggcugucagcca

SEQ ID NO: 4146049 - RNA, 13 nt, Yersinia pestis
auaaaaucaaaac

SEQ ID NO: 4146050 - RNA, 16 nt, Yersinia pestis
auaaaaucgaacccuu

SEQ ID NO: 4146051 - RNA, 12 nt, Yersinia pestis
auaaaaucuuaa

SEQ ID NO: 4146052 - RNA, 13 nt, Yersinia pestis
auaaaaucuuaau

SEQ ID NO: 4146053 - RNA, 12 nt, Yersinia pestis
auaaaauuaacg

SEQ ID NO: 4146054 - RNA, 20 nt, Yersinia pestis
auaaaauuaacggaaaagag

SEQ ID NO: 4146055 - RNA, 20 nt, Yersinia pestis
auaaaauucguuugggcuaa

SEQ ID NO: 4146056 - RNA, 16 nt, Yersinia pestis
auaaacaauaaacaga

SEQ ID NO: 4146057 - RNA, 20 nt, Yersinia pestis
auaaacaccgugcuggguaa

SEQ ID NO: 4146058 - RNA, 19 nt, Yersinia pestis
auaaacagcuuaucagcgu

SEQ ID NO: 4146059 - RNA, 20 nt, Yersinia pestis
auaaacaucaugacaaaaau

SEQ ID NO: 4146060 - RNA, 21 nt, Yersinia pestis
auaaaccaacugaaacuggag

SEQ ID NO: 4146061 - RNA, 22 nt, Yersinia pestis
auaaaccaauaucugccaauuc

SEQ ID NO: 4146062 - RNA, 14 nt, Yersinia pestis
auaaaccagccagu

SEQ ID NO: 4146063 - RNA, 15 nt, Yersinia pestis
auaaacccuacagca

SEQ ID NO: 4146064 - RNA, 17 nt, Yersinia pestis
auaaaccgcuauaucau

SEQ ID NO: 4146065 - RNA, 13 nt, Yersinia pestis
auaaaccugauuu

SEQ ID NO: 4146066 - RNA, 22 nt, Yersinia pestis
auaaacgucuuaugccauaaca

SEQ ID NO: 4146067 - RNA, 16 nt, Yersinia pestis
auaaacugaaguuaaa

SEQ ID NO: 4146068 - RNA, 21 nt, Yersinia pestis
auaaacugugcccuugagcua

SEQ ID NO: 4146069 - RNA, 19 nt, Yersinia pestis
auaaacuuaucgguuuuuu

SEQ ID NO: 4146070 - RNA, 14 nt, Yersinia pestis
auaaacuucacaau

SEQ ID NO: 4146071 - RNA, 17 nt, Yersinia pestis
auaaagaauaaugggua

SEQ ID NO: 4146072 - RNA, 15 nt, Yersinia pestis
auaaagagugaaaua

SEQ ID NO: 4146073 - RNA, 19 nt, Yersinia pestis
auaaagaugaaggucacca

SEQ ID NO: 4146074 - RNA, 14 nt, Yersinia pestis
auaaagaugcaagc

SEQ ID NO: 4146075 - RNA, 20 nt, Yersinia pestis
auaaagcaucagacugcucu

SEQ ID NO: 4146076 - RNA, 16 nt, Yersinia pestis
auaaagcauuuaucau

SEQ ID NO: 4146077 - RNA, 21 nt, Yersinia pestis
auaaagcauuuaucauauuaa

SEQ ID NO: 4146078 - RNA, 23 nt, Yersinia pestis
auaaagccauuggucaaucuaga

SEQ ID NO: 4146079 - RNA, 18 nt, Yersinia pestis
auaaagccauuucaguaa

SEQ ID NO: 4146080 - RNA, 22 nt, Yersinia pestis
auaaagccuuguugaaucagau

SEQ ID NO: 4146081 - RNA, 21 nt, Yersinia pestis
auaaaggcaaaagcaucacca

SEQ ID NO: 4146082 - RNA, 22 nt, Yersinia pestis
auaaaggcaaaagcaucaccaa

SEQ ID NO: 4146083 - RNA, 14 nt, Yersinia pestis
auaaagguuugcca

SEQ ID NO: 4146084 - RNA, 15 nt, Yersinia pestis
auaaaguuuuuccuc

SEQ ID NO: 4146085 - RNA, 13 nt, Yersinia pestis
auaaauaaaauaa

SEQ ID NO: 4146086 - RNA, 14 nt, Yersinia pestis
auaaauaaaauaau

SEQ ID NO: 4146087 - RNA, 14 nt, Yersinia pestis
auaaauaaccgagc

SEQ ID NO: 4146088 - RNA, 21 nt, Yersinia pestis
auaaauaaccgagcgugaaga

SEQ ID NO: 4146089 - RNA, 23 nt, Yersinia pestis
auaaauaaccgagcgugaagagc

SEQ ID NO: 4146090 - RNA, 14 nt, Yersinia pestis
auaaauaaguucag

SEQ ID NO: 4146091 - RNA, 14 nt, Yersinia pestis
auaaauaauaucaa

SEQ ID NO: 4146092 - RNA, 15 nt, Yersinia pestis
auaaauaauaucaau

SEQ ID NO: 4146093 - RNA, 17 nt, Yersinia pestis
auaaauaauaucaauga

SEQ ID NO: 4146094 - RNA, 15 nt, Yersinia pestis
auaaauacaaaauua

SEQ ID NO: 4146095 - RNA, 13 nt, Yersinia pestis
auaaauaccaauu

SEQ ID NO: 4146096 - RNA, 20 nt, Yersinia pestis
auaaauaccgccaaauacaa

SEQ ID NO: 4146097 - RNA, 21 nt, Yersinia pestis
auaaauacucuugagaaauga

SEQ ID NO: 4146098 - RNA, 22 nt, Yersinia pestis
auaaauacucuugagaaaugaa

SEQ ID NO: 4146099 - RNA, 17 nt, Yersinia pestis
auaaauaucauuaacaa

SEQ ID NO: 4146100 - RNA, 20 nt, Yersinia pestis
auaaauaucauuaacaaacu

SEQ ID NO: 4146101 - RNA, 11 nt, Yersinia pestis
auaaauauccu

SEQ ID NO: 4146102 - RNA, 14 nt, Yersinia pestis
auaaauauccuccg

SEQ ID NO: 4146103 - RNA, 17 nt, Yersinia pestis
auaaauauucauuaaaa

SEQ ID NO: 4146104 - RNA, 20 nt, Yersinia pestis
auaaauauucauuaaaaaau

SEQ ID NO: 4146105 - RNA, 22 nt, Yersinia pestis
auaaauauugguacauaggucu

SEQ ID NO: 4146106 - RNA, 15 nt, Yersinia pestis
auaaaucaugucccu

SEQ ID NO: 4146107 - RNA, 21 nt, Yersinia pestis
auaaaucccgagacacucauc

SEQ ID NO: 4146108 - RNA, 13 nt, Yersinia pestis
auaaaugcucucg

SEQ ID NO: 4146109 - RNA, 15 nt, Yersinia pestis
auaaauggcauuuuu

SEQ ID NO: 4146110 - RNA, 22 nt, Yersinia pestis
auaaauggcuagauucaucggc

SEQ ID NO: 4146111 - RNA, 14 nt, Yersinia pestis
auaaaugucacuug

SEQ ID NO: 4146112 - RNA, 16 nt, Yersinia pestis
auaaaugucgcuaaua

SEQ ID NO: 4146113 - RNA, 12 nt, Yersinia pestis
auaaauuaaaac

SEQ ID NO: 4146114 - RNA, 23 nt, Yersinia pestis
auaaauuaucugaauagcgcugc

SEQ ID NO: 4146115 - RNA, 14 nt, Yersinia pestis
auaaauucaaaaua

SEQ ID NO: 4146116 - RNA, 17 nt, Yersinia pestis
auaaauucaaauaucau

SEQ ID NO: 4146117 - RNA, 20 nt, Yersinia pestis
auaaauucacagcgcgacaa

SEQ ID NO: 4146118 - RNA, 21 nt, Yersinia pestis
auaaauucgauaaaaggcuau

SEQ ID NO: 4146119 - RNA, 19 nt, Yersinia pestis
auaaauucgggaucaugau

SEQ ID NO: 4146120 - RNA, 22 nt, Yersinia pestis
auaaauugcccgcguaaucucu

SEQ ID NO: 4146121 - RNA, 12 nt, Yersinia pestis
auaaauuggccg

SEQ ID NO: 4146122 - RNA, 13 nt, Yersinia pestis
auaaauuuaauaa

SEQ ID NO: 4146123 - RNA, 16 nt, Yersinia pestis
auaaauuuaucgauaa

SEQ ID NO: 4146124 - RNA, 23 nt, Yersinia pestis
auaaauuucugguuugaauccag

SEQ ID NO: 4146125 - RNA, 22 nt, Yersinia pestis
auaaauuuuaaguuaauguuua

SEQ ID NO: 4146126 - RNA, 20 nt, Yersinia pestis
auaacaaguuacauuuuuaa

SEQ ID NO: 4146127 - RNA, 22 nt, Yersinia pestis
auaacaaguuacauuuuuaaca

SEQ ID NO: 4146128 - RNA, 22 nt, Yersinia pestis
auaacaauggccggacucauua

SEQ ID NO: 4146129 - RNA, 20 nt, Yersinia pestis
auaacacggccuauugaaua

SEQ ID NO: 4146130 - RNA, 20 nt, Yersinia pestis
auaacacuuaauugguuuau

SEQ ID NO: 4146131 - RNA, 14 nt, Yersinia pestis
auaacagauauuac

SEQ ID NO: 4146132 - RNA, 17 nt, Yersinia pestis
auaacagccauuuauau

SEQ ID NO: 4146133 - RNA, 23 nt, Yersinia pestis
auaacagcuaaucauugcaaugc

SEQ ID NO: 4146134 - RNA, 17 nt, Yersinia pestis
auaacagggaggccagc

SEQ ID NO: 4146135 - RNA, 19 nt, Yersinia pestis
auaacagggaggccagcaa

SEQ ID NO: 4146136 - RNA, 17 nt, Yersinia pestis
auaacauccauguaagc

SEQ ID NO: 4146137 - RNA, 20 nt, Yersinia pestis
auaacauuuuuucuuuuagc

SEQ ID NO: 4146138 - RNA, 14 nt, Yersinia pestis
auaaccaaaucacc

SEQ ID NO: 4146139 - RNA, 17 nt, Yersinia pestis
auaaccaauccaugcca

SEQ ID NO: 4146140 - RNA, 18 nt, Yersinia pestis
auaaccaauccaugccag

SEQ ID NO: 4146141 - RNA, 19 nt, Yersinia pestis
auaaccacaacgacagcca

SEQ ID NO: 4146142 - RNA, 21 nt, Yersinia pestis
auaaccacaacgacagccaaa

SEQ ID NO: 4146143 - RNA, 15 nt, Yersinia pestis
auaaccagagucagu

SEQ ID NO: 4146144 - RNA, 12 nt, Yersinia pestis
auaaccagcagc

SEQ ID NO: 4146145 - RNA, 21 nt, Yersinia pestis
auaaccauaaaauaaauaauu

SEQ ID NO: 4146146 - RNA, 18 nt, Yersinia pestis
auaaccaucaaacauaga

SEQ ID NO: 4146147 - RNA, 16 nt, Yersinia pestis
auaaccaucaaauaca

SEQ ID NO: 4146148 - RNA, 18 nt, Yersinia pestis
auaaccaugaugacaaug

SEQ ID NO: 4146149 - RNA, 16 nt, Yersinia pestis
auaaccauuaacaaua

SEQ ID NO: 4146150 - RNA, 22 nt, Yersinia pestis
auaacccaaugccauagcugcu

SEQ ID NO: 4146151 - RNA, 18 nt, Yersinia pestis
auaacccgccuagcauca

SEQ ID NO: 4146152 - RNA, 19 nt, Yersinia pestis
auaacccgccuagcaucau

SEQ ID NO: 4146153 - RNA, 13 nt, Yersinia pestis
auaacccuugcca

SEQ ID NO: 4146154 - RNA, 16 nt, Yersinia pestis
auaaccgaguuuuuug

SEQ ID NO: 4146155 - RNA, 22 nt, Yersinia pestis
auaaccgcgaagaggguuuuuu

SEQ ID NO: 4146156 - RNA, 17 nt, Yersinia pestis
auaaccgucaccaaaau

SEQ ID NO: 4146157 - RNA, 16 nt, Yersinia pestis
auaaccucaaaaggau

SEQ ID NO: 4146158 - RNA, 14 nt, Yersinia pestis
auaaccucagccuc

SEQ ID NO: 4146159 - RNA, 21 nt, Yersinia pestis
auaaccucagccucauucaug

SEQ ID NO: 4146160 - RNA, 22 nt, Yersinia pestis
auaaccucagggcgucucuacg

SEQ ID NO: 4146161 - RNA, 23 nt, Yersinia pestis
auaaccucgguggcucaauccaa

SEQ ID NO: 4146162 - RNA, 16 nt, Yersinia pestis
auaaccugauauuggg

SEQ ID NO: 4146163 - RNA, 14 nt, Yersinia pestis
auaaccuucuucau

SEQ ID NO: 4146164 - RNA, 21 nt, Yersinia pestis
auaacgaauuucauuuuaaaa

SEQ ID NO: 4146165 - RNA, 13 nt, Yersinia pestis
auaacgauaacuc

SEQ ID NO: 4146166 - RNA, 14 nt, Yersinia pestis
auaacgccacaaua

SEQ ID NO: 4146167 - RNA, 20 nt, Yersinia pestis
auaacgccccuguaaauaaa

SEQ ID NO: 4146168 - RNA, 15 nt, Yersinia pestis
auaacgcggccagaa

SEQ ID NO: 4146169 - RNA, 16 nt, Yersinia pestis
auaacgcggccagaaa

SEQ ID NO: 4146170 - RNA, 22 nt, Yersinia pestis
auaacgugaugguaucaaucgc

SEQ ID NO: 4146171 - RNA, 16 nt, Yersinia pestis
auaacguuguuucuga

SEQ ID NO: 4146172 - RNA, 20 nt, Yersinia pestis
auaacuaagagucacagcau

SEQ ID NO: 4146173 - RNA, 20 nt, Yersinia pestis
auaacuauauucucauugcc

SEQ ID NO: 4146174 - RNA, 13 nt, Yersinia pestis
auaacuauuuuug

SEQ ID NO: 4146175 - RNA, 14 nt, Yersinia pestis
auaacuauuuuuga

SEQ ID NO: 4146176 - RNA, 12 nt, Yersinia pestis
auaacucaucag

SEQ ID NO: 4146177 - RNA, 15 nt, Yersinia pestis
auaacuggagaauuu

SEQ ID NO: 4146178 - RNA, 15 nt, Yersinia pestis
auaacugguccaacu

SEQ ID NO: 4146179 - RNA, 15 nt, Yersinia pestis
auaacuucauuuuuc

SEQ ID NO: 4146180 - RNA, 20 nt, Yersinia pestis
auaacuuuggguauaugacu

SEQ ID NO: 4146181 - RNA, 18 nt, Yersinia pestis
auaagaaaucaucagcau

SEQ ID NO: 4146182 - RNA, 16 nt, Yersinia pestis
auaagacaccacauca

SEQ ID NO: 4146183 - RNA, 14 nt, Yersinia pestis
auaagacagggguu

SEQ ID NO: 4146184 - RNA, 17 nt, Yersinia pestis
auaagacuaacagaaua

SEQ ID NO: 4146185 - RNA, 17 nt, Yersinia pestis
auaagauccagaacacc

SEQ ID NO: 4146186 - RNA, 15 nt, Yersinia pestis
auaagauucagcugc

SEQ ID NO: 4146187 - RNA, 20 nt, Yersinia pestis
auaagauucagcugcccuug

SEQ ID NO: 4146188 - RNA, 18 nt, Yersinia pestis
auaagcacaacgcucuaa

SEQ ID NO: 4146189 - RNA, 20 nt, Yersinia pestis
auaagcacgaauuuuauuca

SEQ ID NO: 4146190 - RNA, 16 nt, Yersinia pestis
auaagcacuccacugg

SEQ ID NO: 4146191 - RNA, 14 nt, Yersinia pestis
auaagcaggaaugc

SEQ ID NO: 4146192 - RNA, 22 nt, Yersinia pestis
auaagccgcaggcaaacaaugu

SEQ ID NO: 4146193 - RNA, 20 nt, Yersinia pestis
auaagccgcuaucacaucgc

SEQ ID NO: 4146194 - RNA, 15 nt, Yersinia pestis
auaagcgcucaaaua

SEQ ID NO: 4146195 - RNA, 21 nt, Yersinia pestis
auaagcgggguuaaucccccg

SEQ ID NO: 4146196 - RNA, 20 nt, Yersinia pestis
auaagcgguuucauggcugg

SEQ ID NO: 4146197 - RNA, 17 nt, Yersinia pestis
auaagcgguuuuaucaa

SEQ ID NO: 4146198 - RNA, 18 nt, Yersinia pestis
auaagcgguuuuaucaau

SEQ ID NO: 4146199 - RNA, 13 nt, Yersinia pestis
auaagcugacacc

SEQ ID NO: 4146200 - RNA, 13 nt, Yersinia pestis
auaaggaauaacu

SEQ ID NO: 4146201 - RNA, 14 nt, Yersinia pestis
auaaggaauauacu

SEQ ID NO: 4146202 - RNA, 17 nt, Yersinia pestis
auaaggauaaccgccug

SEQ ID NO: 4146203 - RNA, 18 nt, Yersinia pestis
auaaggccuuuuucugua

SEQ ID NO: 4146204 - RNA, 16 nt, Yersinia pestis
auaaggcgaauaugau

SEQ ID NO: 4146205 - RNA, 20 nt, Yersinia pestis
auaaggcuagaucguuacau

SEQ ID NO: 4146206 - RNA, 13 nt, Yersinia pestis
auaagggccacca

SEQ ID NO: 4146207 - RNA, 13 nt, Yersinia pestis
auaagggccaccc

SEQ ID NO: 4146208 - RNA, 23 nt, Yersinia pestis
auaagguccgcgauaaauuagau

SEQ ID NO: 4146209 - RNA, 19 nt, Yersinia pestis
auaaggugccacacagaau

SEQ ID NO: 4146210 - RNA, 14 nt, Yersinia pestis
auaaguaagugauu

SEQ ID NO: 4146211 - RNA, 14 nt, Yersinia pestis
auaaguaauaagua

SEQ ID NO: 4146212 - RNA, 21 nt, Yersinia pestis
auaagucaaugcauuguaaaa

SEQ ID NO: 4146213 - RNA, 19 nt, Yersinia pestis
auaagugaaacaaauacac

SEQ ID NO: 4146214 - RNA, 21 nt, Yersinia pestis
auaagugaaacaaauacaccu

SEQ ID NO: 4146215 - RNA, 14 nt, Yersinia pestis
auaagugaauaaau

SEQ ID NO: 4146216 - RNA, 22 nt, Yersinia pestis
auaagugaauaacgcugaauaa

SEQ ID NO: 4146217 - RNA, 21 nt, Yersinia pestis
auaagugcaaacuuaaaaauc

SEQ ID NO: 4146218 - RNA, 22 nt, Yersinia pestis
auaaguuacgucagaaauaaau

SEQ ID NO: 4146219 - RNA, 23 nt, Yersinia pestis
auaaguuagcgugagaauaauaa

SEQ ID NO: 4146220 - RNA, 17 nt, Yersinia pestis
auaaguuauuucagcca

SEQ ID NO: 4146221 - RNA, 20 nt, Yersinia pestis
auaaguucagguugaaauaa

SEQ ID NO: 4146222 - RNA, 21 nt, Yersinia pestis
auaaguuccggcagauaugau

SEQ ID NO: 4146223 - RNA, 23 nt, Yersinia pestis
auaaguuccggcagauaugaugc

SEQ ID NO: 4146224 - RNA, 13 nt, Yersinia pestis
auaaguugaacca

SEQ ID NO: 4146225 - RNA, 19 nt, Yersinia pestis
auaauaacgaauuucauuu

SEQ ID NO: 4146226 - RNA, 20 nt, Yersinia pestis
auaauaagggcgcauauccu

SEQ ID NO: 4146227 - RNA, 13 nt, Yersinia pestis
auaauaauauuga

SEQ ID NO: 4146228 - RNA, 14 nt, Yersinia pestis
auaauaauauugau

SEQ ID NO: 4146229 - RNA, 13 nt, Yersinia pestis
auaauaauccaua

SEQ ID NO: 4146230 - RNA, 13 nt, Yersinia pestis
auaauaaugcgau

SEQ ID NO: 4146231 - RNA, 10 nt, Yersinia pestis
auaauaaugg

SEQ ID NO: 4146232 - RNA, 15 nt, Yersinia pestis
auaauacgaaauacu

SEQ ID NO: 4146233 - RNA, 16 nt, Yersinia pestis
auaauacuuaagucaa

SEQ ID NO: 4146234 - RNA, 20 nt, Yersinia pestis
auaauagauaacaaacuacu

SEQ ID NO: 4146235 - RNA, 15 nt, Yersinia pestis
auaauagauaguacu

SEQ ID NO: 4146236 - RNA, 21 nt, Yersinia pestis
auaauagcuggcggauaaaaa

SEQ ID NO: 4146237 - RNA, 15 nt, Yersinia pestis
auaauauagcugaau

SEQ ID NO: 4146238 - RNA, 23 nt, Yersinia pestis
auaauaucaagucuugaagagug

SEQ ID NO: 4146239 - RNA, 16 nt, Yersinia pestis
auaauauuaaagccau

SEQ ID NO: 4146240 - RNA, 13 nt, Yersinia pestis
auaauauuggccg

SEQ ID NO: 4146241 - RNA, 16 nt, Yersinia pestis
auaauauuggccgcca

SEQ ID NO: 4146242 - RNA, 12 nt, Yersinia pestis
auaaucaaugac

SEQ ID NO: 4146243 - RNA, 13 nt, Yersinia pestis
auaaucaccagac

SEQ ID NO: 4146244 - RNA, 21 nt, Yersinia pestis
auaaucaccagacaaccaaua

SEQ ID NO: 4146245 - RNA, 14 nt, Yersinia pestis
auaaucaccuucaa

SEQ ID NO: 4146246 - RNA, 14 nt, Yersinia pestis
auaaucacguucaa

SEQ ID NO: 4146247 - RNA, 22 nt, Yersinia pestis
auaaucacguucaacuuccuga

SEQ ID NO: 4146248 - RNA, 19 nt, Yersinia pestis
auaaucaucuacaacauca

SEQ ID NO: 4146249 - RNA, 19 nt, Yersinia pestis
auaauccaaaccgccuucu

SEQ ID NO: 4146250 - RNA, 20 nt, Yersinia pestis
auaauccgguuagcaaaaaa

SEQ ID NO: 4146251 - RNA, 22 nt, Yersinia pestis
auaaucgcguucagagcagcau

SEQ ID NO: 4146252 - RNA, 15 nt, Yersinia pestis
auaaucuaaauuaau

SEQ ID NO: 4146253 - RNA, 18 nt, Yersinia pestis
auaaucucagcaucggca

SEQ ID NO: 4146254 - RNA, 16 nt, Yersinia pestis
auaaucuuuacugcau

SEQ ID NO: 4146255 - RNA, 13 nt, Yersinia pestis
auaaugaauuauu

SEQ ID NO: 4146256 - RNA, 16 nt, Yersinia pestis
auaaugagguuaucca

SEQ ID NO: 4146257 - RNA, 23 nt, Yersinia pestis
auaaugagguuauccaauaacau

SEQ ID NO: 4146258 - RNA, 14 nt, Yersinia pestis
auaaugcaccaauc

SEQ ID NO: 4146259 - RNA, 16 nt, Yersinia pestis
auaaugcaccaaucaa

SEQ ID NO: 4146260 - RNA, 18 nt, Yersinia pestis
auaaugcaccaaucaaca

SEQ ID NO: 4146261 - RNA, 21 nt, Yersinia pestis
auaaugcuaaaugagaucgcu

SEQ ID NO: 4146262 - RNA, 15 nt, Yersinia pestis
auaauggacgaacag

SEQ ID NO: 4146263 - RNA, 13 nt, Yersinia pestis
auaauggcagccc

SEQ ID NO: 4146264 - RNA, 17 nt, Yersinia pestis
auaaugguauuugaaau

SEQ ID NO: 4146265 - RNA, 21 nt, Yersinia pestis
auaaugguuagguugaaauac

SEQ ID NO: 4146266 - RNA, 22 nt, Yersinia pestis
auaaugucaccacggcuuucaa

SEQ ID NO: 4146267 - RNA, 12 nt, Yersinia pestis
auaauuaaauau

SEQ ID NO: 4146268 - RNA, 14 nt, Yersinia pestis
auaauuaacagcau

SEQ ID NO: 4146269 - RNA, 12 nt, Yersinia pestis
auaauuaacuau

SEQ ID NO: 4146270 - RNA, 13 nt, Yersinia pestis
auaauuaaucuaa

SEQ ID NO: 4146271 - RNA, 17 nt, Yersinia pestis
auaauuauaccuacccu

SEQ ID NO: 4146272 - RNA, 22 nt, Yersinia pestis
auaauuauccauuuucugccaa

SEQ ID NO: 4146273 - RNA, 13 nt, Yersinia pestis
auaauuaugaaag

SEQ ID NO: 4146274 - RNA, 15 nt, Yersinia pestis
auaauuauuucucug

SEQ ID NO: 4146275 - RNA, 12 nt, Yersinia pestis
auaauucagacg

SEQ ID NO: 4146276 - RNA, 13 nt, Yersinia pestis
auaauucagcauc

SEQ ID NO: 4146277 - RNA, 15 nt, Yersinia pestis
auaauugaagauuua

SEQ ID NO: 4146278 - RNA, 17 nt, Yersinia pestis
auaauugaagauuuaaa

SEQ ID NO: 4146279 - RNA, 21 nt, Yersinia pestis
auaauuguucauaaaccugau

SEQ ID NO: 4146280 - RNA, 15 nt, Yersinia pestis
auaauuuagcaaagc

SEQ ID NO: 4146281 - RNA, 21 nt, Yersinia pestis
auaauuuagcaaagcgauauc

SEQ ID NO: 4146282 - RNA, 14 nt, Yersinia pestis
auaauuuauacaua

SEQ ID NO: 4146283 - RNA, 14 nt, Yersinia pestis
auaauuuauuucag

SEQ ID NO: 4146284 - RNA, 16 nt, Yersinia pestis
auaauuucaaaguaaa

SEQ ID NO: 4146285 - RNA, 23 nt, Yersinia pestis
auaauuucuacgccgucaucauc

SEQ ID NO: 4146286 - RNA, 14 nt, Yersinia pestis
auaauuugccuggc

SEQ ID NO: 4146287 - RNA, 14 nt, Yersinia pestis
auaauuuugaugcu

SEQ ID NO: 4146288 - RNA, 13 nt, Yersinia pestis
auaauuuuucuuc

SEQ ID NO: 4146289 - RNA, 22 nt, Yersinia pestis
auacaacaacgggucacagcca

SEQ ID NO: 4146290 - RNA, 18 nt, Yersinia pestis
auacaaccaacaaacaau

SEQ ID NO: 4146291 - RNA, 20 nt, Yersinia pestis
auacaaccacugaacaccau

SEQ ID NO: 4146292 - RNA, 15 nt, Yersinia pestis
auacaaccauuucaa

SEQ ID NO: 4146293 - RNA, 18 nt, Yersinia pestis
auacaaccccacaccucg

SEQ ID NO: 4146294 - RNA, 13 nt, Yersinia pestis
auacaaccguuac

SEQ ID NO: 4146295 - RNA, 15 nt, Yersinia pestis
auacaauuauuuuua

SEQ ID NO: 4146296 - RNA, 20 nt, Yersinia pestis
auacaauugccugauuuuua

SEQ ID NO: 4146297 - RNA, 12 nt, Yersinia pestis
auacaauuuuug

SEQ ID NO: 4146298 - RNA, 23 nt, Yersinia pestis
auacaauuuuuggucguauucau

SEQ ID NO: 4146299 - RNA, 23 nt, Yersinia pestis
auacacagcacggcaacaggcuu

SEQ ID NO: 4146300 - RNA, 9 nt, Yersinia pestis
auacaccaa

SEQ ID NO: 4146301 - RNA, 13 nt, Yersinia pestis
auacaccaucgcg

SEQ ID NO: 4146302 - RNA, 17 nt, Yersinia pestis
auacaccauuuccaggc

SEQ ID NO: 4146303 - RNA, 23 nt, Yersinia pestis
auacaccauuuccaggcuaccaa

SEQ ID NO: 4146304 - RNA, 21 nt, Yersinia pestis
auacacccgaaggccauugcc

SEQ ID NO: 4146305 - RNA, 12 nt, Yersinia pestis
auacaccgccag

SEQ ID NO: 4146306 - RNA, 21 nt, Yersinia pestis
auacaccuucuuuaucugucc

SEQ ID NO: 4146307 - RNA, 11 nt, Yersinia pestis
auacacgcuuc

SEQ ID NO: 4146308 - RNA, 20 nt, Yersinia pestis
auacacuccauuaauuuauu

SEQ ID NO: 4146309 - RNA, 20 nt, Yersinia pestis
auacacucguggugauuaau

SEQ ID NO: 4146310 - RNA, 12 nt, Yersinia pestis
auacacuugcuc

SEQ ID NO: 4146311 - RNA, 16 nt, Yersinia pestis
auacagccagcgggcg

SEQ ID NO: 4146312 - RNA, 19 nt, Yersinia pestis
auacaggcugacauuucuu

SEQ ID NO: 4146313 - RNA, 18 nt, Yersinia pestis
auacaggugucaucaagg

SEQ ID NO: 4146314 - RNA, 19 nt, Yersinia pestis
auacaggugucaucaaggc

SEQ ID NO: 4146315 - RNA, 17 nt, Yersinia pestis
auacagucaauugagaa

SEQ ID NO: 4146316 - RNA, 20 nt, Yersinia pestis
auacagucaauugagaauaa

SEQ ID NO: 4146317 - RNA, 15 nt, Yersinia pestis
auacaguuccuguuu

SEQ ID NO: 4146318 - RNA, 14 nt, Yersinia pestis
auacaguuuugccg

SEQ ID NO: 4146319 - RNA, 16 nt, Yersinia pestis
auacauacgucuccau

SEQ ID NO: 4146320 - RNA, 15 nt, Yersinia pestis
auacauaucaacacu

SEQ ID NO: 4146321 - RNA, 20 nt, Yersinia pestis
auacaucaaaucagaggcuu

SEQ ID NO: 4146322 - RNA, 20 nt, Yersinia pestis
auacaucaagcuacaugugc

SEQ ID NO: 4146323 - RNA, 13 nt, Yersinia pestis
auacaucacguua

SEQ ID NO: 4146324 - RNA, 19 nt, Yersinia pestis
auacauccauguaggcucg

SEQ ID NO: 4146325 - RNA, 17 nt, Yersinia pestis
auacauccuaaauaauu

SEQ ID NO: 4146326 - RNA, 21 nt, Yersinia pestis
auacaucgccaguguugccau

SEQ ID NO: 4146327 - RNA, 22 nt, Yersinia pestis
auacaugccucugcuaacaaca

SEQ ID NO: 4146328 - RNA, 12 nt, Yersinia pestis
auacauggcgau

SEQ ID NO: 4146329 - RNA, 18 nt, Yersinia pestis
auacauggcgaucaccag

SEQ ID NO: 4146330 - RNA, 18 nt, Yersinia pestis
auacauuggcuccccuuu

SEQ ID NO: 4146331 - RNA, 15 nt, Yersinia pestis
auaccaaaaaucucu

SEQ ID NO: 4146332 - RNA, 12 nt, Yersinia pestis
auaccaaauuua

SEQ ID NO: 4146333 - RNA, 17 nt, Yersinia pestis
auaccaaauuuaccgac

SEQ ID NO: 4146334 - RNA, 17 nt, Yersinia pestis
auaccaagccaaauuaa

SEQ ID NO: 4146335 - RNA, 17 nt, Yersinia pestis
auaccaauucuucaucu

SEQ ID NO: 4146336 - RNA, 13 nt, Yersinia pestis
auaccacaucaaa

SEQ ID NO: 4146337 - RNA, 16 nt, Yersinia pestis
auaccacaucaaaccg

SEQ ID NO: 4146338 - RNA, 20 nt, Yersinia pestis
auaccacaucaaaccggcua

SEQ ID NO: 4146339 - RNA, 14 nt, Yersinia pestis
auaccagaugcaua

SEQ ID NO: 4146340 - RNA, 16 nt, Yersinia pestis
auaccagaugcauaua

SEQ ID NO: 4146341 - RNA, 15 nt, Yersinia pestis
auaccaugccaucaa

SEQ ID NO: 4146342 - RNA, 21 nt, Yersinia pestis
auaccauguugaaucaauugc

SEQ ID NO: 4146343 - RNA, 22 nt, Yersinia pestis
auaccauucucugucuuccauu

SEQ ID NO: 4146344 - RNA, 22 nt, Yersinia pestis
auaccauuucuuauaucuguuu

SEQ ID NO: 4146345 - RNA, 13 nt, Yersinia pestis
auaccauuuuagc

SEQ ID NO: 4146346 - RNA, 19 nt, Yersinia pestis
auaccauuuuagcuggcag

SEQ ID NO: 4146347 - RNA, 15 nt, Yersinia pestis
auacccaaagccagu

SEQ ID NO: 4146348 - RNA, 16 nt, Yersinia pestis
auacccaacagguugg

SEQ ID NO: 4146349 - RNA, 24 nt, Yersinia pestis
auacccacuaauacucuguuacca

SEQ ID NO: 4146350 - RNA, 18 nt, Yersinia pestis
auacccgccgcaucuaaa

SEQ ID NO: 4146351 - RNA, 22 nt, Yersinia pestis
auacccgccgcaucuaaaccga

SEQ ID NO: 4146352 - RNA, 14 nt, Yersinia pestis
auacccguaauauu

SEQ ID NO: 4146353 - RNA, 21 nt, Yersinia pestis
auacccguaauauuucaagcu

SEQ ID NO: 4146354 - RNA, 21 nt, Yersinia pestis
auacccguuauaccucaagcu

SEQ ID NO: 4146355 - RNA, 23 nt, Yersinia pestis
auacccugguuuaccauccgacu

SEQ ID NO: 4146356 - RNA, 17 nt, Yersinia pestis
auacccuucaggauuau

SEQ ID NO: 4146357 - RNA, 16 nt, Yersinia pestis
auacccuucaucuuuc

SEQ ID NO: 4146358 - RNA, 19 nt, Yersinia pestis
auacccuuuggucaauaaa

SEQ ID NO: 4146359 - RNA, 15 nt, Yersinia pestis
auaccgacaucaaca

SEQ ID NO: 4146360 - RNA, 22 nt, Yersinia pestis
auaccgccacacaauacauaga

SEQ ID NO: 4146361 - RNA, 16 nt, Yersinia pestis
auaccgccgguuuuug

SEQ ID NO: 4146362 - RNA, 18 nt, Yersinia pestis
auaccggcggcacacugg

SEQ ID NO: 4146363 - RNA, 15 nt, Yersinia pestis
auaccggcuucacgg

SEQ ID NO: 4146364 - RNA, 23 nt, Yersinia pestis
auaccggcuucacggguaaaaac

SEQ ID NO: 4146365 - RNA, 17 nt, Yersinia pestis
auaccuaaaauuaucgc

SEQ ID NO: 4146366 - RNA, 20 nt, Yersinia pestis
auaccucaagcugcauguac

SEQ ID NO: 4146367 - RNA, 22 nt, Yersinia pestis
auaccucacuggcuuuauuaua

SEQ ID NO: 4146368 - RNA, 19 nt, Yersinia pestis
auaccucaguuaucagggc

SEQ ID NO: 4146369 - RNA, 22 nt, Yersinia pestis
auaccugcaccaaugacuaauu

SEQ ID NO: 4146370 - RNA, 18 nt, Yersinia pestis
auaccuguacuuugauuc

SEQ ID NO: 4146371 - RNA, 12 nt, Yersinia pestis
auaccuuacugc

SEQ ID NO: 4146372 - RNA, 14 nt, Yersinia pestis
auaccuuacugcau

SEQ ID NO: 4146373 - RNA, 17 nt, Yersinia pestis
auaccuuacugcaucaa

SEQ ID NO: 4146374 - RNA, 14 nt, Yersinia pestis
auaccuuacuucca

SEQ ID NO: 4146375 - RNA, 19 nt, Yersinia pestis
auacgaccgucaccaaaua

SEQ ID NO: 4146376 - RNA, 20 nt, Yersinia pestis
auacgaccgucaccaaauag

SEQ ID NO: 4146377 - RNA, 14 nt, Yersinia pestis
auacgaucagcaag

SEQ ID NO: 4146378 - RNA, 17 nt, Yersinia pestis
auacgaucaucugguga

SEQ ID NO: 4146379 - RNA, 18 nt, Yersinia pestis
auacgcgcaccggcuaac

SEQ ID NO: 4146380 - RNA, 23 nt, Yersinia pestis
auacgcgcaccggcuaaccacag

SEQ ID NO: 4146381 - RNA, 22 nt, Yersinia pestis
auacggcuucaccgcuuuucug

SEQ ID NO: 4146382 - RNA, 15 nt, Yersinia pestis
auacggucaaaagcu

SEQ ID NO: 4146383 - RNA, 14 nt, Yersinia pestis
auacgguccagcau

SEQ ID NO: 4146384 - RNA, 20 nt, Yersinia pestis
auacgguccagcaucgcuga

SEQ ID NO: 4146385 - RNA, 18 nt, Yersinia pestis
auacgguucaaaucaguu

SEQ ID NO: 4146386 - RNA, 21 nt, Yersinia pestis
auacgugccaaaaugccuacc

SEQ ID NO: 4146387 - RNA, 16 nt, Yersinia pestis
auacguguaaaaccuu

SEQ ID NO: 4146388 - RNA, 17 nt, Yersinia pestis
auacguucguagccacg

SEQ ID NO: 4146389 - RNA, 21 nt, Yersinia pestis
auacguucguagccacgaucg

SEQ ID NO: 4146390 - RNA, 16 nt, Yersinia pestis
auacguugaauuaaaa

SEQ ID NO: 4146391 - RNA, 13 nt, Yersinia pestis
auacguugcaggu

SEQ ID NO: 4146392 - RNA, 13 nt, Yersinia pestis
auacuaaaacagc

SEQ ID NO: 4146393 - RNA, 12 nt, Yersinia pestis
auacuaaagaaa

SEQ ID NO: 4146394 - RNA, 19 nt, Yersinia pestis
auacuaaagaaauaaucau

SEQ ID NO: 4146395 - RNA, 15 nt, Yersinia pestis
auacuacuuucucuu

SEQ ID NO: 4146396 - RNA, 20 nt, Yersinia pestis
auacuauuuguaguuuuuca

SEQ ID NO: 4146397 - RNA, 17 nt, Yersinia pestis
auacucaugauggcacc

SEQ ID NO: 4146398 - RNA, 15 nt, Yersinia pestis
auacuccauuugaac

SEQ ID NO: 4146399 - RNA, 21 nt, Yersinia pestis
auacuccgcugagcauauaca

SEQ ID NO: 4146400 - RNA, 21 nt, Yersinia pestis
auacugacggggaguuuuuau

SEQ ID NO: 4146401 - RNA, 22 nt, Yersinia pestis
auacugagaccuuccauaacuc

SEQ ID NO: 4146402 - RNA, 14 nt, Yersinia pestis
auacugauacaaca

SEQ ID NO: 4146403 - RNA, 23 nt, Yersinia pestis
auacugcacguuuaauuucacuu

SEQ ID NO: 4146404 - RNA, 15 nt, Yersinia pestis
auacugccaucauca

SEQ ID NO: 4146405 - RNA, 17 nt, Yersinia pestis
auacugccgaccauauc

SEQ ID NO: 4146406 - RNA, 20 nt, Yersinia pestis
auacugccgaccauaucuuc

SEQ ID NO: 4146407 - RNA, 18 nt, Yersinia pestis
auacugccgcacugccac

SEQ ID NO: 4146408 - RNA, 18 nt, Yersinia pestis
auacuguuaacucgccaa

SEQ ID NO: 4146409 - RNA, 12 nt, Yersinia pestis
auacuguuuggu

SEQ ID NO: 4146410 - RNA, 23 nt, Yersinia pestis
auacuuaacaaucagugcaauaa

SEQ ID NO: 4146411 - RNA, 18 nt, Yersinia pestis
auacuuaucuguuuucca

SEQ ID NO: 4146412 - RNA, 22 nt, Yersinia pestis
auacuucgaugauuauuuugug

SEQ ID NO: 4146413 - RNA, 16 nt, Yersinia pestis
auacuugaaacagcag

SEQ ID NO: 4146414 - RNA, 19 nt, Yersinia pestis
auacuuucccauagcuggc

SEQ ID NO: 4146415 - RNA, 16 nt, Yersinia pestis
auagaacggcagugau

SEQ ID NO: 4146416 - RNA, 15 nt, Yersinia pestis
auagaagagaggcaa

SEQ ID NO: 4146417 - RNA, 21 nt, Yersinia pestis
auagaagguaaucagacugcu

SEQ ID NO: 4146418 - RNA, 17 nt, Yersinia pestis
auagaauggcuuuaccg

SEQ ID NO: 4146419 - RNA, 23 nt, Yersinia pestis
auagacaauacuacuuucucuug

SEQ ID NO: 4146420 - RNA, 17 nt, Yersinia pestis
auagacauauuguccaa

SEQ ID NO: 4146421 - RNA, 16 nt, Yersinia pestis
auagacgaauggccgc

SEQ ID NO: 4146422 - RNA, 20 nt, Yersinia pestis
auagacucaucgggauuaau

SEQ ID NO: 4146423 - RNA, 20 nt, Yersinia pestis
auagacuguuuuauuauaua

SEQ ID NO: 4146424 - RNA, 22 nt, Yersinia pestis
auagacuguuuuauuauauauu

SEQ ID NO: 4146425 - RNA, 21 nt, Yersinia pestis
auagacuuuuaucaacuucau

SEQ ID NO: 4146426 - RNA, 23 nt, Yersinia pestis
auagagacggaaagagccagcac

SEQ ID NO: 4146427 - RNA, 22 nt, Yersinia pestis
auagagcuucgcgaucagacau

SEQ ID NO: 4146428 - RNA, 17 nt, Yersinia pestis
auagaggaaauaaauga

SEQ ID NO: 4146429 - RNA, 17 nt, Yersinia pestis
auagagucacagaggaa

SEQ ID NO: 4146430 - RNA, 18 nt, Yersinia pestis
auagagugcaauuuuauu

SEQ ID NO: 4146431 - RNA, 16 nt, Yersinia pestis
auagauaacaaacuac

SEQ ID NO: 4146432 - RNA, 16 nt, Yersinia pestis
auagaucccauaccca

SEQ ID NO: 4146433 - RNA, 19 nt, Yersinia pestis
auagaucccauacccacua

SEQ ID NO: 4146434 - RNA, 17 nt, Yersinia pestis
auagaugcaaaugucag

SEQ ID NO: 4146435 - RNA, 21 nt, Yersinia pestis
auagauuaaucgaaacaccac

SEQ ID NO: 4146436 - RNA, 15 nt, Yersinia pestis
auagauuuucagcgc

SEQ ID NO: 4146437 - RNA, 14 nt, Yersinia pestis
auagauuuuuauag

SEQ ID NO: 4146438 - RNA, 15 nt, Yersinia pestis
auagcaaaaaaaaag

SEQ ID NO: 4146439 - RNA, 18 nt, Yersinia pestis
auagcaaaagaaucagua

SEQ ID NO: 4146440 - RNA, 21 nt, Yersinia pestis
auagcaaaauugagauaacgc

SEQ ID NO: 4146441 - RNA, 15 nt, Yersinia pestis
auagcaacaucgacc

SEQ ID NO: 4146442 - RNA, 21 nt, Yersinia pestis
auagcaaccggauacaaagug

SEQ ID NO: 4146443 - RNA, 14 nt, Yersinia pestis
auagcaaucaauaa

SEQ ID NO: 4146444 - RNA, 21 nt, Yersinia pestis
auagcaaugaccuuacaguga

SEQ ID NO: 4146445 - RNA, 12 nt, Yersinia pestis
auagcagagaag

SEQ ID NO: 4146446 - RNA, 12 nt, Yersinia pestis
auagcauaaaua

SEQ ID NO: 4146447 - RNA, 19 nt, Yersinia pestis
auagcaucauccagcucaa

SEQ ID NO: 4146448 - RNA, 15 nt, Yersinia pestis
auagccaaaauaauu

SEQ ID NO: 4146449 - RNA, 12 nt, Yersinia pestis
auagccacuaac

SEQ ID NO: 4146450 - RNA, 16 nt, Yersinia pestis
auagccauauuuuaaa

SEQ ID NO: 4146451 - RNA, 15 nt, Yersinia pestis
auagcccucccuggg

SEQ ID NO: 4146452 - RNA, 21 nt, Yersinia pestis
auagccgaaccccuagccagc

SEQ ID NO: 4146453 - RNA, 14 nt, Yersinia pestis
auagccuucccugg

SEQ ID NO: 4146454 - RNA, 13 nt, Yersinia pestis
auagccuuuuugc

SEQ ID NO: 4146455 - RNA, 16 nt, Yersinia pestis
auagcgaucagcaacg

SEQ ID NO: 4146456 - RNA, 14 nt, Yersinia pestis
auagcgcaccaccg

SEQ ID NO: 4146457 - RNA, 15 nt, Yersinia pestis
auagcgcuucaguga

SEQ ID NO: 4146458 - RNA, 21 nt, Yersinia pestis
auagcggaauauuuaaccaga

SEQ ID NO: 4146459 - RNA, 20 nt, Yersinia pestis
auagcggcguucagcaauau

SEQ ID NO: 4146460 - RNA, 22 nt, Yersinia pestis
auagcgggccuuugcuuuucug

SEQ ID NO: 4146461 - RNA, 15 nt, Yersinia pestis
auagcuaucuugccu

SEQ ID NO: 4146462 - RNA, 15 nt, Yersinia pestis
auagcugauugcucc

SEQ ID NO: 4146463 - RNA, 20 nt, Yersinia pestis
auagcugcugcuuucagugu

SEQ ID NO: 4146464 - RNA, 20 nt, Yersinia pestis
auagcugucagcgaaaaaaa

SEQ ID NO: 4146465 - RNA, 21 nt, Yersinia pestis
auagcuguuagccagauaggc

SEQ ID NO: 4146466 - RNA, 22 nt, Yersinia pestis
auaggauaagggccauuuugcu

SEQ ID NO: 4146467 - RNA, 19 nt, Yersinia pestis
auaggcagaaaagcaaagg

SEQ ID NO: 4146468 - RNA, 15 nt, Yersinia pestis
auaggcagaggaagu

SEQ ID NO: 4146469 - RNA, 21 nt, Yersinia pestis
auaggccuaaaccccacagcg

SEQ ID NO: 4146470 - RNA, 15 nt, Yersinia pestis
auaggcgaaaggcgc

SEQ ID NO: 4146471 - RNA, 16 nt, Yersinia pestis
auaggcgaaaggcgca

SEQ ID NO: 4146472 - RNA, 15 nt, Yersinia pestis
auaggcgcauaugaa

SEQ ID NO: 4146473 - RNA, 17 nt, Yersinia pestis
auaggcgcauaugaaaa

SEQ ID NO: 4146474 - RNA, 16 nt, Yersinia pestis
auaggcucaaugcgaa

SEQ ID NO: 4146475 - RNA, 19 nt, Yersinia pestis
auaggcuuggguagaacuu

SEQ ID NO: 4146476 - RNA, 14 nt, Yersinia pestis
auagggaaaaguua

SEQ ID NO: 4146477 - RNA, 16 nt, Yersinia pestis
auaggucagugguuuu

SEQ ID NO: 4146478 - RNA, 14 nt, Yersinia pestis
auaggucauauaca

SEQ ID NO: 4146479 - RNA, 18 nt, Yersinia pestis
auagguuggggaugccau

SEQ ID NO: 4146480 - RNA, 15 nt, Yersinia pestis
auaguaacaccagca

SEQ ID NO: 4146481 - RNA, 11 nt, Yersinia pestis
auaguaacccu

SEQ ID NO: 4146482 - RNA, 14 nt, Yersinia pestis
auaguaacgcuaau

SEQ ID NO: 4146483 - RNA, 15 nt, Yersinia pestis
auaguagaucuauua

SEQ ID NO: 4146484 - RNA, 18 nt, Yersinia pestis
auagucacgucuucacca

SEQ ID NO: 4146485 - RNA, 19 nt, Yersinia pestis
auagucauauauuuuucuu

SEQ ID NO: 4146486 - RNA, 15 nt, Yersinia pestis
auagucaucuuucca

SEQ ID NO: 4146487 - RNA, 21 nt, Yersinia pestis
auagucaucuuuccagcgaac

SEQ ID NO: 4146488 - RNA, 21 nt, Yersinia pestis
auagucuuuuuaauaugugac

SEQ ID NO: 4146489 - RNA, 14 nt, Yersinia pestis
auaguggguaaacc

SEQ ID NO: 4146490 - RNA, 19 nt, Yersinia pestis
auagugggucguggaguag

SEQ ID NO: 4146491 - RNA, 16 nt, Yersinia pestis
auaguguaaaaaccau

SEQ ID NO: 4146492 - RNA, 18 nt, Yersinia pestis
auaguguguguauuuaaa

SEQ ID NO: 4146493 - RNA, 20 nt, Yersinia pestis
auaguguguguauuuaaaag

SEQ ID NO: 4146494 - RNA, 14 nt, Yersinia pestis
auaguguugcuaag

SEQ ID NO: 4146495 - RNA, 21 nt, Yersinia pestis
auaguuaugaugaguaacaua

SEQ ID NO: 4146496 - RNA, 13 nt, Yersinia pestis
auaguugaucuac

SEQ ID NO: 4146497 - RNA, 20 nt, Yersinia pestis
auaguuuagauagaaaucac

SEQ ID NO: 4146498 - RNA, 14 nt, Yersinia pestis
auaguuuuucuccu

SEQ ID NO: 4146499 - RNA, 15 nt, Yersinia pestis
auauaaaacacgcau

SEQ ID NO: 4146500 - RNA, 22 nt, Yersinia pestis
auauaaaagcacagacaaacaa

SEQ ID NO: 4146501 - RNA, 17 nt, Yersinia pestis
auauaaaauaauaagau

SEQ ID NO: 4146502 - RNA, 14 nt, Yersinia pestis
auauaaaccagcca

SEQ ID NO: 4146503 - RNA, 12 nt, Yersinia pestis
auauaaauaaaa

SEQ ID NO: 4146504 - RNA, 13 nt, Yersinia pestis
auauaaauaaaau

SEQ ID NO: 4146505 - RNA, 14 nt, Yersinia pestis
auauaaauaaaaua

SEQ ID NO: 4146506 - RNA, 13 nt, Yersinia pestis
auauaaauccagc

SEQ ID NO: 4146507 - RNA, 17 nt, Yersinia pestis
auauaacagccauuuau

SEQ ID NO: 4146508 - RNA, 18 nt, Yersinia pestis
auauaacugcgaccaaaa

SEQ ID NO: 4146509 - RNA, 13 nt, Yersinia pestis
auauaagagaaau

SEQ ID NO: 4146510 - RNA, 20 nt, Yersinia pestis
auauaagagaugaaauuuua

SEQ ID NO: 4146511 - RNA, 21 nt, Yersinia pestis
auauaagauuccuuaccugau

SEQ ID NO: 4146512 - RNA, 18 nt, Yersinia pestis
auauaauacgaaauacuu

SEQ ID NO: 4146513 - RNA, 13 nt, Yersinia pestis
auauaauagcugg

SEQ ID NO: 4146514 - RNA, 14 nt, Yersinia pestis
auauaauucaauau

SEQ ID NO: 4146515 - RNA, 20 nt, Yersinia pestis
auauaauugaagauuuaaau

SEQ ID NO: 4146516 - RNA, 14 nt, Yersinia pestis
auauacccaccaga

SEQ ID NO: 4146517 - RNA, 17 nt, Yersinia pestis
auauacccgacuaaucu

SEQ ID NO: 4146518 - RNA, 19 nt, Yersinia pestis
auauacccguaauauuuca

SEQ ID NO: 4146519 - RNA, 22 nt, Yersinia pestis
auauacccgucauaaauaaaga

SEQ ID NO: 4146520 - RNA, 22 nt, Yersinia pestis
auauaccggggaagagauaaau

SEQ ID NO: 4146521 - RNA, 21 nt, Yersinia pestis
auauacggcggcuacugguag

SEQ ID NO: 4146522 - RNA, 14 nt, Yersinia pestis
auauagagaaaucu

SEQ ID NO: 4146523 - RNA, 13 nt, Yersinia pestis
auauagagcucag

SEQ ID NO: 4146524 - RNA, 17 nt, Yersinia pestis
auauagcaaucauuuau

SEQ ID NO: 4146525 - RNA, 23 nt, Yersinia pestis
auauaggccauguacuuaauacu

SEQ ID NO: 4146526 - RNA, 13 nt, Yersinia pestis
auauaggcgucau

SEQ ID NO: 4146527 - RNA, 20 nt, Yersinia pestis
auauaggguauaugccuaua

SEQ ID NO: 4146528 - RNA, 16 nt, Yersinia pestis
auauaguaacuauuua

SEQ ID NO: 4146529 - RNA, 22 nt, Yersinia pestis
auauauacaauccaaccuauau

SEQ ID NO: 4146530 - RNA, 21 nt, Yersinia pestis
auauauacccguaauauuuca

SEQ ID NO: 4146531 - RNA, 13 nt, Yersinia pestis
auauauagaaaua

SEQ ID NO: 4146532 - RNA, 15 nt, Yersinia pestis
auauauagagaaauc

SEQ ID NO: 4146533 - RNA, 19 nt, Yersinia pestis
auauauccaggcacugcca

SEQ ID NO: 4146534 - RNA, 19 nt, Yersinia pestis
auauauuaaaugagaauaa

SEQ ID NO: 4146535 - RNA, 22 nt, Yersinia pestis
auauauugcucuaugccgcuau

SEQ ID NO: 4146536 - RNA, 15 nt, Yersinia pestis
auaucaaaacuccau

SEQ ID NO: 4146537 - RNA, 16 nt, Yersinia pestis
auaucaaaauaaaaau

SEQ ID NO: 4146538 - RNA, 21 nt, Yersinia pestis
auaucaaaauaaaaauucaca

SEQ ID NO: 4146539 - RNA, 14 nt, Yersinia pestis
auaucaaauuugca

SEQ ID NO: 4146540 - RNA, 22 nt, Yersinia pestis
auaucaagacucaguaaauaua

SEQ ID NO: 4146541 - RNA, 19 nt, Yersinia pestis
auaucaagucuugaagagu

SEQ ID NO: 4146542 - RNA, 23 nt, Yersinia pestis
auaucaauaagugcaaacuuaaa

SEQ ID NO: 4146543 - RNA, 15 nt, Yersinia pestis
auaucaaugaaaaaa

SEQ ID NO: 4146544 - RNA, 19 nt, Yersinia pestis
auaucaaugcaacuggcau

SEQ ID NO: 4146545 - RNA, 20 nt, Yersinia pestis
auaucacaguuaaaaauaga

SEQ ID NO: 4146546 - RNA, 13 nt, Yersinia pestis
auaucaccagguu

SEQ ID NO: 4146547 - RNA, 13 nt, Yersinia pestis
auaucacuucugc

SEQ ID NO: 4146548 - RNA, 15 nt, Yersinia pestis
auaucaucagcagag

SEQ ID NO: 4146549 - RNA, 17 nt, Yersinia pestis
auaucaucuuuuucugc

SEQ ID NO: 4146550 - RNA, 13 nt, Yersinia pestis
auaucauuauuuu

SEQ ID NO: 4146551 - RNA, 13 nt, Yersinia pestis
auauccaaaauaa

SEQ ID NO: 4146552 - RNA, 16 nt, Yersinia pestis
auauccaaaauaauuc

SEQ ID NO: 4146553 - RNA, 14 nt, Yersinia pestis
auauccacauugga

SEQ ID NO: 4146554 - RNA, 23 nt, Yersinia pestis
auauccagcaacgaauaaaaaag

SEQ ID NO: 4146555 - RNA, 17 nt, Yersinia pestis
auaucccgagaaacaaa

SEQ ID NO: 4146556 - RNA, 18 nt, Yersinia pestis
auaucccgagaaacaaaa

SEQ ID NO: 4146557 - RNA, 22 nt, Yersinia pestis
auaucccgagaaacaaaaccaa

SEQ ID NO: 4146558 - RNA, 17 nt, Yersinia pestis
auauccgccaaagauua

SEQ ID NO: 4146559 - RNA, 10 nt, Yersinia pestis
auauccuccg

SEQ ID NO: 4146560 - RNA, 17 nt, Yersinia pestis
auauccugcucagcuaa

SEQ ID NO: 4146561 - RNA, 15 nt, Yersinia pestis
auaucgaugacagca

SEQ ID NO: 4146562 - RNA, 19 nt, Yersinia pestis
auaucgccacggauaaggu

SEQ ID NO: 4146563 - RNA, 16 nt, Yersinia pestis
auaucgcuaaaacaca

SEQ ID NO: 4146564 - RNA, 15 nt, Yersinia pestis
auaucgguaaaaaau

SEQ ID NO: 4146565 - RNA, 13 nt, Yersinia pestis
auaucuaacugau

SEQ ID NO: 4146566 - RNA, 21 nt, Yersinia pestis
auaucuaaguccaagacagaa

SEQ ID NO: 4146567 - RNA, 21 nt, Yersinia pestis
auaucuaauuuauaaccuuuu

SEQ ID NO: 4146568 - RNA, 20 nt, Yersinia pestis
auaucuagcaacacaucggu

SEQ ID NO: 4146569 - RNA, 13 nt, Yersinia pestis
auaucuauuucca

SEQ ID NO: 4146570 - RNA, 18 nt, Yersinia pestis
auaucucaccgccaauau

SEQ ID NO: 4146571 - RNA, 16 nt, Yersinia pestis
auaucucaguugaaac

SEQ ID NO: 4146572 - RNA, 21 nt, Yersinia pestis
auaucucggugugacuuucaa

SEQ ID NO: 4146573 - RNA, 21 nt, Yersinia pestis
auaucucuacggcauguugca

SEQ ID NO: 4146574 - RNA, 12 nt, Yersinia pestis
auaucucuuuau

SEQ ID NO: 4146575 - RNA, 13 nt, Yersinia pestis
auaucucuuuauc

SEQ ID NO: 4146576 - RNA, 19 nt, Yersinia pestis
auaucugccaauucaaggc

SEQ ID NO: 4146577 - RNA, 21 nt, Yersinia pestis
auaucugccgcucgcgaggug

SEQ ID NO: 4146578 - RNA, 20 nt, Yersinia pestis
auaucugcggugaucaccag

SEQ ID NO: 4146579 - RNA, 14 nt, Yersinia pestis
auaucuucaaucag

SEQ ID NO: 4146580 - RNA, 17 nt, Yersinia pestis
auaucuugaaccaauuu

SEQ ID NO: 4146581 - RNA, 21 nt, Yersinia pestis
auaucuugaaccaauuuuucu

SEQ ID NO: 4146582 - RNA, 18 nt, Yersinia pestis
auaucuuucaaguccugc

SEQ ID NO: 4146583 - RNA, 14 nt, Yersinia pestis
auaugaaaaaccuc

SEQ ID NO: 4146584 - RNA, 16 nt, Yersinia pestis
auaugaaauuucacug

SEQ ID NO: 4146585 - RNA, 16 nt, Yersinia pestis
auaugagcgaggaggu

SEQ ID NO: 4146586 - RNA, 17 nt, Yersinia pestis
auaugauaauaguucau

SEQ ID NO: 4146587 - RNA, 17 nt, Yersinia pestis
auaugauaguguaaaaa

SEQ ID NO: 4146588 - RNA, 16 nt, Yersinia pestis
auaugaucaguggggu

SEQ ID NO: 4146589 - RNA, 14 nt, Yersinia pestis
auaugcaaaaaaag

SEQ ID NO: 4146590 - RNA, 20 nt, Yersinia pestis
auaugcagcauccagcucau

SEQ ID NO: 4146591 - RNA, 14 nt, Yersinia pestis
auaugccaggcauc

SEQ ID NO: 4146592 - RNA, 20 nt, Yersinia pestis
auaugcgccuauaaggcucu

SEQ ID NO: 4146593 - RNA, 22 nt, Yersinia pestis
auaugcgcuggcucuauuuucc

SEQ ID NO: 4146594 - RNA, 12 nt, Yersinia pestis
auaugcugaaua

SEQ ID NO: 4146595 - RNA, 16 nt, Yersinia pestis
auaugcugauaaaauu

SEQ ID NO: 4146596 - RNA, 15 nt, Yersinia pestis
auaugcuucaucacu

SEQ ID NO: 4146597 - RNA, 16 nt, Yersinia pestis
auaugcuucaucacuu

SEQ ID NO: 4146598 - RNA, 22 nt, Yersinia pestis
auauggaugaugcacagcugga

SEQ ID NO: 4146599 - RNA, 15 nt, Yersinia pestis
auauggguuaaaaac

SEQ ID NO: 4146600 - RNA, 15 nt, Yersinia pestis
auauggguuaaugcu

SEQ ID NO: 4146601 - RNA, 23 nt, Yersinia pestis
auauguagcagcaccauacagca

SEQ ID NO: 4146602 - RNA, 20 nt, Yersinia pestis
auauguagggguacagcagg

SEQ ID NO: 4146603 - RNA, 14 nt, Yersinia pestis
auaugucaccucca

SEQ ID NO: 4146604 - RNA, 16 nt, Yersinia pestis
auauguucuuccugug

SEQ ID NO: 4146605 - RNA, 19 nt, Yersinia pestis
auauguugggaaauaacca

SEQ ID NO: 4146606 - RNA, 12 nt, Yersinia pestis
auauuaaaugca

SEQ ID NO: 4146607 - RNA, 15 nt, Yersinia pestis
auauuaaaugcauua

SEQ ID NO: 4146608 - RNA, 18 nt, Yersinia pestis
auauuaacauaucaauaa

SEQ ID NO: 4146609 - RNA, 15 nt, Yersinia pestis
auauuaauaucagcg

SEQ ID NO: 4146610 - RNA, 16 nt, Yersinia pestis
auauuacaguuuaauu

SEQ ID NO: 4146611 - RNA, 12 nt, Yersinia pestis
auauuaccgcug

SEQ ID NO: 4146612 - RNA, 21 nt, Yersinia pestis
auauuacggcccuccugacga

SEQ ID NO: 4146613 - RNA, 15 nt, Yersinia pestis
auauuagguauuaag

SEQ ID NO: 4146614 - RNA, 15 nt, Yersinia pestis
auauuauuaaugaaa

SEQ ID NO: 4146615 - RNA, 15 nt, Yersinia pestis
auauuauuagccaaa

SEQ ID NO: 4146616 - RNA, 21 nt, Yersinia pestis
auauuauugacgguuacagcg

SEQ ID NO: 4146617 - RNA, 24 nt, Yersinia pestis
auauuauuuaauuaaauguauaaa

SEQ ID NO: 4146618 - RNA, 21 nt, Yersinia pestis
auauuauuuacaaaccacauu

SEQ ID NO: 4146619 - RNA, 22 nt, Yersinia pestis
auauuauuuaucaaucagcuga

SEQ ID NO: 4146620 - RNA, 12 nt, Yersinia pestis
auauucaccaca

SEQ ID NO: 4146621 - RNA, 20 nt, Yersinia pestis
auauucaccacacauaccac

SEQ ID NO: 4146622 - RNA, 19 nt, Yersinia pestis
auauucaccaccauuaaca

SEQ ID NO: 4146623 - RNA, 22 nt, Yersinia pestis
auauucaccaccauuaacaagc

SEQ ID NO: 4146624 - RNA, 20 nt, Yersinia pestis
auauucacguuuuuccauuc

SEQ ID NO: 4146625 - RNA, 14 nt, Yersinia pestis
auauucauauuucu

SEQ ID NO: 4146626 - RNA, 13 nt, Yersinia pestis
auauucauuaaaa

SEQ ID NO: 4146627 - RNA, 14 nt, Yersinia pestis
auauucauuaaaaa

SEQ ID NO: 4146628 - RNA, 19 nt, Yersinia pestis
auauucauuaaaaaauaau

SEQ ID NO: 4146629 - RNA, 20 nt, Yersinia pestis
auauucauuaaaaaauaauu

SEQ ID NO: 4146630 - RNA, 12 nt, Yersinia pestis
auauuccuaauu

SEQ ID NO: 4146631 - RNA, 14 nt, Yersinia pestis
auauucgcagccaa

SEQ ID NO: 4146632 - RNA, 20 nt, Yersinia pestis
auauucgcagccaaaauaau

SEQ ID NO: 4146633 - RNA, 15 nt, Yersinia pestis
auauucgugaucaaa

SEQ ID NO: 4146634 - RNA, 13 nt, Yersinia pestis
auauucucaauau

SEQ ID NO: 4146635 - RNA, 15 nt, Yersinia pestis
auauucucauugccc

SEQ ID NO: 4146636 - RNA, 23 nt, Yersinia pestis
auauugacacgaaucccuaacga

SEQ ID NO: 4146637 - RNA, 15 nt, Yersinia pestis
auauugagaaucagu

SEQ ID NO: 4146638 - RNA, 18 nt, Yersinia pestis
auauugauaaaaaucaau

SEQ ID NO: 4146639 - RNA, 17 nt, Yersinia pestis
auauugauaaaaguaau

SEQ ID NO: 4146640 - RNA, 21 nt, Yersinia pestis
auauugauaauggcauuuuca

SEQ ID NO: 4146641 - RNA, 18 nt, Yersinia pestis
auauugauagccacauca

SEQ ID NO: 4146642 - RNA, 20 nt, Yersinia pestis
auauugauccaaauggcugc

SEQ ID NO: 4146643 - RNA, 16 nt, Yersinia pestis
auauugccaucgggca

SEQ ID NO: 4146644 - RNA, 12 nt, Yersinia pestis
auauugcucagu

SEQ ID NO: 4146645 - RNA, 16 nt, Yersinia pestis
auauugcucugccgca

SEQ ID NO: 4146646 - RNA, 18 nt, Yersinia pestis
auauuggauaauaaccug

SEQ ID NO: 4146647 - RNA, 23 nt, Yersinia pestis
auauuggcaacaacagauaaagc

SEQ ID NO: 4146648 - RNA, 19 nt, Yersinia pestis
auauuggcaauauucagua

SEQ ID NO: 4146649 - RNA, 19 nt, Yersinia pestis
auauuggccgucagcagau

SEQ ID NO: 4146650 - RNA, 19 nt, Yersinia pestis
auauugggccggagauaga

SEQ ID NO: 4146651 - RNA, 22 nt, Yersinia pestis
auauuggggggcaguuuuuuau

SEQ ID NO: 4146652 - RNA, 21 nt, Yersinia pestis
auauuggucauuuuucccuuc

SEQ ID NO: 4146653 - RNA, 17 nt, Yersinia pestis
auauuguuuugacuaaa

SEQ ID NO: 4146654 - RNA, 13 nt, Yersinia pestis
auauuuaaagccu

SEQ ID NO: 4146655 - RNA, 15 nt, Yersinia pestis
auauuuaauuuaaau

SEQ ID NO: 4146656 - RNA, 17 nt, Yersinia pestis
auauuuaauuuaaauaa

SEQ ID NO: 4146657 - RNA, 19 nt, Yersinia pestis
auauuuaucugcauuaaaa

SEQ ID NO: 4146658 - RNA, 22 nt, Yersinia pestis
auauuuaucugcauuaaaauaa

SEQ ID NO: 4146659 - RNA, 15 nt, Yersinia pestis
auauuuauuaauucu

SEQ ID NO: 4146660 - RNA, 15 nt, Yersinia pestis
auauuuauugccaac

SEQ ID NO: 4146661 - RNA, 13 nt, Yersinia pestis
auauuuauuuuua

SEQ ID NO: 4146662 - RNA, 14 nt, Yersinia pestis
auauuuauuuuuau

SEQ ID NO: 4146663 - RNA, 16 nt, Yersinia pestis
auauuuauuuuuucuu

SEQ ID NO: 4146664 - RNA, 23 nt, Yersinia pestis
auauuuauuuuuuuggcagauau

SEQ ID NO: 4146665 - RNA, 22 nt, Yersinia pestis
auauuucacguucaucaauacc

SEQ ID NO: 4146666 - RNA, 20 nt, Yersinia pestis
auauuucgcccugcauauca

SEQ ID NO: 4146667 - RNA, 21 nt, Yersinia pestis
auauuucgguaggaauaaggu

SEQ ID NO: 4146668 - RNA, 21 nt, Yersinia pestis
auauuugcugccugcaccagu

SEQ ID NO: 4146669 - RNA, 20 nt, Yersinia pestis
auauuugggucgguaaccug

SEQ ID NO: 4146670 - RNA, 19 nt, Yersinia pestis
auauuuguuugaauuuuag

SEQ ID NO: 4146671 - RNA, 13 nt, Yersinia pestis
auauuuuagcaau

SEQ ID NO: 4146672 - RNA, 23 nt, Yersinia pestis
auauuuuaugcccccuauuaugc

SEQ ID NO: 4146673 - RNA, 13 nt, Yersinia pestis
auauuuuccugca

SEQ ID NO: 4146674 - RNA, 20 nt, Yersinia pestis
auauuuugaauauuuuuaau

SEQ ID NO: 4146675 - RNA, 19 nt, Yersinia pestis
auauuuugcuuuaaauuca

SEQ ID NO: 4146676 - RNA, 13 nt, Yersinia pestis
auauuuuuaaucu

SEQ ID NO: 4146677 - RNA, 23 nt, Yersinia pestis
auauuuuuggggucugaauauaa

SEQ ID NO: 4146678 - RNA, 13 nt, Yersinia pestis
aucaaaaaauaaa

SEQ ID NO: 4146679 - RNA, 21 nt, Yersinia pestis
aucaaaacggaugaugccgau

SEQ ID NO: 4146680 - RNA, 15 nt, Yersinia pestis
aucaaaagcaagacc

SEQ ID NO: 4146681 - RNA, 21 nt, Yersinia pestis
aucaaaagggaucaccaggcu

SEQ ID NO: 4146682 - RNA, 14 nt, Yersinia pestis
aucaaacauaaaaa

SEQ ID NO: 4146683 - RNA, 16 nt, Yersinia pestis
aucaaacggcaacuuc

SEQ ID NO: 4146684 - RNA, 16 nt, Yersinia pestis
aucaaacggcuuuuua

SEQ ID NO: 4146685 - RNA, 20 nt, Yersinia pestis
aucaaacggcuuuuuaaacu

SEQ ID NO: 4146686 - RNA, 20 nt, Yersinia pestis
aucaaacucaccauuauguu

SEQ ID NO: 4146687 - RNA, 16 nt, Yersinia pestis
aucaaaggagugcccg

SEQ ID NO: 4146688 - RNA, 18 nt, Yersinia pestis
aucaaaggcaauaccggu

SEQ ID NO: 4146689 - RNA, 17 nt, Yersinia pestis
aucaaaggcgaccaaug

SEQ ID NO: 4146690 - RNA, 20 nt, Yersinia pestis
aucaaaggcgaccaaugggg

SEQ ID NO: 4146691 - RNA, 22 nt, Yersinia pestis
aucaaagugcuuaacccaccaa

SEQ ID NO: 4146692 - RNA, 16 nt, Yersinia pestis
aucaaaucauacgcag

SEQ ID NO: 4146693 - RNA, 15 nt, Yersinia pestis
aucaacacauaaaau

SEQ ID NO: 4146694 - RNA, 17 nt, Yersinia pestis
aucaacagauaugcauu

SEQ ID NO: 4146695 - RNA, 14 nt, Yersinia pestis
aucaacauacugau

SEQ ID NO: 4146696 - RNA, 20 nt, Yersinia pestis
aucaacaugguccacaguca

SEQ ID NO: 4146697 - RNA, 20 nt, Yersinia pestis
aucaacauuccauaccugaa

SEQ ID NO: 4146698 - RNA, 23 nt, Yersinia pestis
aucaaccacgguuuaaucaaugu

SEQ ID NO: 4146699 - RNA, 14 nt, Yersinia pestis
aucaacccgcagac

SEQ ID NO: 4146700 - RNA, 22 nt, Yersinia pestis
aucaacccgcagacugaaauaa

SEQ ID NO: 4146701 - RNA, 20 nt, Yersinia pestis
aucaaccgggauaucaaauu

SEQ ID NO: 4146702 - RNA, 14 nt, Yersinia pestis
aucaaccucagccu

SEQ ID NO: 4146703 - RNA, 16 nt, Yersinia pestis
aucaaccucagccuca

SEQ ID NO: 4146704 - RNA, 22 nt, Yersinia pestis
aucaaccucagccucauucaug

SEQ ID NO: 4146705 - RNA, 16 nt, Yersinia pestis
aucaaccugaucauca

SEQ ID NO: 4146706 - RNA, 22 nt, Yersinia pestis
aucaacgccguauuuuauaucu

SEQ ID NO: 4146707 - RNA, 17 nt, Yersinia pestis
aucaacgcucaaucacg

SEQ ID NO: 4146708 - RNA, 17 nt, Yersinia pestis
aucaacucgccacccgc

SEQ ID NO: 4146709 - RNA, 23 nt, Yersinia pestis
aucaacucgccacccgcuuucag

SEQ ID NO: 4146710 - RNA, 18 nt, Yersinia pestis
aucaacuuucaccccuuu

SEQ ID NO: 4146711 - RNA, 23 nt, Yersinia pestis
aucaacuuucaccccuuucuugc

SEQ ID NO: 4146712 - RNA, 21 nt, Yersinia pestis
aucaagacucaguaaauauaa

SEQ ID NO: 4146713 - RNA, 13 nt, Yersinia pestis
aucaagaucaaaa

SEQ ID NO: 4146714 - RNA, 13 nt, Yersinia pestis
aucaagcccauga

SEQ ID NO: 4146715 - RNA, 14 nt, Yersinia pestis
aucaagcuacaugu

SEQ ID NO: 4146716 - RNA, 14 nt, Yersinia pestis
aucaaggauaagca

SEQ ID NO: 4146717 - RNA, 19 nt, Yersinia pestis
aucaaggcggcagagccaa

SEQ ID NO: 4146718 - RNA, 18 nt, Yersinia pestis
aucaaggcuuuaauaucu

SEQ ID NO: 4146719 - RNA, 16 nt, Yersinia pestis
aucaaguacacugcac

SEQ ID NO: 4146720 - RNA, 16 nt, Yersinia pestis
aucaaguacuucaauu

SEQ ID NO: 4146721 - RNA, 16 nt, Yersinia pestis
aucaagucuugaagag

SEQ ID NO: 4146722 - RNA, 21 nt, Yersinia pestis
aucaagugaaccaucaaggac

SEQ ID NO: 4146723 - RNA, 19 nt, Yersinia pestis
aucaaguuagcaggcagca

SEQ ID NO: 4146724 - RNA, 18 nt, Yersinia pestis
aucaaguugaaugaagcg

SEQ ID NO: 4146725 - RNA, 18 nt, Yersinia pestis
aucaauaaacucuuucau

SEQ ID NO: 4146726 - RNA, 16 nt, Yersinia pestis
aucaauaaagccauuu

SEQ ID NO: 4146727 - RNA, 14 nt, Yersinia pestis
aucaauaagcuaca

SEQ ID NO: 4146728 - RNA, 20 nt, Yersinia pestis
aucaauaagugcaaacuuaa

SEQ ID NO: 4146729 - RNA, 13 nt, Yersinia pestis
aucaauaccaaua

SEQ ID NO: 4146730 - RNA, 17 nt, Yersinia pestis
aucaauaccaauaaaac

SEQ ID NO: 4146731 - RNA, 16 nt, Yersinia pestis
aucaauacccugccac

SEQ ID NO: 4146732 - RNA, 12 nt, Yersinia pestis
aucaauaccgaa

SEQ ID NO: 4146733 - RNA, 13 nt, Yersinia pestis
aucaauaccuuac

SEQ ID NO: 4146734 - RNA, 14 nt, Yersinia pestis
aucaauaccuuacu

SEQ ID NO: 4146735 - RNA, 16 nt, Yersinia pestis
aucaauaccuuacugc

SEQ ID NO: 4146736 - RNA, 17 nt, Yersinia pestis
aucaauacuguuaucac

SEQ ID NO: 4146737 - RNA, 14 nt, Yersinia pestis
aucaauaggucagu

SEQ ID NO: 4146738 - RNA, 17 nt, Yersinia pestis
aucaauagguguugccg

SEQ ID NO: 4146739 - RNA, 19 nt, Yersinia pestis
aucaauauaacgcccggca

SEQ ID NO: 4146740 - RNA, 23 nt, Yersinia pestis
aucaauaucccgagaaacaaaac

SEQ ID NO: 4146741 - RNA, 16 nt, Yersinia pestis
aucaaucagcggagcu

SEQ ID NO: 4146742 - RNA, 20 nt, Yersinia pestis
aucaaucagcggggcauuca

SEQ ID NO: 4146743 - RNA, 13 nt, Yersinia pestis
aucaaucagcuga

SEQ ID NO: 4146744 - RNA, 19 nt, Yersinia pestis
aucaaucagcugauaugaa

SEQ ID NO: 4146745 - RNA, 22 nt, Yersinia pestis
aucaaucagcugauaugaaaaa

SEQ ID NO: 4146746 - RNA, 16 nt, Yersinia pestis
aucaaucucuucaugg

SEQ ID NO: 4146747 - RNA, 12 nt, Yersinia pestis
aucaaugaaaau

SEQ ID NO: 4146748 - RNA, 20 nt, Yersinia pestis
aucaaugaccacuaaauuaa

SEQ ID NO: 4146749 - RNA, 14 nt, Yersinia pestis
aucaaugcaacugg

SEQ ID NO: 4146750 - RNA, 17 nt, Yersinia pestis
aucaauggcaccucauc

SEQ ID NO: 4146751 - RNA, 15 nt, Yersinia pestis
aucaauggccagcgg

SEQ ID NO: 4146752 - RNA, 15 nt, Yersinia pestis
aucaauguuggccca

SEQ ID NO: 4146753 - RNA, 17 nt, Yersinia pestis
aucaauuaaucaauuaa

SEQ ID NO: 4146754 - RNA, 13 nt, Yersinia pestis
aucacaacccccc

SEQ ID NO: 4146755 - RNA, 12 nt, Yersinia pestis
aucacaauacag

SEQ ID NO: 4146756 - RNA, 17 nt, Yersinia pestis
aucacaauacagcaaau

SEQ ID NO: 4146757 - RNA, 20 nt, Yersinia pestis
aucacaccgcgaucacaaua

SEQ ID NO: 4146758 - RNA, 13 nt, Yersinia pestis
aucacacuggugc

SEQ ID NO: 4146759 - RNA, 13 nt, Yersinia pestis
aucacagcaaauu

SEQ ID NO: 4146760 - RNA, 22 nt, Yersinia pestis
aucacaucgcccugcucuucug

SEQ ID NO: 4146761 - RNA, 17 nt, Yersinia pestis
aucacaucggcgacuuu

SEQ ID NO: 4146762 - RNA, 13 nt, Yersinia pestis
aucacaucuugca

SEQ ID NO: 4146763 - RNA, 16 nt, Yersinia pestis
aucacaugcggauuga

SEQ ID NO: 4146764 - RNA, 13 nt, Yersinia pestis
aucacaugcucag

SEQ ID NO: 4146765 - RNA, 14 nt, Yersinia pestis
aucacauuucaaau

SEQ ID NO: 4146766 - RNA, 22 nt, Yersinia pestis
aucaccaaacagcuucgccacc

SEQ ID NO: 4146767 - RNA, 18 nt, Yersinia pestis
aucaccauaacugcugcu

SEQ ID NO: 4146768 - RNA, 14 nt, Yersinia pestis
aucaccauauucau

SEQ ID NO: 4146769 - RNA, 13 nt, Yersinia pestis
aucaccaugccuu

SEQ ID NO: 4146770 - RNA, 15 nt, Yersinia pestis
aucaccauucaagau

SEQ ID NO: 4146771 - RNA, 15 nt, Yersinia pestis
aucacccagcaaaau

SEQ ID NO: 4146772 - RNA, 18 nt, Yersinia pestis
aucacccauaaaugggau

SEQ ID NO: 4146773 - RNA, 12 nt, Yersinia pestis
aucaccccccug

SEQ ID NO: 4146774 - RNA, 14 nt, Yersinia pestis
aucaccccccugcc

SEQ ID NO: 4146775 - RNA, 17 nt, Yersinia pestis
aucacccgccucuaaau

SEQ ID NO: 4146776 - RNA, 23 nt, Yersinia pestis
aucacccggccaucuucagaaac

SEQ ID NO: 4146777 - RNA, 15 nt, Yersinia pestis
aucaccgaaagaaga

SEQ ID NO: 4146778 - RNA, 21 nt, Yersinia pestis
aucaccgccggauuucaaucc

SEQ ID NO: 4146779 - RNA, 15 nt, Yersinia pestis
aucaccugacaccaa

SEQ ID NO: 4146780 - RNA, 15 nt, Yersinia pestis
aucaccugucaccug

SEQ ID NO: 4146781 - RNA, 20 nt, Yersinia pestis
aucaccuuggaaaacagcaa

SEQ ID NO: 4146782 - RNA, 18 nt, Yersinia pestis
aucaccuuggauggcgaa

SEQ ID NO: 4146783 - RNA, 14 nt, Yersinia pestis
aucacgauccauac

SEQ ID NO: 4146784 - RNA, 19 nt, Yersinia pestis
aucacgcaaugccaguaca

SEQ ID NO: 4146785 - RNA, 19 nt, Yersinia pestis
aucacgcagcuuuuucuca

SEQ ID NO: 4146786 - RNA, 20 nt, Yersinia pestis
aucacgcagcuuuuucucac

SEQ ID NO: 4146787 - RNA, 15 nt, Yersinia pestis
aucacggguuuuucc

SEQ ID NO: 4146788 - RNA, 20 nt, Yersinia pestis
aucacguauugccucggcaa

SEQ ID NO: 4146789 - RNA, 17 nt, Yersinia pestis
aucacuagggggcaauu

SEQ ID NO: 4146790 - RNA, 13 nt, Yersinia pestis
aucacuauaauua

SEQ ID NO: 4146791 - RNA, 20 nt, Yersinia pestis
aucacuauaauuauuucucu

SEQ ID NO: 4146792 - RNA, 14 nt, Yersinia pestis
aucacuauuucaga

SEQ ID NO: 4146793 - RNA, 14 nt, Yersinia pestis
aucacuauuucagg

SEQ ID NO: 4146794 - RNA, 15 nt, Yersinia pestis
aucacuauuucaggc

SEQ ID NO: 4146795 - RNA, 13 nt, Yersinia pestis
aucacugaaagug

SEQ ID NO: 4146796 - RNA, 16 nt, Yersinia pestis
aucacugacugagcgu

SEQ ID NO: 4146797 - RNA, 18 nt, Yersinia pestis
aucacugaugagcuggca

SEQ ID NO: 4146798 - RNA, 16 nt, Yersinia pestis
aucacugauucagaaa

SEQ ID NO: 4146799 - RNA, 19 nt, Yersinia pestis
aucacugauucagaaaggu

SEQ ID NO: 4146800 - RNA, 22 nt, Yersinia pestis
aucacuggaggcguuuuuauug

SEQ ID NO: 4146801 - RNA, 16 nt, Yersinia pestis
aucacuggcauugcau

SEQ ID NO: 4146802 - RNA, 21 nt, Yersinia pestis
aucacuggcgggccguuuacu

SEQ ID NO: 4146803 - RNA, 16 nt, Yersinia pestis
aucacuuauuggaagu

SEQ ID NO: 4146804 - RNA, 23 nt, Yersinia pestis
aucacuuauuggaaguacuuauu

SEQ ID NO: 4146805 - RNA, 23 nt, Yersinia pestis
aucacuucacuugcaugccuggc

SEQ ID NO: 4146806 - RNA, 16 nt, Yersinia pestis
aucacuucugcugcca

SEQ ID NO: 4146807 - RNA, 20 nt, Yersinia pestis
aucacuugccagagcaauaa

SEQ ID NO: 4146808 - RNA, 21 nt, Yersinia pestis
aucacuugccagagcaauaac

SEQ ID NO: 4146809 - RNA, 22 nt, Yersinia pestis
aucacuugcuggcggcuuuuau

SEQ ID NO: 4146810 - RNA, 14 nt, Yersinia pestis
aucagaaacagcag

SEQ ID NO: 4146811 - RNA, 17 nt, Yersinia pestis
aucagaaacagcaggug

SEQ ID NO: 4146812 - RNA, 17 nt, Yersinia pestis
aucagacacguaaaaca

SEQ ID NO: 4146813 - RNA, 15 nt, Yersinia pestis
aucagacauuuuucu

SEQ ID NO: 4146814 - RNA, 17 nt, Yersinia pestis
aucagaccuuuacagga

SEQ ID NO: 4146815 - RNA, 21 nt, Yersinia pestis
aucagaccuuuacaggacuga

SEQ ID NO: 4146816 - RNA, 19 nt, Yersinia pestis
aucagaccuuuaggaaagc

SEQ ID NO: 4146817 - RNA, 19 nt, Yersinia pestis
aucagacggcagcaacgaa

SEQ ID NO: 4146818 - RNA, 17 nt, Yersinia pestis
aucagacugcugacaac

SEQ ID NO: 4146819 - RNA, 19 nt, Yersinia pestis
aucagagucugucauggca

SEQ ID NO: 4146820 - RNA, 19 nt, Yersinia pestis
aucagauacggcuccagaa

SEQ ID NO: 4146821 - RNA, 21 nt, Yersinia pestis
aucagauuguuuauaaauuaa

SEQ ID NO: 4146822 - RNA, 23 nt, Yersinia pestis
aucagauuguuuauaaauuaaaa

SEQ ID NO: 4146823 - RNA, 17 nt, Yersinia pestis
aucagcaagugauagau

SEQ ID NO: 4146824 - RNA, 17 nt, Yersinia pestis
aucagcacauccaugcc

SEQ ID NO: 4146825 - RNA, 14 nt, Yersinia pestis
aucagcagagagcg

SEQ ID NO: 4146826 - RNA, 22 nt, Yersinia pestis
aucagcagagagcgacucacga

SEQ ID NO: 4146827 - RNA, 16 nt, Yersinia pestis
aucagcaucaauaaaa

SEQ ID NO: 4146828 - RNA, 17 nt, Yersinia pestis
aucagcaucaauaaaau

SEQ ID NO: 4146829 - RNA, 13 nt, Yersinia pestis
aucagccagcgaa

SEQ ID NO: 4146830 - RNA, 14 nt, Yersinia pestis
aucagccauaucaa

SEQ ID NO: 4146831 - RNA, 16 nt, Yersinia pestis
aucagcccauugcugu

SEQ ID NO: 4146832 - RNA, 13 nt, Yersinia pestis
aucagcgaaaaau

SEQ ID NO: 4146833 - RNA, 15 nt, Yersinia pestis
aucagcgauagcugc

SEQ ID NO: 4146834 - RNA, 18 nt, Yersinia pestis
aucagcgcccuacugcau

SEQ ID NO: 4146835 - RNA, 15 nt, Yersinia pestis
aucagcgccugcugu

SEQ ID NO: 4146836 - RNA, 17 nt, Yersinia pestis
aucagcgccuuugcccc

SEQ ID NO: 4146837 - RNA, 23 nt, Yersinia pestis
aucagcgccuuugccccgauuug

SEQ ID NO: 4146838 - RNA, 16 nt, Yersinia pestis
aucagcgcuggcuuuu

SEQ ID NO: 4146839 - RNA, 18 nt, Yersinia pestis
aucagcgguaucuagagc

SEQ ID NO: 4146840 - RNA, 20 nt, Yersinia pestis
aucagcguauagcgccgcca

SEQ ID NO: 4146841 - RNA, 17 nt, Yersinia pestis
aucagcguauggggaaa

SEQ ID NO: 4146842 - RNA, 19 nt, Yersinia pestis
aucagcguuuuaaucacau

SEQ ID NO: 4146843 - RNA, 14 nt, Yersinia pestis
aucaggaucaccag

SEQ ID NO: 4146844 - RNA, 16 nt, Yersinia pestis
aucaggcgcacgaaua

SEQ ID NO: 4146845 - RNA, 18 nt, Yersinia pestis
aucaggcgcacgaauauc

SEQ ID NO: 4146846 - RNA, 17 nt, Yersinia pestis
aucaggcuuauauuuau

SEQ ID NO: 4146847 - RNA, 19 nt, Yersinia pestis
aucaggcuuauauuuaugc

SEQ ID NO: 4146848 - RNA, 22 nt, Yersinia pestis
aucaggugaacguuggcuucac

SEQ ID NO: 4146849 - RNA, 20 nt, Yersinia pestis
aucagguuguccgaagagaa

SEQ ID NO: 4146850 - RNA, 14 nt, Yersinia pestis
aucaguaacgccgu

SEQ ID NO: 4146851 - RNA, 14 nt, Yersinia pestis
aucaguaccaccac

SEQ ID NO: 4146852 - RNA, 18 nt, Yersinia pestis
aucaguaccaccaccaca

SEQ ID NO: 4146853 - RNA, 16 nt, Yersinia pestis
aucaguagucaauaca

SEQ ID NO: 4146854 - RNA, 16 nt, Yersinia pestis
aucaguauuauaaaau

SEQ ID NO: 4146855 - RNA, 20 nt, Yersinia pestis
aucagugggauagagaucag

SEQ ID NO: 4146856 - RNA, 12 nt, Yersinia pestis
aucaguggguca

SEQ ID NO: 4146857 - RNA, 14 nt, Yersinia pestis
aucauaaaaauaca

SEQ ID NO: 4146858 - RNA, 18 nt, Yersinia pestis
aucauaaaaauacauauc

SEQ ID NO: 4146859 - RNA, 14 nt, Yersinia pestis
aucauaagugcauu

SEQ ID NO: 4146860 - RNA, 20 nt, Yersinia pestis
aucauaaugguaccggcacc

SEQ ID NO: 4146861 - RNA, 11 nt, Yersinia pestis
aucauauauua

SEQ ID NO: 4146862 - RNA, 13 nt, Yersinia pestis
aucauauauuaaa

SEQ ID NO: 4146863 - RNA, 14 nt, Yersinia pestis
aucauaucaaaaua

SEQ ID NO: 4146864 - RNA, 19 nt, Yersinia pestis
aucauaucaaaauaaaaau

SEQ ID NO: 4146865 - RNA, 19 nt, Yersinia pestis
aucauauguucgaucaaaa

SEQ ID NO: 4146866 - RNA, 21 nt, Yersinia pestis
aucauauuaacauaucaauaa

SEQ ID NO: 4146867 - RNA, 19 nt, Yersinia pestis
aucauauuaggcaggugaa

SEQ ID NO: 4146868 - RNA, 17 nt, Yersinia pestis
aucauauuuuccugcac

SEQ ID NO: 4146869 - RNA, 16 nt, Yersinia pestis
aucaucaaauucaggu

SEQ ID NO: 4146870 - RNA, 15 nt, Yersinia pestis
aucaucaagccaaug

SEQ ID NO: 4146871 - RNA, 14 nt, Yersinia pestis
aucaucaauacccu

SEQ ID NO: 4146872 - RNA, 15 nt, Yersinia pestis
aucaucaccauucaa

SEQ ID NO: 4146873 - RNA, 16 nt, Yersinia pestis
aucaucagacagccau

SEQ ID NO: 4146874 - RNA, 15 nt, Yersinia pestis
aucaucaggcaggua

SEQ ID NO: 4146875 - RNA, 18 nt, Yersinia pestis
aucaucagggaauugacu

SEQ ID NO: 4146876 - RNA, 14 nt, Yersinia pestis
aucaucaucccagu

SEQ ID NO: 4146877 - RNA, 22 nt, Yersinia pestis
aucaucaucgguaccgccagaa

SEQ ID NO: 4146878 - RNA, 14 nt, Yersinia pestis
aucaucaucuugaa

SEQ ID NO: 4146879 - RNA, 15 nt, Yersinia pestis
aucaucaucuuuaau

SEQ ID NO: 4146880 - RNA, 22 nt, Yersinia pestis
aucauccaagcuguuacuuacu

SEQ ID NO: 4146881 - RNA, 22 nt, Yersinia pestis
aucauccaguuuggcugccaug

SEQ ID NO: 4146882 - RNA, 16 nt, Yersinia pestis
aucauccauaaagacg

SEQ ID NO: 4146883 - RNA, 22 nt, Yersinia pestis
aucaucccagucgucuucagcu

SEQ ID NO: 4146884 - RNA, 18 nt, Yersinia pestis
aucauccgcucagcaaaa

SEQ ID NO: 4146885 - RNA, 18 nt, Yersinia pestis
aucaucgcaccauaacca

SEQ ID NO: 4146886 - RNA, 13 nt, Yersinia pestis
aucaucgcacugu

SEQ ID NO: 4146887 - RNA, 22 nt, Yersinia pestis
aucaucgccacuugaaacauuc

SEQ ID NO: 4146888 - RNA, 22 nt, Yersinia pestis
aucaucgcccuugucugggcug

SEQ ID NO: 4146889 - RNA, 17 nt, Yersinia pestis
aucaucgguaccgccag

SEQ ID NO: 4146890 - RNA, 14 nt, Yersinia pestis
aucaucguaguaau

SEQ ID NO: 4146891 - RNA, 14 nt, Yersinia pestis
aucaucuacaacau

SEQ ID NO: 4146892 - RNA, 17 nt, Yersinia pestis
aucaucuacaacaucau

SEQ ID NO: 4146893 - RNA, 21 nt, Yersinia pestis
aucaucugguuuuuuuauaaa

SEQ ID NO: 4146894 - RNA, 18 nt, Yersinia pestis
aucaucuuuaauaauaga

SEQ ID NO: 4146895 - RNA, 21 nt, Yersinia pestis
aucaugaacggauacccagca

SEQ ID NO: 4146896 - RNA, 22 nt, Yersinia pestis
aucaugaacggauacccagcac

SEQ ID NO: 4146897 - RNA, 20 nt, Yersinia pestis
aucaugaauaggauagacag

SEQ ID NO: 4146898 - RNA, 21 nt, Yersinia pestis
aucaugaguaaaagauucaua

SEQ ID NO: 4146899 - RNA, 15 nt, Yersinia pestis
aucaugccagcaaua

SEQ ID NO: 4146900 - RNA, 15 nt, Yersinia pestis
aucaugcucugcuaa

SEQ ID NO: 4146901 - RNA, 17 nt, Yersinia pestis
aucaugcugucauuggu

SEQ ID NO: 4146902 - RNA, 18 nt, Yersinia pestis
aucauggaagaccagaua

SEQ ID NO: 4146903 - RNA, 14 nt, Yersinia pestis
aucaugggccaauc

SEQ ID NO: 4146904 - RNA, 17 nt, Yersinia pestis
aucaugggccaauccaa

SEQ ID NO: 4146905 - RNA, 20 nt, Yersinia pestis
aucauguaaggcaauaccaa

SEQ ID NO: 4146906 - RNA, 15 nt, Yersinia pestis
aucauuaagaugcau

SEQ ID NO: 4146907 - RNA, 16 nt, Yersinia pestis
aucauuacaucaucuu

SEQ ID NO: 4146908 - RNA, 21 nt, Yersinia pestis
aucauuacguaaucccagaaa

SEQ ID NO: 4146909 - RNA, 20 nt, Yersinia pestis
aucauuauauauuuuuucau

SEQ ID NO: 4146910 - RNA, 13 nt, Yersinia pestis
aucauuauuaugu

SEQ ID NO: 4146911 - RNA, 21 nt, Yersinia pestis
aucauuauuauguauuuuuau

SEQ ID NO: 4146912 - RNA, 13 nt, Yersinia pestis
aucauuauugauu

SEQ ID NO: 4146913 - RNA, 13 nt, Yersinia pestis
aucauucaauugu

SEQ ID NO: 4146914 - RNA, 18 nt, Yersinia pestis
aucauucauuuuaaaaaa

SEQ ID NO: 4146915 - RNA, 16 nt, Yersinia pestis
aucauucgacggguuu

SEQ ID NO: 4146916 - RNA, 15 nt, Yersinia pestis
aucauugcucuggau

SEQ ID NO: 4146917 - RNA, 13 nt, Yersinia pestis
aucauuggcuuca

SEQ ID NO: 4146918 - RNA, 15 nt, Yersinia pestis
aucauuuauauagua

SEQ ID NO: 4146919 - RNA, 12 nt, Yersinia pestis
aucauuuuccug

SEQ ID NO: 4146920 - RNA, 16 nt, Yersinia pestis
aucauuuuuuaucuug

SEQ ID NO: 4146921 - RNA, 13 nt, Yersinia pestis
aucauuuuuuuau

SEQ ID NO: 4146922 - RNA, 20 nt, Yersinia pestis
aucauuuuuuuauuaaguuu

SEQ ID NO: 4146923 - RNA, 23 nt, Yersinia pestis
aucauuuuuuuauuaaguuuuuc

SEQ ID NO: 4146924 - RNA, 22 nt, Yersinia pestis
aucauuuuuuuccacccgcugc

SEQ ID NO: 4146925 - RNA, 14 nt, Yersinia pestis
auccaaaauaauuc

SEQ ID NO: 4146926 - RNA, 23 nt, Yersinia pestis
auccaacuuaccuugauccgcca

SEQ ID NO: 4146927 - RNA, 22 nt, Yersinia pestis
auccaagccaccaccacggcca

SEQ ID NO: 4146928 - RNA, 13 nt, Yersinia pestis
auccaagccauca

SEQ ID NO: 4146929 - RNA, 15 nt, Yersinia pestis
auccaaggcagauau

SEQ ID NO: 4146930 - RNA, 17 nt, Yersinia pestis
auccaauaacaucaccu

SEQ ID NO: 4146931 - RNA, 19 nt, Yersinia pestis
auccaauaccaccaaugcg

SEQ ID NO: 4146932 - RNA, 12 nt, Yersinia pestis
auccaauaccga

SEQ ID NO: 4146933 - RNA, 12 nt, Yersinia pestis
auccaauaggau

SEQ ID NO: 4146934 - RNA, 20 nt, Yersinia pestis
auccaaucauucugucauca

SEQ ID NO: 4146935 - RNA, 22 nt, Yersinia pestis
auccaaucauucugucaucaag

SEQ ID NO: 4146936 - RNA, 13 nt, Yersinia pestis
auccaauucagua

SEQ ID NO: 4146937 - RNA, 12 nt, Yersinia pestis
auccacagcaug

SEQ ID NO: 4146938 - RNA, 15 nt, Yersinia pestis
auccacauaaaaaga

SEQ ID NO: 4146939 - RNA, 14 nt, Yersinia pestis
auccacauucugug

SEQ ID NO: 4146940 - RNA, 17 nt, Yersinia pestis
auccacauuggaauuuu

SEQ ID NO: 4146941 - RNA, 17 nt, Yersinia pestis
auccaccuggguuccau

SEQ ID NO: 4146942 - RNA, 14 nt, Yersinia pestis
auccacuagcauca

SEQ ID NO: 4146943 - RNA, 19 nt, Yersinia pestis
auccacuagcaucacccgc

SEQ ID NO: 4146944 - RNA, 15 nt, Yersinia pestis
auccacucuugcacu

SEQ ID NO: 4146945 - RNA, 17 nt, Yersinia pestis
auccacuuauaucucca

SEQ ID NO: 4146946 - RNA, 17 nt, Yersinia pestis
auccacuuuucagauag

SEQ ID NO: 4146947 - RNA, 14 nt, Yersinia pestis
auccagaacaccaa

SEQ ID NO: 4146948 - RNA, 13 nt, Yersinia pestis
auccagaagccau

SEQ ID NO: 4146949 - RNA, 21 nt, Yersinia pestis
auccagaauagagaaaucaaa

SEQ ID NO: 4146950 - RNA, 20 nt, Yersinia pestis
auccagaauuucauugugga

SEQ ID NO: 4146951 - RNA, 13 nt, Yersinia pestis
auccagauucaga

SEQ ID NO: 4146952 - RNA, 20 nt, Yersinia pestis
auccagcaccacaauggcag

SEQ ID NO: 4146953 - RNA, 10 nt, Yersinia pestis
auccagcagc

SEQ ID NO: 4146954 - RNA, 15 nt, Yersinia pestis
auccagcagcgcugg

SEQ ID NO: 4146955 - RNA, 15 nt, Yersinia pestis
auccagugaaaucau

SEQ ID NO: 4146956 - RNA, 14 nt, Yersinia pestis
auccagugccaaaa

SEQ ID NO: 4146957 - RNA, 14 nt, Yersinia pestis
auccagugccaacc

SEQ ID NO: 4146958 - RNA, 20 nt, Yersinia pestis
auccagugucaugcgcagaa

SEQ ID NO: 4146959 - RNA, 21 nt, Yersinia pestis
auccaguguuucgcaguugcc

SEQ ID NO: 4146960 - RNA, 20 nt, Yersinia pestis
auccaguucgaccaauucac

SEQ ID NO: 4146961 - RNA, 24 nt, Yersinia pestis
auccaguuucaguggcuucucuuc

SEQ ID NO: 4146962 - RNA, 18 nt, Yersinia pestis
auccauaaaaucacgcau

SEQ ID NO: 4146963 - RNA, 21 nt, Yersinia pestis
auccauagugauuauuuaaac

SEQ ID NO: 4146964 - RNA, 20 nt, Yersinia pestis
auccaucccaacaauuugcg

SEQ ID NO: 4146965 - RNA, 21 nt, Yersinia pestis
auccauccccgccucaaugca

SEQ ID NO: 4146966 - RNA, 14 nt, Yersinia pestis
auccaucggccagu

SEQ ID NO: 4146967 - RNA, 15 nt, Yersinia pestis
auccaugggccucgc

SEQ ID NO: 4146968 - RNA, 16 nt, Yersinia pestis
auccauuacagcaccu

SEQ ID NO: 4146969 - RNA, 18 nt, Yersinia pestis
auccauucggcuaaauaa

SEQ ID NO: 4146970 - RNA, 18 nt, Yersinia pestis
auccauuguauugcucag

SEQ ID NO: 4146971 - RNA, 15 nt, Yersinia pestis
auccauuuucugcca

SEQ ID NO: 4146972 - RNA, 16 nt, Yersinia pestis
auccauuuucugccaa

SEQ ID NO: 4146973 - RNA, 14 nt, Yersinia pestis
aucccaaaagaaga

SEQ ID NO: 4146974 - RNA, 17 nt, Yersinia pestis
aucccaaaagaagacaa

SEQ ID NO: 4146975 - RNA, 13 nt, Yersinia pestis
aucccaagagaac

SEQ ID NO: 4146976 - RNA, 15 nt, Yersinia pestis
aucccaaugaauauu

SEQ ID NO: 4146977 - RNA, 23 nt, Yersinia pestis
aucccacccugaaggcugauuaa

SEQ ID NO: 4146978 - RNA, 19 nt, Yersinia pestis
aucccacucuguaccgccc

SEQ ID NO: 4146979 - RNA, 16 nt, Yersinia pestis
aucccagaaccucaac

SEQ ID NO: 4146980 - RNA, 23 nt, Yersinia pestis
aucccagagauggcgaucaagcc

SEQ ID NO: 4146981 - RNA, 15 nt, Yersinia pestis
aucccagcagcaaac

SEQ ID NO: 4146982 - RNA, 23 nt, Yersinia pestis
aucccaguuuuuaauuuaaacuc

SEQ ID NO: 4146983 - RNA, 16 nt, Yersinia pestis
aucccauuaaugagua

SEQ ID NO: 4146984 - RNA, 18 nt, Yersinia pestis
auccccacuuguaccugu

SEQ ID NO: 4146985 - RNA, 21 nt, Yersinia pestis
auccccaggugcuuauuuauu

SEQ ID NO: 4146986 - RNA, 20 nt, Yersinia pestis
auccccaucgccaauacaau

SEQ ID NO: 4146987 - RNA, 16 nt, Yersinia pestis
aucccccugcugccag

SEQ ID NO: 4146988 - RNA, 12 nt, Yersinia pestis
aucccgagaaac

SEQ ID NO: 4146989 - RNA, 13 nt, Yersinia pestis
aucccgauauaaa

SEQ ID NO: 4146990 - RNA, 13 nt, Yersinia pestis
aucccgcuggaag

SEQ ID NO: 4146991 - RNA, 18 nt, Yersinia pestis
aucccgugugauuuccau

SEQ ID NO: 4146992 - RNA, 15 nt, Yersinia pestis
aucccuauuuuuucc

SEQ ID NO: 4146993 - RNA, 24 nt, Yersinia pestis
aucccucacguuuagccaugaggu

SEQ ID NO: 4146994 - RNA, 22 nt, Yersinia pestis
aucccugccagaaucagcccca

SEQ ID NO: 4146995 - RNA, 18 nt, Yersinia pestis
aucccugcgguauccuua

SEQ ID NO: 4146996 - RNA, 22 nt, Yersinia pestis
aucccuggcucaucaaaggagu

SEQ ID NO: 4146997 - RNA, 15 nt, Yersinia pestis
aucccuggguuugag

SEQ ID NO: 4146998 - RNA, 20 nt, Yersinia pestis
aucccuucggcaugcaacuu

SEQ ID NO: 4146999 - RNA, 23 nt, Yersinia pestis
aucccuucugaaacuucaaaauc

SEQ ID NO: 4147000 - RNA, 20 nt, Yersinia pestis
aucccuugcggcauagcaaa

SEQ ID NO: 4147001 - RNA, 13 nt, Yersinia pestis
auccgaaaaauau

SEQ ID NO: 4147002 - RNA, 16 nt, Yersinia pestis
auccgaccacugacaa

SEQ ID NO: 4147003 - RNA, 17 nt, Yersinia pestis
auccgacugcagaaaau

SEQ ID NO: 4147004 - RNA, 19 nt, Yersinia pestis
auccgacugcagaaaauca

SEQ ID NO: 4147005 - RNA, 17 nt, Yersinia pestis
auccgaguuauugauau

SEQ ID NO: 4147006 - RNA, 15 nt, Yersinia pestis
auccgauaauaauuc

SEQ ID NO: 4147007 - RNA, 15 nt, Yersinia pestis
auccgaucagccagc

SEQ ID NO: 4147008 - RNA, 16 nt, Yersinia pestis
auccgcagcuuagguu

SEQ ID NO: 4147009 - RNA, 17 nt, Yersinia pestis
auccgcuacguucacug

SEQ ID NO: 4147010 - RNA, 15 nt, Yersinia pestis
auccgcuccagccug

SEQ ID NO: 4147011 - RNA, 14 nt, Yersinia pestis
auccgcugacauug

SEQ ID NO: 4147012 - RNA, 23 nt, Yersinia pestis
auccgcuggcggcguugucuuau

SEQ ID NO: 4147013 - RNA, 16 nt, Yersinia pestis
auccggauuaaauucu

SEQ ID NO: 4147014 - RNA, 23 nt, Yersinia pestis
auccggauuaaauucuaccuggc

SEQ ID NO: 4147015 - RNA, 22 nt, Yersinia pestis
auccggccauuuuuuaccauua

SEQ ID NO: 4147016 - RNA, 21 nt, Yersinia pestis
auccggcgggcaauauaggcg

SEQ ID NO: 4147017 - RNA, 16 nt, Yersinia pestis
auccgggaaaaaauac

SEQ ID NO: 4147018 - RNA, 19 nt, Yersinia pestis
auccgugcugguccuuuug

SEQ ID NO: 4147019 - RNA, 18 nt, Yersinia pestis
auccguguauuuaucaaa

SEQ ID NO: 4147020 - RNA, 16 nt, Yersinia pestis
auccguucagcggcag

SEQ ID NO: 4147021 - RNA, 17 nt, Yersinia pestis
auccguuuuaacgcugc

SEQ ID NO: 4147022 - RNA, 13 nt, Yersinia pestis
auccuauauacaa

SEQ ID NO: 4147023 - RNA, 21 nt, Yersinia pestis
auccuaucuuuacccacgggu

SEQ ID NO: 4147024 - RNA, 18 nt, Yersinia pestis
auccucaccguucaagau

SEQ ID NO: 4147025 - RNA, 21 nt, Yersinia pestis
auccucagagcucgcuaguca

SEQ ID NO: 4147026 - RNA, 13 nt, Yersinia pestis
auccucaguaaaa

SEQ ID NO: 4147027 - RNA, 15 nt, Yersinia pestis
auccucaucacugcc

SEQ ID NO: 4147028 - RNA, 13 nt, Yersinia pestis
auccucauugagc

SEQ ID NO: 4147029 - RNA, 15 nt, Yersinia pestis
auccucgagauguau

SEQ ID NO: 4147030 - RNA, 19 nt, Yersinia pestis
auccucgagauguauccaa

SEQ ID NO: 4147031 - RNA, 18 nt, Yersinia pestis
auccucgucguaauauuu

SEQ ID NO: 4147032 - RNA, 18 nt, Yersinia pestis
auccucuacguauuucgu

SEQ ID NO: 4147033 - RNA, 12 nt, Yersinia pestis
auccucuuccaa

SEQ ID NO: 4147034 - RNA, 12 nt, Yersinia pestis
auccucuucuuc

SEQ ID NO: 4147035 - RNA, 23 nt, Yersinia pestis
auccugaacgaggacuuccugcc

SEQ ID NO: 4147036 - RNA, 17 nt, Yersinia pestis
auccugccgccucugcu

SEQ ID NO: 4147037 - RNA, 18 nt, Yersinia pestis
auccugcuauuuaacaaa

SEQ ID NO: 4147038 - RNA, 18 nt, Yersinia pestis
auccugcucagcuaaaga

SEQ ID NO: 4147039 - RNA, 20 nt, Yersinia pestis
auccuggccguguuuuuccc

SEQ ID NO: 4147040 - RNA, 22 nt, Yersinia pestis
auccuggccguguuuuucccua

SEQ ID NO: 4147041 - RNA, 19 nt, Yersinia pestis
auccugugauucagccaac

SEQ ID NO: 4147042 - RNA, 20 nt, Yersinia pestis
auccuguggccuuaauucgg

SEQ ID NO: 4147043 - RNA, 17 nt, Yersinia pestis
auccuucaagaugcagg

SEQ ID NO: 4147044 - RNA, 19 nt, Yersinia pestis
auccuucaagaugcagggc

SEQ ID NO: 4147045 - RNA, 16 nt, Yersinia pestis
auccuugaucgccaaa

SEQ ID NO: 4147046 - RNA, 19 nt, Yersinia pestis
auccuugggucaguuuuau

SEQ ID NO: 4147047 - RNA, 16 nt, Yersinia pestis
auccuuuacuccccug

SEQ ID NO: 4147048 - RNA, 19 nt, Yersinia pestis
auccuuuuuauuuaagcag

SEQ ID NO: 4147049 - RNA, 11 nt, Yersinia pestis
aucgaaacacc

SEQ ID NO: 4147050 - RNA, 21 nt, Yersinia pestis
aucgaacccgcuaacaugcca

SEQ ID NO: 4147051 - RNA, 13 nt, Yersinia pestis
aucgaccaacugg

SEQ ID NO: 4147052 - RNA, 20 nt, Yersinia pestis
aucgaccgaguguaaaaagc

SEQ ID NO: 4147053 - RNA, 16 nt, Yersinia pestis
aucgacgcgaaauuca

SEQ ID NO: 4147054 - RNA, 17 nt, Yersinia pestis
aucgacuaauuaaacaa

SEQ ID NO: 4147055 - RNA, 18 nt, Yersinia pestis
aucgagaguugcucaccc

SEQ ID NO: 4147056 - RNA, 17 nt, Yersinia pestis
aucgaguggaguuaagu

SEQ ID NO: 4147057 - RNA, 20 nt, Yersinia pestis
aucgaguugaugcaauggca

SEQ ID NO: 4147058 - RNA, 13 nt, Yersinia pestis
aucgauaaaaaga

SEQ ID NO: 4147059 - RNA, 13 nt, Yersinia pestis
aucgaucaaccau

SEQ ID NO: 4147060 - RNA, 23 nt, Yersinia pestis
aucgauugauauauagaaauaag

SEQ ID NO: 4147061 - RNA, 14 nt, Yersinia pestis
aucgauuucuacgg

SEQ ID NO: 4147062 - RNA, 16 nt, Yersinia pestis
aucgcaauuaauacaa

SEQ ID NO: 4147063 - RNA, 14 nt, Yersinia pestis
aucgcaauuucaga

SEQ ID NO: 4147064 - RNA, 16 nt, Yersinia pestis
aucgcacugaguucug

SEQ ID NO: 4147065 - RNA, 16 nt, Yersinia pestis
aucgcaguaauagaaa

SEQ ID NO: 4147066 - RNA, 12 nt, Yersinia pestis
aucgcaguuaaa

SEQ ID NO: 4147067 - RNA, 23 nt, Yersinia pestis
aucgcauuggguaauaucaccau

SEQ ID NO: 4147068 - RNA, 14 nt, Yersinia pestis
aucgccaaagccgu

SEQ ID NO: 4147069 - RNA, 17 nt, Yersinia pestis
aucgccaacaggccuaa

SEQ ID NO: 4147070 - RNA, 19 nt, Yersinia pestis
aucgccaauaaccgcagca

SEQ ID NO: 4147071 - RNA, 23 nt, Yersinia pestis
aucgccagacuguucacaagcca

SEQ ID NO: 4147072 - RNA, 18 nt, Yersinia pestis
aucgccagcaaaucacau

SEQ ID NO: 4147073 - RNA, 16 nt, Yersinia pestis
aucgccagcugcaauu

SEQ ID NO: 4147074 - RNA, 20 nt, Yersinia pestis
aucgccagcugcaauugccg

SEQ ID NO: 4147075 - RNA, 20 nt, Yersinia pestis
aucgccagugaguccuuuac

SEQ ID NO: 4147076 - RNA, 19 nt, Yersinia pestis
aucgccauagccgaucacc

SEQ ID NO: 4147077 - RNA, 22 nt, Yersinia pestis
aucgccauagccgaucaccgca

SEQ ID NO: 4147078 - RNA, 15 nt, Yersinia pestis
aucgcccugcucuuc

SEQ ID NO: 4147079 - RNA, 19 nt, Yersinia pestis
aucgcccuugucugggcug

SEQ ID NO: 4147080 - RNA, 15 nt, Yersinia pestis
aucgccgccgccagc

SEQ ID NO: 4147081 - RNA, 17 nt, Yersinia pestis
aucgccgccgccagccc

SEQ ID NO: 4147082 - RNA, 22 nt, Yersinia pestis
aucgccguagauuuaaccccaa

SEQ ID NO: 4147083 - RNA, 17 nt, Yersinia pestis
aucgccugaugcuuuuc

SEQ ID NO: 4147084 - RNA, 19 nt, Yersinia pestis
aucgccugaugcuuuucuu

SEQ ID NO: 4147085 - RNA, 13 nt, Yersinia pestis
aucgccugcacac

SEQ ID NO: 4147086 - RNA, 19 nt, Yersinia pestis
aucgccugcugagccaaau

SEQ ID NO: 4147087 - RNA, 22 nt, Yersinia pestis
aucgccuggcuugaccuugccu

SEQ ID NO: 4147088 - RNA, 22 nt, Yersinia pestis
aucgccugggcgagaguuuuca

SEQ ID NO: 4147089 - RNA, 17 nt, Yersinia pestis
aucgccuguaaaucuug

SEQ ID NO: 4147090 - RNA, 17 nt, Yersinia pestis
aucgccuucaucgcgau

SEQ ID NO: 4147091 - RNA, 14 nt, Yersinia pestis
aucgcgaccaauuc

SEQ ID NO: 4147092 - RNA, 19 nt, Yersinia pestis
aucgcgaugcgccuguuag

SEQ ID NO: 4147093 - RNA, 19 nt, Yersinia pestis
aucgcgcccauccgcagga

SEQ ID NO: 4147094 - RNA, 19 nt, Yersinia pestis
aucgcgccuaccugccugc

SEQ ID NO: 4147095 - RNA, 18 nt, Yersinia pestis
aucgcgcuucaggucagg

SEQ ID NO: 4147096 - RNA, 21 nt, Yersinia pestis
aucgcgggcgcgcugcugcuc

SEQ ID NO: 4147097 - RNA, 23 nt, Yersinia pestis
aucgcgguaaucccgauauaaau

SEQ ID NO: 4147098 - RNA, 14 nt, Yersinia pestis
aucgcgucuuuacg

SEQ ID NO: 4147099 - RNA, 19 nt, Yersinia pestis
aucgcguucagagcagcau

SEQ ID NO: 4147100 - RNA, 12 nt, Yersinia pestis
aucgcuaaaaag

SEQ ID NO: 4147101 - RNA, 13 nt, Yersinia pestis
aucgcuaaaaagc

SEQ ID NO: 4147102 - RNA, 15 nt, Yersinia pestis
aucgcuaaauacugc

SEQ ID NO: 4147103 - RNA, 18 nt, Yersinia pestis
aucgcuagggauccgcuu

SEQ ID NO: 4147104 - RNA, 19 nt, Yersinia pestis
aucgcucugcguuuuuccc

SEQ ID NO: 4147105 - RNA, 20 nt, Yersinia pestis
aucgcucugcguuuuucccu

SEQ ID NO: 4147106 - RNA, 12 nt, Yersinia pestis
aaaaaaaauaaa

SEQ ID NO: 4147107 - RNA, 15 nt, Yersinia pestis
aaaaaaagacacuaa

SEQ ID NO: 4147108 - RNA, 18 nt, Yersinia pestis
aaaaaacggugaacauuu

SEQ ID NO: 4147109 - RNA, 16 nt, Yersinia pestis
aaaaaacuaagggcga

SEQ ID NO: 4147110 - RNA, 16 nt, Yersinia pestis
aaaaaagaaaauggcu

SEQ ID NO: 4147111 - RNA, 16 nt, Yersinia pestis
aaaaaagucacuuaaa

SEQ ID NO: 4147112 - RNA, 18 nt, Yersinia pestis
aaaaaauacuaucaucau

SEQ ID NO: 4147113 - RNA, 12 nt, Yersinia pestis
aaaaaauccagu

SEQ ID NO: 4147114 - RNA, 13 nt, Yersinia pestis
aaaaaauuaaaau

SEQ ID NO: 4147115 - RNA, 18 nt, Yersinia pestis
aaaaaauuaaaauaauga

SEQ ID NO: 4147116 - RNA, 14 nt, Yersinia pestis
aaaaaauuauuaaa

SEQ ID NO: 4147117 - RNA, 18 nt, Yersinia pestis
aaaaacacagguucucca

SEQ ID NO: 4147118 - RNA, 17 nt, Yersinia pestis
aaaaacacgguugaaaa

SEQ ID NO: 4147119 - RNA, 16 nt, Yersinia pestis
aaaaacagacuaaaaa

SEQ ID NO: 4147120 - RNA, 19 nt, Yersinia pestis
aaaaacagucauuaacaca

SEQ ID NO: 4147121 - RNA, 21 nt, Yersinia pestis
aaaaacagucauuaacacauc

SEQ ID NO: 4147122 - RNA, 21 nt, Yersinia pestis
aaaaaccaucugaugcagguu

SEQ ID NO: 4147123 - RNA, 15 nt, Yersinia pestis
aaaaaccaugagaau

SEQ ID NO: 4147124 - RNA, 21 nt, Yersinia pestis
aaaaaccaugagaauacuuca

SEQ ID NO: 4147125 - RNA, 18 nt, Yersinia pestis
aaaaacccucucauccug

SEQ ID NO: 4147126 - RNA, 14 nt, Yersinia pestis
aaaaacccucuuca

SEQ ID NO: 4147127 - RNA, 23 nt, Yersinia pestis
aaaaacccucuucaaucggauaa

SEQ ID NO: 4147128 - RNA, 12 nt, Yersinia pestis
aaaaaccgcagc

SEQ ID NO: 4147129 - RNA, 22 nt, Yersinia pestis
aaaaaccgcagcagacaacuga

SEQ ID NO: 4147130 - RNA, 12 nt, Yersinia pestis
aaaaaccuccgg

SEQ ID NO: 4147131 - RNA, 16 nt, Yersinia pestis
aaaaaccuccggcuau

SEQ ID NO: 4147132 - RNA, 17 nt, Yersinia pestis
aaaaacgcacgaaaaca

SEQ ID NO: 4147133 - RNA, 23 nt, Yersinia pestis
aaaaacucgcgccugaaaucauu

SEQ ID NO: 4147134 - RNA, 17 nt, Yersinia pestis
aaaaacugaaaaaggca

SEQ ID NO: 4147135 - RNA, 17 nt, Yersinia pestis
aaaaacuuaucuaaaaa

SEQ ID NO: 4147136 - RNA, 14 nt, Yersinia pestis
aaaaacuuuuauug

SEQ ID NO: 4147137 - RNA, 14 nt, Yersinia pestis
aaaaagaaaaaaac

SEQ ID NO: 4147138 - RNA, 17 nt, Yersinia pestis
aaaaagaaaaaaacaga

SEQ ID NO: 4147139 - RNA, 18 nt, Yersinia pestis
aaaaagaaauuuuuagaa

SEQ ID NO: 4147140 - RNA, 22 nt, Yersinia pestis
aaaaagaaugcgaagaaaaaca

SEQ ID NO: 4147141 - RNA, 15 nt, Yersinia pestis
aaaaagauaauaaaa

SEQ ID NO: 4147142 - RNA, 17 nt, Yersinia pestis
aaaaagcagcaaacgaa

SEQ ID NO: 4147143 - RNA, 21 nt, Yersinia pestis
aaaaagcccccuuuuucauau

SEQ ID NO: 4147144 - RNA, 15 nt, Yersinia pestis
aaaaagcgaucgacc

SEQ ID NO: 4147145 - RNA, 16 nt, Yersinia pestis
aaaaagcguuucagag

SEQ ID NO: 4147146 - RNA, 22 nt, Yersinia pestis
aaaaaggauuuuauuaaaucac

SEQ ID NO: 4147147 - RNA, 16 nt, Yersinia pestis
aaaaaggcaccagcgc

SEQ ID NO: 4147148 - RNA, 21 nt, Yersinia pestis
aaaaagugcuauccucuuaau

SEQ ID NO: 4147149 - RNA, 23 nt, Yersinia pestis
aaaaagugcuauccucuuaaugu

SEQ ID NO: 4147150 - RNA, 14 nt, Yersinia pestis
aaaaaguguugacg

SEQ ID NO: 4147151 - RNA, 13 nt, Yersinia pestis
aaaaauaaauucu

SEQ ID NO: 4147152 - RNA, 17 nt, Yersinia pestis
aaaaauaaguaacauuu

SEQ ID NO: 4147153 - RNA, 13 nt, Yersinia pestis
aaaaauaaucaau

SEQ ID NO: 4147154 - RNA, 18 nt, Yersinia pestis
aaaaauacaaccaacaaa

SEQ ID NO: 4147155 - RNA, 14 nt, Yersinia pestis
aaaaauacauauca

SEQ ID NO: 4147156 - RNA, 17 nt, Yersinia pestis
aaaaauacuaucaucau

SEQ ID NO: 4147157 - RNA, 14 nt, Yersinia pestis
aaaaauaucuauuu

SEQ ID NO: 4147158 - RNA, 20 nt, Yersinia pestis
aaaaaucuuguuaauuuaaa

SEQ ID NO: 4147159 - RNA, 22 nt, Yersinia pestis
aaaaaucuuguuaauuuaaaca

SEQ ID NO: 4147160 - RNA, 22 nt, Yersinia pestis
aaaaaugccagccccaaucacc

SEQ ID NO: 4147161 - RNA, 17 nt, Yersinia pestis
aaaaauggaguuuuacu

SEQ ID NO: 4147162 - RNA, 13 nt, Yersinia pestis
aaaaauuaaaaua

SEQ ID NO: 4147163 - RNA, 17 nt, Yersinia pestis
aaaaauuaaaauaauga

SEQ ID NO: 4147164 - RNA, 18 nt, Yersinia pestis
aaaaauuauuaaauaaga

SEQ ID NO: 4147165 - RNA, 23 nt, Yersinia pestis
aaaacaacccgaauuaauaaaac

SEQ ID NO: 4147166 - RNA, 12 nt, Yersinia pestis
aaaacaagcuac

SEQ ID NO: 4147167 - RNA, 18 nt, Yersinia pestis
aaaacaauaaaaagaucu

SEQ ID NO: 4147168 - RNA, 21 nt, Yersinia pestis
aaaacaauuucgaaaacucaa

SEQ ID NO: 4147169 - RNA, 14 nt, Yersinia pestis
aaaacacgcaacac

SEQ ID NO: 4147170 - RNA, 20 nt, Yersinia pestis
aaaacacgcgcuacgaugca

SEQ ID NO: 4147171 - RNA, 19 nt, Yersinia pestis
aaaacacucuuuuugguuu

SEQ ID NO: 4147172 - RNA, 15 nt, Yersinia pestis
aaaacagcaacacca

SEQ ID NO: 4147173 - RNA, 21 nt, Yersinia pestis
aaaacagccuaaggccaucaa

SEQ ID NO: 4147174 - RNA, 20 nt, Yersinia pestis
aaaacaggaucuuauuuaac

SEQ ID NO: 4147175 - RNA, 21 nt, Yersinia pestis
aaaacaggaucuuauuuaaca

SEQ ID NO: 4147176 - RNA, 20 nt, Yersinia pestis
aaaacaggcgaguuucccuu

SEQ ID NO: 4147177 - RNA, 21 nt, Yersinia pestis
aaaacaguuacuccuacacca

SEQ ID NO: 4147178 - RNA, 15 nt, Yersinia pestis
aaaacaucacacuug

SEQ ID NO: 4147179 - RNA, 13 nt, Yersinia pestis
aaaaccaccaaaa

SEQ ID NO: 4147180 - RNA, 12 nt, Yersinia pestis
aaaaccacugac

SEQ ID NO: 4147181 - RNA, 14 nt, Yersinia pestis
aaaaccacugaccu

SEQ ID NO: 4147182 - RNA, 15 nt, Yersinia pestis
aaaaccacugaccua

SEQ ID NO: 4147183 - RNA, 22 nt, Yersinia pestis
aaaaccacugaccuauugauaa

SEQ ID NO: 4147184 - RNA, 22 nt, Yersinia pestis
aaaacccauaaguccuuaaaaa

SEQ ID NO: 4147185 - RNA, 19 nt, Yersinia pestis
aaaaccgcagcagacaacu

SEQ ID NO: 4147186 - RNA, 21 nt, Yersinia pestis
aaaaccgccccccauccccaa

SEQ ID NO: 4147187 - RNA, 18 nt, Yersinia pestis
aaaaccggagucaaucau

SEQ ID NO: 4147188 - RNA, 19 nt, Yersinia pestis
aaaaccggagucaaucauu

SEQ ID NO: 4147189 - RNA, 18 nt, Yersinia pestis
aaaaccgugacuaaaaca

SEQ ID NO: 4147190 - RNA, 18 nt, Yersinia pestis
aaaaccuccggcuaugcc

SEQ ID NO: 4147191 - RNA, 20 nt, Yersinia pestis
aaaaccugcuugaaagcacc

SEQ ID NO: 4147192 - RNA, 22 nt, Yersinia pestis
aaaaccuuuauguaguucaguc

SEQ ID NO: 4147193 - RNA, 16 nt, Yersinia pestis
aaaacgcacgaaaaca

SEQ ID NO: 4147194 - RNA, 19 nt, Yersinia pestis
aaaacgcgacggucagcca

SEQ ID NO: 4147195 - RNA, 22 nt, Yersinia pestis
aaaacggcuuaaaguuauguuu

SEQ ID NO: 4147196 - RNA, 16 nt, Yersinia pestis
aaaacgugaaagcacg

SEQ ID NO: 4147197 - RNA, 15 nt, Yersinia pestis
aaaacuaaggggcca

SEQ ID NO: 4147198 - RNA, 15 nt, Yersinia pestis
aaaacuauucugcuu

SEQ ID NO: 4147199 - RNA, 14 nt, Yersinia pestis
aaaacucaaagauu

SEQ ID NO: 4147200 - RNA, 15 nt, Yersinia pestis
aaaacucaaagauuu

SEQ ID NO: 4147201 - RNA, 15 nt, Yersinia pestis
aaaacucaaauagau

SEQ ID NO: 4147202 - RNA, 22 nt, Yersinia pestis
aaaacucaggugaguaaacacc

SEQ ID NO: 4147203 - RNA, 18 nt, Yersinia pestis
aaaacucgcgccugaaau

SEQ ID NO: 4147204 - RNA, 23 nt, Yersinia pestis
aaaacucgcgccugaaaucauuu

SEQ ID NO: 4147205 - RNA, 11 nt, Yersinia pestis
aaacaauguga

SEQ ID NO: 4147206 - RNA, 22 nt, Yersinia pestis
aaacaaugugccgcgcaaccau

SEQ ID NO: 4147207 - RNA, 13 nt, Yersinia pestis
aaacaauuucgaa

SEQ ID NO: 4147208 - RNA, 23 nt, Yersinia pestis
aaacaauuuugguacagguguug

SEQ ID NO: 4147209 - RNA, 16 nt, Yersinia pestis
aaacacaucacgcuua

SEQ ID NO: 4147210 - RNA, 22 nt, Yersinia pestis
aaacaccuucacugaauaccgu

SEQ ID NO: 4147211 - RNA, 17 nt, Yersinia pestis
aaacaccuucagacuga

SEQ ID NO: 4147212 - RNA, 21 nt, Yersinia pestis
aaacacgauauaccucaguua

SEQ ID NO: 4147213 - RNA, 14 nt, Yersinia pestis
aaacacgcaacacu

SEQ ID NO: 4147214 - RNA, 15 nt, Yersinia pestis
aaacacgcauaugaa

SEQ ID NO: 4147215 - RNA, 17 nt, Yersinia pestis
aaacacuuaugaucuug

SEQ ID NO: 4147216 - RNA, 20 nt, Yersinia pestis
aaacacuuaugaucuugaau

SEQ ID NO: 4147217 - RNA, 21 nt, Yersinia pestis
aaacacuuauuugaaauacuu

SEQ ID NO: 4147218 - RNA, 21 nt, Yersinia pestis
aaacagaacccccgcgaacag

SEQ ID NO: 4147219 - RNA, 14 nt, Yersinia pestis
aaacagagcaccgg

SEQ ID NO: 4147220 - RNA, 19 nt, Yersinia pestis
aaacagauaacucagggcg

SEQ ID NO: 4147221 - RNA, 22 nt, Yersinia pestis
aaacagauauuuucggguaucu

SEQ ID NO: 4147222 - RNA, 22 nt, Yersinia pestis
aaacagcacgguaaacgcaucc

SEQ ID NO: 4147223 - RNA, 22 nt, Yersinia pestis
aaacagccaccagccaacuuuc

SEQ ID NO: 4147224 - RNA, 13 nt, Yersinia pestis
aaacagccagcau

SEQ ID NO: 4147225 - RNA, 16 nt, Yersinia pestis
aaacagucauuaacac

SEQ ID NO: 4147226 - RNA, 12 nt, Yersinia pestis
aaacagucuuau

SEQ ID NO: 4147227 - RNA, 15 nt, Yersinia pestis
aaacagugucacuuc

SEQ ID NO: 4147228 - RNA, 15 nt, Yersinia pestis
aaacaguuacuccua

SEQ ID NO: 4147229 - RNA, 20 nt, Yersinia pestis
aaacauggcggcagcacaga

SEQ ID NO: 4147230 - RNA, 22 nt, Yersinia pestis
aaacauggcucucuuuuuucuc

SEQ ID NO: 4147231 - RNA, 13 nt, Yersinia pestis
aaacauuggcuuu

SEQ ID NO: 4147232 - RNA, 22 nt, Yersinia pestis
aaacauuguuaccuaaccaaac

SEQ ID NO: 4147233 - RNA, 23 nt, Yersinia pestis
aaacauuguuaccuaaccaaaca

SEQ ID NO: 4147234 - RNA, 20 nt, Yersinia pestis
aaacauuuauguaugauauu

SEQ ID NO: 4147235 - RNA, 22 nt, Yersinia pestis
aaacauuucauuccagauaaaa

SEQ ID NO: 4147236 - RNA, 22 nt, Yersinia pestis
aaacauuuucaucugaccaaac

SEQ ID NO: 4147237 - RNA, 13 nt, Yersinia pestis
aaaccaacaauau

SEQ ID NO: 4147238 - RNA, 21 nt, Yersinia pestis
aaaccaacaauauucgcagcc

SEQ ID NO: 4147239 - RNA, 20 nt, Yersinia pestis
aaaccaauagaccguagaaa

SEQ ID NO: 4147240 - RNA, 14 nt, Yersinia pestis
aaaccaauggaaaa

SEQ ID NO: 4147241 - RNA, 15 nt, Yersinia pestis
aaaccaccaaaauag

SEQ ID NO: 4147242 - RNA, 19 nt, Yersinia pestis
aaaccaccugaccuagcaa

SEQ ID NO: 4147243 - RNA, 15 nt, Yersinia pestis
aaaccacgcgguugg

SEQ ID NO: 4147244 - RNA, 15 nt, Yersinia pestis
aaaccacuguuuuuc

SEQ ID NO: 4147245 - RNA, 12 nt, Yersinia pestis
aaaccacuuggc

SEQ ID NO: 4147246 - RNA, 22 nt, Yersinia pestis
aaaccagaugaucugaugauca

SEQ ID NO: 4147247 - RNA, 23 nt, Yersinia pestis
aaaccauauuauuuacaaaccac

SEQ ID NO: 4147248 - RNA, 19 nt, Yersinia pestis
aaaccaucgcucuccugcc

SEQ ID NO: 4147249 - RNA, 18 nt, Yersinia pestis
aaaccaucugaugcaggu

SEQ ID NO: 4147250 - RNA, 21 nt, Yersinia pestis
aaaccauggcucaccauaaau

SEQ ID NO: 4147251 - RNA, 21 nt, Yersinia pestis
aaaccauuuuacuaaaccagu

SEQ ID NO: 4147252 - RNA, 17 nt, Yersinia pestis
aaacccaccugaaucuc

SEQ ID NO: 4147253 - RNA, 17 nt, Yersinia pestis
aaacccauagcaaagau

SEQ ID NO: 4147254 - RNA, 17 nt, Yersinia pestis
aaacccauuaaaaacaa

SEQ ID NO: 4147255 - RNA, 18 nt, Yersinia pestis
aaacccccaacccaagga

SEQ ID NO: 4147256 - RNA, 22 nt, Yersinia pestis
aaacccucuguagagaaauuca

SEQ ID NO: 4147257 - RNA, 18 nt, Yersinia pestis
aaaccgaaaugaucuuca

SEQ ID NO: 4147258 - RNA, 19 nt, Yersinia pestis
aaaccgagccugcuuuaau

SEQ ID NO: 4147259 - RNA, 16 nt, Yersinia pestis
aaaccgcagcagacaa

SEQ ID NO: 4147260 - RNA, 23 nt, Yersinia pestis
aaaccgcagcagacaacugacaa

SEQ ID NO: 4147261 - RNA, 16 nt, Yersinia pestis
aaaccgcuauaucauc

SEQ ID NO: 4147262 - RNA, 23 nt, Yersinia pestis
aaaccgcuauaucaucagcagag

SEQ ID NO: 4147263 - RNA, 14 nt, Yersinia pestis
aaaccggacauaau

SEQ ID NO: 4147264 - RNA, 22 nt, Yersinia pestis
aaaccggacauaaugcauccac

SEQ ID NO: 4147265 - RNA, 21 nt, Yersinia pestis
aaaccgugauugguuuauccc

SEQ ID NO: 4147266 - RNA, 15 nt, Yersinia pestis
aaaccguuugccguu

SEQ ID NO: 4147267 - RNA, 13 nt, Yersinia pestis
aaaccuaaaccuu

SEQ ID NO: 4147268 - RNA, 17 nt, Yersinia pestis
aaaccuaacgccaaaau

SEQ ID NO: 4147269 - RNA, 14 nt, Yersinia pestis
aaaccuaaugccag

SEQ ID NO: 4147270 - RNA, 16 nt, Yersinia pestis
aaaccugauaggccaa

SEQ ID NO: 4147271 - RNA, 17 nt, Yersinia pestis
aaaccugcuugaaagca

SEQ ID NO: 4147272 - RNA, 15 nt, Yersinia pestis
aaaccuuauuuuugc

SEQ ID NO: 4147273 - RNA, 15 nt, Yersinia pestis
aaaccuuuaccagcg

SEQ ID NO: 4147274 - RNA, 19 nt, Yersinia pestis
aaacgaaacuaacgcguga

SEQ ID NO: 4147275 - RNA, 14 nt, Yersinia pestis
aaacgaacgaauaa

SEQ ID NO: 4147276 - RNA, 21 nt, Yersinia pestis
aaacgaccaauuucaauaauu

SEQ ID NO: 4147277 - RNA, 14 nt, Yersinia pestis
aaacgauuacccac

SEQ ID NO: 4147278 - RNA, 14 nt, Yersinia pestis
aaacgcacaacaaa

SEQ ID NO: 4147279 - RNA, 18 nt, Yersinia pestis
aaacgccagugcaaaaug

SEQ ID NO: 4147280 - RNA, 22 nt, Yersinia pestis
aaacgccccgauaaaccaacug

SEQ ID NO: 4147281 - RNA, 16 nt, Yersinia pestis
aaacgcccuugccaua

SEQ ID NO: 4147282 - RNA, 15 nt, Yersinia pestis
aaacgccuccaguga

SEQ ID NO: 4147283 - RNA, 22 nt, Yersinia pestis
aaacgccucguuuaacucaaau

SEQ ID NO: 4147284 - RNA, 13 nt, Yersinia pestis
aaacgccugaucc

SEQ ID NO: 4147285 - RNA, 20 nt, Yersinia pestis
aaacgccugggauccauagg

SEQ ID NO: 4147286 - RNA, 14 nt, Yersinia pestis
aaacgcuaaaccau

SEQ ID NO: 4147287 - RNA, 18 nt, Yersinia pestis
aaacgcucaguuaaacgg

SEQ ID NO: 4147288 - RNA, 14 nt, Yersinia pestis
aaacgcucaucaac

SEQ ID NO: 4147289 - RNA, 14 nt, Yersinia pestis
aaacgcugggcgau

SEQ ID NO: 4147290 - RNA, 19 nt, Yersinia pestis
aaacgcuuuuaacugugca

SEQ ID NO: 4147291 - RNA, 19 nt, Yersinia pestis
aaacggaugagucgcuggu

SEQ ID NO: 4147292 - RNA, 21 nt, Yersinia pestis
aaacggcgcggcaucaccaaa

SEQ ID NO: 4147293 - RNA, 21 nt, Yersinia pestis
aaacggucuguuaauccuaau

SEQ ID NO: 4147294 - RNA, 19 nt, Yersinia pestis
aaacggugaggauaggcag

SEQ ID NO: 4147295 - RNA, 14 nt, Yersinia pestis
aaacgguugcugua

SEQ ID NO: 4147296 - RNA, 23 nt, Yersinia pestis
aaacgucacuucgccuuaucagc

SEQ ID NO: 4147297 - RNA, 15 nt, Yersinia pestis
aaacgugaaacgccu

SEQ ID NO: 4147298 - RNA, 12 nt, Yersinia pestis
aaacgugaaagc

SEQ ID NO: 4147299 - RNA, 14 nt, Yersinia pestis
aaacguuaacugca

SEQ ID NO: 4147300 - RNA, 16 nt, Yersinia pestis
aaacguuaacugcagu

SEQ ID NO: 4147301 - RNA, 16 nt, Yersinia pestis
aaacuaauauuuucua

SEQ ID NO: 4147302 - RNA, 14 nt, Yersinia pestis
aaacuauuaacucu

SEQ ID NO: 4147303 - RNA, 22 nt, Yersinia pestis
aaacuauucaucccuaaaauca

SEQ ID NO: 4147304 - RNA, 13 nt, Yersinia pestis
aaacuauucugcu

SEQ ID NO: 4147305 - RNA, 16 nt, Yersinia pestis
aaacucacaaaauaac

SEQ ID NO: 4147306 - RNA, 21 nt, Yersinia pestis
aaacucacgguuucuaaaaaa

SEQ ID NO: 4147307 - RNA, 22 nt, Yersinia pestis
aaacucacgguuucuaaaaaau

SEQ ID NO: 4147308 - RNA, 21 nt, Yersinia pestis
aaacucccuucaaucaaugaa

SEQ ID NO: 4147309 - RNA, 22 nt, Yersinia pestis
aaacuccuuggaacuuacuccc

SEQ ID NO: 4147310 - RNA, 13 nt, Yersinia pestis
aaacucuaagggu

SEQ ID NO: 4147311 - RNA, 16 nt, Yersinia pestis
aaacucucgaaaaugu

SEQ ID NO: 4147312 - RNA, 20 nt, Yersinia pestis
aaacucugcguagccauuaa

SEQ ID NO: 4147313 - RNA, 14 nt, Yersinia pestis
aaacucuggauggg

SEQ ID NO: 4147314 - RNA, 22 nt, Yersinia pestis
aaacucuuguguugggcaguaa

SEQ ID NO: 4147315 - RNA, 15 nt, Yersinia pestis
aaacugaaaaaggca

SEQ ID NO: 4147316 - RNA, 15 nt, Yersinia pestis
aaacugaaaaguuuc

SEQ ID NO: 4147317 - RNA, 15 nt, Yersinia pestis
aaacugaaguuaaaa

SEQ ID NO: 4147318 - RNA, 22 nt, Yersinia pestis
aaacugaaguuaaaaagccuga

SEQ ID NO: 4147319 - RNA, 23 nt, Yersinia pestis
aaacugaaguuaaaaagccugaa

SEQ ID NO: 4147320 - RNA, 16 nt, Yersinia pestis
aaacugauaaagcaaa

SEQ ID NO: 4147321 - RNA, 16 nt, Yersinia pestis
aaacugauauaaagca

SEQ ID NO: 4147322 - RNA, 14 nt, Yersinia pestis
aaacugaucaucaa

SEQ ID NO: 4147323 - RNA, 15 nt, Yersinia pestis
aaacugaucaucaac

SEQ ID NO: 4147324 - RNA, 20 nt, Yersinia pestis
aaacugccgccaccauauca

SEQ ID NO: 4147325 - RNA, 17 nt, Yersinia pestis
aaacugcucauaaagca

SEQ ID NO: 4147326 - RNA, 11 nt, Yersinia pestis
aaauaaaaaug

SEQ ID NO: 4147327 - RNA, 11 nt, Yersinia pestis
aaauaaaacaa

SEQ ID NO: 4147328 - RNA, 12 nt, Yersinia pestis
aaauaaaauaau

SEQ ID NO: 4147329 - RNA, 14 nt, Yersinia pestis
aaauaaaauaauaa

SEQ ID NO: 4147330 - RNA, 12 nt, Yersinia pestis
aaauaaacaaaa

SEQ ID NO: 4147331 - RNA, 15 nt, Yersinia pestis
aaauaaaccaauauc

SEQ ID NO: 4147332 - RNA, 23 nt, Yersinia pestis
aaauaaaugcucucgagaaauaa

SEQ ID NO: 4147333 - RNA, 14 nt, Yersinia pestis
aaauaaauucuuua

SEQ ID NO: 4147334 - RNA, 12 nt, Yersinia pestis
aaauaaauuuaa

SEQ ID NO: 4147335 - RNA, 13 nt, Yersinia pestis
aaauaaauuuauu

SEQ ID NO: 4147336 - RNA, 14 nt, Yersinia pestis
aaauaacaauucac

SEQ ID NO: 4147337 - RNA, 20 nt, Yersinia pestis
aaauaacaauucacucauaa

SEQ ID NO: 4147338 - RNA, 21 nt, Yersinia pestis
aaauaacaauucacucauaau

SEQ ID NO: 4147339 - RNA, 12 nt, Yersinia pestis
aaauaacagcua

SEQ ID NO: 4147340 - RNA, 12 nt, Yersinia pestis
aaauaaccagag

SEQ ID NO: 4147341 - RNA, 20 nt, Yersinia pestis
aaauaaccagagacagcaac

SEQ ID NO: 4147342 - RNA, 22 nt, Yersinia pestis
aaauaacccgccuagcaucaua

SEQ ID NO: 4147343 - RNA, 14 nt, Yersinia pestis
aaauaaccgagcgu

SEQ ID NO: 4147344 - RNA, 21 nt, Yersinia pestis
aaauaaccgagcgugaagagc

SEQ ID NO: 4147345 - RNA, 19 nt, Yersinia pestis
aaauaaccgccaaaauauc

SEQ ID NO: 4147346 - RNA, 17 nt, Yersinia pestis
aaauaagaucaauaugu

SEQ ID NO: 4147347 - RNA, 14 nt, Yersinia pestis
aaauaagccagugc

SEQ ID NO: 4147348 - RNA, 17 nt, Yersinia pestis
aaauaaggcgaauauga

SEQ ID NO: 4147349 - RNA, 22 nt, Yersinia pestis
aaauaaggcgaauaugauuaau

SEQ ID NO: 4147350 - RNA, 14 nt, Yersinia pestis
aaauaaguaacauu

SEQ ID NO: 4147351 - RNA, 22 nt, Yersinia pestis
aaauaaguacuuccaauaagug

SEQ ID NO: 4147352 - RNA, 22 nt, Yersinia pestis
aaauaaguauuucaaauaagug

SEQ ID NO: 4147353 - RNA, 22 nt, Yersinia pestis
aaauaauauaauucaauauaua

SEQ ID NO: 4147354 - RNA, 22 nt, Yersinia pestis
aaauaauaucaagucuugaaga

SEQ ID NO: 4147355 - RNA, 15 nt, Yersinia pestis
aaauaauaucaauga

SEQ ID NO: 4147356 - RNA, 12 nt, Yersinia pestis
aaauaauauuaa

SEQ ID NO: 4147357 - RNA, 20 nt, Yersinia pestis
aaauaaucagcucauuaaac

SEQ ID NO: 4147358 - RNA, 23 nt, Yersinia pestis
aaauaaucauaucaaaauaaaaa

SEQ ID NO: 4147359 - RNA, 23 nt, Yersinia pestis
aaauaauccauagauuauuuuua

SEQ ID NO: 4147360 - RNA, 16 nt, Yersinia pestis
aaauaauggccaagcg

SEQ ID NO: 4147361 - RNA, 22 nt, Yersinia pestis
aaauaauguccccuugaguauc

SEQ ID NO: 4147362 - RNA, 22 nt, Yersinia pestis
aaauaauuuguauucucaucau

SEQ ID NO: 4147363 - RNA, 13 nt, Yersinia pestis
aaauacaaccaac

SEQ ID NO: 4147364 - RNA, 17 nt, Yersinia pestis
aaauacaaccaacaaac

SEQ ID NO: 4147365 - RNA, 23 nt, Yersinia pestis
aaauacaggggcguuauugagaa

SEQ ID NO: 4147366 - RNA, 12 nt, Yersinia pestis
aaauacauauca

SEQ ID NO: 4147367 - RNA, 16 nt, Yersinia pestis
aaauacauaucaacac

SEQ ID NO: 4147368 - RNA, 16 nt, Yersinia pestis
aaauacauccauguag

SEQ ID NO: 4147369 - RNA, 20 nt, Yersinia pestis
aaauacccagcuucuuuuaa

SEQ ID NO: 4147370 - RNA, 16 nt, Yersinia pestis
aaauacccgguuucca

SEQ ID NO: 4147371 - RNA, 20 nt, Yersinia pestis
aaauaccgccaaauacaaac

SEQ ID NO: 4147372 - RNA, 20 nt, Yersinia pestis
aaauaccgcgaucaacaaga

SEQ ID NO: 4147373 - RNA, 22 nt, Yersinia pestis
aaauacgaucaacucaacuuua

SEQ ID NO: 4147374 - RNA, 23 nt, Yersinia pestis
aaauacucuugagaaaugaauau

SEQ ID NO: 4147375 - RNA, 23 nt, Yersinia pestis
aaauacugcacguuuaauuucac

SEQ ID NO: 4147376 - RNA, 13 nt, Yersinia pestis
aaauacugccaau

SEQ ID NO: 4147377 - RNA, 16 nt, Yersinia pestis
aaauacuuaacaauca

SEQ ID NO: 4147378 - RNA, 14 nt, Yersinia pestis
aaauacuuaucugu

SEQ ID NO: 4147379 - RNA, 12 nt, Yersinia pestis
aaauacuuauuu

SEQ ID NO: 4147380 - RNA, 16 nt, Yersinia pestis
aaauacuuauuugaaa

SEQ ID NO: 4147381 - RNA, 16 nt, Yersinia pestis
aaauacuucaaaugac

SEQ ID NO: 4147382 - RNA, 17 nt, Yersinia pestis
aaauagacucaacaaac

SEQ ID NO: 4147383 - RNA, 20 nt, Yersinia pestis
aaauagauagcaaucaauaa

SEQ ID NO: 4147384 - RNA, 14 nt, Yersinia pestis
aaauagauaucgaa

SEQ ID NO: 4147385 - RNA, 16 nt, Yersinia pestis
aaauagcggccaacau

SEQ ID NO: 4147386 - RNA, 18 nt, Yersinia pestis
aaauagcuuccauuaaaa

SEQ ID NO: 4147387 - RNA, 23 nt, Yersinia pestis
aaauaggcaggcccgcuucccua

SEQ ID NO: 4147388 - RNA, 18 nt, Yersinia pestis
aaauaggcguuaucggcg

SEQ ID NO: 4147389 - RNA, 21 nt, Yersinia pestis
aaauaggggcaccguaaauga

SEQ ID NO: 4147390 - RNA, 16 nt, Yersinia pestis
aaauagguauaaaacu

SEQ ID NO: 4147391 - RNA, 20 nt, Yersinia pestis
aaauaggugcgccaguggca

SEQ ID NO: 4147392 - RNA, 14 nt, Yersinia pestis
aaauaguaauaauu

SEQ ID NO: 4147393 - RNA, 15 nt, Yersinia pestis
aaauaguaauaauua

SEQ ID NO: 4147394 - RNA, 22 nt, Yersinia pestis
aaauagucagugggcuauuuau

SEQ ID NO: 4147395 - RNA, 23 nt, Yersinia pestis
aaauagugcuaucugcugcggua

SEQ ID NO: 4147396 - RNA, 15 nt, Yersinia pestis
aaauaguggcacaaa

SEQ ID NO: 4147397 - RNA, 13 nt, Yersinia pestis
aaauauaaaauaa

SEQ ID NO: 4147398 - RNA, 15 nt, Yersinia pestis
aaauauaaccaaagu

SEQ ID NO: 4147399 - RNA, 15 nt, Yersinia pestis
aaauauaauuucaaa

SEQ ID NO: 4147400 - RNA, 22 nt, Yersinia pestis
aaauauaauuucaaaguaaaau

SEQ ID NO: 4147401 - RNA, 15 nt, Yersinia pestis
aaauauagcauguac

SEQ ID NO: 4147402 - RNA, 17 nt, Yersinia pestis
aaauaucacgacuuuaa

SEQ ID NO: 4147403 - RNA, 13 nt, Yersinia pestis
aaauaucacuuuu

SEQ ID NO: 4147404 - RNA, 15 nt, Yersinia pestis
aaauaucauuaacaa

SEQ ID NO: 4147405 - RNA, 18 nt, Yersinia pestis
aaauaucauuaacaaacu

SEQ ID NO: 4147406 - RNA, 18 nt, Yersinia pestis
aaauaucauuauuuugaa

SEQ ID NO: 4147407 - RNA, 22 nt, Yersinia pestis
aaauauccuccggcauagccgg

SEQ ID NO: 4147408 - RNA, 16 nt, Yersinia pestis
aaauauccugcucagc

SEQ ID NO: 4147409 - RNA, 20 nt, Yersinia pestis
aaauaucuuucagcaccaua

SEQ ID NO: 4147410 - RNA, 17 nt, Yersinia pestis
aaauaugaucuugauaa

SEQ ID NO: 4147411 - RNA, 18 nt, Yersinia pestis
aaauaugcugaccacugc

SEQ ID NO: 4147412 - RNA, 16 nt, Yersinia pestis
aaauauggguuaaaaa

SEQ ID NO: 4147413 - RNA, 22 nt, Yersinia pestis
aaauauggguuaaaaacuuuua

SEQ ID NO: 4147414 - RNA, 14 nt, Yersinia pestis
aaauauuaauccau

SEQ ID NO: 4147415 - RNA, 11 nt, Yersinia pestis
aaauauuauuu

SEQ ID NO: 4147416 - RNA, 19 nt, Yersinia pestis
aaauauuauuuaauuaaau

SEQ ID NO: 4147417 - RNA, 12 nt, Yersinia pestis
aaauauucauua

SEQ ID NO: 4147418 - RNA, 15 nt, Yersinia pestis
aaauauucauuaaaa

SEQ ID NO: 4147419 - RNA, 18 nt, Yersinia pestis
aaauauucauuaaaaaau

SEQ ID NO: 4147420 - RNA, 19 nt, Yersinia pestis
aaauauucgucucaucaau

SEQ ID NO: 4147421 - RNA, 15 nt, Yersinia pestis
aaaucaaauacugug

SEQ ID NO: 4147422 - RNA, 15 nt, Yersinia pestis
aaaucaagcugcucg

SEQ ID NO: 4147423 - RNA, 14 nt, Yersinia pestis
aaaucaagggcgau

SEQ ID NO: 4147424 - RNA, 18 nt, Yersinia pestis
aaaucaagggcgauggca

SEQ ID NO: 4147425 - RNA, 17 nt, Yersinia pestis
aaaucacaauuucaccc

SEQ ID NO: 4147426 - RNA, 20 nt, Yersinia pestis
aaaucacaugcggauugaac

SEQ ID NO: 4147427 - RNA, 18 nt, Yersinia pestis
aaaucacccgcaagaaua

SEQ ID NO: 4147428 - RNA, 22 nt, Yersinia pestis
aaaucacccgcaagaauaacug

SEQ ID NO: 4147429 - RNA, 15 nt, Yersinia pestis
aaaucaccuggccag

SEQ ID NO: 4147430 - RNA, 17 nt, Yersinia pestis
aaaucagaggcuucauu

SEQ ID NO: 4147431 - RNA, 21 nt, Yersinia pestis
aaaucaggccuuuuucucaau

SEQ ID NO: 4147432 - RNA, 22 nt, Yersinia pestis
aaaucagugaaggaugaauaaa

SEQ ID NO: 4147433 - RNA, 21 nt, Yersinia pestis
aaaucaguuccugauucgguu

SEQ ID NO: 4147434 - RNA, 15 nt, Yersinia pestis
aaaucauagccagcg

SEQ ID NO: 4147435 - RNA, 13 nt, Yersinia pestis
aaaucaucagcau

SEQ ID NO: 4147436 - RNA, 17 nt, Yersinia pestis
aaaucaucaucuugaaa

SEQ ID NO: 4147437 - RNA, 15 nt, Yersinia pestis
aaaucaugaaauuuu

SEQ ID NO: 4147438 - RNA, 17 nt, Yersinia pestis
aaaucauugacguuaca

SEQ ID NO: 4147439 - RNA, 18 nt, Yersinia pestis
aaauccaagccaccacca

SEQ ID NO: 4147440 - RNA, 23 nt, Yersinia pestis
aaauccaccagcgggcggcagau

SEQ ID NO: 4147441 - RNA, 14 nt, Yersinia pestis
aaauccagaucagc

SEQ ID NO: 4147442 - RNA, 14 nt, Yersinia pestis
aaauccccauucca

SEQ ID NO: 4147443 - RNA, 15 nt, Yersinia pestis
aaauccccauuccaa

SEQ ID NO: 4147444 - RNA, 17 nt, Yersinia pestis
aaaucccccaccaguaa

SEQ ID NO: 4147445 - RNA, 16 nt, Yersinia pestis
aaaucccccacgaucu

SEQ ID NO: 4147446 - RNA, 22 nt, Yersinia pestis
aaaucccgcuggaagucugcuu

SEQ ID NO: 4147447 - RNA, 20 nt, Yersinia pestis
aaaucccgcuugucgcccug

SEQ ID NO: 4147448 - RNA, 14 nt, Yersinia pestis
aacaacgaaacaca

SEQ ID NO: 4147449 - RNA, 14 nt, Yersinia pestis
aacaagaacaccag

SEQ ID NO: 4147450 - RNA, 23 nt, Yersinia pestis
aacaagacuuuccccagaugaau

SEQ ID NO: 4147451 - RNA, 21 nt, Yersinia pestis
aacaagaucccaagcaggaaa

SEQ ID NO: 4147452 - RNA, 16 nt, Yersinia pestis
aacaagcgaccaucau

SEQ ID NO: 4147453 - RNA, 21 nt, Yersinia pestis
aacaagcgaccaucaugaaua

SEQ ID NO: 4147454 - RNA, 16 nt, Yersinia pestis
aacaaggcaaauagag

SEQ ID NO: 4147455 - RNA, 17 nt, Yersinia pestis
aacaaguugaaccauaa

SEQ ID NO: 4147456 - RNA, 16 nt, Yersinia pestis
aacaaguuucacuuuc

SEQ ID NO: 4147457 - RNA, 22 nt, Yersinia pestis
aacaauaacgccguuaaaauga

SEQ ID NO: 4147458 - RNA, 15 nt, Yersinia pestis
aacaauaaucucagc

SEQ ID NO: 4147459 - RNA, 15 nt, Yersinia pestis
aacaauaccgccaau

SEQ ID NO: 4147460 - RNA, 14 nt, Yersinia pestis
aacaaucaccaccu

SEQ ID NO: 4147461 - RNA, 19 nt, Yersinia pestis
aacaaucagugcaauaaau

SEQ ID NO: 4147462 - RNA, 14 nt, Yersinia pestis
aacaauccgaacaa

SEQ ID NO: 4147463 - RNA, 19 nt, Yersinia pestis
aacaaucgauuccuguuga

SEQ ID NO: 4147464 - RNA, 16 nt, Yersinia pestis
aacaaugaacuguguu

SEQ ID NO: 4147465 - RNA, 18 nt, Yersinia pestis
aacaaugguucaucauuu

SEQ ID NO: 4147466 - RNA, 17 nt, Yersinia pestis
aacaauguuauauuucu

SEQ ID NO: 4147467 - RNA, 19 nt, Yersinia pestis
aacaauuuacgguccauaa

SEQ ID NO: 4147468 - RNA, 17 nt, Yersinia pestis
aacaauuuaucagacaa

SEQ ID NO: 4147469 - RNA, 18 nt, Yersinia pestis
aacaauuucgaaaacuca

SEQ ID NO: 4147470 - RNA, 18 nt, Yersinia pestis
aacaauuuuauuguuuuc

SEQ ID NO: 4147471 - RNA, 14 nt, Yersinia pestis
aacacacagcagac

SEQ ID NO: 4147472 - RNA, 19 nt, Yersinia pestis
aacacaccugcaacguuaa

SEQ ID NO: 4147473 - RNA, 19 nt, Yersinia pestis
aacacacuucgccagguca

SEQ ID NO: 4147474 - RNA, 21 nt, Yersinia pestis
aacacacuucgccaggucagg

SEQ ID NO: 4147475 - RNA, 13 nt, Yersinia pestis
aacacagcucccc

SEQ ID NO: 4147476 - RNA, 13 nt, Yersinia pestis
aacacauaaaauc

SEQ ID NO: 4147477 - RNA, 17 nt, Yersinia pestis
aacacauaaaaucagca

SEQ ID NO: 4147478 - RNA, 12 nt, Yersinia pestis
aacacauccagg

SEQ ID NO: 4147479 - RNA, 20 nt, Yersinia pestis
aacacaucuauuuuuuugaa

SEQ ID NO: 4147480 - RNA, 18 nt, Yersinia pestis
aacacaucuuccaguaca

SEQ ID NO: 4147481 - RNA, 21 nt, Yersinia pestis
aacacauggcucacuggucag

SEQ ID NO: 4147482 - RNA, 22 nt, Yersinia pestis
aacacauuccaguaaaaaaaua

SEQ ID NO: 4147483 - RNA, 16 nt, Yersinia pestis
aacaccaacaccacac

SEQ ID NO: 4147484 - RNA, 14 nt, Yersinia pestis
aacaccauacuuuu

SEQ ID NO: 4147485 - RNA, 11 nt, Yersinia pestis
aacaccaucaa

SEQ ID NO: 4147486 - RNA, 14 nt, Yersinia pestis
aacaccaucaacau

SEQ ID NO: 4147487 - RNA, 19 nt, Yersinia pestis
aacacccaacucaacggca

SEQ ID NO: 4147488 - RNA, 14 nt, Yersinia pestis
aacacccauuugcc

SEQ ID NO: 4147489 - RNA, 16 nt, Yersinia pestis
aacaccggcuucuccu

SEQ ID NO: 4147490 - RNA, 19 nt, Yersinia pestis
aacaccuaacuuccuaaca

SEQ ID NO: 4147491 - RNA, 20 nt, Yersinia pestis
aacaccuaacuuccuaacaa

SEQ ID NO: 4147492 - RNA, 19 nt, Yersinia pestis
aacaccuaguuauucugua

SEQ ID NO: 4147493 - RNA, 18 nt, Yersinia pestis
aacaccuauuuuauccca

SEQ ID NO: 4147494 - RNA, 18 nt, Yersinia pestis
aacaccuucacugaauac

SEQ ID NO: 4147495 - RNA, 16 nt, Yersinia pestis
aacacgaaaagcagca

SEQ ID NO: 4147496 - RNA, 19 nt, Yersinia pestis
aacacgggcaugaacgugu

SEQ ID NO: 4147497 - RNA, 15 nt, Yersinia pestis
aacacggugaauaaa

SEQ ID NO: 4147498 - RNA, 18 nt, Yersinia pestis
aacacgguuugaucaaca

SEQ ID NO: 4147499 - RNA, 20 nt, Yersinia pestis
aacacguucggcgucgccac

SEQ ID NO: 4147500 - RNA, 21 nt, Yersinia pestis
aacacguucggcgucgccacc

SEQ ID NO: 4147501 - RNA, 23 nt, Yersinia pestis
aacacuccucuuucuuaauaaua

SEQ ID NO: 4147502 - RNA, 12 nt, Yersinia pestis
aacacugcaaac

SEQ ID NO: 4147503 - RNA, 14 nt, Yersinia pestis
aacacuggcagcca

SEQ ID NO: 4147504 - RNA, 17 nt, Yersinia pestis
aacacuuagccagcaug

SEQ ID NO: 4147505 - RNA, 15 nt, Yersinia pestis
aacacuucagacuga

SEQ ID NO: 4147506 - RNA, 21 nt, Yersinia pestis
aacacuuuaucgaccacuuuu

SEQ ID NO: 4147507 - RNA, 18 nt, Yersinia pestis
aacagaagaguacgaaca

SEQ ID NO: 4147508 - RNA, 16 nt, Yersinia pestis
aacagacacagcaaca

SEQ ID NO: 4147509 - RNA, 21 nt, Yersinia pestis
aacagacuaaaaaccgccaca

SEQ ID NO: 4147510 - RNA, 15 nt, Yersinia pestis
aacagacucacucuc

SEQ ID NO: 4147511 - RNA, 20 nt, Yersinia pestis
aacagagcagaaagcagcag

SEQ ID NO: 4147512 - RNA, 19 nt, Yersinia pestis
aacagagccuuauaggcgc

SEQ ID NO: 4147513 - RNA, 23 nt, Yersinia pestis
aacagagccuuauaggcgcauau

SEQ ID NO: 4147514 - RNA, 18 nt, Yersinia pestis
aacagagcgcgagugaac

SEQ ID NO: 4147515 - RNA, 18 nt, Yersinia pestis
aacagauaacucagggcg

SEQ ID NO: 4147516 - RNA, 20 nt, Yersinia pestis
aacagauagauaaauguuca

SEQ ID NO: 4147517 - RNA, 18 nt, Yersinia pestis
aacagauauuacgcagcc

SEQ ID NO: 4147518 - RNA, 19 nt, Yersinia pestis
aacagaucacccgcaaaac

SEQ ID NO: 4147519 - RNA, 20 nt, Yersinia pestis
aacagaucacccgcaaaacu

SEQ ID NO: 4147520 - RNA, 21 nt, Yersinia pestis
aacagcaggauuaagcggagg

SEQ ID NO: 4147521 - RNA, 14 nt, Yersinia pestis
aacagcauuuaugc

SEQ ID NO: 4147522 - RNA, 16 nt, Yersinia pestis
aacagcauuuaugcug

SEQ ID NO: 4147523 - RNA, 12 nt, Yersinia pestis
aacagccauuua

SEQ ID NO: 4147524 - RNA, 15 nt, Yersinia pestis
aacagcccagauggc

SEQ ID NO: 4147525 - RNA, 15 nt, Yersinia pestis
aacagcccccugccu

SEQ ID NO: 4147526 - RNA, 23 nt, Yersinia pestis
aacagccuaaggccaucaauaaa

SEQ ID NO: 4147527 - RNA, 18 nt, Yersinia pestis
aacagcgcucauagcaaa

SEQ ID NO: 4147528 - RNA, 17 nt, Yersinia pestis
aacagcguaauaccacu

SEQ ID NO: 4147529 - RNA, 14 nt, Yersinia pestis
aacagcuucgccac

SEQ ID NO: 4147530 - RNA, 15 nt, Yersinia pestis
aacagcuucgccacc

SEQ ID NO: 4147531 - RNA, 22 nt, Yersinia pestis
aacagcuucgccaccagauagu

SEQ ID NO: 4147532 - RNA, 21 nt, Yersinia pestis
aacagcuugauagggcugaag

SEQ ID NO: 4147533 - RNA, 18 nt, Yersinia pestis
aacaggcgaguuucccuu

SEQ ID NO: 4147534 - RNA, 22 nt, Yersinia pestis
aacagggcagccaauuacgcug

SEQ ID NO: 4147535 - RNA, 16 nt, Yersinia pestis
aacaguaaauuauuuu

SEQ ID NO: 4147536 - RNA, 22 nt, Yersinia pestis
aacaguaacccagccccuaaca

SEQ ID NO: 4147537 - RNA, 21 nt, Yersinia pestis
aacaguaauaccccacccaga

SEQ ID NO: 4147538 - RNA, 22 nt, Yersinia pestis
aacaguagcagggccgcccaga

SEQ ID NO: 4147539 - RNA, 22 nt, Yersinia pestis
aacagugauucgcucgcauaaa

SEQ ID NO: 4147540 - RNA, 21 nt, Yersinia pestis
aacagugcaacauuaaaaaua

SEQ ID NO: 4147541 - RNA, 22 nt, Yersinia pestis
aacagugucacuuccgccgcca

SEQ ID NO: 4147542 - RNA, 17 nt, Yersinia pestis
aacaguuaaacaacgcu

SEQ ID NO: 4147543 - RNA, 13 nt, Yersinia pestis
aacaguucaaaca

SEQ ID NO: 4147544 - RNA, 19 nt, Yersinia pestis
aacaguuguuucaauaaau

SEQ ID NO: 4147545 - RNA, 22 nt, Yersinia pestis
aacauaaaaaaugccagcccca

SEQ ID NO: 4147546 - RNA, 16 nt, Yersinia pestis
aacauaaaaaugcacu

SEQ ID NO: 4147547 - RNA, 18 nt, Yersinia pestis
aacauaaaaaugcacuga

SEQ ID NO: 4147548 - RNA, 22 nt, Yersinia pestis
aacauaaggcuagaucguuaca

SEQ ID NO: 4147549 - RNA, 17 nt, Yersinia pestis
aacauaaguaauaagua

SEQ ID NO: 4147550 - RNA, 17 nt, Yersinia pestis
aacauacaaccacugaa

SEQ ID NO: 4147551 - RNA, 12 nt, Yersinia pestis
aacauacaccau

SEQ ID NO: 4147552 - RNA, 13 nt, Yersinia pestis
aacauacugauac

SEQ ID NO: 4147553 - RNA, 16 nt, Yersinia pestis
aacauacugauacaac

SEQ ID NO: 4147554 - RNA, 23 nt, Yersinia pestis
aacauagcuauuggcugauucaa

SEQ ID NO: 4147555 - RNA, 17 nt, Yersinia pestis
aacauauaaaccagcca

SEQ ID NO: 4147556 - RNA, 20 nt, Yersinia pestis
aacauauaaaccagccagug

SEQ ID NO: 4147557 - RNA, 12 nt, Yersinia pestis
aacauaucaaua

SEQ ID NO: 4147558 - RNA, 12 nt, Yersinia pestis
aacauaucguuu

SEQ ID NO: 4147559 - RNA, 17 nt, Yersinia pestis
aacauauugguaauuuc

SEQ ID NO: 4147560 - RNA, 13 nt, Yersinia pestis
aacaucaauggca

SEQ ID NO: 4147561 - RNA, 23 nt, Yersinia pestis
aacaucaauguauuaauuugguu

SEQ ID NO: 4147562 - RNA, 13 nt, Yersinia pestis
aacaucacacuug

SEQ ID NO: 4147563 - RNA, 14 nt, Yersinia pestis
aacaucauccccaa

SEQ ID NO: 4147564 - RNA, 13 nt, Yersinia pestis
aacaucaugacaa

SEQ ID NO: 4147565 - RNA, 14 nt, Yersinia pestis
aacauccauguaag

SEQ ID NO: 4147566 - RNA, 16 nt, Yersinia pestis
aacauccggcugaugu

SEQ ID NO: 4147567 - RNA, 17 nt, Yersinia pestis
aacauccuaaaaagcgc

SEQ ID NO: 4147568 - RNA, 14 nt, Yersinia pestis
aacaucgcccuuuu

SEQ ID NO: 4147569 - RNA, 18 nt, Yersinia pestis
aacaucguuaauccauuu

SEQ ID NO: 4147570 - RNA, 13 nt, Yersinia pestis
aaccggcgcaaau

SEQ ID NO: 4147571 - RNA, 19 nt, Yersinia pestis
aaccggcguaaauaaaagc

SEQ ID NO: 4147572 - RNA, 18 nt, Yersinia pestis
aaccggcuggaaauucau

SEQ ID NO: 4147573 - RNA, 22 nt, Yersinia pestis
aaccgggguucgcaaugaaccc

SEQ ID NO: 4147574 - RNA, 20 nt, Yersinia pestis
aaccgguauugaccagauag

SEQ ID NO: 4147575 - RNA, 17 nt, Yersinia pestis
aaccguagugagucagg

SEQ ID NO: 4147576 - RNA, 12 nt, Yersinia pestis
aaccgucaugcu

SEQ ID NO: 4147577 - RNA, 19 nt, Yersinia pestis
aaccgucgacuguaacagg

SEQ ID NO: 4147578 - RNA, 22 nt, Yersinia pestis
aaccguuuuuucaacuggcugu

SEQ ID NO: 4147579 - RNA, 17 nt, Yersinia pestis
aaccuaaaaaaaacaac

SEQ ID NO: 4147580 - RNA, 12 nt, Yersinia pestis
aaccuaacacgu

SEQ ID NO: 4147581 - RNA, 15 nt, Yersinia pestis
aaccuaauaacgcuc

SEQ ID NO: 4147582 - RNA, 19 nt, Yersinia pestis
aaccuaaucucuacauuua

SEQ ID NO: 4147583 - RNA, 18 nt, Yersinia pestis
aaccuaaugccagacaca

SEQ ID NO: 4147584 - RNA, 14 nt, Yersinia pestis
aaccuaccaccuac

SEQ ID NO: 4147585 - RNA, 16 nt, Yersinia pestis
aaccuagcugcugcaa

SEQ ID NO: 4147586 - RNA, 19 nt, Yersinia pestis
aaccuagcugcugcaagag

SEQ ID NO: 4147587 - RNA, 17 nt, Yersinia pestis
aaccuauuaucccaguu

SEQ ID NO: 4147588 - RNA, 16 nt, Yersinia pestis
aaccucacgggcuucc

SEQ ID NO: 4147589 - RNA, 13 nt, Yersinia pestis
aaccucagccuca

SEQ ID NO: 4147590 - RNA, 19 nt, Yersinia pestis
aaccuccgcgauaccaaua

SEQ ID NO: 4147591 - RNA, 19 nt, Yersinia pestis
aaccuccggcuaugccgga

SEQ ID NO: 4147592 - RNA, 20 nt, Yersinia pestis
aaccuccggcuaugccggag

SEQ ID NO: 4147593 - RNA, 23 nt, Yersinia pestis
aaccucgggcgcuuaaauaaaac

SEQ ID NO: 4147594 - RNA, 21 nt, Yersinia pestis
aaccucgguggcucaauccaa

SEQ ID NO: 4147595 - RNA, 18 nt, Yersinia pestis
aaccucuucuuccgccac

SEQ ID NO: 4147596 - RNA, 18 nt, Yersinia pestis
aaccugacccgaucugug

SEQ ID NO: 4147597 - RNA, 22 nt, Yersinia pestis
aaccugagcggcguuguucucu

SEQ ID NO: 4147598 - RNA, 14 nt, Yersinia pestis
aaccugcacuuuca

SEQ ID NO: 4147599 - RNA, 23 nt, Yersinia pestis
aaccugcacuuucaugccuugaa

SEQ ID NO: 4147600 - RNA, 21 nt, Yersinia pestis
aaccuggcaccggacaaacca

SEQ ID NO: 4147601 - RNA, 14 nt, Yersinia pestis
aaccugguuaucgg

SEQ ID NO: 4147602 - RNA, 18 nt, Yersinia pestis
aaccugucgcagaaaaca

SEQ ID NO: 4147603 - RNA, 15 nt, Yersinia pestis
aaccugugugaccuc

SEQ ID NO: 4147604 - RNA, 22 nt, Yersinia pestis
aaccuguuacaucagagcucaa

SEQ ID NO: 4147605 - RNA, 16 nt, Yersinia pestis
aaccuuaucaccaacg

SEQ ID NO: 4147606 - RNA, 14 nt, Yersinia pestis
aaccuucucugcac

SEQ ID NO: 4147607 - RNA, 16 nt, Yersinia pestis
aaccuuuacaauuaca

SEQ ID NO: 4147608 - RNA, 22 nt, Yersinia pestis
aaccuuuaccagcgucaaacca

SEQ ID NO: 4147609 - RNA, 20 nt, Yersinia pestis
aacgaaacacacuucgccgg

SEQ ID NO: 4147610 - RNA, 18 nt, Yersinia pestis
aacgaaacuaacgcguga

SEQ ID NO: 4147611 - RNA, 15 nt, Yersinia pestis
aacgaaguuagaccc

SEQ ID NO: 4147612 - RNA, 18 nt, Yersinia pestis
aacgaauaauucagauaa

SEQ ID NO: 4147613 - RNA, 17 nt, Yersinia pestis
aacgaauuucauuuuaa

SEQ ID NO: 4147614 - RNA, 12 nt, Yersinia pestis
aacgacaaccca

SEQ ID NO: 4147615 - RNA, 15 nt, Yersinia pestis
aacgaguuuccaguu

SEQ ID NO: 4147616 - RNA, 21 nt, Yersinia pestis
aacgaucagaacuaacacuau

SEQ ID NO: 4147617 - RNA, 16 nt, Yersinia pestis
aacgaugaccgugaca

SEQ ID NO: 4147618 - RNA, 16 nt, Yersinia pestis
aacgcaacgcacgauc

SEQ ID NO: 4147619 - RNA, 16 nt, Yersinia pestis
aacgcaauaggcuauu

SEQ ID NO: 4147620 - RNA, 15 nt, Yersinia pestis
aacgcaauugcaccg

SEQ ID NO: 4147621 - RNA, 23 nt, Yersinia pestis
aacgcaccccacaaccugcgcca

SEQ ID NO: 4147622 - RNA, 21 nt, Yersinia pestis
aacgcacuggucaguauaaau

SEQ ID NO: 4147623 - RNA, 21 nt, Yersinia pestis
aacgcaggcacugcagaaaau

SEQ ID NO: 4147624 - RNA, 22 nt, Yersinia pestis
aacgcauucauaucguccaaag

SEQ ID NO: 4147625 - RNA, 21 nt, Yersinia pestis
aacgccaccagcgccaugaua

SEQ ID NO: 4147626 - RNA, 15 nt, Yersinia pestis
aacgccagauaacga

SEQ ID NO: 4147627 - RNA, 17 nt, Yersinia pestis
aacgccagauaugauca

SEQ ID NO: 4147628 - RNA, 19 nt, Yersinia pestis
aacgccagugcaaaaugcu

SEQ ID NO: 4147629 - RNA, 16 nt, Yersinia pestis
aacgcccaaaucugcc

SEQ ID NO: 4147630 - RNA, 13 nt, Yersinia pestis
aacgccgaguaag

SEQ ID NO: 4147631 - RNA, 19 nt, Yersinia pestis
aacgccgaucauaaaucac

SEQ ID NO: 4147632 - RNA, 20 nt, Yersinia pestis
aacgccgcgucaauaacauu

SEQ ID NO: 4147633 - RNA, 15 nt, Yersinia pestis
aacgccgcuaaauca

SEQ ID NO: 4147634 - RNA, 21 nt, Yersinia pestis
aacgcgccauauucaccacac

SEQ ID NO: 4147635 - RNA, 22 nt, Yersinia pestis
aacgcgccauauucaccacaca

SEQ ID NO: 4147636 - RNA, 23 nt, Yersinia pestis
aacgcgccauauucaccacacau

SEQ ID NO: 4147637 - RNA, 20 nt, Yersinia pestis
aacgcgccuuucggcaauau

SEQ ID NO: 4147638 - RNA, 20 nt, Yersinia pestis
aacgcggagccaaacgugcu

SEQ ID NO: 4147639 - RNA, 13 nt, Yersinia pestis
aacgcgucacugg

SEQ ID NO: 4147640 - RNA, 17 nt, Yersinia pestis
aacgcgucacuggccac

SEQ ID NO: 4147641 - RNA, 22 nt, Yersinia pestis
aacgcuaccaugagugaaaaua

SEQ ID NO: 4147642 - RNA, 22 nt, Yersinia pestis
aacgcucaucaaccgggauauc

SEQ ID NO: 4147643 - RNA, 14 nt, Yersinia pestis
aacgcuccagugca

SEQ ID NO: 4147644 - RNA, 12 nt, Yersinia pestis
aacgcucccucc

SEQ ID NO: 4147645 - RNA, 23 nt, Yersinia pestis
aacgcucccuccgccagcaaguu

SEQ ID NO: 4147646 - RNA, 23 nt, Yersinia pestis
aacgcuccgguuuucacccccac

SEQ ID NO: 4147647 - RNA, 21 nt, Yersinia pestis
aacgcugauguaggcaauaca

SEQ ID NO: 4147648 - RNA, 22 nt, Yersinia pestis
aacgcugcaauuauaagcacaa

SEQ ID NO: 4147649 - RNA, 13 nt, Yersinia pestis
aacgcugcuugcc

SEQ ID NO: 4147650 - RNA, 14 nt, Yersinia pestis
aacgcuucaguaaa

SEQ ID NO: 4147651 - RNA, 23 nt, Yersinia pestis
aacgcuuuacuccucugccuauc

SEQ ID NO: 4147652 - RNA, 13 nt, Yersinia pestis
aacggacauuuua

SEQ ID NO: 4147653 - RNA, 17 nt, Yersinia pestis
aacggacgaccuguagc

SEQ ID NO: 4147654 - RNA, 22 nt, Yersinia pestis
aacggacuaucgcgaaagcacu

SEQ ID NO: 4147655 - RNA, 13 nt, Yersinia pestis
aacggagaugauu

SEQ ID NO: 4147656 - RNA, 16 nt, Yersinia pestis
aacggauacccagcac

SEQ ID NO: 4147657 - RNA, 16 nt, Yersinia pestis
aacggcaaugaccauc

SEQ ID NO: 4147658 - RNA, 21 nt, Yersinia pestis
aacggcaaugaccaucaacuc

SEQ ID NO: 4147659 - RNA, 16 nt, Yersinia pestis
aacggcacaucccaau

SEQ ID NO: 4147660 - RNA, 18 nt, Yersinia pestis
aacggcagugaucgcacu

SEQ ID NO: 4147661 - RNA, 18 nt, Yersinia pestis
aacggcaguuaacgacgc

SEQ ID NO: 4147662 - RNA, 12 nt, Yersinia pestis
aacggccccuca

SEQ ID NO: 4147663 - RNA, 17 nt, Yersinia pestis
aacggcccucuuggcgu

SEQ ID NO: 4147664 - RNA, 15 nt, Yersinia pestis
aacggcggcaauacc

SEQ ID NO: 4147665 - RNA, 16 nt, Yersinia pestis
aacgggcaaccuguac

SEQ ID NO: 4147666 - RNA, 20 nt, Yersinia pestis
aacgggccgcauucaccacc

SEQ ID NO: 4147667 - RNA, 12 nt, Yersinia pestis
aacgggcggcug

SEQ ID NO: 4147668 - RNA, 14 nt, Yersinia pestis
aacgggcuuccauc

SEQ ID NO: 4147669 - RNA, 16 nt, Yersinia pestis
aacggguaacgaacgc

SEQ ID NO: 4147670 - RNA, 15 nt, Yersinia pestis
aacgguaaaagguua

SEQ ID NO: 4147671 - RNA, 15 nt, Yersinia pestis
aacgguaaccaggcg

SEQ ID NO: 4147672 - RNA, 16 nt, Yersinia pestis
aacgguaacccgauaa

SEQ ID NO: 4147673 - RNA, 13 nt, Yersinia pestis
aacgguaucaguc

SEQ ID NO: 4147674 - RNA, 13 nt, Yersinia pestis
aacggugaacaga

SEQ ID NO: 4147675 - RNA, 18 nt, Yersinia pestis
aacggugaggauaggcug

SEQ ID NO: 4147676 - RNA, 17 nt, Yersinia pestis
aacggugcgacaaugcc

SEQ ID NO: 4147677 - RNA, 15 nt, Yersinia pestis
aacgguuggucagca

SEQ ID NO: 4147678 - RNA, 19 nt, Yersinia pestis
aacgguuucaacuucaacg

SEQ ID NO: 4147679 - RNA, 15 nt, Yersinia pestis
aacguagcugaauug

SEQ ID NO: 4147680 - RNA, 16 nt, Yersinia pestis
aacgucaauggcaccg

SEQ ID NO: 4147681 - RNA, 17 nt, Yersinia pestis
aacgucagauaaacaaa

SEQ ID NO: 4147682 - RNA, 19 nt, Yersinia pestis
aacgucaucgccacacgca

SEQ ID NO: 4147683 - RNA, 12 nt, Yersinia pestis
aacgucgccagu

SEQ ID NO: 4147684 - RNA, 11 nt, Yersinia pestis
aacgugacaua

SEQ ID NO: 4147685 - RNA, 16 nt, Yersinia pestis
aacgugacucuuuguu

SEQ ID NO: 4147686 - RNA, 22 nt, Yersinia pestis
aacguguuagguaauaccaaug

SEQ ID NO: 4147687 - RNA, 13 nt, Yersinia pestis
aacguuaacugca

SEQ ID NO: 4147688 - RNA, 16 nt, Yersinia pestis
aacguuaacugcagua

SEQ ID NO: 4147689 - RNA, 13 nt, Yersinia pestis
aacguuagagcac

SEQ ID NO: 4147690 - RNA, 15 nt, Yersinia pestis
aacguucaauugauc

SEQ ID NO: 4147691 - RNA, 13 nt, Yersinia pestis
aacguucugccaa

SEQ ID NO: 4147692 - RNA, 20 nt, Yersinia pestis
aacuuuuuguugcaccaacg

SEQ ID NO: 4147693 - RNA, 17 nt, Yersinia pestis
aacuuuuuuaccacauu

SEQ ID NO: 4147694 - RNA, 18 nt, Yersinia pestis
aacuuuuuucauccuaaa

SEQ ID NO: 4147695 - RNA, 21 nt, Yersinia pestis
aacuuuuuucuuaaggacccg

SEQ ID NO: 4147696 - RNA, 12 nt, Yersinia pestis
aagaaaagcacc

SEQ ID NO: 4147697 - RNA, 12 nt, Yersinia pestis
aagaaaccagcg

SEQ ID NO: 4147698 - RNA, 21 nt, Yersinia pestis
aagaaacgccccgauaaacca

SEQ ID NO: 4147699 - RNA, 23 nt, Yersinia pestis
aagaaacuucauuucagguaaaa

SEQ ID NO: 4147700 - RNA, 11 nt, Yersinia pestis
aagaaauaaaa

SEQ ID NO: 4147701 - RNA, 23 nt, Yersinia pestis
aagaaaucauuuaggcguuucuu

SEQ ID NO: 4147702 - RNA, 20 nt, Yersinia pestis
aagaacuggcuggaucagca

SEQ ID NO: 4147703 - RNA, 23 nt, Yersinia pestis
aagaacuggcuggaucagcagac

SEQ ID NO: 4147704 - RNA, 19 nt, Yersinia pestis
aagaagaauccacauaaaa

SEQ ID NO: 4147705 - RNA, 19 nt, Yersinia pestis
aagaagacaauagagucac

SEQ ID NO: 4147706 - RNA, 20 nt, Yersinia pestis
aagaagacgaguaaugaaau

SEQ ID NO: 4147707 - RNA, 14 nt, Yersinia pestis
aagaagccaagaug

SEQ ID NO: 4147708 - RNA, 12 nt, Yersinia pestis
aagaagccucau

SEQ ID NO: 4147709 - RNA, 21 nt, Yersinia pestis
aagaagcgggcggccucugcu

SEQ ID NO: 4147710 - RNA, 22 nt, Yersinia pestis
aagaaggcgaguuucucugcuc

SEQ ID NO: 4147711 - RNA, 12 nt, Yersinia pestis
aagaauaaauaa

SEQ ID NO: 4147712 - RNA, 14 nt, Yersinia pestis
aagaauaaauaaua

SEQ ID NO: 4147713 - RNA, 15 nt, Yersinia pestis
aagaauaaauaauau

SEQ ID NO: 4147714 - RNA, 16 nt, Yersinia pestis
aagaauaaaugucacu

SEQ ID NO: 4147715 - RNA, 22 nt, Yersinia pestis
aagaauaaggguagguucaaua

SEQ ID NO: 4147716 - RNA, 13 nt, Yersinia pestis
aagaauauaauac

SEQ ID NO: 4147717 - RNA, 19 nt, Yersinia pestis
aagaaucaccgaaagaaga

SEQ ID NO: 4147718 - RNA, 19 nt, Yersinia pestis
aagaauccucugaauaaaa

SEQ ID NO: 4147719 - RNA, 20 nt, Yersinia pestis
aagaauccucugaauaaaaa

SEQ ID NO: 4147720 - RNA, 16 nt, Yersinia pestis
aagaauggcgcgacca

SEQ ID NO: 4147721 - RNA, 20 nt, Yersinia pestis
aagaauggucgaucagcgua

SEQ ID NO: 4147722 - RNA, 15 nt, Yersinia pestis
aagaauguauugaga

SEQ ID NO: 4147723 - RNA, 23 nt, Yersinia pestis
aagaauguauugagauuuuccca

SEQ ID NO: 4147724 - RNA, 23 nt, Yersinia pestis
aagaauugcagauaccacaucaa

SEQ ID NO: 4147725 - RNA, 16 nt, Yersinia pestis
aagacaacaaacagua

SEQ ID NO: 4147726 - RNA, 22 nt, Yersinia pestis
aagacaauaaaucgccacgcca

SEQ ID NO: 4147727 - RNA, 19 nt, Yersinia pestis
aagacaauagagucacaga

SEQ ID NO: 4147728 - RNA, 21 nt, Yersinia pestis
aagacaccacaucacgcagcg

SEQ ID NO: 4147729 - RNA, 19 nt, Yersinia pestis
aagaccacaucaaccugau

SEQ ID NO: 4147730 - RNA, 21 nt, Yersinia pestis
aagaccgcuuuaucaaagaau

SEQ ID NO: 4147731 - RNA, 23 nt, Yersinia pestis
aagaccgcuuuaucaaagaauuc

SEQ ID NO: 4147732 - RNA, 18 nt, Yersinia pestis
aagaccgguggcuuuuuc

SEQ ID NO: 4147733 - RNA, 20 nt, Yersinia pestis
aagaccugccaauuccuuag

SEQ ID NO: 4147734 - RNA, 17 nt, Yersinia pestis
aagaccuguugaucuuc

SEQ ID NO: 4147735 - RNA, 19 nt, Yersinia pestis
aagacgaguaaugaaaucu

SEQ ID NO: 4147736 - RNA, 17 nt, Yersinia pestis
aagacgccguaaauaca

SEQ ID NO: 4147737 - RNA, 19 nt, Yersinia pestis
aagacguaucgcaguuaaa

SEQ ID NO: 4147738 - RNA, 11 nt, Yersinia pestis
aagacugaagu

SEQ ID NO: 4147739 - RNA, 18 nt, Yersinia pestis
aagacuuuuccaacggcu

SEQ ID NO: 4147740 - RNA, 13 nt, Yersinia pestis
aagagaaaagcag

SEQ ID NO: 4147741 - RNA, 14 nt, Yersinia pestis
aagagaaaagcaga

SEQ ID NO: 4147742 - RNA, 21 nt, Yersinia pestis
aagagaaagccugcguuaaaa

SEQ ID NO: 4147743 - RNA, 21 nt, Yersinia pestis
aagagaaaguugauccugggu

SEQ ID NO: 4147744 - RNA, 15 nt, Yersinia pestis
aagagaacggagaga

SEQ ID NO: 4147745 - RNA, 15 nt, Yersinia pestis
aagagagaauccauu

SEQ ID NO: 4147746 - RNA, 22 nt, Yersinia pestis
aagagagaauccauuuaaucgc

SEQ ID NO: 4147747 - RNA, 14 nt, Yersinia pestis
aagagagccauaau

SEQ ID NO: 4147748 - RNA, 18 nt, Yersinia pestis
aagagaggcaaugauuuu

SEQ ID NO: 4147749 - RNA, 23 nt, Yersinia pestis
aagagauaaaucggcggccaugu

SEQ ID NO: 4147750 - RNA, 15 nt, Yersinia pestis
aagagcgccucacug

SEQ ID NO: 4147751 - RNA, 22 nt, Yersinia pestis
aagagcggucgacaaaauguga

SEQ ID NO: 4147752 - RNA, 14 nt, Yersinia pestis
aagaggaaaugccg

SEQ ID NO: 4147753 - RNA, 19 nt, Yersinia pestis
aagagggcgguuaaauaca

SEQ ID NO: 4147754 - RNA, 16 nt, Yersinia pestis
aagaguacgaacagag

SEQ ID NO: 4147755 - RNA, 12 nt, Yersinia pestis
aagagucacagc

SEQ ID NO: 4147756 - RNA, 21 nt, Yersinia pestis
aagagucgcaaaacuucacuu

SEQ ID NO: 4147757 - RNA, 19 nt, Yersinia pestis
aagagugaccaaagcagua

SEQ ID NO: 4147758 - RNA, 21 nt, Yersinia pestis
aagagugaccaaagcaguaaa

SEQ ID NO: 4147759 - RNA, 21 nt, Yersinia pestis
aagauaacuuuuuauuucuuu

SEQ ID NO: 4147760 - RNA, 13 nt, Yersinia pestis
aagauaaucugca

SEQ ID NO: 4147761 - RNA, 17 nt, Yersinia pestis
aagauaccaacccacuc

SEQ ID NO: 4147762 - RNA, 20 nt, Yersinia pestis
aagauacccgccauaaauaa

SEQ ID NO: 4147763 - RNA, 20 nt, Yersinia pestis
aagauacccuucucuuuauc

SEQ ID NO: 4147764 - RNA, 22 nt, Yersinia pestis
aagauagacauauuguccaaca

SEQ ID NO: 4147765 - RNA, 16 nt, Yersinia pestis
aagauagccacuaacu

SEQ ID NO: 4147766 - RNA, 14 nt, Yersinia pestis
aagauagcugucag

SEQ ID NO: 4147767 - RNA, 16 nt, Yersinia pestis
aagauaucuuugaguu

SEQ ID NO: 4147768 - RNA, 19 nt, Yersinia pestis
aagaucacgcuaccggaac

SEQ ID NO: 4147769 - RNA, 13 nt, Yersinia pestis
aagauccaguuca

SEQ ID NO: 4147770 - RNA, 15 nt, Yersinia pestis
aagaugaccaccaau

SEQ ID NO: 4147771 - RNA, 12 nt, Yersinia pestis
aagaugcagggc

SEQ ID NO: 4147772 - RNA, 21 nt, Yersinia pestis
aagaugccaaucaaaaaaccg

SEQ ID NO: 4147773 - RNA, 18 nt, Yersinia pestis
aagaugccuauuugcaga

SEQ ID NO: 4147774 - RNA, 18 nt, Yersinia pestis
aagauuacguagacauaa

SEQ ID NO: 4147775 - RNA, 12 nt, Yersinia pestis
aagauucaacca

SEQ ID NO: 4147776 - RNA, 16 nt, Yersinia pestis
aagauucauaaaaaaa

SEQ ID NO: 4147777 - RNA, 15 nt, Yersinia pestis
aagauuggcagcgua

SEQ ID NO: 4147778 - RNA, 16 nt, Yersinia pestis
aagauuggcagcguaa

SEQ ID NO: 4147779 - RNA, 15 nt, Yersinia pestis
aagauuuaaauaaca

SEQ ID NO: 4147780 - RNA, 23 nt, Yersinia pestis
aagauuucaucggcaaaaacagu

SEQ ID NO: 4147781 - RNA, 22 nt, Yersinia pestis
aagauuuuguagcccacugaca

SEQ ID NO: 4147782 - RNA, 23 nt, Yersinia pestis
aagcaaccgcaaugccgcuaggg

SEQ ID NO: 4147783 - RNA, 19 nt, Yersinia pestis
aagcaagaccgguggcuuu

SEQ ID NO: 4147784 - RNA, 19 nt, Yersinia pestis
aagcaagcggcagcgcugg

SEQ ID NO: 4147785 - RNA, 15 nt, Yersinia pestis
aagcaauaaacucau

SEQ ID NO: 4147786 - RNA, 20 nt, Yersinia pestis
aagcaauguucaaaucugcu

SEQ ID NO: 4147787 - RNA, 20 nt, Yersinia pestis
aagcaauucggccaaguuug

SEQ ID NO: 4147788 - RNA, 21 nt, Yersinia pestis
aagcaauuugaucaccaaucg

SEQ ID NO: 4147789 - RNA, 15 nt, Yersinia pestis
aagcacagacaaaca

SEQ ID NO: 4147790 - RNA, 13 nt, Yersinia pestis
aagcacagucgcc

SEQ ID NO: 4147791 - RNA, 22 nt, Yersinia pestis
aagcacuguacugggaugaaga

SEQ ID NO: 4147792 - RNA, 15 nt, Yersinia pestis
aagcagauaaagaaa

SEQ ID NO: 4147793 - RNA, 19 nt, Yersinia pestis
aagcagcaccaauaucaau

SEQ ID NO: 4147794 - RNA, 14 nt, Yersinia pestis
aagcagccgccgcu

SEQ ID NO: 4147795 - RNA, 17 nt, Yersinia pestis
aagcagcgucucgugua

SEQ ID NO: 4147796 - RNA, 16 nt, Yersinia pestis
aagcagcguucaaauc

SEQ ID NO: 4147797 - RNA, 20 nt, Yersinia pestis
aagcagcguucaaaucugcu

SEQ ID NO: 4147798 - RNA, 18 nt, Yersinia pestis
aagcaggggaucgggcug

SEQ ID NO: 4147799 - RNA, 17 nt, Yersinia pestis
aagcagguaguuacagc

SEQ ID NO: 4147800 - RNA, 15 nt, Yersinia pestis
aagcaguaaacauuu

SEQ ID NO: 4147801 - RNA, 22 nt, Yersinia pestis
aagcagucgacaguguaaaaag

SEQ ID NO: 4147802 - RNA, 22 nt, Yersinia pestis
aagcaguucacucuguuuuaaa

SEQ ID NO: 4147803 - RNA, 23 nt, Yersinia pestis
aagcauaaccgguaccggcuggg

SEQ ID NO: 4147804 - RNA, 17 nt, Yersinia pestis
aagcaucaccaaagaua

SEQ ID NO: 4147805 - RNA, 22 nt, Yersinia pestis
aagcaugcccagccucuggaua

SEQ ID NO: 4147806 - RNA, 22 nt, Yersinia pestis
aagcauggcagguaucaauaca

SEQ ID NO: 4147807 - RNA, 19 nt, Yersinia pestis
aagcauucgcgguuacacc

SEQ ID NO: 4147808 - RNA, 22 nt, Yersinia pestis
aagcauuuuaucgugaauaaaa

SEQ ID NO: 4147809 - RNA, 17 nt, Yersinia pestis
aagccaaaacagccuaa

SEQ ID NO: 4147810 - RNA, 17 nt, Yersinia pestis
aagccaaacaaaugaac

SEQ ID NO: 4147811 - RNA, 14 nt, Yersinia pestis
aagccaacccccau

SEQ ID NO: 4147812 - RNA, 12 nt, Yersinia pestis
aagccaaucucu

SEQ ID NO: 4147813 - RNA, 17 nt, Yersinia pestis
aaguaaaagucagcaaa

SEQ ID NO: 4147814 - RNA, 23 nt, Yersinia pestis
aaguaacauuuguauuuuuucuu

SEQ ID NO: 4147815 - RNA, 16 nt, Yersinia pestis
aaguaaggagcaaaag

SEQ ID NO: 4147816 - RNA, 12 nt, Yersinia pestis
aaguaaggugcc

SEQ ID NO: 4147817 - RNA, 14 nt, Yersinia pestis
aaguaaguuuaaac

SEQ ID NO: 4147818 - RNA, 12 nt, Yersinia pestis
aaguaauaaaaa

SEQ ID NO: 4147819 - RNA, 16 nt, Yersinia pestis
aaguaauccagauggc

SEQ ID NO: 4147820 - RNA, 21 nt, Yersinia pestis
aaguaauuuaucaguagucaa

SEQ ID NO: 4147821 - RNA, 20 nt, Yersinia pestis
aaguacaaggggcaucugcu

SEQ ID NO: 4147822 - RNA, 22 nt, Yersinia pestis
aaguaccgcuuugugaugcacc

SEQ ID NO: 4147823 - RNA, 23 nt, Yersinia pestis
aaguaccgcuuugugaugcaccu

SEQ ID NO: 4147824 - RNA, 13 nt, Yersinia pestis
aaguacuaucuau

SEQ ID NO: 4147825 - RNA, 21 nt, Yersinia pestis
aaguacuuauuugaaacacuu

SEQ ID NO: 4147826 - RNA, 19 nt, Yersinia pestis
aaguacuuccaauaaguga

SEQ ID NO: 4147827 - RNA, 19 nt, Yersinia pestis
aaguagccacuuaauaaug

SEQ ID NO: 4147828 - RNA, 18 nt, Yersinia pestis
aaguaggcaucugccaca

SEQ ID NO: 4147829 - RNA, 20 nt, Yersinia pestis
aaguaggcuuauuaugacaa

SEQ ID NO: 4147830 - RNA, 21 nt, Yersinia pestis
aaguaggcuuauuaugacaac

SEQ ID NO: 4147831 - RNA, 14 nt, Yersinia pestis
aaguagucagcaac

SEQ ID NO: 4147832 - RNA, 13 nt, Yersinia pestis
aaguaugcagggu

SEQ ID NO: 4147833 - RNA, 17 nt, Yersinia pestis
aagucaaauuuaaaguu

SEQ ID NO: 4147834 - RNA, 21 nt, Yersinia pestis
aagucaaucggaacucagacu

SEQ ID NO: 4147835 - RNA, 11 nt, Yersinia pestis
aagucacaccg

SEQ ID NO: 4147836 - RNA, 15 nt, Yersinia pestis
aagucaugauguuga

SEQ ID NO: 4147837 - RNA, 22 nt, Yersinia pestis
aagucaugguacaacugcggcg

SEQ ID NO: 4147838 - RNA, 23 nt, Yersinia pestis
aaguccaagaagauaacuuuuua

SEQ ID NO: 4147839 - RNA, 14 nt, Yersinia pestis
aagucccucccuuc

SEQ ID NO: 4147840 - RNA, 15 nt, Yersinia pestis
aaguccgucuuguau

SEQ ID NO: 4147841 - RNA, 18 nt, Yersinia pestis
aaguccuuaaaaauccau

SEQ ID NO: 4147842 - RNA, 15 nt, Yersinia pestis
aagucucuagaauuc

SEQ ID NO: 4147843 - RNA, 18 nt, Yersinia pestis
aagucuuauaaugcaggg

SEQ ID NO: 4147844 - RNA, 21 nt, Yersinia pestis
aagucuugaagagugaccaaa

SEQ ID NO: 4147845 - RNA, 14 nt, Yersinia pestis
aagucuuuccuaca

SEQ ID NO: 4147846 - RNA, 15 nt, Yersinia pestis
aagugaacaugauga

SEQ ID NO: 4147847 - RNA, 13 nt, Yersinia pestis
aagugaauaacgc

SEQ ID NO: 4147848 - RNA, 15 nt, Yersinia pestis
aagugaauaacgcug

SEQ ID NO: 4147849 - RNA, 16 nt, Yersinia pestis
aagugaauaccgcuaa

SEQ ID NO: 4147850 - RNA, 18 nt, Yersinia pestis
aagugacccaagaugacc

SEQ ID NO: 4147851 - RNA, 20 nt, Yersinia pestis
aagugaucagcuaacaaaac

SEQ ID NO: 4147852 - RNA, 22 nt, Yersinia pestis
aagugaucagcuaacaaaaccg

SEQ ID NO: 4147853 - RNA, 17 nt, Yersinia pestis
aagugauccacauuacc

SEQ ID NO: 4147854 - RNA, 14 nt, Yersinia pestis
aagugcaaacuuaa

SEQ ID NO: 4147855 - RNA, 17 nt, Yersinia pestis
aagugcaaacuuaaaaa

SEQ ID NO: 4147856 - RNA, 21 nt, Yersinia pestis
aagugcaaacuuaaaaaucaa

SEQ ID NO: 4147857 - RNA, 18 nt, Yersinia pestis
aagugcauuuuugaaacu

SEQ ID NO: 4147858 - RNA, 19 nt, Yersinia pestis
aagugcgggaaaguaauau

SEQ ID NO: 4147859 - RNA, 17 nt, Yersinia pestis
aagugcugcaaggcauu

SEQ ID NO: 4147860 - RNA, 19 nt, Yersinia pestis
aagugcugcaaggcauuaa

SEQ ID NO: 4147861 - RNA, 23 nt, Yersinia pestis
aagugguagccggacucaaaaua

SEQ ID NO: 4147862 - RNA, 15 nt, Yersinia pestis
aaguguaaaagauag

SEQ ID NO: 4147863 - RNA, 22 nt, Yersinia pestis
aaguguauucgcaucuuccaaa

SEQ ID NO: 4147864 - RNA, 16 nt, Yersinia pestis
aagugucaauaacccu

SEQ ID NO: 4147865 - RNA, 14 nt, Yersinia pestis
aaguguuucaaaua

SEQ ID NO: 4147866 - RNA, 17 nt, Yersinia pestis
aaguuaaaaagccugaa

SEQ ID NO: 4147867 - RNA, 15 nt, Yersinia pestis
aaguuaaacaauguu

SEQ ID NO: 4147868 - RNA, 18 nt, Yersinia pestis
aaguuaaacaauguuaaa

SEQ ID NO: 4147869 - RNA, 12 nt, Yersinia pestis
aaguuaaauaug

SEQ ID NO: 4147870 - RNA, 12 nt, Yersinia pestis
aaguuaauguuu

SEQ ID NO: 4147871 - RNA, 15 nt, Yersinia pestis
aaguuacgucagaaa

SEQ ID NO: 4147872 - RNA, 18 nt, Yersinia pestis
aaguuagcgauaucugcg

SEQ ID NO: 4147873 - RNA, 20 nt, Yersinia pestis
aaguuagcgugagaauaaua

SEQ ID NO: 4147874 - RNA, 23 nt, Yersinia pestis
aaguuaggguucaguaaaaccaa

SEQ ID NO: 4147875 - RNA, 17 nt, Yersinia pestis
aaguuagucgcaaagcg

SEQ ID NO: 4147876 - RNA, 19 nt, Yersinia pestis
aaguuagugguguuaucca

SEQ ID NO: 4147877 - RNA, 22 nt, Yersinia pestis
aaguuagugguguuauccacuu

SEQ ID NO: 4147878 - RNA, 16 nt, Yersinia pestis
aaguuaugccacauca

SEQ ID NO: 4147879 - RNA, 18 nt, Yersinia pestis
aaguuauuucagccaugg

SEQ ID NO: 4147880 - RNA, 17 nt, Yersinia pestis
aaguucacaugaugaau

SEQ ID NO: 4147881 - RNA, 19 nt, Yersinia pestis
aaguucagguugaaauaaa

SEQ ID NO: 4147882 - RNA, 23 nt, Yersinia pestis
aaguugaugggaggaaacugccg

SEQ ID NO: 4147883 - RNA, 19 nt, Yersinia pestis
aaguugccggacgccccac

SEQ ID NO: 4147884 - RNA, 11 nt, Yersinia pestis
aaguuuaacca

SEQ ID NO: 4147885 - RNA, 22 nt, Yersinia pestis
aaguuuaccgcaugaauauuca

SEQ ID NO: 4147886 - RNA, 16 nt, Yersinia pestis
aaguuuauuuaacaca

SEQ ID NO: 4147887 - RNA, 18 nt, Yersinia pestis
aaguuugauguagcagau

SEQ ID NO: 4147888 - RNA, 16 nt, Yersinia pestis
aaguuuucuggcaauu

SEQ ID NO: 4147889 - RNA, 14 nt, Yersinia pestis
aauaaaaaacugac

SEQ ID NO: 4147890 - RNA, 12 nt, Yersinia pestis
aauaaaaaagua

SEQ ID NO: 4147891 - RNA, 19 nt, Yersinia pestis
aauaaaaaauccagugcgc

SEQ ID NO: 4147892 - RNA, 18 nt, Yersinia pestis
aauaaaaaauuauuaaau

SEQ ID NO: 4147893 - RNA, 12 nt, Yersinia pestis
aauaaaaacaca

SEQ ID NO: 4147894 - RNA, 16 nt, Yersinia pestis
aauaaaaaccgcagca

SEQ ID NO: 4147895 - RNA, 20 nt, Yersinia pestis
aauaaaaaugauaauaaaaa

SEQ ID NO: 4147896 - RNA, 14 nt, Yersinia pestis
aauaaaacucacuu

SEQ ID NO: 4147897 - RNA, 12 nt, Yersinia pestis
aauaaaaucaaa

SEQ ID NO: 4147898 - RNA, 13 nt, Yersinia pestis
aauaaacaaaaua

SEQ ID NO: 4147899 - RNA, 15 nt, Yersinia pestis
aauaaacacuuggca

SEQ ID NO: 4147900 - RNA, 13 nt, Yersinia pestis
aauaaaccagcaa

SEQ ID NO: 4147901 - RNA, 16 nt, Yersinia pestis
aauaaaccagcaagcc

SEQ ID NO: 4147902 - RNA, 16 nt, Yersinia pestis
aauaaaccgaaaugau

SEQ ID NO: 4147903 - RNA, 18 nt, Yersinia pestis
aauaaaccgaaaugaucu

SEQ ID NO: 4147904 - RNA, 14 nt, Yersinia pestis
aauaaagaggccag

SEQ ID NO: 4147905 - RNA, 18 nt, Yersinia pestis
aauaaagccguuaucaau

SEQ ID NO: 4147906 - RNA, 19 nt, Yersinia pestis
aauaaagcgauaaauacuc

SEQ ID NO: 4147907 - RNA, 22 nt, Yersinia pestis
aauaaaguccaccucgaaauca

SEQ ID NO: 4147908 - RNA, 14 nt, Yersinia pestis
aauaaauaaguuca

SEQ ID NO: 4147909 - RNA, 17 nt, Yersinia pestis
aauaaauaauuuguaaa

SEQ ID NO: 4147910 - RNA, 19 nt, Yersinia pestis
aauaaauacccugcaccau

SEQ ID NO: 4147911 - RNA, 20 nt, Yersinia pestis
aauaaauacccugcaccaua

SEQ ID NO: 4147912 - RNA, 19 nt, Yersinia pestis
aauaaauauccuccggcau

SEQ ID NO: 4147913 - RNA, 19 nt, Yersinia pestis
aauaaaugucacuugcccu

SEQ ID NO: 4147914 - RNA, 15 nt, Yersinia pestis
aauaaauucaaaaua

SEQ ID NO: 4147915 - RNA, 11 nt, Yersinia pestis
aauaacaaaca

SEQ ID NO: 4147916 - RNA, 11 nt, Yersinia pestis
aauaacaauau

SEQ ID NO: 4147917 - RNA, 18 nt, Yersinia pestis
aauaacaauauucauuuu

SEQ ID NO: 4147918 - RNA, 16 nt, Yersinia pestis
aauaacaccagcaggu

SEQ ID NO: 4147919 - RNA, 19 nt, Yersinia pestis
aauaacacggccuauugaa

SEQ ID NO: 4147920 - RNA, 18 nt, Yersinia pestis
aauaacagcuaaaaugau

SEQ ID NO: 4147921 - RNA, 15 nt, Yersinia pestis
aauaaccaaaagccc

SEQ ID NO: 4147922 - RNA, 20 nt, Yersinia pestis
aauaaccaccucggaaggcc

SEQ ID NO: 4147923 - RNA, 17 nt, Yersinia pestis
aauaacccuugccaccu

SEQ ID NO: 4147924 - RNA, 13 nt, Yersinia pestis
aauaaccggguaa

SEQ ID NO: 4147925 - RNA, 21 nt, Yersinia pestis
aauaaccucacacgauuuuua

SEQ ID NO: 4147926 - RNA, 22 nt, Yersinia pestis
aauaaccucacgggcuuccauc

SEQ ID NO: 4147927 - RNA, 23 nt, Yersinia pestis
aauaaccucacgggcuuccauca

SEQ ID NO: 4147928 - RNA, 15 nt, Yersinia pestis
aauaaccucagccuc

SEQ ID NO: 4147929 - RNA, 22 nt, Yersinia pestis
aauaaccucaggcccgcuauca

SEQ ID NO: 4147930 - RNA, 19 nt, Yersinia pestis
aauaacgauccgucacaac

SEQ ID NO: 4147931 - RNA, 13 nt, Yersinia pestis
aauaacgccacaa

SEQ ID NO: 4147932 - RNA, 18 nt, Yersinia pestis
aauaacgccguuaaaaug

SEQ ID NO: 4147933 - RNA, 14 nt, Yersinia pestis
aauaacgcggccag

SEQ ID NO: 4147934 - RNA, 15 nt, Yersinia pestis
aauaacgcuggauaa

SEQ ID NO: 4147935 - RNA, 17 nt, Yersinia pestis
aauagacgaauggccgc

SEQ ID NO: 4147936 - RNA, 18 nt, Yersinia pestis
aauagagaauagauagca

SEQ ID NO: 4147937 - RNA, 15 nt, Yersinia pestis
aauagaggaaauaaa

SEQ ID NO: 4147938 - RNA, 21 nt, Yersinia pestis
aauagagugaaguaucaccac

SEQ ID NO: 4147939 - RNA, 12 nt, Yersinia pestis
aauagauaacaa

SEQ ID NO: 4147940 - RNA, 14 nt, Yersinia pestis
aauagauaacaaac

SEQ ID NO: 4147941 - RNA, 23 nt, Yersinia pestis
aauagauacugaaauauacacaa

SEQ ID NO: 4147942 - RNA, 18 nt, Yersinia pestis
aauagauagcaaucaaua

SEQ ID NO: 4147943 - RNA, 14 nt, Yersinia pestis
aauagauaguacuu

SEQ ID NO: 4147944 - RNA, 20 nt, Yersinia pestis
aauagauaucgaaacacaua

SEQ ID NO: 4147945 - RNA, 16 nt, Yersinia pestis
aauagcaaaacugagg

SEQ ID NO: 4147946 - RNA, 13 nt, Yersinia pestis
aauagcaaaccca

SEQ ID NO: 4147947 - RNA, 18 nt, Yersinia pestis
aauagcaaacccaccuga

SEQ ID NO: 4147948 - RNA, 19 nt, Yersinia pestis
aauagcaaacccaccugaa

SEQ ID NO: 4147949 - RNA, 13 nt, Yersinia pestis
aauagcaagccaa

SEQ ID NO: 4147950 - RNA, 23 nt, Yersinia pestis
aauagcaccauuaggcuuaggca

SEQ ID NO: 4147951 - RNA, 16 nt, Yersinia pestis
aauagcaguggccauu

SEQ ID NO: 4147952 - RNA, 14 nt, Yersinia pestis
aauagccagaagcc

SEQ ID NO: 4147953 - RNA, 18 nt, Yersinia pestis
aauagcccaaauaaccuc

SEQ ID NO: 4147954 - RNA, 14 nt, Yersinia pestis
aauagcccgcgaau

SEQ ID NO: 4147955 - RNA, 11 nt, Yersinia pestis
aauagccugua

SEQ ID NO: 4147956 - RNA, 16 nt, Yersinia pestis
aauagcgaucagcaac

SEQ ID NO: 4147957 - RNA, 16 nt, Yersinia pestis
aauagcgccugcccuc

SEQ ID NO: 4147958 - RNA, 13 nt, Yersinia pestis
aauagcgcugcau

SEQ ID NO: 4147959 - RNA, 21 nt, Yersinia pestis
aauagcuaccccuucagucag

SEQ ID NO: 4147960 - RNA, 22 nt, Yersinia pestis
aauagcugguagugauccccca

SEQ ID NO: 4147961 - RNA, 17 nt, Yersinia pestis
aauagcuuaaucaucau

SEQ ID NO: 4147962 - RNA, 22 nt, Yersinia pestis
aauaggcaggcccgcuucccua

SEQ ID NO: 4147963 - RNA, 14 nt, Yersinia pestis
aauaggcgucagca

SEQ ID NO: 4147964 - RNA, 17 nt, Yersinia pestis
aauaggggaauuuuuag

SEQ ID NO: 4147965 - RNA, 16 nt, Yersinia pestis
aauagguaaauccaga

SEQ ID NO: 4147966 - RNA, 19 nt, Yersinia pestis
aauagguaaauccagauca

SEQ ID NO: 4147967 - RNA, 15 nt, Yersinia pestis
aauaggucagugguu

SEQ ID NO: 4147968 - RNA, 20 nt, Yersinia pestis
aauaggucagugguuuuaua

SEQ ID NO: 4147969 - RNA, 21 nt, Yersinia pestis
aauaggucagugguuuuauca

SEQ ID NO: 4147970 - RNA, 14 nt, Yersinia pestis
aauagguguugccg

SEQ ID NO: 4147971 - RNA, 16 nt, Yersinia pestis
aauagguuggcauuag

SEQ ID NO: 4147972 - RNA, 13 nt, Yersinia pestis
aauaguagaucua

SEQ ID NO: 4147973 - RNA, 13 nt, Yersinia pestis
aauagucaguaaa

SEQ ID NO: 4147974 - RNA, 16 nt, Yersinia pestis
aauagucuguuucauu

SEQ ID NO: 4147975 - RNA, 14 nt, Yersinia pestis
aauagugucauaau

SEQ ID NO: 4147976 - RNA, 23 nt, Yersinia pestis
aauaguguguguauuuaaaagau

SEQ ID NO: 4147977 - RNA, 20 nt, Yersinia pestis
aauaguguuguaagauuuca

SEQ ID NO: 4147978 - RNA, 22 nt, Yersinia pestis
aauaguuauccaaacuuuuuaa

SEQ ID NO: 4147979 - RNA, 13 nt, Yersinia pestis
aauaguucauuuu

SEQ ID NO: 4147980 - RNA, 14 nt, Yersinia pestis
aauauaaaagcaca

SEQ ID NO: 4147981 - RNA, 18 nt, Yersinia pestis
aauauaaaagcacagaca

SEQ ID NO: 4147982 - RNA, 20 nt, Yersinia pestis
aauauaaaagcacagacaaa

SEQ ID NO: 4147983 - RNA, 13 nt, Yersinia pestis
aauauaaauuuaa

SEQ ID NO: 4147984 - RNA, 17 nt, Yersinia pestis
aauauaaauuuaauaaa

SEQ ID NO: 4147985 - RNA, 18 nt, Yersinia pestis
aauauaaauuuaauaaaa

SEQ ID NO: 4147986 - RNA, 22 nt, Yersinia pestis
aauauaaauuuaauaaaaacca

SEQ ID NO: 4147987 - RNA, 13 nt, Yersinia pestis
aauauaaccaaag

SEQ ID NO: 4147988 - RNA, 17 nt, Yersinia pestis
aauauaauacuuaaguc

SEQ ID NO: 4147989 - RNA, 13 nt, Yersinia pestis
aauauacuuuaca

SEQ ID NO: 4147990 - RNA, 21 nt, Yersinia pestis
aauauacuuuacauauaggaa

SEQ ID NO: 4147991 - RNA, 18 nt, Yersinia pestis
aauauagcaaucauuuau

SEQ ID NO: 4147992 - RNA, 19 nt, Yersinia pestis
aauauagcaaucauuuaua

SEQ ID NO: 4147993 - RNA, 21 nt, Yersinia pestis
aauauagcaaucauuuauaua

SEQ ID NO: 4147994 - RNA, 13 nt, Yersinia pestis
aauauaguugauc

SEQ ID NO: 4147995 - RNA, 14 nt, Yersinia pestis
aauauaguugaucu

SEQ ID NO: 4147996 - RNA, 17 nt, Yersinia pestis
aauauauaaaauaaauu

SEQ ID NO: 4147997 - RNA, 21 nt, Yersinia pestis
aauauauacccguaauauuuc

SEQ ID NO: 4147998 - RNA, 17 nt, Yersinia pestis
aauauaugauaccaaac

SEQ ID NO: 4147999 - RNA, 17 nt, Yersinia pestis
aauaucaagucuugaag

SEQ ID NO: 4148000 - RNA, 18 nt, Yersinia pestis
aauaucaagucuugaaga

SEQ ID NO: 4148001 - RNA, 13 nt, Yersinia pestis
aauaucaaugaaa

SEQ ID NO: 4148002 - RNA, 16 nt, Yersinia pestis
aauaucaaugauguca

SEQ ID NO: 4148003 - RNA, 16 nt, Yersinia pestis
aauaucaccauauuca

SEQ ID NO: 4148004 - RNA, 15 nt, Yersinia pestis
aauaucacugauauc

SEQ ID NO: 4148005 - RNA, 22 nt, Yersinia pestis
aauaucagcaaaguaccgcuuu

SEQ ID NO: 4148006 - RNA, 16 nt, Yersinia pestis
aauaucagcgauuaaa

SEQ ID NO: 4148007 - RNA, 12 nt, Yersinia pestis
aauaucaucauc

SEQ ID NO: 4148008 - RNA, 13 nt, Yersinia pestis
aauaucaucaucu

SEQ ID NO: 4148009 - RNA, 18 nt, Yersinia pestis
aauaucauccccuuucug

SEQ ID NO: 4148010 - RNA, 20 nt, Yersinia pestis
aauaucauccccuuucugcu

SEQ ID NO: 4148011 - RNA, 17 nt, Yersinia pestis
aauaucauguucuuugu

SEQ ID NO: 4148012 - RNA, 13 nt, Yersinia pestis
aauauccaauggu

SEQ ID NO: 4148013 - RNA, 14 nt, Yersinia pestis
aauauccaauggug

SEQ ID NO: 4148014 - RNA, 20 nt, Yersinia pestis
aauauccauauuaaaugcau

SEQ ID NO: 4148015 - RNA, 17 nt, Yersinia pestis
aauaucccgagaaacaa

SEQ ID NO: 4148016 - RNA, 16 nt, Yersinia pestis
aauauccgugggcaaa

SEQ ID NO: 4148017 - RNA, 19 nt, Yersinia pestis
aauauccugcucagcuaaa

SEQ ID NO: 4148018 - RNA, 15 nt, Yersinia pestis
aauaucgguaaaaaa

SEQ ID NO: 4148019 - RNA, 18 nt, Yersinia pestis
aauaucgguaaaaaauca

SEQ ID NO: 4148020 - RNA, 24 nt, Yersinia pestis
aauaucguguuggaguaucagaaa

SEQ ID NO: 4148021 - RNA, 12 nt, Yersinia pestis
aauaucuauuuc

SEQ ID NO: 4148022 - RNA, 16 nt, Yersinia pestis
aauaucuauuuccauc

SEQ ID NO: 4148023 - RNA, 22 nt, Yersinia pestis
aauaucugccaccgcacaguua

SEQ ID NO: 4148024 - RNA, 12 nt, Yersinia pestis
aauaucugucug

SEQ ID NO: 4148025 - RNA, 20 nt, Yersinia pestis
aauaucuguggugacaugau

SEQ ID NO: 4148026 - RNA, 16 nt, Yersinia pestis
aauaucuuucauauca

SEQ ID NO: 4148027 - RNA, 20 nt, Yersinia pestis
aauaugaucuugauaaacau

SEQ ID NO: 4148028 - RNA, 16 nt, Yersinia pestis
aauaugauucgguuau

SEQ ID NO: 4148029 - RNA, 15 nt, Yersinia pestis
aauaugcaaaaaaag

SEQ ID NO: 4148030 - RNA, 16 nt, Yersinia pestis
aauaugcuucaucacu

SEQ ID NO: 4148031 - RNA, 17 nt, Yersinia pestis
aauauggguaaauacau

SEQ ID NO: 4148032 - RNA, 23 nt, Yersinia pestis
aauauggguauugagcgcgguaa

SEQ ID NO: 4148033 - RNA, 14 nt, Yersinia pestis
aauaugguauucaa

SEQ ID NO: 4148034 - RNA, 22 nt, Yersinia pestis
aauauguaguuguaccccugaa

SEQ ID NO: 4148035 - RNA, 20 nt, Yersinia pestis
aauaugugacaauaguguug

SEQ ID NO: 4148036 - RNA, 12 nt, Yersinia pestis
aauauuaaaauc

SEQ ID NO: 4148037 - RNA, 17 nt, Yersinia pestis
aauauuaaagccauuca

SEQ ID NO: 4148038 - RNA, 16 nt, Yersinia pestis
aauauuaacugcagug

SEQ ID NO: 4148039 - RNA, 14 nt, Yersinia pestis
aauauuaauaaugc

SEQ ID NO: 4148040 - RNA, 18 nt, Yersinia pestis
aauauuaccaauaugaaa

SEQ ID NO: 4148041 - RNA, 22 nt, Yersinia pestis
aauauuagcgguggcaugccaa

SEQ ID NO: 4148042 - RNA, 13 nt, Yersinia pestis
aauauuauucagu

SEQ ID NO: 4148043 - RNA, 13 nt, Yersinia pestis
aauauuauuuaau

SEQ ID NO: 4148044 - RNA, 22 nt, Yersinia pestis
aauauuauuuaauuaaauguau

SEQ ID NO: 4148045 - RNA, 13 nt, Yersinia pestis
aauauucaguaag

SEQ ID NO: 4148046 - RNA, 17 nt, Yersinia pestis
aauauucaguaagguuu

SEQ ID NO: 4148047 - RNA, 20 nt, Yersinia pestis
aauauucaguaagguuuuac

SEQ ID NO: 4148048 - RNA, 13 nt, Yersinia pestis
aauauucauuaaa

SEQ ID NO: 4148049 - RNA, 21 nt, Yersinia pestis
aauauuccccaccauugcaaa

SEQ ID NO: 4148050 - RNA, 19 nt, Yersinia pestis
aauauuccggccagcuuuu

SEQ ID NO: 4148051 - RNA, 22 nt, Yersinia pestis
aauauuccggccagcuuuuuau

SEQ ID NO: 4148052 - RNA, 16 nt, Yersinia pestis
aauauucgcagccaaa

SEQ ID NO: 4148053 - RNA, 18 nt, Yersinia pestis
aauauucgcagccaaaau

SEQ ID NO: 4148054 - RNA, 23 nt, Yersinia pestis
aauauucgcauucgugccauaaa

SEQ ID NO: 4148055 - RNA, 19 nt, Yersinia pestis
aauauucucaauauuaaua

SEQ ID NO: 4148056 - RNA, 13 nt, Yersinia pestis
aauauucucuaug

SEQ ID NO: 4148057 - RNA, 23 nt, Yersinia pestis
aauauucugacgggacaaucugu

SEQ ID NO: 4148058 - RNA, 15 nt, Yersinia pestis
aaucgcccaauguca

SEQ ID NO: 4148059 - RNA, 23 nt, Yersinia pestis
aaucgccguuacccccuucacca

SEQ ID NO: 4148060 - RNA, 14 nt, Yersinia pestis
aaucgcgcauuucu

SEQ ID NO: 4148061 - RNA, 19 nt, Yersinia pestis
aaucgcguucagagcagca

SEQ ID NO: 4148062 - RNA, 19 nt, Yersinia pestis
aaucgcucugcguuuuucc

SEQ ID NO: 4148063 - RNA, 22 nt, Yersinia pestis
aaucgcucugcguuuuucccug

SEQ ID NO: 4148064 - RNA, 18 nt, Yersinia pestis
aaucgcugccaaaccaaa

SEQ ID NO: 4148065 - RNA, 14 nt, Yersinia pestis
aaucggauaaccgc

SEQ ID NO: 4148066 - RNA, 16 nt, Yersinia pestis
aaucgggugauaaagg

SEQ ID NO: 4148067 - RNA, 22 nt, Yersinia pestis
aaucgguugccgccuuccugcu

SEQ ID NO: 4148068 - RNA, 13 nt, Yersinia pestis
aaucgguuucagc

SEQ ID NO: 4148069 - RNA, 23 nt, Yersinia pestis
aaucgucccacaugaacucaacu

SEQ ID NO: 4148070 - RNA, 20 nt, Yersinia pestis
aaucgucuuguuggucacca

SEQ ID NO: 4148071 - RNA, 18 nt, Yersinia pestis
aaucgugcacccccuucg

SEQ ID NO: 4148072 - RNA, 21 nt, Yersinia pestis
aaucguuuuaauuugccuuca

SEQ ID NO: 4148073 - RNA, 14 nt, Yersinia pestis
aaucuaacgccgga

SEQ ID NO: 4148074 - RNA, 22 nt, Yersinia pestis
aaucuacugugggacugaucaa

SEQ ID NO: 4148075 - RNA, 15 nt, Yersinia pestis
aaucuacuuuauuca

SEQ ID NO: 4148076 - RNA, 14 nt, Yersinia pestis
aaucuagaacuauu

SEQ ID NO: 4148077 - RNA, 22 nt, Yersinia pestis
aaucuagaggacggcggccuua

SEQ ID NO: 4148078 - RNA, 22 nt, Yersinia pestis
aaucuaucgauacccuucaucu

SEQ ID NO: 4148079 - RNA, 14 nt, Yersinia pestis
aaucuauuaauauc

SEQ ID NO: 4148080 - RNA, 16 nt, Yersinia pestis
aaucuccaucauggcu

SEQ ID NO: 4148081 - RNA, 19 nt, Yersinia pestis
aaucuccuggugguuuggu

SEQ ID NO: 4148082 - RNA, 22 nt, Yersinia pestis
aaucucguuaucagccacauca

SEQ ID NO: 4148083 - RNA, 18 nt, Yersinia pestis
aaucucuccuagaggcuu

SEQ ID NO: 4148084 - RNA, 12 nt, Yersinia pestis
aaucucugccug

SEQ ID NO: 4148085 - RNA, 18 nt, Yersinia pestis
aaucucugccugugauuu

SEQ ID NO: 4148086 - RNA, 17 nt, Yersinia pestis
aaucucugggugcugcu

SEQ ID NO: 4148087 - RNA, 21 nt, Yersinia pestis
aaucugacgguuauuuucuga

SEQ ID NO: 4148088 - RNA, 13 nt, Yersinia pestis
aaucugauacuga

SEQ ID NO: 4148089 - RNA, 18 nt, Yersinia pestis
aaucugaugaauuaaaga

SEQ ID NO: 4148090 - RNA, 18 nt, Yersinia pestis
aaucugcaacgcaacccu

SEQ ID NO: 4148091 - RNA, 22 nt, Yersinia pestis
aaucugcaaugucauuaauugg

SEQ ID NO: 4148092 - RNA, 17 nt, Yersinia pestis
aaucugcaguuuccaac

SEQ ID NO: 4148093 - RNA, 19 nt, Yersinia pestis
aaucugcccagccugguuu

SEQ ID NO: 4148094 - RNA, 19 nt, Yersinia pestis
aaucugcggcauaaauucu

SEQ ID NO: 4148095 - RNA, 18 nt, Yersinia pestis
aaucuguaagucauucuu

SEQ ID NO: 4148096 - RNA, 13 nt, Yersinia pestis
aaucugucgcugu

SEQ ID NO: 4148097 - RNA, 18 nt, Yersinia pestis
aaucuguuccugauucca

SEQ ID NO: 4148098 - RNA, 21 nt, Yersinia pestis
aaucuguucgggcugauuaau

SEQ ID NO: 4148099 - RNA, 16 nt, Yersinia pestis
aaucuuaaauugaaga

SEQ ID NO: 4148100 - RNA, 14 nt, Yersinia pestis
aaucuuauuuaauc

SEQ ID NO: 4148101 - RNA, 17 nt, Yersinia pestis
aaucuuauuuguaaaua

SEQ ID NO: 4148102 - RNA, 11 nt, Yersinia pestis
aaucuuccuuu

SEQ ID NO: 4148103 - RNA, 17 nt, Yersinia pestis
aaucuuguuaauuuaaa

SEQ ID NO: 4148104 - RNA, 14 nt, Yersinia pestis
aaucuuugagcacc

SEQ ID NO: 4148105 - RNA, 18 nt, Yersinia pestis
aaucuuugccuauuucag

SEQ ID NO: 4148106 - RNA, 20 nt, Yersinia pestis
aaucuuugccuauuucaggg

SEQ ID NO: 4148107 - RNA, 20 nt, Yersinia pestis
aaucuuuuuguaauguuucu

SEQ ID NO: 4148108 - RNA, 23 nt, Yersinia pestis
aaugaaauugcgauuaggacaaa

SEQ ID NO: 4148109 - RNA, 22 nt, Yersinia pestis
aaugaaauugggggucagggcg

SEQ ID NO: 4148110 - RNA, 20 nt, Yersinia pestis
aaugaaguuauccuccauuc

SEQ ID NO: 4148111 - RNA, 15 nt, Yersinia pestis
aaugaauauuauuca

SEQ ID NO: 4148112 - RNA, 15 nt, Yersinia pestis
aaugaauucauugau

SEQ ID NO: 4148113 - RNA, 19 nt, Yersinia pestis
aaugacagcaucaauaucg

SEQ ID NO: 4148114 - RNA, 23 nt, Yersinia pestis
aaugacaguauuuguaguggaug

SEQ ID NO: 4148115 - RNA, 16 nt, Yersinia pestis
aaugacauugcgaaua

SEQ ID NO: 4148116 - RNA, 21 nt, Yersinia pestis
aaugaccacccacguuccccc

SEQ ID NO: 4148117 - RNA, 22 nt, Yersinia pestis
aaugaccacgcaucaauaauaa

SEQ ID NO: 4148118 - RNA, 17 nt, Yersinia pestis
aaugacgcgaucugaaa

SEQ ID NO: 4148119 - RNA, 22 nt, Yersinia pestis
aaugacuaauugugcagcauca

SEQ ID NO: 4148120 - RNA, 18 nt, Yersinia pestis
aaugacucgauaacccaa

SEQ ID NO: 4148121 - RNA, 22 nt, Yersinia pestis
aaugagaagugagaagugaaaa

SEQ ID NO: 4148122 - RNA, 19 nt, Yersinia pestis
aaugagagcgaauggcaau

SEQ ID NO: 4148123 - RNA, 14 nt, Yersinia pestis
aaugagauugauca

SEQ ID NO: 4148124 - RNA, 20 nt, Yersinia pestis
aaugagcacggacagcagca

SEQ ID NO: 4148125 - RNA, 21 nt, Yersinia pestis
aaugagcacggacagcagcac

SEQ ID NO: 4148126 - RNA, 22 nt, Yersinia pestis
aaugagccgcauugauccucgu

SEQ ID NO: 4148127 - RNA, 14 nt, Yersinia pestis
aaugagcgccaaau

SEQ ID NO: 4148128 - RNA, 13 nt, Yersinia pestis
aaugaggcugagg

SEQ ID NO: 4148129 - RNA, 16 nt, Yersinia pestis
aaugaguuaaugagaa

SEQ ID NO: 4148130 - RNA, 20 nt, Yersinia pestis
aaugaguuuuguccugagcc

SEQ ID NO: 4148131 - RNA, 20 nt, Yersinia pestis
aaugauaaaauccugaauaa

SEQ ID NO: 4148132 - RNA, 18 nt, Yersinia pestis
aaugaucgucaauguaac

SEQ ID NO: 4148133 - RNA, 16 nt, Yersinia pestis
aaugaugguaacgcgc

SEQ ID NO: 4148134 - RNA, 18 nt, Yersinia pestis
aaugaugguauuaaucaa

SEQ ID NO: 4148135 - RNA, 22 nt, Yersinia pestis
aaugauuaauaauaguuucugg

SEQ ID NO: 4148136 - RNA, 14 nt, Yersinia pestis
aaugauuauugacc

SEQ ID NO: 4148137 - RNA, 15 nt, Yersinia pestis
aaugauucagugaua

SEQ ID NO: 4148138 - RNA, 23 nt, Yersinia pestis
aaugauucauugaguuaucuccu

SEQ ID NO: 4148139 - RNA, 21 nt, Yersinia pestis
aaugauuugcggcaugauaga

SEQ ID NO: 4148140 - RNA, 17 nt, Yersinia pestis
aaugauuuuuuugcuuu

SEQ ID NO: 4148141 - RNA, 18 nt, Yersinia pestis
aaugcaaccaguuaaaga

SEQ ID NO: 4148142 - RNA, 17 nt, Yersinia pestis
aaugcaccgacaaagau

SEQ ID NO: 4148143 - RNA, 21 nt, Yersinia pestis
aaugcacgauaccaccaccaa

SEQ ID NO: 4148144 - RNA, 18 nt, Yersinia pestis
aaugcacugaacaaugcc

SEQ ID NO: 4148145 - RNA, 18 nt, Yersinia pestis
aaugcagacucuuauaua

SEQ ID NO: 4148146 - RNA, 15 nt, Yersinia pestis
aaugcagauaaccgu

SEQ ID NO: 4148147 - RNA, 13 nt, Yersinia pestis
aaugcagaugcca

SEQ ID NO: 4148148 - RNA, 14 nt, Yersinia pestis
aaugcagguuuugc

SEQ ID NO: 4148149 - RNA, 19 nt, Yersinia pestis
aaugcagguuuugccagau

SEQ ID NO: 4148150 - RNA, 21 nt, Yersinia pestis
aaugccagacacaagauaaau

SEQ ID NO: 4148151 - RNA, 16 nt, Yersinia pestis
aaugccaguacaguga

SEQ ID NO: 4148152 - RNA, 17 nt, Yersinia pestis
aaugccaguacagugaa

SEQ ID NO: 4148153 - RNA, 16 nt, Yersinia pestis
aaugccagucaaugac

SEQ ID NO: 4148154 - RNA, 12 nt, Yersinia pestis
aaugccauucaa

SEQ ID NO: 4148155 - RNA, 16 nt, Yersinia pestis
aaugccccauccugac

SEQ ID NO: 4148156 - RNA, 17 nt, Yersinia pestis
aaugcccgucauauuua

SEQ ID NO: 4148157 - RNA, 18 nt, Yersinia pestis
aaugcccgucauauuuaa

SEQ ID NO: 4148158 - RNA, 16 nt, Yersinia pestis
aaugccgaaugauuca

SEQ ID NO: 4148159 - RNA, 19 nt, Yersinia pestis
aaugccgcugugauuaagc

SEQ ID NO: 4148160 - RNA, 20 nt, Yersinia pestis
aaugccggcggcccauaucc

SEQ ID NO: 4148161 - RNA, 20 nt, Yersinia pestis
aaugccucgaccugaauauc

SEQ ID NO: 4148162 - RNA, 13 nt, Yersinia pestis
aaugcgaaaaaau

SEQ ID NO: 4148163 - RNA, 15 nt, Yersinia pestis
aaugcgaaaaaauau

SEQ ID NO: 4148164 - RNA, 18 nt, Yersinia pestis
aaugcgaaaaaauauauu

SEQ ID NO: 4148165 - RNA, 20 nt, Yersinia pestis
aaugcgaaaaaauauauucc

SEQ ID NO: 4148166 - RNA, 13 nt, Yersinia pestis
aaugcggcggcug

SEQ ID NO: 4148167 - RNA, 20 nt, Yersinia pestis
aaugcggugguuaacagcgu

SEQ ID NO: 4148168 - RNA, 17 nt, Yersinia pestis
aaugcguuauaaccaug

SEQ ID NO: 4148169 - RNA, 21 nt, Yersinia pestis
aaugcuacuuaacguugagaa

SEQ ID NO: 4148170 - RNA, 19 nt, Yersinia pestis
aaugcucaucaaguauuuu

SEQ ID NO: 4148171 - RNA, 20 nt, Yersinia pestis
aaugcucggcgucagccgcg

SEQ ID NO: 4148172 - RNA, 20 nt, Yersinia pestis
aaugcucuucaccaaaggaa

SEQ ID NO: 4148173 - RNA, 21 nt, Yersinia pestis
aaugcugcccgaguaagcgcu

SEQ ID NO: 4148174 - RNA, 21 nt, Yersinia pestis
aaugcugcguguggucagcac

SEQ ID NO: 4148175 - RNA, 11 nt, Yersinia pestis
aauggaagaau

SEQ ID NO: 4148176 - RNA, 23 nt, Yersinia pestis
aauggauugaaaccgcugauaac

SEQ ID NO: 4148177 - RNA, 17 nt, Yersinia pestis
aauggcaaaacagauau

SEQ ID NO: 4148178 - RNA, 14 nt, Yersinia pestis
aauggcaacgcgca

SEQ ID NO: 4148179 - RNA, 18 nt, Yersinia pestis
aauucuccuuucuuuucg

SEQ ID NO: 4148180 - RNA, 19 nt, Yersinia pestis
aauucugagaucuaaaaaa

SEQ ID NO: 4148181 - RNA, 21 nt, Yersinia pestis
aauucuggguacaacacaaaa

SEQ ID NO: 4148182 - RNA, 15 nt, Yersinia pestis
aauucuguagaguaa

SEQ ID NO: 4148183 - RNA, 18 nt, Yersinia pestis
aauucuguguaacugcca

SEQ ID NO: 4148184 - RNA, 17 nt, Yersinia pestis
aauucuuaggauaacca

SEQ ID NO: 4148185 - RNA, 18 nt, Yersinia pestis
aauucuuaggauaaccaa

SEQ ID NO: 4148186 - RNA, 22 nt, Yersinia pestis
aauugaagaguugauccgauaa

SEQ ID NO: 4148187 - RNA, 17 nt, Yersinia pestis
aauugaagauuuaaaua

SEQ ID NO: 4148188 - RNA, 17 nt, Yersinia pestis
aauugaagcagauaaag

SEQ ID NO: 4148189 - RNA, 18 nt, Yersinia pestis
aauugaagcagauaaaga

SEQ ID NO: 4148190 - RNA, 22 nt, Yersinia pestis
aauugaccauagagagaaaaag

SEQ ID NO: 4148191 - RNA, 15 nt, Yersinia pestis
aauugacuguauaua

SEQ ID NO: 4148192 - RNA, 19 nt, Yersinia pestis
aauugaguaacugauuaau

SEQ ID NO: 4148193 - RNA, 12 nt, Yersinia pestis
aauugauaugau

SEQ ID NO: 4148194 - RNA, 14 nt, Yersinia pestis
aauugauaugauuu

SEQ ID NO: 4148195 - RNA, 15 nt, Yersinia pestis
aauugauauuauuua

SEQ ID NO: 4148196 - RNA, 17 nt, Yersinia pestis
aauugauauuauuuaua

SEQ ID NO: 4148197 - RNA, 20 nt, Yersinia pestis
aauugauauuauuuauauga

SEQ ID NO: 4148198 - RNA, 16 nt, Yersinia pestis
aauugaucugauauua

SEQ ID NO: 4148199 - RNA, 13 nt, Yersinia pestis
aauugccuuugcg

SEQ ID NO: 4148200 - RNA, 23 nt, Yersinia pestis
aauugcgauuaggacaaauagau

SEQ ID NO: 4148201 - RNA, 20 nt, Yersinia pestis
aauugcgcuucgcgcagcau

SEQ ID NO: 4148202 - RNA, 17 nt, Yersinia pestis
aauugcggucagcauac

SEQ ID NO: 4148203 - RNA, 22 nt, Yersinia pestis
aauugcggucagcauacuggcu

SEQ ID NO: 4148204 - RNA, 19 nt, Yersinia pestis
aauugcugcuugcgcgccu

SEQ ID NO: 4148205 - RNA, 20 nt, Yersinia pestis
aauugcuggcuaucaucccu

SEQ ID NO: 4148206 - RNA, 20 nt, Yersinia pestis
aauugcuguuggaucucucc

SEQ ID NO: 4148207 - RNA, 20 nt, Yersinia pestis
aauuggcuuaacucgccacu

SEQ ID NO: 4148208 - RNA, 19 nt, Yersinia pestis
aauuggugcuuuauguauu

SEQ ID NO: 4148209 - RNA, 22 nt, Yersinia pestis
aauugguuuauaacaaggaaau

SEQ ID NO: 4148210 - RNA, 18 nt, Yersinia pestis
aauugugaguuaaaaaua

SEQ ID NO: 4148211 - RNA, 15 nt, Yersinia pestis
aauuguggaaauaac

SEQ ID NO: 4148212 - RNA, 20 nt, Yersinia pestis
aauuguuauuauuaaauuuu

SEQ ID NO: 4148213 - RNA, 14 nt, Yersinia pestis
aauuguucaucgcu

SEQ ID NO: 4148214 - RNA, 15 nt, Yersinia pestis
aauuguuucuucccc

SEQ ID NO: 4148215 - RNA, 23 nt, Yersinia pestis
aauuguuugcuaucaauugcugg

SEQ ID NO: 4148216 - RNA, 22 nt, Yersinia pestis
aauuuaaaguuuuuuauuuaua

SEQ ID NO: 4148217 - RNA, 15 nt, Yersinia pestis
aauuuaaauaaaaua

SEQ ID NO: 4148218 - RNA, 16 nt, Yersinia pestis
aauuuaaauaaaauaa

SEQ ID NO: 4148219 - RNA, 20 nt, Yersinia pestis
aauuuaaccaucuaauguaa

SEQ ID NO: 4148220 - RNA, 14 nt, Yersinia pestis
aauuuaagaaaucu

SEQ ID NO: 4148221 - RNA, 18 nt, Yersinia pestis
aauuuaauaaaaaccaau

SEQ ID NO: 4148222 - RNA, 11 nt, Yersinia pestis
aauuuacccug

SEQ ID NO: 4148223 - RNA, 15 nt, Yersinia pestis
aauuuagccauucaa

SEQ ID NO: 4148224 - RNA, 17 nt, Yersinia pestis
aauuuaggugaaaauaa

SEQ ID NO: 4148225 - RNA, 18 nt, Yersinia pestis
aauuuaggugaaaauaau

SEQ ID NO: 4148226 - RNA, 14 nt, Yersinia pestis
aauuuaucagacaa

SEQ ID NO: 4148227 - RNA, 19 nt, Yersinia pestis
aauuuaucaggcuaauaca

SEQ ID NO: 4148228 - RNA, 14 nt, Yersinia pestis
aauuuaucaguagu

SEQ ID NO: 4148229 - RNA, 22 nt, Yersinia pestis
aauuuaucaguagucaauacaa

SEQ ID NO: 4148230 - RNA, 22 nt, Yersinia pestis
aauuuauccuguacauauauaa

SEQ ID NO: 4148231 - RNA, 22 nt, Yersinia pestis
aauuuaucucuaucaauauaua

SEQ ID NO: 4148232 - RNA, 13 nt, Yersinia pestis
aauuuaugauuaa

SEQ ID NO: 4148233 - RNA, 13 nt, Yersinia pestis
aauuuauuauuua

SEQ ID NO: 4148234 - RNA, 16 nt, Yersinia pestis
aauuuauuucagauuu

SEQ ID NO: 4148235 - RNA, 21 nt, Yersinia pestis
aauuucacuaucguuagcaua

SEQ ID NO: 4148236 - RNA, 13 nt, Yersinia pestis
aauuucacuggca

SEQ ID NO: 4148237 - RNA, 18 nt, Yersinia pestis
aauuucacuggcaccgcu

SEQ ID NO: 4148238 - RNA, 14 nt, Yersinia pestis
aauuucacugugcu

SEQ ID NO: 4148239 - RNA, 13 nt, Yersinia pestis
aauuucagauaaa

SEQ ID NO: 4148240 - RNA, 19 nt, Yersinia pestis
aauuucagauaaaaauaau

SEQ ID NO: 4148241 - RNA, 20 nt, Yersinia pestis
aauuucaggucgauuacaua

SEQ ID NO: 4148242 - RNA, 11 nt, Yersinia pestis
aauuucaguaa

SEQ ID NO: 4148243 - RNA, 18 nt, Yersinia pestis
aauuuccaguucaacacc

SEQ ID NO: 4148244 - RNA, 23 nt, Yersinia pestis
aauuucccuagcgaaguauuaau

SEQ ID NO: 4148245 - RNA, 21 nt, Yersinia pestis
aauuuccgguaacugacgcag

SEQ ID NO: 4148246 - RNA, 13 nt, Yersinia pestis
aauuucucaaaua

SEQ ID NO: 4148247 - RNA, 10 nt, Yersinia pestis
aauuucucuu

SEQ ID NO: 4148248 - RNA, 16 nt, Yersinia pestis
aauuucuguuaccaga

SEQ ID NO: 4148249 - RNA, 23 nt, Yersinia pestis
aauuucuucuagcucuuccagca

SEQ ID NO: 4148250 - RNA, 22 nt, Yersinia pestis
aauuucuugucaccugaguaau

SEQ ID NO: 4148251 - RNA, 15 nt, Yersinia pestis
aauuugacauuuccu

SEQ ID NO: 4148252 - RNA, 22 nt, Yersinia pestis
aauuugauauuaauaucagcga

SEQ ID NO: 4148253 - RNA, 16 nt, Yersinia pestis
aauuugcaaagaaaua

SEQ ID NO: 4148254 - RNA, 14 nt, Yersinia pestis
aauuugccauacca

SEQ ID NO: 4148255 - RNA, 16 nt, Yersinia pestis
aauuugguaauuucca

SEQ ID NO: 4148256 - RNA, 16 nt, Yersinia pestis
aauuugguagaacugc

SEQ ID NO: 4148257 - RNA, 13 nt, Yersinia pestis
aauuuuacguuca

SEQ ID NO: 4148258 - RNA, 15 nt, Yersinia pestis
aauuuuacguucaga

SEQ ID NO: 4148259 - RNA, 14 nt, Yersinia pestis
aauuuuagucaaaa

SEQ ID NO: 4148260 - RNA, 19 nt, Yersinia pestis
aauuuuagucaaaacaaua

SEQ ID NO: 4148261 - RNA, 13 nt, Yersinia pestis
aauuuuauucagc

SEQ ID NO: 4148262 - RNA, 16 nt, Yersinia pestis
aauuuuauucagcaag

SEQ ID NO: 4148263 - RNA, 21 nt, Yersinia pestis
aauuuuguacaacuucuucau

SEQ ID NO: 4148264 - RNA, 20 nt, Yersinia pestis
aauuuuuaccuucuacaaau

SEQ ID NO: 4148265 - RNA, 15 nt, Yersinia pestis
aauuuuuuauauucc

SEQ ID NO: 4148266 - RNA, 22 nt, Yersinia pestis
aauuuuuuauauuccacauaca

SEQ ID NO: 4148267 - RNA, 22 nt, Yersinia pestis
acaaaaaagggggcccugaacu

SEQ ID NO: 4148268 - RNA, 14 nt, Yersinia pestis
acaaaaaauuaaug

SEQ ID NO: 4148269 - RNA, 19 nt, Yersinia pestis
acaaaaaguuaaauaugcu

SEQ ID NO: 4148270 - RNA, 18 nt, Yersinia pestis
acaaaaauaaacgggcuu

SEQ ID NO: 4148271 - RNA, 13 nt, Yersinia pestis
acaaaaccaaccc

SEQ ID NO: 4148272 - RNA, 19 nt, Yersinia pestis
acaaaagugacgaaugagc

SEQ ID NO: 4148273 - RNA, 15 nt, Yersinia pestis
acaaaaucccccacc

SEQ ID NO: 4148274 - RNA, 21 nt, Yersinia pestis
acaaaaugccguacaacaaua

SEQ ID NO: 4148275 - RNA, 21 nt, Yersinia pestis
acaaaauggaauaagccauua

SEQ ID NO: 4148276 - RNA, 18 nt, Yersinia pestis
acaaaauggccuugccca

SEQ ID NO: 4148277 - RNA, 12 nt, Yersinia pestis
acaaaaugugaa

SEQ ID NO: 4148278 - RNA, 17 nt, Yersinia pestis
acaaaaugugaaaagca

SEQ ID NO: 4148279 - RNA, 14 nt, Yersinia pestis
acaaacacauggcu

SEQ ID NO: 4148280 - RNA, 16 nt, Yersinia pestis
acaaacagggcagcca

SEQ ID NO: 4148281 - RNA, 18 nt, Yersinia pestis
acaaacauggcggcagca

SEQ ID NO: 4148282 - RNA, 20 nt, Yersinia pestis
acaaaccacauuuuuuaaaa

SEQ ID NO: 4148283 - RNA, 15 nt, Yersinia pestis
acaaaccguugcuca

SEQ ID NO: 4148284 - RNA, 23 nt, Yersinia pestis
acaaacuguuuuuuaaagaaaaa

SEQ ID NO: 4148285 - RNA, 20 nt, Yersinia pestis
acaaagauacagcccaagag

SEQ ID NO: 4148286 - RNA, 13 nt, Yersinia pestis
acaaagcauuuca

SEQ ID NO: 4148287 - RNA, 17 nt, Yersinia pestis
acaaagccgcuuaauuu

SEQ ID NO: 4148288 - RNA, 12 nt, Yersinia pestis
acaaaggucagc

SEQ ID NO: 4148289 - RNA, 21 nt, Yersinia pestis
acaaaggucagcauggucccu

SEQ ID NO: 4148290 - RNA, 18 nt, Yersinia pestis
acaaaguccacgugcuua

SEQ ID NO: 4148291 - RNA, 23 nt, Yersinia pestis
acaaagugcccgcgacgagagaa

SEQ ID NO: 4148292 - RNA, 18 nt, Yersinia pestis
acaaaguuaaaugaagga

SEQ ID NO: 4148293 - RNA, 20 nt, Yersinia pestis
acaaaguuaugccacaucag

SEQ ID NO: 4148294 - RNA, 14 nt, Yersinia pestis
acaaauaaaaccaa

SEQ ID NO: 4148295 - RNA, 16 nt, Yersinia pestis
acaaauaaaaccaaga

SEQ ID NO: 4148296 - RNA, 23 nt, Yersinia pestis
acaaauaacccgccuagcaucau

SEQ ID NO: 4148297 - RNA, 18 nt, Yersinia pestis
acaaauaaggcguuuaau

SEQ ID NO: 4148298 - RNA, 22 nt, Yersinia pestis
acaaauaauuaggauuuauuuu

SEQ ID NO: 4148299 - RNA, 16 nt, Yersinia pestis
acaaauagauuuaacu

SEQ ID NO: 4148300 - RNA, 14 nt, Yersinia pestis
acaaauagcgcugc

SEQ ID NO: 4148301 - RNA, 17 nt, Yersinia pestis
acacaucaaaauuaggu

SEQ ID NO: 4148302 - RNA, 17 nt, Yersinia pestis
acacaucgaagcugucu

SEQ ID NO: 4148303 - RNA, 19 nt, Yersinia pestis
acacaucuuccaguacaga

SEQ ID NO: 4148304 - RNA, 18 nt, Yersinia pestis
acacauuccaguaaaaaa

SEQ ID NO: 4148305 - RNA, 22 nt, Yersinia pestis
acacauuccaguaaaaaaauag

SEQ ID NO: 4148306 - RNA, 13 nt, Yersinia pestis
acaccaacacuga

SEQ ID NO: 4148307 - RNA, 13 nt, Yersinia pestis
acaccaacuggcg

SEQ ID NO: 4148308 - RNA, 20 nt, Yersinia pestis
acaccacaucacgcagcgcu

SEQ ID NO: 4148309 - RNA, 21 nt, Yersinia pestis
acaccaccgccgcaacaauaa

SEQ ID NO: 4148310 - RNA, 21 nt, Yersinia pestis
acaccacgcuauauagacgaa

SEQ ID NO: 4148311 - RNA, 13 nt, Yersinia pestis
acaccagcauccu

SEQ ID NO: 4148312 - RNA, 13 nt, Yersinia pestis
acaccauaaucgc

SEQ ID NO: 4148313 - RNA, 15 nt, Yersinia pestis
acaccauauugcugu

SEQ ID NO: 4148314 - RNA, 14 nt, Yersinia pestis
acaccaucaacaug

SEQ ID NO: 4148315 - RNA, 12 nt, Yersinia pestis
acaccauuucca

SEQ ID NO: 4148316 - RNA, 22 nt, Yersinia pestis
acacccguuccuucagccacca

SEQ ID NO: 4148317 - RNA, 20 nt, Yersinia pestis
acacccucaacucaaaacaa

SEQ ID NO: 4148318 - RNA, 21 nt, Yersinia pestis
acacccucucuuuccagcaaa

SEQ ID NO: 4148319 - RNA, 15 nt, Yersinia pestis
acaccgaaauuagaa

SEQ ID NO: 4148320 - RNA, 15 nt, Yersinia pestis
acaccggcugcaaua

SEQ ID NO: 4148321 - RNA, 15 nt, Yersinia pestis
acaccguuguuggcg

SEQ ID NO: 4148322 - RNA, 18 nt, Yersinia pestis
acaccuaaaacauaccau

SEQ ID NO: 4148323 - RNA, 17 nt, Yersinia pestis
acaccuaacuuccuaac

SEQ ID NO: 4148324 - RNA, 14 nt, Yersinia pestis
acaccuuaaaacag

SEQ ID NO: 4148325 - RNA, 15 nt, Yersinia pestis
acaccuuaaaacagc

SEQ ID NO: 4148326 - RNA, 17 nt, Yersinia pestis
acacgacagcgcggcua

SEQ ID NO: 4148327 - RNA, 20 nt, Yersinia pestis
acacgacauguguaguaugc

SEQ ID NO: 4148328 - RNA, 19 nt, Yersinia pestis
acacgaugccaguagccgu

SEQ ID NO: 4148329 - RNA, 13 nt, Yersinia pestis
acacgauuuuuac

SEQ ID NO: 4148330 - RNA, 14 nt, Yersinia pestis
acacgcccaggcca

SEQ ID NO: 4148331 - RNA, 17 nt, Yersinia pestis
acacggcggugcuuuuu

SEQ ID NO: 4148332 - RNA, 20 nt, Yersinia pestis
acacggucuggcaacgcugu

SEQ ID NO: 4148333 - RNA, 14 nt, Yersinia pestis
acacgguugaaaag

SEQ ID NO: 4148334 - RNA, 16 nt, Yersinia pestis
acacguaaaacaggga

SEQ ID NO: 4148335 - RNA, 22 nt, Yersinia pestis
acacgugagaauugcugcuugc

SEQ ID NO: 4148336 - RNA, 19 nt, Yersinia pestis
acacuauacccaaguuacu

SEQ ID NO: 4148337 - RNA, 15 nt, Yersinia pestis
acacugacaucauca

SEQ ID NO: 4148338 - RNA, 17 nt, Yersinia pestis
acacugauugaaguccu

SEQ ID NO: 4148339 - RNA, 21 nt, Yersinia pestis
acacugcacuuuaaucgccag

SEQ ID NO: 4148340 - RNA, 15 nt, Yersinia pestis
acacugccugaugcu

SEQ ID NO: 4148341 - RNA, 13 nt, Yersinia pestis
acacugguugaaa

SEQ ID NO: 4148342 - RNA, 16 nt, Yersinia pestis
acacugucaucacugc

SEQ ID NO: 4148343 - RNA, 16 nt, Yersinia pestis
acacugucgcauaaga

SEQ ID NO: 4148344 - RNA, 23 nt, Yersinia pestis
acacuuaaauagaaaaaugauuu

SEQ ID NO: 4148345 - RNA, 14 nt, Yersinia pestis
acacuuagccagca

SEQ ID NO: 4148346 - RNA, 20 nt, Yersinia pestis
acacuuauuaaccuacugac

SEQ ID NO: 4148347 - RNA, 22 nt, Yersinia pestis
acacuuauuaaccuacugacau

SEQ ID NO: 4148348 - RNA, 22 nt, Yersinia pestis
acacuucgccaggucaggaaga

SEQ ID NO: 4148349 - RNA, 22 nt, Yersinia pestis
acacuucgccgggucaggaaga

SEQ ID NO: 4148350 - RNA, 22 nt, Yersinia pestis
acacuugcucuaccacguuuau

SEQ ID NO: 4148351 - RNA, 19 nt, Yersinia pestis
acacuuuuacaggccauua

SEQ ID NO: 4148352 - RNA, 23 nt, Yersinia pestis
acacuuuugcuggugucacaauc

SEQ ID NO: 4148353 - RNA, 17 nt, Yersinia pestis
acagaaaaauaacaucc

SEQ ID NO: 4148354 - RNA, 15 nt, Yersinia pestis
acagaaaauguccau

SEQ ID NO: 4148355 - RNA, 15 nt, Yersinia pestis
acagaaacgauuacc

SEQ ID NO: 4148356 - RNA, 12 nt, Yersinia pestis
acagaaaucaau

SEQ ID NO: 4148357 - RNA, 16 nt, Yersinia pestis
acagaagcguaaagca

SEQ ID NO: 4148358 - RNA, 13 nt, Yersinia pestis
acagaaucgccgu

SEQ ID NO: 4148359 - RNA, 15 nt, Yersinia pestis
acagacaaacaaccu

SEQ ID NO: 4148360 - RNA, 15 nt, Yersinia pestis
acagacacagcaaca

SEQ ID NO: 4148361 - RNA, 13 nt, Yersinia pestis
acagacccuguuc

SEQ ID NO: 4148362 - RNA, 23 nt, Yersinia pestis
acagacgccccgaaccauuuacc

SEQ ID NO: 4148363 - RNA, 13 nt, Yersinia pestis
acagacuggugaa

SEQ ID NO: 4148364 - RNA, 14 nt, Yersinia pestis
acagagcacaacgg

SEQ ID NO: 4148365 - RNA, 15 nt, Yersinia pestis
acagagcagaaagca

SEQ ID NO: 4148366 - RNA, 18 nt, Yersinia pestis
acagagcagaaagcagca

SEQ ID NO: 4148367 - RNA, 14 nt, Yersinia pestis
acagagccuuauag

SEQ ID NO: 4148368 - RNA, 22 nt, Yersinia pestis
acagaggccgaguaaucagagu

SEQ ID NO: 4148369 - RNA, 19 nt, Yersinia pestis
acagagguagacguaucau

SEQ ID NO: 4148370 - RNA, 14 nt, Yersinia pestis
acagaguauacaua

SEQ ID NO: 4148371 - RNA, 23 nt, Yersinia pestis
acagauaaagcuugaucacaauc

SEQ ID NO: 4148372 - RNA, 14 nt, Yersinia pestis
acagauaauaugac

SEQ ID NO: 4148373 - RNA, 20 nt, Yersinia pestis
acagauauauccaggcacug

SEQ ID NO: 4148374 - RNA, 23 nt, Yersinia pestis
acagauauuuucggguaucugug

SEQ ID NO: 4148375 - RNA, 19 nt, Yersinia pestis
acagaucacccgcaaaacu

SEQ ID NO: 4148376 - RNA, 21 nt, Yersinia pestis
acagauccugccgccucugcu

SEQ ID NO: 4148377 - RNA, 19 nt, Yersinia pestis
acagauuauuucagcuuca

SEQ ID NO: 4148378 - RNA, 18 nt, Yersinia pestis
acagauuuuccauccccu

SEQ ID NO: 4148379 - RNA, 19 nt, Yersinia pestis
acagcaacaggguaauaac

SEQ ID NO: 4148380 - RNA, 21 nt, Yersinia pestis
acagcaaugcaccgacaaaga

SEQ ID NO: 4148381 - RNA, 23 nt, Yersinia pestis
acagcaaugcaccgacaaagaua

SEQ ID NO: 4148382 - RNA, 19 nt, Yersinia pestis
acagcaccaccgauggcac

SEQ ID NO: 4148383 - RNA, 17 nt, Yersinia pestis
acagcaccauuaucuuc

SEQ ID NO: 4148384 - RNA, 16 nt, Yersinia pestis
acagcacggcaacagg

SEQ ID NO: 4148385 - RNA, 18 nt, Yersinia pestis
acagcacgguaaacgcau

SEQ ID NO: 4148386 - RNA, 16 nt, Yersinia pestis
acagcacgguaaccuu

SEQ ID NO: 4148387 - RNA, 15 nt, Yersinia pestis
acagcacguaccgcu

SEQ ID NO: 4148388 - RNA, 15 nt, Yersinia pestis
acagcacucaguaca

SEQ ID NO: 4148389 - RNA, 18 nt, Yersinia pestis
acagcagaacaaaacaag

SEQ ID NO: 4148390 - RNA, 19 nt, Yersinia pestis
acagcagaacaaaacaagc

SEQ ID NO: 4148391 - RNA, 22 nt, Yersinia pestis
acagcaggugguuaaacugaca

SEQ ID NO: 4148392 - RNA, 19 nt, Yersinia pestis
acagcaguucaucuucgau

SEQ ID NO: 4148393 - RNA, 23 nt, Yersinia pestis
acagcaucugcaauggcuggcaa

SEQ ID NO: 4148394 - RNA, 18 nt, Yersinia pestis
acagcauuaccaaggaaa

SEQ ID NO: 4148395 - RNA, 23 nt, Yersinia pestis
acagcauuaccaaggaaaccacc

SEQ ID NO: 4148396 - RNA, 17 nt, Yersinia pestis
acagcauuuaugcugcc

SEQ ID NO: 4148397 - RNA, 23 nt, Yersinia pestis
acagccacgauuaucucuuacau

SEQ ID NO: 4148398 - RNA, 12 nt, Yersinia pestis
acagccagccuu

SEQ ID NO: 4148399 - RNA, 17 nt, Yersinia pestis
acagccaucacccgaua

SEQ ID NO: 4148400 - RNA, 12 nt, Yersinia pestis
acagcccaagag

SEQ ID NO: 4148401 - RNA, 16 nt, Yersinia pestis
acagcccaagagaaau

SEQ ID NO: 4148402 - RNA, 17 nt, Yersinia pestis
acagccccaaccaucuc

SEQ ID NO: 4148403 - RNA, 15 nt, Yersinia pestis
acagcccccugccua

SEQ ID NO: 4148404 - RNA, 21 nt, Yersinia pestis
acagccguauaucuuaccuuc

SEQ ID NO: 4148405 - RNA, 14 nt, Yersinia pestis
acagccuaaccgcu

SEQ ID NO: 4148406 - RNA, 19 nt, Yersinia pestis
acagcgagauaaacugugc

SEQ ID NO: 4148407 - RNA, 16 nt, Yersinia pestis
acagcgcgcagccaac

SEQ ID NO: 4148408 - RNA, 17 nt, Yersinia pestis
acagcgcggcuaaauau

SEQ ID NO: 4148409 - RNA, 19 nt, Yersinia pestis
acagcgcuuggugaugcug

SEQ ID NO: 4148410 - RNA, 14 nt, Yersinia pestis
acagcguauucacg

SEQ ID NO: 4148411 - RNA, 18 nt, Yersinia pestis
acagcgugaagugaugac

SEQ ID NO: 4148412 - RNA, 15 nt, Yersinia pestis
acagcguuggucagc

SEQ ID NO: 4148413 - RNA, 19 nt, Yersinia pestis
acagcuaauuuucauugau

SEQ ID NO: 4148414 - RNA, 22 nt, Yersinia pestis
acagcucagacuggccagaagg

SEQ ID NO: 4148415 - RNA, 12 nt, Yersinia pestis
acaggaaacucc

SEQ ID NO: 4148416 - RNA, 16 nt, Yersinia pestis
acaggaacguucaauu

SEQ ID NO: 4148417 - RNA, 17 nt, Yersinia pestis
acaggccccaauccacc

SEQ ID NO: 4148418 - RNA, 21 nt, Yersinia pestis
acaggccgcuuccgauaacca

SEQ ID NO: 4148419 - RNA, 13 nt, Yersinia pestis
acaggcugcaugg

SEQ ID NO: 4148420 - RNA, 14 nt, Yersinia pestis
acaggcugccugcc

SEQ ID NO: 4148421 - RNA, 16 nt, Yersinia pestis
acaggcuuucaggacu

SEQ ID NO: 4148422 - RNA, 15 nt, Yersinia pestis
acagggcagaaaaua

SEQ ID NO: 4148423 - RNA, 21 nt, Yersinia pestis
acauuagccgguuaggccagu

SEQ ID NO: 4148424 - RNA, 21 nt, Yersinia pestis
acauuagggccaccagacuga

SEQ ID NO: 4148425 - RNA, 12 nt, Yersinia pestis
acauuauuauuu

SEQ ID NO: 4148426 - RNA, 15 nt, Yersinia pestis
acauuauuauuuaca

SEQ ID NO: 4148427 - RNA, 16 nt, Yersinia pestis
acauuauuuuucaccu

SEQ ID NO: 4148428 - RNA, 13 nt, Yersinia pestis
acauuccacaaau

SEQ ID NO: 4148429 - RNA, 16 nt, Yersinia pestis
acauuccacaaauuuu

SEQ ID NO: 4148430 - RNA, 18 nt, Yersinia pestis
acauuccaguaaaaaaau

SEQ ID NO: 4148431 - RNA, 20 nt, Yersinia pestis
acauuccaguaaaaaaauag

SEQ ID NO: 4148432 - RNA, 23 nt, Yersinia pestis
acauucucuacucgcucaccacu

SEQ ID NO: 4148433 - RNA, 19 nt, Yersinia pestis
acauucugauagugauuuu

SEQ ID NO: 4148434 - RNA, 23 nt, Yersinia pestis
acauucugauagugauuuuuuuc

SEQ ID NO: 4148435 - RNA, 20 nt, Yersinia pestis
acauugcaguauuuuggccg

SEQ ID NO: 4148436 - RNA, 15 nt, Yersinia pestis
acauuggaauuuucu

SEQ ID NO: 4148437 - RNA, 23 nt, Yersinia pestis
acauugucaccuaaccaaacauu

SEQ ID NO: 4148438 - RNA, 18 nt, Yersinia pestis
acauugucuaacaacugg

SEQ ID NO: 4148439 - RNA, 21 nt, Yersinia pestis
acauuguuaccuaaccaaaca

SEQ ID NO: 4148440 - RNA, 22 nt, Yersinia pestis
acauuguuaccuaaccaaacau

SEQ ID NO: 4148441 - RNA, 20 nt, Yersinia pestis
acauuuaucuaucuguucac

SEQ ID NO: 4148442 - RNA, 22 nt, Yersinia pestis
acauuuccuuguggauccagca

SEQ ID NO: 4148443 - RNA, 15 nt, Yersinia pestis
acauuucuuauauua

SEQ ID NO: 4148444 - RNA, 19 nt, Yersinia pestis
acauuucuuauauuauuaa

SEQ ID NO: 4148445 - RNA, 15 nt, Yersinia pestis
acauuugaaaugcau

SEQ ID NO: 4148446 - RNA, 15 nt, Yersinia pestis
acauuugagcaggug

SEQ ID NO: 4148447 - RNA, 18 nt, Yersinia pestis
acauuuggcgcucauuuc

SEQ ID NO: 4148448 - RNA, 19 nt, Yersinia pestis
acauuuguauuuuuucuuu

SEQ ID NO: 4148449 - RNA, 17 nt, Yersinia pestis
acauuuuaaagaaugca

SEQ ID NO: 4148450 - RNA, 22 nt, Yersinia pestis
acauuuucaucugaccaaacau

SEQ ID NO: 4148451 - RNA, 17 nt, Yersinia pestis
acauuuucuaucucauc

SEQ ID NO: 4148452 - RNA, 21 nt, Yersinia pestis
acauuuugguuucuccaagca

SEQ ID NO: 4148453 - RNA, 23 nt, Yersinia pestis
acauuuugguuucuccaagcaca

SEQ ID NO: 4148454 - RNA, 15 nt, Yersinia pestis
acauuuugugugagu

SEQ ID NO: 4148455 - RNA, 21 nt, Yersinia pestis
acauuuuuaauaauguguuug

SEQ ID NO: 4148456 - RNA, 17 nt, Yersinia pestis
acauuuuucuauuucug

SEQ ID NO: 4148457 - RNA, 16 nt, Yersinia pestis
acauuuuuuaaaacca

SEQ ID NO: 4148458 - RNA, 21 nt, Yersinia pestis
acauuuuuuaaaaccaaauua

SEQ ID NO: 4148459 - RNA, 13 nt, Yersinia pestis
accaaaaaucuug

SEQ ID NO: 4148460 - RNA, 15 nt, Yersinia pestis
accaaaaaucuuguu

SEQ ID NO: 4148461 - RNA, 17 nt, Yersinia pestis
accaaaaaucuuguuaa

SEQ ID NO: 4148462 - RNA, 15 nt, Yersinia pestis
accaaaaccggcauu

SEQ ID NO: 4148463 - RNA, 21 nt, Yersinia pestis
accaaaacgccaccagcgcca

SEQ ID NO: 4148464 - RNA, 12 nt, Yersinia pestis
accaaaacuccc

SEQ ID NO: 4148465 - RNA, 14 nt, Yersinia pestis
accaaaaugacaau

SEQ ID NO: 4148466 - RNA, 19 nt, Yersinia pestis
accaaaauucacaacuugu

SEQ ID NO: 4148467 - RNA, 12 nt, Yersinia pestis
accaaacauugu

SEQ ID NO: 4148468 - RNA, 19 nt, Yersinia pestis
accaaacauuuucaucuga

SEQ ID NO: 4148469 - RNA, 22 nt, Yersinia pestis
accaaacggaaugguuuggcca

SEQ ID NO: 4148470 - RNA, 11 nt, Yersinia pestis
accaaagcagu

SEQ ID NO: 4148471 - RNA, 15 nt, Yersinia pestis
accaaauaaaacaag

SEQ ID NO: 4148472 - RNA, 17 nt, Yersinia pestis
accaaauagccggcucu

SEQ ID NO: 4148473 - RNA, 20 nt, Yersinia pestis
accaaaucugacgguuauuu

SEQ ID NO: 4148474 - RNA, 14 nt, Yersinia pestis
accaaaugcucagc

SEQ ID NO: 4148475 - RNA, 18 nt, Yersinia pestis
accaaaugcucagccauc

SEQ ID NO: 4148476 - RNA, 19 nt, Yersinia pestis
accaacaccacacugagca

SEQ ID NO: 4148477 - RNA, 22 nt, Yersinia pestis
accaacaccacacugagcaccg

SEQ ID NO: 4148478 - RNA, 15 nt, Yersinia pestis
accaacaguuauuuu

SEQ ID NO: 4148479 - RNA, 22 nt, Yersinia pestis
accaacccgccccccaucaacg

SEQ ID NO: 4148480 - RNA, 22 nt, Yersinia pestis
accaaccuugggggaccagcac

SEQ ID NO: 4148481 - RNA, 16 nt, Yersinia pestis
accaacugauuuuuau

SEQ ID NO: 4148482 - RNA, 21 nt, Yersinia pestis
accaacugauuuuuauggcag

SEQ ID NO: 4148483 - RNA, 13 nt, Yersinia pestis
accaagaaaaccc

SEQ ID NO: 4148484 - RNA, 19 nt, Yersinia pestis
accaagacuucaugacuac

SEQ ID NO: 4148485 - RNA, 15 nt, Yersinia pestis
accaagagagaaucc

SEQ ID NO: 4148486 - RNA, 17 nt, Yersinia pestis
accaagaggaaaugccg

SEQ ID NO: 4148487 - RNA, 18 nt, Yersinia pestis
accaagaggaaaugccgc

SEQ ID NO: 4148488 - RNA, 12 nt, Yersinia pestis
accaagaggcug

SEQ ID NO: 4148489 - RNA, 14 nt, Yersinia pestis
accaagcuuugccu

SEQ ID NO: 4148490 - RNA, 13 nt, Yersinia pestis
accaaguccauga

SEQ ID NO: 4148491 - RNA, 18 nt, Yersinia pestis
accaaguuugacuuauga

SEQ ID NO: 4148492 - RNA, 13 nt, Yersinia pestis
accaauaauuaau

SEQ ID NO: 4148493 - RNA, 22 nt, Yersinia pestis
accaauaccauuuucagacuga

SEQ ID NO: 4148494 - RNA, 16 nt, Yersinia pestis
accaauagauuucacu

SEQ ID NO: 4148495 - RNA, 17 nt, Yersinia pestis
accaauagucacgucuu

SEQ ID NO: 4148496 - RNA, 15 nt, Yersinia pestis
accaauaucauaaua

SEQ ID NO: 4148497 - RNA, 15 nt, Yersinia pestis
accaaucaauacacu

SEQ ID NO: 4148498 - RNA, 14 nt, Yersinia pestis
accaauccaugcca

SEQ ID NO: 4148499 - RNA, 18 nt, Yersinia pestis
accaaucguugcugguua

SEQ ID NO: 4148500 - RNA, 15 nt, Yersinia pestis
accaaucuccaauga

SEQ ID NO: 4148501 - RNA, 20 nt, Yersinia pestis
accaaucuccaaugaccccg

SEQ ID NO: 4148502 - RNA, 22 nt, Yersinia pestis
accaaugaauuacguuuuggau

SEQ ID NO: 4148503 - RNA, 13 nt, Yersinia pestis
accaaugauuaac

SEQ ID NO: 4148504 - RNA, 13 nt, Yersinia pestis
accaaugauuuug

SEQ ID NO: 4148505 - RNA, 16 nt, Yersinia pestis
accaauggaaaauaca

SEQ ID NO: 4148506 - RNA, 21 nt, Yersinia pestis
accaaugggguaaucacuaca

SEQ ID NO: 4148507 - RNA, 21 nt, Yersinia pestis
accaauggugcccaucacauc

SEQ ID NO: 4148508 - RNA, 17 nt, Yersinia pestis
accaaugguuucaccgu

SEQ ID NO: 4148509 - RNA, 12 nt, Yersinia pestis
accaauucaguu

SEQ ID NO: 4148510 - RNA, 15 nt, Yersinia pestis
accaauucaucagcg

SEQ ID NO: 4148511 - RNA, 12 nt, Yersinia pestis
accaauucuuca

SEQ ID NO: 4148512 - RNA, 23 nt, Yersinia pestis
accaauuugccauaccaggccac

SEQ ID NO: 4148513 - RNA, 16 nt, Yersinia pestis
accacaaaaacagugu

SEQ ID NO: 4148514 - RNA, 19 nt, Yersinia pestis
accacaaugauuucaguuu

SEQ ID NO: 4148515 - RNA, 15 nt, Yersinia pestis
accacaccggcugca

SEQ ID NO: 4148516 - RNA, 18 nt, Yersinia pestis
accacagauaaauaaaau

SEQ ID NO: 4148517 - RNA, 19 nt, Yersinia pestis
accacagauaaauaaaaua

SEQ ID NO: 4148518 - RNA, 19 nt, Yersinia pestis
accacagcgaucucauuua

SEQ ID NO: 4148519 - RNA, 21 nt, Yersinia pestis
accacauaacgcacuggucag

SEQ ID NO: 4148520 - RNA, 18 nt, Yersinia pestis
accacaucaaccugauca

SEQ ID NO: 4148521 - RNA, 14 nt, Yersinia pestis
accaccaacagcau

SEQ ID NO: 4148522 - RNA, 19 nt, Yersinia pestis
accaccaacuccugccuac

SEQ ID NO: 4148523 - RNA, 15 nt, Yersinia pestis
accaccaccaacagc

SEQ ID NO: 4148524 - RNA, 13 nt, Yersinia pestis
accaccaccaacc

SEQ ID NO: 4148525 - RNA, 12 nt, Yersinia pestis
accaccaccaca

SEQ ID NO: 4148526 - RNA, 14 nt, Yersinia pestis
accaccaccacaaa

SEQ ID NO: 4148527 - RNA, 15 nt, Yersinia pestis
accaccaccacaaac

SEQ ID NO: 4148528 - RNA, 13 nt, Yersinia pestis
accaccaccaggc

SEQ ID NO: 4148529 - RNA, 20 nt, Yersinia pestis
accaccaucacuuccagcgc

SEQ ID NO: 4148530 - RNA, 15 nt, Yersinia pestis
accaccauuaacaag

SEQ ID NO: 4148531 - RNA, 11 nt, Yersinia pestis
accacccacgu

SEQ ID NO: 4148532 - RNA, 17 nt, Yersinia pestis
accacccguugcauuuu

SEQ ID NO: 4148533 - RNA, 16 nt, Yersinia pestis
accaccggguuuagua

SEQ ID NO: 4148534 - RNA, 13 nt, Yersinia pestis
accaccgucaaga

SEQ ID NO: 4148535 - RNA, 15 nt, Yersinia pestis
accaccuaauacagc

SEQ ID NO: 4148536 - RNA, 20 nt, Yersinia pestis
accaccuaauacagcaccac

SEQ ID NO: 4148537 - RNA, 14 nt, Yersinia pestis
accaccuacaaccu

SEQ ID NO: 4148538 - RNA, 15 nt, Yersinia pestis
accaccuacaaccua

SEQ ID NO: 4148539 - RNA, 14 nt, Yersinia pestis
accaccuaccaccu

SEQ ID NO: 4148540 - RNA, 17 nt, Yersinia pestis
accaccuaccaccuaca

SEQ ID NO: 4148541 - RNA, 18 nt, Yersinia pestis
accaccuaccaccuacaa

SEQ ID NO: 4148542 - RNA, 19 nt, Yersinia pestis
accacgaaaaaauggcagc

SEQ ID NO: 4148543 - RNA, 17 nt, Yersinia pestis
accacgacgaucuuguu

SEQ ID NO: 4148544 - RNA, 18 nt, Yersinia pestis
accacgacgaucuuguuc

SEQ ID NO: 4148545 - RNA, 19 nt, Yersinia pestis
accccacaaccugcgccac

SEQ ID NO: 4148546 - RNA, 15 nt, Yersinia pestis
accccauaaaucccg

SEQ ID NO: 4148547 - RNA, 23 nt, Yersinia pestis
accccauuuaucgccaagccagu

SEQ ID NO: 4148548 - RNA, 19 nt, Yersinia pestis
acccccaacccaaggagau

SEQ ID NO: 4148549 - RNA, 16 nt, Yersinia pestis
acccccaucaggaggu

SEQ ID NO: 4148550 - RNA, 14 nt, Yersinia pestis
acccccuucaccaa

SEQ ID NO: 4148551 - RNA, 18 nt, Yersinia pestis
accccguggcaggccuuu

SEQ ID NO: 4148552 - RNA, 15 nt, Yersinia pestis
accccguuacggcug

SEQ ID NO: 4148553 - RNA, 21 nt, Yersinia pestis
accccuaauccagcagccucu

SEQ ID NO: 4148554 - RNA, 15 nt, Yersinia pestis
accccuagccagcca

SEQ ID NO: 4148555 - RNA, 16 nt, Yersinia pestis
accccuauuagggaac

SEQ ID NO: 4148556 - RNA, 22 nt, Yersinia pestis
accccuauuagggaacgccagc

SEQ ID NO: 4148557 - RNA, 18 nt, Yersinia pestis
accccugucuuauuuuuu

SEQ ID NO: 4148558 - RNA, 18 nt, Yersinia pestis
accccuucgagcaccgcg

SEQ ID NO: 4148559 - RNA, 13 nt, Yersinia pestis
acccgaaucacuu

SEQ ID NO: 4148560 - RNA, 19 nt, Yersinia pestis
acccgaauuaauaaaaccu

SEQ ID NO: 4148561 - RNA, 17 nt, Yersinia pestis
acccgagaauaccuggc

SEQ ID NO: 4148562 - RNA, 18 nt, Yersinia pestis
acccgaugagcguauucg

SEQ ID NO: 4148563 - RNA, 15 nt, Yersinia pestis
acccgauuuccacga

SEQ ID NO: 4148564 - RNA, 17 nt, Yersinia pestis
acccgauuuccacgaaa

SEQ ID NO: 4148565 - RNA, 17 nt, Yersinia pestis
acccgccccccaucaac

SEQ ID NO: 4148566 - RNA, 17 nt, Yersinia pestis
acccgcgcagccuaaaa

SEQ ID NO: 4148567 - RNA, 18 nt, Yersinia pestis
acccgcuaauucaccaau

SEQ ID NO: 4148568 - RNA, 18 nt, Yersinia pestis
acccgcucugucagcccu

SEQ ID NO: 4148569 - RNA, 15 nt, Yersinia pestis
acccgcuucauucgc

SEQ ID NO: 4148570 - RNA, 20 nt, Yersinia pestis
acccgcuucguccgcuuagc

SEQ ID NO: 4148571 - RNA, 22 nt, Yersinia pestis
acccgcuugucuugaaaguguc

SEQ ID NO: 4148572 - RNA, 15 nt, Yersinia pestis
acccggcaucaacca

SEQ ID NO: 4148573 - RNA, 23 nt, Yersinia pestis
acccggccuugcccaucaaccac

SEQ ID NO: 4148574 - RNA, 18 nt, Yersinia pestis
acccggugacccgugcgg

SEQ ID NO: 4148575 - RNA, 20 nt, Yersinia pestis
acccguaggcccacaaucaa

SEQ ID NO: 4148576 - RNA, 19 nt, Yersinia pestis
acccgucauccuucaaguu

SEQ ID NO: 4148577 - RNA, 14 nt, Yersinia pestis
acccguuacugcau

SEQ ID NO: 4148578 - RNA, 17 nt, Yersinia pestis
acccguuagcaccggau

SEQ ID NO: 4148579 - RNA, 20 nt, Yersinia pestis
acccguuauaccucaagcug

SEQ ID NO: 4148580 - RNA, 14 nt, Yersinia pestis
acccguuauauuuc

SEQ ID NO: 4148581 - RNA, 17 nt, Yersinia pestis
acccguugcaaggccuc

SEQ ID NO: 4148582 - RNA, 13 nt, Yersinia pestis
acccuaauaccaa

SEQ ID NO: 4148583 - RNA, 20 nt, Yersinia pestis
acccuaauaccaacagcagg

SEQ ID NO: 4148584 - RNA, 13 nt, Yersinia pestis
acccuaucgucac

SEQ ID NO: 4148585 - RNA, 20 nt, Yersinia pestis
acccuaucgucacagcaauu

SEQ ID NO: 4148586 - RNA, 15 nt, Yersinia pestis
acccuaucugcucuu

SEQ ID NO: 4148587 - RNA, 23 nt, Yersinia pestis
acccuaucugcucuugcucagua

SEQ ID NO: 4148588 - RNA, 17 nt, Yersinia pestis
acccucaacucaaaaca

SEQ ID NO: 4148589 - RNA, 19 nt, Yersinia pestis
acccucaacucaaaacaau

SEQ ID NO: 4148590 - RNA, 22 nt, Yersinia pestis
acccucaggcucuggugucucu

SEQ ID NO: 4148591 - RNA, 17 nt, Yersinia pestis
acccucauguaagccaa

SEQ ID NO: 4148592 - RNA, 22 nt, Yersinia pestis
acccuccaauaauucgugaaaa

SEQ ID NO: 4148593 - RNA, 16 nt, Yersinia pestis
acccuccgacuuugau

SEQ ID NO: 4148594 - RNA, 21 nt, Yersinia pestis
acccucgacaccaaaacuccc

SEQ ID NO: 4148595 - RNA, 16 nt, Yersinia pestis
acccugcuacaggcga

SEQ ID NO: 4148596 - RNA, 22 nt, Yersinia pestis
acccuggucguuacguacuucu

SEQ ID NO: 4148597 - RNA, 16 nt, Yersinia pestis
acccuucaucuuucaa

SEQ ID NO: 4148598 - RNA, 23 nt, Yersinia pestis
acccuugagguuauugacaaagu

SEQ ID NO: 4148599 - RNA, 20 nt, Yersinia pestis
acccuuuagaggcugauaac

SEQ ID NO: 4148600 - RNA, 20 nt, Yersinia pestis
acccuuuugaauucaccaaa

SEQ ID NO: 4148601 - RNA, 21 nt, Yersinia pestis
acccuuuuugaguaaauucgg

SEQ ID NO: 4148602 - RNA, 16 nt, Yersinia pestis
accgaaagaagacaua

SEQ ID NO: 4148603 - RNA, 23 nt, Yersinia pestis
accgaaauauucgucucaucaau

SEQ ID NO: 4148604 - RNA, 14 nt, Yersinia pestis
accgaaauuagaag

SEQ ID NO: 4148605 - RNA, 14 nt, Yersinia pestis
accgaacacgaucc

SEQ ID NO: 4148606 - RNA, 14 nt, Yersinia pestis
accgacgauaauca

SEQ ID NO: 4148607 - RNA, 18 nt, Yersinia pestis
accgacgauaaucaggcu

SEQ ID NO: 4148608 - RNA, 14 nt, Yersinia pestis
accgacgcugaacu

SEQ ID NO: 4148609 - RNA, 14 nt, Yersinia pestis
accgacuugcccaa

SEQ ID NO: 4148610 - RNA, 21 nt, Yersinia pestis
accgaggcucgacgggaacga

SEQ ID NO: 4148611 - RNA, 22 nt, Yersinia pestis
accgaggcucgacgggaacgac

SEQ ID NO: 4148612 - RNA, 17 nt, Yersinia pestis
accgaguguaaaaagca

SEQ ID NO: 4148613 - RNA, 15 nt, Yersinia pestis
accgaguucucacca

SEQ ID NO: 4148614 - RNA, 19 nt, Yersinia pestis
accgauaauaaauauccuc

SEQ ID NO: 4148615 - RNA, 19 nt, Yersinia pestis
accgauauugauagccaca

SEQ ID NO: 4148616 - RNA, 16 nt, Yersinia pestis
accgaucacuauauac

SEQ ID NO: 4148617 - RNA, 18 nt, Yersinia pestis
accgaugagugaaaucuc

SEQ ID NO: 4148618 - RNA, 23 nt, Yersinia pestis
accgaugauaagugaauaaauca

SEQ ID NO: 4148619 - RNA, 19 nt, Yersinia pestis
accgaugcaaucgcauugc

SEQ ID NO: 4148620 - RNA, 21 nt, Yersinia pestis
accgaugcaaucgcauugcgu

SEQ ID NO: 4148621 - RNA, 19 nt, Yersinia pestis
accgauuucaggucgcaag

SEQ ID NO: 4148622 - RNA, 21 nt, Yersinia pestis
accgcaauaucaaugaaaaaa

SEQ ID NO: 4148623 - RNA, 22 nt, Yersinia pestis
accgcacacugacagcaacgac

SEQ ID NO: 4148624 - RNA, 22 nt, Yersinia pestis
accgcacugagggugauaucgu

SEQ ID NO: 4148625 - RNA, 17 nt, Yersinia pestis
accgcagauaaaagaaa

SEQ ID NO: 4148626 - RNA, 16 nt, Yersinia pestis
accgcagucgauaaac

SEQ ID NO: 4148627 - RNA, 14 nt, Yersinia pestis
accgcauucccugc

SEQ ID NO: 4148628 - RNA, 15 nt, Yersinia pestis
accgccaaauacaaa

SEQ ID NO: 4148629 - RNA, 13 nt, Yersinia pestis
accgccaaaucca

SEQ ID NO: 4148630 - RNA, 14 nt, Yersinia pestis
accgccaaaugaaa

SEQ ID NO: 4148631 - RNA, 16 nt, Yersinia pestis
accgccacacaauaca

SEQ ID NO: 4148632 - RNA, 14 nt, Yersinia pestis
accgccagucugaa

SEQ ID NO: 4148633 - RNA, 14 nt, Yersinia pestis
accgccagugccac

SEQ ID NO: 4148634 - RNA, 13 nt, Yersinia pestis
accgccagugccg

SEQ ID NO: 4148635 - RNA, 22 nt, Yersinia pestis
accgccagugccgcggcggcca

SEQ ID NO: 4148636 - RNA, 21 nt, Yersinia pestis
accgcccccaauaagggccac

SEQ ID NO: 4148637 - RNA, 16 nt, Yersinia pestis
accgccccccaucccc

SEQ ID NO: 4148638 - RNA, 20 nt, Yersinia pestis
accgcccccuccaauaacua

SEQ ID NO: 4148639 - RNA, 22 nt, Yersinia pestis
accgcccgacuugcugaaucaa

SEQ ID NO: 4148640 - RNA, 12 nt, Yersinia pestis
accgcccucuug

SEQ ID NO: 4148641 - RNA, 14 nt, Yersinia pestis
accgccgcaggcca

SEQ ID NO: 4148642 - RNA, 19 nt, Yersinia pestis
accgccgcaggccauuacc

SEQ ID NO: 4148643 - RNA, 19 nt, Yersinia pestis
accgccggcaacagcgccu

SEQ ID NO: 4148644 - RNA, 23 nt, Yersinia pestis
accgccugugacgcuugaauaua

SEQ ID NO: 4148645 - RNA, 14 nt, Yersinia pestis
accgcgaucacaau

SEQ ID NO: 4148646 - RNA, 21 nt, Yersinia pestis
accgcgcuuuugauuuucuua

SEQ ID NO: 4148647 - RNA, 20 nt, Yersinia pestis
accgcguaaaauuagagcaa

SEQ ID NO: 4148648 - RNA, 14 nt, Yersinia pestis
accgcuaaggccaa

SEQ ID NO: 4148649 - RNA, 18 nt, Yersinia pestis
accgcuaaggccaaugga

SEQ ID NO: 4148650 - RNA, 22 nt, Yersinia pestis
accgcuagauucggugacuaaa

SEQ ID NO: 4148651 - RNA, 21 nt, Yersinia pestis
accgcuaugcuaaaaaacagc

SEQ ID NO: 4148652 - RNA, 23 nt, Yersinia pestis
accgcuaugcuaaaaaacagccu

SEQ ID NO: 4148653 - RNA, 14 nt, Yersinia pestis
accgcucaguauuc

SEQ ID NO: 4148654 - RNA, 21 nt, Yersinia pestis
accgcucuucacauucaguca

SEQ ID NO: 4148655 - RNA, 23 nt, Yersinia pestis
accgcugaaguggcugaauauca

SEQ ID NO: 4148656 - RNA, 20 nt, Yersinia pestis
accgcugauaaccagccaac

SEQ ID NO: 4148657 - RNA, 15 nt, Yersinia pestis
accgcugcccggcuc

SEQ ID NO: 4148658 - RNA, 12 nt, Yersinia pestis
accgcugucauu

SEQ ID NO: 4148659 - RNA, 18 nt, Yersinia pestis
accgcuucagcaggggca

SEQ ID NO: 4148660 - RNA, 21 nt, Yersinia pestis
accgcuuugaugccuaauaau

SEQ ID NO: 4148661 - RNA, 13 nt, Yersinia pestis
accggaacagcag

SEQ ID NO: 4148662 - RNA, 17 nt, Yersinia pestis
accggaauaaaucagug

SEQ ID NO: 4148663 - RNA, 14 nt, Yersinia pestis
accggacaaaccag

SEQ ID NO: 4148664 - RNA, 15 nt, Yersinia pestis
accggauaaaacaau

SEQ ID NO: 4148665 - RNA, 12 nt, Yersinia pestis
accggauacaaa

SEQ ID NO: 4148666 - RNA, 17 nt, Yersinia pestis
accugucaccugucacc

SEQ ID NO: 4148667 - RNA, 18 nt, Yersinia pestis
accugucaccugucaccu

SEQ ID NO: 4148668 - RNA, 19 nt, Yersinia pestis
accugucaccugucaccug

SEQ ID NO: 4148669 - RNA, 13 nt, Yersinia pestis
accugucgcagaa

SEQ ID NO: 4148670 - RNA, 22 nt, Yersinia pestis
accuguuuuuguuguucuugau

SEQ ID NO: 4148671 - RNA, 19 nt, Yersinia pestis
accuuaacugcauagcuaa

SEQ ID NO: 4148672 - RNA, 16 nt, Yersinia pestis
accuuaaguaaguuua

SEQ ID NO: 4148673 - RNA, 21 nt, Yersinia pestis
accuuauauaacuagcaagga

SEQ ID NO: 4148674 - RNA, 13 nt, Yersinia pestis
accuuaucaccaa

SEQ ID NO: 4148675 - RNA, 19 nt, Yersinia pestis
accuuaucaccaacguuua

SEQ ID NO: 4148676 - RNA, 11 nt, Yersinia pestis
accuuaucacu

SEQ ID NO: 4148677 - RNA, 20 nt, Yersinia pestis
accuuauuggcccuuuuugc

SEQ ID NO: 4148678 - RNA, 23 nt, Yersinia pestis
accuuauuuuugcauauaaaaca

SEQ ID NO: 4148679 - RNA, 17 nt, Yersinia pestis
accuucaaacgggugau

SEQ ID NO: 4148680 - RNA, 13 nt, Yersinia pestis
accuucaaucauu

SEQ ID NO: 4148681 - RNA, 15 nt, Yersinia pestis
accuucaaucauuga

SEQ ID NO: 4148682 - RNA, 22 nt, Yersinia pestis
accuucaaucauugagaucagu

SEQ ID NO: 4148683 - RNA, 15 nt, Yersinia pestis
accuucacauuuucu

SEQ ID NO: 4148684 - RNA, 23 nt, Yersinia pestis
accuucaccgugaguuuucgcuu

SEQ ID NO: 4148685 - RNA, 14 nt, Yersinia pestis
accuucacugaaua

SEQ ID NO: 4148686 - RNA, 21 nt, Yersinia pestis
accuucacuggggagaucagu

SEQ ID NO: 4148687 - RNA, 21 nt, Yersinia pestis
accuucagacugacgcagagc

SEQ ID NO: 4148688 - RNA, 20 nt, Yersinia pestis
accuucaggaauaaacagca

SEQ ID NO: 4148689 - RNA, 15 nt, Yersinia pestis
accuuccauauugau

SEQ ID NO: 4148690 - RNA, 19 nt, Yersinia pestis
accuucccguccacuuuca

SEQ ID NO: 4148691 - RNA, 20 nt, Yersinia pestis
accuucccguccacuuucac

SEQ ID NO: 4148692 - RNA, 18 nt, Yersinia pestis
accuuccgucccaagaaa

SEQ ID NO: 4148693 - RNA, 22 nt, Yersinia pestis
accuuccgucccaagaaaagca

SEQ ID NO: 4148694 - RNA, 14 nt, Yersinia pestis
accuucgagagcua

SEQ ID NO: 4148695 - RNA, 18 nt, Yersinia pestis
accuucuacaaauuuuuu

SEQ ID NO: 4148696 - RNA, 20 nt, Yersinia pestis
accuucuacaaauuuuuuau

SEQ ID NO: 4148697 - RNA, 20 nt, Yersinia pestis
accuucuuauuuaucacauu

SEQ ID NO: 4148698 - RNA, 23 nt, Yersinia pestis
accuucuuauuuaucacauuucg

SEQ ID NO: 4148699 - RNA, 14 nt, Yersinia pestis
accuugauccgcca

SEQ ID NO: 4148700 - RNA, 15 nt, Yersinia pestis
accuugauccgccaa

SEQ ID NO: 4148701 - RNA, 22 nt, Yersinia pestis
accuugcuccgcaauuugccca

SEQ ID NO: 4148702 - RNA, 19 nt, Yersinia pestis
accuugcuggcuaucugug

SEQ ID NO: 4148703 - RNA, 15 nt, Yersinia pestis
accuuggaaaacagc

SEQ ID NO: 4148704 - RNA, 20 nt, Yersinia pestis
accuuggauggcgaaacaau

SEQ ID NO: 4148705 - RNA, 15 nt, Yersinia pestis
accuugguaaauacc

SEQ ID NO: 4148706 - RNA, 23 nt, Yersinia pestis
accuugguuugauagcaaaacac

SEQ ID NO: 4148707 - RNA, 18 nt, Yersinia pestis
accuuguggcacaaauag

SEQ ID NO: 4148708 - RNA, 14 nt, Yersinia pestis
accuuuauguaaca

SEQ ID NO: 4148709 - RNA, 19 nt, Yersinia pestis
accuuucgguugcaucaga

SEQ ID NO: 4148710 - RNA, 19 nt, Yersinia pestis
accuuuuuaggguuguugg

SEQ ID NO: 4148711 - RNA, 16 nt, Yersinia pestis
acgaaaaccuaauacu

SEQ ID NO: 4148712 - RNA, 19 nt, Yersinia pestis
acgaaaagcagcaguuaca

SEQ ID NO: 4148713 - RNA, 19 nt, Yersinia pestis
acgaaagagaacacaaaag

SEQ ID NO: 4148714 - RNA, 20 nt, Yersinia pestis
acgaaagauaauuuagcaaa

SEQ ID NO: 4148715 - RNA, 19 nt, Yersinia pestis
acgaaagcagccaauacac

SEQ ID NO: 4148716 - RNA, 22 nt, Yersinia pestis
acgaaauacucgagcguauugc

SEQ ID NO: 4148717 - RNA, 16 nt, Yersinia pestis
acgaaauugauaugau

SEQ ID NO: 4148718 - RNA, 17 nt, Yersinia pestis
acgaaauugauaugauu

SEQ ID NO: 4148719 - RNA, 16 nt, Yersinia pestis
acgaacagccccaacc

SEQ ID NO: 4148720 - RNA, 18 nt, Yersinia pestis
acgaacagugccaacagc

SEQ ID NO: 4148721 - RNA, 22 nt, Yersinia pestis
acgaacagugccaacagcgaga

SEQ ID NO: 4148722 - RNA, 20 nt, Yersinia pestis
acgaaggcaacaacacccga

SEQ ID NO: 4148723 - RNA, 21 nt, Yersinia pestis
acgaauagaaccggcugacau

SEQ ID NO: 4148724 - RNA, 21 nt, Yersinia pestis
acgaaugagcaguaauagcaa

SEQ ID NO: 4148725 - RNA, 18 nt, Yersinia pestis
acgaauggcgacuaaugg

SEQ ID NO: 4148726 - RNA, 19 nt, Yersinia pestis
acgaauuaaaacauauuaa

SEQ ID NO: 4148727 - RNA, 15 nt, Yersinia pestis
acgacaacaucaaug

SEQ ID NO: 4148728 - RNA, 18 nt, Yersinia pestis
acgacaacaucaauggca

SEQ ID NO: 4148729 - RNA, 16 nt, Yersinia pestis
acgacaaugaucguca

SEQ ID NO: 4148730 - RNA, 19 nt, Yersinia pestis
acgacacaaaugcugugcc

SEQ ID NO: 4148731 - RNA, 22 nt, Yersinia pestis
acgacacaaaugcugugccaug

SEQ ID NO: 4148732 - RNA, 21 nt, Yersinia pestis
acgacagauuauuguuaucca

SEQ ID NO: 4148733 - RNA, 11 nt, Yersinia pestis
acgacagccaa

SEQ ID NO: 4148734 - RNA, 21 nt, Yersinia pestis
acgacagccaaaucaguacca

SEQ ID NO: 4148735 - RNA, 18 nt, Yersinia pestis
acgacccacucguucuca

SEQ ID NO: 4148736 - RNA, 12 nt, Yersinia pestis
acgaccgucacc

SEQ ID NO: 4148737 - RNA, 18 nt, Yersinia pestis
acgacgcccgcagacugc

SEQ ID NO: 4148738 - RNA, 16 nt, Yersinia pestis
acgacgugcagcgcgc

SEQ ID NO: 4148739 - RNA, 16 nt, Yersinia pestis
acgacuuuaauaugau

SEQ ID NO: 4148740 - RNA, 22 nt, Yersinia pestis
acgagagcucgguugaccauuu

SEQ ID NO: 4148741 - RNA, 16 nt, Yersinia pestis
acgagcgguauuacag

SEQ ID NO: 4148742 - RNA, 21 nt, Yersinia pestis
acgaggacuuccugcccagcg

SEQ ID NO: 4148743 - RNA, 17 nt, Yersinia pestis
acgagggcucaaucucu

SEQ ID NO: 4148744 - RNA, 23 nt, Yersinia pestis
acgaguuuucccugcgccagcag

SEQ ID NO: 4148745 - RNA, 19 nt, Yersinia pestis
acgauaaaggcgagucagc

SEQ ID NO: 4148746 - RNA, 22 nt, Yersinia pestis
acgauaacuuuuggcagcacca

SEQ ID NO: 4148747 - RNA, 16 nt, Yersinia pestis
acgauaauuugcagcc

SEQ ID NO: 4148748 - RNA, 18 nt, Yersinia pestis
acgauacguugcagguca

SEQ ID NO: 4148749 - RNA, 16 nt, Yersinia pestis
acgauagccagugaca

SEQ ID NO: 4148750 - RNA, 20 nt, Yersinia pestis
acgauauaggguauaugccu

SEQ ID NO: 4148751 - RNA, 14 nt, Yersinia pestis
acgauauuaccgag

SEQ ID NO: 4148752 - RNA, 23 nt, Yersinia pestis
acgaucagcguauagcgccgcca

SEQ ID NO: 4148753 - RNA, 14 nt, Yersinia pestis
acgaucaguggcac

SEQ ID NO: 4148754 - RNA, 23 nt, Yersinia pestis
acgauccacgauugguugcauuu

SEQ ID NO: 4148755 - RNA, 15 nt, Yersinia pestis
acgauccugccagac

SEQ ID NO: 4148756 - RNA, 13 nt, Yersinia pestis
acgaucgauagua

SEQ ID NO: 4148757 - RNA, 23 nt, Yersinia pestis
acgaucgauaguaacaccagcau

SEQ ID NO: 4148758 - RNA, 16 nt, Yersinia pestis
acgaucuccuccagaa

SEQ ID NO: 4148759 - RNA, 20 nt, Yersinia pestis
acgaucugccuguucucucc

SEQ ID NO: 4148760 - RNA, 18 nt, Yersinia pestis
acgaucuugcccaaugcc

SEQ ID NO: 4148761 - RNA, 14 nt, Yersinia pestis
acgauggaaaaaau

SEQ ID NO: 4148762 - RNA, 22 nt, Yersinia pestis
acgauggaguggucaugcucac

SEQ ID NO: 4148763 - RNA, 23 nt, Yersinia pestis
acgaugguguaacccgccuugcg

SEQ ID NO: 4148764 - RNA, 15 nt, Yersinia pestis
acgauuaccugcaua

SEQ ID NO: 4148765 - RNA, 15 nt, Yersinia pestis
acgauuauuaaacua

SEQ ID NO: 4148766 - RNA, 22 nt, Yersinia pestis
acgauugcacuggcuaauacca

SEQ ID NO: 4148767 - RNA, 19 nt, Yersinia pestis
acgauugccggaaauuuau

SEQ ID NO: 4148768 - RNA, 19 nt, Yersinia pestis
acgauuguuacgccuucag

SEQ ID NO: 4148769 - RNA, 23 nt, Yersinia pestis
acgauuguuacgccuucagcgau

SEQ ID NO: 4148770 - RNA, 22 nt, Yersinia pestis
acgcaaaccccgaaccaaaaua

SEQ ID NO: 4148771 - RNA, 20 nt, Yersinia pestis
acgcaaagggcaacaauaua

SEQ ID NO: 4148772 - RNA, 21 nt, Yersinia pestis
acgcaaauaaagggccugcaa

SEQ ID NO: 4148773 - RNA, 22 nt, Yersinia pestis
acgcaaauaaagggccugcaaa

SEQ ID NO: 4148774 - RNA, 23 nt, Yersinia pestis
acgcaacguaauaucugccaccg

SEQ ID NO: 4148775 - RNA, 12 nt, Yersinia pestis
acgcaaggccag

SEQ ID NO: 4148776 - RNA, 14 nt, Yersinia pestis
acgcaaguaaaagu

SEQ ID NO: 4148777 - RNA, 17 nt, Yersinia pestis
acgcaaguaaaagucag

SEQ ID NO: 4148778 - RNA, 18 nt, Yersinia pestis
acgcaauacgguaggcau

SEQ ID NO: 4148779 - RNA, 15 nt, Yersinia pestis
acgcaauaucaaaac

SEQ ID NO: 4148780 - RNA, 22 nt, Yersinia pestis
acgcaauuagguugcagcuaaa

SEQ ID NO: 4148781 - RNA, 19 nt, Yersinia pestis
acgcaauucgcauaucaac

SEQ ID NO: 4148782 - RNA, 16 nt, Yersinia pestis
acgcaauugcaccgcg

SEQ ID NO: 4148783 - RNA, 16 nt, Yersinia pestis
acgcaccauccagcaa

SEQ ID NO: 4148784 - RNA, 15 nt, Yersinia pestis
acgcacguugaguga

SEQ ID NO: 4148785 - RNA, 16 nt, Yersinia pestis
acgcacguugagugau

SEQ ID NO: 4148786 - RNA, 15 nt, Yersinia pestis
acggcuuaucaaucu

SEQ ID NO: 4148787 - RNA, 19 nt, Yersinia pestis
acggcuuuucgcucagacu

SEQ ID NO: 4148788 - RNA, 13 nt, Yersinia pestis
acgggaugcaauc

SEQ ID NO: 4148789 - RNA, 14 nt, Yersinia pestis
acgggcaaccugua

SEQ ID NO: 4148790 - RNA, 17 nt, Yersinia pestis
acgggcgcaauggaaga

SEQ ID NO: 4148791 - RNA, 17 nt, Yersinia pestis
acgggcugcugcagccg

SEQ ID NO: 4148792 - RNA, 18 nt, Yersinia pestis
acgggcuuccaucaggaa

SEQ ID NO: 4148793 - RNA, 19 nt, Yersinia pestis
acgggcuuccaucaggaag

SEQ ID NO: 4148794 - RNA, 21 nt, Yersinia pestis
acgggcuuccaucaggaaguc

SEQ ID NO: 4148795 - RNA, 13 nt, Yersinia pestis
acgggcuugcugc

SEQ ID NO: 4148796 - RNA, 21 nt, Yersinia pestis
acgggcuugcugcaaccacuu

SEQ ID NO: 4148797 - RNA, 19 nt, Yersinia pestis
acgggcuuuaaugaguaaa

SEQ ID NO: 4148798 - RNA, 22 nt, Yersinia pestis
acggggaaacaguaaauuauuu

SEQ ID NO: 4148799 - RNA, 17 nt, Yersinia pestis
acggguaaugaaugccu

SEQ ID NO: 4148800 - RNA, 13 nt, Yersinia pestis
acgggucacagcc

SEQ ID NO: 4148801 - RNA, 21 nt, Yersinia pestis
acgguaaacgcaucccaggca

SEQ ID NO: 4148802 - RNA, 16 nt, Yersinia pestis
acgguaaccauccaua

SEQ ID NO: 4148803 - RNA, 15 nt, Yersinia pestis
acgguaaggccgcga

SEQ ID NO: 4148804 - RNA, 16 nt, Yersinia pestis
acgguaccgcagguca

SEQ ID NO: 4148805 - RNA, 13 nt, Yersinia pestis
acgguagcaauac

SEQ ID NO: 4148806 - RNA, 20 nt, Yersinia pestis
acgguaucuaggugcaguaa

SEQ ID NO: 4148807 - RNA, 18 nt, Yersinia pestis
acgguauuugaacuucaa

SEQ ID NO: 4148808 - RNA, 18 nt, Yersinia pestis
acggucauucacuguggc

SEQ ID NO: 4148809 - RNA, 13 nt, Yersinia pestis
acggugaacagau

SEQ ID NO: 4148810 - RNA, 16 nt, Yersinia pestis
acggugagaauaaaua

SEQ ID NO: 4148811 - RNA, 13 nt, Yersinia pestis
acggugauguccg

SEQ ID NO: 4148812 - RNA, 16 nt, Yersinia pestis
acgguggcccucugcc

SEQ ID NO: 4148813 - RNA, 18 nt, Yersinia pestis
acgguggguacuccucgc

SEQ ID NO: 4148814 - RNA, 17 nt, Yersinia pestis
acggugguaaucguccc

SEQ ID NO: 4148815 - RNA, 18 nt, Yersinia pestis
acgguuuaaucaaugugc

SEQ ID NO: 4148816 - RNA, 20 nt, Yersinia pestis
acgguuugaucaacaugggu

SEQ ID NO: 4148817 - RNA, 19 nt, Yersinia pestis
acguaauauguauuuagga

SEQ ID NO: 4148818 - RNA, 16 nt, Yersinia pestis
acguacauauaucacu

SEQ ID NO: 4148819 - RNA, 13 nt, Yersinia pestis
acguacuaucuau

SEQ ID NO: 4148820 - RNA, 17 nt, Yersinia pestis
acguagccucaauuuug

SEQ ID NO: 4148821 - RNA, 14 nt, Yersinia pestis
acguauauuggccu

SEQ ID NO: 4148822 - RNA, 16 nt, Yersinia pestis
acguaucaucagugcu

SEQ ID NO: 4148823 - RNA, 20 nt, Yersinia pestis
acguaucuauaaacuucacg

SEQ ID NO: 4148824 - RNA, 18 nt, Yersinia pestis
acguauucgucaccauca

SEQ ID NO: 4148825 - RNA, 20 nt, Yersinia pestis
acgucaguaaugaggguaag

SEQ ID NO: 4148826 - RNA, 14 nt, Yersinia pestis
acgucaucgaagag

SEQ ID NO: 4148827 - RNA, 20 nt, Yersinia pestis
acgucaucgccacacgcauu

SEQ ID NO: 4148828 - RNA, 17 nt, Yersinia pestis
acguccauaaucuggaa

SEQ ID NO: 4148829 - RNA, 17 nt, Yersinia pestis
acgucuaauugcugccc

SEQ ID NO: 4148830 - RNA, 21 nt, Yersinia pestis
acgucuacuggcugagagccg

SEQ ID NO: 4148831 - RNA, 16 nt, Yersinia pestis
acgucucuuccagugg

SEQ ID NO: 4148832 - RNA, 16 nt, Yersinia pestis
acgucugcaauagcuc

SEQ ID NO: 4148833 - RNA, 12 nt, Yersinia pestis
acgucugcaucg

SEQ ID NO: 4148834 - RNA, 20 nt, Yersinia pestis
acgucuuaugccauaacauc

SEQ ID NO: 4148835 - RNA, 17 nt, Yersinia pestis
acgucuucaccaaugau

SEQ ID NO: 4148836 - RNA, 13 nt, Yersinia pestis
acgugaucaucuu

SEQ ID NO: 4148837 - RNA, 23 nt, Yersinia pestis
acgugaugaugcuagugauaaac

SEQ ID NO: 4148838 - RNA, 19 nt, Yersinia pestis
acgugccccaaugaugacu

SEQ ID NO: 4148839 - RNA, 14 nt, Yersinia pestis
acgugcuauagaaa

SEQ ID NO: 4148840 - RNA, 22 nt, Yersinia pestis
acgugcuuacuggccuggcauu

SEQ ID NO: 4148841 - RNA, 13 nt, Yersinia pestis
acguguagccaaa

SEQ ID NO: 4148842 - RNA, 13 nt, Yersinia pestis
acguguccuuuuu

SEQ ID NO: 4148843 - RNA, 18 nt, Yersinia pestis
acguguuguuuucaugau

SEQ ID NO: 4148844 - RNA, 12 nt, Yersinia pestis
acguuaacugca

SEQ ID NO: 4148845 - RNA, 20 nt, Yersinia pestis
acguuacaacgagggcucaa

SEQ ID NO: 4148846 - RNA, 12 nt, Yersinia pestis
acguuagagcac

SEQ ID NO: 4148847 - RNA, 18 nt, Yersinia pestis
acguuaucucaaccaguu

SEQ ID NO: 4148848 - RNA, 17 nt, Yersinia pestis
acguuaugaauaaacca

SEQ ID NO: 4148849 - RNA, 16 nt, Yersinia pestis
acguuauuauugauua

SEQ ID NO: 4148850 - RNA, 12 nt, Yersinia pestis
acguucaccaaa

SEQ ID NO: 4148851 - RNA, 12 nt, Yersinia pestis
acguucagcagc

SEQ ID NO: 4148852 - RNA, 16 nt, Yersinia pestis
acguucaggcuuucga

SEQ ID NO: 4148853 - RNA, 14 nt, Yersinia pestis
acguugccagccau

SEQ ID NO: 4148854 - RNA, 19 nt, Yersinia pestis
acguuguuucugaagggca

SEQ ID NO: 4148855 - RNA, 15 nt, Yersinia pestis
acguuuaccggcaac

SEQ ID NO: 4148856 - RNA, 21 nt, Yersinia pestis
acuaaaaccugcuugaaagca

SEQ ID NO: 4148857 - RNA, 15 nt, Yersinia pestis
acuaaaauaucaaau

SEQ ID NO: 4148858 - RNA, 17 nt, Yersinia pestis
acuaaaaucugcucccg

SEQ ID NO: 4148859 - RNA, 16 nt, Yersinia pestis
acuaaaauucaaacaa

SEQ ID NO: 4148860 - RNA, 13 nt, Yersinia pestis
acuaaaccacaua

SEQ ID NO: 4148861 - RNA, 15 nt, Yersinia pestis
acuaaaccacauaac

SEQ ID NO: 4148862 - RNA, 13 nt, Yersinia pestis
acuaaaccuugaa

SEQ ID NO: 4148863 - RNA, 19 nt, Yersinia pestis
acuaaagaaauaaucauau

SEQ ID NO: 4148864 - RNA, 20 nt, Yersinia pestis
acuaaagccgauuuagacaa

SEQ ID NO: 4148865 - RNA, 16 nt, Yersinia pestis
acuaaauaauccagaa

SEQ ID NO: 4148866 - RNA, 21 nt, Yersinia pestis
acuaaauccuuguaaggugcu

SEQ ID NO: 4148867 - RNA, 15 nt, Yersinia pestis
acuaaauuaaaugca

SEQ ID NO: 4148868 - RNA, 15 nt, Yersinia pestis
acuaaauuagaaaac

SEQ ID NO: 4148869 - RNA, 17 nt, Yersinia pestis
acuaaauuagaaaacaa

SEQ ID NO: 4148870 - RNA, 15 nt, Yersinia pestis
acuaacaucagcgau

SEQ ID NO: 4148871 - RNA, 13 nt, Yersinia pestis
acuaaccucugca

SEQ ID NO: 4148872 - RNA, 16 nt, Yersinia pestis
acuaaccucugcaaug

SEQ ID NO: 4148873 - RNA, 18 nt, Yersinia pestis
acuaacgaaucccacacu

SEQ ID NO: 4148874 - RNA, 23 nt, Yersinia pestis
acuaacgauugacggaaaauuaa

SEQ ID NO: 4148875 - RNA, 18 nt, Yersinia pestis
acuaagagucacagcauu

SEQ ID NO: 4148876 - RNA, 15 nt, Yersinia pestis
acuaagaguccuuaa

SEQ ID NO: 4148877 - RNA, 21 nt, Yersinia pestis
acuaagcagauggucaacuaa

SEQ ID NO: 4148878 - RNA, 22 nt, Yersinia pestis
acuaagggcgauagacuuucac

SEQ ID NO: 4148879 - RNA, 15 nt, Yersinia pestis
acuaauaauaauuaa

SEQ ID NO: 4148880 - RNA, 15 nt, Yersinia pestis
acuaauagcauuuuu

SEQ ID NO: 4148881 - RNA, 15 nt, Yersinia pestis
acuaauggagagaug

SEQ ID NO: 4148882 - RNA, 18 nt, Yersinia pestis
acuaauggccagacacug

SEQ ID NO: 4148883 - RNA, 19 nt, Yersinia pestis
acuaauggccagacacuga

SEQ ID NO: 4148884 - RNA, 19 nt, Yersinia pestis
acuaauguuuguuucucug

SEQ ID NO: 4148885 - RNA, 15 nt, Yersinia pestis
acuaauuaauaacca

SEQ ID NO: 4148886 - RNA, 13 nt, Yersinia pestis
acuacaucgaguu

SEQ ID NO: 4148887 - RNA, 16 nt, Yersinia pestis
acuaccaaaauuuaaa

SEQ ID NO: 4148888 - RNA, 18 nt, Yersinia pestis
acuaccccacauucagua

SEQ ID NO: 4148889 - RNA, 23 nt, Yersinia pestis
acuacccuaucgucacagcaauu

SEQ ID NO: 4148890 - RNA, 17 nt, Yersinia pestis
acuaccgcucagauaaa

SEQ ID NO: 4148891 - RNA, 18 nt, Yersinia pestis
acuaccuugcuccgcaau

SEQ ID NO: 4148892 - RNA, 22 nt, Yersinia pestis
acuaccuuuugcauauuucucu

SEQ ID NO: 4148893 - RNA, 22 nt, Yersinia pestis
acuacggcgacuugccguggcu

SEQ ID NO: 4148894 - RNA, 19 nt, Yersinia pestis
acuacgguguuuggugaag

SEQ ID NO: 4148895 - RNA, 21 nt, Yersinia pestis
acuacugcaagccguaauuca

SEQ ID NO: 4148896 - RNA, 14 nt, Yersinia pestis
acuacuuauuuccg

SEQ ID NO: 4148897 - RNA, 14 nt, Yersinia pestis
acuacuugguuuaa

SEQ ID NO: 4148898 - RNA, 20 nt, Yersinia pestis
acuagagcguuacacaucag

SEQ ID NO: 4148899 - RNA, 16 nt, Yersinia pestis
acuagcagagcacgca

SEQ ID NO: 4148900 - RNA, 14 nt, Yersinia pestis
acuaguuaaaacca

SEQ ID NO: 4148901 - RNA, 18 nt, Yersinia pestis
acuauaagcgcucaaaua

SEQ ID NO: 4148902 - RNA, 13 nt, Yersinia pestis
acuauaggcuauu

SEQ ID NO: 4148903 - RNA, 18 nt, Yersinia pestis
acuaucaaacucaccauu

SEQ ID NO: 4148904 - RNA, 20 nt, Yersinia pestis
acuaucacaucaaauuuuug

SEQ ID NO: 4148905 - RNA, 16 nt, Yersinia pestis
acuaucccuucaauca

SEQ ID NO: 4148906 - RNA, 14 nt, Yersinia pestis
acuaucgaaacacc

SEQ ID NO: 4148907 - RNA, 14 nt, Yersinia pestis
acuauuaacucuuu

SEQ ID NO: 4148908 - RNA, 15 nt, Yersinia pestis
acuauuaacucuuuu

SEQ ID NO: 4148909 - RNA, 14 nt, Yersinia pestis
acuguuuuauuaua

SEQ ID NO: 4148910 - RNA, 17 nt, Yersinia pestis
acuguuuuauuauauau

SEQ ID NO: 4148911 - RNA, 23 nt, Yersinia pestis
acuguuuugguuuccgcugacau

SEQ ID NO: 4148912 - RNA, 21 nt, Yersinia pestis
acuguuuuuuaaagaaaaaac

SEQ ID NO: 4148913 - RNA, 14 nt, Yersinia pestis
acuuaaaaaucaaa

SEQ ID NO: 4148914 - RNA, 19 nt, Yersinia pestis
acuuaaaaaucaaaaguua

SEQ ID NO: 4148915 - RNA, 15 nt, Yersinia pestis
acuuaaaaguaggcu

SEQ ID NO: 4148916 - RNA, 18 nt, Yersinia pestis
acuuaaagcccagguuac

SEQ ID NO: 4148917 - RNA, 18 nt, Yersinia pestis
acuuaacaaucagugcaa

SEQ ID NO: 4148918 - RNA, 17 nt, Yersinia pestis
acuuaacuacugcaagc

SEQ ID NO: 4148919 - RNA, 17 nt, Yersinia pestis
acuuaacugaaagccaa

SEQ ID NO: 4148920 - RNA, 14 nt, Yersinia pestis
acuuaaggcuagcc

SEQ ID NO: 4148921 - RNA, 22 nt, Yersinia pestis
acuuaauaaugaccacgcauca

SEQ ID NO: 4148922 - RNA, 21 nt, Yersinia pestis
acuuaaucgccagugaguccu

SEQ ID NO: 4148923 - RNA, 17 nt, Yersinia pestis
acuuaauggucuucuuu

SEQ ID NO: 4148924 - RNA, 16 nt, Yersinia pestis
acuuaauuccaugcaa

SEQ ID NO: 4148925 - RNA, 15 nt, Yersinia pestis
acuuaauuucaguca

SEQ ID NO: 4148926 - RNA, 15 nt, Yersinia pestis
acuuaccugaguaag

SEQ ID NO: 4148927 - RNA, 20 nt, Yersinia pestis
acuuaccugaguaagcucau

SEQ ID NO: 4148928 - RNA, 15 nt, Yersinia pestis
acuuacgguaagcac

SEQ ID NO: 4148929 - RNA, 15 nt, Yersinia pestis
acuuacugaucaaua

SEQ ID NO: 4148930 - RNA, 14 nt, Yersinia pestis
acuuacugccaaag

SEQ ID NO: 4148931 - RNA, 23 nt, Yersinia pestis
acuuacuguauuaccucacguuu

SEQ ID NO: 4148932 - RNA, 16 nt, Yersinia pestis
acuuagcucaaucggc

SEQ ID NO: 4148933 - RNA, 16 nt, Yersinia pestis
acuuaucgacaccaau

SEQ ID NO: 4148934 - RNA, 16 nt, Yersinia pestis
acuuaucgguuuuuug

SEQ ID NO: 4148935 - RNA, 20 nt, Yersinia pestis
acuuaucgguuuuuuggagc

SEQ ID NO: 4148936 - RNA, 16 nt, Yersinia pestis
acuuaucuaaaaaacc

SEQ ID NO: 4148937 - RNA, 17 nt, Yersinia pestis
acuuaucuaaaaaacca

SEQ ID NO: 4148938 - RNA, 17 nt, Yersinia pestis
acuuaucugagccuuca

SEQ ID NO: 4148939 - RNA, 22 nt, Yersinia pestis
acuuaucugagccuucaacaaa

SEQ ID NO: 4148940 - RNA, 12 nt, Yersinia pestis
acuuauggguuu

SEQ ID NO: 4148941 - RNA, 15 nt, Yersinia pestis
acuuauggguuuuua

SEQ ID NO: 4148942 - RNA, 22 nt, Yersinia pestis
acuuauuacaccuuaaaacagc

SEQ ID NO: 4148943 - RNA, 15 nt, Yersinia pestis
acuuauuauaaagcu

SEQ ID NO: 4148944 - RNA, 12 nt, Yersinia pestis
acuuauuugaaa

SEQ ID NO: 4148945 - RNA, 14 nt, Yersinia pestis
acuuauuugaaaua

SEQ ID NO: 4148946 - RNA, 16 nt, Yersinia pestis
acuucaagcagcaugu

SEQ ID NO: 4148947 - RNA, 21 nt, Yersinia pestis
acuucaauuuggccauuaacc

SEQ ID NO: 4148948 - RNA, 24 nt, Yersinia pestis
acuucaauuuggccauuaaccuaa

SEQ ID NO: 4148949 - RNA, 14 nt, Yersinia pestis
acuucaggccaaua

SEQ ID NO: 4148950 - RNA, 14 nt, Yersinia pestis
acuucaucuuuuuu

SEQ ID NO: 4148951 - RNA, 22 nt, Yersinia pestis
acuucaugacuaccuugcuccg

SEQ ID NO: 4148952 - RNA, 19 nt, Yersinia pestis
acuucauuggcuugguugu

SEQ ID NO: 4148953 - RNA, 16 nt, Yersinia pestis
acuucauuucagguaa

SEQ ID NO: 4148954 - RNA, 14 nt, Yersinia pestis
acuucauuuucucg

SEQ ID NO: 4148955 - RNA, 15 nt, Yersinia pestis
acuuccaauuucuca

SEQ ID NO: 4148956 - RNA, 19 nt, Yersinia pestis
acuuccagcguauguuccu

SEQ ID NO: 4148957 - RNA, 16 nt, Yersinia pestis
acuuccauaaacggaa

SEQ ID NO: 4148958 - RNA, 12 nt, Yersinia pestis
acuuccauuccg

SEQ ID NO: 4148959 - RNA, 20 nt, Yersinia pestis
acuucccgcacaauuccagg

SEQ ID NO: 4148960 - RNA, 20 nt, Yersinia pestis
acuuccgccgccaacaguga

SEQ ID NO: 4148961 - RNA, 23 nt, Yersinia pestis
acuuccgccgccaacagugaaua

SEQ ID NO: 4148962 - RNA, 22 nt, Yersinia pestis
acuuccuaacaauauuaccaau

SEQ ID NO: 4148963 - RNA, 13 nt, Yersinia pestis
acuuccuuugccc

SEQ ID NO: 4148964 - RNA, 15 nt, Yersinia pestis
acuucgaaagaaaua

SEQ ID NO: 4148965 - RNA, 21 nt, Yersinia pestis
acuucgaaagaaauaaaagaa

SEQ ID NO: 4148966 - RNA, 16 nt, Yersinia pestis
acuucgaugauuauuu

SEQ ID NO: 4148967 - RNA, 17 nt, Yersinia pestis
acuucgccaggucagga

SEQ ID NO: 4148968 - RNA, 17 nt, Yersinia pestis
acuucgccgggucagga

SEQ ID NO: 4148969 - RNA, 19 nt, Yersinia pestis
acuucuauuacccuaacag

SEQ ID NO: 4148970 - RNA, 21 nt, Yersinia pestis
acuucuccuguauuugguuau

SEQ ID NO: 4148971 - RNA, 19 nt, Yersinia pestis
acuucucugacacacaaau

SEQ ID NO: 4148972 - RNA, 18 nt, Yersinia pestis
acuucugcgaccugaucc

SEQ ID NO: 4148973 - RNA, 15 nt, Yersinia pestis
acuucuuauuaauca

SEQ ID NO: 4148974 - RNA, 15 nt, Yersinia pestis
acuucuuucacuaau

SEQ ID NO: 4148975 - RNA, 14 nt, Yersinia pestis
acuugagucagcac

SEQ ID NO: 4148976 - RNA, 19 nt, Yersinia pestis
acuugauuaacaucgccac

SEQ ID NO: 4148977 - RNA, 14 nt, Yersinia pestis
acuugauucaccag

SEQ ID NO: 4148978 - RNA, 19 nt, Yersinia pestis
acuugccacaacugaaugu

SEQ ID NO: 4148979 - RNA, 15 nt, Yersinia pestis
acuugcccaauggca

SEQ ID NO: 4148980 - RNA, 15 nt, Yersinia pestis
acuugcccugagugu

SEQ ID NO: 4148981 - RNA, 23 nt, Yersinia pestis
acuugccguuuugggcuugagca

SEQ ID NO: 4148982 - RNA, 14 nt, Yersinia pestis
acuugccugaaauu

SEQ ID NO: 4148983 - RNA, 16 nt, Yersinia pestis
acuugcucuugagugu

SEQ ID NO: 4148984 - RNA, 14 nt, Yersinia pestis
acuugcuggaggcu

SEQ ID NO: 4148985 - RNA, 20 nt, Yersinia pestis
acuugcuggaggcuggcagg

SEQ ID NO: 4148986 - RNA, 14 nt, Yersinia pestis
acuuggacaucugc

SEQ ID NO: 4148987 - RNA, 22 nt, Yersinia pestis
acuuggauacguucaacgaccu

SEQ ID NO: 4148988 - RNA, 20 nt, Yersinia pestis
acuuggcuaauugucacaga

SEQ ID NO: 4148989 - RNA, 16 nt, Yersinia pestis
acuuggcuuuuucuuc

SEQ ID NO: 4148990 - RNA, 19 nt, Yersinia pestis
acuuguagguuaaauucac

SEQ ID NO: 4148991 - RNA, 23 nt, Yersinia pestis
acuuguagguuaaauucacuuuc

SEQ ID NO: 4148992 - RNA, 12 nt, Yersinia pestis
acuuuaaauacc

SEQ ID NO: 4148993 - RNA, 17 nt, Yersinia pestis
acuuuaagcugcagagg

SEQ ID NO: 4148994 - RNA, 12 nt, Yersinia pestis
acuuuaauuaaa

SEQ ID NO: 4148995 - RNA, 16 nt, Yersinia pestis
acuuuacauauaggaa

SEQ ID NO: 4148996 - RNA, 12 nt, Yersinia pestis
acuuuaucaguc

SEQ ID NO: 4148997 - RNA, 22 nt, Yersinia pestis
acuuuaucugccaaauauugca

SEQ ID NO: 4148998 - RNA, 18 nt, Yersinia pestis
acuuuauucacagcagaa

SEQ ID NO: 4148999 - RNA, 22 nt, Yersinia pestis
acuuuauucacagcagaacaaa

SEQ ID NO: 4149000 - RNA, 19 nt, Yersinia pestis
acuuuauugacuguaaaua

SEQ ID NO: 4149001 - RNA, 17 nt, Yersinia pestis
acuuuauuuaaaauuaa

SEQ ID NO: 4149002 - RNA, 22 nt, Yersinia pestis
acuuucaccaaaccaucagcga

SEQ ID NO: 4149003 - RNA, 17 nt, Yersinia pestis
acuuucaugccuugaaa

SEQ ID NO: 4149004 - RNA, 13 nt, Yersinia pestis
acuuuccacaaca

SEQ ID NO: 4149005 - RNA, 21 nt, Yersinia pestis
acuuucccauagcuggcuuca

SEQ ID NO: 4149006 - RNA, 22 nt, Yersinia pestis
acuuucgauagucagcuucacu

SEQ ID NO: 4149007 - RNA, 18 nt, Yersinia pestis
acuuugaugccaaggccg

SEQ ID NO: 4149008 - RNA, 17 nt, Yersinia pestis
acuuugcgcuuuuuaau

SEQ ID NO: 4149009 - RNA, 15 nt, Yersinia pestis
acuuuggcaaaguca

SEQ ID NO: 4149010 - RNA, 20 nt, Yersinia pestis
acuuuggcaaagucaucaaa

SEQ ID NO: 4149011 - RNA, 15 nt, Yersinia pestis
acuuuggguauauga

SEQ ID NO: 4149012 - RNA, 20 nt, Yersinia pestis
acuuugucacccgucaggau

SEQ ID NO: 4149013 - RNA, 23 nt, Yersinia pestis
acuuuguuauccaucaaccacgg

SEQ ID NO: 4149014 - RNA, 20 nt, Yersinia pestis
acuuuuacgggccuuuuaau

SEQ ID NO: 4149015 - RNA, 19 nt, Yersinia pestis
acuuuuacugguucauuuu

SEQ ID NO: 4149016 - RNA, 14 nt, Yersinia pestis
acuuuuauuauaua

SEQ ID NO: 4149017 - RNA, 16 nt, Yersinia pestis
acuuuuauuugauucg

SEQ ID NO: 4149018 - RNA, 16 nt, Yersinia pestis
acuuuucaguuuuaau

SEQ ID NO: 4149019 - RNA, 21 nt, Yersinia pestis
acuuuucaucgcauaggccaa

SEQ ID NO: 4149020 - RNA, 23 nt, Yersinia pestis
acuuuucaucgcauaggccaaua

SEQ ID NO: 4149021 - RNA, 18 nt, Yersinia pestis
acuuuucuucauugcugc

SEQ ID NO: 4149022 - RNA, 11 nt, Yersinia pestis
acuuuuuguga

SEQ ID NO: 4149023 - RNA, 19 nt, Yersinia pestis
acuuuuuuaccacauuucc

SEQ ID NO: 4149024 - RNA, 23 nt, Yersinia pestis
acuuuuuuaccacauuuccuaug

SEQ ID NO: 4149025 - RNA, 12 nt, Yersinia pestis
acuuuuuuuaac

SEQ ID NO: 4149026 - RNA, 18 nt, Yersinia pestis
agaaaaacacuuuauuga

SEQ ID NO: 4149027 - RNA, 22 nt, Yersinia pestis
agaaaaaguauugcacugagag

SEQ ID NO: 4149028 - RNA, 21 nt, Yersinia pestis
agaaaacaguuacuccuacac

SEQ ID NO: 4149029 - RNA, 19 nt, Yersinia pestis
agaaaaccuucagcaaaga

SEQ ID NO: 4149030 - RNA, 14 nt, Yersinia pestis
agaaaauuucucuu

SEQ ID NO: 4149031 - RNA, 20 nt, Yersinia pestis
agaccaaauagcaagccaaa

SEQ ID NO: 4149032 - RNA, 15 nt, Yersinia pestis
agaccaagcauuuua

SEQ ID NO: 4149033 - RNA, 13 nt, Yersinia pestis
agaccaccaacuc

SEQ ID NO: 4149034 - RNA, 23 nt, Yersinia pestis
agacccauuucugcuucuacccu

SEQ ID NO: 4149035 - RNA, 16 nt, Yersinia pestis
agaccccugcgauaau

SEQ ID NO: 4149036 - RNA, 23 nt, Yersinia pestis
agaccccugcgauaaucuccauc

SEQ ID NO: 4149037 - RNA, 13 nt, Yersinia pestis
agacccgauuuca

SEQ ID NO: 4149038 - RNA, 15 nt, Yersinia pestis
agacccuaauaucau

SEQ ID NO: 4149039 - RNA, 21 nt, Yersinia pestis
agaccgguggcuuuuucaccc

SEQ ID NO: 4149040 - RNA, 15 nt, Yersinia pestis
agaccguaucacccg

SEQ ID NO: 4149041 - RNA, 19 nt, Yersinia pestis
agaccugaggauaaaaacu

SEQ ID NO: 4149042 - RNA, 13 nt, Yersinia pestis
agacgaaggcacg

SEQ ID NO: 4149043 - RNA, 16 nt, Yersinia pestis
agacgacuagccuaac

SEQ ID NO: 4149044 - RNA, 16 nt, Yersinia pestis
agacgagcguaauucc

SEQ ID NO: 4149045 - RNA, 17 nt, Yersinia pestis
agacgaguauuccccac

SEQ ID NO: 4149046 - RNA, 23 nt, Yersinia pestis
agacgagucuauugaaaaaauaa

SEQ ID NO: 4149047 - RNA, 16 nt, Yersinia pestis
agacgccguaaauaca

SEQ ID NO: 4149048 - RNA, 17 nt, Yersinia pestis
agacggcagcaacgaaa

SEQ ID NO: 4149049 - RNA, 16 nt, Yersinia pestis
agacggcguaagccuu

SEQ ID NO: 4149050 - RNA, 15 nt, Yersinia pestis
agacgucauaaauau

SEQ ID NO: 4149051 - RNA, 18 nt, Yersinia pestis
agacgucauaaauauuuu

SEQ ID NO: 4149052 - RNA, 23 nt, Yersinia pestis
agacguccauaaucuggaagcgc

SEQ ID NO: 4149053 - RNA, 22 nt, Yersinia pestis
agacgugcguuuuugaaauacc

SEQ ID NO: 4149054 - RNA, 21 nt, Yersinia pestis
agacguuuaaauaagcuauca

SEQ ID NO: 4149055 - RNA, 19 nt, Yersinia pestis
agacuaaacgcuaccauga

SEQ ID NO: 4149056 - RNA, 15 nt, Yersinia pestis
agacuaaauguagag

SEQ ID NO: 4149057 - RNA, 19 nt, Yersinia pestis
agacuaaccucugcaaugc

SEQ ID NO: 4149058 - RNA, 18 nt, Yersinia pestis
agacuacacacagcaaua

SEQ ID NO: 4149059 - RNA, 18 nt, Yersinia pestis
agacuaccggaaccgccg

SEQ ID NO: 4149060 - RNA, 15 nt, Yersinia pestis
agacucaguaaauau

SEQ ID NO: 4149061 - RNA, 19 nt, Yersinia pestis
agacucgcuaacucaauaa

SEQ ID NO: 4149062 - RNA, 16 nt, Yersinia pestis
agacugaaauaauggu

SEQ ID NO: 4149063 - RNA, 16 nt, Yersinia pestis
agacugacgcagagcu

SEQ ID NO: 4149064 - RNA, 16 nt, Yersinia pestis
agacugcucuuucccu

SEQ ID NO: 4149065 - RNA, 15 nt, Yersinia pestis
agacugcugacaacc

SEQ ID NO: 4149066 - RNA, 21 nt, Yersinia pestis
agacuggcgauauggcacagg

SEQ ID NO: 4149067 - RNA, 16 nt, Yersinia pestis
agacuguuuuauuaua

SEQ ID NO: 4149068 - RNA, 21 nt, Yersinia pestis
agacuuacgcgaugccaacaa

SEQ ID NO: 4149069 - RNA, 14 nt, Yersinia pestis
agacuucgccguuc

SEQ ID NO: 4149070 - RNA, 19 nt, Yersinia pestis
agacuucgguauggcgcuu

SEQ ID NO: 4149071 - RNA, 23 nt, Yersinia pestis
agacuucuaaaucacgcagcagg

SEQ ID NO: 4149072 - RNA, 22 nt, Yersinia pestis
agagaaaagcagacuugaacuu

SEQ ID NO: 4149073 - RNA, 14 nt, Yersinia pestis
agagaaauaaccca

SEQ ID NO: 4149074 - RNA, 20 nt, Yersinia pestis
agagaaaugcucaucaagua

SEQ ID NO: 4149075 - RNA, 15 nt, Yersinia pestis
agagaacaggcagau

SEQ ID NO: 4149076 - RNA, 22 nt, Yersinia pestis
agagaacaggcagaucguaaag

SEQ ID NO: 4149077 - RNA, 21 nt, Yersinia pestis
agagaacaggcagcaaauaaa

SEQ ID NO: 4149078 - RNA, 18 nt, Yersinia pestis
agagaacgggcaaccugu

SEQ ID NO: 4149079 - RNA, 18 nt, Yersinia pestis
agagaacuccacauuuug

SEQ ID NO: 4149080 - RNA, 16 nt, Yersinia pestis
agagaauccauuuaau

SEQ ID NO: 4149081 - RNA, 13 nt, Yersinia pestis
agagaccacagau

SEQ ID NO: 4149082 - RNA, 12 nt, Yersinia pestis
agagacggaaag

SEQ ID NO: 4149083 - RNA, 19 nt, Yersinia pestis
agagacggaaagagccagc

SEQ ID NO: 4149084 - RNA, 22 nt, Yersinia pestis
agagacuauucucgaaaaagag

SEQ ID NO: 4149085 - RNA, 12 nt, Yersinia pestis
agagacuuugua

SEQ ID NO: 4149086 - RNA, 19 nt, Yersinia pestis
agagacuuuguaccgguuc

SEQ ID NO: 4149087 - RNA, 14 nt, Yersinia pestis
agagagacuuugua

SEQ ID NO: 4149088 - RNA, 13 nt, Yersinia pestis
agagauaauaggu

SEQ ID NO: 4149089 - RNA, 14 nt, Yersinia pestis
agagauacuuccuu

SEQ ID NO: 4149090 - RNA, 14 nt, Yersinia pestis
agagaucagaguac

SEQ ID NO: 4149091 - RNA, 15 nt, Yersinia pestis
agagaucguaggcuu

SEQ ID NO: 4149092 - RNA, 20 nt, Yersinia pestis
agagaucguaggcuuuuuac

SEQ ID NO: 4149093 - RNA, 14 nt, Yersinia pestis
agagaugauagcaa

SEQ ID NO: 4149094 - RNA, 16 nt, Yersinia pestis
agagaugcaaucuaac

SEQ ID NO: 4149095 - RNA, 13 nt, Yersinia pestis
agagaugcagaga

SEQ ID NO: 4149096 - RNA, 19 nt, Yersinia pestis
agagauguucgcagaaaag

SEQ ID NO: 4149097 - RNA, 23 nt, Yersinia pestis
agagauucguuuuuuuaucaaug

SEQ ID NO: 4149098 - RNA, 16 nt, Yersinia pestis
agagcaaaacugggcu

SEQ ID NO: 4149099 - RNA, 20 nt, Yersinia pestis
agagcaaaacugggcuugag

SEQ ID NO: 4149100 - RNA, 16 nt, Yersinia pestis
agagcagugcagcaaa

SEQ ID NO: 4149101 - RNA, 13 nt, Yersinia pestis
agagccaccagaa

SEQ ID NO: 4149102 - RNA, 23 nt, Yersinia pestis
agagccucuauuaccucaauacg

SEQ ID NO: 4149103 - RNA, 14 nt, Yersinia pestis
agagcgacucaaua

SEQ ID NO: 4149104 - RNA, 16 nt, Yersinia pestis
agagcgauugacugaa

SEQ ID NO: 4149105 - RNA, 22 nt, Yersinia pestis
agagcgauugacugaaugugaa

SEQ ID NO: 4149106 - RNA, 23 nt, Yersinia pestis
agagcggaugauucgccauucug

SEQ ID NO: 4149107 - RNA, 18 nt, Yersinia pestis
agagcggucgacaaaaug

SEQ ID NO: 4149108 - RNA, 22 nt, Yersinia pestis
agagcgucccugauggggcaau

SEQ ID NO: 4149109 - RNA, 17 nt, Yersinia pestis
agagcguccugauuuag

SEQ ID NO: 4149110 - RNA, 13 nt, Yersinia pestis
agaggaaauaaau

SEQ ID NO: 4149111 - RNA, 17 nt, Yersinia pestis
agaggacucugcgcuca

SEQ ID NO: 4149112 - RNA, 21 nt, Yersinia pestis
agaggccagcuucccugcaua

SEQ ID NO: 4149113 - RNA, 23 nt, Yersinia pestis
agaggcugaaggcgcuccccugc

SEQ ID NO: 4149114 - RNA, 22 nt, Yersinia pestis
agagggccccgauuaaggagcc

SEQ ID NO: 4149115 - RNA, 16 nt, Yersinia pestis
agagguuaaauuguuc

SEQ ID NO: 4149116 - RNA, 19 nt, Yersinia pestis
agagguuauugacaaagag

SEQ ID NO: 4149117 - RNA, 16 nt, Yersinia pestis
agaguaacggaggggc

SEQ ID NO: 4149118 - RNA, 17 nt, Yersinia pestis
agaguaaggccaauugg

SEQ ID NO: 4149119 - RNA, 13 nt, Yersinia pestis
agaguaaguaaaa

SEQ ID NO: 4149120 - RNA, 13 nt, Yersinia pestis
agagucacagcau

SEQ ID NO: 4149121 - RNA, 16 nt, Yersinia pestis
agaguccagcacuggu

SEQ ID NO: 4149122 - RNA, 21 nt, Yersinia pestis
agagucgagcggggcaaaaau

SEQ ID NO: 4149123 - RNA, 19 nt, Yersinia pestis
agagucgaugaaacacaac

SEQ ID NO: 4149124 - RNA, 20 nt, Yersinia pestis
agagucugucauggcacgcu

SEQ ID NO: 4149125 - RNA, 18 nt, Yersinia pestis
agagugaaugugaguguu

SEQ ID NO: 4149126 - RNA, 18 nt, Yersinia pestis
agagugaccaaagcagua

SEQ ID NO: 4149127 - RNA, 17 nt, Yersinia pestis
agaguggcggccaguga

SEQ ID NO: 4149128 - RNA, 21 nt, Yersinia pestis
agaguguucauaaauuaaaac

SEQ ID NO: 4149129 - RNA, 23 nt, Yersinia pestis
agaguugauccgauaaacuucac

SEQ ID NO: 4149130 - RNA, 12 nt, Yersinia pestis
agaguugcaguu

SEQ ID NO: 4149131 - RNA, 17 nt, Yersinia pestis
agaguugcucacccauu

SEQ ID NO: 4149132 - RNA, 22 nt, Yersinia pestis
agauaaacaaggcagaaguaug

SEQ ID NO: 4149133 - RNA, 20 nt, Yersinia pestis
agauaaagcuugaucacaau

SEQ ID NO: 4149134 - RNA, 17 nt, Yersinia pestis
agauaaauaaaauaaua

SEQ ID NO: 4149135 - RNA, 12 nt, Yersinia pestis
agauaacaacaa

SEQ ID NO: 4149136 - RNA, 13 nt, Yersinia pestis
agauaacaacaaa

SEQ ID NO: 4149137 - RNA, 15 nt, Yersinia pestis
agauaacaacaaaga

SEQ ID NO: 4149138 - RNA, 23 nt, Yersinia pestis
agauaacgcaaaacgcccuugcc

SEQ ID NO: 4149139 - RNA, 12 nt, Yersinia pestis
agauaaggccug

SEQ ID NO: 4149140 - RNA, 15 nt, Yersinia pestis
agauaauuauccauu

SEQ ID NO: 4149141 - RNA, 15 nt, Yersinia pestis
agauaauuuagcaaa

SEQ ID NO: 4149142 - RNA, 16 nt, Yersinia pestis
agauaccacaucaaac

SEQ ID NO: 4149143 - RNA, 19 nt, Yersinia pestis
agauaccacaucaaaccgg

SEQ ID NO: 4149144 - RNA, 17 nt, Yersinia pestis
agauacccuucucuuua

SEQ ID NO: 4149145 - RNA, 19 nt, Yersinia pestis
agauaccgaguucucacca

SEQ ID NO: 4149146 - RNA, 15 nt, Yersinia pestis
agauaccgcaaccau

SEQ ID NO: 4149147 - RNA, 13 nt, Yersinia pestis
agauaccgccaau

SEQ ID NO: 4149148 - RNA, 22 nt, Yersinia pestis
agauacggcuccagaacaucuu

SEQ ID NO: 4149149 - RNA, 13 nt, Yersinia pestis
agauacucaugau

SEQ ID NO: 4149150 - RNA, 16 nt, Yersinia pestis
agauacuggaagaaac

SEQ ID NO: 4149151 - RNA, 14 nt, Yersinia pestis
agauacuugcguuc

SEQ ID NO: 4149152 - RNA, 11 nt, Yersinia pestis
agauagagcag

SEQ ID NO: 4149153 - RNA, 16 nt, Yersinia pestis
agcaaguuagcgauau

SEQ ID NO: 4149154 - RNA, 17 nt, Yersinia pestis
agcaaguuaucaaucag

SEQ ID NO: 4149155 - RNA, 19 nt, Yersinia pestis
agcaauaaacucauaccga

SEQ ID NO: 4149156 - RNA, 18 nt, Yersinia pestis
agcaauaccagccgauaa

SEQ ID NO: 4149157 - RNA, 15 nt, Yersinia pestis
agcaauacgccaguu

SEQ ID NO: 4149158 - RNA, 14 nt, Yersinia pestis
agcaauauauugcu

SEQ ID NO: 4149159 - RNA, 17 nt, Yersinia pestis
agcaauaugaauacgaa

SEQ ID NO: 4149160 - RNA, 22 nt, Yersinia pestis
agcaaucgggggaggaagcuga

SEQ ID NO: 4149161 - RNA, 14 nt, Yersinia pestis
agcaaucuggcggc

SEQ ID NO: 4149162 - RNA, 19 nt, Yersinia pestis
agcaaugaccucccuguua

SEQ ID NO: 4149163 - RNA, 20 nt, Yersinia pestis
agcaaugcaccgacaaagau

SEQ ID NO: 4149164 - RNA, 23 nt, Yersinia pestis
agcacaaacauggcggcagcaca

SEQ ID NO: 4149165 - RNA, 21 nt, Yersinia pestis
agcacaagcgccugcgacagc

SEQ ID NO: 4149166 - RNA, 22 nt, Yersinia pestis
agcacaagcgccugcgacagca

SEQ ID NO: 4149167 - RNA, 22 nt, Yersinia pestis
agcacaaugacuuaacugaaag

SEQ ID NO: 4149168 - RNA, 15 nt, Yersinia pestis
agcacaauuguuaug

SEQ ID NO: 4149169 - RNA, 11 nt, Yersinia pestis
agcacacacag

SEQ ID NO: 4149170 - RNA, 13 nt, Yersinia pestis
agcacacugguug

SEQ ID NO: 4149171 - RNA, 15 nt, Yersinia pestis
agcacagacaaacaa

SEQ ID NO: 4149172 - RNA, 16 nt, Yersinia pestis
agcacagacaaacaac

SEQ ID NO: 4149173 - RNA, 14 nt, Yersinia pestis
agcaccaauauugc

SEQ ID NO: 4149174 - RNA, 12 nt, Yersinia pestis
agcaccacaaug

SEQ ID NO: 4149175 - RNA, 23 nt, Yersinia pestis
agcaccagaaaguuguucaacgc

SEQ ID NO: 4149176 - RNA, 14 nt, Yersinia pestis
agcaccauuaucuu

SEQ ID NO: 4149177 - RNA, 22 nt, Yersinia pestis
agcaccauuaucuuccauagau

SEQ ID NO: 4149178 - RNA, 16 nt, Yersinia pestis
agcaccauucaaugua

SEQ ID NO: 4149179 - RNA, 22 nt, Yersinia pestis
agcaccauucaauguaaaacga

SEQ ID NO: 4149180 - RNA, 16 nt, Yersinia pestis
agcacccacaccgcag

SEQ ID NO: 4149181 - RNA, 19 nt, Yersinia pestis
agcaccgcccccuccaaua

SEQ ID NO: 4149182 - RNA, 17 nt, Yersinia pestis
agcaccggauggucacc

SEQ ID NO: 4149183 - RNA, 20 nt, Yersinia pestis
agcacgaaccugagcgauca

SEQ ID NO: 4149184 - RNA, 13 nt, Yersinia pestis
agcacgaccuugc

SEQ ID NO: 4149185 - RNA, 16 nt, Yersinia pestis
agcacgcuuuccagcu

SEQ ID NO: 4149186 - RNA, 14 nt, Yersinia pestis
agcacguaccgcug

SEQ ID NO: 4149187 - RNA, 21 nt, Yersinia pestis
agcacguucaccaaagcaaug

SEQ ID NO: 4149188 - RNA, 20 nt, Yersinia pestis
agcacuaagauucaaacagu

SEQ ID NO: 4149189 - RNA, 23 nt, Yersinia pestis
agcacuacguguuuuucaucugu

SEQ ID NO: 4149190 - RNA, 14 nt, Yersinia pestis
agcacuaucacauc

SEQ ID NO: 4149191 - RNA, 17 nt, Yersinia pestis
agcacuaucacaucaaa

SEQ ID NO: 4149192 - RNA, 21 nt, Yersinia pestis
agcacucaaugucaugcaauu

SEQ ID NO: 4149193 - RNA, 13 nt, Yersinia pestis
agcacucaguaca

SEQ ID NO: 4149194 - RNA, 21 nt, Yersinia pestis
agcacugcuagguuuacuguu

SEQ ID NO: 4149195 - RNA, 21 nt, Yersinia pestis
agcacuguacugggaugaaga

SEQ ID NO: 4149196 - RNA, 22 nt, Yersinia pestis
agcacuuccaacuuuucauugg

SEQ ID NO: 4149197 - RNA, 13 nt, Yersinia pestis
agcagaaagcagc

SEQ ID NO: 4149198 - RNA, 14 nt, Yersinia pestis
agcagaaagcagca

SEQ ID NO: 4149199 - RNA, 17 nt, Yersinia pestis
agcagaaagcagcagcu

SEQ ID NO: 4149200 - RNA, 18 nt, Yersinia pestis
agcagaaagcagcagcuu

SEQ ID NO: 4149201 - RNA, 14 nt, Yersinia pestis
agcagaaagggcgc

SEQ ID NO: 4149202 - RNA, 12 nt, Yersinia pestis
agcagaacaaaa

SEQ ID NO: 4149203 - RNA, 13 nt, Yersinia pestis
agcagaacaaaac

SEQ ID NO: 4149204 - RNA, 16 nt, Yersinia pestis
agcagacaacugacaa

SEQ ID NO: 4149205 - RNA, 21 nt, Yersinia pestis
agcagacaacugacaacauca

SEQ ID NO: 4149206 - RNA, 13 nt, Yersinia pestis
agcagacagcgag

SEQ ID NO: 4149207 - RNA, 20 nt, Yersinia pestis
agcagacucaagcauuguca

SEQ ID NO: 4149208 - RNA, 18 nt, Yersinia pestis
agcagacuuacgcgaugc

SEQ ID NO: 4149209 - RNA, 23 nt, Yersinia pestis
agcagagaagugaacgaacacau

SEQ ID NO: 4149210 - RNA, 18 nt, Yersinia pestis
agcagagucgcaaaaaau

SEQ ID NO: 4149211 - RNA, 22 nt, Yersinia pestis
agcagauggucaacuaaacaga

SEQ ID NO: 4149212 - RNA, 14 nt, Yersinia pestis
agcagcaacuguuu

SEQ ID NO: 4149213 - RNA, 17 nt, Yersinia pestis
agcagcaagaaacuccc

SEQ ID NO: 4149214 - RNA, 20 nt, Yersinia pestis
agcagcaccaauaucaauau

SEQ ID NO: 4149215 - RNA, 21 nt, Yersinia pestis
agcagcaccaauaucaauauu

SEQ ID NO: 4149216 - RNA, 21 nt, Yersinia pestis
agcagcaucuggcgcagagua

SEQ ID NO: 4149217 - RNA, 18 nt, Yersinia pestis
agcagccaccaaaaaacg

SEQ ID NO: 4149218 - RNA, 22 nt, Yersinia pestis
agcagccucuaacauacucaga

SEQ ID NO: 4149219 - RNA, 13 nt, Yersinia pestis
agcagcgcacugg

SEQ ID NO: 4149220 - RNA, 17 nt, Yersinia pestis
agcagcgcgcuacuccc

SEQ ID NO: 4149221 - RNA, 21 nt, Yersinia pestis
agcagcgcuggcuauccugaa

SEQ ID NO: 4149222 - RNA, 15 nt, Yersinia pestis
agcagcguggugcgg

SEQ ID NO: 4149223 - RNA, 17 nt, Yersinia pestis
agcaggaaacaugcuga

SEQ ID NO: 4149224 - RNA, 14 nt, Yersinia pestis
agcaggauugcgcc

SEQ ID NO: 4149225 - RNA, 23 nt, Yersinia pestis
agcaggggguuuucugaauacca

SEQ ID NO: 4149226 - RNA, 14 nt, Yersinia pestis
agcagggucaccac

SEQ ID NO: 4149227 - RNA, 21 nt, Yersinia pestis
agcagguucggcgcaaucaua

SEQ ID NO: 4149228 - RNA, 20 nt, Yersinia pestis
agcaguaaacauuuugacuu

SEQ ID NO: 4149229 - RNA, 21 nt, Yersinia pestis
agcaguaugucgucgcaugac

SEQ ID NO: 4149230 - RNA, 15 nt, Yersinia pestis
agcagucaaaaugaa

SEQ ID NO: 4149231 - RNA, 15 nt, Yersinia pestis
agcagucugaagggu

SEQ ID NO: 4149232 - RNA, 17 nt, Yersinia pestis
agcagucugagccucau

SEQ ID NO: 4149233 - RNA, 19 nt, Yersinia pestis
agcagucugagccucauga

SEQ ID NO: 4149234 - RNA, 21 nt, Yersinia pestis
agcagucugagccucaugaau

SEQ ID NO: 4149235 - RNA, 23 nt, Yersinia pestis
agcagucugagccucaugaauga

SEQ ID NO: 4149236 - RNA, 18 nt, Yersinia pestis
agcagucugaggcccgcu

SEQ ID NO: 4149237 - RNA, 17 nt, Yersinia pestis
agcagucugagggccac

SEQ ID NO: 4149238 - RNA, 19 nt, Yersinia pestis
agcagucugagggccacuu

SEQ ID NO: 4149239 - RNA, 17 nt, Yersinia pestis
agcagucugagguggcc

SEQ ID NO: 4149240 - RNA, 19 nt, Yersinia pestis
agcagucugauuaccuucu

SEQ ID NO: 4149241 - RNA, 15 nt, Yersinia pestis
agcagugauuucagu

SEQ ID NO: 4149242 - RNA, 15 nt, Yersinia pestis
agcagugcagccaag

SEQ ID NO: 4149243 - RNA, 23 nt, Yersinia pestis
agcagugucagggcaauaacaaa

SEQ ID NO: 4149244 - RNA, 16 nt, Yersinia pestis
agcaguucacucuguu

SEQ ID NO: 4149245 - RNA, 18 nt, Yersinia pestis
agcaguucuggcucugcg

SEQ ID NO: 4149246 - RNA, 20 nt, Yersinia pestis
agcaguucuggcucugcgac

SEQ ID NO: 4149247 - RNA, 16 nt, Yersinia pestis
agcaguugcugcucug

SEQ ID NO: 4149248 - RNA, 12 nt, Yersinia pestis
agcauaaauauc

SEQ ID NO: 4149249 - RNA, 19 nt, Yersinia pestis
agcauaaauaucagugaca

SEQ ID NO: 4149250 - RNA, 14 nt, Yersinia pestis
agcauaaccagugc

SEQ ID NO: 4149251 - RNA, 18 nt, Yersinia pestis
agcauaaguaucagcggc

SEQ ID NO: 4149252 - RNA, 18 nt, Yersinia pestis
agcauacguugccagcca

SEQ ID NO: 4149253 - RNA, 21 nt, Yersinia pestis
agcauacguugccagccaucu

SEQ ID NO: 4149254 - RNA, 22 nt, Yersinia pestis
agcauagaagaagaauugcaga

SEQ ID NO: 4149255 - RNA, 18 nt, Yersinia pestis
agcauauacagcccggua

SEQ ID NO: 4149256 - RNA, 22 nt, Yersinia pestis
agcauaucaaugcaacuggcau

SEQ ID NO: 4149257 - RNA, 17 nt, Yersinia pestis
agcauauccaacgcuuu

SEQ ID NO: 4149258 - RNA, 17 nt, Yersinia pestis
agcauaucccuguuuuc

SEQ ID NO: 4149259 - RNA, 14 nt, Yersinia pestis
agcauauucaguaa

SEQ ID NO: 4149260 - RNA, 19 nt, Yersinia pestis
agcaucaaauuauuuuucc

SEQ ID NO: 4149261 - RNA, 22 nt, Yersinia pestis
agcaucaauaacgguaaggccg

SEQ ID NO: 4149262 - RNA, 12 nt, Yersinia pestis
agcaucaccaaa

SEQ ID NO: 4149263 - RNA, 20 nt, Yersinia pestis
agcaucacgauagccaguga

SEQ ID NO: 4149264 - RNA, 22 nt, Yersinia pestis
agcaucauaagacuaacagaau

SEQ ID NO: 4149265 - RNA, 15 nt, Yersinia pestis
agcauccagcucaua

SEQ ID NO: 4149266 - RNA, 13 nt, Yersinia pestis
agcaucccagcca

SEQ ID NO: 4149267 - RNA, 15 nt, Yersinia pestis
agcaucccagccacc

SEQ ID NO: 4149268 - RNA, 16 nt, Yersinia pestis
agcaucccagccacca

SEQ ID NO: 4149269 - RNA, 17 nt, Yersinia pestis
agcauccugaacuuccu

SEQ ID NO: 4149270 - RNA, 23 nt, Yersinia pestis
agcaucgaggauuuuccgcagcu

SEQ ID NO: 4149271 - RNA, 12 nt, Yersinia pestis
agcaucggcauu

SEQ ID NO: 4149272 - RNA, 16 nt, Yersinia pestis
agcaucuagcagugau

SEQ ID NO: 4149273 - RNA, 15 nt, Yersinia pestis
agcaucuucaaucaa

SEQ ID NO: 4149274 - RNA, 14 nt, Yersinia pestis
agccggagagucgg

SEQ ID NO: 4149275 - RNA, 18 nt, Yersinia pestis
agccguaauucagauaag

SEQ ID NO: 4149276 - RNA, 15 nt, Yersinia pestis
agccuaacaaacuga

SEQ ID NO: 4149277 - RNA, 17 nt, Yersinia pestis
agccuaacaaacugaau

SEQ ID NO: 4149278 - RNA, 12 nt, Yersinia pestis
agccuacaugga

SEQ ID NO: 4149279 - RNA, 20 nt, Yersinia pestis
agccuacauggauguauuua

SEQ ID NO: 4149280 - RNA, 14 nt, Yersinia pestis
agccuacgagagau

SEQ ID NO: 4149281 - RNA, 15 nt, Yersinia pestis
agccuacgagagauc

SEQ ID NO: 4149282 - RNA, 18 nt, Yersinia pestis
agccuacuacauggaugu

SEQ ID NO: 4149283 - RNA, 16 nt, Yersinia pestis
agccucaauuuugccu

SEQ ID NO: 4149284 - RNA, 14 nt, Yersinia pestis
agccucaugaauga

SEQ ID NO: 4149285 - RNA, 15 nt, Yersinia pestis
agccucaugaaugag

SEQ ID NO: 4149286 - RNA, 17 nt, Yersinia pestis
agccucaugaaugaggc

SEQ ID NO: 4149287 - RNA, 20 nt, Yersinia pestis
agccucauucaugaggcuca

SEQ ID NO: 4149288 - RNA, 18 nt, Yersinia pestis
agccuccaagaugauaaa

SEQ ID NO: 4149289 - RNA, 20 nt, Yersinia pestis
agccuccaagaugauaaaua

SEQ ID NO: 4149290 - RNA, 20 nt, Yersinia pestis
agccucgugagugaaggggu

SEQ ID NO: 4149291 - RNA, 21 nt, Yersinia pestis
agccucuagcuaacagugacc

SEQ ID NO: 4149292 - RNA, 22 nt, Yersinia pestis
agccucuguaaaacgauaguaa

SEQ ID NO: 4149293 - RNA, 16 nt, Yersinia pestis
agccucuugcgcucca

SEQ ID NO: 4149294 - RNA, 12 nt, Yersinia pestis
agccugaauucu

SEQ ID NO: 4149295 - RNA, 20 nt, Yersinia pestis
agccugaauuuccugcgcuu

SEQ ID NO: 4149296 - RNA, 20 nt, Yersinia pestis
agccugcacggcucaggugc

SEQ ID NO: 4149297 - RNA, 18 nt, Yersinia pestis
agccugccauacccgcug

SEQ ID NO: 4149298 - RNA, 22 nt, Yersinia pestis
agccugcugcccuuugcuggca

SEQ ID NO: 4149299 - RNA, 23 nt, Yersinia pestis
agccuggagcgguuaaucaaacg

SEQ ID NO: 4149300 - RNA, 17 nt, Yersinia pestis
agccugguguaaaaacu

SEQ ID NO: 4149301 - RNA, 14 nt, Yersinia pestis
agccugugcagccg

SEQ ID NO: 4149302 - RNA, 14 nt, Yersinia pestis
agccuguuaauaau

SEQ ID NO: 4149303 - RNA, 14 nt, Yersinia pestis
agccuuaacugcau

SEQ ID NO: 4149304 - RNA, 14 nt, Yersinia pestis
agccuuaauguuuu

SEQ ID NO: 4149305 - RNA, 22 nt, Yersinia pestis
agccuuauaggcgcauaugaaa

SEQ ID NO: 4149306 - RNA, 17 nt, Yersinia pestis
agccuucauucaauuga

SEQ ID NO: 4149307 - RNA, 17 nt, Yersinia pestis
agcgaaagucggugacu

SEQ ID NO: 4149308 - RNA, 13 nt, Yersinia pestis
agcgaacguaaaa

SEQ ID NO: 4149309 - RNA, 15 nt, Yersinia pestis
agcgaauaaauaauu

SEQ ID NO: 4149310 - RNA, 13 nt, Yersinia pestis
agcgaaucacauc

SEQ ID NO: 4149311 - RNA, 16 nt, Yersinia pestis
agcgaauggcaauggc

SEQ ID NO: 4149312 - RNA, 23 nt, Yersinia pestis
agcgaauugacuuaacaguuaaa

SEQ ID NO: 4149313 - RNA, 13 nt, Yersinia pestis
agcgacaaccugu

SEQ ID NO: 4149314 - RNA, 18 nt, Yersinia pestis
agcgacauuucggccacc

SEQ ID NO: 4149315 - RNA, 20 nt, Yersinia pestis
agcgaccaggcauuggcgcu

SEQ ID NO: 4149316 - RNA, 16 nt, Yersinia pestis
agcgagcacugccccg

SEQ ID NO: 4149317 - RNA, 14 nt, Yersinia pestis
agcgaggcuucuca

SEQ ID NO: 4149318 - RNA, 21 nt, Yersinia pestis
agcgagggccuuucugaacaa

SEQ ID NO: 4149319 - RNA, 18 nt, Yersinia pestis
agcgaguucccgauuauu

SEQ ID NO: 4149320 - RNA, 19 nt, Yersinia pestis
agcgauagauccacuccag

SEQ ID NO: 4149321 - RNA, 18 nt, Yersinia pestis
agcgaucaauacaccaga

SEQ ID NO: 4149322 - RNA, 20 nt, Yersinia pestis
agcgaucucauuuagcauua

SEQ ID NO: 4149323 - RNA, 18 nt, Yersinia pestis
agcgauuaaaauaaagcg

SEQ ID NO: 4149324 - RNA, 19 nt, Yersinia pestis
agcgcaaugcuccagcaac

SEQ ID NO: 4149325 - RNA, 22 nt, Yersinia pestis
agcgcaaugcuccagcaacuga

SEQ ID NO: 4149326 - RNA, 16 nt, Yersinia pestis
agcgcaauucagccuc

SEQ ID NO: 4149327 - RNA, 12 nt, Yersinia pestis
agcgcagacguu

SEQ ID NO: 4149328 - RNA, 12 nt, Yersinia pestis
agcgcaggaaag

SEQ ID NO: 4149329 - RNA, 15 nt, Yersinia pestis
agcgcaggauaaagc

SEQ ID NO: 4149330 - RNA, 12 nt, Yersinia pestis
agcgcagguaac

SEQ ID NO: 4149331 - RNA, 21 nt, Yersinia pestis
agcgcagguuaugcagcucaa

SEQ ID NO: 4149332 - RNA, 13 nt, Yersinia pestis
agcgccagcaauu

SEQ ID NO: 4149333 - RNA, 20 nt, Yersinia pestis
agcgccaugauaaccacaac

SEQ ID NO: 4149334 - RNA, 23 nt, Yersinia pestis
agcgccaugauaaccacaacgac

SEQ ID NO: 4149335 - RNA, 15 nt, Yersinia pestis
agcgccccugagguu

SEQ ID NO: 4149336 - RNA, 18 nt, Yersinia pestis
agcgcccggcugaccugu

SEQ ID NO: 4149337 - RNA, 13 nt, Yersinia pestis
agcgcccuacugc

SEQ ID NO: 4149338 - RNA, 23 nt, Yersinia pestis
agcgcccuugccagugcaauccg

SEQ ID NO: 4149339 - RNA, 22 nt, Yersinia pestis
agcgccgauggugugcagcaag

SEQ ID NO: 4149340 - RNA, 22 nt, Yersinia pestis
agcgccgugcauaauggacgaa

SEQ ID NO: 4149341 - RNA, 13 nt, Yersinia pestis
agcgccugcccuc

SEQ ID NO: 4149342 - RNA, 18 nt, Yersinia pestis
agcgccuguuguuuuuca

SEQ ID NO: 4149343 - RNA, 15 nt, Yersinia pestis
agcgccuuccuuuua

SEQ ID NO: 4149344 - RNA, 14 nt, Yersinia pestis
agcgcgcuccagau

SEQ ID NO: 4149345 - RNA, 19 nt, Yersinia pestis
agcgcgcuccagauuguca

SEQ ID NO: 4149346 - RNA, 18 nt, Yersinia pestis
agcgcggcuucagcaccu

SEQ ID NO: 4149347 - RNA, 14 nt, Yersinia pestis
agcgcgguaacgaa

SEQ ID NO: 4149348 - RNA, 16 nt, Yersinia pestis
agcgcguaaugccugg

SEQ ID NO: 4149349 - RNA, 23 nt, Yersinia pestis
agcgcguaucguccagcagcagg

SEQ ID NO: 4149350 - RNA, 14 nt, Yersinia pestis
agcgcguugcgcug

SEQ ID NO: 4149351 - RNA, 13 nt, Yersinia pestis
agcgcuaauauua

SEQ ID NO: 4149352 - RNA, 21 nt, Yersinia pestis
agcgcuauguuggcaaauaau

SEQ ID NO: 4149353 - RNA, 14 nt, Yersinia pestis
agcgcucagcgcca

SEQ ID NO: 4149354 - RNA, 19 nt, Yersinia pestis
agcgcuggugcuggugaau

SEQ ID NO: 4149355 - RNA, 15 nt, Yersinia pestis
agcgcuugcugguau

SEQ ID NO: 4149356 - RNA, 19 nt, Yersinia pestis
agcgcuugcugguauucau

SEQ ID NO: 4149357 - RNA, 21 nt, Yersinia pestis
agcgcuuuuucgggaaaaaau

SEQ ID NO: 4149358 - RNA, 14 nt, Yersinia pestis
agcggaugauaaau

SEQ ID NO: 4149359 - RNA, 21 nt, Yersinia pestis
agcggaugauaaauaucauua

SEQ ID NO: 4149360 - RNA, 13 nt, Yersinia pestis
agcggcaauaaca

SEQ ID NO: 4149361 - RNA, 15 nt, Yersinia pestis
agcggcagcgaagaa

SEQ ID NO: 4149362 - RNA, 14 nt, Yersinia pestis
agcggcaggggcgc

SEQ ID NO: 4149363 - RNA, 20 nt, Yersinia pestis
agcggcauccaguaagcugu

SEQ ID NO: 4149364 - RNA, 16 nt, Yersinia pestis
agcggccaacauaauc

SEQ ID NO: 4149365 - RNA, 16 nt, Yersinia pestis
agcggcgggcuaaccc

SEQ ID NO: 4149366 - RNA, 20 nt, Yersinia pestis
agcggcguauuaucaguaac

SEQ ID NO: 4149367 - RNA, 17 nt, Yersinia pestis
agcgggcggccucugcu

SEQ ID NO: 4149368 - RNA, 19 nt, Yersinia pestis
agcgggcuaaaugcucgcu

SEQ ID NO: 4149369 - RNA, 13 nt, Yersinia pestis
agcggggcaaaaa

SEQ ID NO: 4149370 - RNA, 20 nt, Yersinia pestis
agcggggcggauaguuuuua

SEQ ID NO: 4149371 - RNA, 18 nt, Yersinia pestis
agcggguaauaccgggga

SEQ ID NO: 4149372 - RNA, 13 nt, Yersinia pestis
agcgguaauuaau

SEQ ID NO: 4149373 - RNA, 22 nt, Yersinia pestis
agcgguaauuaauauauaaaau

SEQ ID NO: 4149374 - RNA, 23 nt, Yersinia pestis
agcgguaauuaauauauaaaaua

SEQ ID NO: 4149375 - RNA, 19 nt, Yersinia pestis
agcggucgacaaaauguga

SEQ ID NO: 4149376 - RNA, 14 nt, Yersinia pestis
agcggugccuugcc

SEQ ID NO: 4149377 - RNA, 14 nt, Yersinia pestis
agcgguggcgggaa

SEQ ID NO: 4149378 - RNA, 18 nt, Yersinia pestis
agcgguuucauggcuggg

SEQ ID NO: 4149379 - RNA, 14 nt, Yersinia pestis
agcguacacgcagu

SEQ ID NO: 4149380 - RNA, 18 nt, Yersinia pestis
agcguaggggacauugag

SEQ ID NO: 4149381 - RNA, 15 nt, Yersinia pestis
agcguauaagcaggg

SEQ ID NO: 4149382 - RNA, 19 nt, Yersinia pestis
agcguauguuccugaaugg

SEQ ID NO: 4149383 - RNA, 18 nt, Yersinia pestis
agcguauuaaaccagugc

SEQ ID NO: 4149384 - RNA, 18 nt, Yersinia pestis
agcguauugccuucuccu

SEQ ID NO: 4149385 - RNA, 21 nt, Yersinia pestis
agcguauuuugucaugaaaau

SEQ ID NO: 4149386 - RNA, 12 nt, Yersinia pestis
agcgucaaccca

SEQ ID NO: 4149387 - RNA, 16 nt, Yersinia pestis
agcgucaacccagaca

SEQ ID NO: 4149388 - RNA, 12 nt, Yersinia pestis
agcgucacccaa

SEQ ID NO: 4149389 - RNA, 21 nt, Yersinia pestis
agcgucaugauagacagcaaa

SEQ ID NO: 4149390 - RNA, 15 nt, Yersinia pestis
agcguccauaaaccc

SEQ ID NO: 4149391 - RNA, 13 nt, Yersinia pestis
agcgugaaagcau

SEQ ID NO: 4149392 - RNA, 17 nt, Yersinia pestis
agcgugaauucacucag

SEQ ID NO: 4149393 - RNA, 16 nt, Yersinia pestis
agcgugcgcuccauuu

SEQ ID NO: 4149394 - RNA, 20 nt, Yersinia pestis
agcgugcgguagaccaccaa

SEQ ID NO: 4149395 - RNA, 22 nt, Yersinia pestis
agcgugcgguagaccaccaacu

SEQ ID NO: 4149396 - RNA, 19 nt, Yersinia pestis
aggauuccguuuuacccuc

SEQ ID NO: 4149397 - RNA, 16 nt, Yersinia pestis
aggauugaccaauaaa

SEQ ID NO: 4149398 - RNA, 12 nt, Yersinia pestis
aggauugagaga

SEQ ID NO: 4149399 - RNA, 11 nt, Yersinia pestis
aggcaaagaag

SEQ ID NO: 4149400 - RNA, 13 nt, Yersinia pestis
aggcaaagaagaa

SEQ ID NO: 4149401 - RNA, 15 nt, Yersinia pestis
aggcaaagaagaaua

SEQ ID NO: 4149402 - RNA, 15 nt, Yersinia pestis
aggcaaauucucaau

SEQ ID NO: 4149403 - RNA, 18 nt, Yersinia pestis
aggcaaauucucaaugau

SEQ ID NO: 4149404 - RNA, 18 nt, Yersinia pestis
aggcaaccuuggugaaga

SEQ ID NO: 4149405 - RNA, 14 nt, Yersinia pestis
aggcaacgaaggca

SEQ ID NO: 4149406 - RNA, 11 nt, Yersinia pestis
aggcaagaaac

SEQ ID NO: 4149407 - RNA, 18 nt, Yersinia pestis
aggcaagaacauuuccac

SEQ ID NO: 4149408 - RNA, 15 nt, Yersinia pestis
aggcaaggccguuua

SEQ ID NO: 4149409 - RNA, 14 nt, Yersinia pestis
aggcaauuauccau

SEQ ID NO: 4149410 - RNA, 23 nt, Yersinia pestis
aggcacaucuccagaauauaaaa

SEQ ID NO: 4149411 - RNA, 16 nt, Yersinia pestis
aggcaccaccaugaug

SEQ ID NO: 4149412 - RNA, 16 nt, Yersinia pestis
aggcaccagcgcacug

SEQ ID NO: 4149413 - RNA, 20 nt, Yersinia pestis
aggcacccgagcacugcgcg

SEQ ID NO: 4149414 - RNA, 18 nt, Yersinia pestis
aggcaccguugaggugcc

SEQ ID NO: 4149415 - RNA, 18 nt, Yersinia pestis
aggcacuaacugcgccua

SEQ ID NO: 4149416 - RNA, 16 nt, Yersinia pestis
aggcacugcagaaaau

SEQ ID NO: 4149417 - RNA, 22 nt, Yersinia pestis
aggcacuuugucaauaaccuca

SEQ ID NO: 4149418 - RNA, 18 nt, Yersinia pestis
aggcagaaauaauaucaa

SEQ ID NO: 4149419 - RNA, 18 nt, Yersinia pestis
aggcaggcccgcuucccu

SEQ ID NO: 4149420 - RNA, 15 nt, Yersinia pestis
aggcaguauuccaau

SEQ ID NO: 4149421 - RNA, 12 nt, Yersinia pestis
aggcauccgcca

SEQ ID NO: 4149422 - RNA, 16 nt, Yersinia pestis
aggcauccgccagcca

SEQ ID NO: 4149423 - RNA, 17 nt, Yersinia pestis
aggcaucucugaagccu

SEQ ID NO: 4149424 - RNA, 15 nt, Yersinia pestis
aggcauuggcgcuca

SEQ ID NO: 4149425 - RNA, 12 nt, Yersinia pestis
aggccaaccucu

SEQ ID NO: 4149426 - RNA, 15 nt, Yersinia pestis
aggccaauuuggcca

SEQ ID NO: 4149427 - RNA, 21 nt, Yersinia pestis
aggccaccaaucacacugggu

SEQ ID NO: 4149428 - RNA, 16 nt, Yersinia pestis
aggccagcuucccugc

SEQ ID NO: 4149429 - RNA, 22 nt, Yersinia pestis
aggccauagcaaccggauacaa

SEQ ID NO: 4149430 - RNA, 14 nt, Yersinia pestis
aggccccucggggc

SEQ ID NO: 4149431 - RNA, 15 nt, Yersinia pestis
aggcccgcuaucacu

SEQ ID NO: 4149432 - RNA, 19 nt, Yersinia pestis
aggcccgcuaucacuagcg

SEQ ID NO: 4149433 - RNA, 16 nt, Yersinia pestis
aggcccgcuucccuac

SEQ ID NO: 4149434 - RNA, 19 nt, Yersinia pestis
aggcccgguugagugagac

SEQ ID NO: 4149435 - RNA, 21 nt, Yersinia pestis
aggccgaucaacaggccaccu

SEQ ID NO: 4149436 - RNA, 13 nt, Yersinia pestis
aggccgccaaaua

SEQ ID NO: 4149437 - RNA, 21 nt, Yersinia pestis
aggccgccaucaucaucaaua

SEQ ID NO: 4149438 - RNA, 11 nt, Yersinia pestis
aggccgcgaau

SEQ ID NO: 4149439 - RNA, 21 nt, Yersinia pestis
aggccgcgaauaacagacguu

SEQ ID NO: 4149440 - RNA, 13 nt, Yersinia pestis
aggccgcuaucuc

SEQ ID NO: 4149441 - RNA, 14 nt, Yersinia pestis
aggccguucacccu

SEQ ID NO: 4149442 - RNA, 20 nt, Yersinia pestis
aggccguuuaaaggucccuu

SEQ ID NO: 4149443 - RNA, 20 nt, Yersinia pestis
aggccuagcccaguaccgcu

SEQ ID NO: 4149444 - RNA, 18 nt, Yersinia pestis
aggccuauaacccccaca

SEQ ID NO: 4149445 - RNA, 15 nt, Yersinia pestis
aggccuucugggccg

SEQ ID NO: 4149446 - RNA, 14 nt, Yersinia pestis
aggcgacgcaguaa

SEQ ID NO: 4149447 - RNA, 20 nt, Yersinia pestis
aggcgaucccgguauaagua

SEQ ID NO: 4149448 - RNA, 13 nt, Yersinia pestis
aggcgaucugggc

SEQ ID NO: 4149449 - RNA, 15 nt, Yersinia pestis
aggcgauuaaacguc

SEQ ID NO: 4149450 - RNA, 15 nt, Yersinia pestis
aggcgcauaugaaaa

SEQ ID NO: 4149451 - RNA, 20 nt, Yersinia pestis
aggcgcaucgcgaucugaca

SEQ ID NO: 4149452 - RNA, 22 nt, Yersinia pestis
aggcggcgauggaccaugccau

SEQ ID NO: 4149453 - RNA, 13 nt, Yersinia pestis
aggcgggucagaa

SEQ ID NO: 4149454 - RNA, 21 nt, Yersinia pestis
aggcggugagggagucaggga

SEQ ID NO: 4149455 - RNA, 22 nt, Yersinia pestis
aggcggugagggagucagggag

SEQ ID NO: 4149456 - RNA, 13 nt, Yersinia pestis
aggcguuacccac

SEQ ID NO: 4149457 - RNA, 15 nt, Yersinia pestis
aggcguuuuuuugcc

SEQ ID NO: 4149458 - RNA, 17 nt, Yersinia pestis
aggcguuuuuuugccag

SEQ ID NO: 4149459 - RNA, 15 nt, Yersinia pestis
aggcuaaaccggcac

SEQ ID NO: 4149460 - RNA, 18 nt, Yersinia pestis
aggcuaaagacuucagcc

SEQ ID NO: 4149461 - RNA, 20 nt, Yersinia pestis
aggcuaauacaugcuggcgg

SEQ ID NO: 4149462 - RNA, 11 nt, Yersinia pestis
aggcuaauuua

SEQ ID NO: 4149463 - RNA, 14 nt, Yersinia pestis
aggcuaccaaggcu

SEQ ID NO: 4149464 - RNA, 17 nt, Yersinia pestis
aggcuaccugcaccaau

SEQ ID NO: 4149465 - RNA, 17 nt, Yersinia pestis
aggcuauuuuacuugcc

SEQ ID NO: 4149466 - RNA, 20 nt, Yersinia pestis
aggcuauuuuacuugccguu

SEQ ID NO: 4149467 - RNA, 15 nt, Yersinia pestis
aggcucauucagugg

SEQ ID NO: 4149468 - RNA, 18 nt, Yersinia pestis
aggcucccaaggguauaa

SEQ ID NO: 4149469 - RNA, 19 nt, Yersinia pestis
aggcuccuccuuggggccu

SEQ ID NO: 4149470 - RNA, 22 nt, Yersinia pestis
aggcucucauaucccccccaag

SEQ ID NO: 4149471 - RNA, 17 nt, Yersinia pestis
aggcucuggucacuaaa

SEQ ID NO: 4149472 - RNA, 19 nt, Yersinia pestis
aggcugaaggcgcuccccu

SEQ ID NO: 4149473 - RNA, 19 nt, Yersinia pestis
aggcugcgauucgccccgc

SEQ ID NO: 4149474 - RNA, 15 nt, Yersinia pestis
aggcuggcagguuau

SEQ ID NO: 4149475 - RNA, 19 nt, Yersinia pestis
aggcuggcugugugaguaa

SEQ ID NO: 4149476 - RNA, 17 nt, Yersinia pestis
aggcugugguggcgguc

SEQ ID NO: 4149477 - RNA, 22 nt, Yersinia pestis
aggcuguugcguaccauaugga

SEQ ID NO: 4149478 - RNA, 21 nt, Yersinia pestis
aggcuuauuaugacaacugaa

SEQ ID NO: 4149479 - RNA, 20 nt, Yersinia pestis
aggcuugagguuauugacaa

SEQ ID NO: 4149480 - RNA, 15 nt, Yersinia pestis
aggcuuggcgggcug

SEQ ID NO: 4149481 - RNA, 17 nt, Yersinia pestis
aggcuuggcgggcuggc

SEQ ID NO: 4149482 - RNA, 16 nt, Yersinia pestis
aggcuuuaggugcgca

SEQ ID NO: 4149483 - RNA, 13 nt, Yersinia pestis
aggcuuucacgcu

SEQ ID NO: 4149484 - RNA, 14 nt, Yersinia pestis
aggcuuuuuacuuu

SEQ ID NO: 4149485 - RNA, 14 nt, Yersinia pestis
agggaaauugucug

SEQ ID NO: 4149486 - RNA, 18 nt, Yersinia pestis
agggaacggauagagggc

SEQ ID NO: 4149487 - RNA, 21 nt, Yersinia pestis
agggaaguuucuuacuaaaau

SEQ ID NO: 4149488 - RNA, 23 nt, Yersinia pestis
agggacaacaucauauauuaaau

SEQ ID NO: 4149489 - RNA, 13 nt, Yersinia pestis
agggagccgcccu

SEQ ID NO: 4149490 - RNA, 12 nt, Yersinia pestis
agggagggcgcg

SEQ ID NO: 4149491 - RNA, 14 nt, Yersinia pestis
agggagucagggag

SEQ ID NO: 4149492 - RNA, 16 nt, Yersinia pestis
agggagucagggagua

SEQ ID NO: 4149493 - RNA, 16 nt, Yersinia pestis
agggaguuacucagca

SEQ ID NO: 4149494 - RNA, 16 nt, Yersinia pestis
agggaguuauucugau

SEQ ID NO: 4149495 - RNA, 13 nt, Yersinia pestis
agggaguucauca

SEQ ID NO: 4149496 - RNA, 22 nt, Yersinia pestis
agggauaucucaccgccaauau

SEQ ID NO: 4149497 - RNA, 19 nt, Yersinia pestis
agggauaugacagaaaaau

SEQ ID NO: 4149498 - RNA, 13 nt, Yersinia pestis
agggauucuguca

SEQ ID NO: 4149499 - RNA, 14 nt, Yersinia pestis
agggcaaucaggaa

SEQ ID NO: 4149500 - RNA, 18 nt, Yersinia pestis
agggccaccagacugaca

SEQ ID NO: 4149501 - RNA, 20 nt, Yersinia pestis
agggccacccugccaaaaaa

SEQ ID NO: 4149502 - RNA, 22 nt, Yersinia pestis
agggccacccugccaaaaaaua

SEQ ID NO: 4149503 - RNA, 18 nt, Yersinia pestis
agggccacuucgguggcc

SEQ ID NO: 4149504 - RNA, 18 nt, Yersinia pestis
agggccgcccagauaaag

SEQ ID NO: 4149505 - RNA, 17 nt, Yersinia pestis
agggccgcuagugagug

SEQ ID NO: 4149506 - RNA, 18 nt, Yersinia pestis
agggccgcuagugaguga

SEQ ID NO: 4149507 - RNA, 22 nt, Yersinia pestis
agggcgaugcaguuuauccaag

SEQ ID NO: 4149508 - RNA, 14 nt, Yersinia pestis
agggcgauggcaac

SEQ ID NO: 4149509 - RNA, 13 nt, Yersinia pestis
agggcgcagcccc

SEQ ID NO: 4149510 - RNA, 20 nt, Yersinia pestis
agggcgcauccccaucgcca

SEQ ID NO: 4149511 - RNA, 11 nt, Yersinia pestis
agggcgccccg

SEQ ID NO: 4149512 - RNA, 20 nt, Yersinia pestis
agggcgcgcuucgagccccc

SEQ ID NO: 4149513 - RNA, 21 nt, Yersinia pestis
agggcgcuuguuuuacaauua

SEQ ID NO: 4149514 - RNA, 16 nt, Yersinia pestis
agggcgcuuucugggu

SEQ ID NO: 4149515 - RNA, 18 nt, Yersinia pestis
agggcggcgcaagcgaua

SEQ ID NO: 4149516 - RNA, 14 nt, Yersinia pestis
agggcuaaaauggc

SEQ ID NO: 4149517 - RNA, 15 nt, Yersinia pestis
agggcugaauaucau

SEQ ID NO: 4149518 - RNA, 14 nt, Yersinia pestis
agggcugacagagc

SEQ ID NO: 4149519 - RNA, 14 nt, Yersinia pestis
aguaacguccaacu

SEQ ID NO: 4149520 - RNA, 14 nt, Yersinia pestis
aguaacucaaguau

SEQ ID NO: 4149521 - RNA, 23 nt, Yersinia pestis
aguaacuugccguaaaauuuaaa

SEQ ID NO: 4149522 - RNA, 13 nt, Yersinia pestis
aguaagaugucau

SEQ ID NO: 4149523 - RNA, 16 nt, Yersinia pestis
aguaagcguuuacucg

SEQ ID NO: 4149524 - RNA, 15 nt, Yersinia pestis
aguaaggagcaaaag

SEQ ID NO: 4149525 - RNA, 18 nt, Yersinia pestis
aguaaggccaauuggcuu

SEQ ID NO: 4149526 - RNA, 23 nt, Yersinia pestis
aguaagguauugauacaguaagg

SEQ ID NO: 4149527 - RNA, 15 nt, Yersinia pestis
aguaaggugccgcuu

SEQ ID NO: 4149528 - RNA, 16 nt, Yersinia pestis
aguaaguaaaaaggau

SEQ ID NO: 4149529 - RNA, 15 nt, Yersinia pestis
aguaagucuuuccua

SEQ ID NO: 4149530 - RNA, 18 nt, Yersinia pestis
aguaagugauucggguga

SEQ ID NO: 4149531 - RNA, 13 nt, Yersinia pestis
aguaauagcaaaa

SEQ ID NO: 4149532 - RNA, 15 nt, Yersinia pestis
aguaauauuauucaa

SEQ ID NO: 4149533 - RNA, 23 nt, Yersinia pestis
aguaaucgccugcugagccaaau

SEQ ID NO: 4149534 - RNA, 23 nt, Yersinia pestis
aguaaucguucguuuacugccuu

SEQ ID NO: 4149535 - RNA, 12 nt, Yersinia pestis
aguaaugaaauc

SEQ ID NO: 4149536 - RNA, 19 nt, Yersinia pestis
aguaaugaggcuaccugca

SEQ ID NO: 4149537 - RNA, 12 nt, Yersinia pestis
aguaaugcccau

SEQ ID NO: 4149538 - RNA, 13 nt, Yersinia pestis
aguaaugggauca

SEQ ID NO: 4149539 - RNA, 17 nt, Yersinia pestis
aguaaugggaucaaaug

SEQ ID NO: 4149540 - RNA, 19 nt, Yersinia pestis
aguaauuucagauaaaaau

SEQ ID NO: 4149541 - RNA, 22 nt, Yersinia pestis
aguaauuucagauaaaaauaau

SEQ ID NO: 4149542 - RNA, 13 nt, Yersinia pestis
aguacaaaaaaca

SEQ ID NO: 4149543 - RNA, 20 nt, Yersinia pestis
aguacaaggggcaucugcug

SEQ ID NO: 4149544 - RNA, 14 nt, Yersinia pestis
aguacagaauuuca

SEQ ID NO: 4149545 - RNA, 16 nt, Yersinia pestis
aguacagaauuucauu

SEQ ID NO: 4149546 - RNA, 20 nt, Yersinia pestis
aguacagugaaaaugguuuc

SEQ ID NO: 4149547 - RNA, 15 nt, Yersinia pestis
aguacggugccagca

SEQ ID NO: 4149548 - RNA, 20 nt, Yersinia pestis
aguacggugccagcagcaag

SEQ ID NO: 4149549 - RNA, 21 nt, Yersinia pestis
aguacggugccagcagcaagu

SEQ ID NO: 4149550 - RNA, 22 nt, Yersinia pestis
aguacguaacgaauucagcagc

SEQ ID NO: 4149551 - RNA, 23 nt, Yersinia pestis
aguacguaacgaauucagcagcg

SEQ ID NO: 4149552 - RNA, 22 nt, Yersinia pestis
aguacguagcgauaacagauau

SEQ ID NO: 4149553 - RNA, 20 nt, Yersinia pestis
aguacucaccgccguauuca

SEQ ID NO: 4149554 - RNA, 19 nt, Yersinia pestis
aguacuuauuugaaacacu

SEQ ID NO: 4149555 - RNA, 15 nt, Yersinia pestis
aguacuucagguaau

SEQ ID NO: 4149556 - RNA, 13 nt, Yersinia pestis
aguacuuccaaua

SEQ ID NO: 4149557 - RNA, 18 nt, Yersinia pestis
aguagaauaccucacugg

SEQ ID NO: 4149558 - RNA, 13 nt, Yersinia pestis
aguagagcuucca

SEQ ID NO: 4149559 - RNA, 24 nt, Yersinia pestis
aguagauaaucaugcucugcuaau

SEQ ID NO: 4149560 - RNA, 22 nt, Yersinia pestis
aguagcaauaaggugccacaca

SEQ ID NO: 4149561 - RNA, 23 nt, Yersinia pestis
aguagcagggccgcccagauaaa

SEQ ID NO: 4149562 - RNA, 15 nt, Yersinia pestis
aguagcuaauaaaau

SEQ ID NO: 4149563 - RNA, 21 nt, Yersinia pestis
aguaggcaucugccacacuga

SEQ ID NO: 4149564 - RNA, 20 nt, Yersinia pestis
aguaggcuuauuaugacaac

SEQ ID NO: 4149565 - RNA, 22 nt, Yersinia pestis
aguaggggccaccaaauaaaac

SEQ ID NO: 4149566 - RNA, 14 nt, Yersinia pestis
aguaguaaaaccua

SEQ ID NO: 4149567 - RNA, 13 nt, Yersinia pestis
aguagucagagcg

SEQ ID NO: 4149568 - RNA, 14 nt, Yersinia pestis
aguauacuaaaaca

SEQ ID NO: 4149569 - RNA, 16 nt, Yersinia pestis
aguauacuaaaacagc

SEQ ID NO: 4149570 - RNA, 13 nt, Yersinia pestis
aguaucaccagau

SEQ ID NO: 4149571 - RNA, 18 nt, Yersinia pestis
aguauccauaaaaucacg

SEQ ID NO: 4149572 - RNA, 17 nt, Yersinia pestis
aguaucgaagacaaaca

SEQ ID NO: 4149573 - RNA, 23 nt, Yersinia pestis
aguaucgcuaucaccggaugaaa

SEQ ID NO: 4149574 - RNA, 13 nt, Yersinia pestis
aguaucuggggua

SEQ ID NO: 4149575 - RNA, 14 nt, Yersinia pestis
aguaucuucauccg

SEQ ID NO: 4149576 - RNA, 19 nt, Yersinia pestis
aguaugcguggguucuuca

SEQ ID NO: 4149577 - RNA, 15 nt, Yersinia pestis
aguaugguuaaucua

SEQ ID NO: 4149578 - RNA, 19 nt, Yersinia pestis
aguauuagccagcagaaac

SEQ ID NO: 4149579 - RNA, 14 nt, Yersinia pestis
aguauuccaauaau

SEQ ID NO: 4149580 - RNA, 17 nt, Yersinia pestis
aguauuccccacuguaa

SEQ ID NO: 4149581 - RNA, 18 nt, Yersinia pestis
aguauucgccagauacaa

SEQ ID NO: 4149582 - RNA, 19 nt, Yersinia pestis
aguauucgccagauacaag

SEQ ID NO: 4149583 - RNA, 18 nt, Yersinia pestis
aguauugcagagcaaaac

SEQ ID NO: 4149584 - RNA, 19 nt, Yersinia pestis
aguauuuaacgccaccaau

SEQ ID NO: 4149585 - RNA, 19 nt, Yersinia pestis
aguauuuauuccacagagu

SEQ ID NO: 4149586 - RNA, 12 nt, Yersinia pestis
agucaaaacaau

SEQ ID NO: 4149587 - RNA, 20 nt, Yersinia pestis
agucaaaacaauaucuauuu

SEQ ID NO: 4149588 - RNA, 20 nt, Yersinia pestis
agucaaauuuaaaguuuuuu

SEQ ID NO: 4149589 - RNA, 19 nt, Yersinia pestis
agucaauguucucugggua

SEQ ID NO: 4149590 - RNA, 21 nt, Yersinia pestis
agucaccuuuuuagcgagugc

SEQ ID NO: 4149591 - RNA, 20 nt, Yersinia pestis
agucacgucuucaccaauga

SEQ ID NO: 4149592 - RNA, 15 nt, Yersinia pestis
agucacuaaaccauu

SEQ ID NO: 4149593 - RNA, 13 nt, Yersinia pestis
agucacuggccgc

SEQ ID NO: 4149594 - RNA, 16 nt, Yersinia pestis
agucacuggccgcagg

SEQ ID NO: 4149595 - RNA, 17 nt, Yersinia pestis
agucacuuaaacccuuu

SEQ ID NO: 4149596 - RNA, 15 nt, Yersinia pestis
agucagcaaaucaaa

SEQ ID NO: 4149597 - RNA, 19 nt, Yersinia pestis
agucagcaaaucaaacaaa

SEQ ID NO: 4149598 - RNA, 15 nt, Yersinia pestis
agucagcaacgcgau

SEQ ID NO: 4149599 - RNA, 17 nt, Yersinia pestis
agucagcacaucgggau

SEQ ID NO: 4149600 - RNA, 16 nt, Yersinia pestis
agucagggaucaccuc

SEQ ID NO: 4149601 - RNA, 15 nt, Yersinia pestis
agucagggugaaagc

SEQ ID NO: 4149602 - RNA, 20 nt, Yersinia pestis
agucaguaauucacccuuua

SEQ ID NO: 4149603 - RNA, 18 nt, Yersinia pestis
agucagugauucggguga

SEQ ID NO: 4149604 - RNA, 18 nt, Yersinia pestis
agucauauauuuuucuuu

SEQ ID NO: 4149605 - RNA, 19 nt, Yersinia pestis
agucauauauuuuucuuuc

SEQ ID NO: 4149606 - RNA, 21 nt, Yersinia pestis
agucauauauuuuucuuucuc

SEQ ID NO: 4149607 - RNA, 18 nt, Yersinia pestis
agucaucgcggguuuuua

SEQ ID NO: 4149608 - RNA, 20 nt, Yersinia pestis
agucaucgcggguuuuuaac

SEQ ID NO: 4149609 - RNA, 15 nt, Yersinia pestis
agucauucaccugcc

SEQ ID NO: 4149610 - RNA, 19 nt, Yersinia pestis
agucauugguguuacagca

SEQ ID NO: 4149611 - RNA, 16 nt, Yersinia pestis
agucauuuacugauga

SEQ ID NO: 4149612 - RNA, 23 nt, Yersinia pestis
aguccaacgcacugguugcuuca

SEQ ID NO: 4149613 - RNA, 16 nt, Yersinia pestis
aguccagcacugguag

SEQ ID NO: 4149614 - RNA, 12 nt, Yersinia pestis
aguccggccauu

SEQ ID NO: 4149615 - RNA, 13 nt, Yersinia pestis
aguccguagaaau

SEQ ID NO: 4149616 - RNA, 15 nt, Yersinia pestis
aguccucucaccaag

SEQ ID NO: 4149617 - RNA, 23 nt, Yersinia pestis
aguccugauucgcgaccagcaga

SEQ ID NO: 4149618 - RNA, 21 nt, Yersinia pestis
aguccuggccaaagccgguau

SEQ ID NO: 4149619 - RNA, 17 nt, Yersinia pestis
agucgacaguguaaaaa

SEQ ID NO: 4149620 - RNA, 19 nt, Yersinia pestis
agucgacaguguaaaaagc

SEQ ID NO: 4149621 - RNA, 17 nt, Yersinia pestis
agucgauaugagucagu

SEQ ID NO: 4149622 - RNA, 17 nt, Yersinia pestis
agucgaugaaacacaac

SEQ ID NO: 4149623 - RNA, 18 nt, Yersinia pestis
agucgcacugauagcaau

SEQ ID NO: 4149624 - RNA, 17 nt, Yersinia pestis
agucgccuuaaaugcgu

SEQ ID NO: 4149625 - RNA, 13 nt, Yersinia pestis
agucgcgaaauaa

SEQ ID NO: 4149626 - RNA, 22 nt, Yersinia pestis
agucgcgauaaaauucagccac

SEQ ID NO: 4149627 - RNA, 18 nt, Yersinia pestis
agucgcuccucagccuuu

SEQ ID NO: 4149628 - RNA, 13 nt, Yersinia pestis
agucgcugcuguu

SEQ ID NO: 4149629 - RNA, 13 nt, Yersinia pestis
agucuacgcucua

SEQ ID NO: 4149630 - RNA, 16 nt, Yersinia pestis
agucuauugaaaaaau

SEQ ID NO: 4149631 - RNA, 16 nt, Yersinia pestis
agucuccaaauucauu

SEQ ID NO: 4149632 - RNA, 18 nt, Yersinia pestis
agucucgcagccgccagu

SEQ ID NO: 4149633 - RNA, 19 nt, Yersinia pestis
agucucgcagccgccagua

SEQ ID NO: 4149634 - RNA, 19 nt, Yersinia pestis
agucucuguggauugccaa

SEQ ID NO: 4149635 - RNA, 20 nt, Yersinia pestis
agucucuguggauugccaaa

SEQ ID NO: 4149636 - RNA, 21 nt, Yersinia pestis
agucucuguggauugccaaau

SEQ ID NO: 4149637 - RNA, 22 nt, Yersinia pestis
agucugaaacgccagccucugc

SEQ ID NO: 4149638 - RNA, 19 nt, Yersinia pestis
agucugaaaugaucaccgc

SEQ ID NO: 4149639 - RNA, 20 nt, Yersinia pestis
agucugaaggguauugaaga

SEQ ID NO: 4149640 - RNA, 23 nt, Yersinia pestis
agucugacaccggggauccauag

SEQ ID NO: 4149641 - RNA, 18 nt, Yersinia pestis
aguguucauaaauuaaaa

SEQ ID NO: 4149642 - RNA, 13 nt, Yersinia pestis
aguguugccaugg

SEQ ID NO: 4149643 - RNA, 15 nt, Yersinia pestis
aguuaaaaauaaauu

SEQ ID NO: 4149644 - RNA, 20 nt, Yersinia pestis
aguuaaaaauaaauucuuua

SEQ ID NO: 4149645 - RNA, 15 nt, Yersinia pestis
aguuaaaaauagaca

SEQ ID NO: 4149646 - RNA, 12 nt, Yersinia pestis
aguuaaaaccag

SEQ ID NO: 4149647 - RNA, 14 nt, Yersinia pestis
aguuaaaaccagua

SEQ ID NO: 4149648 - RNA, 17 nt, Yersinia pestis
aguuaaaaccaguaacu

SEQ ID NO: 4149649 - RNA, 18 nt, Yersinia pestis
aguuaaacaacgcugaaa

SEQ ID NO: 4149650 - RNA, 22 nt, Yersinia pestis
aguuaaacgguaaccauccaua

SEQ ID NO: 4149651 - RNA, 16 nt, Yersinia pestis
aguuaaagguaaaagg

SEQ ID NO: 4149652 - RNA, 20 nt, Yersinia pestis
aguuaacacgaaaagcagca

SEQ ID NO: 4149653 - RNA, 20 nt, Yersinia pestis
aguuaacacgggcaugaacg

SEQ ID NO: 4149654 - RNA, 20 nt, Yersinia pestis
aguuaacccuaccuaggcca

SEQ ID NO: 4149655 - RNA, 16 nt, Yersinia pestis
aguuaaguaauaacuc

SEQ ID NO: 4149656 - RNA, 23 nt, Yersinia pestis
aguuaauaccagaugcauauacu

SEQ ID NO: 4149657 - RNA, 14 nt, Yersinia pestis
aguuaaucgcagca

SEQ ID NO: 4149658 - RNA, 19 nt, Yersinia pestis
aguuaaugacauaucucau

SEQ ID NO: 4149659 - RNA, 19 nt, Yersinia pestis
aguuaauguguuuuuguca

SEQ ID NO: 4149660 - RNA, 16 nt, Yersinia pestis
aguuacaauaaaucaa

SEQ ID NO: 4149661 - RNA, 22 nt, Yersinia pestis
aguuacaguagugaagauaaua

SEQ ID NO: 4149662 - RNA, 15 nt, Yersinia pestis
aguuacgucagaaau

SEQ ID NO: 4149663 - RNA, 18 nt, Yersinia pestis
aguuacuccuacaccauu

SEQ ID NO: 4149664 - RNA, 13 nt, Yersinia pestis
aguuacugcgcuc

SEQ ID NO: 4149665 - RNA, 16 nt, Yersinia pestis
aguuacuguaagauaa

SEQ ID NO: 4149666 - RNA, 21 nt, Yersinia pestis
aguuacuguaagauaauucga

SEQ ID NO: 4149667 - RNA, 19 nt, Yersinia pestis
aguuagacccaauugcagg

SEQ ID NO: 4149668 - RNA, 15 nt, Yersinia pestis
aguuagcaggcagca

SEQ ID NO: 4149669 - RNA, 14 nt, Yersinia pestis
aguuauccaaacuu

SEQ ID NO: 4149670 - RNA, 21 nt, Yersinia pestis
aguuaucucccauuaauuaau

SEQ ID NO: 4149671 - RNA, 20 nt, Yersinia pestis
aguuaucuguuucaaauaag

SEQ ID NO: 4149672 - RNA, 21 nt, Yersinia pestis
aguuaucuguuucaaauaagu

SEQ ID NO: 4149673 - RNA, 16 nt, Yersinia pestis
aguuauuauuuuuaau

SEQ ID NO: 4149674 - RNA, 13 nt, Yersinia pestis
aguuauucccauc

SEQ ID NO: 4149675 - RNA, 15 nt, Yersinia pestis
aguuauucgccccuu

SEQ ID NO: 4149676 - RNA, 12 nt, Yersinia pestis
aguuauucugau

SEQ ID NO: 4149677 - RNA, 19 nt, Yersinia pestis
aguuauuucagccaugggc

SEQ ID NO: 4149678 - RNA, 14 nt, Yersinia pestis
aguucaacaguauc

SEQ ID NO: 4149679 - RNA, 16 nt, Yersinia pestis
aguucacucuguuuua

SEQ ID NO: 4149680 - RNA, 20 nt, Yersinia pestis
aguucacugaguugcuggaa

SEQ ID NO: 4149681 - RNA, 21 nt, Yersinia pestis
aguucagauuuagcgauauaa

SEQ ID NO: 4149682 - RNA, 17 nt, Yersinia pestis
aguucagcaucccagcc

SEQ ID NO: 4149683 - RNA, 17 nt, Yersinia pestis
aguucagguugaaauaa

SEQ ID NO: 4149684 - RNA, 18 nt, Yersinia pestis
aguucauuccccaucgcc

SEQ ID NO: 4149685 - RNA, 11 nt, Yersinia pestis
aguucauucgc

SEQ ID NO: 4149686 - RNA, 16 nt, Yersinia pestis
aguucauuuugaccag

SEQ ID NO: 4149687 - RNA, 19 nt, Yersinia pestis
aguucauuuugaccagcau

SEQ ID NO: 4149688 - RNA, 14 nt, Yersinia pestis
aguucggcuuucga

SEQ ID NO: 4149689 - RNA, 18 nt, Yersinia pestis
aguucgguugccaaaauu

SEQ ID NO: 4149690 - RNA, 21 nt, Yersinia pestis
aguucguauguuuuuaacaaa

SEQ ID NO: 4149691 - RNA, 14 nt, Yersinia pestis
aguucguucccugu

SEQ ID NO: 4149692 - RNA, 14 nt, Yersinia pestis
aguucugcgccccc

SEQ ID NO: 4149693 - RNA, 21 nt, Yersinia pestis
aguucugcgccccccggauac

SEQ ID NO: 4149694 - RNA, 19 nt, Yersinia pestis
aguucuggaucggcauacu

SEQ ID NO: 4149695 - RNA, 20 nt, Yersinia pestis
aguucuguaucgcuagggau

SEQ ID NO: 4149696 - RNA, 18 nt, Yersinia pestis
aguucuucugauaaaaca

SEQ ID NO: 4149697 - RNA, 20 nt, Yersinia pestis
aguucuucugauaaaacagu

SEQ ID NO: 4149698 - RNA, 20 nt, Yersinia pestis
aguucuuuauccacuuggcu

SEQ ID NO: 4149699 - RNA, 14 nt, Yersinia pestis
aguugaaccauaaa

SEQ ID NO: 4149700 - RNA, 17 nt, Yersinia pestis
aguugaauaagauccca

SEQ ID NO: 4149701 - RNA, 19 nt, Yersinia pestis
aguugaauaagaucccaga

SEQ ID NO: 4149702 - RNA, 17 nt, Yersinia pestis
aguugagagacaaaaau

SEQ ID NO: 4149703 - RNA, 17 nt, Yersinia pestis
aguugauaaacaauaaa

SEQ ID NO: 4149704 - RNA, 16 nt, Yersinia pestis
aguugauaaagcugga

SEQ ID NO: 4149705 - RNA, 23 nt, Yersinia pestis
aguugauauaccgauuaccgggu

SEQ ID NO: 4149706 - RNA, 16 nt, Yersinia pestis
aguugaugcaauggca

SEQ ID NO: 4149707 - RNA, 23 nt, Yersinia pestis
aguugcagaagggcggccagcaa

SEQ ID NO: 4149708 - RNA, 15 nt, Yersinia pestis
aguugcagugggccu

SEQ ID NO: 4149709 - RNA, 16 nt, Yersinia pestis
aguugcaguucaucaa

SEQ ID NO: 4149710 - RNA, 19 nt, Yersinia pestis
aguugcucacccauuuuau

SEQ ID NO: 4149711 - RNA, 21 nt, Yersinia pestis
aguugcuggaauccaaguuca

SEQ ID NO: 4149712 - RNA, 12 nt, Yersinia pestis
aguuggcagaga

SEQ ID NO: 4149713 - RNA, 14 nt, Yersinia pestis
aguugggcauugga

SEQ ID NO: 4149714 - RNA, 18 nt, Yersinia pestis
aguuggguaucuuugcuu

SEQ ID NO: 4149715 - RNA, 16 nt, Yersinia pestis
aguugguggcacaagg

SEQ ID NO: 4149716 - RNA, 21 nt, Yersinia pestis
aguuguaaugaauucagaauc

SEQ ID NO: 4149717 - RNA, 19 nt, Yersinia pestis
aguugucuguaauaauaau

SEQ ID NO: 4149718 - RNA, 20 nt, Yersinia pestis
aguuuaacuaggcgagccgc

SEQ ID NO: 4149719 - RNA, 18 nt, Yersinia pestis
aguuuaaucaguucuuua

SEQ ID NO: 4149720 - RNA, 21 nt, Yersinia pestis
aguuuacgcacguugagugau

SEQ ID NO: 4149721 - RNA, 15 nt, Yersinia pestis
aguuuacgcagugcu

SEQ ID NO: 4149722 - RNA, 18 nt, Yersinia pestis
aguuuagcgagaaaguca

SEQ ID NO: 4149723 - RNA, 23 nt, Yersinia pestis
aguuuagucuagucuagcugcgc

SEQ ID NO: 4149724 - RNA, 17 nt, Yersinia pestis
aguuuauggaaauuauu

SEQ ID NO: 4149725 - RNA, 14 nt, Yersinia pestis
aguuuauuuaagcu

SEQ ID NO: 4149726 - RNA, 23 nt, Yersinia pestis
aguuuauuuuauuuaaucaucga

SEQ ID NO: 4149727 - RNA, 13 nt, Yersinia pestis
aguuuauuuuccc

SEQ ID NO: 4149728 - RNA, 15 nt, Yersinia pestis
aguuuauuuucccuu

SEQ ID NO: 4149729 - RNA, 21 nt, Yersinia pestis
aguuuauuuucccuuucucag

SEQ ID NO: 4149730 - RNA, 14 nt, Yersinia pestis
aguuucaaauagua

SEQ ID NO: 4149731 - RNA, 14 nt, Yersinia pestis
aguuuccaguucaa

SEQ ID NO: 4149732 - RNA, 14 nt, Yersinia pestis
aguuugaucacagc

SEQ ID NO: 4149733 - RNA, 19 nt, Yersinia pestis
aguuugccuugugugaaua

SEQ ID NO: 4149734 - RNA, 16 nt, Yersinia pestis
aguuuggcugccaugg

SEQ ID NO: 4149735 - RNA, 19 nt, Yersinia pestis
aguuuuaaacgucagauua

SEQ ID NO: 4149736 - RNA, 14 nt, Yersinia pestis
aguuuuagacguca

SEQ ID NO: 4149737 - RNA, 19 nt, Yersinia pestis
aguuuuagaugucagauua

SEQ ID NO: 4149738 - RNA, 21 nt, Yersinia pestis
aguuuuagaugucagauuagu

SEQ ID NO: 4149739 - RNA, 22 nt, Yersinia pestis
aguuuucccugcgccagcagca

SEQ ID NO: 4149740 - RNA, 18 nt, Yersinia pestis
aguuuucuggcaauuucu

SEQ ID NO: 4149741 - RNA, 21 nt, Yersinia pestis
aguuuuucauuauuugauaua

SEQ ID NO: 4149742 - RNA, 19 nt, Yersinia pestis
aguuuuuccguaaccucca

SEQ ID NO: 4149743 - RNA, 23 nt, Yersinia pestis
aguuuuuuguuuuucugacaaaa

SEQ ID NO: 4149744 - RNA, 14 nt, Yersinia pestis
auaaaaaacugacu

SEQ ID NO: 4149745 - RNA, 19 nt, Yersinia pestis
auaaaaaagauaauaaaac

SEQ ID NO: 4149746 - RNA, 15 nt, Yersinia pestis
auaaaaaagucacuu

SEQ ID NO: 4149747 - RNA, 12 nt, Yersinia pestis
auaaaaacauug

SEQ ID NO: 4149748 - RNA, 15 nt, Yersinia pestis
auaaaaauaaucaau

SEQ ID NO: 4149749 - RNA, 13 nt, Yersinia pestis
auaaaaauacaua

SEQ ID NO: 4149750 - RNA, 14 nt, Yersinia pestis
auaaaaauacauau

SEQ ID NO: 4149751 - RNA, 12 nt, Yersinia pestis
auaaaaauagcu

SEQ ID NO: 4149752 - RNA, 20 nt, Yersinia pestis
auaaaaaugcacugaacaau

SEQ ID NO: 4149753 - RNA, 11 nt, Yersinia pestis
auaaaacaaua

SEQ ID NO: 4149754 - RNA, 12 nt, Yersinia pestis
auaaaacaauag

SEQ ID NO: 4149755 - RNA, 18 nt, Yersinia pestis
auaaaacagaacccccgc

SEQ ID NO: 4149756 - RNA, 21 nt, Yersinia pestis
auaaaacagaacccccgcgaa

SEQ ID NO: 4149757 - RNA, 16 nt, Yersinia pestis
auaaaaccacugaccu

SEQ ID NO: 4149758 - RNA, 17 nt, Yersinia pestis
auaaaaccuuuacaauu

SEQ ID NO: 4149759 - RNA, 19 nt, Yersinia pestis
auaaaacugcucacuggag

SEQ ID NO: 4149760 - RNA, 15 nt, Yersinia pestis
auaaaagaaagggca

SEQ ID NO: 4149761 - RNA, 20 nt, Yersinia pestis
auaaaagcuucggucucuuu

SEQ ID NO: 4149762 - RNA, 21 nt, Yersinia pestis
auaaaaggauggcccaagcca

SEQ ID NO: 4149763 - RNA, 21 nt, Yersinia pestis
auaaccgcuaaggccaaugga

SEQ ID NO: 4149764 - RNA, 14 nt, Yersinia pestis
auaaccguuuuuuc

SEQ ID NO: 4149765 - RNA, 13 nt, Yersinia pestis
auaaccucagccu

SEQ ID NO: 4149766 - RNA, 15 nt, Yersinia pestis
auaaccucagccuca

SEQ ID NO: 4149767 - RNA, 16 nt, Yersinia pestis
auaaccucagccucau

SEQ ID NO: 4149768 - RNA, 17 nt, Yersinia pestis
auaaccucagggcgucu

SEQ ID NO: 4149769 - RNA, 16 nt, Yersinia pestis
auaaccucaggggcca

SEQ ID NO: 4149770 - RNA, 21 nt, Yersinia pestis
auaaccucauuggcgguuauu

SEQ ID NO: 4149771 - RNA, 18 nt, Yersinia pestis
auaaccugagcaccagaa

SEQ ID NO: 4149772 - RNA, 19 nt, Yersinia pestis
auaacgcaucaugguccag

SEQ ID NO: 4149773 - RNA, 22 nt, Yersinia pestis
auaacgcuuuuucauugguaau

SEQ ID NO: 4149774 - RNA, 18 nt, Yersinia pestis
auaacggaaaaucaucgc

SEQ ID NO: 4149775 - RNA, 14 nt, Yersinia pestis
auaacggcggcaau

SEQ ID NO: 4149776 - RNA, 16 nt, Yersinia pestis
auaacggcgguaccag

SEQ ID NO: 4149777 - RNA, 21 nt, Yersinia pestis
auaacggcguucuaaaugcug

SEQ ID NO: 4149778 - RNA, 17 nt, Yersinia pestis
auaacgguaucagucau

SEQ ID NO: 4149779 - RNA, 15 nt, Yersinia pestis
auaacguuauaacuc

SEQ ID NO: 4149780 - RNA, 22 nt, Yersinia pestis
auaacguuuaccgcugcagggc

SEQ ID NO: 4149781 - RNA, 17 nt, Yersinia pestis
auaacguuucagggugg

SEQ ID NO: 4149782 - RNA, 18 nt, Yersinia pestis
auaacuauuuuugacuuu

SEQ ID NO: 4149783 - RNA, 13 nt, Yersinia pestis
auaacucaucagu

SEQ ID NO: 4149784 - RNA, 14 nt, Yersinia pestis
auaacucaucagua

SEQ ID NO: 4149785 - RNA, 19 nt, Yersinia pestis
auaacugagguauaucgug

SEQ ID NO: 4149786 - RNA, 14 nt, Yersinia pestis
auaacugccagggc

SEQ ID NO: 4149787 - RNA, 14 nt, Yersinia pestis
auaacugccauaca

SEQ ID NO: 4149788 - RNA, 22 nt, Yersinia pestis
auaacugguccaacuaaacagg

SEQ ID NO: 4149789 - RNA, 20 nt, Yersinia pestis
auaacuugagcacauagcau

SEQ ID NO: 4149790 - RNA, 13 nt, Yersinia pestis
auaagaagacuuc

SEQ ID NO: 4149791 - RNA, 21 nt, Yersinia pestis
auaagagcgacucaauaauau

SEQ ID NO: 4149792 - RNA, 22 nt, Yersinia pestis
auaagaugaccaccaauuucau

SEQ ID NO: 4149793 - RNA, 23 nt, Yersinia pestis
auaagauugagggcgucucuacg

SEQ ID NO: 4149794 - RNA, 15 nt, Yersinia pestis
auaagcagcaccaau

SEQ ID NO: 4149795 - RNA, 13 nt, Yersinia pestis
auaagccaaagua

SEQ ID NO: 4149796 - RNA, 15 nt, Yersinia pestis
auaagccagugcuau

SEQ ID NO: 4149797 - RNA, 19 nt, Yersinia pestis
auaagccgcaggcaaacaa

SEQ ID NO: 4149798 - RNA, 23 nt, Yersinia pestis
auaagcgcucaaauacgguagca

SEQ ID NO: 4149799 - RNA, 16 nt, Yersinia pestis
auaagcugacaccuuu

SEQ ID NO: 4149800 - RNA, 15 nt, Yersinia pestis
auaaggcuaacaccu

SEQ ID NO: 4149801 - RNA, 16 nt, Yersinia pestis
auaaggcuaacaccuu

SEQ ID NO: 4149802 - RNA, 17 nt, Yersinia pestis
auaaggcuuuauauugc

SEQ ID NO: 4149803 - RNA, 19 nt, Yersinia pestis
auaaggcuuuuagccccuu

SEQ ID NO: 4149804 - RNA, 18 nt, Yersinia pestis
auaagggccauuuugcug

SEQ ID NO: 4149805 - RNA, 21 nt, Yersinia pestis
auaaggggauugcugccaacg

SEQ ID NO: 4149806 - RNA, 17 nt, Yersinia pestis
auaaguaacauuuguau

SEQ ID NO: 4149807 - RNA, 19 nt, Yersinia pestis
auaaguaggcaucugccac

SEQ ID NO: 4149808 - RNA, 22 nt, Yersinia pestis
auaagucacuuuccuuugcuuc

SEQ ID NO: 4149809 - RNA, 18 nt, Yersinia pestis
auaagucagugcuauuca

SEQ ID NO: 4149810 - RNA, 17 nt, Yersinia pestis
auaagugaucagcuaac

SEQ ID NO: 4149811 - RNA, 22 nt, Yersinia pestis
auaagugcaaacuuaaaaauca

SEQ ID NO: 4149812 - RNA, 18 nt, Yersinia pestis
auaaguguuucaaauaag

SEQ ID NO: 4149813 - RNA, 20 nt, Yersinia pestis
auaaguguuucaaauaagua

SEQ ID NO: 4149814 - RNA, 20 nt, Yersinia pestis
auaaguuagcgugagaauaa

SEQ ID NO: 4149815 - RNA, 22 nt, Yersinia pestis
auaaguuagcgugagaauaaua

SEQ ID NO: 4149816 - RNA, 12 nt, Yersinia pestis
auaaguuauuuc

SEQ ID NO: 4149817 - RNA, 20 nt, Yersinia pestis
auaaguuauuucagccaugg

SEQ ID NO: 4149818 - RNA, 23 nt, Yersinia pestis
auaaguugauaacgccggauaaa

SEQ ID NO: 4149819 - RNA, 14 nt, Yersinia pestis
auaaguuugaugua

SEQ ID NO: 4149820 - RNA, 11 nt, Yersinia pestis
auaaguuuuaa

SEQ ID NO: 4149821 - RNA, 11 nt, Yersinia pestis
auaauaaaaaa

SEQ ID NO: 4149822 - RNA, 12 nt, Yersinia pestis
auaauaaaaaaa

SEQ ID NO: 4149823 - RNA, 13 nt, Yersinia pestis
auaauaaaaaaaa

SEQ ID NO: 4149824 - RNA, 15 nt, Yersinia pestis
auaauaaaaaaaaau

SEQ ID NO: 4149825 - RNA, 14 nt, Yersinia pestis
auaauaaauauccu

SEQ ID NO: 4149826 - RNA, 15 nt, Yersinia pestis
auaauaaauauccuc

SEQ ID NO: 4149827 - RNA, 12 nt, Yersinia pestis
auaauaaauuaa

SEQ ID NO: 4149828 - RNA, 18 nt, Yersinia pestis
auaauaaauuaucugaau

SEQ ID NO: 4149829 - RNA, 17 nt, Yersinia pestis
auaauaaccauuuauau

SEQ ID NO: 4149830 - RNA, 20 nt, Yersinia pestis
auaauaacgucgccaguugc

SEQ ID NO: 4149831 - RNA, 16 nt, Yersinia pestis
auaauaauccauaacu

SEQ ID NO: 4149832 - RNA, 11 nt, Yersinia pestis
auaauaauggc

SEQ ID NO: 4149833 - RNA, 20 nt, Yersinia pestis
auaauaauucugcuauuaau

SEQ ID NO: 4149834 - RNA, 18 nt, Yersinia pestis
auaauacgaaauacuuau

SEQ ID NO: 4149835 - RNA, 16 nt, Yersinia pestis
auaauacgaucagcgu

SEQ ID NO: 4149836 - RNA, 20 nt, Yersinia pestis
auaauagaggguaaccgccg

SEQ ID NO: 4149837 - RNA, 14 nt, Yersinia pestis
auaauagauaguac

SEQ ID NO: 4149838 - RNA, 14 nt, Yersinia pestis
auaauaucaaugau

SEQ ID NO: 4149839 - RNA, 15 nt, Yersinia pestis
auaauaucgacaauc

SEQ ID NO: 4149840 - RNA, 23 nt, Yersinia pestis
auaauaucucggugugacuuuca

SEQ ID NO: 4149841 - RNA, 15 nt, Yersinia pestis
auaauaucuggcguu

SEQ ID NO: 4149842 - RNA, 13 nt, Yersinia pestis
auaauaucugucu

SEQ ID NO: 4149843 - RNA, 17 nt, Yersinia pestis
auaauauuaaagccauu

SEQ ID NO: 4149844 - RNA, 16 nt, Yersinia pestis
auaaucaacggcacca

SEQ ID NO: 4149845 - RNA, 18 nt, Yersinia pestis
auaaucaacggcaccaca

SEQ ID NO: 4149846 - RNA, 15 nt, Yersinia pestis
auaaucaauccuaca

SEQ ID NO: 4149847 - RNA, 13 nt, Yersinia pestis
auaaucaauuaau

SEQ ID NO: 4149848 - RNA, 15 nt, Yersinia pestis
auaaucaccagacaa

SEQ ID NO: 4149849 - RNA, 19 nt, Yersinia pestis
auaaucaccagacaaccaa

SEQ ID NO: 4149850 - RNA, 15 nt, Yersinia pestis
auaaucagccugcug

SEQ ID NO: 4149851 - RNA, 12 nt, Yersinia pestis
auaaucaucuac

SEQ ID NO: 4149852 - RNA, 13 nt, Yersinia pestis
auaaucaucuaca

SEQ ID NO: 4149853 - RNA, 17 nt, Yersinia pestis
auaaucaucuacaacau

SEQ ID NO: 4149854 - RNA, 12 nt, Yersinia pestis
auaauccaaaau

SEQ ID NO: 4149855 - RNA, 23 nt, Yersinia pestis
auaauccaccugacgaaaugccg

SEQ ID NO: 4149856 - RNA, 16 nt, Yersinia pestis
auaauccacugaaaua

SEQ ID NO: 4149857 - RNA, 14 nt, Yersinia pestis
auaaucccuuuccu

SEQ ID NO: 4149858 - RNA, 19 nt, Yersinia pestis
auaauccgccaauagcugg

SEQ ID NO: 4149859 - RNA, 23 nt, Yersinia pestis
auaaucgcguucagagcagcauu

SEQ ID NO: 4149860 - RNA, 14 nt, Yersinia pestis
auaaucuaaauuaa

SEQ ID NO: 4149861 - RNA, 13 nt, Yersinia pestis
auaaucucagcau

SEQ ID NO: 4149862 - RNA, 21 nt, Yersinia pestis
auaaucuccauugauucacga

SEQ ID NO: 4149863 - RNA, 16 nt, Yersinia pestis
auaaucuuaaguaaau

SEQ ID NO: 4149864 - RNA, 14 nt, Yersinia pestis
auaaugaauuauua

SEQ ID NO: 4149865 - RNA, 13 nt, Yersinia pestis
auaaugacauaau

SEQ ID NO: 4149866 - RNA, 14 nt, Yersinia pestis
auaaugagccauaa

SEQ ID NO: 4149867 - RNA, 23 nt, Yersinia pestis
auaaugauuauugaccagauagc

SEQ ID NO: 4149868 - RNA, 15 nt, Yersinia pestis
auaaugcgauuaacc

SEQ ID NO: 4149869 - RNA, 23 nt, Yersinia pestis
auaaugcggcucucuuucuccaa

SEQ ID NO: 4149870 - RNA, 14 nt, Yersinia pestis
auaaugcuuuggua

SEQ ID NO: 4149871 - RNA, 18 nt, Yersinia pestis
auaaugguauuugaaaua

SEQ ID NO: 4149872 - RNA, 20 nt, Yersinia pestis
auaaugguauuugaaauauu

SEQ ID NO: 4149873 - RNA, 22 nt, Yersinia pestis
auaauguggcauguucagcauu

SEQ ID NO: 4149874 - RNA, 22 nt, Yersinia pestis
auaauguucguuuuuuggguuu

SEQ ID NO: 4149875 - RNA, 13 nt, Yersinia pestis
auaauuaaauauu

SEQ ID NO: 4149876 - RNA, 14 nt, Yersinia pestis
auaauuaaauauua

SEQ ID NO: 4149877 - RNA, 16 nt, Yersinia pestis
auaauuaacagcauca

SEQ ID NO: 4149878 - RNA, 13 nt, Yersinia pestis
auaauuaacuauu

SEQ ID NO: 4149879 - RNA, 14 nt, Yersinia pestis
auaauuaacuauuu

SEQ ID NO: 4149880 - RNA, 13 nt, Yersinia pestis
auaauuaauuauu

SEQ ID NO: 4149881 - RNA, 15 nt, Yersinia pestis
auaauuaauuauuca

SEQ ID NO: 4149882 - RNA, 21 nt, Yersinia pestis
auaauuaauuauucaacguga

SEQ ID NO: 4149883 - RNA, 15 nt, Yersinia pestis
auaauuagauugaca

SEQ ID NO: 4149884 - RNA, 19 nt, Yersinia pestis
auaauuauaaauuccuggc

SEQ ID NO: 4149885 - RNA, 16 nt, Yersinia pestis
auaauuaugaaaguaa

SEQ ID NO: 4149886 - RNA, 12 nt, Yersinia pestis
auagagaacucc

SEQ ID NO: 4149887 - RNA, 20 nt, Yersinia pestis
auagagacggaaagagccag

SEQ ID NO: 4149888 - RNA, 16 nt, Yersinia pestis
auagagauacuuccuu

SEQ ID NO: 4149889 - RNA, 20 nt, Yersinia pestis
auagagugaaguaucaccac

SEQ ID NO: 4149890 - RNA, 19 nt, Yersinia pestis
auagagugcaauuuuauug

SEQ ID NO: 4149891 - RNA, 15 nt, Yersinia pestis
auagauacacuccau

SEQ ID NO: 4149892 - RNA, 21 nt, Yersinia pestis
auagauacacuccauuaauuu

SEQ ID NO: 4149893 - RNA, 16 nt, Yersinia pestis
auagauagcaaucaau

SEQ ID NO: 4149894 - RNA, 17 nt, Yersinia pestis
auagauaucgaaacaca

SEQ ID NO: 4149895 - RNA, 16 nt, Yersinia pestis
auagauggcuuuggug

SEQ ID NO: 4149896 - RNA, 17 nt, Yersinia pestis
auagauuggcaucagug

SEQ ID NO: 4149897 - RNA, 17 nt, Yersinia pestis
auagauuuauucaacau

SEQ ID NO: 4149898 - RNA, 17 nt, Yersinia pestis
auagauuucacuuuccc

SEQ ID NO: 4149899 - RNA, 18 nt, Yersinia pestis
auagauuuuaugaauuaa

SEQ ID NO: 4149900 - RNA, 15 nt, Yersinia pestis
auagcaaaauugaga

SEQ ID NO: 4149901 - RNA, 14 nt, Yersinia pestis
auagcaacuaaaca

SEQ ID NO: 4149902 - RNA, 14 nt, Yersinia pestis
auagcaacugccaa

SEQ ID NO: 4149903 - RNA, 23 nt, Yersinia pestis
auagcaauagaacugagaauaau

SEQ ID NO: 4149904 - RNA, 22 nt, Yersinia pestis
auagcaaugaccuuacagugau

SEQ ID NO: 4149905 - RNA, 22 nt, Yersinia pestis
auagcaaugucacuauucccau

SEQ ID NO: 4149906 - RNA, 16 nt, Yersinia pestis
auagcaccgagcaugc

SEQ ID NO: 4149907 - RNA, 20 nt, Yersinia pestis
auagcaccgagcaugcuaac

SEQ ID NO: 4149908 - RNA, 21 nt, Yersinia pestis
auagcaccgagcaugcuaacu

SEQ ID NO: 4149909 - RNA, 20 nt, Yersinia pestis
auagcagggccgguuaauug

SEQ ID NO: 4149910 - RNA, 23 nt, Yersinia pestis
auagccagaugucccagaaauau

SEQ ID NO: 4149911 - RNA, 15 nt, Yersinia pestis
auagccagugggcag

SEQ ID NO: 4149912 - RNA, 17 nt, Yersinia pestis
auagccauggcuucugc

SEQ ID NO: 4149913 - RNA, 17 nt, Yersinia pestis
auagcccaaagcaauaa

SEQ ID NO: 4149914 - RNA, 17 nt, Yersinia pestis
auagcccaaauaaccuc

SEQ ID NO: 4149915 - RNA, 23 nt, Yersinia pestis
auagccccauauaaaaaacuaau

SEQ ID NO: 4149916 - RNA, 19 nt, Yersinia pestis
auagcccucguuguuguau

SEQ ID NO: 4149917 - RNA, 23 nt, Yersinia pestis
auagcccucguuguuguaugaca

SEQ ID NO: 4149918 - RNA, 18 nt, Yersinia pestis
auagccggagguuuuuca

SEQ ID NO: 4149919 - RNA, 17 nt, Yersinia pestis
auagccggcucuucucg

SEQ ID NO: 4149920 - RNA, 23 nt, Yersinia pestis
auagccuguaauccggcaaaaac

SEQ ID NO: 4149921 - RNA, 14 nt, Yersinia pestis
auagcgaucagcaa

SEQ ID NO: 4149922 - RNA, 15 nt, Yersinia pestis
auagcgaucagcaac

SEQ ID NO: 4149923 - RNA, 19 nt, Yersinia pestis
auagcgcaauucagccuca

SEQ ID NO: 4149924 - RNA, 14 nt, Yersinia pestis
auagcgccugcccu

SEQ ID NO: 4149925 - RNA, 14 nt, Yersinia pestis
auagcgcugcauca

SEQ ID NO: 4149926 - RNA, 16 nt, Yersinia pestis
auagcgcugcaucagc

SEQ ID NO: 4149927 - RNA, 17 nt, Yersinia pestis
auagcgcugcaucagca

SEQ ID NO: 4149928 - RNA, 18 nt, Yersinia pestis
auagcggcguucagcaau

SEQ ID NO: 4149929 - RNA, 16 nt, Yersinia pestis
auagcguugcuuccua

SEQ ID NO: 4149930 - RNA, 16 nt, Yersinia pestis
auagcuaaccuuaacu

SEQ ID NO: 4149931 - RNA, 17 nt, Yersinia pestis
auagcuaaccuuaacug

SEQ ID NO: 4149932 - RNA, 20 nt, Yersinia pestis
auagcuaaccuuaacugcau

SEQ ID NO: 4149933 - RNA, 20 nt, Yersinia pestis
auagcuaccccuucagucag

SEQ ID NO: 4149934 - RNA, 20 nt, Yersinia pestis
auagcuaucuugccuguuga

SEQ ID NO: 4149935 - RNA, 21 nt, Yersinia pestis
auagcucauuuuaaauaugau

SEQ ID NO: 4149936 - RNA, 22 nt, Yersinia pestis
auagcuggcggauaaaaaugca

SEQ ID NO: 4149937 - RNA, 20 nt, Yersinia pestis
auagcuggcuucaaaaucac

SEQ ID NO: 4149938 - RNA, 15 nt, Yersinia pestis
auagcuggcuuucgc

SEQ ID NO: 4149939 - RNA, 17 nt, Yersinia pestis
auagcugucagcgaaaa

SEQ ID NO: 4149940 - RNA, 18 nt, Yersinia pestis
auagcuuaaucaucauca

SEQ ID NO: 4149941 - RNA, 11 nt, Yersinia pestis
auagcuucccu

SEQ ID NO: 4149942 - RNA, 13 nt, Yersinia pestis
auagcuucccugg

SEQ ID NO: 4149943 - RNA, 14 nt, Yersinia pestis
auagcuuucuccuu

SEQ ID NO: 4149944 - RNA, 13 nt, Yersinia pestis
auaggauuuucau

SEQ ID NO: 4149945 - RNA, 17 nt, Yersinia pestis
auaggcagaauagucac

SEQ ID NO: 4149946 - RNA, 13 nt, Yersinia pestis
auaggcagaggag

SEQ ID NO: 4149947 - RNA, 17 nt, Yersinia pestis
auaggcgaaaggcgcaa

SEQ ID NO: 4149948 - RNA, 22 nt, Yersinia pestis
auaggcgcauaugaaaaaccuc

SEQ ID NO: 4149949 - RNA, 19 nt, Yersinia pestis
auaggcguuaucggcgcag

SEQ ID NO: 4149950 - RNA, 13 nt, Yersinia pestis
auaggcuauuuua

SEQ ID NO: 4149951 - RNA, 16 nt, Yersinia pestis
auagggacugccagau

SEQ ID NO: 4149952 - RNA, 20 nt, Yersinia pestis
auagggcugaagacccaagg

SEQ ID NO: 4149953 - RNA, 16 nt, Yersinia pestis
auagggcugucagcca

SEQ ID NO: 4149954 - RNA, 17 nt, Yersinia pestis
auaggggaaauagcuuc

SEQ ID NO: 4149955 - RNA, 14 nt, Yersinia pestis
auaggguaauacca

SEQ ID NO: 4149956 - RNA, 22 nt, Yersinia pestis
auagguauacaccucaacguga

SEQ ID NO: 4149957 - RNA, 20 nt, Yersinia pestis
auagguaucauuuuccugca

SEQ ID NO: 4149958 - RNA, 17 nt, Yersinia pestis
auaggucagugguuuua

SEQ ID NO: 4149959 - RNA, 15 nt, Yersinia pestis
auaggugaugccccg

SEQ ID NO: 4149960 - RNA, 23 nt, Yersinia pestis
auaggugucucgcccacagucac

SEQ ID NO: 4149961 - RNA, 13 nt, Yersinia pestis
auaguaaaacagg

SEQ ID NO: 4149962 - RNA, 21 nt, Yersinia pestis
auaguacgauaaccuucuuca

SEQ ID NO: 4149963 - RNA, 17 nt, Yersinia pestis
auaguacguagcgauaa

SEQ ID NO: 4149964 - RNA, 13 nt, Yersinia pestis
auaguacuuagca

SEQ ID NO: 4149965 - RNA, 17 nt, Yersinia pestis
auaguacuuagcaauaa

SEQ ID NO: 4149966 - RNA, 20 nt, Yersinia pestis
auaguacuugccacaacuga

SEQ ID NO: 4149967 - RNA, 17 nt, Yersinia pestis
auaguauaaauaccugu

SEQ ID NO: 4149968 - RNA, 22 nt, Yersinia pestis
auagucacgucuucaccaauga

SEQ ID NO: 4149969 - RNA, 13 nt, Yersinia pestis
auagucaucuuuc

SEQ ID NO: 4149970 - RNA, 18 nt, Yersinia pestis
auagucuccaaauucauu

SEQ ID NO: 4149971 - RNA, 13 nt, Yersinia pestis
auagucuguuuca

SEQ ID NO: 4149972 - RNA, 17 nt, Yersinia pestis
auagucuuggaugcguu

SEQ ID NO: 4149973 - RNA, 22 nt, Yersinia pestis
auagugaaaacguuaacugcag

SEQ ID NO: 4149974 - RNA, 17 nt, Yersinia pestis
auagugaaggccgucgu

SEQ ID NO: 4149975 - RNA, 12 nt, Yersinia pestis
auagugaguaug

SEQ ID NO: 4149976 - RNA, 15 nt, Yersinia pestis
auagugaguauguau

SEQ ID NO: 4149977 - RNA, 22 nt, Yersinia pestis
auagugauuuucaauccgggca

SEQ ID NO: 4149978 - RNA, 16 nt, Yersinia pestis
auaguggcacaaauaa

SEQ ID NO: 4149979 - RNA, 14 nt, Yersinia pestis
auagugggcuaaaa

SEQ ID NO: 4149980 - RNA, 19 nt, Yersinia pestis
auaguguguguauuuaaaa

SEQ ID NO: 4149981 - RNA, 18 nt, Yersinia pestis
auaguguuguaagauuuc

SEQ ID NO: 4149982 - RNA, 17 nt, Yersinia pestis
auaguuaaucgcagcag

SEQ ID NO: 4149983 - RNA, 17 nt, Yersinia pestis
auaguuacccacauuca

SEQ ID NO: 4149984 - RNA, 17 nt, Yersinia pestis
auaguucccccagcguu

SEQ ID NO: 4149985 - RNA, 22 nt, Yersinia pestis
auaguugaucuaccugaaugcg

SEQ ID NO: 4149986 - RNA, 19 nt, Yersinia pestis
auauaaaagcacagacaaa

SEQ ID NO: 4149987 - RNA, 14 nt, Yersinia pestis
auauaaacauaaaa

SEQ ID NO: 4149988 - RNA, 15 nt, Yersinia pestis
auauaaacauaaaaa

SEQ ID NO: 4149989 - RNA, 15 nt, Yersinia pestis
auauaaaccagccag

SEQ ID NO: 4149990 - RNA, 17 nt, Yersinia pestis
auauaaacuaauaucuu

SEQ ID NO: 4149991 - RNA, 21 nt, Yersinia pestis
auauaaagcauuuaucauauu

SEQ ID NO: 4149992 - RNA, 22 nt, Yersinia pestis
auauaaauccagcccacuggcc

SEQ ID NO: 4149993 - RNA, 14 nt, Yersinia pestis
auauaaauuuaaua

SEQ ID NO: 4149994 - RNA, 20 nt, Yersinia pestis
auauaacaaguuacauuuuu

SEQ ID NO: 4149995 - RNA, 13 nt, Yersinia pestis
auauaacagccau

SEQ ID NO: 4149996 - RNA, 14 nt, Yersinia pestis
auauaaccaucaaa

SEQ ID NO: 4149997 - RNA, 24 nt, Yersinia pestis
auauaaccaucaaauacacauaac

SEQ ID NO: 4149998 - RNA, 14 nt, Yersinia pestis
auauaagagaaauu

SEQ ID NO: 4149999 - RNA, 22 nt, Yersinia pestis
auauaagauuccuuaccugaug

SEQ ID NO: 4150000 - RNA, 14 nt, Yersinia pestis
auauaauaaugcug

SEQ ID NO: 4150001 - RNA, 15 nt, Yersinia pestis
auauaauacgaaaua

SEQ ID NO: 4150002 - RNA, 17 nt, Yersinia pestis
auauaauacgaaauacu

SEQ ID NO: 4150003 - RNA, 21 nt, Yersinia pestis
auauaauacuuaagucaaauu

SEQ ID NO: 4150004 - RNA, 20 nt, Yersinia pestis
auauaauagcuggcggauaa

SEQ ID NO: 4150005 - RNA, 14 nt, Yersinia pestis
auauaaucauacug

SEQ ID NO: 4150006 - RNA, 17 nt, Yersinia pestis
auauaaugcugaaugaa

SEQ ID NO: 4150007 - RNA, 13 nt, Yersinia pestis
auauaauucaaua

SEQ ID NO: 4150008 - RNA, 16 nt, Yersinia pestis
auauuggcaacaacag

SEQ ID NO: 4150009 - RNA, 19 nt, Yersinia pestis
auauuggggggcaguuuuu

SEQ ID NO: 4150010 - RNA, 18 nt, Yersinia pestis
auauuggguaucgaugug

SEQ ID NO: 4150011 - RNA, 17 nt, Yersinia pestis
auauuggucauuuuucc

SEQ ID NO: 4150012 - RNA, 15 nt, Yersinia pestis
auauuguccaaagga

SEQ ID NO: 4150013 - RNA, 18 nt, Yersinia pestis
auauugucuuaugauaua

SEQ ID NO: 4150014 - RNA, 23 nt, Yersinia pestis
auauuguggggccuuuauucauu

SEQ ID NO: 4150015 - RNA, 16 nt, Yersinia pestis
auauuuaauuuaaaua

SEQ ID NO: 4150016 - RNA, 22 nt, Yersinia pestis
auauuuacggugagaauaaaua

SEQ ID NO: 4150017 - RNA, 14 nt, Yersinia pestis
auauuuauaaaaaa

SEQ ID NO: 4150018 - RNA, 14 nt, Yersinia pestis
auauuuauuaaaac

SEQ ID NO: 4150019 - RNA, 16 nt, Yersinia pestis
auauuuauuaauucuu

SEQ ID NO: 4150020 - RNA, 13 nt, Yersinia pestis
auauuuauuuaau

SEQ ID NO: 4150021 - RNA, 20 nt, Yersinia pestis
auauuuauuuuauugcguua

SEQ ID NO: 4150022 - RNA, 14 nt, Yersinia pestis
auauuuauuuuccc

SEQ ID NO: 4150023 - RNA, 18 nt, Yersinia pestis
auauuucaaaugccagua

SEQ ID NO: 4150024 - RNA, 14 nt, Yersinia pestis
auauuucaggcugu

SEQ ID NO: 4150025 - RNA, 11 nt, Yersinia pestis
auauuucucuu

SEQ ID NO: 4150026 - RNA, 17 nt, Yersinia pestis
auauuucuuagagagag

SEQ ID NO: 4150027 - RNA, 23 nt, Yersinia pestis
auauuugaacgugccccaaugau

SEQ ID NO: 4150028 - RNA, 15 nt, Yersinia pestis
auauuugagauauag

SEQ ID NO: 4150029 - RNA, 19 nt, Yersinia pestis
auauuugagauauaggcau

SEQ ID NO: 4150030 - RNA, 12 nt, Yersinia pestis
auauuuuaaaua

SEQ ID NO: 4150031 - RNA, 18 nt, Yersinia pestis
auauuuuuaauuuagcca

SEQ ID NO: 4150032 - RNA, 19 nt, Yersinia pestis
aucaaaaaaggacacgauu

SEQ ID NO: 4150033 - RNA, 14 nt, Yersinia pestis
aucaaaaaauaaau

SEQ ID NO: 4150034 - RNA, 17 nt, Yersinia pestis
aucaaaacugauuaaua

SEQ ID NO: 4150035 - RNA, 19 nt, Yersinia pestis
aucaaaacugauuaauagu

SEQ ID NO: 4150036 - RNA, 16 nt, Yersinia pestis
aucaaaagcaagaccg

SEQ ID NO: 4150037 - RNA, 14 nt, Yersinia pestis
aucaaaauaucggu

SEQ ID NO: 4150038 - RNA, 22 nt, Yersinia pestis
aucaaacaaaucuuaaauugaa

SEQ ID NO: 4150039 - RNA, 19 nt, Yersinia pestis
aucaaacaccgguacugag

SEQ ID NO: 4150040 - RNA, 19 nt, Yersinia pestis
aucaaacagcacaucgcca

SEQ ID NO: 4150041 - RNA, 16 nt, Yersinia pestis
aucaaaccagagaaag

SEQ ID NO: 4150042 - RNA, 20 nt, Yersinia pestis
aucaaacggcaacuucuaca

SEQ ID NO: 4150043 - RNA, 18 nt, Yersinia pestis
aucaaacggcuuuuuaaa

SEQ ID NO: 4150044 - RNA, 20 nt, Yersinia pestis
aucaaauacgaccgucacca

SEQ ID NO: 4150045 - RNA, 16 nt, Yersinia pestis
aucaaaugucagcguu

SEQ ID NO: 4150046 - RNA, 21 nt, Yersinia pestis
aucaaauuugcaguauucagg

SEQ ID NO: 4150047 - RNA, 21 nt, Yersinia pestis
aucaacacauaaaaucagcau

SEQ ID NO: 4150048 - RNA, 13 nt, Yersinia pestis
aucaacacugccu

SEQ ID NO: 4150049 - RNA, 16 nt, Yersinia pestis
aucaacagauuuucca

SEQ ID NO: 4150050 - RNA, 14 nt, Yersinia pestis
aucaacaggccacc

SEQ ID NO: 4150051 - RNA, 23 nt, Yersinia pestis
aucaacaggccaccuaacacuuu

SEQ ID NO: 4150052 - RNA, 15 nt, Yersinia pestis
aucaacauacugaua

SEQ ID NO: 4150053 - RNA, 15 nt, Yersinia pestis
aucaacaugggcaag

SEQ ID NO: 4150054 - RNA, 14 nt, Yersinia pestis
aucaacauuuuuag

SEQ ID NO: 4150055 - RNA, 18 nt, Yersinia pestis
aucaacauuuuuagcuuc

SEQ ID NO: 4150056 - RNA, 15 nt, Yersinia pestis
aucaaccaagacaua

SEQ ID NO: 4150057 - RNA, 18 nt, Yersinia pestis
aucaaccaagacauaaug

SEQ ID NO: 4150058 - RNA, 21 nt, Yersinia pestis
aucaaccacgguuuaaucaau

SEQ ID NO: 4150059 - RNA, 17 nt, Yersinia pestis
aucaaccauucauacug

SEQ ID NO: 4150060 - RNA, 22 nt, Yersinia pestis
aucaacccccuguggaaacucu

SEQ ID NO: 4150061 - RNA, 18 nt, Yersinia pestis
aucaacccgcagacugaa

SEQ ID NO: 4150062 - RNA, 15 nt, Yersinia pestis
aucaaccucagccuc

SEQ ID NO: 4150063 - RNA, 17 nt, Yersinia pestis
aucaaccucagccucau

SEQ ID NO: 4150064 - RNA, 14 nt, Yersinia pestis
aucaacgcccagcu

SEQ ID NO: 4150065 - RNA, 18 nt, Yersinia pestis
aucaacgcgccuuucggc

SEQ ID NO: 4150066 - RNA, 14 nt, Yersinia pestis
aucaacggcaccac

SEQ ID NO: 4150067 - RNA, 16 nt, Yersinia pestis
aucaacggcaccacag

SEQ ID NO: 4150068 - RNA, 16 nt, Yersinia pestis
aucaacguaauacccu

SEQ ID NO: 4150069 - RNA, 20 nt, Yersinia pestis
aucaacguagcugaauugcu

SEQ ID NO: 4150070 - RNA, 17 nt, Yersinia pestis
aucaacuucugcaaaau

SEQ ID NO: 4150071 - RNA, 16 nt, Yersinia pestis
aucaacuuucaccccu

SEQ ID NO: 4150072 - RNA, 19 nt, Yersinia pestis
aucaagacucaguaaauau

SEQ ID NO: 4150073 - RNA, 14 nt, Yersinia pestis
aucaagcaauaauu

SEQ ID NO: 4150074 - RNA, 24 nt, Yersinia pestis
aucaagcauacguugccagccauc

SEQ ID NO: 4150075 - RNA, 12 nt, Yersinia pestis
aucaagcccgca

SEQ ID NO: 4150076 - RNA, 19 nt, Yersinia pestis
aucaagcccgcaauuuuaa

SEQ ID NO: 4150077 - RNA, 12 nt, Yersinia pestis
aucaagccgcuu

SEQ ID NO: 4150078 - RNA, 22 nt, Yersinia pestis
aucaaggacgaaggguaaaaua

SEQ ID NO: 4150079 - RNA, 15 nt, Yersinia pestis
aucaaggauaagaau

SEQ ID NO: 4150080 - RNA, 17 nt, Yersinia pestis
aucaaggcggcagagcc

SEQ ID NO: 4150081 - RNA, 12 nt, Yersinia pestis
aucaagggcgau

SEQ ID NO: 4150082 - RNA, 20 nt, Yersinia pestis
aucaauaaaauuacccagca

SEQ ID NO: 4150083 - RNA, 16 nt, Yersinia pestis
aucaauaaagcuggcu

SEQ ID NO: 4150084 - RNA, 17 nt, Yersinia pestis
aucaauacacuggcagu

SEQ ID NO: 4150085 - RNA, 19 nt, Yersinia pestis
aucaauacccugccaccuu

SEQ ID NO: 4150086 - RNA, 18 nt, Yersinia pestis
aucaauaccuuacugcau

SEQ ID NO: 4150087 - RNA, 20 nt, Yersinia pestis
aucaauaccuuacugcauca

SEQ ID NO: 4150088 - RNA, 17 nt, Yersinia pestis
aucaauaggauuuucau

SEQ ID NO: 4150089 - RNA, 20 nt, Yersinia pestis
aucaauaggauuuucaugau

SEQ ID NO: 4150090 - RNA, 13 nt, Yersinia pestis
aucaauaggucag

SEQ ID NO: 4150091 - RNA, 18 nt, Yersinia pestis
aucaauaggucagugguu

SEQ ID NO: 4150092 - RNA, 14 nt, Yersinia pestis
aucaauauaacgcc

SEQ ID NO: 4150093 - RNA, 16 nt, Yersinia pestis
aucaauauaagagaaa

SEQ ID NO: 4150094 - RNA, 21 nt, Yersinia pestis
aucaauaucccgagaaacaaa

SEQ ID NO: 4150095 - RNA, 15 nt, Yersinia pestis
aucaaucaaaaaaua

SEQ ID NO: 4150096 - RNA, 17 nt, Yersinia pestis
aucaauccuacauucag

SEQ ID NO: 4150097 - RNA, 18 nt, Yersinia pestis
aucaaucguacuggcggc

SEQ ID NO: 4150098 - RNA, 15 nt, Yersinia pestis
aucaaucguuuuaau

SEQ ID NO: 4150099 - RNA, 17 nt, Yersinia pestis
aucaaucguuuuaauuu

SEQ ID NO: 4150100 - RNA, 16 nt, Yersinia pestis
aucaaucucaucaauc

SEQ ID NO: 4150101 - RNA, 19 nt, Yersinia pestis
aucaauggauucuugcugc

SEQ ID NO: 4150102 - RNA, 22 nt, Yersinia pestis
aucaauggccagcgggaaucaa

SEQ ID NO: 4150103 - RNA, 17 nt, Yersinia pestis
aucaauguuaucgccaa

SEQ ID NO: 4150104 - RNA, 23 nt, Yersinia pestis
aucaauguuaucgccaacacuau

SEQ ID NO: 4150105 - RNA, 20 nt, Yersinia pestis
aucaauguuggcccaagaua

SEQ ID NO: 4150106 - RNA, 15 nt, Yersinia pestis
aucaauugcuggcua

SEQ ID NO: 4150107 - RNA, 22 nt, Yersinia pestis
aucaauuuauacccguuauauu

SEQ ID NO: 4150108 - RNA, 13 nt, Yersinia pestis
aucacaaaaguca

SEQ ID NO: 4150109 - RNA, 20 nt, Yersinia pestis
aucacaacguuggguaaucg

SEQ ID NO: 4150110 - RNA, 16 nt, Yersinia pestis
aucacaauacagcaaa

SEQ ID NO: 4150111 - RNA, 14 nt, Yersinia pestis
aucacaaugcaaau

SEQ ID NO: 4150112 - RNA, 16 nt, Yersinia pestis
aucacacccagcgaac

SEQ ID NO: 4150113 - RNA, 19 nt, Yersinia pestis
aucacaccgcgaucacaau

SEQ ID NO: 4150114 - RNA, 17 nt, Yersinia pestis
aucacagcucucugagc

SEQ ID NO: 4150115 - RNA, 15 nt, Yersinia pestis
aucacaguuaaaaau

SEQ ID NO: 4150116 - RNA, 16 nt, Yersinia pestis
aucacaguuaaaaaua

SEQ ID NO: 4150117 - RNA, 13 nt, Yersinia pestis
aucacauaaauaa

SEQ ID NO: 4150118 - RNA, 15 nt, Yersinia pestis
aucacauaaauaagu

SEQ ID NO: 4150119 - RNA, 18 nt, Yersinia pestis
aucacauccccugccguu

SEQ ID NO: 4150120 - RNA, 22 nt, Yersinia pestis
aucacaucucggcguaaacaau

SEQ ID NO: 4150121 - RNA, 17 nt, Yersinia pestis
aucacaugacugaacau

SEQ ID NO: 4150122 - RNA, 20 nt, Yersinia pestis
aucacauuucgguuugucau

SEQ ID NO: 4150123 - RNA, 12 nt, Yersinia pestis
aucaccaaacag

SEQ ID NO: 4150124 - RNA, 20 nt, Yersinia pestis
aucaccaacaccaccaucac

SEQ ID NO: 4150125 - RNA, 18 nt, Yersinia pestis
aucaccaccgcauuuuca

SEQ ID NO: 4150126 - RNA, 14 nt, Yersinia pestis
aucaccagacaacc

SEQ ID NO: 4150127 - RNA, 17 nt, Yersinia pestis
aucaccagacaaccaau

SEQ ID NO: 4150128 - RNA, 15 nt, Yersinia pestis
aucaccaucggcaau

SEQ ID NO: 4150129 - RNA, 14 nt, Yersinia pestis
aucaccauugacca

SEQ ID NO: 4150130 - RNA, 17 nt, Yersinia pestis
aucaugccagcaauaua

SEQ ID NO: 4150131 - RNA, 17 nt, Yersinia pestis
aucaugcgggauuacuc

SEQ ID NO: 4150132 - RNA, 19 nt, Yersinia pestis
aucauggaagaccagauaa

SEQ ID NO: 4150133 - RNA, 21 nt, Yersinia pestis
aucauggaagaccagauaauc

SEQ ID NO: 4150134 - RNA, 21 nt, Yersinia pestis
aucauggcuugugcagcaaua

SEQ ID NO: 4150135 - RNA, 18 nt, Yersinia pestis
aucauguaacacacagca

SEQ ID NO: 4150136 - RNA, 15 nt, Yersinia pestis
aucauguaaggcaau

SEQ ID NO: 4150137 - RNA, 23 nt, Yersinia pestis
aucauguaaggcaauaccaauau

SEQ ID NO: 4150138 - RNA, 15 nt, Yersinia pestis
aucauuacaucaucu

SEQ ID NO: 4150139 - RNA, 23 nt, Yersinia pestis
aucauuauuauguauuuuuaugc

SEQ ID NO: 4150140 - RNA, 17 nt, Yersinia pestis
aucauucaauuccugau

SEQ ID NO: 4150141 - RNA, 18 nt, Yersinia pestis
aucauucagcgucacgau

SEQ ID NO: 4150142 - RNA, 15 nt, Yersinia pestis
aucauucauuuuaaa

SEQ ID NO: 4150143 - RNA, 18 nt, Yersinia pestis
aucauucgguuauuuaga

SEQ ID NO: 4150144 - RNA, 16 nt, Yersinia pestis
aucauucugucaucaa

SEQ ID NO: 4150145 - RNA, 19 nt, Yersinia pestis
aucauugagaucaguucag

SEQ ID NO: 4150146 - RNA, 23 nt, Yersinia pestis
aucauugccacgacgcagcucca

SEQ ID NO: 4150147 - RNA, 17 nt, Yersinia pestis
aucauuuuccugcauau

SEQ ID NO: 4150148 - RNA, 18 nt, Yersinia pestis
aucauuuuccugcauauu

SEQ ID NO: 4150149 - RNA, 14 nt, Yersinia pestis
auccaaaaagcgcu

SEQ ID NO: 4150150 - RNA, 16 nt, Yersinia pestis
auccaaagauaucuuu

SEQ ID NO: 4150151 - RNA, 15 nt, Yersinia pestis
auccaaaugacacuu

SEQ ID NO: 4150152 - RNA, 18 nt, Yersinia pestis
auccaaaugcccauuagu

SEQ ID NO: 4150153 - RNA, 21 nt, Yersinia pestis
auccaacguaaacauuggcuu

SEQ ID NO: 4150154 - RNA, 14 nt, Yersinia pestis
auccaacucaccau

SEQ ID NO: 4150155 - RNA, 22 nt, Yersinia pestis
auccaaggcggaauagaggaag

SEQ ID NO: 4150156 - RNA, 18 nt, Yersinia pestis
auccaauaacaucaccua

SEQ ID NO: 4150157 - RNA, 14 nt, Yersinia pestis
auccaauucaguac

SEQ ID NO: 4150158 - RNA, 16 nt, Yersinia pestis
auccacaaacucaugc

SEQ ID NO: 4150159 - RNA, 17 nt, Yersinia pestis
auccacaaugaucaaac

SEQ ID NO: 4150160 - RNA, 19 nt, Yersinia pestis
auccacacagcauucugcu

SEQ ID NO: 4150161 - RNA, 19 nt, Yersinia pestis
auccacacaguauucugcu

SEQ ID NO: 4150162 - RNA, 21 nt, Yersinia pestis
auccacacccucuaucucacc

SEQ ID NO: 4150163 - RNA, 23 nt, Yersinia pestis
auccacacccucuaucucacccu

SEQ ID NO: 4150164 - RNA, 14 nt, Yersinia pestis
auccacauaaaaag

SEQ ID NO: 4150165 - RNA, 23 nt, Yersinia pestis
auccacauauauagagaaaucua

SEQ ID NO: 4150166 - RNA, 23 nt, Yersinia pestis
auccaccagcgggcggcagauau

SEQ ID NO: 4150167 - RNA, 18 nt, Yersinia pestis
auccacuuauaucuccac

SEQ ID NO: 4150168 - RNA, 16 nt, Yersinia pestis
auccacuuggcuaauu

SEQ ID NO: 4150169 - RNA, 18 nt, Yersinia pestis
auccagauccucaucacu

SEQ ID NO: 4150170 - RNA, 13 nt, Yersinia pestis
auccagcaaacgc

SEQ ID NO: 4150171 - RNA, 11 nt, Yersinia pestis
auccagcagcg

SEQ ID NO: 4150172 - RNA, 21 nt, Yersinia pestis
auccagcguaaacaguagcag

SEQ ID NO: 4150173 - RNA, 16 nt, Yersinia pestis
auccagcuacgcaggc

SEQ ID NO: 4150174 - RNA, 18 nt, Yersinia pestis
auccaggaugguuaucaa

SEQ ID NO: 4150175 - RNA, 17 nt, Yersinia pestis
auccagugaaaucauca

SEQ ID NO: 4150176 - RNA, 18 nt, Yersinia pestis
auccauacgaauuuuucc

SEQ ID NO: 4150177 - RNA, 12 nt, Yersinia pestis
auccauauuaaa

SEQ ID NO: 4150178 - RNA, 21 nt, Yersinia pestis
auccauauuuggcauguucac

SEQ ID NO: 4150179 - RNA, 22 nt, Yersinia pestis
auccauauuuggcauguucaca

SEQ ID NO: 4150180 - RNA, 23 nt, Yersinia pestis
auccaucauugcuaaauuuugua

SEQ ID NO: 4150181 - RNA, 22 nt, Yersinia pestis
auccaucugaugaguguuuauu

SEQ ID NO: 4150182 - RNA, 17 nt, Yersinia pestis
auccaugagaugauuag

SEQ ID NO: 4150183 - RNA, 23 nt, Yersinia pestis
auccaugccauggcgaaaauccu

SEQ ID NO: 4150184 - RNA, 23 nt, Yersinia pestis
auccauguaggcucgagccgcgc

SEQ ID NO: 4150185 - RNA, 13 nt, Yersinia pestis
auccauguauauu

SEQ ID NO: 4150186 - RNA, 18 nt, Yersinia pestis
auccauuucaaucacugc

SEQ ID NO: 4150187 - RNA, 17 nt, Yersinia pestis
auccauuuucugccaac

SEQ ID NO: 4150188 - RNA, 16 nt, Yersinia pestis
aucccaaaagaagaca

SEQ ID NO: 4150189 - RNA, 14 nt, Yersinia pestis
aucccaagagaacg

SEQ ID NO: 4150190 - RNA, 14 nt, Yersinia pestis
aucccaaucaucau

SEQ ID NO: 4150191 - RNA, 15 nt, Yersinia pestis
aucccaaucaucauc

SEQ ID NO: 4150192 - RNA, 19 nt, Yersinia pestis
aucccaccaaaccauuggu

SEQ ID NO: 4150193 - RNA, 16 nt, Yersinia pestis
aucccacgcagauacu

SEQ ID NO: 4150194 - RNA, 16 nt, Yersinia pestis
aucccagcagcaaaca

SEQ ID NO: 4150195 - RNA, 13 nt, Yersinia pestis
aucccagccacca

SEQ ID NO: 4150196 - RNA, 19 nt, Yersinia pestis
aucccagccaccaugggua

SEQ ID NO: 4150197 - RNA, 19 nt, Yersinia pestis
auccccaaacgcugaccau

SEQ ID NO: 4150198 - RNA, 15 nt, Yersinia pestis
auccccaccaacaca

SEQ ID NO: 4150199 - RNA, 23 nt, Yersinia pestis
auccccacuuguaccugugccag

SEQ ID NO: 4150200 - RNA, 13 nt, Yersinia pestis
auccccugccguu

SEQ ID NO: 4150201 - RNA, 20 nt, Yersinia pestis
auccccugccguuggcauau

SEQ ID NO: 4150202 - RNA, 15 nt, Yersinia pestis
auccccuuucugcuc

SEQ ID NO: 4150203 - RNA, 20 nt, Yersinia pestis
auccccuuugacagcaucug

SEQ ID NO: 4150204 - RNA, 22 nt, Yersinia pestis
aucccgaaucaagcuacgccaa

SEQ ID NO: 4150205 - RNA, 13 nt, Yersinia pestis
aucccgagacacu

SEQ ID NO: 4150206 - RNA, 21 nt, Yersinia pestis
aucccgggaauaaucaauuaa

SEQ ID NO: 4150207 - RNA, 14 nt, Yersinia pestis
aucccggugaucau

SEQ ID NO: 4150208 - RNA, 14 nt, Yersinia pestis
aucccgugccagau

SEQ ID NO: 4150209 - RNA, 15 nt, Yersinia pestis
aucccguuccgcuuc

SEQ ID NO: 4150210 - RNA, 15 nt, Yersinia pestis
aucccuaacgccgug

SEQ ID NO: 4150211 - RNA, 14 nt, Yersinia pestis
aucccugugcugag

SEQ ID NO: 4150212 - RNA, 15 nt, Yersinia pestis
aucccuugacugacc

SEQ ID NO: 4150213 - RNA, 16 nt, Yersinia pestis
aucccuuuccucucuc

SEQ ID NO: 4150214 - RNA, 22 nt, Yersinia pestis
aucccuuugggugguggacuga

SEQ ID NO: 4150215 - RNA, 14 nt, Yersinia pestis
auccgaauauguca

SEQ ID NO: 4150216 - RNA, 17 nt, Yersinia pestis
auccgaauuaucauauu

SEQ ID NO: 4150217 - RNA, 21 nt, Yersinia pestis
auccgaccacugacaaaaaca

SEQ ID NO: 4150218 - RNA, 16 nt, Yersinia pestis
auccgcaaaaugggua

SEQ ID NO: 4150219 - RNA, 15 nt, Yersinia pestis
auccgcaggaagcaa

SEQ ID NO: 4150220 - RNA, 17 nt, Yersinia pestis
auccgcccuuguaagcg

SEQ ID NO: 4150221 - RNA, 20 nt, Yersinia pestis
auccgccucggugaaauaag

SEQ ID NO: 4150222 - RNA, 21 nt, Yersinia pestis
auccgccugcuggccauuuac

SEQ ID NO: 4150223 - RNA, 23 nt, Yersinia pestis
auccgcgauaacguuguuucuga

SEQ ID NO: 4150224 - RNA, 18 nt, Yersinia pestis
auccgcugacauugcccg

SEQ ID NO: 4150225 - RNA, 17 nt, Yersinia pestis
auccgggaaaaaauacg

SEQ ID NO: 4150226 - RNA, 15 nt, Yersinia pestis
auccguaaaaaaccu

SEQ ID NO: 4150227 - RNA, 13 nt, Yersinia pestis
auccguagacauu

SEQ ID NO: 4150228 - RNA, 17 nt, Yersinia pestis
auccguguauuuaucaa

SEQ ID NO: 4150229 - RNA, 18 nt, Yersinia pestis
auccguuaacccaaagcc

SEQ ID NO: 4150230 - RNA, 22 nt, Yersinia pestis
auccguuuuaacgcugcccaau

SEQ ID NO: 4150231 - RNA, 14 nt, Yersinia pestis
auccuacaauaucu

SEQ ID NO: 4150232 - RNA, 17 nt, Yersinia pestis
auccuacaauaucuucc

SEQ ID NO: 4150233 - RNA, 15 nt, Yersinia pestis
auccuacauucagua

SEQ ID NO: 4150234 - RNA, 18 nt, Yersinia pestis
auccuagcguuucuacaa

SEQ ID NO: 4150235 - RNA, 16 nt, Yersinia pestis
auccucaccguucaag

SEQ ID NO: 4150236 - RNA, 19 nt, Yersinia pestis
auccucaccguucaagauc

SEQ ID NO: 4150237 - RNA, 19 nt, Yersinia pestis
auccucggguuuuauaccg

SEQ ID NO: 4150238 - RNA, 17 nt, Yersinia pestis
auccucugaauaaaaaa

SEQ ID NO: 4150239 - RNA, 15 nt, Yersinia pestis
auccucuucuucuug

SEQ ID NO: 4150240 - RNA, 22 nt, Yersinia pestis
auccugaaauacggaacgcaga

SEQ ID NO: 4150241 - RNA, 21 nt, Yersinia pestis
auccugaauaauacugucaaa

SEQ ID NO: 4150242 - RNA, 15 nt, Yersinia pestis
auccugaauccccgc

SEQ ID NO: 4150243 - RNA, 16 nt, Yersinia pestis
auccugcaacccacgc

SEQ ID NO: 4150244 - RNA, 22 nt, Yersinia pestis
auccugccgugucguggcauau

SEQ ID NO: 4150245 - RNA, 20 nt, Yersinia pestis
auccugcuauuuaacaaaaa

SEQ ID NO: 4150246 - RNA, 24 nt, Yersinia pestis
auccuguacauauauaauacuauu

SEQ ID NO: 4150247 - RNA, 16 nt, Yersinia pestis
auccuguagcucagcc

SEQ ID NO: 4150248 - RNA, 15 nt, Yersinia pestis
auccuucauuucagg

SEQ ID NO: 4150249 - RNA, 17 nt, Yersinia pestis
auccuucauuucaggac

SEQ ID NO: 4150250 - RNA, 21 nt, Yersinia pestis
auccuugauggaaauacgcuu

SEQ ID NO: 4150251 - RNA, 21 nt, Yersinia pestis
aucuauugauugcuuaccacu

SEQ ID NO: 4150252 - RNA, 23 nt, Yersinia pestis
aucuauuguauauaccugucaua

SEQ ID NO: 4150253 - RNA, 16 nt, Yersinia pestis
aucuauuuccaucaaa

SEQ ID NO: 4150254 - RNA, 17 nt, Yersinia pestis
aucuauuuccaucaaag

SEQ ID NO: 4150255 - RNA, 19 nt, Yersinia pestis
aucuauuuuuuugaaauuc

SEQ ID NO: 4150256 - RNA, 13 nt, Yersinia pestis
aucucaccacgcc

SEQ ID NO: 4150257 - RNA, 16 nt, Yersinia pestis
aucucacgcugaauaa

SEQ ID NO: 4150258 - RNA, 22 nt, Yersinia pestis
aucucacgguagugacucauca

SEQ ID NO: 4150259 - RNA, 15 nt, Yersinia pestis
aucucacucaggcgu

SEQ ID NO: 4150260 - RNA, 20 nt, Yersinia pestis
aucucacucaggcgugucau

SEQ ID NO: 4150261 - RNA, 23 nt, Yersinia pestis
aucucaucaaucgucaauccaau

SEQ ID NO: 4150262 - RNA, 16 nt, Yersinia pestis
aucuccagaagcauau

SEQ ID NO: 4150263 - RNA, 16 nt, Yersinia pestis
aucuccagaauauaaa

SEQ ID NO: 4150264 - RNA, 16 nt, Yersinia pestis
aucuccaguaaaucua

SEQ ID NO: 4150265 - RNA, 18 nt, Yersinia pestis
aucuccauugauucacga

SEQ ID NO: 4150266 - RNA, 17 nt, Yersinia pestis
aucucccgcaaagccug

SEQ ID NO: 4150267 - RNA, 17 nt, Yersinia pestis
aucucccgcuacacgca

SEQ ID NO: 4150268 - RNA, 21 nt, Yersinia pestis
aucuccuguggcacaucaaua

SEQ ID NO: 4150269 - RNA, 18 nt, Yersinia pestis
aucucgagguguuuuccc

SEQ ID NO: 4150270 - RNA, 16 nt, Yersinia pestis
aucucggcuuucaggu

SEQ ID NO: 4150271 - RNA, 14 nt, Yersinia pestis
aucucuaacaggga

SEQ ID NO: 4150272 - RNA, 20 nt, Yersinia pestis
aucucuaacagggaugaaua

SEQ ID NO: 4150273 - RNA, 20 nt, Yersinia pestis
aucucuacgcacuuaaugcc

SEQ ID NO: 4150274 - RNA, 18 nt, Yersinia pestis
aucucuaucaauauauac

SEQ ID NO: 4150275 - RNA, 13 nt, Yersinia pestis
aucucucacagcg

SEQ ID NO: 4150276 - RNA, 14 nt, Yersinia pestis
aucucuccagccug

SEQ ID NO: 4150277 - RNA, 15 nt, Yersinia pestis
aucucuccagccugc

SEQ ID NO: 4150278 - RNA, 15 nt, Yersinia pestis
aucucugccgcugaa

SEQ ID NO: 4150279 - RNA, 23 nt, Yersinia pestis
aucucuggcaacggcacauccca

SEQ ID NO: 4150280 - RNA, 23 nt, Yersinia pestis
aucucuggccguggucuugguca

SEQ ID NO: 4150281 - RNA, 16 nt, Yersinia pestis
aucucugggugcugcu

SEQ ID NO: 4150282 - RNA, 16 nt, Yersinia pestis
aucucuuaccccuuuc

SEQ ID NO: 4150283 - RNA, 17 nt, Yersinia pestis
aucucuuccgacaggcu

SEQ ID NO: 4150284 - RNA, 20 nt, Yersinia pestis
aucucuucggcccagauauc

SEQ ID NO: 4150285 - RNA, 19 nt, Yersinia pestis
aucugaaacggugaggaua

SEQ ID NO: 4150286 - RNA, 19 nt, Yersinia pestis
aucugaauagcgcugcauc

SEQ ID NO: 4150287 - RNA, 20 nt, Yersinia pestis
aucugaauaggggaauuuuu

SEQ ID NO: 4150288 - RNA, 13 nt, Yersinia pestis
aucugaccaaaca

SEQ ID NO: 4150289 - RNA, 18 nt, Yersinia pestis
aucugauaucucuuuauc

SEQ ID NO: 4150290 - RNA, 14 nt, Yersinia pestis
aucugaucaaucuc

SEQ ID NO: 4150291 - RNA, 13 nt, Yersinia pestis
aucugaugagugu

SEQ ID NO: 4150292 - RNA, 21 nt, Yersinia pestis
aucugauuugggaacaacagc

SEQ ID NO: 4150293 - RNA, 13 nt, Yersinia pestis
aucugcaauggcu

SEQ ID NO: 4150294 - RNA, 22 nt, Yersinia pestis
aucugcauaccuggaucacgau

SEQ ID NO: 4150295 - RNA, 17 nt, Yersinia pestis
aucugcauuaaaauaac

SEQ ID NO: 4150296 - RNA, 18 nt, Yersinia pestis
aucugcauuaaaauaaca

SEQ ID NO: 4150297 - RNA, 16 nt, Yersinia pestis
aucugcauugauuaaa

SEQ ID NO: 4150298 - RNA, 14 nt, Yersinia pestis
aucugccaccgcuc

SEQ ID NO: 4150299 - RNA, 19 nt, Yersinia pestis
aucugccaccgcuccuuuc

SEQ ID NO: 4150300 - RNA, 21 nt, Yersinia pestis
aucugccaguaaacggcgguu

SEQ ID NO: 4150301 - RNA, 12 nt, Yersinia pestis
aucugcccagcc

SEQ ID NO: 4150302 - RNA, 22 nt, Yersinia pestis
aucugcggauuuacucgccuuu

SEQ ID NO: 4150303 - RNA, 16 nt, Yersinia pestis
aucugcggugaucacc

SEQ ID NO: 4150304 - RNA, 23 nt, Yersinia pestis
aucugcucauuaccaauaccauu

SEQ ID NO: 4150305 - RNA, 22 nt, Yersinia pestis
aucugcucccggcacuaagugu

SEQ ID NO: 4150306 - RNA, 23 nt, Yersinia pestis
aucugcucccggcacuaaguguc

SEQ ID NO: 4150307 - RNA, 17 nt, Yersinia pestis
aucugcuguaagggaaa

SEQ ID NO: 4150308 - RNA, 15 nt, Yersinia pestis
aucuggauauauuua

SEQ ID NO: 4150309 - RNA, 21 nt, Yersinia pestis
aucuggcguagguaguggcug

SEQ ID NO: 4150310 - RNA, 14 nt, Yersinia pestis
aucuggcugaaaua

SEQ ID NO: 4150311 - RNA, 12 nt, Yersinia pestis
aucuggcuggca

SEQ ID NO: 4150312 - RNA, 13 nt, Yersinia pestis
aucuggcuggcau

SEQ ID NO: 4150313 - RNA, 15 nt, Yersinia pestis
aucuggcuggcauau

SEQ ID NO: 4150314 - RNA, 22 nt, Yersinia pestis
aucuggcuggcauauuucucuu

SEQ ID NO: 4150315 - RNA, 17 nt, Yersinia pestis
aucugggcgacccaaag

SEQ ID NO: 4150316 - RNA, 19 nt, Yersinia pestis
aucugggcgacccaaagcu

SEQ ID NO: 4150317 - RNA, 19 nt, Yersinia pestis
aucugggcugcgcuuacca

SEQ ID NO: 4150318 - RNA, 17 nt, Yersinia pestis
aucuggucugccagaau

SEQ ID NO: 4150319 - RNA, 21 nt, Yersinia pestis
aucugugucaguaccugaugu

SEQ ID NO: 4150320 - RNA, 16 nt, Yersinia pestis
aucuguuucaaauaag

SEQ ID NO: 4150321 - RNA, 16 nt, Yersinia pestis
aucuuaaauugaagag

SEQ ID NO: 4150322 - RNA, 14 nt, Yersinia pestis
aucuuaaucacgau

SEQ ID NO: 4150323 - RNA, 19 nt, Yersinia pestis
aucuuaccuucaguuuauu

SEQ ID NO: 4150324 - RNA, 17 nt, Yersinia pestis
aucuuauccacagcaug

SEQ ID NO: 4150325 - RNA, 22 nt, Yersinia pestis
aucuucagaaacggugaaaaua

SEQ ID NO: 4150326 - RNA, 19 nt, Yersinia pestis
aucuucauccgcuccagcc

SEQ ID NO: 4150327 - RNA, 21 nt, Yersinia pestis
aucuucauccgcuccagccug

SEQ ID NO: 4150328 - RNA, 13 nt, Yersinia pestis
aucuuccaaagga

SEQ ID NO: 4150329 - RNA, 15 nt, Yersinia pestis
aucuuccaaaggaag

SEQ ID NO: 4150330 - RNA, 16 nt, Yersinia pestis
aucuuccaaaggaagg

SEQ ID NO: 4150331 - RNA, 19 nt, Yersinia pestis
aucuuccagauagcgaauc

SEQ ID NO: 4150332 - RNA, 15 nt, Yersinia pestis
aucuuccucacucca

SEQ ID NO: 4150333 - RNA, 18 nt, Yersinia pestis
aucuucgcuuagucgcca

SEQ ID NO: 4150334 - RNA, 19 nt, Yersinia pestis
aucuucgcuuucaucuucu

SEQ ID NO: 4150335 - RNA, 19 nt, Yersinia pestis
aucuucuacuuacgagcua

SEQ ID NO: 4150336 - RNA, 19 nt, Yersinia pestis
aucuugaaccaauuuuucu

SEQ ID NO: 4150337 - RNA, 16 nt, Yersinia pestis
aucuugaacggugagg

SEQ ID NO: 4150338 - RNA, 18 nt, Yersinia pestis
aucuugaacggugaggau

SEQ ID NO: 4150339 - RNA, 19 nt, Yersinia pestis
aucuugaacggugaggaua

SEQ ID NO: 4150340 - RNA, 18 nt, Yersinia pestis
aucuugaauaauauucaa

SEQ ID NO: 4150341 - RNA, 22 nt, Yersinia pestis
aucuugauaaacaugccacuuc

SEQ ID NO: 4150342 - RNA, 22 nt, Yersinia pestis
aucuugauucguuuucggugca

SEQ ID NO: 4150343 - RNA, 18 nt, Yersinia pestis
aucuugcaacaacgccuc

SEQ ID NO: 4150344 - RNA, 19 nt, Yersinia pestis
aucuugggcgggaucucca

SEQ ID NO: 4150345 - RNA, 14 nt, Yersinia pestis
aucuuguaguaacc

SEQ ID NO: 4150346 - RNA, 16 nt, Yersinia pestis
aucuuguaguaaccac

SEQ ID NO: 4150347 - RNA, 22 nt, Yersinia pestis
aucuugucgucacccauuuuac

SEQ ID NO: 4150348 - RNA, 22 nt, Yersinia pestis
aucuugugaugcauauuauuaa

SEQ ID NO: 4150349 - RNA, 23 nt, Yersinia pestis
aucuugugaugcauauuauuaau

SEQ ID NO: 4150350 - RNA, 16 nt, Yersinia pestis
aucuuguuaauuuaaa

SEQ ID NO: 4150351 - RNA, 15 nt, Yersinia pestis
aucuuuaaauuauug

SEQ ID NO: 4150352 - RNA, 22 nt, Yersinia pestis
aucuuuaacaacaaccaagcuu

SEQ ID NO: 4150353 - RNA, 16 nt, Yersinia pestis
aucuuuaauaauagau

SEQ ID NO: 4150354 - RNA, 19 nt, Yersinia pestis
aucuuuaccccauugcacc

SEQ ID NO: 4150355 - RNA, 21 nt, Yersinia pestis
aucuuucaaguccugcuucaa

SEQ ID NO: 4150356 - RNA, 19 nt, Yersinia pestis
aucuuucauaucaaaagga

SEQ ID NO: 4150357 - RNA, 20 nt, Yersinia pestis
aucuuugauuuaaauauuau

SEQ ID NO: 4150358 - RNA, 11 nt, Yersinia pestis
aucuuugcuuc

SEQ ID NO: 4150359 - RNA, 21 nt, Yersinia pestis
aucuuuuacaaauuugacauu

SEQ ID NO: 4150360 - RNA, 23 nt, Yersinia pestis
aucuuuuaguaacaaaaugcggu

SEQ ID NO: 4150361 - RNA, 15 nt, Yersinia pestis
aucuuuuauuuauga

SEQ ID NO: 4150362 - RNA, 23 nt, Yersinia pestis
aucuuuuuuuuuauuaucaucuu

SEQ ID NO: 4150363 - RNA, 16 nt, Yersinia pestis
augaaaaaaagaagaa

SEQ ID NO: 4150364 - RNA, 12 nt, Yersinia pestis
augaaaaacaga

SEQ ID NO: 4150365 - RNA, 19 nt, Yersinia pestis
augaaaaaccuccggcuau

SEQ ID NO: 4150366 - RNA, 23 nt, Yersinia pestis
augaaaaacugugcaaauggcuu

SEQ ID NO: 4150367 - RNA, 14 nt, Yersinia pestis
augaaaaauacaaa

SEQ ID NO: 4150368 - RNA, 19 nt, Yersinia pestis
augaaaaauacaaauauaa

SEQ ID NO: 4150369 - RNA, 20 nt, Yersinia pestis
augaaaggcggugaacagua

SEQ ID NO: 4150370 - RNA, 17 nt, Yersinia pestis
augaaaggcuccacaua

SEQ ID NO: 4150371 - RNA, 21 nt, Yersinia pestis
augaaaguaagagucuggauu

SEQ ID NO: 4150372 - RNA, 12 nt, Yersinia pestis
augcauccaagc

SEQ ID NO: 4150373 - RNA, 15 nt, Yersinia pestis
augcaucgcaucaga

SEQ ID NO: 4150374 - RNA, 20 nt, Yersinia pestis
augcauuggaaaaaaucuuc

SEQ ID NO: 4150375 - RNA, 16 nt, Yersinia pestis
augccaacaacugggu

SEQ ID NO: 4150376 - RNA, 15 nt, Yersinia pestis
augccaagaauaauu

SEQ ID NO: 4150377 - RNA, 13 nt, Yersinia pestis
augccacccccag

SEQ ID NO: 4150378 - RNA, 17 nt, Yersinia pestis
augccacccccagugcu

SEQ ID NO: 4150379 - RNA, 19 nt, Yersinia pestis
augccacuucgcuacgccg

SEQ ID NO: 4150380 - RNA, 17 nt, Yersinia pestis
augccagcaauauauug

SEQ ID NO: 4150381 - RNA, 19 nt, Yersinia pestis
augccagcaauauauugcu

SEQ ID NO: 4150382 - RNA, 14 nt, Yersinia pestis
augccagcccauca

SEQ ID NO: 4150383 - RNA, 12 nt, Yersinia pestis
augccagcccca

SEQ ID NO: 4150384 - RNA, 13 nt, Yersinia pestis
augccaguagccg

SEQ ID NO: 4150385 - RNA, 15 nt, Yersinia pestis
augccaguuauuauu

SEQ ID NO: 4150386 - RNA, 23 nt, Yersinia pestis
augccauaacaucguuaauccau

SEQ ID NO: 4150387 - RNA, 14 nt, Yersinia pestis
augccaucccccuu

SEQ ID NO: 4150388 - RNA, 15 nt, Yersinia pestis
augccauuuacccug

SEQ ID NO: 4150389 - RNA, 16 nt, Yersinia pestis
augcccagcguuggca

SEQ ID NO: 4150390 - RNA, 15 nt, Yersinia pestis
augcccaguuuacca

SEQ ID NO: 4150391 - RNA, 13 nt, Yersinia pestis
augcccauuagua

SEQ ID NO: 4150392 - RNA, 21 nt, Yersinia pestis
augccgauauagcgcaccacc

SEQ ID NO: 4150393 - RNA, 15 nt, Yersinia pestis
augccgcuccagcac

SEQ ID NO: 4150394 - RNA, 17 nt, Yersinia pestis
augccgcugaucaggaa

SEQ ID NO: 4150395 - RNA, 17 nt, Yersinia pestis
augccggaaucagccag

SEQ ID NO: 4150396 - RNA, 14 nt, Yersinia pestis
augccggaggauau

SEQ ID NO: 4150397 - RNA, 20 nt, Yersinia pestis
augccuaauaauuuauacau

SEQ ID NO: 4150398 - RNA, 20 nt, Yersinia pestis
augccugcgaauuaucaucc

SEQ ID NO: 4150399 - RNA, 21 nt, Yersinia pestis
augccuggugcaaccgcugaa

SEQ ID NO: 4150400 - RNA, 20 nt, Yersinia pestis
augccuguuauaaggcuaac

SEQ ID NO: 4150401 - RNA, 18 nt, Yersinia pestis
augccuuggcaaagagac

SEQ ID NO: 4150402 - RNA, 16 nt, Yersinia pestis
augcgaaaaaagaugg

SEQ ID NO: 4150403 - RNA, 15 nt, Yersinia pestis
augcgcaccagcuca

SEQ ID NO: 4150404 - RNA, 23 nt, Yersinia pestis
augcgccauauacccaaagccag

SEQ ID NO: 4150405 - RNA, 17 nt, Yersinia pestis
augcgccuguuagggcg

SEQ ID NO: 4150406 - RNA, 17 nt, Yersinia pestis
augcgcucgcuugcugc

SEQ ID NO: 4150407 - RNA, 14 nt, Yersinia pestis
augcggaagaaggc

SEQ ID NO: 4150408 - RNA, 22 nt, Yersinia pestis
augcggguuuuuuuacauauaa

SEQ ID NO: 4150409 - RNA, 15 nt, Yersinia pestis
augcguagagucagu

SEQ ID NO: 4150410 - RNA, 16 nt, Yersinia pestis
augcgucuuuagauuu

SEQ ID NO: 4150411 - RNA, 15 nt, Yersinia pestis
augcguuggcucaga

SEQ ID NO: 4150412 - RNA, 16 nt, Yersinia pestis
augcguuggcucagau

SEQ ID NO: 4150413 - RNA, 22 nt, Yersinia pestis
augcguuggcucagauaauaac

SEQ ID NO: 4150414 - RNA, 18 nt, Yersinia pestis
augcguuggcugccuucc

SEQ ID NO: 4150415 - RNA, 15 nt, Yersinia pestis
augcuaaaaaacagc

SEQ ID NO: 4150416 - RNA, 17 nt, Yersinia pestis
augcuaaaaaacagccu

SEQ ID NO: 4150417 - RNA, 18 nt, Yersinia pestis
augcuaaccgaauaaaac

SEQ ID NO: 4150418 - RNA, 11 nt, Yersinia pestis
augcuaacucg

SEQ ID NO: 4150419 - RNA, 22 nt, Yersinia pestis
augcuacaccauccauaggcua

SEQ ID NO: 4150420 - RNA, 16 nt, Yersinia pestis
augcuacuuguuuuuu

SEQ ID NO: 4150421 - RNA, 15 nt, Yersinia pestis
augcuagugauaaac

SEQ ID NO: 4150422 - RNA, 11 nt, Yersinia pestis
augcuauauuu

SEQ ID NO: 4150423 - RNA, 12 nt, Yersinia pestis
augcuauauuug

SEQ ID NO: 4150424 - RNA, 20 nt, Yersinia pestis
augcucaaguguaaaagaua

SEQ ID NO: 4150425 - RNA, 18 nt, Yersinia pestis
augcucaucaaguauuuu

SEQ ID NO: 4150426 - RNA, 21 nt, Yersinia pestis
augcucgcuaaucaagccuuc

SEQ ID NO: 4150427 - RNA, 17 nt, Yersinia pestis
augcucgcucaucauaa

SEQ ID NO: 4150428 - RNA, 17 nt, Yersinia pestis
augcucuucauaagcca

SEQ ID NO: 4150429 - RNA, 15 nt, Yersinia pestis
augcucuuuuuaugc

SEQ ID NO: 4150430 - RNA, 20 nt, Yersinia pestis
augcugaacuugcucgggcg

SEQ ID NO: 4150431 - RNA, 22 nt, Yersinia pestis
augcugaaucuguaagucauuc

SEQ ID NO: 4150432 - RNA, 23 nt, Yersinia pestis
augcugaaugaauuguuguaauu

SEQ ID NO: 4150433 - RNA, 17 nt, Yersinia pestis
augcugaccacugcuuc

SEQ ID NO: 4150434 - RNA, 18 nt, Yersinia pestis
augcugaccccaaauuug

SEQ ID NO: 4150435 - RNA, 21 nt, Yersinia pestis
augcugaccccaaauuugaau

SEQ ID NO: 4150436 - RNA, 15 nt, Yersinia pestis
augcugauuaaugag

SEQ ID NO: 4150437 - RNA, 14 nt, Yersinia pestis
augcugcacaucaa

SEQ ID NO: 4150438 - RNA, 21 nt, Yersinia pestis
augcugcacaucaacggacag

SEQ ID NO: 4150439 - RNA, 22 nt, Yersinia pestis
augcuggcuuuuuuguuuuuau

SEQ ID NO: 4150440 - RNA, 17 nt, Yersinia pestis
augcuggguauauauac

SEQ ID NO: 4150441 - RNA, 19 nt, Yersinia pestis
augcuggguauauauacag

SEQ ID NO: 4150442 - RNA, 19 nt, Yersinia pestis
augcugucacugucaaaac

SEQ ID NO: 4150443 - RNA, 12 nt, Yersinia pestis
augcugugccau

SEQ ID NO: 4150444 - RNA, 21 nt, Yersinia pestis
augcuguuguagcgccaggua

SEQ ID NO: 4150445 - RNA, 17 nt, Yersinia pestis
augcuuaagaggaucuu

SEQ ID NO: 4150446 - RNA, 18 nt, Yersinia pestis
augcuucaagcugccuau

SEQ ID NO: 4150447 - RNA, 13 nt, Yersinia pestis
augcuuucaucuu

SEQ ID NO: 4150448 - RNA, 15 nt, Yersinia pestis
augcuuuucuuuccc

SEQ ID NO: 4150449 - RNA, 22 nt, Yersinia pestis
augcuuuucuuucccgccggca

SEQ ID NO: 4150450 - RNA, 22 nt, Yersinia pestis
augcuuuuugcaucgcuucuga

SEQ ID NO: 4150451 - RNA, 23 nt, Yersinia pestis
augcuuuuugcaucgcuucugaa

SEQ ID NO: 4150452 - RNA, 16 nt, Yersinia pestis
auggaaaaaauacagg

SEQ ID NO: 4150453 - RNA, 19 nt, Yersinia pestis
auggaaaaaauacaggugu

SEQ ID NO: 4150454 - RNA, 23 nt, Yersinia pestis
auggaacggacauuuuacucccu

SEQ ID NO: 4150455 - RNA, 24 nt, Yersinia pestis
auggaagaaucaccgaaagaagac

SEQ ID NO: 4150456 - RNA, 16 nt, Yersinia pestis
auggaaguaauccaga

SEQ ID NO: 4150457 - RNA, 12 nt, Yersinia pestis
auggaauaacug

SEQ ID NO: 4150458 - RNA, 22 nt, Yersinia pestis
auggacgccgcuacaagcaugu

SEQ ID NO: 4150459 - RNA, 23 nt, Yersinia pestis
auggacuacacagacuggugaac

SEQ ID NO: 4150460 - RNA, 13 nt, Yersinia pestis
auggaucacccgu

SEQ ID NO: 4150461 - RNA, 17 nt, Yersinia pestis
auggauggucauaaaau

SEQ ID NO: 4150462 - RNA, 19 nt, Yersinia pestis
auggauuaucgccuggcuu

SEQ ID NO: 4150463 - RNA, 20 nt, Yersinia pestis
auggauugaaaccgcugaua

SEQ ID NO: 4150464 - RNA, 15 nt, Yersinia pestis
auggauuugcacaua

SEQ ID NO: 4150465 - RNA, 16 nt, Yersinia pestis
auggauuugugcaaau

SEQ ID NO: 4150466 - RNA, 19 nt, Yersinia pestis
auggcaaagcacagucgcc

SEQ ID NO: 4150467 - RNA, 19 nt, Yersinia pestis
auggcaaaggauaaugaua

SEQ ID NO: 4150468 - RNA, 13 nt, Yersinia pestis
auggcaacagcau

SEQ ID NO: 4150469 - RNA, 15 nt, Yersinia pestis
auggcacaauccaau

SEQ ID NO: 4150470 - RNA, 19 nt, Yersinia pestis
auggcacuggaaacaaaac

SEQ ID NO: 4150471 - RNA, 20 nt, Yersinia pestis
auggcacuugugaugucuga

SEQ ID NO: 4150472 - RNA, 17 nt, Yersinia pestis
auggcagagcuuuucuc

SEQ ID NO: 4150473 - RNA, 17 nt, Yersinia pestis
auggcagcccuuauuca

SEQ ID NO: 4150474 - RNA, 22 nt, Yersinia pestis
auggcaggucucgcaaugaaag

SEQ ID NO: 4150475 - RNA, 20 nt, Yersinia pestis
auggcauuuaggcgggcagu

SEQ ID NO: 4150476 - RNA, 13 nt, Yersinia pestis
auggccaccauua

SEQ ID NO: 4150477 - RNA, 15 nt, Yersinia pestis
auggcccaagccauc

SEQ ID NO: 4150478 - RNA, 14 nt, Yersinia pestis
auggccggacucau

SEQ ID NO: 4150479 - RNA, 21 nt, Yersinia pestis
auggccucguauuacccucau

SEQ ID NO: 4150480 - RNA, 17 nt, Yersinia pestis
auggccuugaaucaaaa

SEQ ID NO: 4150481 - RNA, 20 nt, Yersinia pestis
auggcggcuggaaaaccaau

SEQ ID NO: 4150482 - RNA, 20 nt, Yersinia pestis
auggcgguauagaccaauuc

SEQ ID NO: 4150483 - RNA, 13 nt, Yersinia pestis
auggcggucgcac

SEQ ID NO: 4150484 - RNA, 19 nt, Yersinia pestis
auggcguauugagugucau

SEQ ID NO: 4150485 - RNA, 13 nt, Yersinia pestis
auggcguuuucuu

SEQ ID NO: 4150486 - RNA, 23 nt, Yersinia pestis
auggcuaaacucuggcacuggca

SEQ ID NO: 4150487 - RNA, 21 nt, Yersinia pestis
auggcuacguagcucagcugg

SEQ ID NO: 4150488 - RNA, 16 nt, Yersinia pestis
auggcugccaucagga

SEQ ID NO: 4150489 - RNA, 17 nt, Yersinia pestis
auggcuggcaaggcacg

SEQ ID NO: 4150490 - RNA, 21 nt, Yersinia pestis
auggcuugcucaauaccauug

SEQ ID NO: 4150491 - RNA, 18 nt, Yersinia pestis
auggcuugugcagcaaua

SEQ ID NO: 4150492 - RNA, 20 nt, Yersinia pestis
auggcuuuacggcucaccug

SEQ ID NO: 4150493 - RNA, 14 nt, Yersinia pestis
auggcuuuaugacc

SEQ ID NO: 4150494 - RNA, 15 nt, Yersinia pestis
auuaaagauuaagac

SEQ ID NO: 4150495 - RNA, 22 nt, Yersinia pestis
auuaaagauuucaucauucaau

SEQ ID NO: 4150496 - RNA, 21 nt, Yersinia pestis
auuaaagccauucagcagcaa

SEQ ID NO: 4150497 - RNA, 18 nt, Yersinia pestis
auuaaaguuuagcaaagc

SEQ ID NO: 4150498 - RNA, 20 nt, Yersinia pestis
auuaaaguuuagcaaagcau

SEQ ID NO: 4150499 - RNA, 13 nt, Yersinia pestis
auuaaaugcauua

SEQ ID NO: 4150500 - RNA, 19 nt, Yersinia pestis
auuaaauggugguuuucuu

SEQ ID NO: 4150501 - RNA, 14 nt, Yersinia pestis
auuaaaugguuuau

SEQ ID NO: 4150502 - RNA, 19 nt, Yersinia pestis
auuaaaugguuuauuuaag

SEQ ID NO: 4150503 - RNA, 20 nt, Yersinia pestis
auuaaauguauaaaaaagau

SEQ ID NO: 4150504 - RNA, 17 nt, Yersinia pestis
auuaaauuaauauuuaa

SEQ ID NO: 4150505 - RNA, 18 nt, Yersinia pestis
auuaaauuaauauuuaaa

SEQ ID NO: 4150506 - RNA, 21 nt, Yersinia pestis
auuaaauucuaccuggcucaa

SEQ ID NO: 4150507 - RNA, 23 nt, Yersinia pestis
auuaacaagcgaccaucaugaau

SEQ ID NO: 4150508 - RNA, 14 nt, Yersinia pestis
auuaacaauauuau

SEQ ID NO: 4150509 - RNA, 22 nt, Yersinia pestis
auuaacaauuacuuuggcauuu

SEQ ID NO: 4150510 - RNA, 12 nt, Yersinia pestis
auuaacacaucu

SEQ ID NO: 4150511 - RNA, 22 nt, Yersinia pestis
auuaacacccaauaauaaaaaa

SEQ ID NO: 4150512 - RNA, 14 nt, Yersinia pestis
auuaacacuuauua

SEQ ID NO: 4150513 - RNA, 21 nt, Yersinia pestis
auuaacauuaauccucucuug

SEQ ID NO: 4150514 - RNA, 18 nt, Yersinia pestis
auuaaccgcuccaggcug

SEQ ID NO: 4150515 - RNA, 14 nt, Yersinia pestis
auuaaccuaaaaac

SEQ ID NO: 4150516 - RNA, 20 nt, Yersinia pestis
auuaaccuaaaaacgucacu

SEQ ID NO: 4150517 - RNA, 17 nt, Yersinia pestis
auuaaccuguaaaagca

SEQ ID NO: 4150518 - RNA, 18 nt, Yersinia pestis
auuaaccuguaaaagcag

SEQ ID NO: 4150519 - RNA, 17 nt, Yersinia pestis
auuaaccuuaucaccaa

SEQ ID NO: 4150520 - RNA, 24 nt, Yersinia pestis
auuaacgcacaugccgucaccuca

SEQ ID NO: 4150521 - RNA, 22 nt, Yersinia pestis
auuaacgcucuacaacguccag

SEQ ID NO: 4150522 - RNA, 18 nt, Yersinia pestis
auuaacuauuugaugcua

SEQ ID NO: 4150523 - RNA, 22 nt, Yersinia pestis
auuaacucuucuguugcccccu

SEQ ID NO: 4150524 - RNA, 16 nt, Yersinia pestis
auuaacucuuuuuaaa

SEQ ID NO: 4150525 - RNA, 11 nt, Yersinia pestis
auuaacugcag

SEQ ID NO: 4150526 - RNA, 17 nt, Yersinia pestis
auuaacuucuuccgcaa

SEQ ID NO: 4150527 - RNA, 11 nt, Yersinia pestis
auuaaggccac

SEQ ID NO: 4150528 - RNA, 16 nt, Yersinia pestis
auuaaguaagccgcac

SEQ ID NO: 4150529 - RNA, 22 nt, Yersinia pestis
auuaaguuuuucauaaucaccu

SEQ ID NO: 4150530 - RNA, 18 nt, Yersinia pestis
auuaauaaauauccuccg

SEQ ID NO: 4150531 - RNA, 20 nt, Yersinia pestis
auuaauacacgcuuccagua

SEQ ID NO: 4150532 - RNA, 14 nt, Yersinia pestis
auuaauacaucauc

SEQ ID NO: 4150533 - RNA, 16 nt, Yersinia pestis
auuaauacaucaucaa

SEQ ID NO: 4150534 - RNA, 17 nt, Yersinia pestis
auuaauacaucaucaaa

SEQ ID NO: 4150535 - RNA, 17 nt, Yersinia pestis
auuaauauaauacuuaa

SEQ ID NO: 4150536 - RNA, 19 nt, Yersinia pestis
auuaauauauaaaauaaau

SEQ ID NO: 4150537 - RNA, 16 nt, Yersinia pestis
auuaauaucaaaacug

SEQ ID NO: 4150538 - RNA, 17 nt, Yersinia pestis
auuaauaucaaaacuga

SEQ ID NO: 4150539 - RNA, 15 nt, Yersinia pestis
auuaauaucagcgau

SEQ ID NO: 4150540 - RNA, 20 nt, Yersinia pestis
auuaaucaacagauaugcau

SEQ ID NO: 4150541 - RNA, 13 nt, Yersinia pestis
auuaaucaauuaa

SEQ ID NO: 4150542 - RNA, 14 nt, Yersinia pestis
auuaaucaauuaaa

SEQ ID NO: 4150543 - RNA, 15 nt, Yersinia pestis
auuaaucaauuaaau

SEQ ID NO: 4150544 - RNA, 14 nt, Yersinia pestis
auuaaucaauuaau

SEQ ID NO: 4150545 - RNA, 23 nt, Yersinia pestis
auuaauccccggucacuuaaaua

SEQ ID NO: 4150546 - RNA, 22 nt, Yersinia pestis
auuaauccucucuugaaaugau

SEQ ID NO: 4150547 - RNA, 23 nt, Yersinia pestis
auuaaucuaauuucaaaugaacu

SEQ ID NO: 4150548 - RNA, 18 nt, Yersinia pestis
auuaaucuauuaauaucg

SEQ ID NO: 4150549 - RNA, 18 nt, Yersinia pestis
auuaaugaaauuaguuaa

SEQ ID NO: 4150550 - RNA, 17 nt, Yersinia pestis
auuaauggauagcugua

SEQ ID NO: 4150551 - RNA, 22 nt, Yersinia pestis
auuaauggauugaucauucucu

SEQ ID NO: 4150552 - RNA, 14 nt, Yersinia pestis
auuaauguacaccu

SEQ ID NO: 4150553 - RNA, 20 nt, Yersinia pestis
auuaaugucgccauaacgca

SEQ ID NO: 4150554 - RNA, 22 nt, Yersinia pestis
auuaaugucgccauaacgcaca

SEQ ID NO: 4150555 - RNA, 12 nt, Yersinia pestis
auuaauuauuuu

SEQ ID NO: 4150556 - RNA, 14 nt, Yersinia pestis
auuaauuauuuuau

SEQ ID NO: 4150557 - RNA, 22 nt, Yersinia pestis
auuaauuccacgcugaaacuuu

SEQ ID NO: 4150558 - RNA, 17 nt, Yersinia pestis
auuaauucuuuuugcca

SEQ ID NO: 4150559 - RNA, 15 nt, Yersinia pestis
auuaauuuaaacaac

SEQ ID NO: 4150560 - RNA, 12 nt, Yersinia pestis
auuaauuuauuu

SEQ ID NO: 4150561 - RNA, 22 nt, Yersinia pestis
auuaauuuauuuucauuagucc

SEQ ID NO: 4150562 - RNA, 15 nt, Yersinia pestis
auuacaagugccaaa

SEQ ID NO: 4150563 - RNA, 16 nt, Yersinia pestis
auuacaagugccaaau

SEQ ID NO: 4150564 - RNA, 20 nt, Yersinia pestis
auuacacacccucaacucaa

SEQ ID NO: 4150565 - RNA, 13 nt, Yersinia pestis
auuacacagcauc

SEQ ID NO: 4150566 - RNA, 22 nt, Yersinia pestis
auuacacccaacuuuuuuacca

SEQ ID NO: 4150567 - RNA, 14 nt, Yersinia pestis
auuacacgguggcc

SEQ ID NO: 4150568 - RNA, 18 nt, Yersinia pestis
auuacaggccccaaucca

SEQ ID NO: 4150569 - RNA, 15 nt, Yersinia pestis
auuacaucaucuucu

SEQ ID NO: 4150570 - RNA, 16 nt, Yersinia pestis
auuaccaauaauuaau

SEQ ID NO: 4150571 - RNA, 17 nt, Yersinia pestis
auuaccaauaugaaauu

SEQ ID NO: 4150572 - RNA, 20 nt, Yersinia pestis
auuaccaauaugaaauuuca

SEQ ID NO: 4150573 - RNA, 23 nt, Yersinia pestis
auuaccaccgucaagacaacaaa

SEQ ID NO: 4150574 - RNA, 17 nt, Yersinia pestis
auuaccgucagggacaa

SEQ ID NO: 4150575 - RNA, 23 nt, Yersinia pestis
auuaccgucagggacaacaucau

SEQ ID NO: 4150576 - RNA, 14 nt, Yersinia pestis
auuaccguuaucaa

SEQ ID NO: 4150577 - RNA, 18 nt, Yersinia pestis
auuaccguuugguagcuc

SEQ ID NO: 4150578 - RNA, 14 nt, Yersinia pestis
auuaccuaauuuau

SEQ ID NO: 4150579 - RNA, 15 nt, Yersinia pestis
auuaccucacguuuu

SEQ ID NO: 4150580 - RNA, 23 nt, Yersinia pestis
auuaccugagagagguugaggau

SEQ ID NO: 4150581 - RNA, 18 nt, Yersinia pestis
auuacgggucagcucacc

SEQ ID NO: 4150582 - RNA, 20 nt, Yersinia pestis
auuacguagacauaaauuua

SEQ ID NO: 4150583 - RNA, 17 nt, Yersinia pestis
auuacgugaugaugcua

SEQ ID NO: 4150584 - RNA, 23 nt, Yersinia pestis
auuacucacacagccagccuuaa

SEQ ID NO: 4150585 - RNA, 20 nt, Yersinia pestis
auuacucagcacauuuuuau

SEQ ID NO: 4150586 - RNA, 22 nt, Yersinia pestis
auuacucaggaacaagacuuuc

SEQ ID NO: 4150587 - RNA, 13 nt, Yersinia pestis
auuacuccacacg

SEQ ID NO: 4150588 - RNA, 17 nt, Yersinia pestis
auuacucguauaaaaaa

SEQ ID NO: 4150589 - RNA, 20 nt, Yersinia pestis
auuacucucgccaaacaaau

SEQ ID NO: 4150590 - RNA, 23 nt, Yersinia pestis
auuacucuuauaaagauuuuaag

SEQ ID NO: 4150591 - RNA, 17 nt, Yersinia pestis
auuacuggucucaaggu

SEQ ID NO: 4150592 - RNA, 15 nt, Yersinia pestis
auuacuucuuuuuaa

SEQ ID NO: 4150593 - RNA, 20 nt, Yersinia pestis
auuacuucuuuuuaacgacg

SEQ ID NO: 4150594 - RNA, 16 nt, Yersinia pestis
auuacuuuaaagccaa

SEQ ID NO: 4150595 - RNA, 18 nt, Yersinia pestis
auuacuuuauuuaaaauu

SEQ ID NO: 4150596 - RNA, 14 nt, Yersinia pestis
auuacuuugaauag

SEQ ID NO: 4150597 - RNA, 15 nt, Yersinia pestis
auuacuuugaauagc

SEQ ID NO: 4150598 - RNA, 15 nt, Yersinia pestis
auuagaaaacaaguu

SEQ ID NO: 4150599 - RNA, 17 nt, Yersinia pestis
auuagaaguucuaaaua

SEQ ID NO: 4150600 - RNA, 13 nt, Yersinia pestis
auuagaaucaauc

SEQ ID NO: 4150601 - RNA, 21 nt, Yersinia pestis
auuagagguuauugacaaaga

SEQ ID NO: 4150602 - RNA, 20 nt, Yersinia pestis
auuagagguuguugacaaag

SEQ ID NO: 4150603 - RNA, 18 nt, Yersinia pestis
auuagaugaugcuacuug

SEQ ID NO: 4150604 - RNA, 13 nt, Yersinia pestis
auuagcaguaacg

SEQ ID NO: 4150605 - RNA, 17 nt, Yersinia pestis
auuagcaguaacgucca

SEQ ID NO: 4150606 - RNA, 17 nt, Yersinia pestis
auuagccccaaaugcca

SEQ ID NO: 4150607 - RNA, 16 nt, Yersinia pestis
auuagccgaauauccc

SEQ ID NO: 4150608 - RNA, 17 nt, Yersinia pestis
auuagcgaaauaucagg

SEQ ID NO: 4150609 - RNA, 17 nt, Yersinia pestis
auuagcgcuuuuuaaag

SEQ ID NO: 4150610 - RNA, 17 nt, Yersinia pestis
auuagcguuacagcuaa

SEQ ID NO: 4150611 - RNA, 17 nt, Yersinia pestis
auuaggauuuauuuuug

SEQ ID NO: 4150612 - RNA, 15 nt, Yersinia pestis
auuaggcaugauaag

SEQ ID NO: 4150613 - RNA, 16 nt, Yersinia pestis
auuagggcugacagag

SEQ ID NO: 4150614 - RNA, 18 nt, Yersinia pestis
auuagggcugacagagcg

SEQ ID NO: 4150615 - RNA, 17 nt, Yersinia pestis
auucauuuuaaaaaaau

SEQ ID NO: 4150616 - RNA, 20 nt, Yersinia pestis
auucauuuuaaaaaaauuaa

SEQ ID NO: 4150617 - RNA, 15 nt, Yersinia pestis
auucauuuugcugga

SEQ ID NO: 4150618 - RNA, 21 nt, Yersinia pestis
auucauuuugcuggaaaagua

SEQ ID NO: 4150619 - RNA, 19 nt, Yersinia pestis
auuccaaccuuguaacuuu

SEQ ID NO: 4150620 - RNA, 16 nt, Yersinia pestis
auuccacaaauuuuua

SEQ ID NO: 4150621 - RNA, 20 nt, Yersinia pestis
auuccacagaguauacauaa

SEQ ID NO: 4150622 - RNA, 11 nt, Yersinia pestis
auuccagaccg

SEQ ID NO: 4150623 - RNA, 13 nt, Yersinia pestis
auucccagccacu

SEQ ID NO: 4150624 - RNA, 21 nt, Yersinia pestis
auuccccaccauugcaaacau

SEQ ID NO: 4150625 - RNA, 16 nt, Yersinia pestis
auucccccaaaaccuc

SEQ ID NO: 4150626 - RNA, 15 nt, Yersinia pestis
auucccgccagguuu

SEQ ID NO: 4150627 - RNA, 21 nt, Yersinia pestis
auucccguuuuauuacugaua

SEQ ID NO: 4150628 - RNA, 23 nt, Yersinia pestis
auuccgcgagcaauaccaaaaau

SEQ ID NO: 4150629 - RNA, 19 nt, Yersinia pestis
auuccgcuucacauuugaa

SEQ ID NO: 4150630 - RNA, 22 nt, Yersinia pestis
auuccgucgauaucuaagucca

SEQ ID NO: 4150631 - RNA, 15 nt, Yersinia pestis
auuccguuuaaacuc

SEQ ID NO: 4150632 - RNA, 16 nt, Yersinia pestis
auucgauaaaaggcua

SEQ ID NO: 4150633 - RNA, 14 nt, Yersinia pestis
auucgaugauuuau

SEQ ID NO: 4150634 - RNA, 22 nt, Yersinia pestis
auucgcacaguuuucuuaaaau

SEQ ID NO: 4150635 - RNA, 21 nt, Yersinia pestis
auucgcaucuuccaaaggaag

SEQ ID NO: 4150636 - RNA, 22 nt, Yersinia pestis
auucgcaucuuccaaaggaagg

SEQ ID NO: 4150637 - RNA, 13 nt, Yersinia pestis
auucgccagauac

SEQ ID NO: 4150638 - RNA, 15 nt, Yersinia pestis
auucgcgaccagcag

SEQ ID NO: 4150639 - RNA, 21 nt, Yersinia pestis
auucgggcaacuaauucuuag

SEQ ID NO: 4150640 - RNA, 17 nt, Yersinia pestis
auucggugacuaaaauc

SEQ ID NO: 4150641 - RNA, 13 nt, Yersinia pestis
auucguagaaaca

SEQ ID NO: 4150642 - RNA, 18 nt, Yersinia pestis
auucgucaccaucaauau

SEQ ID NO: 4150643 - RNA, 13 nt, Yersinia pestis
auucgucugccau

SEQ ID NO: 4150644 - RNA, 19 nt, Yersinia pestis
auucgucugccauugcuca

SEQ ID NO: 4150645 - RNA, 23 nt, Yersinia pestis
auucgugccauaaaguuuuuccu

SEQ ID NO: 4150646 - RNA, 18 nt, Yersinia pestis
auucguuagcucuucacg

SEQ ID NO: 4150647 - RNA, 12 nt, Yersinia pestis
auucuagcaaca

SEQ ID NO: 4150648 - RNA, 18 nt, Yersinia pestis
auucuauccggauuaaau

SEQ ID NO: 4150649 - RNA, 12 nt, Yersinia pestis
auucucaauauu

SEQ ID NO: 4150650 - RNA, 18 nt, Yersinia pestis
auucucaauggcuuuuuu

SEQ ID NO: 4150651 - RNA, 13 nt, Yersinia pestis
auucucacucuau

SEQ ID NO: 4150652 - RNA, 13 nt, Yersinia pestis
auucucaucauca

SEQ ID NO: 4150653 - RNA, 21 nt, Yersinia pestis
auucucauugcccccuucaau

SEQ ID NO: 4150654 - RNA, 13 nt, Yersinia pestis
auucucccauuua

SEQ ID NO: 4150655 - RNA, 14 nt, Yersinia pestis
auucuccuuucuuu

SEQ ID NO: 4150656 - RNA, 20 nt, Yersinia pestis
auucucuacucgcucaccac

SEQ ID NO: 4150657 - RNA, 22 nt, Yersinia pestis
auucucuauucugcuuuuugcu

SEQ ID NO: 4150658 - RNA, 23 nt, Yersinia pestis
auucucucuuuugagaguucacu

SEQ ID NO: 4150659 - RNA, 15 nt, Yersinia pestis
auucucuucaccuuc

SEQ ID NO: 4150660 - RNA, 14 nt, Yersinia pestis
auucugauaccugc

SEQ ID NO: 4150661 - RNA, 18 nt, Yersinia pestis
auucugauaccugcgcua

SEQ ID NO: 4150662 - RNA, 14 nt, Yersinia pestis
auucugauagugau

SEQ ID NO: 4150663 - RNA, 23 nt, Yersinia pestis
auucugauagugauuuuuuucac

SEQ ID NO: 4150664 - RNA, 14 nt, Yersinia pestis
auucugaucgaguu

SEQ ID NO: 4150665 - RNA, 21 nt, Yersinia pestis
auucugccgacuaauauuuca

SEQ ID NO: 4150666 - RNA, 15 nt, Yersinia pestis
auucugccuauccuc

SEQ ID NO: 4150667 - RNA, 16 nt, Yersinia pestis
auucugccuauccuca

SEQ ID NO: 4150668 - RNA, 18 nt, Yersinia pestis
auucugccuauccucacc

SEQ ID NO: 4150669 - RNA, 16 nt, Yersinia pestis
auucugcuuuuugcuu

SEQ ID NO: 4150670 - RNA, 17 nt, Yersinia pestis
auucugcuuuuugcuuu

SEQ ID NO: 4150671 - RNA, 20 nt, Yersinia pestis
auucuggguacaacacaaaa

SEQ ID NO: 4150672 - RNA, 18 nt, Yersinia pestis
auucuguagaguaaaacu

SEQ ID NO: 4150673 - RNA, 21 nt, Yersinia pestis
auucuguagaguaaaacugau

SEQ ID NO: 4150674 - RNA, 20 nt, Yersinia pestis
auucugucagagcuauguuc

SEQ ID NO: 4150675 - RNA, 23 nt, Yersinia pestis
auucuguuuccucuucaucuaca

SEQ ID NO: 4150676 - RNA, 18 nt, Yersinia pestis
auucuuaccguuucagau

SEQ ID NO: 4150677 - RNA, 17 nt, Yersinia pestis
auucuuaggucaucguc

SEQ ID NO: 4150678 - RNA, 18 nt, Yersinia pestis
auucuuaucaaucaaaaa

SEQ ID NO: 4150679 - RNA, 19 nt, Yersinia pestis
auucuuaucaaucaaaaaa

SEQ ID NO: 4150680 - RNA, 13 nt, Yersinia pestis
auucuucaucuag

SEQ ID NO: 4150681 - RNA, 23 nt, Yersinia pestis
auucuucguugccccaucagcac

SEQ ID NO: 4150682 - RNA, 16 nt, Yersinia pestis
auucuucuaugcucac

SEQ ID NO: 4150683 - RNA, 21 nt, Yersinia pestis
auucuuugguccucuuauggu

SEQ ID NO: 4150684 - RNA, 15 nt, Yersinia pestis
auucuuuuuguuaaa

SEQ ID NO: 4150685 - RNA, 22 nt, Yersinia pestis
auugaaaaucaguuuacaugau

SEQ ID NO: 4150686 - RNA, 14 nt, Yersinia pestis
auugaaaccgcuga

SEQ ID NO: 4150687 - RNA, 21 nt, Yersinia pestis
auugaagauacccuucucuuu

SEQ ID NO: 4150688 - RNA, 19 nt, Yersinia pestis
auugaagauuuaaauaaca

SEQ ID NO: 4150689 - RNA, 20 nt, Yersinia pestis
auugaagggcaaaacgugaa

SEQ ID NO: 4150690 - RNA, 15 nt, Yersinia pestis
auugaagugauauag

SEQ ID NO: 4150691 - RNA, 20 nt, Yersinia pestis
auugaagugauauagaaagc

SEQ ID NO: 4150692 - RNA, 13 nt, Yersinia pestis
auugaauaacuuc

SEQ ID NO: 4150693 - RNA, 14 nt, Yersinia pestis
auugacaaagugcc

SEQ ID NO: 4150694 - RNA, 15 nt, Yersinia pestis
auugaccaauaaaau

SEQ ID NO: 4150695 - RNA, 17 nt, Yersinia pestis
auugaccaauaaaaugc

SEQ ID NO: 4150696 - RNA, 12 nt, Yersinia pestis
auugaccacuug

SEQ ID NO: 4150697 - RNA, 17 nt, Yersinia pestis
auugaccagauagcugu

SEQ ID NO: 4150698 - RNA, 13 nt, Yersinia pestis
auugacuuuaaaa

SEQ ID NO: 4150699 - RNA, 16 nt, Yersinia pestis
auugacuuuaaaaaaa

SEQ ID NO: 4150700 - RNA, 22 nt, Yersinia pestis
auugagaagaaaucauuuaggc

SEQ ID NO: 4150701 - RNA, 17 nt, Yersinia pestis
auugagagaccagggca

SEQ ID NO: 4150702 - RNA, 19 nt, Yersinia pestis
auugagaucauauuguuaa

SEQ ID NO: 4150703 - RNA, 16 nt, Yersinia pestis
auugagcauaucaauc

SEQ ID NO: 4150704 - RNA, 16 nt, Yersinia pestis
auugagcauauucagu

SEQ ID NO: 4150705 - RNA, 19 nt, Yersinia pestis
auugagcauauucaguaac

SEQ ID NO: 4150706 - RNA, 13 nt, Yersinia pestis
auugaggugguaa

SEQ ID NO: 4150707 - RNA, 15 nt, Yersinia pestis
auugagguugccggu

SEQ ID NO: 4150708 - RNA, 21 nt, Yersinia pestis
auugagguugccgguaaugau

SEQ ID NO: 4150709 - RNA, 16 nt, Yersinia pestis
auugaguaacauuaau

SEQ ID NO: 4150710 - RNA, 17 nt, Yersinia pestis
auugaguaacugauuaa

SEQ ID NO: 4150711 - RNA, 14 nt, Yersinia pestis
auugauaaaaccac

SEQ ID NO: 4150712 - RNA, 21 nt, Yersinia pestis
auugauaaaaguaauuuauca

SEQ ID NO: 4150713 - RNA, 19 nt, Yersinia pestis
auugauaaaaucaccgccg

SEQ ID NO: 4150714 - RNA, 13 nt, Yersinia pestis
auugauaccacaa

SEQ ID NO: 4150715 - RNA, 15 nt, Yersinia pestis
auugaucauucucug

SEQ ID NO: 4150716 - RNA, 18 nt, Yersinia pestis
auugauccccaaauacug

SEQ ID NO: 4150717 - RNA, 18 nt, Yersinia pestis
auugaugacgcuaaccac

SEQ ID NO: 4150718 - RNA, 17 nt, Yersinia pestis
auugaugagucagucug

SEQ ID NO: 4150719 - RNA, 19 nt, Yersinia pestis
auugauggccuugaaucaa

SEQ ID NO: 4150720 - RNA, 18 nt, Yersinia pestis
auugaugucaauuaaaaa

SEQ ID NO: 4150721 - RNA, 19 nt, Yersinia pestis
auugaugucaauuaaaaac

SEQ ID NO: 4150722 - RNA, 22 nt, Yersinia pestis
auugaugugaaacauaauuaaa

SEQ ID NO: 4150723 - RNA, 23 nt, Yersinia pestis
auugauuaauuuuucauaauaau

SEQ ID NO: 4150724 - RNA, 15 nt, Yersinia pestis
auugcacaauagcua

SEQ ID NO: 4150725 - RNA, 15 nt, Yersinia pestis
auugcagagcaaaac

SEQ ID NO: 4150726 - RNA, 19 nt, Yersinia pestis
auugcagagcaaaacuggg

SEQ ID NO: 4150727 - RNA, 11 nt, Yersinia pestis
auugcagauac

SEQ ID NO: 4150728 - RNA, 18 nt, Yersinia pestis
auugcaggaaguuaugga

SEQ ID NO: 4150729 - RNA, 21 nt, Yersinia pestis
auugcaggauaauagugucau

SEQ ID NO: 4150730 - RNA, 22 nt, Yersinia pestis
auugcaucgucaugauugagau

SEQ ID NO: 4150731 - RNA, 18 nt, Yersinia pestis
auugccaaaugcaaacca

SEQ ID NO: 4150732 - RNA, 14 nt, Yersinia pestis
auugccacggcauu

SEQ ID NO: 4150733 - RNA, 18 nt, Yersinia pestis
auugccagaacaagacug

SEQ ID NO: 4150734 - RNA, 22 nt, Yersinia pestis
auugccaucgggcaauugaaaa

SEQ ID NO: 4150735 - RNA, 17 nt, Yersinia pestis
auugcccaucaugccag

SEQ ID NO: 4150736 - RNA, 20 nt, Yersinia pestis
auugcccccucccgauacuc

SEQ ID NO: 4150737 - RNA, 13 nt, Yersinia pestis
auuuauuccucuc

SEQ ID NO: 4150738 - RNA, 21 nt, Yersinia pestis
auuuauugcggcuuagccacu

SEQ ID NO: 4150739 - RNA, 16 nt, Yersinia pestis
auuuauuggucaauaa

SEQ ID NO: 4150740 - RNA, 18 nt, Yersinia pestis
auuuauuggucaauaaaa

SEQ ID NO: 4150741 - RNA, 20 nt, Yersinia pestis
auuuauuggucaauaaaauu

SEQ ID NO: 4150742 - RNA, 21 nt, Yersinia pestis
auuuauuguuaucaaaucagg

SEQ ID NO: 4150743 - RNA, 16 nt, Yersinia pestis
auuuauuuacucuuuu

SEQ ID NO: 4150744 - RNA, 18 nt, Yersinia pestis
auuuauuuauaaaaccac

SEQ ID NO: 4150745 - RNA, 16 nt, Yersinia pestis
auuuauuuccagauca

SEQ ID NO: 4150746 - RNA, 20 nt, Yersinia pestis
auuuauuuccgaauuaaaaa

SEQ ID NO: 4150747 - RNA, 23 nt, Yersinia pestis
auuuauuuccgcugacuuaaggc

SEQ ID NO: 4150748 - RNA, 13 nt, Yersinia pestis
auuuauuugauaa

SEQ ID NO: 4150749 - RNA, 20 nt, Yersinia pestis
auuuauuuuauaaugagaau

SEQ ID NO: 4150750 - RNA, 13 nt, Yersinia pestis
auuuauuuucauu

SEQ ID NO: 4150751 - RNA, 13 nt, Yersinia pestis
auuuauuuucccc

SEQ ID NO: 4150752 - RNA, 22 nt, Yersinia pestis
auuuauuuuuaugguuuuuaac

SEQ ID NO: 4150753 - RNA, 19 nt, Yersinia pestis
auuuauuuuuuguuuuuau

SEQ ID NO: 4150754 - RNA, 15 nt, Yersinia pestis
auuucaaaaaagccc

SEQ ID NO: 4150755 - RNA, 13 nt, Yersinia pestis
auuucaaacuccg

SEQ ID NO: 4150756 - RNA, 18 nt, Yersinia pestis
auuucaaaguaaaauaaa

SEQ ID NO: 4150757 - RNA, 21 nt, Yersinia pestis
auuucaacgcaccauccagca

SEQ ID NO: 4150758 - RNA, 22 nt, Yersinia pestis
auuucaacgcaccauccagcaa

SEQ ID NO: 4150759 - RNA, 19 nt, Yersinia pestis
auuucaauucucccauuua

SEQ ID NO: 4150760 - RNA, 14 nt, Yersinia pestis
auuucacacuguuu

SEQ ID NO: 4150761 - RNA, 12 nt, Yersinia pestis
auuucacccucu

SEQ ID NO: 4150762 - RNA, 18 nt, Yersinia pestis
auuucaccuauaauuaac

SEQ ID NO: 4150763 - RNA, 20 nt, Yersinia pestis
auuucaccuauaauuaacag

SEQ ID NO: 4150764 - RNA, 17 nt, Yersinia pestis
auuucacgcuaauuauu

SEQ ID NO: 4150765 - RNA, 21 nt, Yersinia pestis
auuucacgcugguuaagcauu

SEQ ID NO: 4150766 - RNA, 13 nt, Yersinia pestis
auuucacuggaaa

SEQ ID NO: 4150767 - RNA, 18 nt, Yersinia pestis
auuucacuggaaaaagug

SEQ ID NO: 4150768 - RNA, 23 nt, Yersinia pestis
auuucacuggccuauuaagauaa

SEQ ID NO: 4150769 - RNA, 19 nt, Yersinia pestis
auuucacugugcuuuucuu

SEQ ID NO: 4150770 - RNA, 16 nt, Yersinia pestis
auuucacuuccauucc

SEQ ID NO: 4150771 - RNA, 12 nt, Yersinia pestis
auuucacuuucc

SEQ ID NO: 4150772 - RNA, 13 nt, Yersinia pestis
auuucacuuuccc

SEQ ID NO: 4150773 - RNA, 15 nt, Yersinia pestis
auuucacuuucccgg

SEQ ID NO: 4150774 - RNA, 13 nt, Yersinia pestis
auuucagacugcu

SEQ ID NO: 4150775 - RNA, 19 nt, Yersinia pestis
auuucagacugcugacaac

SEQ ID NO: 4150776 - RNA, 21 nt, Yersinia pestis
auuucagaguaagucuuuccu

SEQ ID NO: 4150777 - RNA, 19 nt, Yersinia pestis
auuucagcaccauaaauuu

SEQ ID NO: 4150778 - RNA, 13 nt, Yersinia pestis
auuucagcagcac

SEQ ID NO: 4150779 - RNA, 15 nt, Yersinia pestis
auuucagccaugggc

SEQ ID NO: 4150780 - RNA, 11 nt, Yersinia pestis
auuucagggcg

SEQ ID NO: 4150781 - RNA, 17 nt, Yersinia pestis
auuucaguaaucguuua

SEQ ID NO: 4150782 - RNA, 17 nt, Yersinia pestis
auuucaguagcaaauaa

SEQ ID NO: 4150783 - RNA, 15 nt, Yersinia pestis
auuucagucaauaaa

SEQ ID NO: 4150784 - RNA, 14 nt, Yersinia pestis
auuucaguuuuucc

SEQ ID NO: 4150785 - RNA, 19 nt, Yersinia pestis
auuucaucggcaaaaacag

SEQ ID NO: 4150786 - RNA, 24 nt, Yersinia pestis
auuucaucggcaaaaacagucauu

SEQ ID NO: 4150787 - RNA, 14 nt, Yersinia pestis
auuucaucuugauu

SEQ ID NO: 4150788 - RNA, 20 nt, Yersinia pestis
auuucaugauucucuauucu

SEQ ID NO: 4150789 - RNA, 12 nt, Yersinia pestis
auuuccacaauc

SEQ ID NO: 4150790 - RNA, 13 nt, Yersinia pestis
auuuccaucaaaa

SEQ ID NO: 4150791 - RNA, 14 nt, Yersinia pestis
auuuccaucugcaa

SEQ ID NO: 4150792 - RNA, 23 nt, Yersinia pestis
auuuccaucugcaauaacgugau

SEQ ID NO: 4150793 - RNA, 11 nt, Yersinia pestis
auuuccgaaag

SEQ ID NO: 4150794 - RNA, 22 nt, Yersinia pestis
auuuccgccccuugcuucaguu

SEQ ID NO: 4150795 - RNA, 23 nt, Yersinia pestis
auuuccgguaacugacgcagcgu

SEQ ID NO: 4150796 - RNA, 16 nt, Yersinia pestis
auuuccguuaacccaa

SEQ ID NO: 4150797 - RNA, 17 nt, Yersinia pestis
auuuccguuaacccaaa

SEQ ID NO: 4150798 - RNA, 20 nt, Yersinia pestis
auuuccuaugugauauuuua

SEQ ID NO: 4150799 - RNA, 21 nt, Yersinia pestis
auuuccuaugugauauuuuac

SEQ ID NO: 4150800 - RNA, 21 nt, Yersinia pestis
auuuccuccgcuuuagcugua

SEQ ID NO: 4150801 - RNA, 21 nt, Yersinia pestis
auuuccuuguggauccagcac

SEQ ID NO: 4150802 - RNA, 22 nt, Yersinia pestis
auuuccuuguggauccagcacc

SEQ ID NO: 4150803 - RNA, 21 nt, Yersinia pestis
auuuccuuucgcacuuuaaau

SEQ ID NO: 4150804 - RNA, 23 nt, Yersinia pestis
auuuccuuucgcacuuuaaauac

SEQ ID NO: 4150805 - RNA, 14 nt, Yersinia pestis
auuucgaaaacuca

SEQ ID NO: 4150806 - RNA, 14 nt, Yersinia pestis
auuucgaagcaguc

SEQ ID NO: 4150807 - RNA, 21 nt, Yersinia pestis
auuucgacggcgggguuuuca

SEQ ID NO: 4150808 - RNA, 13 nt, Yersinia pestis
auuucgcccugca

SEQ ID NO: 4150809 - RNA, 22 nt, Yersinia pestis
auuucgccguauuuguauuuac

SEQ ID NO: 4150810 - RNA, 17 nt, Yersinia pestis
auuucgccuuucauaca

SEQ ID NO: 4150811 - RNA, 15 nt, Yersinia pestis
auuucggcuauuuca

SEQ ID NO: 4150812 - RNA, 17 nt, Yersinia pestis
auuucgugauuuucuuu

SEQ ID NO: 4150813 - RNA, 16 nt, Yersinia pestis
auuucuccauugcggu

SEQ ID NO: 4150814 - RNA, 18 nt, Yersinia pestis
auuucugcuucuacccug

SEQ ID NO: 4150815 - RNA, 14 nt, Yersinia pestis
auuucugguuugaa

SEQ ID NO: 4150816 - RNA, 20 nt, Yersinia pestis
auuucugguuugaauccagu

SEQ ID NO: 4150817 - RNA, 16 nt, Yersinia pestis
auuucuguuaccagaa

SEQ ID NO: 4150818 - RNA, 23 nt, Yersinia pestis
auuucuguuaccagaaaaccuuc

SEQ ID NO: 4150819 - RNA, 13 nt, Yersinia pestis
auuucuuauauua

SEQ ID NO: 4150820 - RNA, 22 nt, Yersinia pestis
auuucuucuagcucuuccagca

SEQ ID NO: 4150821 - RNA, 20 nt, Yersinia pestis
auuucuugaugucggguggu

SEQ ID NO: 4150822 - RNA, 20 nt, Yersinia pestis
auuucuuuaaggaucuuuca

SEQ ID NO: 4150823 - RNA, 14 nt, Yersinia pestis
auuucuuuuuaugu

SEQ ID NO: 4150824 - RNA, 22 nt, Yersinia pestis
auuugaaacacuuauuugaaau

SEQ ID NO: 4150825 - RNA, 11 nt, Yersinia pestis
auuugaaacag

SEQ ID NO: 4150826 - RNA, 21 nt, Yersinia pestis
auuugaacgugccccaaugau

SEQ ID NO: 4150827 - RNA, 16 nt, Yersinia pestis
auuugaacuucaaauc

SEQ ID NO: 4150828 - RNA, 20 nt, Yersinia pestis
auuugaagacaacucuucua

SEQ ID NO: 4150829 - RNA, 19 nt, Yersinia pestis
auuugacauggauugugaa

SEQ ID NO: 4150830 - RNA, 14 nt, Yersinia pestis
auuugacauuuccu

SEQ ID NO: 4150831 - RNA, 20 nt, Yersinia pestis
auuugaccuccguaggccaa

SEQ ID NO: 4150832 - RNA, 18 nt, Yersinia pestis
auuugacgcuguauaccc

SEQ ID NO: 4150833 - RNA, 19 nt, Yersinia pestis
auuugacgcuguauacccg

SEQ ID NO: 4150834 - RNA, 23 nt, Yersinia pestis
auuugacgcuguauacccgccgc

SEQ ID NO: 4150835 - RNA, 23 nt, Yersinia pestis
auuugagaccgcacgaguugccg

SEQ ID NO: 4150836 - RNA, 22 nt, Yersinia pestis
auuugagcagguguaaauuuca

SEQ ID NO: 4150837 - RNA, 17 nt, Yersinia pestis
auuugauauuagccaag

SEQ ID NO: 4150838 - RNA, 15 nt, Yersinia pestis
auuugaucaccaauc

SEQ ID NO: 4150839 - RNA, 15 nt, Yersinia pestis
auuugcacauagccc

SEQ ID NO: 4150840 - RNA, 11 nt, Yersinia pestis
auuugcagcgg

SEQ ID NO: 4150841 - RNA, 20 nt, Yersinia pestis
auuugcagcggaugauaaau

SEQ ID NO: 4150842 - RNA, 19 nt, Yersinia pestis
auuugcccgaaucacuggu

SEQ ID NO: 4150843 - RNA, 14 nt, Yersinia pestis
auuugccguauuca

SEQ ID NO: 4150844 - RNA, 14 nt, Yersinia pestis
auuugcgcccgcgc

SEQ ID NO: 4150845 - RNA, 20 nt, Yersinia pestis
auuugcggcaugauagacgc

SEQ ID NO: 4150846 - RNA, 22 nt, Yersinia pestis
auuuggagguguauuuuuaugg

SEQ ID NO: 4150847 - RNA, 20 nt, Yersinia pestis
auuuggcuaaugguuuuuau

SEQ ID NO: 4150848 - RNA, 20 nt, Yersinia pestis
auuugggguauaacgaucag

SEQ ID NO: 4150849 - RNA, 21 nt, Yersinia pestis
auuuggucugcguauggggau

SEQ ID NO: 4150850 - RNA, 21 nt, Yersinia pestis
auuuggugguugaaauaacug

SEQ ID NO: 4150851 - RNA, 17 nt, Yersinia pestis
auuugguuggcuuuaac

SEQ ID NO: 4150852 - RNA, 19 nt, Yersinia pestis
auuuguggugguugcagug

SEQ ID NO: 4150853 - RNA, 18 nt, Yersinia pestis
auuugugucgggauuuuu

SEQ ID NO: 4150854 - RNA, 23 nt, Yersinia pestis
auuuguuuuugaaucauaauggu

SEQ ID NO: 4150855 - RNA, 18 nt, Yersinia pestis
auuuuaaucucuccauga

SEQ ID NO: 4150856 - RNA, 16 nt, Yersinia pestis
auuuuaauuauaaucc

SEQ ID NO: 4150857 - RNA, 14 nt, Yersinia pestis
auuuuacugaugaa

SEQ ID NO: 4150858 - RNA, 17 nt, Yersinia pestis
caaaccccgaugacuca

SEQ ID NO: 4150859 - RNA, 16 nt, Yersinia pestis
caaacccggugcauug

SEQ ID NO: 4150860 - RNA, 16 nt, Yersinia pestis
caaacccuaauaccaa

SEQ ID NO: 4150861 - RNA, 20 nt, Yersinia pestis
caaaccgcuggugacggcuu

SEQ ID NO: 4150862 - RNA, 16 nt, Yersinia pestis
caaaccguugcucagc

SEQ ID NO: 4150863 - RNA, 14 nt, Yersinia pestis
caaacgcacaacaa

SEQ ID NO: 4150864 - RNA, 22 nt, Yersinia pestis
caaacgccucguuuaacucaaa

SEQ ID NO: 4150865 - RNA, 20 nt, Yersinia pestis
caaacgcugauuaaccugua

SEQ ID NO: 4150866 - RNA, 23 nt, Yersinia pestis
caaacggcgcgucgccauaacca

SEQ ID NO: 4150867 - RNA, 16 nt, Yersinia pestis
caaacggugugcaaug

SEQ ID NO: 4150868 - RNA, 17 nt, Yersinia pestis
caaacggugugcaaugc

SEQ ID NO: 4150869 - RNA, 15 nt, Yersinia pestis
caaacguauugguaa

SEQ ID NO: 4150870 - RNA, 16 nt, Yersinia pestis
caaacguauugguaac

SEQ ID NO: 4150871 - RNA, 17 nt, Yersinia pestis
caaacgugcuacuuaau

SEQ ID NO: 4150872 - RNA, 23 nt, Yersinia pestis
caaacucagcgaauaaauaauug

SEQ ID NO: 4150873 - RNA, 21 nt, Yersinia pestis
caaacucaugcucuucauaag

SEQ ID NO: 4150874 - RNA, 14 nt, Yersinia pestis
caaacucuggaugg

SEQ ID NO: 4150875 - RNA, 15 nt, Yersinia pestis
caaacuggcccagcu

SEQ ID NO: 4150876 - RNA, 22 nt, Yersinia pestis
caaacuguuuuuuaaagaaaaa

SEQ ID NO: 4150877 - RNA, 13 nt, Yersinia pestis
caaacuuaaaaau

SEQ ID NO: 4150878 - RNA, 14 nt, Yersinia pestis
caaacuuaaaaauc

SEQ ID NO: 4150879 - RNA, 16 nt, Yersinia pestis
caaacuugagucagca

SEQ ID NO: 4150880 - RNA, 15 nt, Yersinia pestis
caaacuuuguggaua

SEQ ID NO: 4150881 - RNA, 22 nt, Yersinia pestis
caaagaauugagguaaaccaag

SEQ ID NO: 4150882 - RNA, 23 nt, Yersinia pestis
caaagaauugagguaaaccaagu

SEQ ID NO: 4150883 - RNA, 24 nt, Yersinia pestis
caaagacuaaccucugcaaugccc

SEQ ID NO: 4150884 - RNA, 20 nt, Yersinia pestis
caaagacuuuauucacagca

SEQ ID NO: 4150885 - RNA, 21 nt, Yersinia pestis
caaagagaacgggcaaccugu

SEQ ID NO: 4150886 - RNA, 22 nt, Yersinia pestis
caaagagaacgggcaaccugua

SEQ ID NO: 4150887 - RNA, 17 nt, Yersinia pestis
caaagagucgcaaaacu

SEQ ID NO: 4150888 - RNA, 22 nt, Yersinia pestis
caaagauagacauauuguccaa

SEQ ID NO: 4150889 - RNA, 16 nt, Yersinia pestis
caaagauuggcagcgu

SEQ ID NO: 4150890 - RNA, 23 nt, Yersinia pestis
caaagauuucaucggcaaaaaca

SEQ ID NO: 4150891 - RNA, 17 nt, Yersinia pestis
caaagcagcguuuuuag

SEQ ID NO: 4150892 - RNA, 19 nt, Yersinia pestis
caaagcauucgcgguuaca

SEQ ID NO: 4150893 - RNA, 13 nt, Yersinia pestis
caaagcccaaaaa

SEQ ID NO: 4150894 - RNA, 20 nt, Yersinia pestis
caaagcccggaaacguccag

SEQ ID NO: 4150895 - RNA, 16 nt, Yersinia pestis
caaagccgcugcucac

SEQ ID NO: 4150896 - RNA, 22 nt, Yersinia pestis
caaagccgcugcucacauagcg

SEQ ID NO: 4150897 - RNA, 14 nt, Yersinia pestis
caaagccgucaguu

SEQ ID NO: 4150898 - RNA, 21 nt, Yersinia pestis
caaagcgcguaucguccagca

SEQ ID NO: 4150899 - RNA, 22 nt, Yersinia pestis
caaagcgcguaucguccagcag

SEQ ID NO: 4150900 - RNA, 23 nt, Yersinia pestis
caaagcgcguaucguccagcagc

SEQ ID NO: 4150901 - RNA, 15 nt, Yersinia pestis
caaagcgcucagcgc

SEQ ID NO: 4150902 - RNA, 13 nt, Yersinia pestis
caaagcuauuuuu

SEQ ID NO: 4150903 - RNA, 11 nt, Yersinia pestis
caaagcuucca

SEQ ID NO: 4150904 - RNA, 16 nt, Yersinia pestis
caaaggaagccgagcu

SEQ ID NO: 4150905 - RNA, 15 nt, Yersinia pestis
caaaggcccaaguau

SEQ ID NO: 4150906 - RNA, 17 nt, Yersinia pestis
caaagguuucacaugug

SEQ ID NO: 4150907 - RNA, 21 nt, Yersinia pestis
caaagguuucacaugugcaau

SEQ ID NO: 4150908 - RNA, 18 nt, Yersinia pestis
caaaguaaggugccgcuu

SEQ ID NO: 4150909 - RNA, 20 nt, Yersinia pestis
caaaguaaggugccgcuugu

SEQ ID NO: 4150910 - RNA, 17 nt, Yersinia pestis
caaaguaugggaaagua

SEQ ID NO: 4150911 - RNA, 22 nt, Yersinia pestis
caaagucaucgggguugcaguu

SEQ ID NO: 4150912 - RNA, 19 nt, Yersinia pestis
caaaguggcauaaccaauc

SEQ ID NO: 4150913 - RNA, 20 nt, Yersinia pestis
caaaguggcauaaccaauca

SEQ ID NO: 4150914 - RNA, 15 nt, Yersinia pestis
caaaguuaaaugaag

SEQ ID NO: 4150915 - RNA, 17 nt, Yersinia pestis
caaaguugaguauuucu

SEQ ID NO: 4150916 - RNA, 13 nt, Yersinia pestis
caaauaaacaaaa

SEQ ID NO: 4150917 - RNA, 19 nt, Yersinia pestis
caaauaaggcguuuaauuc

SEQ ID NO: 4150918 - RNA, 23 nt, Yersinia pestis
caaauaaguacuuccaauaagug

SEQ ID NO: 4150919 - RNA, 18 nt, Yersinia pestis
caaauaaguauuucaaau

SEQ ID NO: 4150920 - RNA, 23 nt, Yersinia pestis
caaauaaguauuucaaauaagug

SEQ ID NO: 4150921 - RNA, 18 nt, Yersinia pestis
caaauaaguguuucaaau

SEQ ID NO: 4150922 - RNA, 23 nt, Yersinia pestis
caaauaaguguuucaaauaagua

SEQ ID NO: 4150923 - RNA, 21 nt, Yersinia pestis
caaauaaucagcucauuaaac

SEQ ID NO: 4150924 - RNA, 22 nt, Yersinia pestis
caaauacaaaccguuugccguu

SEQ ID NO: 4150925 - RNA, 23 nt, Yersinia pestis
caaauacauauaaccaucaaaua

SEQ ID NO: 4150926 - RNA, 23 nt, Yersinia pestis
caaauacgaccgucaccaaauag

SEQ ID NO: 4150927 - RNA, 16 nt, Yersinia pestis
caaauacggcgaaaua

SEQ ID NO: 4150928 - RNA, 20 nt, Yersinia pestis
caaauacggcgaaauauaaa

SEQ ID NO: 4150929 - RNA, 18 nt, Yersinia pestis
caaauagauagcaaucaa

SEQ ID NO: 4150930 - RNA, 20 nt, Yersinia pestis
caaauagauagcaaucaaua

SEQ ID NO: 4150931 - RNA, 22 nt, Yersinia pestis
caaauagcgcugcagcaucaag

SEQ ID NO: 4150932 - RNA, 20 nt, Yersinia pestis
caaauagcuggcauccucag

SEQ ID NO: 4150933 - RNA, 15 nt, Yersinia pestis
caaauagguuuuacu

SEQ ID NO: 4150934 - RNA, 14 nt, Yersinia pestis
caaauaguaauaau

SEQ ID NO: 4150935 - RNA, 16 nt, Yersinia pestis
caaauaguaauaauua

SEQ ID NO: 4150936 - RNA, 16 nt, Yersinia pestis
caaauauagcauguac

SEQ ID NO: 4150937 - RNA, 18 nt, Yersinia pestis
caaauaucauuauuuuga

SEQ ID NO: 4150938 - RNA, 20 nt, Yersinia pestis
caaauauuaccguuaucaaa

SEQ ID NO: 4150939 - RNA, 18 nt, Yersinia pestis
caaauauugaauuaaagu

SEQ ID NO: 4150940 - RNA, 19 nt, Yersinia pestis
caaauauugcacaauagcu

SEQ ID NO: 4150941 - RNA, 17 nt, Yersinia pestis
caaaucacauuucaaau

SEQ ID NO: 4150942 - RNA, 18 nt, Yersinia pestis
caaaucagcaagcugcuc

SEQ ID NO: 4150943 - RNA, 21 nt, Yersinia pestis
caaaucagcaagcugcucaau

SEQ ID NO: 4150944 - RNA, 19 nt, Yersinia pestis
caaaucaucaucuugaaaa

SEQ ID NO: 4150945 - RNA, 14 nt, Yersinia pestis
caaaucauuuaauu

SEQ ID NO: 4150946 - RNA, 17 nt, Yersinia pestis
caaaucauuuaauuuau

SEQ ID NO: 4150947 - RNA, 18 nt, Yersinia pestis
caaaucauuuaauuuauc

SEQ ID NO: 4150948 - RNA, 22 nt, Yersinia pestis
caaaucccguuccgcuuccccu

SEQ ID NO: 4150949 - RNA, 21 nt, Yersinia pestis
caaauccucggguuuuauacc

SEQ ID NO: 4150950 - RNA, 20 nt, Yersinia pestis
caaauccuguagcucagccu

SEQ ID NO: 4150951 - RNA, 20 nt, Yersinia pestis
caaaucgccaaacugcucau

SEQ ID NO: 4150952 - RNA, 20 nt, Yersinia pestis
caaaucugcccccagcgugc

SEQ ID NO: 4150953 - RNA, 11 nt, Yersinia pestis
caaaugaaaaa

SEQ ID NO: 4150954 - RNA, 14 nt, Yersinia pestis
caaaugacacuuuu

SEQ ID NO: 4150955 - RNA, 21 nt, Yersinia pestis
caaaugcugacugaacgccuc

SEQ ID NO: 4150956 - RNA, 22 nt, Yersinia pestis
caaauggaauaaaaagucagcu

SEQ ID NO: 4150957 - RNA, 23 nt, Yersinia pestis
caaaugggucgggaaucauuuga

SEQ ID NO: 4150958 - RNA, 13 nt, Yersinia pestis
caaauguuggaua

SEQ ID NO: 4150959 - RNA, 14 nt, Yersinia pestis
caaauuaaccugcu

SEQ ID NO: 4150960 - RNA, 17 nt, Yersinia pestis
caaauuaaguaagccgc

SEQ ID NO: 4150961 - RNA, 15 nt, Yersinia pestis
caaauuaaucuugua

SEQ ID NO: 4150962 - RNA, 16 nt, Yersinia pestis
caaauuaccaccaccu

SEQ ID NO: 4150963 - RNA, 19 nt, Yersinia pestis
caaauuaccaccaccucca

SEQ ID NO: 4150964 - RNA, 22 nt, Yersinia pestis
caaauuaccaccaccuccacag

SEQ ID NO: 4150965 - RNA, 14 nt, Yersinia pestis
caaauuacuuuaaa

SEQ ID NO: 4150966 - RNA, 13 nt, Yersinia pestis
caaauuagcaggg

SEQ ID NO: 4150967 - RNA, 23 nt, Yersinia pestis
caaauuccgcuucucagucgcga

SEQ ID NO: 4150968 - RNA, 21 nt, Yersinia pestis
caaauucucaaugauaaaauc

SEQ ID NO: 4150969 - RNA, 21 nt, Yersinia pestis
caaauugugaguuaaaaauaa

SEQ ID NO: 4150970 - RNA, 22 nt, Yersinia pestis
caaauuguggaaauaacgcggc

SEQ ID NO: 4150971 - RNA, 14 nt, Yersinia pestis
caaauuuaaaguuu

SEQ ID NO: 4150972 - RNA, 15 nt, Yersinia pestis
caaauuugacauuuc

SEQ ID NO: 4150973 - RNA, 14 nt, Yersinia pestis
caaauuuuuuauau

SEQ ID NO: 4150974 - RNA, 13 nt, Yersinia pestis
caacaaacagccg

SEQ ID NO: 4150975 - RNA, 23 nt, Yersinia pestis
caacaacgccgcaccggauuuau

SEQ ID NO: 4150976 - RNA, 18 nt, Yersinia pestis
caacaacgggucacagcc

SEQ ID NO: 4150977 - RNA, 21 nt, Yersinia pestis
caacaacgggucacagccacg

SEQ ID NO: 4150978 - RNA, 21 nt, Yersinia pestis
caacucccaaauauauucuau

SEQ ID NO: 4150979 - RNA, 17 nt, Yersinia pestis
caacuccuuaccacugc

SEQ ID NO: 4150980 - RNA, 18 nt, Yersinia pestis
caacuccuuaccacugcu

SEQ ID NO: 4150981 - RNA, 18 nt, Yersinia pestis
caacucgagcauuugacc

SEQ ID NO: 4150982 - RNA, 17 nt, Yersinia pestis
caacucgccacccgcuu

SEQ ID NO: 4150983 - RNA, 21 nt, Yersinia pestis
caacucuacauugacuaauua

SEQ ID NO: 4150984 - RNA, 23 nt, Yersinia pestis
caacugaaaauacuacucaaaaa

SEQ ID NO: 4150985 - RNA, 20 nt, Yersinia pestis
caacugacaacaucaaauga

SEQ ID NO: 4150986 - RNA, 13 nt, Yersinia pestis
caacugacugaag

SEQ ID NO: 4150987 - RNA, 15 nt, Yersinia pestis
caacugacugaaguu

SEQ ID NO: 4150988 - RNA, 16 nt, Yersinia pestis
caacugacugaaguua

SEQ ID NO: 4150989 - RNA, 17 nt, Yersinia pestis
caacugagcuaacgacc

SEQ ID NO: 4150990 - RNA, 20 nt, Yersinia pestis
caacugaggcaacauuuguu

SEQ ID NO: 4150991 - RNA, 11 nt, Yersinia pestis
caacugauaaa

SEQ ID NO: 4150992 - RNA, 19 nt, Yersinia pestis
caacugcucaacgccccgu

SEQ ID NO: 4150993 - RNA, 13 nt, Yersinia pestis
caacugcucaacu

SEQ ID NO: 4150994 - RNA, 15 nt, Yersinia pestis
caacugcucaacugc

SEQ ID NO: 4150995 - RNA, 18 nt, Yersinia pestis
caacugcucaacugcuca

SEQ ID NO: 4150996 - RNA, 19 nt, Yersinia pestis
caacugcucaacugcucaa

SEQ ID NO: 4150997 - RNA, 22 nt, Yersinia pestis
caacugcuggccaacugcgccu

SEQ ID NO: 4150998 - RNA, 20 nt, Yersinia pestis
caacuggguggccaguaacg

SEQ ID NO: 4150999 - RNA, 14 nt, Yersinia pestis
caacuguaaugccc

SEQ ID NO: 4151000 - RNA, 17 nt, Yersinia pestis
caacuguuuuauuggca

SEQ ID NO: 4151001 - RNA, 20 nt, Yersinia pestis
caacuuagcccuucagcggu

SEQ ID NO: 4151002 - RNA, 14 nt, Yersinia pestis
caacuucaagccga

SEQ ID NO: 4151003 - RNA, 20 nt, Yersinia pestis
caacuucaauaccaaauuua

SEQ ID NO: 4151004 - RNA, 17 nt, Yersinia pestis
caacuucaugacgaaaa

SEQ ID NO: 4151005 - RNA, 23 nt, Yersinia pestis
caacuucaugacgaaaaacaccu

SEQ ID NO: 4151006 - RNA, 17 nt, Yersinia pestis
caacuucuacauagaaa

SEQ ID NO: 4151007 - RNA, 14 nt, Yersinia pestis
caacuucuccugua

SEQ ID NO: 4151008 - RNA, 13 nt, Yersinia pestis
caacuugcuggca

SEQ ID NO: 4151009 - RNA, 15 nt, Yersinia pestis
caacuuggcaccuaa

SEQ ID NO: 4151010 - RNA, 21 nt, Yersinia pestis
caacuuucccagucauaaaua

SEQ ID NO: 4151011 - RNA, 22 nt, Yersinia pestis
caacuuucucuuuccucuucuc

SEQ ID NO: 4151012 - RNA, 21 nt, Yersinia pestis
caacuuuggcaaagucaucaa

SEQ ID NO: 4151013 - RNA, 14 nt, Yersinia pestis
caagaaaagcaccg

SEQ ID NO: 4151014 - RNA, 23 nt, Yersinia pestis
caagaaacgccccgauaaaccaa

SEQ ID NO: 4151015 - RNA, 22 nt, Yersinia pestis
caagaaacuucauuucagguaa

SEQ ID NO: 4151016 - RNA, 18 nt, Yersinia pestis
caagaaagaaaaauagac

SEQ ID NO: 4151017 - RNA, 19 nt, Yersinia pestis
caagaaagaaaaauagacu

SEQ ID NO: 4151018 - RNA, 18 nt, Yersinia pestis
caagaaauuuaaaaaccc

SEQ ID NO: 4151019 - RNA, 20 nt, Yersinia pestis
caagaacauuuccacaauca

SEQ ID NO: 4151020 - RNA, 23 nt, Yersinia pestis
caagaaccugucgcagaaaacag

SEQ ID NO: 4151021 - RNA, 15 nt, Yersinia pestis
caagaagauaacuuu

SEQ ID NO: 4151022 - RNA, 16 nt, Yersinia pestis
caagaagauaacuuuu

SEQ ID NO: 4151023 - RNA, 22 nt, Yersinia pestis
caagaagcgggcggccucugcu

SEQ ID NO: 4151024 - RNA, 22 nt, Yersinia pestis
caagaauauaauacgaaauacu

SEQ ID NO: 4151025 - RNA, 23 nt, Yersinia pestis
caagaaugucaugguuaaacuga

SEQ ID NO: 4151026 - RNA, 14 nt, Yersinia pestis
caagacagaacuua

SEQ ID NO: 4151027 - RNA, 15 nt, Yersinia pestis
caagaccugccaauu

SEQ ID NO: 4151028 - RNA, 17 nt, Yersinia pestis
caagacgauaucgacgc

SEQ ID NO: 4151029 - RNA, 19 nt, Yersinia pestis
caagacucaguaaauauaa

SEQ ID NO: 4151030 - RNA, 14 nt, Yersinia pestis
caagagcaauggcg

SEQ ID NO: 4151031 - RNA, 22 nt, Yersinia pestis
caagagugagucaucgggguuu

SEQ ID NO: 4151032 - RNA, 17 nt, Yersinia pestis
caagaucacaugacuga

SEQ ID NO: 4151033 - RNA, 13 nt, Yersinia pestis
caagaucccaagc

SEQ ID NO: 4151034 - RNA, 21 nt, Yersinia pestis
caagaucgcgucaucgggguu

SEQ ID NO: 4151035 - RNA, 22 nt, Yersinia pestis
caagaucgcgucaucgggguuu

SEQ ID NO: 4151036 - RNA, 14 nt, Yersinia pestis
caagaugauaaaua

SEQ ID NO: 4151037 - RNA, 15 nt, Yersinia pestis
caagaugcgugaaau

SEQ ID NO: 4151038 - RNA, 15 nt, Yersinia pestis
caagauggucauaaa

SEQ ID NO: 4151039 - RNA, 23 nt, Yersinia pestis
caagauugaugacucgauaguga

SEQ ID NO: 4151040 - RNA, 17 nt, Yersinia pestis
caagauugccaccuuca

SEQ ID NO: 4151041 - RNA, 18 nt, Yersinia pestis
caagauugccaccuucac

SEQ ID NO: 4151042 - RNA, 18 nt, Yersinia pestis
caagauuuuguagcccac

SEQ ID NO: 4151043 - RNA, 19 nt, Yersinia pestis
caagcaaccgcaaugccgc

SEQ ID NO: 4151044 - RNA, 20 nt, Yersinia pestis
caagcaaccuuguuuuaucg

SEQ ID NO: 4151045 - RNA, 13 nt, Yersinia pestis
caagcacacuggu

SEQ ID NO: 4151046 - RNA, 19 nt, Yersinia pestis
caagcauacguugccagcc

SEQ ID NO: 4151047 - RNA, 13 nt, Yersinia pestis
caagcauagaaga

SEQ ID NO: 4151048 - RNA, 18 nt, Yersinia pestis
caagcaucggaauccauu

SEQ ID NO: 4151049 - RNA, 16 nt, Yersinia pestis
caagccaaacaaauga

SEQ ID NO: 4151050 - RNA, 23 nt, Yersinia pestis
caagccaaauuaaguaagccgca

SEQ ID NO: 4151051 - RNA, 19 nt, Yersinia pestis
caagccaauauuacggccc

SEQ ID NO: 4151052 - RNA, 17 nt, Yersinia pestis
caagccaccgcuggugg

SEQ ID NO: 4151053 - RNA, 14 nt, Yersinia pestis
caagccaguaacua

SEQ ID NO: 4151054 - RNA, 15 nt, Yersinia pestis
caagccagugcggga

SEQ ID NO: 4151055 - RNA, 16 nt, Yersinia pestis
caagcccgauugccug

SEQ ID NO: 4151056 - RNA, 17 nt, Yersinia pestis
caagcccuuuggcaauc

SEQ ID NO: 4151057 - RNA, 22 nt, Yersinia pestis
caagccgauaaucccugccaga

SEQ ID NO: 4151058 - RNA, 18 nt, Yersinia pestis
caagccgcguuccaaucu

SEQ ID NO: 4151059 - RNA, 18 nt, Yersinia pestis
caagccguggauauccac

SEQ ID NO: 4151060 - RNA, 17 nt, Yersinia pestis
caagccucgcugagucu

SEQ ID NO: 4151061 - RNA, 22 nt, Yersinia pestis
caagcgacccggcugcacgcca

SEQ ID NO: 4151062 - RNA, 14 nt, Yersinia pestis
caagcgcuguuaac

SEQ ID NO: 4151063 - RNA, 23 nt, Yersinia pestis
caagcggcuggcccccaaugaca

SEQ ID NO: 4151064 - RNA, 24 nt, Yersinia pestis
caagcguucgaggauaucacucug

SEQ ID NO: 4151065 - RNA, 23 nt, Yersinia pestis
caagcuacggccuguaccaccac

SEQ ID NO: 4151066 - RNA, 20 nt, Yersinia pestis
caagcucucacccaauaaga

SEQ ID NO: 4151067 - RNA, 13 nt, Yersinia pestis
caagcugcucaau

SEQ ID NO: 4151068 - RNA, 14 nt, Yersinia pestis
caagcugugccuga

SEQ ID NO: 4151069 - RNA, 15 nt, Yersinia pestis
caagcugugccugag

SEQ ID NO: 4151070 - RNA, 22 nt, Yersinia pestis
caagcuuaguauccgcgccaga

SEQ ID NO: 4151071 - RNA, 23 nt, Yersinia pestis
caagcuuaguauccgcgccagac

SEQ ID NO: 4151072 - RNA, 16 nt, Yersinia pestis
caaggaaggcuauuuu

SEQ ID NO: 4151073 - RNA, 17 nt, Yersinia pestis
caaggacgaaggguaaa

SEQ ID NO: 4151074 - RNA, 23 nt, Yersinia pestis
caaggagaucgcucucacccugc

SEQ ID NO: 4151075 - RNA, 17 nt, Yersinia pestis
caaggauggggcugcca

SEQ ID NO: 4151076 - RNA, 15 nt, Yersinia pestis
caaggccgaucaaca

SEQ ID NO: 4151077 - RNA, 20 nt, Yersinia pestis
caaggccgaucaacaggcca

SEQ ID NO: 4151078 - RNA, 21 nt, Yersinia pestis
caaggccgaucaacaggccac

SEQ ID NO: 4151079 - RNA, 12 nt, Yersinia pestis
caaggcggaugu

SEQ ID NO: 4151080 - RNA, 17 nt, Yersinia pestis
caaggcguacaucucuu

SEQ ID NO: 4151081 - RNA, 16 nt, Yersinia pestis
caagguaaugguaaaa

SEQ ID NO: 4151082 - RNA, 15 nt, Yersinia pestis
caagguacugauaau

SEQ ID NO: 4151083 - RNA, 15 nt, Yersinia pestis
caaggucgcaaccag

SEQ ID NO: 4151084 - RNA, 21 nt, Yersinia pestis
caaggugccauaaauaccaau

SEQ ID NO: 4151085 - RNA, 24 nt, Yersinia pestis
caagguucgaaaaaacaucacacu

SEQ ID NO: 4151086 - RNA, 15 nt, Yersinia pestis
caaguaaaagucagc

SEQ ID NO: 4151087 - RNA, 19 nt, Yersinia pestis
caaguaauaaaaacacaau

SEQ ID NO: 4151088 - RNA, 15 nt, Yersinia pestis
caaguacaaggggca

SEQ ID NO: 4151089 - RNA, 17 nt, Yersinia pestis
caagucagugauucggg

SEQ ID NO: 4151090 - RNA, 15 nt, Yersinia pestis
caagucauuggaguc

SEQ ID NO: 4151091 - RNA, 9 nt, Yersinia pestis
caagucccg

SEQ ID NO: 4151092 - RNA, 14 nt, Yersinia pestis
caaguccugcuuca

SEQ ID NO: 4151093 - RNA, 17 nt, Yersinia pestis
caagucuugaagaguga

SEQ ID NO: 4151094 - RNA, 23 nt, Yersinia pestis
caagugcuucaaauccucggguu

SEQ ID NO: 4151095 - RNA, 12 nt, Yersinia pestis
caaguuaaauac

SEQ ID NO: 4151096 - RNA, 18 nt, Yersinia pestis
caaguuacuucaagaugu

SEQ ID NO: 4151097 - RNA, 20 nt, Yersinia pestis
caaguucagcaucccagcca

SEQ ID NO: 4151098 - RNA, 17 nt, Yersinia pestis
caaguugcugagauauc

SEQ ID NO: 4151099 - RNA, 23 nt, Yersinia pestis
caaugaccuuacagugauaauca

SEQ ID NO: 4151100 - RNA, 13 nt, Yersinia pestis
caaugacuuaacu

SEQ ID NO: 4151101 - RNA, 15 nt, Yersinia pestis
caaugacuuaacuga

SEQ ID NO: 4151102 - RNA, 15 nt, Yersinia pestis
caaugacuucuucca

SEQ ID NO: 4151103 - RNA, 17 nt, Yersinia pestis
caaugagugauauccgc

SEQ ID NO: 4151104 - RNA, 16 nt, Yersinia pestis
caaugaucaaacggau

SEQ ID NO: 4151105 - RNA, 19 nt, Yersinia pestis
caaugaugacuugauuaac

SEQ ID NO: 4151106 - RNA, 18 nt, Yersinia pestis
caaugauggcggcuaaau

SEQ ID NO: 4151107 - RNA, 16 nt, Yersinia pestis
caaugaugucaucuuc

SEQ ID NO: 4151108 - RNA, 13 nt, Yersinia pestis
caaugauuuuuuu

SEQ ID NO: 4151109 - RNA, 21 nt, Yersinia pestis
caaugcaccgacaaagauacu

SEQ ID NO: 4151110 - RNA, 14 nt, Yersinia pestis
caaugcaguaaaga

SEQ ID NO: 4151111 - RNA, 17 nt, Yersinia pestis
caaugcauuguaaaaua

SEQ ID NO: 4151112 - RNA, 18 nt, Yersinia pestis
caaugcauuguaaaauaa

SEQ ID NO: 4151113 - RNA, 12 nt, Yersinia pestis
caaugcccccag

SEQ ID NO: 4151114 - RNA, 15 nt, Yersinia pestis
caaugccucuucaau

SEQ ID NO: 4151115 - RNA, 17 nt, Yersinia pestis
caaugccucuucaauac

SEQ ID NO: 4151116 - RNA, 13 nt, Yersinia pestis
caaugccuuggca

SEQ ID NO: 4151117 - RNA, 15 nt, Yersinia pestis
caaugcgaaaaaaua

SEQ ID NO: 4151118 - RNA, 16 nt, Yersinia pestis
caaugcgaaaaaauau

SEQ ID NO: 4151119 - RNA, 22 nt, Yersinia pestis
caaugcguuggcucagauaaua

SEQ ID NO: 4151120 - RNA, 15 nt, Yersinia pestis
caaugcucaagugua

SEQ ID NO: 4151121 - RNA, 17 nt, Yersinia pestis
caaugcuccagcaacug

SEQ ID NO: 4151122 - RNA, 23 nt, Yersinia pestis
caaugcuggcaguggcggcaaaa

SEQ ID NO: 4151123 - RNA, 23 nt, Yersinia pestis
caaugcuuuuguacgaaauugau

SEQ ID NO: 4151124 - RNA, 18 nt, Yersinia pestis
caauggauucuugcugca

SEQ ID NO: 4151125 - RNA, 18 nt, Yersinia pestis
caauggauuugugcaaau

SEQ ID NO: 4151126 - RNA, 21 nt, Yersinia pestis
caauggccggacucauuaucc

SEQ ID NO: 4151127 - RNA, 14 nt, Yersinia pestis
caauggcgaugaga

SEQ ID NO: 4151128 - RNA, 18 nt, Yersinia pestis
caauggcguuauguaaaa

SEQ ID NO: 4151129 - RNA, 13 nt, Yersinia pestis
caauggcucaggc

SEQ ID NO: 4151130 - RNA, 14 nt, Yersinia pestis
caauggcuccaccg

SEQ ID NO: 4151131 - RNA, 18 nt, Yersinia pestis
caauggcuggcaaggcac

SEQ ID NO: 4151132 - RNA, 16 nt, Yersinia pestis
caaugggaugcccaca

SEQ ID NO: 4151133 - RNA, 20 nt, Yersinia pestis
caauggugcccaucacaucg

SEQ ID NO: 4151134 - RNA, 23 nt, Yersinia pestis
caauguaaaacgaguaaauacaa

SEQ ID NO: 4151135 - RNA, 18 nt, Yersinia pestis
caaugucaccugaaccug

SEQ ID NO: 4151136 - RNA, 15 nt, Yersinia pestis
caaugucaugcaauu

SEQ ID NO: 4151137 - RNA, 19 nt, Yersinia pestis
caaugucaugcaauuacug

SEQ ID NO: 4151138 - RNA, 18 nt, Yersinia pestis
caaugugccgcgcaacca

SEQ ID NO: 4151139 - RNA, 20 nt, Yersinia pestis
caaugugcguuuauuacgug

SEQ ID NO: 4151140 - RNA, 19 nt, Yersinia pestis
caauguuaaacuuugcuau

SEQ ID NO: 4151141 - RNA, 16 nt, Yersinia pestis
caauguuauauuucuu

SEQ ID NO: 4151142 - RNA, 16 nt, Yersinia pestis
caauguugagaaauau

SEQ ID NO: 4151143 - RNA, 16 nt, Yersinia pestis
caauguuggcccaaga

SEQ ID NO: 4151144 - RNA, 15 nt, Yersinia pestis
caauuaaaaacgcgc

SEQ ID NO: 4151145 - RNA, 22 nt, Yersinia pestis
caauuaauacccuaucgacuuc

SEQ ID NO: 4151146 - RNA, 18 nt, Yersinia pestis
caauuaaucaauuaaaua

SEQ ID NO: 4151147 - RNA, 22 nt, Yersinia pestis
caauuaaucaauuaaucaauua

SEQ ID NO: 4151148 - RNA, 17 nt, Yersinia pestis
caauuacuuuggcauuu

SEQ ID NO: 4151149 - RNA, 21 nt, Yersinia pestis
caauuagcugaucgggcuuua

SEQ ID NO: 4151150 - RNA, 21 nt, Yersinia pestis
caauuaggggaagguaaaaaa

SEQ ID NO: 4151151 - RNA, 21 nt, Yersinia pestis
caauuagguugcagcuaaaca

SEQ ID NO: 4151152 - RNA, 14 nt, Yersinia pestis
caauuaucuuaucc

SEQ ID NO: 4151153 - RNA, 20 nt, Yersinia pestis
caauuaugacguucaguagu

SEQ ID NO: 4151154 - RNA, 16 nt, Yersinia pestis
caauuauuuagccugc

SEQ ID NO: 4151155 - RNA, 20 nt, Yersinia pestis
caauuauuuagccugccaau

SEQ ID NO: 4151156 - RNA, 22 nt, Yersinia pestis
caauucaaggccagcacguuuu

SEQ ID NO: 4151157 - RNA, 17 nt, Yersinia pestis
caauucacgcaaggcca

SEQ ID NO: 4151158 - RNA, 11 nt, Yersinia pestis
caauucaguuu

SEQ ID NO: 4151159 - RNA, 17 nt, Yersinia pestis
caauucaucagcgcugg

SEQ ID NO: 4151160 - RNA, 12 nt, Yersinia pestis
caauucaugcau

SEQ ID NO: 4151161 - RNA, 15 nt, Yersinia pestis
caauucaugcaucuc

SEQ ID NO: 4151162 - RNA, 18 nt, Yersinia pestis
caauucauguugccaaug

SEQ ID NO: 4151163 - RNA, 22 nt, Yersinia pestis
caauucccaaagcgcagugcuc

SEQ ID NO: 4151164 - RNA, 22 nt, Yersinia pestis
caauucccguuagguucaauuc

SEQ ID NO: 4151165 - RNA, 20 nt, Yersinia pestis
caauucgaccguuuuuacaa

SEQ ID NO: 4151166 - RNA, 13 nt, Yersinia pestis
caauucggcuggc

SEQ ID NO: 4151167 - RNA, 22 nt, Yersinia pestis
caauucuuaggguaaccaaugu

SEQ ID NO: 4151168 - RNA, 15 nt, Yersinia pestis
caauugauccugugc

SEQ ID NO: 4151169 - RNA, 17 nt, Yersinia pestis
caauugcccccuaguga

SEQ ID NO: 4151170 - RNA, 16 nt, Yersinia pestis
caauugccugauuuuu

SEQ ID NO: 4151171 - RNA, 16 nt, Yersinia pestis
caauuggucaugauga

SEQ ID NO: 4151172 - RNA, 23 nt, Yersinia pestis
caauuucacgcucgcccaugacc

SEQ ID NO: 4151173 - RNA, 14 nt, Yersinia pestis
caauuuccccugcu

SEQ ID NO: 4151174 - RNA, 22 nt, Yersinia pestis
caauuucgaaaacucaaagauu

SEQ ID NO: 4151175 - RNA, 15 nt, Yersinia pestis
caauuucucaaauac

SEQ ID NO: 4151176 - RNA, 16 nt, Yersinia pestis
caauuucucaaauacu

SEQ ID NO: 4151177 - RNA, 22 nt, Yersinia pestis
caauuucucaaauacuucaaau

SEQ ID NO: 4151178 - RNA, 16 nt, Yersinia pestis
caauuucucggccaac

SEQ ID NO: 4151179 - RNA, 17 nt, Yersinia pestis
caauuugcaaagaaaua

SEQ ID NO: 4151180 - RNA, 13 nt, Yersinia pestis
caauuugcauaau

SEQ ID NO: 4151181 - RNA, 14 nt, Yersinia pestis
caauuugcccaucu

SEQ ID NO: 4151182 - RNA, 13 nt, Yersinia pestis
caauuuggccaau

SEQ ID NO: 4151183 - RNA, 15 nt, Yersinia pestis
caauuugguagaacu

SEQ ID NO: 4151184 - RNA, 22 nt, Yersinia pestis
caauuugucauguugaccaaac

SEQ ID NO: 4151185 - RNA, 15 nt, Yersinia pestis
caauuuucccaagcc

SEQ ID NO: 4151186 - RNA, 15 nt, Yersinia pestis
caauuuucccucugc

SEQ ID NO: 4151187 - RNA, 14 nt, Yersinia pestis
caauuuuugauacu

SEQ ID NO: 4151188 - RNA, 23 nt, Yersinia pestis
cacaaaaaccggcguaaauaaaa

SEQ ID NO: 4151189 - RNA, 12 nt, Yersinia pestis
cacaaacauggc

SEQ ID NO: 4151190 - RNA, 17 nt, Yersinia pestis
cacaaacauggcggcag

SEQ ID NO: 4151191 - RNA, 15 nt, Yersinia pestis
cacaaaugcugugcc

SEQ ID NO: 4151192 - RNA, 16 nt, Yersinia pestis
cacaaauuuuuaccuu

SEQ ID NO: 4151193 - RNA, 14 nt, Yersinia pestis
cacaacaagcggcc

SEQ ID NO: 4151194 - RNA, 22 nt, Yersinia pestis
cacaacccccccgacccacgcc

SEQ ID NO: 4151195 - RNA, 18 nt, Yersinia pestis
cacaacccgcugaugccg

SEQ ID NO: 4151196 - RNA, 14 nt, Yersinia pestis
cacaacgacagcca

SEQ ID NO: 4151197 - RNA, 15 nt, Yersinia pestis
cacaacgacagccaa

SEQ ID NO: 4151198 - RNA, 19 nt, Yersinia pestis
cacaacggaaggcccagcc

SEQ ID NO: 4151199 - RNA, 17 nt, Yersinia pestis
cacaacugaaugucucu

SEQ ID NO: 4151200 - RNA, 21 nt, Yersinia pestis
cacaacugcucguuagucuca

SEQ ID NO: 4151201 - RNA, 18 nt, Yersinia pestis
cacaagucauuggagucg

SEQ ID NO: 4151202 - RNA, 21 nt, Yersinia pestis
cacaaguucugccccugacuc

SEQ ID NO: 4151203 - RNA, 15 nt, Yersinia pestis
cacaauacagcaaau

SEQ ID NO: 4151204 - RNA, 16 nt, Yersinia pestis
cacaauagaugcagua

SEQ ID NO: 4151205 - RNA, 18 nt, Yersinia pestis
cacaauagaugcaguaac

SEQ ID NO: 4151206 - RNA, 19 nt, Yersinia pestis
cacaauagaugcaguaacg

SEQ ID NO: 4151207 - RNA, 22 nt, Yersinia pestis
cacaauagcuaccccuucaguc

SEQ ID NO: 4151208 - RNA, 14 nt, Yersinia pestis
cacaauauauacau

SEQ ID NO: 4151209 - RNA, 15 nt, Yersinia pestis
cacaauauauacaua

SEQ ID NO: 4151210 - RNA, 21 nt, Yersinia pestis
cacaaucagcccgauggcaaa

SEQ ID NO: 4151211 - RNA, 21 nt, Yersinia pestis
cacaaucagggcacucugcuu

SEQ ID NO: 4151212 - RNA, 14 nt, Yersinia pestis
cacaauccaauuua

SEQ ID NO: 4151213 - RNA, 18 nt, Yersinia pestis
cacaauccaggcgaccca

SEQ ID NO: 4151214 - RNA, 23 nt, Yersinia pestis
cacaaucgcgcuguacaacaaga

SEQ ID NO: 4151215 - RNA, 12 nt, Yersinia pestis
cacaaucuucuu

SEQ ID NO: 4151216 - RNA, 18 nt, Yersinia pestis
cacaaugcacagugccgu

SEQ ID NO: 4151217 - RNA, 18 nt, Yersinia pestis
cacaaugccuaaaauggc

SEQ ID NO: 4151218 - RNA, 21 nt, Yersinia pestis
cacaaugccuaaaauggccgu

SEQ ID NO: 4151219 - RNA, 21 nt, Yersinia pestis
cacaauuucaccccgacauuc

SEQ ID NO: 4151220 - RNA, 12 nt, Yersinia pestis
cacacaauacau

SEQ ID NO: 4151221 - RNA, 12 nt, Yersinia pestis
caccauccauag

SEQ ID NO: 4151222 - RNA, 22 nt, Yersinia pestis
caccauccccugucuugccagc

SEQ ID NO: 4151223 - RNA, 22 nt, Yersinia pestis
caccaucgccccuguaguucau

SEQ ID NO: 4151224 - RNA, 17 nt, Yersinia pestis
caccaucgcgcugucuu

SEQ ID NO: 4151225 - RNA, 20 nt, Yersinia pestis
caccaucgcgcugucuuuca

SEQ ID NO: 4151226 - RNA, 15 nt, Yersinia pestis
caccauggaaaauau

SEQ ID NO: 4151227 - RNA, 16 nt, Yersinia pestis
caccauuaauaauaac

SEQ ID NO: 4151228 - RNA, 15 nt, Yersinia pestis
caccauuaucuucca

SEQ ID NO: 4151229 - RNA, 13 nt, Yersinia pestis
caccauugaccag

SEQ ID NO: 4151230 - RNA, 20 nt, Yersinia pestis
caccauuggcgaucgcgcca

SEQ ID NO: 4151231 - RNA, 17 nt, Yersinia pestis
caccauuuggacugaau

SEQ ID NO: 4151232 - RNA, 17 nt, Yersinia pestis
cacccaacucaacggca

SEQ ID NO: 4151233 - RNA, 22 nt, Yersinia pestis
cacccaacuuuuuuaccacauu

SEQ ID NO: 4151234 - RNA, 20 nt, Yersinia pestis
cacccaccaagggucaucaa

SEQ ID NO: 4151235 - RNA, 20 nt, Yersinia pestis
cacccaccuuuugcgcgaua

SEQ ID NO: 4151236 - RNA, 20 nt, Yersinia pestis
cacccagcaaaauagcacag

SEQ ID NO: 4151237 - RNA, 20 nt, Yersinia pestis
cacccaggcugugguggcgg

SEQ ID NO: 4151238 - RNA, 14 nt, Yersinia pestis
cacccaguaacuga

SEQ ID NO: 4151239 - RNA, 15 nt, Yersinia pestis
cacccauaccaacca

SEQ ID NO: 4151240 - RNA, 23 nt, Yersinia pestis
caccccuauuagggaacgccagc

SEQ ID NO: 4151241 - RNA, 16 nt, Yersinia pestis
cacccgcuuucagaca

SEQ ID NO: 4151242 - RNA, 15 nt, Yersinia pestis
cacccggcauaaagg

SEQ ID NO: 4151243 - RNA, 12 nt, Yersinia pestis
cacccguugcaa

SEQ ID NO: 4151244 - RNA, 23 nt, Yersinia pestis
cacccguugcauuuuucuguuca

SEQ ID NO: 4151245 - RNA, 21 nt, Yersinia pestis
cacccuaucugcucuugcuca

SEQ ID NO: 4151246 - RNA, 16 nt, Yersinia pestis
cacccucaacucaaaa

SEQ ID NO: 4151247 - RNA, 21 nt, Yersinia pestis
cacccucucuuuccagcaaaa

SEQ ID NO: 4151248 - RNA, 15 nt, Yersinia pestis
cacccucugcagcuu

SEQ ID NO: 4151249 - RNA, 14 nt, Yersinia pestis
cacccugacgaaau

SEQ ID NO: 4151250 - RNA, 20 nt, Yersinia pestis
cacccugcgugguauacccu

SEQ ID NO: 4151251 - RNA, 21 nt, Yersinia pestis
cacccuggcucuggccagcgu

SEQ ID NO: 4151252 - RNA, 17 nt, Yersinia pestis
caccgacaccacgauca

SEQ ID NO: 4151253 - RNA, 13 nt, Yersinia pestis
caccgagcaccaa

SEQ ID NO: 4151254 - RNA, 22 nt, Yersinia pestis
caccgagcaccaauauugcgga

SEQ ID NO: 4151255 - RNA, 16 nt, Yersinia pestis
caccgauggcaccgac

SEQ ID NO: 4151256 - RNA, 16 nt, Yersinia pestis
caccgcacacugacag

SEQ ID NO: 4151257 - RNA, 14 nt, Yersinia pestis
caccgcccccucca

SEQ ID NO: 4151258 - RNA, 20 nt, Yersinia pestis
caccgccgucaaaccaagcc

SEQ ID NO: 4151259 - RNA, 22 nt, Yersinia pestis
caccgccgucaaaccaagcccu

SEQ ID NO: 4151260 - RNA, 19 nt, Yersinia pestis
caccgccuaucgugaacag

SEQ ID NO: 4151261 - RNA, 14 nt, Yersinia pestis
caccgcgacuucag

SEQ ID NO: 4151262 - RNA, 15 nt, Yersinia pestis
caccgcgacuucagc

SEQ ID NO: 4151263 - RNA, 14 nt, Yersinia pestis
caccgcuaucacug

SEQ ID NO: 4151264 - RNA, 23 nt, Yersinia pestis
caccgcuggucgggugcaggcca

SEQ ID NO: 4151265 - RNA, 20 nt, Yersinia pestis
caccggauuuauugcucucg

SEQ ID NO: 4151266 - RNA, 14 nt, Yersinia pestis
caccggcuaaccac

SEQ ID NO: 4151267 - RNA, 21 nt, Yersinia pestis
caccgguucacgugguuuugu

SEQ ID NO: 4151268 - RNA, 16 nt, Yersinia pestis
caccguaacuucuucg

SEQ ID NO: 4151269 - RNA, 18 nt, Yersinia pestis
caccguaacuucuucgcg

SEQ ID NO: 4151270 - RNA, 15 nt, Yersinia pestis
caccguggcgcgcca

SEQ ID NO: 4151271 - RNA, 15 nt, Yersinia pestis
caccgugugauaaac

SEQ ID NO: 4151272 - RNA, 16 nt, Yersinia pestis
caccguguuucagcau

SEQ ID NO: 4151273 - RNA, 16 nt, Yersinia pestis
caccguugauugauaa

SEQ ID NO: 4151274 - RNA, 17 nt, Yersinia pestis
caccuaaccaaacauug

SEQ ID NO: 4151275 - RNA, 17 nt, Yersinia pestis
caccuaacuuccuaaca

SEQ ID NO: 4151276 - RNA, 14 nt, Yersinia pestis
caccuaauacagca

SEQ ID NO: 4151277 - RNA, 16 nt, Yersinia pestis
caccuaauccaaggcg

SEQ ID NO: 4151278 - RNA, 13 nt, Yersinia pestis
caccuacaaccua

SEQ ID NO: 4151279 - RNA, 19 nt, Yersinia pestis
caccuaccaccuacaaccu

SEQ ID NO: 4151280 - RNA, 15 nt, Yersinia pestis
caccuaccaccuacc

SEQ ID NO: 4151281 - RNA, 19 nt, Yersinia pestis
caccuaccaccuaccaccu

SEQ ID NO: 4151282 - RNA, 13 nt, Yersinia pestis
caccucaaacuga

SEQ ID NO: 4151283 - RNA, 15 nt, Yersinia pestis
caccucagucaucgc

SEQ ID NO: 4151284 - RNA, 21 nt, Yersinia pestis
caccucaucccaaaauagcca

SEQ ID NO: 4151285 - RNA, 13 nt, Yersinia pestis
caccuccgcaucc

SEQ ID NO: 4151286 - RNA, 21 nt, Yersinia pestis
caccucuugcauacucaggcc

SEQ ID NO: 4151287 - RNA, 18 nt, Yersinia pestis
caccugacgaaaugccgc

SEQ ID NO: 4151288 - RNA, 16 nt, Yersinia pestis
caccugaguaauauua

SEQ ID NO: 4151289 - RNA, 16 nt, Yersinia pestis
caccugaucaugccac

SEQ ID NO: 4151290 - RNA, 22 nt, Yersinia pestis
caccugcgggauagcauaaaua

SEQ ID NO: 4151291 - RNA, 17 nt, Yersinia pestis
caccugcgguugcugug

SEQ ID NO: 4151292 - RNA, 14 nt, Yersinia pestis
caccugucaccugu

SEQ ID NO: 4151293 - RNA, 14 nt, Yersinia pestis
caccuuaaaauaag

SEQ ID NO: 4151294 - RNA, 19 nt, Yersinia pestis
caccuuccgucccaagaaa

SEQ ID NO: 4151295 - RNA, 18 nt, Yersinia pestis
caccuucuugguuaguuc

SEQ ID NO: 4151296 - RNA, 19 nt, Yersinia pestis
caccuucuugguuaguucu

SEQ ID NO: 4151297 - RNA, 18 nt, Yersinia pestis
caccuuggaaaacagcaa

SEQ ID NO: 4151298 - RNA, 15 nt, Yersinia pestis
cacgaaaagcagcag

SEQ ID NO: 4151299 - RNA, 18 nt, Yersinia pestis
cacgaacaaucgcccccu

SEQ ID NO: 4151300 - RNA, 13 nt, Yersinia pestis
cacgaggacaggu

SEQ ID NO: 4151301 - RNA, 19 nt, Yersinia pestis
cacgauaaauucgauaaaa

SEQ ID NO: 4151302 - RNA, 21 nt, Yersinia pestis
cacgauagcaaugaccuuaca

SEQ ID NO: 4151303 - RNA, 12 nt, Yersinia pestis
cacgaucagcuc

SEQ ID NO: 4151304 - RNA, 19 nt, Yersinia pestis
cacgaucaucaacucgcca

SEQ ID NO: 4151305 - RNA, 22 nt, Yersinia pestis
cacgaucaucaacucgccaccc

SEQ ID NO: 4151306 - RNA, 15 nt, Yersinia pestis
cacgaucuccuccag

SEQ ID NO: 4151307 - RNA, 20 nt, Yersinia pestis
cacgaugccaguagccguua

SEQ ID NO: 4151308 - RNA, 17 nt, Yersinia pestis
cacgcagugcaucuucc

SEQ ID NO: 4151309 - RNA, 19 nt, Yersinia pestis
cacgcauuccaucagccaa

SEQ ID NO: 4151310 - RNA, 15 nt, Yersinia pestis
cacgcccaacucuuu

SEQ ID NO: 4151311 - RNA, 13 nt, Yersinia pestis
cacgcccaauucc

SEQ ID NO: 4151312 - RNA, 13 nt, Yersinia pestis
cacgcgaagcccu

SEQ ID NO: 4151313 - RNA, 23 nt, Yersinia pestis
cacgcgagcauaaagcuauucau

SEQ ID NO: 4151314 - RNA, 13 nt, Yersinia pestis
cacgcguucaauc

SEQ ID NO: 4151315 - RNA, 13 nt, Yersinia pestis
cacgcuauauaga

SEQ ID NO: 4151316 - RNA, 19 nt, Yersinia pestis
cacgcuauccgcgccgagc

SEQ ID NO: 4151317 - RNA, 18 nt, Yersinia pestis
cacgcuccacacccgcca

SEQ ID NO: 4151318 - RNA, 21 nt, Yersinia pestis
cacgcugaauaacaaaagccc

SEQ ID NO: 4151319 - RNA, 16 nt, Yersinia pestis
cacgcuguucaccgau

SEQ ID NO: 4151320 - RNA, 20 nt, Yersinia pestis
cacggaaacguucaggcuuu

SEQ ID NO: 4151321 - RNA, 16 nt, Yersinia pestis
cacggagaauaaaaau

SEQ ID NO: 4151322 - RNA, 22 nt, Yersinia pestis
cacggcagugaucaaugacuuc

SEQ ID NO: 4151323 - RNA, 20 nt, Yersinia pestis
cacggccuaacaacacgcua

SEQ ID NO: 4151324 - RNA, 17 nt, Yersinia pestis
cacggccuauugaauaa

SEQ ID NO: 4151325 - RNA, 19 nt, Yersinia pestis
cacggccuauugaauaaca

SEQ ID NO: 4151326 - RNA, 21 nt, Yersinia pestis
cacggcgagaccuacucgccg

SEQ ID NO: 4151327 - RNA, 15 nt, Yersinia pestis
cacggcgcuccauca

SEQ ID NO: 4151328 - RNA, 14 nt, Yersinia pestis
cacggcggccguca

SEQ ID NO: 4151329 - RNA, 17 nt, Yersinia pestis
cacggcuaccagcagca

SEQ ID NO: 4151330 - RNA, 16 nt, Yersinia pestis
cacggcuuucaauaaa

SEQ ID NO: 4151331 - RNA, 18 nt, Yersinia pestis
cacgggcgcaauggaaga

SEQ ID NO: 4151332 - RNA, 19 nt, Yersinia pestis
cacgggcuuccaucaggaa

SEQ ID NO: 4151333 - RNA, 19 nt, Yersinia pestis
cacgguagugacucaucaa

SEQ ID NO: 4151334 - RNA, 19 nt, Yersinia pestis
cacggucaugcggccuucc

SEQ ID NO: 4151335 - RNA, 17 nt, Yersinia pestis
cacggugaauaaacccu

SEQ ID NO: 4151336 - RNA, 14 nt, Yersinia pestis
cacgguugaaaagu

SEQ ID NO: 4151337 - RNA, 18 nt, Yersinia pestis
cacguaauuauuguucaa

SEQ ID NO: 4151338 - RNA, 20 nt, Yersinia pestis
cacguaccaaaucagcaagc

SEQ ID NO: 4151339 - RNA, 16 nt, Yersinia pestis
cacguggguauccagu

SEQ ID NO: 4151340 - RNA, 18 nt, Yersinia pestis
cacguuaaauuucuucaa

SEQ ID NO: 4151341 - RNA, 20 nt, Yersinia pestis
cacguucggcgucgccaccc

SEQ ID NO: 4151342 - RNA, 18 nt, Yersinia pestis
cacguuuaauucaaaguu

SEQ ID NO: 4151343 - RNA, 13 nt, Yersinia pestis
cagaaaauaccgc

SEQ ID NO: 4151344 - RNA, 19 nt, Yersinia pestis
cagaaacagcccagauggc

SEQ ID NO: 4151345 - RNA, 16 nt, Yersinia pestis
cagaaacgauuaccca

SEQ ID NO: 4151346 - RNA, 22 nt, Yersinia pestis
cagaaaggacaguaauauuuuc

SEQ ID NO: 4151347 - RNA, 22 nt, Yersinia pestis
cagaaauaaauauccuccggca

SEQ ID NO: 4151348 - RNA, 14 nt, Yersinia pestis
cagaaauaaauuca

SEQ ID NO: 4151349 - RNA, 18 nt, Yersinia pestis
cagaaauaaauucaucuc

SEQ ID NO: 4151350 - RNA, 14 nt, Yersinia pestis
cagaaauauugugc

SEQ ID NO: 4151351 - RNA, 15 nt, Yersinia pestis
cagaaaucagccaua

SEQ ID NO: 4151352 - RNA, 20 nt, Yersinia pestis
cagaaaucagccauaucaaa

SEQ ID NO: 4151353 - RNA, 16 nt, Yersinia pestis
cagaacaaaacaagcc

SEQ ID NO: 4151354 - RNA, 24 nt, Yersinia pestis
cagaacaccaacaccacacugagc

SEQ ID NO: 4151355 - RNA, 21 nt, Yersinia pestis
cagaacccccgcgaacagcag

SEQ ID NO: 4151356 - RNA, 21 nt, Yersinia pestis
cagaacuagcgccgcaucaaa

SEQ ID NO: 4151357 - RNA, 20 nt, Yersinia pestis
cagaacugauuucaggaaug

SEQ ID NO: 4151358 - RNA, 18 nt, Yersinia pestis
cagaagcguaaagcaccc

SEQ ID NO: 4151359 - RNA, 16 nt, Yersinia pestis
cagaagcuuauccauu

SEQ ID NO: 4151360 - RNA, 20 nt, Yersinia pestis
cagaagggcggccagcaaga

SEQ ID NO: 4151361 - RNA, 22 nt, Yersinia pestis
cagaaguaugcguggguucuuc

SEQ ID NO: 4151362 - RNA, 21 nt, Yersinia pestis
cagaauaauaagccgugccug

SEQ ID NO: 4151363 - RNA, 15 nt, Yersinia pestis
cagaauauaaaagca

SEQ ID NO: 4151364 - RNA, 16 nt, Yersinia pestis
cagaauaucguggaga

SEQ ID NO: 4151365 - RNA, 21 nt, Yersinia pestis
cagaaucaccaacaccaccau

SEQ ID NO: 4151366 - RNA, 21 nt, Yersinia pestis
cagaaucacugucaaaaagca

SEQ ID NO: 4151367 - RNA, 14 nt, Yersinia pestis
cagaaucagcccca

SEQ ID NO: 4151368 - RNA, 18 nt, Yersinia pestis
cagaaucgccguagauuu

SEQ ID NO: 4151369 - RNA, 17 nt, Yersinia pestis
cagaauggcaaagcaca

SEQ ID NO: 4151370 - RNA, 11 nt, Yersinia pestis
cagaauuucau

SEQ ID NO: 4151371 - RNA, 20 nt, Yersinia pestis
cagaauuucauuguggagga

SEQ ID NO: 4151372 - RNA, 14 nt, Yersinia pestis
cagacaaacaaccu

SEQ ID NO: 4151373 - RNA, 15 nt, Yersinia pestis
cagacaacagucaca

SEQ ID NO: 4151374 - RNA, 19 nt, Yersinia pestis
cagacaacagucacaccaa

SEQ ID NO: 4151375 - RNA, 16 nt, Yersinia pestis
cagacaaccaauacac

SEQ ID NO: 4151376 - RNA, 15 nt, Yersinia pestis
cagacaagaaugccu

SEQ ID NO: 4151377 - RNA, 15 nt, Yersinia pestis
cagacacaagauaaa

SEQ ID NO: 4151378 - RNA, 14 nt, Yersinia pestis
cagacacaaugcug

SEQ ID NO: 4151379 - RNA, 15 nt, Yersinia pestis
cagacauaucugaac

SEQ ID NO: 4151380 - RNA, 14 nt, Yersinia pestis
cagacauuuuucua

SEQ ID NO: 4151381 - RNA, 19 nt, Yersinia pestis
cagacauuuuucuauuucu

SEQ ID NO: 4151382 - RNA, 20 nt, Yersinia pestis
cagaccaaauagcaagccaa

SEQ ID NO: 4151383 - RNA, 14 nt, Yersinia pestis
cagacccgugaaca

SEQ ID NO: 4151384 - RNA, 15 nt, Yersinia pestis
cagacccugcaccac

SEQ ID NO: 4151385 - RNA, 18 nt, Yersinia pestis
cagacgacgugcagcgcg

SEQ ID NO: 4151386 - RNA, 19 nt, Yersinia pestis
cagacgaguauuccccacu

SEQ ID NO: 4151387 - RNA, 23 nt, Yersinia pestis
cagacgcgguuaacgacgcauua

SEQ ID NO: 4151388 - RNA, 17 nt, Yersinia pestis
cagacggaauaccaccc

SEQ ID NO: 4151389 - RNA, 21 nt, Yersinia pestis
cagacggcagauccugaacga

SEQ ID NO: 4151390 - RNA, 20 nt, Yersinia pestis
cagacguacauauaucacua

SEQ ID NO: 4151391 - RNA, 15 nt, Yersinia pestis
cagacguuuaaauaa

SEQ ID NO: 4151392 - RNA, 16 nt, Yersinia pestis
cagacguuuaaauaag

SEQ ID NO: 4151393 - RNA, 18 nt, Yersinia pestis
cagacguuuaaauaagcu

SEQ ID NO: 4151394 - RNA, 15 nt, Yersinia pestis
cagacuaaaaaccau

SEQ ID NO: 4151395 - RNA, 16 nt, Yersinia pestis
cagacuaaaaaccgcc

SEQ ID NO: 4151396 - RNA, 17 nt, Yersinia pestis
cagacuaaaaaccgcca

SEQ ID NO: 4151397 - RNA, 21 nt, Yersinia pestis
cagacuaaaaaccgccacagc

SEQ ID NO: 4151398 - RNA, 14 nt, Yersinia pestis
cagacucaagcauu

SEQ ID NO: 4151399 - RNA, 13 nt, Yersinia pestis
cagacuccugccc

SEQ ID NO: 4151400 - RNA, 18 nt, Yersinia pestis
cagacucugcuaccagga

SEQ ID NO: 4151401 - RNA, 16 nt, Yersinia pestis
cagacugaaaguagaa

SEQ ID NO: 4151402 - RNA, 21 nt, Yersinia pestis
cagacugaaaguagaaauaaa

SEQ ID NO: 4151403 - RNA, 22 nt, Yersinia pestis
cagacugaaaguagaaauaaaa

SEQ ID NO: 4151404 - RNA, 22 nt, Yersinia pestis
cagacugaaaugacauugcgaa

SEQ ID NO: 4151405 - RNA, 14 nt, Yersinia pestis
cagacugacgcaga

SEQ ID NO: 4151406 - RNA, 20 nt, Yersinia pestis
cagacugacgcagagcuaaa

SEQ ID NO: 4151407 - RNA, 13 nt, Yersinia pestis
cagacugcugaca

SEQ ID NO: 4151408 - RNA, 18 nt, Yersinia pestis
cagacugcugacaaaccc

SEQ ID NO: 4151409 - RNA, 21 nt, Yersinia pestis
cagacuuggguaaccaaucac

SEQ ID NO: 4151410 - RNA, 16 nt, Yersinia pestis
cagagaaugaguaaag

SEQ ID NO: 4151411 - RNA, 24 nt, Yersinia pestis
cagagacagcaacaaacagccgau

SEQ ID NO: 4151412 - RNA, 18 nt, Yersinia pestis
cagagaccacagauaaau

SEQ ID NO: 4151413 - RNA, 15 nt, Yersinia pestis
cagagaggagaauua

SEQ ID NO: 4151414 - RNA, 22 nt, Yersinia pestis
cagagauaauagauaacaaacu

SEQ ID NO: 4151415 - RNA, 19 nt, Yersinia pestis
cagagaucauguaguacuu

SEQ ID NO: 4151416 - RNA, 12 nt, Yersinia pestis
cagagcaaaacu

SEQ ID NO: 4151417 - RNA, 20 nt, Yersinia pestis
cagagcaagggucuccacac

SEQ ID NO: 4151418 - RNA, 13 nt, Yersinia pestis
cagagcacgcaga

SEQ ID NO: 4151419 - RNA, 19 nt, Yersinia pestis
cagagcacgcagagaugaa

SEQ ID NO: 4151420 - RNA, 17 nt, Yersinia pestis
cagagcagaaagcagca

SEQ ID NO: 4151421 - RNA, 12 nt, Yersinia pestis
cagagccuuaua

SEQ ID NO: 4151422 - RNA, 20 nt, Yersinia pestis
cagagcguuucaguauugua

SEQ ID NO: 4151423 - RNA, 17 nt, Yersinia pestis
cagagcucgcuagucau

SEQ ID NO: 4151424 - RNA, 18 nt, Yersinia pestis
cagaggaaagagagccau

SEQ ID NO: 4151425 - RNA, 14 nt, Yersinia pestis
cagaggaaucaaag

SEQ ID NO: 4151426 - RNA, 13 nt, Yersinia pestis
cagaggaguaaag

SEQ ID NO: 4151427 - RNA, 17 nt, Yersinia pestis
cagaguauccagcguca

SEQ ID NO: 4151428 - RNA, 16 nt, Yersinia pestis
cagaguccucucacca

SEQ ID NO: 4151429 - RNA, 18 nt, Yersinia pestis
cagagucgcaaaaaauau

SEQ ID NO: 4151430 - RNA, 14 nt, Yersinia pestis
cagagugugaaauc

SEQ ID NO: 4151431 - RNA, 14 nt, Yersinia pestis
cagaguucggucau

SEQ ID NO: 4151432 - RNA, 16 nt, Yersinia pestis
cagaguucggucauaa

SEQ ID NO: 4151433 - RNA, 16 nt, Yersinia pestis
cagauaaagaaaaacc

SEQ ID NO: 4151434 - RNA, 17 nt, Yersinia pestis
cagauaaagaaaaaccc

SEQ ID NO: 4151435 - RNA, 20 nt, Yersinia pestis
cagauaaagaaaaacccguu

SEQ ID NO: 4151436 - RNA, 18 nt, Yersinia pestis
cagauaaagcuugaucac

SEQ ID NO: 4151437 - RNA, 14 nt, Yersinia pestis
cagauaaauaaaau

SEQ ID NO: 4151438 - RNA, 15 nt, Yersinia pestis
cagauaaauaaaaua

SEQ ID NO: 4151439 - RNA, 16 nt, Yersinia pestis
cagauaaauaaaauaa

SEQ ID NO: 4151440 - RNA, 22 nt, Yersinia pestis
cagauaaauaaaauaauaaugg

SEQ ID NO: 4151441 - RNA, 19 nt, Yersinia pestis
cagauaaaucaguggguca

SEQ ID NO: 4151442 - RNA, 13 nt, Yersinia pestis
cagauaacaacaa

SEQ ID NO: 4151443 - RNA, 17 nt, Yersinia pestis
cagauaacauacaccau

SEQ ID NO: 4151444 - RNA, 15 nt, Yersinia pestis
cagauaacucagggc

SEQ ID NO: 4151445 - RNA, 16 nt, Yersinia pestis
cagauaacucagggcg

SEQ ID NO: 4151446 - RNA, 14 nt, Yersinia pestis
cagauaaugccuaa

SEQ ID NO: 4151447 - RNA, 14 nt, Yersinia pestis
cagauaccacauca

SEQ ID NO: 4151448 - RNA, 18 nt, Yersinia pestis
cagauacggcuccagaac

SEQ ID NO: 4151449 - RNA, 19 nt, Yersinia pestis
cagauacuuucggguaucu

SEQ ID NO: 4151450 - RNA, 19 nt, Yersinia pestis
cagauagcgaaucacauca

SEQ ID NO: 4151451 - RNA, 13 nt, Yersinia pestis
cagauagucaucu

SEQ ID NO: 4151452 - RNA, 15 nt, Yersinia pestis
cagauagucaucuuu

SEQ ID NO: 4151453 - RNA, 23 nt, Yersinia pestis
cagauaucacucagcgucacgga

SEQ ID NO: 4151454 - RNA, 13 nt, Yersinia pestis
cagauaugaucaa

SEQ ID NO: 4151455 - RNA, 18 nt, Yersinia pestis
cagauaugccaggcauca

SEQ ID NO: 4151456 - RNA, 21 nt, Yersinia pestis
cagauaugccaggcaucaucu

SEQ ID NO: 4151457 - RNA, 17 nt, Yersinia pestis
cagauauuacgcagcca

SEQ ID NO: 4151458 - RNA, 21 nt, Yersinia pestis
cagaucagcgugacguuaucu

SEQ ID NO: 4151459 - RNA, 18 nt, Yersinia pestis
cagaucauuuuuuuccac

SEQ ID NO: 4151460 - RNA, 17 nt, Yersinia pestis
cagauccagaauuucau

SEQ ID NO: 4151461 - RNA, 18 nt, Yersinia pestis
cagaucccccugcugcca

SEQ ID NO: 4151462 - RNA, 19 nt, Yersinia pestis
cagaucccccugcugccag

SEQ ID NO: 4151463 - RNA, 21 nt, Yersinia pestis
cagauccucaucacugccguc

SEQ ID NO: 4151464 - RNA, 21 nt, Yersinia pestis
cagaucgcgaugcgccuguua

SEQ ID NO: 4151465 - RNA, 11 nt, Yersinia pestis
cagccaccauu

SEQ ID NO: 4151466 - RNA, 18 nt, Yersinia pestis
cagccacgauuaucucuu

SEQ ID NO: 4151467 - RNA, 15 nt, Yersinia pestis
cagccagagaauuau

SEQ ID NO: 4151468 - RNA, 18 nt, Yersinia pestis
cagccagccuuaacugca

SEQ ID NO: 4151469 - RNA, 19 nt, Yersinia pestis
cagccagcgggcgcagcca

SEQ ID NO: 4151470 - RNA, 20 nt, Yersinia pestis
cagccagugcuggcaacagc

SEQ ID NO: 4151471 - RNA, 14 nt, Yersinia pestis
cagccauaacuucu

SEQ ID NO: 4151472 - RNA, 24 nt, Yersinia pestis
cagccauauccaaagauaucuuug

SEQ ID NO: 4151473 - RNA, 22 nt, Yersinia pestis
cagccauauguugccaccagcg

SEQ ID NO: 4151474 - RNA, 23 nt, Yersinia pestis
cagccaucaguucacugaauccc

SEQ ID NO: 4151475 - RNA, 15 nt, Yersinia pestis
cagccaucggucauu

SEQ ID NO: 4151476 - RNA, 23 nt, Yersinia pestis
cagccaucuugggccgacucugc

SEQ ID NO: 4151477 - RNA, 11 nt, Yersinia pestis
cagccauuacc

SEQ ID NO: 4151478 - RNA, 17 nt, Yersinia pestis
cagcccagauggcaauc

SEQ ID NO: 4151479 - RNA, 13 nt, Yersinia pestis
cagcccagcaggc

SEQ ID NO: 4151480 - RNA, 19 nt, Yersinia pestis
cagcccagucucuuugcca

SEQ ID NO: 4151481 - RNA, 20 nt, Yersinia pestis
cagcccagucucuuugccaa

SEQ ID NO: 4151482 - RNA, 13 nt, Yersinia pestis
cagcccauccugu

SEQ ID NO: 4151483 - RNA, 22 nt, Yersinia pestis
cagcccauuuagcuggcugaac

SEQ ID NO: 4151484 - RNA, 19 nt, Yersinia pestis
cagccccaaacacuuagca

SEQ ID NO: 4151485 - RNA, 20 nt, Yersinia pestis
cagccccaaucaccggcugg

SEQ ID NO: 4151486 - RNA, 15 nt, Yersinia pestis
cagcccgauggcaaa

SEQ ID NO: 4151487 - RNA, 14 nt, Yersinia pestis
cagcccugccuggc

SEQ ID NO: 4151488 - RNA, 15 nt, Yersinia pestis
cagcccuuugaccau

SEQ ID NO: 4151489 - RNA, 18 nt, Yersinia pestis
cagccuaaaaugaauaac

SEQ ID NO: 4151490 - RNA, 21 nt, Yersinia pestis
cagccuaaggccaucaauaaa

SEQ ID NO: 4151491 - RNA, 19 nt, Yersinia pestis
cagccucauucaugaggcu

SEQ ID NO: 4151492 - RNA, 18 nt, Yersinia pestis
cagccuggagcgguuaau

SEQ ID NO: 4151493 - RNA, 15 nt, Yersinia pestis
cagccugguugguaa

SEQ ID NO: 4151494 - RNA, 20 nt, Yersinia pestis
cagccugguuuuuuaaaaaa

SEQ ID NO: 4151495 - RNA, 17 nt, Yersinia pestis
cagccuguuggucauau

SEQ ID NO: 4151496 - RNA, 15 nt, Yersinia pestis
cagccuuaacugcau

SEQ ID NO: 4151497 - RNA, 20 nt, Yersinia pestis
cagccuuaacugcauagcua

SEQ ID NO: 4151498 - RNA, 23 nt, Yersinia pestis
cagccuuaauguuuuacgaucaa

SEQ ID NO: 4151499 - RNA, 13 nt, Yersinia pestis
cagccuuuaucca

SEQ ID NO: 4151500 - RNA, 23 nt, Yersinia pestis
cagccuuuuuugcuuaaaacagg

SEQ ID NO: 4151501 - RNA, 21 nt, Yersinia pestis
cagcgaaaaauuucacuggca

SEQ ID NO: 4151502 - RNA, 14 nt, Yersinia pestis
cagcgaaauguaag

SEQ ID NO: 4151503 - RNA, 16 nt, Yersinia pestis
cagcgaagugccgcca

SEQ ID NO: 4151504 - RNA, 16 nt, Yersinia pestis
cagcgaauaguaucua

SEQ ID NO: 4151505 - RNA, 13 nt, Yersinia pestis
cagcgacaaccug

SEQ ID NO: 4151506 - RNA, 15 nt, Yersinia pestis
cagcgacaaccugua

SEQ ID NO: 4151507 - RNA, 20 nt, Yersinia pestis
cagcgacauggcgcaauggc

SEQ ID NO: 4151508 - RNA, 17 nt, Yersinia pestis
cagcgagacgauuaucu

SEQ ID NO: 4151509 - RNA, 15 nt, Yersinia pestis
cagcgagcacugccc

SEQ ID NO: 4151510 - RNA, 16 nt, Yersinia pestis
cagcgagcacugcccc

SEQ ID NO: 4151511 - RNA, 17 nt, Yersinia pestis
cagcgauacaaccggcu

SEQ ID NO: 4151512 - RNA, 18 nt, Yersinia pestis
cagcgauauacaucacgu

SEQ ID NO: 4151513 - RNA, 17 nt, Yersinia pestis
cagcgaucuauucucug

SEQ ID NO: 4151514 - RNA, 16 nt, Yersinia pestis
cagcgcaauaacguuu

SEQ ID NO: 4151515 - RNA, 23 nt, Yersinia pestis
cagcgcacugaauaacgcggcac

SEQ ID NO: 4151516 - RNA, 12 nt, Yersinia pestis
cagcgccacagu

SEQ ID NO: 4151517 - RNA, 14 nt, Yersinia pestis
cagcgcccuacugc

SEQ ID NO: 4151518 - RNA, 20 nt, Yersinia pestis
cagcgccgauauacacccca

SEQ ID NO: 4151519 - RNA, 15 nt, Yersinia pestis
cagcgcgcagccaac

SEQ ID NO: 4151520 - RNA, 12 nt, Yersinia pestis
cagcgcuggcuu

SEQ ID NO: 4151521 - RNA, 23 nt, Yersinia pestis
cagcgcuuggugaugcugcuggc

SEQ ID NO: 4151522 - RNA, 15 nt, Yersinia pestis
cagcggaugauaaau

SEQ ID NO: 4151523 - RNA, 13 nt, Yersinia pestis
cagcggcggccau

SEQ ID NO: 4151524 - RNA, 15 nt, Yersinia pestis
cagcgggcgcagcca

SEQ ID NO: 4151525 - RNA, 23 nt, Yersinia pestis
cagcgguuuuuucuuucuucagc

SEQ ID NO: 4151526 - RNA, 13 nt, Yersinia pestis
cagcguaaacagu

SEQ ID NO: 4151527 - RNA, 18 nt, Yersinia pestis
cagcguagauuuucucag

SEQ ID NO: 4151528 - RNA, 18 nt, Yersinia pestis
cagcguagccguuaaaua

SEQ ID NO: 4151529 - RNA, 19 nt, Yersinia pestis
cagcguagccguuaaauau

SEQ ID NO: 4151530 - RNA, 16 nt, Yersinia pestis
cagcguauucaguaaa

SEQ ID NO: 4151531 - RNA, 20 nt, Yersinia pestis
cagcgucagcagauugauaa

SEQ ID NO: 4151532 - RNA, 23 nt, Yersinia pestis
cagcguccauaaacccggugacc

SEQ ID NO: 4151533 - RNA, 22 nt, Yersinia pestis
cagcgucgccguaaauugcuca

SEQ ID NO: 4151534 - RNA, 23 nt, Yersinia pestis
cagcgucuuucgggcugaugaau

SEQ ID NO: 4151535 - RNA, 21 nt, Yersinia pestis
cagcguggcccaggcaaucuc

SEQ ID NO: 4151536 - RNA, 18 nt, Yersinia pestis
cagcguucuucugauuca

SEQ ID NO: 4151537 - RNA, 14 nt, Yersinia pestis
cagcguugaaaaac

SEQ ID NO: 4151538 - RNA, 19 nt, Yersinia pestis
cagcguuucaguaagauac

SEQ ID NO: 4151539 - RNA, 22 nt, Yersinia pestis
cagcguuuccucgaucagauac

SEQ ID NO: 4151540 - RNA, 15 nt, Yersinia pestis
cagcuaauguuggca

SEQ ID NO: 4151541 - RNA, 20 nt, Yersinia pestis
cagcuacugcacgcauucuu

SEQ ID NO: 4151542 - RNA, 22 nt, Yersinia pestis
cagcuauguacgcaaguaucuu

SEQ ID NO: 4151543 - RNA, 12 nt, Yersinia pestis
cagcucaauacg

SEQ ID NO: 4151544 - RNA, 13 nt, Yersinia pestis
cagcucaccguca

SEQ ID NO: 4151545 - RNA, 18 nt, Yersinia pestis
cagcucacucgguaauga

SEQ ID NO: 4151546 - RNA, 21 nt, Yersinia pestis
cagcucacucgguaaugagcc

SEQ ID NO: 4151547 - RNA, 14 nt, Yersinia pestis
cagcucaucaccaa

SEQ ID NO: 4151548 - RNA, 16 nt, Yersinia pestis
cagcucauuaaacugu

SEQ ID NO: 4151549 - RNA, 19 nt, Yersinia pestis
cagcucauuaaacuguucu

SEQ ID NO: 4151550 - RNA, 17 nt, Yersinia pestis
cagcucuacagugacuu

SEQ ID NO: 4151551 - RNA, 15 nt, Yersinia pestis
cagcugacgcagcag

SEQ ID NO: 4151552 - RNA, 21 nt, Yersinia pestis
cagcugauaugaaaaaucuga

SEQ ID NO: 4151553 - RNA, 16 nt, Yersinia pestis
cagcugcuuuaucgua

SEQ ID NO: 4151554 - RNA, 19 nt, Yersinia pestis
cagcuguguuagcggcgcu

SEQ ID NO: 4151555 - RNA, 21 nt, Yersinia pestis
cagcuuauaggucauugguua

SEQ ID NO: 4151556 - RNA, 24 nt, Yersinia pestis
cagcuuauccgggugauguucccc

SEQ ID NO: 4151557 - RNA, 15 nt, Yersinia pestis
cagcuuccagcaccc

SEQ ID NO: 4151558 - RNA, 20 nt, Yersinia pestis
cagcuuccagcaccccuuca

SEQ ID NO: 4151559 - RNA, 15 nt, Yersinia pestis
cagcuucuuuuaaag

SEQ ID NO: 4151560 - RNA, 17 nt, Yersinia pestis
cagcuucuuuuaaagaa

SEQ ID NO: 4151561 - RNA, 20 nt, Yersinia pestis
cagcuugauagggcugaaga

SEQ ID NO: 4151562 - RNA, 19 nt, Yersinia pestis
cagcuugcaacucggccgc

SEQ ID NO: 4151563 - RNA, 22 nt, Yersinia pestis
cagcuugguaaugcgcaccagc

SEQ ID NO: 4151564 - RNA, 13 nt, Yersinia pestis
cagcuuguugaua

SEQ ID NO: 4151565 - RNA, 14 nt, Yersinia pestis
caggaaacuccagu

SEQ ID NO: 4151566 - RNA, 13 nt, Yersinia pestis
caggaaacuggcc

SEQ ID NO: 4151567 - RNA, 17 nt, Yersinia pestis
caggaaacuggccaacu

SEQ ID NO: 4151568 - RNA, 16 nt, Yersinia pestis
caggaagagaaaagca

SEQ ID NO: 4151569 - RNA, 23 nt, Yersinia pestis
caggaagcccgucagacugcuga

SEQ ID NO: 4151570 - RNA, 16 nt, Yersinia pestis
caggaagcggccaggu

SEQ ID NO: 4151571 - RNA, 21 nt, Yersinia pestis
caggaagcggccagguucaau

SEQ ID NO: 4151572 - RNA, 22 nt, Yersinia pestis
caggaagguaccugaucagcau

SEQ ID NO: 4151573 - RNA, 15 nt, Yersinia pestis
caggagugaauuucu

SEQ ID NO: 4151574 - RNA, 18 nt, Yersinia pestis
caggaucaccagcaaagg

SEQ ID NO: 4151575 - RNA, 15 nt, Yersinia pestis
caggcacugcagaaa

SEQ ID NO: 4151576 - RNA, 19 nt, Yersinia pestis
caggcacuuugucaauaac

SEQ ID NO: 4151577 - RNA, 13 nt, Yersinia pestis
caggcagaaauaa

SEQ ID NO: 4151578 - RNA, 14 nt, Yersinia pestis
caggcagaaauaau

SEQ ID NO: 4151579 - RNA, 16 nt, Yersinia pestis
caggcagagcaagggu

SEQ ID NO: 4151580 - RNA, 22 nt, Yersinia pestis
caggcagaucguaaagacgccg

SEQ ID NO: 4151581 - RNA, 13 nt, Yersinia pestis
caggcauaucacu

SEQ ID NO: 4151582 - RNA, 14 nt, Yersinia pestis
caggcauaucacua

SEQ ID NO: 4151583 - RNA, 18 nt, Yersinia pestis
caggccaagccugugcua

SEQ ID NO: 4151584 - RNA, 12 nt, Yersinia pestis
caggccauuuuc

SEQ ID NO: 4151585 - RNA, 15 nt, Yersinia pestis
caggccccuuaaaua

SEQ ID NO: 4151586 - RNA, 19 nt, Yersinia pestis
caggcccgcuaucacuagc

SEQ ID NO: 4151587 - RNA, 13 nt, Yersinia pestis
cagucccugugcg

SEQ ID NO: 4151588 - RNA, 18 nt, Yersinia pestis
cagucccugugcgcccac

SEQ ID NO: 4151589 - RNA, 20 nt, Yersinia pestis
cagucgacaguguaaaaagc

SEQ ID NO: 4151590 - RNA, 18 nt, Yersinia pestis
cagucgcgaugcgcugcu

SEQ ID NO: 4151591 - RNA, 19 nt, Yersinia pestis
cagucgcuucauccgcgcu

SEQ ID NO: 4151592 - RNA, 17 nt, Yersinia pestis
cagucugaaaucuccuc

SEQ ID NO: 4151593 - RNA, 19 nt, Yersinia pestis
cagucugacaccggggauc

SEQ ID NO: 4151594 - RNA, 16 nt, Yersinia pestis
cagucugaggcccgcu

SEQ ID NO: 4151595 - RNA, 21 nt, Yersinia pestis
cagucugaggcccgcuaguga

SEQ ID NO: 4151596 - RNA, 22 nt, Yersinia pestis
cagucugaggggcguuuaaugc

SEQ ID NO: 4151597 - RNA, 22 nt, Yersinia pestis
cagucugguugugagguuagaa

SEQ ID NO: 4151598 - RNA, 13 nt, Yersinia pestis
cagucuuccauga

SEQ ID NO: 4151599 - RNA, 22 nt, Yersinia pestis
cagugaaaagguuaacugcagu

SEQ ID NO: 4151600 - RNA, 20 nt, Yersinia pestis
cagugaagagauaaccguua

SEQ ID NO: 4151601 - RNA, 21 nt, Yersinia pestis
cagugaauaacugguccaacu

SEQ ID NO: 4151602 - RNA, 13 nt, Yersinia pestis
cagugacgcagug

SEQ ID NO: 4151603 - RNA, 14 nt, Yersinia pestis
cagugacgcaguga

SEQ ID NO: 4151604 - RNA, 19 nt, Yersinia pestis
cagugacgcagugacgcag

SEQ ID NO: 4151605 - RNA, 20 nt, Yersinia pestis
cagugacgcagugacgcagu

SEQ ID NO: 4151606 - RNA, 13 nt, Yersinia pestis
cagugagcaaauu

SEQ ID NO: 4151607 - RNA, 13 nt, Yersinia pestis
cagugagguuauu

SEQ ID NO: 4151608 - RNA, 22 nt, Yersinia pestis
cagugauaaucacguucaacuu

SEQ ID NO: 4151609 - RNA, 17 nt, Yersinia pestis
cagugauauaacccagu

SEQ ID NO: 4151610 - RNA, 15 nt, Yersinia pestis
cagugauauuauuua

SEQ ID NO: 4151611 - RNA, 18 nt, Yersinia pestis
cagugauauuauuuauuu

SEQ ID NO: 4151612 - RNA, 13 nt, Yersinia pestis
cagugaucagucc

SEQ ID NO: 4151613 - RNA, 18 nt, Yersinia pestis
cagugcaaaaugcucuuc

SEQ ID NO: 4151614 - RNA, 14 nt, Yersinia pestis
cagugcaaauuuau

SEQ ID NO: 4151615 - RNA, 16 nt, Yersinia pestis
cagugcaacauuaaaa

SEQ ID NO: 4151616 - RNA, 20 nt, Yersinia pestis
cagugcaaccaacaccaaug

SEQ ID NO: 4151617 - RNA, 16 nt, Yersinia pestis
cagugcacggcaguga

SEQ ID NO: 4151618 - RNA, 14 nt, Yersinia pestis
cagugcagccaaga

SEQ ID NO: 4151619 - RNA, 17 nt, Yersinia pestis
cagugcauccccacuga

SEQ ID NO: 4151620 - RNA, 17 nt, Yersinia pestis
cagugcauugcagaaag

SEQ ID NO: 4151621 - RNA, 22 nt, Yersinia pestis
cagugccgcggcggccagcggc

SEQ ID NO: 4151622 - RNA, 16 nt, Yersinia pestis
cagugcgcgauaaacg

SEQ ID NO: 4151623 - RNA, 15 nt, Yersinia pestis
cagugcgcggcgccg

SEQ ID NO: 4151624 - RNA, 23 nt, Yersinia pestis
cagugcggccaccuaucuauuuu

SEQ ID NO: 4151625 - RNA, 16 nt, Yersinia pestis
cagugcuauucauaaa

SEQ ID NO: 4151626 - RNA, 23 nt, Yersinia pestis
cagugcuauucauaaaucaguac

SEQ ID NO: 4151627 - RNA, 20 nt, Yersinia pestis
cagugcucccugaacgccuu

SEQ ID NO: 4151628 - RNA, 23 nt, Yersinia pestis
cagugcucccugaacgccuugcc

SEQ ID NO: 4151629 - RNA, 13 nt, Yersinia pestis
cagugcucgcaaa

SEQ ID NO: 4151630 - RNA, 16 nt, Yersinia pestis
caguggaacauuuucg

SEQ ID NO: 4151631 - RNA, 20 nt, Yersinia pestis
caguggaaccuccaaaugaa

SEQ ID NO: 4151632 - RNA, 13 nt, Yersinia pestis
caguggcaucaau

SEQ ID NO: 4151633 - RNA, 14 nt, Yersinia pestis
cagugggauagaga

SEQ ID NO: 4151634 - RNA, 15 nt, Yersinia pestis
caguguaaaaagcga

SEQ ID NO: 4151635 - RNA, 17 nt, Yersinia pestis
caguguaucaauaggau

SEQ ID NO: 4151636 - RNA, 18 nt, Yersinia pestis
cagugucacuuccgccgc

SEQ ID NO: 4151637 - RNA, 14 nt, Yersinia pestis
cagugucaguucga

SEQ ID NO: 4151638 - RNA, 20 nt, Yersinia pestis
caguguccagccugguuggu

SEQ ID NO: 4151639 - RNA, 18 nt, Yersinia pestis
cagugucuggcaauccag

SEQ ID NO: 4151640 - RNA, 20 nt, Yersinia pestis
cagugugugugcgcugagug

SEQ ID NO: 4151641 - RNA, 20 nt, Yersinia pestis
caguguuaccaagagagaau

SEQ ID NO: 4151642 - RNA, 18 nt, Yersinia pestis
caguguugcaacggucau

SEQ ID NO: 4151643 - RNA, 13 nt, Yersinia pestis
caguguugccaug

SEQ ID NO: 4151644 - RNA, 23 nt, Yersinia pestis
caguguuuguagcgcuccagccu

SEQ ID NO: 4151645 - RNA, 15 nt, Yersinia pestis
caguguuuucuccac

SEQ ID NO: 4151646 - RNA, 20 nt, Yersinia pestis
caguuaaaaauagacagcag

SEQ ID NO: 4151647 - RNA, 22 nt, Yersinia pestis
caguuaagguguuguuuaaaaa

SEQ ID NO: 4151648 - RNA, 13 nt, Yersinia pestis
caguuaauuucaa

SEQ ID NO: 4151649 - RNA, 18 nt, Yersinia pestis
caguuacgucaggaauaa

SEQ ID NO: 4151650 - RNA, 19 nt, Yersinia pestis
caguuacgucaggaauaaa

SEQ ID NO: 4151651 - RNA, 19 nt, Yersinia pestis
caguuauuauuuuuaauga

SEQ ID NO: 4151652 - RNA, 14 nt, Yersinia pestis
caguucaacaccaa

SEQ ID NO: 4151653 - RNA, 20 nt, Yersinia pestis
caguucaacaguaucaauac

SEQ ID NO: 4151654 - RNA, 23 nt, Yersinia pestis
caguucaagauaaaguucuucga

SEQ ID NO: 4151655 - RNA, 19 nt, Yersinia pestis
caguucauaucgauaccga

SEQ ID NO: 4151656 - RNA, 15 nt, Yersinia pestis
caguucaucaauaac

SEQ ID NO: 4151657 - RNA, 17 nt, Yersinia pestis
caguucauuacaggccc

SEQ ID NO: 4151658 - RNA, 21 nt, Yersinia pestis
caguucauuacaggccccaau

SEQ ID NO: 4151659 - RNA, 13 nt, Yersinia pestis
caguucauucccc

SEQ ID NO: 4151660 - RNA, 21 nt, Yersinia pestis
caguucauuccccaucgccaa

SEQ ID NO: 4151661 - RNA, 16 nt, Yersinia pestis
caguucccuguucucu

SEQ ID NO: 4151662 - RNA, 16 nt, Yersinia pestis
caguucgacaccuuca

SEQ ID NO: 4151663 - RNA, 13 nt, Yersinia pestis
caguucuaacccg

SEQ ID NO: 4151664 - RNA, 13 nt, Yersinia pestis
caguucuggcucu

SEQ ID NO: 4151665 - RNA, 15 nt, Yersinia pestis
caguugaccauuuuu

SEQ ID NO: 4151666 - RNA, 14 nt, Yersinia pestis
caguugaugcaaaa

SEQ ID NO: 4151667 - RNA, 15 nt, Yersinia pestis
caguugcacaccauc

SEQ ID NO: 4151668 - RNA, 22 nt, Yersinia pestis
caguugccaaacaaacgcuuga

SEQ ID NO: 4151669 - RNA, 12 nt, Yersinia pestis
caguugccacuc

SEQ ID NO: 4151670 - RNA, 13 nt, Yersinia pestis
caguugcgccgcu

SEQ ID NO: 4151671 - RNA, 17 nt, Yersinia pestis
caguugguagagcacga

SEQ ID NO: 4151672 - RNA, 16 nt, Yersinia pestis
caguugguuagagcac

SEQ ID NO: 4151673 - RNA, 17 nt, Yersinia pestis
caguuuaccauccacua

SEQ ID NO: 4151674 - RNA, 16 nt, Yersinia pestis
caguuuauccaaggca

SEQ ID NO: 4151675 - RNA, 16 nt, Yersinia pestis
caguuuauuuucccuu

SEQ ID NO: 4151676 - RNA, 12 nt, Yersinia pestis
caguuucaggcg

SEQ ID NO: 4151677 - RNA, 17 nt, Yersinia pestis
caguuucgucaugauaa

SEQ ID NO: 4151678 - RNA, 19 nt, Yersinia pestis
caguuugaucgcuaaucgc

SEQ ID NO: 4151679 - RNA, 16 nt, Yersinia pestis
caguuugcgaccaaua

SEQ ID NO: 4151680 - RNA, 19 nt, Yersinia pestis
caguuugcgaccaauaccg

SEQ ID NO: 4151681 - RNA, 17 nt, Yersinia pestis
caguuuggcugccaugg

SEQ ID NO: 4151682 - RNA, 18 nt, Yersinia pestis
caguuuuauuguauaaaa

SEQ ID NO: 4151683 - RNA, 13 nt, Yersinia pestis
caguuuugccgug

SEQ ID NO: 4151684 - RNA, 18 nt, Yersinia pestis
caguuuuuaauuuaaacu

SEQ ID NO: 4151685 - RNA, 22 nt, Yersinia pestis
caguuuuuaauuuaaacucuuu

SEQ ID NO: 4151686 - RNA, 19 nt, Yersinia pestis
caguuuuucccguaacuua

SEQ ID NO: 4151687 - RNA, 17 nt, Yersinia pestis
caguuuuugguagguuu

SEQ ID NO: 4151688 - RNA, 23 nt, Yersinia pestis
caguuuuuuauggcauaaacuga

SEQ ID NO: 4151689 - RNA, 22 nt, Yersinia pestis
cauaaaaaaacggugaacauuu

SEQ ID NO: 4151690 - RNA, 22 nt, Yersinia pestis
cauaaaaacuaaggggccaaua

SEQ ID NO: 4151691 - RNA, 16 nt, Yersinia pestis
cauaaaaagaaaaaaa

SEQ ID NO: 4151692 - RNA, 23 nt, Yersinia pestis
cauaaaaauacauaucaacacug

SEQ ID NO: 4151693 - RNA, 13 nt, Yersinia pestis
cauaaaaggaugg

SEQ ID NO: 4151694 - RNA, 16 nt, Yersinia pestis
cauaaaaggauggccc

SEQ ID NO: 4151695 - RNA, 19 nt, Yersinia pestis
cauaaaauaaauaauuugu

SEQ ID NO: 4151696 - RNA, 18 nt, Yersinia pestis
cauaaacacgcaaucaga

SEQ ID NO: 4151697 - RNA, 21 nt, Yersinia pestis
cauaaaccaacgguucauauu

SEQ ID NO: 4151698 - RNA, 14 nt, Yersinia pestis
cauaaacugaaguu

SEQ ID NO: 4151699 - RNA, 21 nt, Yersinia pestis
cauaaagacccaauacaccac

SEQ ID NO: 4151700 - RNA, 16 nt, Yersinia pestis
cauaaagauagccacu

SEQ ID NO: 4151701 - RNA, 19 nt, Yersinia pestis
cauaaagauagccacuaac

SEQ ID NO: 4151702 - RNA, 18 nt, Yersinia pestis
cauaaagcaucagacugc

SEQ ID NO: 4151703 - RNA, 20 nt, Yersinia pestis
cauaaagcccgcuucaaagg

SEQ ID NO: 4151704 - RNA, 14 nt, Yersinia pestis
cauaaagcuauuca

SEQ ID NO: 4151705 - RNA, 11 nt, Yersinia pestis
cauaaauaaag

SEQ ID NO: 4151706 - RNA, 22 nt, Yersinia pestis
cauaaauauucauuaaaaaaua

SEQ ID NO: 4151707 - RNA, 17 nt, Yersinia pestis
cauaaauauugguacau

SEQ ID NO: 4151708 - RNA, 16 nt, Yersinia pestis
cauaaauauuuuaugc

SEQ ID NO: 4151709 - RNA, 21 nt, Yersinia pestis
caucaaaugaauaaccuugcu

SEQ ID NO: 4151710 - RNA, 22 nt, Yersinia pestis
caucaacagaggcauuuuuguu

SEQ ID NO: 4151711 - RNA, 20 nt, Yersinia pestis
caucaacaugggcaagcucu

SEQ ID NO: 4151712 - RNA, 17 nt, Yersinia pestis
caucaaggacuucauca

SEQ ID NO: 4151713 - RNA, 15 nt, Yersinia pestis
caucaaggugccaua

SEQ ID NO: 4151714 - RNA, 13 nt, Yersinia pestis
caucaaguauuuu

SEQ ID NO: 4151715 - RNA, 19 nt, Yersinia pestis
caucaauaaaauuacccag

SEQ ID NO: 4151716 - RNA, 22 nt, Yersinia pestis
caucaauaaaauuacccagcau

SEQ ID NO: 4151717 - RNA, 22 nt, Yersinia pestis
caucaauaaauagagugaagua

SEQ ID NO: 4151718 - RNA, 12 nt, Yersinia pestis
caucaauaauaa

SEQ ID NO: 4151719 - RNA, 22 nt, Yersinia pestis
caucaauaauaacgaauuucau

SEQ ID NO: 4151720 - RNA, 18 nt, Yersinia pestis
caucaauacuguuaucac

SEQ ID NO: 4151721 - RNA, 20 nt, Yersinia pestis
caucaauagguaaauccaga

SEQ ID NO: 4151722 - RNA, 17 nt, Yersinia pestis
caucaauagguguugcc

SEQ ID NO: 4151723 - RNA, 19 nt, Yersinia pestis
caucaauguuggcccaaga

SEQ ID NO: 4151724 - RNA, 23 nt, Yersinia pestis
caucaauguuggcccaagauacu

SEQ ID NO: 4151725 - RNA, 14 nt, Yersinia pestis
caucacaccgcgau

SEQ ID NO: 4151726 - RNA, 14 nt, Yersinia pestis
caucacagugccaa

SEQ ID NO: 4151727 - RNA, 16 nt, Yersinia pestis
caucacaucggcgacu

SEQ ID NO: 4151728 - RNA, 12 nt, Yersinia pestis
caucaccacccu

SEQ ID NO: 4151729 - RNA, 17 nt, Yersinia pestis
caucacccaacguggcu

SEQ ID NO: 4151730 - RNA, 13 nt, Yersinia pestis
caucacccagcaa

SEQ ID NO: 4151731 - RNA, 15 nt, Yersinia pestis
caucacccagcaaaa

SEQ ID NO: 4151732 - RNA, 18 nt, Yersinia pestis
caucaccgcuaucacuga

SEQ ID NO: 4151733 - RNA, 19 nt, Yersinia pestis
caucaccuugcgcccuugu

SEQ ID NO: 4151734 - RNA, 22 nt, Yersinia pestis
caucacuggcgggccguuuacu

SEQ ID NO: 4151735 - RNA, 22 nt, Yersinia pestis
caucacuuagugguucuggccc

SEQ ID NO: 4151736 - RNA, 18 nt, Yersinia pestis
caucacuuccagcgcccg

SEQ ID NO: 4151737 - RNA, 22 nt, Yersinia pestis
caucagacacguaaaacaggga

SEQ ID NO: 4151738 - RNA, 22 nt, Yersinia pestis
caucagacugcucuuucccuuc

SEQ ID NO: 4151739 - RNA, 13 nt, Yersinia pestis
caucagaugauga

SEQ ID NO: 4151740 - RNA, 11 nt, Yersinia pestis
caucagcaauu

SEQ ID NO: 4151741 - RNA, 21 nt, Yersinia pestis
caucagcagugacgucaucgu

SEQ ID NO: 4151742 - RNA, 19 nt, Yersinia pestis
caucagcauauuacccagu

SEQ ID NO: 4151743 - RNA, 18 nt, Yersinia pestis
caucagcccauugcugua

SEQ ID NO: 4151744 - RNA, 18 nt, Yersinia pestis
caucagcgacgcuaaaca

SEQ ID NO: 4151745 - RNA, 22 nt, Yersinia pestis
caucagcgacgcuaaacacaga

SEQ ID NO: 4151746 - RNA, 18 nt, Yersinia pestis
caucagcgcccuugccag

SEQ ID NO: 4151747 - RNA, 21 nt, Yersinia pestis
caucagcguagccguuaaaua

SEQ ID NO: 4151748 - RNA, 18 nt, Yersinia pestis
caucaggccuucuuuucu

SEQ ID NO: 4151749 - RNA, 18 nt, Yersinia pestis
caucaggcgcuuuucuau

SEQ ID NO: 4151750 - RNA, 18 nt, Yersinia pestis
caucaggcggguaacugu

SEQ ID NO: 4151751 - RNA, 16 nt, Yersinia pestis
caucaggcuuauauuu

SEQ ID NO: 4151752 - RNA, 20 nt, Yersinia pestis
caucagggaauucaccggca

SEQ ID NO: 4151753 - RNA, 21 nt, Yersinia pestis
caucagggugaccgcacugcc

SEQ ID NO: 4151754 - RNA, 15 nt, Yersinia pestis
caucagguguuguau

SEQ ID NO: 4151755 - RNA, 14 nt, Yersinia pestis
caucaguaauguga

SEQ ID NO: 4151756 - RNA, 19 nt, Yersinia pestis
caucaguaauuuuuuguag

SEQ ID NO: 4151757 - RNA, 17 nt, Yersinia pestis
caucagucacuaaacca

SEQ ID NO: 4151758 - RNA, 11 nt, Yersinia pestis
caucagugacu

SEQ ID NO: 4151759 - RNA, 16 nt, Yersinia pestis
caucauaaaaauacau

SEQ ID NO: 4151760 - RNA, 22 nt, Yersinia pestis
caucauaaaaauacauaucaac

SEQ ID NO: 4151761 - RNA, 22 nt, Yersinia pestis
caucauaaaggcuaaaccggca

SEQ ID NO: 4151762 - RNA, 14 nt, Yersinia pestis
caucauaacgaaug

SEQ ID NO: 4151763 - RNA, 14 nt, Yersinia pestis
caucauauauuaaa

SEQ ID NO: 4151764 - RNA, 16 nt, Yersinia pestis
caucauauucagccga

SEQ ID NO: 4151765 - RNA, 12 nt, Yersinia pestis
caucaucaaaac

SEQ ID NO: 4151766 - RNA, 20 nt, Yersinia pestis
caucaucaaaugaauaaccu

SEQ ID NO: 4151767 - RNA, 13 nt, Yersinia pestis
caucaucaauaaa

SEQ ID NO: 4151768 - RNA, 20 nt, Yersinia pestis
caucaucaauggauucuugc

SEQ ID NO: 4151769 - RNA, 15 nt, Yersinia pestis
caucaucacaaauaa

SEQ ID NO: 4151770 - RNA, 16 nt, Yersinia pestis
caucaucacaaauaac

SEQ ID NO: 4151771 - RNA, 20 nt, Yersinia pestis
caucaucacaaauaacccgc

SEQ ID NO: 4151772 - RNA, 18 nt, Yersinia pestis
caucaucacauucaaaca

SEQ ID NO: 4151773 - RNA, 12 nt, Yersinia pestis
caucauccauaa

SEQ ID NO: 4151774 - RNA, 22 nt, Yersinia pestis
caucaucccagucgucuucagc

SEQ ID NO: 4151775 - RNA, 15 nt, Yersinia pestis
caucaucgcacugua

SEQ ID NO: 4151776 - RNA, 23 nt, Yersinia pestis
caucaucgccacuugaaacauuc

SEQ ID NO: 4151777 - RNA, 13 nt, Yersinia pestis
caucaucuucuuc

SEQ ID NO: 4151778 - RNA, 14 nt, Yersinia pestis
caucaucuucuuca

SEQ ID NO: 4151779 - RNA, 13 nt, Yersinia pestis
caucaucuugaaa

SEQ ID NO: 4151780 - RNA, 21 nt, Yersinia pestis
caucaucuuuuuguaagccag

SEQ ID NO: 4151781 - RNA, 14 nt, Yersinia pestis
caucaugacaaaaa

SEQ ID NO: 4151782 - RNA, 12 nt, Yersinia pestis
caucaugacgau

SEQ ID NO: 4151783 - RNA, 14 nt, Yersinia pestis
caucaugaguaaaa

SEQ ID NO: 4151784 - RNA, 17 nt, Yersinia pestis
caucaugaguaaaagau

SEQ ID NO: 4151785 - RNA, 21 nt, Yersinia pestis
caucauuagccguaaugacuc

SEQ ID NO: 4151786 - RNA, 22 nt, Yersinia pestis
caucauuauuguccgcgcggcu

SEQ ID NO: 4151787 - RNA, 22 nt, Yersinia pestis
caucauucaauuguuccauaug

SEQ ID NO: 4151788 - RNA, 19 nt, Yersinia pestis
caucauucauuuuaaaaaa

SEQ ID NO: 4151789 - RNA, 21 nt, Yersinia pestis
caucauucauuuuaaaaaaau

SEQ ID NO: 4151790 - RNA, 22 nt, Yersinia pestis
caucauucauuuuaaaaaaauu

SEQ ID NO: 4151791 - RNA, 16 nt, Yersinia pestis
caucauuguuuacuau

SEQ ID NO: 4151792 - RNA, 17 nt, Yersinia pestis
cauccaaauagccuugc

SEQ ID NO: 4151793 - RNA, 23 nt, Yersinia pestis
cauccaacguaaacauuggcuuu

SEQ ID NO: 4151794 - RNA, 16 nt, Yersinia pestis
cauccaagccaucauu

SEQ ID NO: 4151795 - RNA, 21 nt, Yersinia pestis
cauccacauauauagagaaau

SEQ ID NO: 4151796 - RNA, 16 nt, Yersinia pestis
cauccagauucagacg

SEQ ID NO: 4151797 - RNA, 15 nt, Yersinia pestis
cauccagcucauaua

SEQ ID NO: 4151798 - RNA, 14 nt, Yersinia pestis
cauccaguaagcug

SEQ ID NO: 4151799 - RNA, 18 nt, Yersinia pestis
cauccaguaagcuguuga

SEQ ID NO: 4151800 - RNA, 13 nt, Yersinia pestis
cauccagugccaa

SEQ ID NO: 4151801 - RNA, 14 nt, Yersinia pestis
cauccagugccaac

SEQ ID NO: 4151802 - RNA, 23 nt, Yersinia pestis
cauccauaaugagugacaacauu

SEQ ID NO: 4151803 - RNA, 16 nt, Yersinia pestis
cauccauuacauccuu

SEQ ID NO: 4151804 - RNA, 13 nt, Yersinia pestis
caucccaaaauag

SEQ ID NO: 4151805 - RNA, 13 nt, Yersinia pestis
caucccaacaauu

SEQ ID NO: 4151806 - RNA, 18 nt, Yersinia pestis
caucccaauaauuaccac

SEQ ID NO: 4151807 - RNA, 14 nt, Yersinia pestis
caucccacucugua

SEQ ID NO: 4151808 - RNA, 20 nt, Yersinia pestis
caucccagucgucuucagcu

SEQ ID NO: 4151809 - RNA, 20 nt, Yersinia pestis
cauccccugccguuggcaua

SEQ ID NO: 4151810 - RNA, 20 nt, Yersinia pestis
caucccggcgacggcuggaa

SEQ ID NO: 4151811 - RNA, 22 nt, Yersinia pestis
caucccgguugcgauacagcgc

SEQ ID NO: 4151812 - RNA, 16 nt, Yersinia pestis
caucccguaggcuugg

SEQ ID NO: 4151813 - RNA, 21 nt, Yersinia pestis
caucccuucgcaaaaugccaa

SEQ ID NO: 4151814 - RNA, 17 nt, Yersinia pestis
cauccgaucagccagcg

SEQ ID NO: 4151815 - RNA, 19 nt, Yersinia pestis
cauccgcaaaauggguaua

SEQ ID NO: 4151816 - RNA, 20 nt, Yersinia pestis
cauccgcaggaagcaaugaa

SEQ ID NO: 4151817 - RNA, 22 nt, Yersinia pestis
cauccgcgaugacacaauuccc

SEQ ID NO: 4151818 - RNA, 14 nt, Yersinia pestis
cauccggcgggcaa

SEQ ID NO: 4151819 - RNA, 16 nt, Yersinia pestis
cauccgguacgcauca

SEQ ID NO: 4151820 - RNA, 20 nt, Yersinia pestis
cauccggugagacagugagg

SEQ ID NO: 4151821 - RNA, 23 nt, Yersinia pestis
cauccggugagacagugagguua

SEQ ID NO: 4151822 - RNA, 19 nt, Yersinia pestis
cauccguccaaugaauauc

SEQ ID NO: 4151823 - RNA, 13 nt, Yersinia pestis
cauccuaaaaagc

SEQ ID NO: 4151824 - RNA, 16 nt, Yersinia pestis
cauccuaaagauaauu

SEQ ID NO: 4151825 - RNA, 19 nt, Yersinia pestis
cauccugcuauuuaacaaa

SEQ ID NO: 4151826 - RNA, 16 nt, Yersinia pestis
cauccuugaucgccaa

SEQ ID NO: 4151827 - RNA, 16 nt, Yersinia pestis
cauccuuuacuccccu

SEQ ID NO: 4151828 - RNA, 23 nt, Yersinia pestis
caucgaagagugcauugaaggua

SEQ ID NO: 4151829 - RNA, 20 nt, Yersinia pestis
caucgacuaauuaaacaagu

SEQ ID NO: 4151830 - RNA, 22 nt, Yersinia pestis
cauguaacacacagcagacagc

SEQ ID NO: 4151831 - RNA, 23 nt, Yersinia pestis
cauguacgcuccgguucuugcgc

SEQ ID NO: 4151832 - RNA, 14 nt, Yersinia pestis
cauguagcacacua

SEQ ID NO: 4151833 - RNA, 16 nt, Yersinia pestis
cauguagcacacuacc

SEQ ID NO: 4151834 - RNA, 21 nt, Yersinia pestis
cauguaguacuuaccuuccca

SEQ ID NO: 4151835 - RNA, 18 nt, Yersinia pestis
cauguccguguuggcaaa

SEQ ID NO: 4151836 - RNA, 14 nt, Yersinia pestis
caugucgaucaugg

SEQ ID NO: 4151837 - RNA, 20 nt, Yersinia pestis
caugucucgguuaaagacau

SEQ ID NO: 4151838 - RNA, 15 nt, Yersinia pestis
caugugcauugacua

SEQ ID NO: 4151839 - RNA, 23 nt, Yersinia pestis
cauguguauuagguuuggccuaa

SEQ ID NO: 4151840 - RNA, 18 nt, Yersinia pestis
cauguuaggauaggguuu

SEQ ID NO: 4151841 - RNA, 14 nt, Yersinia pestis
cauguucagccgcu

SEQ ID NO: 4151842 - RNA, 17 nt, Yersinia pestis
cauguucgcacugcucu

SEQ ID NO: 4151843 - RNA, 14 nt, Yersinia pestis
cauguucucuccua

SEQ ID NO: 4151844 - RNA, 21 nt, Yersinia pestis
cauguucucuccuaaaaucua

SEQ ID NO: 4151845 - RNA, 16 nt, Yersinia pestis
cauguugcgcaggguu

SEQ ID NO: 4151846 - RNA, 15 nt, Yersinia pestis
cauguuuaucaaaca

SEQ ID NO: 4151847 - RNA, 12 nt, Yersinia pestis
cauuaaaaacaa

SEQ ID NO: 4151848 - RNA, 13 nt, Yersinia pestis
cauuaaaaacaaa

SEQ ID NO: 4151849 - RNA, 14 nt, Yersinia pestis
cauuaaaaauacaa

SEQ ID NO: 4151850 - RNA, 13 nt, Yersinia pestis
cauuaaaauaaca

SEQ ID NO: 4151851 - RNA, 15 nt, Yersinia pestis
cauuaaaauaacaau

SEQ ID NO: 4151852 - RNA, 18 nt, Yersinia pestis
cauuaaaauaacaauuca

SEQ ID NO: 4151853 - RNA, 11 nt, Yersinia pestis
cauuaaacaga

SEQ ID NO: 4151854 - RNA, 15 nt, Yersinia pestis
cauuaaacuguucuu

SEQ ID NO: 4151855 - RNA, 21 nt, Yersinia pestis
cauuaaagauuucaucauuca

SEQ ID NO: 4151856 - RNA, 22 nt, Yersinia pestis
cauuaaagauuucaucauucaa

SEQ ID NO: 4151857 - RNA, 13 nt, Yersinia pestis
cauuaacaaacug

SEQ ID NO: 4151858 - RNA, 22 nt, Yersinia pestis
cauuaauaccguuuucuuucaa

SEQ ID NO: 4151859 - RNA, 22 nt, Yersinia pestis
cauuaaugcagguucauuacac

SEQ ID NO: 4151860 - RNA, 22 nt, Yersinia pestis
cauuaauggcagcauacauauc

SEQ ID NO: 4151861 - RNA, 17 nt, Yersinia pestis
cauuaauuaauaagccc

SEQ ID NO: 4151862 - RNA, 18 nt, Yersinia pestis
cauuaauuaaucagacac

SEQ ID NO: 4151863 - RNA, 17 nt, Yersinia pestis
cauuacaagugccaaau

SEQ ID NO: 4151864 - RNA, 21 nt, Yersinia pestis
cauuacagggcgaauggaaga

SEQ ID NO: 4151865 - RNA, 13 nt, Yersinia pestis
cauuacaucaucu

SEQ ID NO: 4151866 - RNA, 23 nt, Yersinia pestis
cauuaccccguugcucuacacag

SEQ ID NO: 4151867 - RNA, 18 nt, Yersinia pestis
cauuacccgaaucacuga

SEQ ID NO: 4151868 - RNA, 20 nt, Yersinia pestis
cauuacccgaaucacugacu

SEQ ID NO: 4151869 - RNA, 20 nt, Yersinia pestis
cauuaccgcacacuacagcc

SEQ ID NO: 4151870 - RNA, 18 nt, Yersinia pestis
cauuaccuuggugagaac

SEQ ID NO: 4151871 - RNA, 20 nt, Yersinia pestis
cauuacugaugcguugugau

SEQ ID NO: 4151872 - RNA, 16 nt, Yersinia pestis
cauuacugcggaucaa

SEQ ID NO: 4151873 - RNA, 20 nt, Yersinia pestis
cauuacugcggaucaaccgc

SEQ ID NO: 4151874 - RNA, 19 nt, Yersinia pestis
cauuagccccaaaugccag

SEQ ID NO: 4151875 - RNA, 19 nt, Yersinia pestis
cauuagggccaccagacug

SEQ ID NO: 4151876 - RNA, 16 nt, Yersinia pestis
cauuagucugaggcca

SEQ ID NO: 4151877 - RNA, 20 nt, Yersinia pestis
cauuagugaaucaucaauac

SEQ ID NO: 4151878 - RNA, 18 nt, Yersinia pestis
cauuauaaggaauauacu

SEQ ID NO: 4151879 - RNA, 14 nt, Yersinia pestis
cauuauauuauuua

SEQ ID NO: 4151880 - RNA, 15 nt, Yersinia pestis
cauuauauuauuuau

SEQ ID NO: 4151881 - RNA, 22 nt, Yersinia pestis
cauuauauuauuuaucaaucag

SEQ ID NO: 4151882 - RNA, 19 nt, Yersinia pestis
cauuauccggccauuuuuu

SEQ ID NO: 4151883 - RNA, 19 nt, Yersinia pestis
cauuaucgccagcaacuau

SEQ ID NO: 4151884 - RNA, 21 nt, Yersinia pestis
cauuaucuaaacaauugccuu

SEQ ID NO: 4151885 - RNA, 15 nt, Yersinia pestis
cauuaucugaaagca

SEQ ID NO: 4151886 - RNA, 18 nt, Yersinia pestis
cauuaucuuuaauuuuuc

SEQ ID NO: 4151887 - RNA, 20 nt, Yersinia pestis
cauuauuauaggcguugaug

SEQ ID NO: 4151888 - RNA, 17 nt, Yersinia pestis
cauuauuauguauuuuu

SEQ ID NO: 4151889 - RNA, 21 nt, Yersinia pestis
cauuauuauguauuuuuaugc

SEQ ID NO: 4151890 - RNA, 13 nt, Yersinia pestis
cauuauuauuuac

SEQ ID NO: 4151891 - RNA, 16 nt, Yersinia pestis
cauuauugauugcauc

SEQ ID NO: 4151892 - RNA, 17 nt, Yersinia pestis
cauuauuuauagguaua

SEQ ID NO: 4151893 - RNA, 15 nt, Yersinia pestis
cauucaaaaauuaaa

SEQ ID NO: 4151894 - RNA, 13 nt, Yersinia pestis
cauucaagccuaa

SEQ ID NO: 4151895 - RNA, 13 nt, Yersinia pestis
cauucaauguaaa

SEQ ID NO: 4151896 - RNA, 12 nt, Yersinia pestis
cauucaauuccu

SEQ ID NO: 4151897 - RNA, 18 nt, Yersinia pestis
cauucacgccgcuccuga

SEQ ID NO: 4151898 - RNA, 14 nt, Yersinia pestis
cauucagcaauauu

SEQ ID NO: 4151899 - RNA, 18 nt, Yersinia pestis
cauucagcacccaacuua

SEQ ID NO: 4151900 - RNA, 15 nt, Yersinia pestis
cauucagcagcaaga

SEQ ID NO: 4151901 - RNA, 20 nt, Yersinia pestis
cauucagcgucacgauagca

SEQ ID NO: 4151902 - RNA, 16 nt, Yersinia pestis
cauucaggccgaguaa

SEQ ID NO: 4151903 - RNA, 23 nt, Yersinia pestis
cauucaucccgguugcgauacag

SEQ ID NO: 4151904 - RNA, 22 nt, Yersinia pestis
cauucaugaggcuucuuaauuc

SEQ ID NO: 4151905 - RNA, 14 nt, Yersinia pestis
cauucauuuuaaaa

SEQ ID NO: 4151906 - RNA, 16 nt, Yersinia pestis
cauuccccaucgccaa

SEQ ID NO: 4151907 - RNA, 20 nt, Yersinia pestis
cauuccccaucgccaauugg

SEQ ID NO: 4151908 - RNA, 15 nt, Yersinia pestis
cauucccugcgguua

SEQ ID NO: 4151909 - RNA, 22 nt, Yersinia pestis
cauucccugcgguuauuugcua

SEQ ID NO: 4151910 - RNA, 17 nt, Yersinia pestis
cauuccguuuaaacucc

SEQ ID NO: 4151911 - RNA, 14 nt, Yersinia pestis
cauucgccugauaa

SEQ ID NO: 4151912 - RNA, 15 nt, Yersinia pestis
cauucgccugauaaa

SEQ ID NO: 4151913 - RNA, 18 nt, Yersinia pestis
cauucgcgccccaaauaa

SEQ ID NO: 4151914 - RNA, 22 nt, Yersinia pestis
cauucgcgguuacaccaauaau

SEQ ID NO: 4151915 - RNA, 15 nt, Yersinia pestis
cauucguucguuauu

SEQ ID NO: 4151916 - RNA, 12 nt, Yersinia pestis
cauucuagccuu

SEQ ID NO: 4151917 - RNA, 14 nt, Yersinia pestis
cauucuaucauccu

SEQ ID NO: 4151918 - RNA, 23 nt, Yersinia pestis
cauucucuacucgcucaccacug

SEQ ID NO: 4151919 - RNA, 16 nt, Yersinia pestis
cauucugauagugauu

SEQ ID NO: 4151920 - RNA, 12 nt, Yersinia pestis
cauucuugauuu

SEQ ID NO: 4151921 - RNA, 19 nt, Yersinia pestis
cauucuuuuuguuaaaaua

SEQ ID NO: 4151922 - RNA, 22 nt, Yersinia pestis
cauugaauggugcuguauuuaa

SEQ ID NO: 4151923 - RNA, 13 nt, Yersinia pestis
cauugaccaaagc

SEQ ID NO: 4151924 - RNA, 13 nt, Yersinia pestis
cauugaccgccaa

SEQ ID NO: 4151925 - RNA, 13 nt, Yersinia pestis
cauugacguuaca

SEQ ID NO: 4151926 - RNA, 13 nt, Yersinia pestis
cauugagaucaga

SEQ ID NO: 4151927 - RNA, 22 nt, Yersinia pestis
cauugagcgccacaucggcguu

SEQ ID NO: 4151928 - RNA, 23 nt, Yersinia pestis
cauugaguucugaucauuauuau

SEQ ID NO: 4151929 - RNA, 14 nt, Yersinia pestis
cauugauaauaaua

SEQ ID NO: 4151930 - RNA, 17 nt, Yersinia pestis
cauugauaaucuccauu

SEQ ID NO: 4151931 - RNA, 19 nt, Yersinia pestis
cauugauaaucuccauuga

SEQ ID NO: 4151932 - RNA, 18 nt, Yersinia pestis
cauugauccucguuaguc

SEQ ID NO: 4151933 - RNA, 13 nt, Yersinia pestis
cauugauggccuu

SEQ ID NO: 4151934 - RNA, 23 nt, Yersinia pestis
cauugauuggcuccuauagcuca

SEQ ID NO: 4151935 - RNA, 16 nt, Yersinia pestis
cauugcaaacaucaca

SEQ ID NO: 4151936 - RNA, 19 nt, Yersinia pestis
cauugcagaaagcugaacu

SEQ ID NO: 4151937 - RNA, 14 nt, Yersinia pestis
cauugcagacugcu

SEQ ID NO: 4151938 - RNA, 16 nt, Yersinia pestis
cauugcgcuaacagcg

SEQ ID NO: 4151939 - RNA, 17 nt, Yersinia pestis
cauugcguaauuaccca

SEQ ID NO: 4151940 - RNA, 19 nt, Yersinia pestis
cauugcgugcaauaaagcg

SEQ ID NO: 4151941 - RNA, 12 nt, Yersinia pestis
cauugcuaaauu

SEQ ID NO: 4151942 - RNA, 19 nt, Yersinia pestis
cauugcucaaacucagcau

SEQ ID NO: 4151943 - RNA, 16 nt, Yersinia pestis
cauugcugcuguuauu

SEQ ID NO: 4151944 - RNA, 20 nt, Yersinia pestis
cauugcuguuguuauuacug

SEQ ID NO: 4151945 - RNA, 20 nt, Yersinia pestis
cauugcuuugcgauacacca

SEQ ID NO: 4151946 - RNA, 17 nt, Yersinia pestis
cauuggaaaaaaucuuc

SEQ ID NO: 4151947 - RNA, 19 nt, Yersinia pestis
cauuggagauccguuuuuu

SEQ ID NO: 4151948 - RNA, 20 nt, Yersinia pestis
cauuggauaauuugccuggc

SEQ ID NO: 4151949 - RNA, 15 nt, Yersinia pestis
cauuggcaaaggcca

SEQ ID NO: 4151950 - RNA, 16 nt, Yersinia pestis
cauuggcaaaggccag

SEQ ID NO: 4151951 - RNA, 18 nt, Yersinia pestis
cauuggcgguuauuauuu

SEQ ID NO: 4151952 - RNA, 20 nt, Yersinia pestis
ccaacccccauuagcaguaa

SEQ ID NO: 4151953 - RNA, 13 nt, Yersinia pestis
ccaaccgguauug

SEQ ID NO: 4151954 - RNA, 21 nt, Yersinia pestis
ccaacgcaagcgggccaaggg

SEQ ID NO: 4151955 - RNA, 21 nt, Yersinia pestis
ccaacgcacugguugcuucau

SEQ ID NO: 4151956 - RNA, 16 nt, Yersinia pestis
ccaacgcggcccccgc

SEQ ID NO: 4151957 - RNA, 22 nt, Yersinia pestis
ccaacgcggcccccgcaggggu

SEQ ID NO: 4151958 - RNA, 23 nt, Yersinia pestis
ccaacgguagggcguucugucac

SEQ ID NO: 4151959 - RNA, 22 nt, Yersinia pestis
ccaacgucauuuccguuaaccc

SEQ ID NO: 4151960 - RNA, 20 nt, Yersinia pestis
ccaacuaaacagggcagaaa

SEQ ID NO: 4151961 - RNA, 22 nt, Yersinia pestis
ccaacuaaacagggcagaaaau

SEQ ID NO: 4151962 - RNA, 23 nt, Yersinia pestis
ccaacucaccuaaaucauacagg

SEQ ID NO: 4151963 - RNA, 15 nt, Yersinia pestis
ccaacugaaacugga

SEQ ID NO: 4151964 - RNA, 14 nt, Yersinia pestis
ccaacuguaaaauc

SEQ ID NO: 4151965 - RNA, 19 nt, Yersinia pestis
ccaacuuaccuugauccgc

SEQ ID NO: 4151966 - RNA, 14 nt, Yersinia pestis
ccaacuugccgcgg

SEQ ID NO: 4151967 - RNA, 19 nt, Yersinia pestis
ccaacuugcuggcaggaaa

SEQ ID NO: 4151968 - RNA, 18 nt, Yersinia pestis
ccaagaaaagcaccgcag

SEQ ID NO: 4151969 - RNA, 22 nt, Yersinia pestis
ccaagaaacgccccgauaaacc

SEQ ID NO: 4151970 - RNA, 18 nt, Yersinia pestis
ccaagaagauaacuuuuu

SEQ ID NO: 4151971 - RNA, 19 nt, Yersinia pestis
ccaagaagauaacuuuuua

SEQ ID NO: 4151972 - RNA, 12 nt, Yersinia pestis
ccaagacugaag

SEQ ID NO: 4151973 - RNA, 14 nt, Yersinia pestis
ccaagacuuuccac

SEQ ID NO: 4151974 - RNA, 17 nt, Yersinia pestis
ccaagauaccgaguucu

SEQ ID NO: 4151975 - RNA, 24 nt, Yersinia pestis
ccaagauuuuuagcgugccgcagu

SEQ ID NO: 4151976 - RNA, 15 nt, Yersinia pestis
ccaagcccaguaaag

SEQ ID NO: 4151977 - RNA, 14 nt, Yersinia pestis
ccaagcggcagggg

SEQ ID NO: 4151978 - RNA, 18 nt, Yersinia pestis
ccaagcggcaggggcgcg

SEQ ID NO: 4151979 - RNA, 13 nt, Yersinia pestis
ccaaggauggcgc

SEQ ID NO: 4151980 - RNA, 17 nt, Yersinia pestis
ccaaggcaugauaggca

SEQ ID NO: 4151981 - RNA, 20 nt, Yersinia pestis
ccaaggcggaauagaggaag

SEQ ID NO: 4151982 - RNA, 17 nt, Yersinia pestis
ccaaggggagccacaca

SEQ ID NO: 4151983 - RNA, 19 nt, Yersinia pestis
ccaaggggagccacacacu

SEQ ID NO: 4151984 - RNA, 15 nt, Yersinia pestis
ccaagguuauacacu

SEQ ID NO: 4151985 - RNA, 15 nt, Yersinia pestis
ccaaguccuccuuga

SEQ ID NO: 4151986 - RNA, 15 nt, Yersinia pestis
ccaaguucaacuuca

SEQ ID NO: 4151987 - RNA, 18 nt, Yersinia pestis
ccaaguuugcagucgcuu

SEQ ID NO: 4151988 - RNA, 17 nt, Yersinia pestis
ccaauaaaaugcaccgc

SEQ ID NO: 4151989 - RNA, 14 nt, Yersinia pestis
ccaauaacguccug

SEQ ID NO: 4151990 - RNA, 15 nt, Yersinia pestis
ccaauaagauaaaca

SEQ ID NO: 4151991 - RNA, 14 nt, Yersinia pestis
ccaauaauaaaaaa

SEQ ID NO: 4151992 - RNA, 18 nt, Yersinia pestis
ccaauaauaaaaaaaaau

SEQ ID NO: 4151993 - RNA, 19 nt, Yersinia pestis
ccaauaauaaaaaaaaaua

SEQ ID NO: 4151994 - RNA, 23 nt, Yersinia pestis
ccaauaauaaaaaaaaauaaaau

SEQ ID NO: 4151995 - RNA, 17 nt, Yersinia pestis
ccaauaauaauccauaa

SEQ ID NO: 4151996 - RNA, 10 nt, Yersinia pestis
ccaauaaugc

SEQ ID NO: 4151997 - RNA, 16 nt, Yersinia pestis
ccaauacaaacagggc

SEQ ID NO: 4151998 - RNA, 23 nt, Yersinia pestis
ccaauacaaacagggcagccaau

SEQ ID NO: 4151999 - RNA, 14 nt, Yersinia pestis
ccaauacaaucguc

SEQ ID NO: 4152000 - RNA, 15 nt, Yersinia pestis
ccaauaccaauucuu

SEQ ID NO: 4152001 - RNA, 16 nt, Yersinia pestis
ccaauagaaaaacacu

SEQ ID NO: 4152002 - RNA, 19 nt, Yersinia pestis
ccaauagaaaaacacuggc

SEQ ID NO: 4152003 - RNA, 13 nt, Yersinia pestis
ccaauauccauau

SEQ ID NO: 4152004 - RNA, 21 nt, Yersinia pestis
ccaauaucuguggugacauga

SEQ ID NO: 4152005 - RNA, 18 nt, Yersinia pestis
ccaauaugaaauuucacu

SEQ ID NO: 4152006 - RNA, 19 nt, Yersinia pestis
ccaauauggguauugagcg

SEQ ID NO: 4152007 - RNA, 13 nt, Yersinia pestis
ccaauauugaucc

SEQ ID NO: 4152008 - RNA, 20 nt, Yersinia pestis
ccaauauuggauaauaaccu

SEQ ID NO: 4152009 - RNA, 13 nt, Yersinia pestis
ccaaucaaaaaac

SEQ ID NO: 4152010 - RNA, 24 nt, Yersinia pestis
ccaaucaccuuggaaaacagcaac

SEQ ID NO: 4152011 - RNA, 22 nt, Yersinia pestis
ccaaucaucacgauaauaucga

SEQ ID NO: 4152012 - RNA, 18 nt, Yersinia pestis
ccaaucaucaucccaguc

SEQ ID NO: 4152013 - RNA, 18 nt, Yersinia pestis
ccaaucauuacaucaucu

SEQ ID NO: 4152014 - RNA, 14 nt, Yersinia pestis
ccaauccccaccaa

SEQ ID NO: 4152015 - RNA, 21 nt, Yersinia pestis
ccaauccgccuuuaauaccgc

SEQ ID NO: 4152016 - RNA, 18 nt, Yersinia pestis
ccaaucggccuuaaccaa

SEQ ID NO: 4152017 - RNA, 17 nt, Yersinia pestis
ccaaugacguugaguaa

SEQ ID NO: 4152018 - RNA, 12 nt, Yersinia pestis
ccaaugauuaac

SEQ ID NO: 4152019 - RNA, 19 nt, Yersinia pestis
ccaaugcauccaagccauc

SEQ ID NO: 4152020 - RNA, 16 nt, Yersinia pestis
ccaaugccucuucaau

SEQ ID NO: 4152021 - RNA, 14 nt, Yersinia pestis
ccaauggcucaccu

SEQ ID NO: 4152022 - RNA, 19 nt, Yersinia pestis
ccaauguugcugaauaaau

SEQ ID NO: 4152023 - RNA, 18 nt, Yersinia pestis
ccaauuacgcugcccuga

SEQ ID NO: 4152024 - RNA, 19 nt, Yersinia pestis
ccaauucaaggccagcacg

SEQ ID NO: 4152025 - RNA, 18 nt, Yersinia pestis
ccaauucacgcaaggcca

SEQ ID NO: 4152026 - RNA, 17 nt, Yersinia pestis
ccaauucagcaacgguu

SEQ ID NO: 4152027 - RNA, 16 nt, Yersinia pestis
ccaauugaguaacuga

SEQ ID NO: 4152028 - RNA, 22 nt, Yersinia pestis
ccaauuggugcuuuauguauuc

SEQ ID NO: 4152029 - RNA, 12 nt, Yersinia pestis
ccaauuguuuua

SEQ ID NO: 4152030 - RNA, 22 nt, Yersinia pestis
ccaauuucucggccaacaucuu

SEQ ID NO: 4152031 - RNA, 19 nt, Yersinia pestis
ccacaaaggucagcauggu

SEQ ID NO: 4152032 - RNA, 20 nt, Yersinia pestis
ccacaaaggucagcaugguc

SEQ ID NO: 4152033 - RNA, 14 nt, Yersinia pestis
ccacaaauuuuuac

SEQ ID NO: 4152034 - RNA, 15 nt, Yersinia pestis
ccacaaccugcgcca

SEQ ID NO: 4152035 - RNA, 15 nt, Yersinia pestis
ccacacaauacauag

SEQ ID NO: 4152036 - RNA, 21 nt, Yersinia pestis
ccacacaguauucugcuucca

SEQ ID NO: 4152037 - RNA, 20 nt, Yersinia pestis
ccacacauaccacacacaaa

SEQ ID NO: 4152038 - RNA, 16 nt, Yersinia pestis
ccacacauucagucac

SEQ ID NO: 4152039 - RNA, 21 nt, Yersinia pestis
ccacacccucuaucucacccu

SEQ ID NO: 4152040 - RNA, 14 nt, Yersinia pestis
ccacacccucucuu

SEQ ID NO: 4152041 - RNA, 24 nt, Yersinia pestis
ccacaccggcugcaauaagccaga

SEQ ID NO: 4152042 - RNA, 12 nt, Yersinia pestis
ccacacugucau

SEQ ID NO: 4152043 - RNA, 17 nt, Yersinia pestis
ccacacugucaucacug

SEQ ID NO: 4152044 - RNA, 14 nt, Yersinia pestis
ccacacuuuugcug

SEQ ID NO: 4152045 - RNA, 18 nt, Yersinia pestis
ccacagcaacaggguaau

SEQ ID NO: 4152046 - RNA, 21 nt, Yersinia pestis
ccacagcaaugcaccgacaaa

SEQ ID NO: 4152047 - RNA, 18 nt, Yersinia pestis
ccacagguggggcaguua

SEQ ID NO: 4152048 - RNA, 20 nt, Yersinia pestis
ccacagguggggcaguuaac

SEQ ID NO: 4152049 - RNA, 19 nt, Yersinia pestis
ccacagucgccgucaauuu

SEQ ID NO: 4152050 - RNA, 14 nt, Yersinia pestis
ccacagugagaaac

SEQ ID NO: 4152051 - RNA, 22 nt, Yersinia pestis
ccacauaaaaagaaaaaaacag

SEQ ID NO: 4152052 - RNA, 17 nt, Yersinia pestis
ccacauaaaauagccca

SEQ ID NO: 4152053 - RNA, 19 nt, Yersinia pestis
ccacauaacgcacugguca

SEQ ID NO: 4152054 - RNA, 22 nt, Yersinia pestis
ccacauagcugcgauaauccgc

SEQ ID NO: 4152055 - RNA, 23 nt, Yersinia pestis
ccacauagcugcgauaauccgcc

SEQ ID NO: 4152056 - RNA, 19 nt, Yersinia pestis
ccacaucaaaccggcuaau

SEQ ID NO: 4152057 - RNA, 13 nt, Yersinia pestis
ccacaucaggccg

SEQ ID NO: 4152058 - RNA, 17 nt, Yersinia pestis
ccacaugagauucagga

SEQ ID NO: 4152059 - RNA, 19 nt, Yersinia pestis
ccacaugagauucaggaga

SEQ ID NO: 4152060 - RNA, 18 nt, Yersinia pestis
ccacauggcugcucagcc

SEQ ID NO: 4152061 - RNA, 22 nt, Yersinia pestis
ccacaugguuucaaugagcaua

SEQ ID NO: 4152062 - RNA, 14 nt, Yersinia pestis
ccacauucaggccg

SEQ ID NO: 4152063 - RNA, 20 nt, Yersinia pestis
ccacauucaguacauaaacc

SEQ ID NO: 4152064 - RNA, 23 nt, Yersinia pestis
ccacauuuccuaugugauauuuu

SEQ ID NO: 4152065 - RNA, 18 nt, Yersinia pestis
ccacauuuuggccuucau

SEQ ID NO: 4152066 - RNA, 14 nt, Yersinia pestis
ccaccaacccgccc

SEQ ID NO: 4152067 - RNA, 16 nt, Yersinia pestis
ccaccaacccgccccc

SEQ ID NO: 4152068 - RNA, 16 nt, Yersinia pestis
ccaccaacuccugccu

SEQ ID NO: 4152069 - RNA, 14 nt, Yersinia pestis
ccaccaagggucau

SEQ ID NO: 4152070 - RNA, 20 nt, Yersinia pestis
ccaccaagggucaucaacaa

SEQ ID NO: 4152071 - RNA, 15 nt, Yersinia pestis
ccaccaauuucaucg

SEQ ID NO: 4152072 - RNA, 16 nt, Yersinia pestis
ccaccaccacaccggc

SEQ ID NO: 4152073 - RNA, 13 nt, Yersinia pestis
ccagcggcggcca

SEQ ID NO: 4152074 - RNA, 15 nt, Yersinia pestis
ccagcggcuuauucc

SEQ ID NO: 4152075 - RNA, 17 nt, Yersinia pestis
ccagcgggaaucaaacu

SEQ ID NO: 4152076 - RNA, 15 nt, Yersinia pestis
ccagcgggcgcagcc

SEQ ID NO: 4152077 - RNA, 16 nt, Yersinia pestis
ccagcgggcgcagcca

SEQ ID NO: 4152078 - RNA, 21 nt, Yersinia pestis
ccagcguccugugcaaagugc

SEQ ID NO: 4152079 - RNA, 19 nt, Yersinia pestis
ccagcgucuucaguggcug

SEQ ID NO: 4152080 - RNA, 13 nt, Yersinia pestis
ccagcugcaauug

SEQ ID NO: 4152081 - RNA, 20 nt, Yersinia pestis
ccagcuuacgguuagcgauu

SEQ ID NO: 4152082 - RNA, 16 nt, Yersinia pestis
ccagcuucuuuuaaag

SEQ ID NO: 4152083 - RNA, 14 nt, Yersinia pestis
ccagcuugggugaa

SEQ ID NO: 4152084 - RNA, 19 nt, Yersinia pestis
ccagcuuuagcauugcaga

SEQ ID NO: 4152085 - RNA, 24 nt, Yersinia pestis
ccagcuuuagcauugcagauuucu

SEQ ID NO: 4152086 - RNA, 15 nt, Yersinia pestis
ccaggaagcggccag

SEQ ID NO: 4152087 - RNA, 18 nt, Yersinia pestis
ccaggaauuaacaauucu

SEQ ID NO: 4152088 - RNA, 14 nt, Yersinia pestis
ccaggacauccagc

SEQ ID NO: 4152089 - RNA, 20 nt, Yersinia pestis
ccaggacgacauccacauug

SEQ ID NO: 4152090 - RNA, 16 nt, Yersinia pestis
ccaggacuuuguuagc

SEQ ID NO: 4152091 - RNA, 19 nt, Yersinia pestis
ccaggaucaacuuucucuu

SEQ ID NO: 4152092 - RNA, 17 nt, Yersinia pestis
ccaggcaacgacagcaa

SEQ ID NO: 4152093 - RNA, 16 nt, Yersinia pestis
ccaggcaagaaacuuc

SEQ ID NO: 4152094 - RNA, 20 nt, Yersinia pestis
ccaggcaagaaacuucauuu

SEQ ID NO: 4152095 - RNA, 13 nt, Yersinia pestis
ccaggcacugucc

SEQ ID NO: 4152096 - RNA, 17 nt, Yersinia pestis
ccaggccacuugggcug

SEQ ID NO: 4152097 - RNA, 19 nt, Yersinia pestis
ccaggccuccgcaaacuua

SEQ ID NO: 4152098 - RNA, 12 nt, Yersinia pestis
ccaggcuggcca

SEQ ID NO: 4152099 - RNA, 13 nt, Yersinia pestis
ccagggcaccaag

SEQ ID NO: 4152100 - RNA, 20 nt, Yersinia pestis
ccagggcuaaaauggcacaa

SEQ ID NO: 4152101 - RNA, 17 nt, Yersinia pestis
ccaggucaaucaauucu

SEQ ID NO: 4152102 - RNA, 17 nt, Yersinia pestis
ccaggucaguuuuaccc

SEQ ID NO: 4152103 - RNA, 12 nt, Yersinia pestis
ccagguuacugc

SEQ ID NO: 4152104 - RNA, 19 nt, Yersinia pestis
ccagguucauuauuuauuc

SEQ ID NO: 4152105 - RNA, 19 nt, Yersinia pestis
ccagguucuaccgcuagau

SEQ ID NO: 4152106 - RNA, 17 nt, Yersinia pestis
ccaguaaaagaauaaau

SEQ ID NO: 4152107 - RNA, 12 nt, Yersinia pestis
ccaguaacuggc

SEQ ID NO: 4152108 - RNA, 19 nt, Yersinia pestis
ccaguagcacaaugccuaa

SEQ ID NO: 4152109 - RNA, 14 nt, Yersinia pestis
ccaguagcccagcc

SEQ ID NO: 4152110 - RNA, 21 nt, Yersinia pestis
ccaguagccguuacaaucugc

SEQ ID NO: 4152111 - RNA, 22 nt, Yersinia pestis
ccaguaggggccaccaaauaaa

SEQ ID NO: 4152112 - RNA, 18 nt, Yersinia pestis
ccaguauugcagagcaaa

SEQ ID NO: 4152113 - RNA, 21 nt, Yersinia pestis
ccagucacuaccgcucagaua

SEQ ID NO: 4152114 - RNA, 13 nt, Yersinia pestis
ccagucauucacc

SEQ ID NO: 4152115 - RNA, 19 nt, Yersinia pestis
ccagucgucuucagcuucc

SEQ ID NO: 4152116 - RNA, 18 nt, Yersinia pestis
ccagucuaaacgccgcgu

SEQ ID NO: 4152117 - RNA, 17 nt, Yersinia pestis
ccagucucuuugccaag

SEQ ID NO: 4152118 - RNA, 15 nt, Yersinia pestis
ccagugaguccuuua

SEQ ID NO: 4152119 - RNA, 16 nt, Yersinia pestis
ccagugauaaaugcua

SEQ ID NO: 4152120 - RNA, 17 nt, Yersinia pestis
ccagugcaaauuuaugc

SEQ ID NO: 4152121 - RNA, 19 nt, Yersinia pestis
ccagugccgcggcggccag

SEQ ID NO: 4152122 - RNA, 21 nt, Yersinia pestis
ccagugcgcgauaaacgguag

SEQ ID NO: 4152123 - RNA, 13 nt, Yersinia pestis
ccagugcggaagc

SEQ ID NO: 4152124 - RNA, 16 nt, Yersinia pestis
ccagugcuauucauaa

SEQ ID NO: 4152125 - RNA, 19 nt, Yersinia pestis
ccaguggcucgacggccaa

SEQ ID NO: 4152126 - RNA, 18 nt, Yersinia pestis
ccaguggucaucaccguu

SEQ ID NO: 4152127 - RNA, 20 nt, Yersinia pestis
ccaguguuuucuccacacca

SEQ ID NO: 4152128 - RNA, 17 nt, Yersinia pestis
ccaguuaaagaauacag

SEQ ID NO: 4152129 - RNA, 13 nt, Yersinia pestis
ccaguuauagcgg

SEQ ID NO: 4152130 - RNA, 14 nt, Yersinia pestis
ccaguucaguccag

SEQ ID NO: 4152131 - RNA, 20 nt, Yersinia pestis
ccaguucugguagcugcuca

SEQ ID NO: 4152132 - RNA, 21 nt, Yersinia pestis
ccaguuugcgaccaauaccga

SEQ ID NO: 4152133 - RNA, 20 nt, Yersinia pestis
ccaguuuuccagagcccggg

SEQ ID NO: 4152134 - RNA, 16 nt, Yersinia pestis
ccaguuuuuuccugcu

SEQ ID NO: 4152135 - RNA, 18 nt, Yersinia pestis
ccaguuuuuuccugcugc

SEQ ID NO: 4152136 - RNA, 20 nt, Yersinia pestis
ccauaaaaacuucagagcca

SEQ ID NO: 4152137 - RNA, 19 nt, Yersinia pestis
ccauaaaaggauggcccaa

SEQ ID NO: 4152138 - RNA, 17 nt, Yersinia pestis
ccauaaaauaaauaauu

SEQ ID NO: 4152139 - RNA, 18 nt, Yersinia pestis
ccauaaacggaacucauc

SEQ ID NO: 4152140 - RNA, 11 nt, Yersinia pestis
ccauaaauaaa

SEQ ID NO: 4152141 - RNA, 20 nt, Yersinia pestis
ccauaaccugagcaccagaa

SEQ ID NO: 4152142 - RNA, 14 nt, Yersinia pestis
ccauaacuucuggu

SEQ ID NO: 4152143 - RNA, 23 nt, Yersinia pestis
ccauaaucgcaccggagcaaggg

SEQ ID NO: 4152144 - RNA, 22 nt, Yersinia pestis
ccauaaucuggaagcgcagguu

SEQ ID NO: 4152145 - RNA, 21 nt, Yersinia pestis
ccauaaugagugacaacauug

SEQ ID NO: 4152146 - RNA, 14 nt, Yersinia pestis
ccauaaugccguua

SEQ ID NO: 4152147 - RNA, 14 nt, Yersinia pestis
ccauaaugugccuc

SEQ ID NO: 4152148 - RNA, 12 nt, Yersinia pestis
ccauaauuccac

SEQ ID NO: 4152149 - RNA, 22 nt, Yersinia pestis
ccauaauucugccgacuaauau

SEQ ID NO: 4152150 - RNA, 14 nt, Yersinia pestis
ccauacaguuaauu

SEQ ID NO: 4152151 - RNA, 18 nt, Yersinia pestis
ccauacaguuaauuucaa

SEQ ID NO: 4152152 - RNA, 17 nt, Yersinia pestis
ccauaccaggccacggc

SEQ ID NO: 4152153 - RNA, 21 nt, Yersinia pestis
ccauagaugcaaaugucagau

SEQ ID NO: 4152154 - RNA, 12 nt, Yersinia pestis
ccauagauuaau

SEQ ID NO: 4152155 - RNA, 18 nt, Yersinia pestis
ccauagccgaucaccgca

SEQ ID NO: 4152156 - RNA, 16 nt, Yersinia pestis
ccauagguugcaacug

SEQ ID NO: 4152157 - RNA, 23 nt, Yersinia pestis
ccauagugauuauuuaaacaaug

SEQ ID NO: 4152158 - RNA, 12 nt, Yersinia pestis
ccauaguugaac

SEQ ID NO: 4152159 - RNA, 19 nt, Yersinia pestis
ccauauacccaaagccagu

SEQ ID NO: 4152160 - RNA, 23 nt, Yersinia pestis
ccauauauucuguuguaaccagu

SEQ ID NO: 4152161 - RNA, 12 nt, Yersinia pestis
ccauaucaaccg

SEQ ID NO: 4152162 - RNA, 16 nt, Yersinia pestis
ccauauccucaagacc

SEQ ID NO: 4152163 - RNA, 19 nt, Yersinia pestis
ccauauugauauagcggua

SEQ ID NO: 4152164 - RNA, 13 nt, Yersinia pestis
ccaucaaaggaga

SEQ ID NO: 4152165 - RNA, 14 nt, Yersinia pestis
ccaucaacauacug

SEQ ID NO: 4152166 - RNA, 17 nt, Yersinia pestis
ccaucaacauacugaua

SEQ ID NO: 4152167 - RNA, 13 nt, Yersinia pestis
ccaucaacauggg

SEQ ID NO: 4152168 - RNA, 14 nt, Yersinia pestis
ccaucaacaugggc

SEQ ID NO: 4152169 - RNA, 14 nt, Yersinia pestis
ccaucaaccaccgc

SEQ ID NO: 4152170 - RNA, 21 nt, Yersinia pestis
ccaucaaccacgguuuaauca

SEQ ID NO: 4152171 - RNA, 19 nt, Yersinia pestis
ccaucaacgacaacaucaa

SEQ ID NO: 4152172 - RNA, 14 nt, Yersinia pestis
ccaucaagccaccg

SEQ ID NO: 4152173 - RNA, 18 nt, Yersinia pestis
ccaucaagccaccgcugg

SEQ ID NO: 4152174 - RNA, 19 nt, Yersinia pestis
ccaucaaggacuucaucac

SEQ ID NO: 4152175 - RNA, 12 nt, Yersinia pestis
ccaucaauaauu

SEQ ID NO: 4152176 - RNA, 13 nt, Yersinia pestis
ccaucaauaccaa

SEQ ID NO: 4152177 - RNA, 22 nt, Yersinia pestis
ccaucaccaucggcaauaauau

SEQ ID NO: 4152178 - RNA, 14 nt, Yersinia pestis
ccaucaccaugccu

SEQ ID NO: 4152179 - RNA, 18 nt, Yersinia pestis
ccaucacggucaugcggc

SEQ ID NO: 4152180 - RNA, 18 nt, Yersinia pestis
ccaucagcauauuaccca

SEQ ID NO: 4152181 - RNA, 15 nt, Yersinia pestis
ccaucagccaacaaa

SEQ ID NO: 4152182 - RNA, 23 nt, Yersinia pestis
ccaucaggcgcuuuucuauugga

SEQ ID NO: 4152183 - RNA, 17 nt, Yersinia pestis
ccaucaugccagcaaua

SEQ ID NO: 4152184 - RNA, 24 nt, Yersinia pestis
ccaucauuacccucauguaagcca

SEQ ID NO: 4152185 - RNA, 13 nt, Yersinia pestis
ccauccacuaggu

SEQ ID NO: 4152186 - RNA, 13 nt, Yersinia pestis
ccaucccaauaau

SEQ ID NO: 4152187 - RNA, 14 nt, Yersinia pestis
ccaucccaauaauu

SEQ ID NO: 4152188 - RNA, 20 nt, Yersinia pestis
ccaucccccauggggccacc

SEQ ID NO: 4152189 - RNA, 16 nt, Yersinia pestis
ccauccgcaggaagca

SEQ ID NO: 4152190 - RNA, 17 nt, Yersinia pestis
ccauccggguuuauccc

SEQ ID NO: 4152191 - RNA, 21 nt, Yersinia pestis
ccauccugccaacgccccuga

SEQ ID NO: 4152192 - RNA, 23 nt, Yersinia pestis
ccauccuuggcgcggacgcuuua

SEQ ID NO: 4152193 - RNA, 22 nt, Yersinia pestis
ccauccuuuacuccccugccua

SEQ ID NO: 4152194 - RNA, 20 nt, Yersinia pestis
ccaucgaacgcgucacuggc

SEQ ID NO: 4152195 - RNA, 15 nt, Yersinia pestis
cccaucagcacuccc

SEQ ID NO: 4152196 - RNA, 15 nt, Yersinia pestis
cccaucagcaucaau

SEQ ID NO: 4152197 - RNA, 21 nt, Yersinia pestis
cccaucgaacgcgucacuggc

SEQ ID NO: 4152198 - RNA, 21 nt, Yersinia pestis
cccaucgccaauacaaucguc

SEQ ID NO: 4152199 - RNA, 15 nt, Yersinia pestis
cccaugaccacuugg

SEQ ID NO: 4152200 - RNA, 14 nt, Yersinia pestis
cccauggggccacc

SEQ ID NO: 4152201 - RNA, 22 nt, Yersinia pestis
cccauggggccaccuaauccaa

SEQ ID NO: 4152202 - RNA, 18 nt, Yersinia pestis
cccauuccguuuaaacuc

SEQ ID NO: 4152203 - RNA, 19 nt, Yersinia pestis
cccauuccguuuaaacucc

SEQ ID NO: 4152204 - RNA, 17 nt, Yersinia pestis
cccauucgcgccccaaa

SEQ ID NO: 4152205 - RNA, 18 nt, Yersinia pestis
cccauucgcgccccaaau

SEQ ID NO: 4152206 - RNA, 14 nt, Yersinia pestis
cccauugcaccaau

SEQ ID NO: 4152207 - RNA, 18 nt, Yersinia pestis
cccauuugucgcgccuga

SEQ ID NO: 4152208 - RNA, 13 nt, Yersinia pestis
cccauuuuauccu

SEQ ID NO: 4152209 - RNA, 18 nt, Yersinia pestis
ccccaauaagggccaccc

SEQ ID NO: 4152210 - RNA, 12 nt, Yersinia pestis
ccccaaucaagc

SEQ ID NO: 4152211 - RNA, 14 nt, Yersinia pestis
ccccaaugaugacu

SEQ ID NO: 4152212 - RNA, 20 nt, Yersinia pestis
ccccaauucacgcaaggcca

SEQ ID NO: 4152213 - RNA, 22 nt, Yersinia pestis
ccccaauucacgcaaggccagg

SEQ ID NO: 4152214 - RNA, 17 nt, Yersinia pestis
ccccacggugccuagcc

SEQ ID NO: 4152215 - RNA, 18 nt, Yersinia pestis
ccccacuauucuccaaca

SEQ ID NO: 4152216 - RNA, 14 nt, Yersinia pestis
ccccacuucacgca

SEQ ID NO: 4152217 - RNA, 22 nt, Yersinia pestis
ccccacuuguaccugugccagu

SEQ ID NO: 4152218 - RNA, 14 nt, Yersinia pestis
ccccagaugaaugg

SEQ ID NO: 4152219 - RNA, 20 nt, Yersinia pestis
ccccagcaaagccaaaacca

SEQ ID NO: 4152220 - RNA, 19 nt, Yersinia pestis
ccccaguagcacaaugccu

SEQ ID NO: 4152221 - RNA, 20 nt, Yersinia pestis
ccccagucacuuacugauca

SEQ ID NO: 4152222 - RNA, 12 nt, Yersinia pestis
ccccauccccaa

SEQ ID NO: 4152223 - RNA, 11 nt, Yersinia pestis
ccccaucgcca

SEQ ID NO: 4152224 - RNA, 13 nt, Yersinia pestis
ccccaucgccaau

SEQ ID NO: 4152225 - RNA, 16 nt, Yersinia pestis
ccccaugaccgccagu

SEQ ID NO: 4152226 - RNA, 21 nt, Yersinia pestis
ccccaugguuacgccagcagc

SEQ ID NO: 4152227 - RNA, 15 nt, Yersinia pestis
cccccacucgcccca

SEQ ID NO: 4152228 - RNA, 21 nt, Yersinia pestis
cccccagccagaaugaacuga

SEQ ID NO: 4152229 - RNA, 22 nt, Yersinia pestis
cccccagcggugaucgcugcca

SEQ ID NO: 4152230 - RNA, 12 nt, Yersinia pestis
cccccaucccca

SEQ ID NO: 4152231 - RNA, 16 nt, Yersinia pestis
cccccgacccacgccc

SEQ ID NO: 4152232 - RNA, 20 nt, Yersinia pestis
cccccuguaaccgcaaggau

SEQ ID NO: 4152233 - RNA, 16 nt, Yersinia pestis
cccccuguaacgcuaa

SEQ ID NO: 4152234 - RNA, 17 nt, Yersinia pestis
cccccuuucaccaacca

SEQ ID NO: 4152235 - RNA, 15 nt, Yersinia pestis
cccccuuuggccgcu

SEQ ID NO: 4152236 - RNA, 16 nt, Yersinia pestis
ccccgacccacgcccc

SEQ ID NO: 4152237 - RNA, 17 nt, Yersinia pestis
ccccgccucaaugcaac

SEQ ID NO: 4152238 - RNA, 21 nt, Yersinia pestis
ccccgcuucguccagaugcca

SEQ ID NO: 4152239 - RNA, 14 nt, Yersinia pestis
ccccgguaaucuga

SEQ ID NO: 4152240 - RNA, 19 nt, Yersinia pestis
ccccgguuuuuacuguucu

SEQ ID NO: 4152241 - RNA, 17 nt, Yersinia pestis
ccccuaagguucacccu

SEQ ID NO: 4152242 - RNA, 19 nt, Yersinia pestis
ccccuagauaccgccccuc

SEQ ID NO: 4152243 - RNA, 17 nt, Yersinia pestis
ccccucgaaaauaacca

SEQ ID NO: 4152244 - RNA, 14 nt, Yersinia pestis
ccccugcugccagg

SEQ ID NO: 4152245 - RNA, 14 nt, Yersinia pestis
ccccuggcaggcca

SEQ ID NO: 4152246 - RNA, 21 nt, Yersinia pestis
ccccugggauauagaagguuu

SEQ ID NO: 4152247 - RNA, 11 nt, Yersinia pestis
ccccugucucc

SEQ ID NO: 4152248 - RNA, 16 nt, Yersinia pestis
ccccuucgagcaccgc

SEQ ID NO: 4152249 - RNA, 19 nt, Yersinia pestis
ccccuucgauauuacaguu

SEQ ID NO: 4152250 - RNA, 13 nt, Yersinia pestis
ccccuucuucacc

SEQ ID NO: 4152251 - RNA, 14 nt, Yersinia pestis
ccccuuuagugcgg

SEQ ID NO: 4152252 - RNA, 16 nt, Yersinia pestis
ccccuuuuauuuuuac

SEQ ID NO: 4152253 - RNA, 14 nt, Yersinia pestis
ccccuuuuuucuau

SEQ ID NO: 4152254 - RNA, 17 nt, Yersinia pestis
cccgaagcucaagcugg

SEQ ID NO: 4152255 - RNA, 18 nt, Yersinia pestis
cccgaauuaauaaaaccu

SEQ ID NO: 4152256 - RNA, 21 nt, Yersinia pestis
cccgacagaacugauuucagg

SEQ ID NO: 4152257 - RNA, 13 nt, Yersinia pestis
cccgaguuaaacu

SEQ ID NO: 4152258 - RNA, 12 nt, Yersinia pestis
cccgauaaacca

SEQ ID NO: 4152259 - RNA, 18 nt, Yersinia pestis
cccgaucaucaucgguac

SEQ ID NO: 4152260 - RNA, 21 nt, Yersinia pestis
cccgaucuaucgggagaugca

SEQ ID NO: 4152261 - RNA, 19 nt, Yersinia pestis
cccgauuucaacgcaccau

SEQ ID NO: 4152262 - RNA, 14 nt, Yersinia pestis
cccgcacgcccaua

SEQ ID NO: 4152263 - RNA, 18 nt, Yersinia pestis
cccgcagcggcuagcagc

SEQ ID NO: 4152264 - RNA, 11 nt, Yersinia pestis
cccgcaggcgg

SEQ ID NO: 4152265 - RNA, 16 nt, Yersinia pestis
cccgcagggguauccg

SEQ ID NO: 4152266 - RNA, 20 nt, Yersinia pestis
cccgccaguaaaccuggcgg

SEQ ID NO: 4152267 - RNA, 15 nt, Yersinia pestis
cccgcccgguaccgc

SEQ ID NO: 4152268 - RNA, 13 nt, Yersinia pestis
cccgccugcuugc

SEQ ID NO: 4152269 - RNA, 20 nt, Yersinia pestis
cccgccuguauccagcagcg

SEQ ID NO: 4152270 - RNA, 21 nt, Yersinia pestis
cccgccuugcggaagguaucc

SEQ ID NO: 4152271 - RNA, 16 nt, Yersinia pestis
cccgcgcuuccaggcu

SEQ ID NO: 4152272 - RNA, 15 nt, Yersinia pestis
cccgcguugucagcc

SEQ ID NO: 4152273 - RNA, 17 nt, Yersinia pestis
cccgcuaacaugccaca

SEQ ID NO: 4152274 - RNA, 16 nt, Yersinia pestis
cccgcuaauucaccaa

SEQ ID NO: 4152275 - RNA, 17 nt, Yersinia pestis
cccgcuaccaagcccag

SEQ ID NO: 4152276 - RNA, 13 nt, Yersinia pestis
cccgcuaucacua

SEQ ID NO: 4152277 - RNA, 16 nt, Yersinia pestis
cccgcuugucuugaaa

SEQ ID NO: 4152278 - RNA, 18 nt, Yersinia pestis
cccggauuaaaacuguug

SEQ ID NO: 4152279 - RNA, 14 nt, Yersinia pestis
cccggcaaguugau

SEQ ID NO: 4152280 - RNA, 17 nt, Yersinia pestis
cccggcaccuucaacga

SEQ ID NO: 4152281 - RNA, 19 nt, Yersinia pestis
cccggcaucccaccuucag

SEQ ID NO: 4152282 - RNA, 22 nt, Yersinia pestis
cccggccaaccguagugaguca

SEQ ID NO: 4152283 - RNA, 21 nt, Yersinia pestis
cccggccgccauugagucguu

SEQ ID NO: 4152284 - RNA, 16 nt, Yersinia pestis
cccggcugaccuguug

SEQ ID NO: 4152285 - RNA, 22 nt, Yersinia pestis
cccgguaaagugacucugcccu

SEQ ID NO: 4152286 - RNA, 20 nt, Yersinia pestis
cccggugaucaucgcaccau

SEQ ID NO: 4152287 - RNA, 15 nt, Yersinia pestis
cccgguuagauaggc

SEQ ID NO: 4152288 - RNA, 18 nt, Yersinia pestis
cccgguugauaucggcaa

SEQ ID NO: 4152289 - RNA, 20 nt, Yersinia pestis
cccguaauauuucaagcugu

SEQ ID NO: 4152290 - RNA, 23 nt, Yersinia pestis
cccguacaaaaauaaacgggcuu

SEQ ID NO: 4152291 - RNA, 21 nt, Yersinia pestis
cccgucauccuucaaguuguc

SEQ ID NO: 4152292 - RNA, 13 nt, Yersinia pestis
cccgugcggcagu

SEQ ID NO: 4152293 - RNA, 15 nt, Yersinia pestis
cccgugcuuugccuu

SEQ ID NO: 4152294 - RNA, 21 nt, Yersinia pestis
cccguuacacaaucaguaaau

SEQ ID NO: 4152295 - RNA, 15 nt, Yersinia pestis
cccguuacugcaucu

SEQ ID NO: 4152296 - RNA, 16 nt, Yersinia pestis
cccguuugcagcucaa

SEQ ID NO: 4152297 - RNA, 18 nt, Yersinia pestis
cccuaaacagcaacacaa

SEQ ID NO: 4152298 - RNA, 17 nt, Yersinia pestis
cccuaaagccaucgcca

SEQ ID NO: 4152299 - RNA, 20 nt, Yersinia pestis
cccuaacaggcgcaucgcga

SEQ ID NO: 4152300 - RNA, 18 nt, Yersinia pestis
cccuaacucuuuggaugg

SEQ ID NO: 4152301 - RNA, 13 nt, Yersinia pestis
cccuacagcaaac

SEQ ID NO: 4152302 - RNA, 18 nt, Yersinia pestis
cccuaccguaucaacgua

SEQ ID NO: 4152303 - RNA, 22 nt, Yersinia pestis
cccuacgggaaauaacugguga

SEQ ID NO: 4152304 - RNA, 24 nt, Yersinia pestis
cccuacuggcugaaguuaaugaca

SEQ ID NO: 4152305 - RNA, 16 nt, Yersinia pestis
cccuagcgaaguauua

SEQ ID NO: 4152306 - RNA, 12 nt, Yersinia pestis
cccuagcgcaaa

SEQ ID NO: 4152307 - RNA, 18 nt, Yersinia pestis
cccuauaggcucaaugcg

SEQ ID NO: 4152308 - RNA, 12 nt, Yersinia pestis
cccucaauaccg

SEQ ID NO: 4152309 - RNA, 16 nt, Yersinia pestis
cccucacgacgcgcuu

SEQ ID NO: 4152310 - RNA, 13 nt, Yersinia pestis
cccucccuucgca

SEQ ID NO: 4152311 - RNA, 14 nt, Yersinia pestis
cccucgacaccaaa

SEQ ID NO: 4152312 - RNA, 22 nt, Yersinia pestis
cccucgcggcgguaaccccggc

SEQ ID NO: 4152313 - RNA, 15 nt, Yersinia pestis
cccucucauccugcu

SEQ ID NO: 4152314 - RNA, 19 nt, Yersinia pestis
cccucucuuuccagcaaaa

SEQ ID NO: 4152315 - RNA, 15 nt, Yersinia pestis
cccucuggcauagag

SEQ ID NO: 4152316 - RNA, 21 nt, Yersinia pestis
cccugacgaaauuuaagaaau

SEQ ID NO: 4152317 - RNA, 13 nt, Yersinia pestis
cccugacucccug

SEQ ID NO: 4152318 - RNA, 21 nt, Yersinia pestis
ccgccucuuuuuccacacccu

SEQ ID NO: 4152319 - RNA, 19 nt, Yersinia pestis
ccgccuguauccagcagcg

SEQ ID NO: 4152320 - RNA, 17 nt, Yersinia pestis
ccgccuuccucaaugca

SEQ ID NO: 4152321 - RNA, 16 nt, Yersinia pestis
ccgccuuccugcaacu

SEQ ID NO: 4152322 - RNA, 14 nt, Yersinia pestis
ccgcgaauaacaga

SEQ ID NO: 4152323 - RNA, 19 nt, Yersinia pestis
ccgcgaauaacagacguua

SEQ ID NO: 4152324 - RNA, 22 nt, Yersinia pestis
ccgcgaauuccaaccagagauu

SEQ ID NO: 4152325 - RNA, 19 nt, Yersinia pestis
ccgcgauaaaaaauaaagu

SEQ ID NO: 4152326 - RNA, 13 nt, Yersinia pestis
ccgcgccagggag

SEQ ID NO: 4152327 - RNA, 14 nt, Yersinia pestis
ccgcgcccucccug

SEQ ID NO: 4152328 - RNA, 16 nt, Yersinia pestis
ccgcgcuuccaggcug

SEQ ID NO: 4152329 - RNA, 14 nt, Yersinia pestis
ccgcgucgccgcuu

SEQ ID NO: 4152330 - RNA, 23 nt, Yersinia pestis
ccgcuaacguuuauuuauaagaa

SEQ ID NO: 4152331 - RNA, 18 nt, Yersinia pestis
ccgcuaauucaggcaaau

SEQ ID NO: 4152332 - RNA, 18 nt, Yersinia pestis
ccgcuaauucugcgccua

SEQ ID NO: 4152333 - RNA, 17 nt, Yersinia pestis
ccgcuaccaagcccagu

SEQ ID NO: 4152334 - RNA, 12 nt, Yersinia pestis
ccgcuacccgcc

SEQ ID NO: 4152335 - RNA, 22 nt, Yersinia pestis
ccgcuaccgguuaaacuucuuu

SEQ ID NO: 4152336 - RNA, 18 nt, Yersinia pestis
ccgcuagugauagcgggc

SEQ ID NO: 4152337 - RNA, 19 nt, Yersinia pestis
ccgcuagugauagcgggcc

SEQ ID NO: 4152338 - RNA, 20 nt, Yersinia pestis
ccgcuagugauagcgggccu

SEQ ID NO: 4152339 - RNA, 13 nt, Yersinia pestis
ccgcuaguuugac

SEQ ID NO: 4152340 - RNA, 19 nt, Yersinia pestis
ccgcuauaucaucagcaga

SEQ ID NO: 4152341 - RNA, 18 nt, Yersinia pestis
ccgcuaucacuagcgggc

SEQ ID NO: 4152342 - RNA, 16 nt, Yersinia pestis
ccgcuaucucgcaaua

SEQ ID NO: 4152343 - RNA, 19 nt, Yersinia pestis
ccgcucagcaucuucaauc

SEQ ID NO: 4152344 - RNA, 16 nt, Yersinia pestis
ccgcucuucaccaauc

SEQ ID NO: 4152345 - RNA, 17 nt, Yersinia pestis
ccgcugaucaggaaggu

SEQ ID NO: 4152346 - RNA, 14 nt, Yersinia pestis
ccgcugcaagcaau

SEQ ID NO: 4152347 - RNA, 12 nt, Yersinia pestis
ccgcugcccggc

SEQ ID NO: 4152348 - RNA, 13 nt, Yersinia pestis
ccgcugcccggcu

SEQ ID NO: 4152349 - RNA, 24 nt, Yersinia pestis
ccgcugcuaccagcagugcagcca

SEQ ID NO: 4152350 - RNA, 23 nt, Yersinia pestis
ccgcuggcgcgcauaguauccau

SEQ ID NO: 4152351 - RNA, 14 nt, Yersinia pestis
ccgcugggccgucu

SEQ ID NO: 4152352 - RNA, 17 nt, Yersinia pestis
ccgcuggucgauaagca

SEQ ID NO: 4152353 - RNA, 17 nt, Yersinia pestis
ccgcuggugcugcgggc

SEQ ID NO: 4152354 - RNA, 15 nt, Yersinia pestis
ccgcuguagcgccaa

SEQ ID NO: 4152355 - RNA, 19 nt, Yersinia pestis
ccgcugugauuaagcguua

SEQ ID NO: 4152356 - RNA, 17 nt, Yersinia pestis
ccgcuuaucccuccauc

SEQ ID NO: 4152357 - RNA, 17 nt, Yersinia pestis
ccgcuucgcgcccgccc

SEQ ID NO: 4152358 - RNA, 12 nt, Yersinia pestis
ccgcuucugggc

SEQ ID NO: 4152359 - RNA, 19 nt, Yersinia pestis
ccgcuugcuuugcuucauc

SEQ ID NO: 4152360 - RNA, 18 nt, Yersinia pestis
ccgcuuuagcgaugacca

SEQ ID NO: 4152361 - RNA, 15 nt, Yersinia pestis
ccgcuuuaucgccaa

SEQ ID NO: 4152362 - RNA, 18 nt, Yersinia pestis
ccggaagagaagcagcgg

SEQ ID NO: 4152363 - RNA, 23 nt, Yersinia pestis
ccggaagagaagcagcgggggau

SEQ ID NO: 4152364 - RNA, 20 nt, Yersinia pestis
ccggaaucagcguuuuauuc

SEQ ID NO: 4152365 - RNA, 14 nt, Yersinia pestis
ccggacucaaaaua

SEQ ID NO: 4152366 - RNA, 12 nt, Yersinia pestis
ccggacucauua

SEQ ID NO: 4152367 - RNA, 23 nt, Yersinia pestis
ccggaggauauuuauuguuucug

SEQ ID NO: 4152368 - RNA, 21 nt, Yersinia pestis
ccggauagggggcaaccauau

SEQ ID NO: 4152369 - RNA, 13 nt, Yersinia pestis
ccggaucaucaac

SEQ ID NO: 4152370 - RNA, 20 nt, Yersinia pestis
ccggaucgcgacgaaaaccu

SEQ ID NO: 4152371 - RNA, 16 nt, Yersinia pestis
ccggaugcaucgggca

SEQ ID NO: 4152372 - RNA, 14 nt, Yersinia pestis
ccggauuccaccug

SEQ ID NO: 4152373 - RNA, 18 nt, Yersinia pestis
ccggcaaaaacgccauca

SEQ ID NO: 4152374 - RNA, 22 nt, Yersinia pestis
ccggcaaccaguuauagcggug

SEQ ID NO: 4152375 - RNA, 16 nt, Yersinia pestis
ccggcaaucgcuucca

SEQ ID NO: 4152376 - RNA, 15 nt, Yersinia pestis
ccggcaccuucaacg

SEQ ID NO: 4152377 - RNA, 15 nt, Yersinia pestis
ccggcacuaaaaucu

SEQ ID NO: 4152378 - RNA, 17 nt, Yersinia pestis
ccggcaucaaccaagac

SEQ ID NO: 4152379 - RNA, 17 nt, Yersinia pestis
ccggcaucccaccuuca

SEQ ID NO: 4152380 - RNA, 14 nt, Yersinia pestis
ccggcccaacuggc

SEQ ID NO: 4152381 - RNA, 13 nt, Yersinia pestis
ccggccugauuua

SEQ ID NO: 4152382 - RNA, 21 nt, Yersinia pestis
ccggcgaagggcgcagccccc

SEQ ID NO: 4152383 - RNA, 20 nt, Yersinia pestis
ccggcgguuaucacaucauc

SEQ ID NO: 4152384 - RNA, 19 nt, Yersinia pestis
ccggcgugaguuccagccc

SEQ ID NO: 4152385 - RNA, 18 nt, Yersinia pestis
ccggcuaaccacagcaau

SEQ ID NO: 4152386 - RNA, 17 nt, Yersinia pestis
ccggcuaaugccgagaa

SEQ ID NO: 4152387 - RNA, 23 nt, Yersinia pestis
ccggcuaggcucagcauggaaga

SEQ ID NO: 4152388 - RNA, 14 nt, Yersinia pestis
ccggcucauccgcc

SEQ ID NO: 4152389 - RNA, 20 nt, Yersinia pestis
ccggcugacuggacaaauaa

SEQ ID NO: 4152390 - RNA, 14 nt, Yersinia pestis
ccgggaaaaaauac

SEQ ID NO: 4152391 - RNA, 14 nt, Yersinia pestis
ccgggaacaacgaa

SEQ ID NO: 4152392 - RNA, 19 nt, Yersinia pestis
ccgggaucuaucagaccuu

SEQ ID NO: 4152393 - RNA, 20 nt, Yersinia pestis
ccgggcaaacgccagugcaa

SEQ ID NO: 4152394 - RNA, 20 nt, Yersinia pestis
ccggggcgauacaccaacgc

SEQ ID NO: 4152395 - RNA, 13 nt, Yersinia pestis
ccggguaacgcca

SEQ ID NO: 4152396 - RNA, 23 nt, Yersinia pestis
ccgguaaaaucacguuuccaaaa

SEQ ID NO: 4152397 - RNA, 13 nt, Yersinia pestis
ccgguaauaccga

SEQ ID NO: 4152398 - RNA, 14 nt, Yersinia pestis
ccgguaauaccgau

SEQ ID NO: 4152399 - RNA, 22 nt, Yersinia pestis
ccgguauucagccaaaucauca

SEQ ID NO: 4152400 - RNA, 20 nt, Yersinia pestis
ccggucaacgucaucgccac

SEQ ID NO: 4152401 - RNA, 19 nt, Yersinia pestis
ccggucgaacccauucauc

SEQ ID NO: 4152402 - RNA, 17 nt, Yersinia pestis
ccggucgcguaccuuca

SEQ ID NO: 4152403 - RNA, 21 nt, Yersinia pestis
ccggucguauucagcacugcc

SEQ ID NO: 4152404 - RNA, 19 nt, Yersinia pestis
ccggucugaauaccgcugg

SEQ ID NO: 4152405 - RNA, 17 nt, Yersinia pestis
ccggugguucaaccacc

SEQ ID NO: 4152406 - RNA, 22 nt, Yersinia pestis
ccgguguauuuggguuaaauag

SEQ ID NO: 4152407 - RNA, 19 nt, Yersinia pestis
ccgguguuuuugacacggg

SEQ ID NO: 4152408 - RNA, 16 nt, Yersinia pestis
ccgguucuugcgcgcu

SEQ ID NO: 4152409 - RNA, 15 nt, Yersinia pestis
ccgguugagugagac

SEQ ID NO: 4152410 - RNA, 15 nt, Yersinia pestis
ccgguuuuggucagu

SEQ ID NO: 4152411 - RNA, 20 nt, Yersinia pestis
ccguaaacugccguaaacaa

SEQ ID NO: 4152412 - RNA, 12 nt, Yersinia pestis
ccguaacuucuu

SEQ ID NO: 4152413 - RNA, 23 nt, Yersinia pestis
ccguaagauucgccgcaaggcaa

SEQ ID NO: 4152414 - RNA, 12 nt, Yersinia pestis
ccguacaaauau

SEQ ID NO: 4152415 - RNA, 15 nt, Yersinia pestis
ccguaccaguugucu

SEQ ID NO: 4152416 - RNA, 12 nt, Yersinia pestis
ccguacccgcuc

SEQ ID NO: 4152417 - RNA, 17 nt, Yersinia pestis
ccguagcacacacagcc

SEQ ID NO: 4152418 - RNA, 18 nt, Yersinia pestis
ccguauagauuauuuucu

SEQ ID NO: 4152419 - RNA, 18 nt, Yersinia pestis
ccguaucaccgguuuuug

SEQ ID NO: 4152420 - RNA, 13 nt, Yersinia pestis
ccguaucagcccc

SEQ ID NO: 4152421 - RNA, 20 nt, Yersinia pestis
ccguaucauggaagaccaga

SEQ ID NO: 4152422 - RNA, 19 nt, Yersinia pestis
ccguaucuuguaguaacca

SEQ ID NO: 4152423 - RNA, 13 nt, Yersinia pestis
ccguaugcgcaua

SEQ ID NO: 4152424 - RNA, 19 nt, Yersinia pestis
ccguauuuuauaucugcgc

SEQ ID NO: 4152425 - RNA, 21 nt, Yersinia pestis
ccgucaaaccaucgcucuccu

SEQ ID NO: 4152426 - RNA, 13 nt, Yersinia pestis
ccgucaauaucau

SEQ ID NO: 4152427 - RNA, 21 nt, Yersinia pestis
ccgucaauaucaucaucuuua

SEQ ID NO: 4152428 - RNA, 21 nt, Yersinia pestis
ccgucaccucaucagugacua

SEQ ID NO: 4152429 - RNA, 16 nt, Yersinia pestis
ccguccagcccaccau

SEQ ID NO: 4152430 - RNA, 15 nt, Yersinia pestis
ccgucgacuguaaca

SEQ ID NO: 4152431 - RNA, 17 nt, Yersinia pestis
ccgucuuggauauuuga

SEQ ID NO: 4152432 - RNA, 18 nt, Yersinia pestis
ccgugaacaucuggcgau

SEQ ID NO: 4152433 - RNA, 11 nt, Yersinia pestis
ccgugacuaaa

SEQ ID NO: 4152434 - RNA, 18 nt, Yersinia pestis
ccgugauaaaucuuauuu

SEQ ID NO: 4152435 - RNA, 22 nt, Yersinia pestis
ccgugcauagcgugauuuuuau

SEQ ID NO: 4152436 - RNA, 23 nt, Yersinia pestis
ccgugccaggugugcccaacaac

SEQ ID NO: 4152437 - RNA, 19 nt, Yersinia pestis
ccgugcgccugaacagccu

SEQ ID NO: 4152438 - RNA, 15 nt, Yersinia pestis
ccgugcggacugccg

SEQ ID NO: 4152439 - RNA, 16 nt, Yersinia pestis
ccgugcgggaugacuc

SEQ ID NO: 4152440 - RNA, 13 nt, Yersinia pestis
ccuccaagaugau

SEQ ID NO: 4152441 - RNA, 16 nt, Yersinia pestis
ccuccagucccccuca

SEQ ID NO: 4152442 - RNA, 18 nt, Yersinia pestis
ccuccagucccccucaca

SEQ ID NO: 4152443 - RNA, 16 nt, Yersinia pestis
ccuccggcgcccuucc

SEQ ID NO: 4152444 - RNA, 14 nt, Yersinia pestis
ccuccguaggccaa

SEQ ID NO: 4152445 - RNA, 18 nt, Yersinia pestis
ccuccugacgaugauaaa

SEQ ID NO: 4152446 - RNA, 14 nt, Yersinia pestis
ccuccugcccaaga

SEQ ID NO: 4152447 - RNA, 18 nt, Yersinia pestis
ccuccugcggcggagcaa

SEQ ID NO: 4152448 - RNA, 18 nt, Yersinia pestis
ccuccuugagauccucca

SEQ ID NO: 4152449 - RNA, 12 nt, Yersinia pestis
ccucgaaaauaa

SEQ ID NO: 4152450 - RNA, 20 nt, Yersinia pestis
ccucgaaaucauccgcggca

SEQ ID NO: 4152451 - RNA, 20 nt, Yersinia pestis
ccucgacaccaaaacucccu

SEQ ID NO: 4152452 - RNA, 15 nt, Yersinia pestis
ccucgcuucugcgag

SEQ ID NO: 4152453 - RNA, 18 nt, Yersinia pestis
ccucggugauaaguuuua

SEQ ID NO: 4152454 - RNA, 19 nt, Yersinia pestis
ccucgguggcucaauccaa

SEQ ID NO: 4152455 - RNA, 23 nt, Yersinia pestis
ccucguaguuggugauagguuaa

SEQ ID NO: 4152456 - RNA, 18 nt, Yersinia pestis
ccucguuuaacucaaaua

SEQ ID NO: 4152457 - RNA, 17 nt, Yersinia pestis
ccucuaaggggcgagaa

SEQ ID NO: 4152458 - RNA, 21 nt, Yersinia pestis
ccucuacgucaaucucaccgc

SEQ ID NO: 4152459 - RNA, 19 nt, Yersinia pestis
ccucuagcuguauugcccg

SEQ ID NO: 4152460 - RNA, 23 nt, Yersinia pestis
ccucuagcuguauugcccgauca

SEQ ID NO: 4152461 - RNA, 12 nt, Yersinia pestis
ccucucaccaag

SEQ ID NO: 4152462 - RNA, 17 nt, Yersinia pestis
ccucucaguugauggcu

SEQ ID NO: 4152463 - RNA, 15 nt, Yersinia pestis
ccucuccccuaccuc

SEQ ID NO: 4152464 - RNA, 20 nt, Yersinia pestis
ccucucgccgguuaucaccu

SEQ ID NO: 4152465 - RNA, 23 nt, Yersinia pestis
ccucucuggucuugcaccugauc

SEQ ID NO: 4152466 - RNA, 18 nt, Yersinia pestis
ccucugauuguaacaauc

SEQ ID NO: 4152467 - RNA, 17 nt, Yersinia pestis
ccucugcaaugcccaga

SEQ ID NO: 4152468 - RNA, 17 nt, Yersinia pestis
ccucugccgauuuaaac

SEQ ID NO: 4152469 - RNA, 20 nt, Yersinia pestis
ccucugccgauuuaaacccu

SEQ ID NO: 4152470 - RNA, 16 nt, Yersinia pestis
ccucugcgaagccgcu

SEQ ID NO: 4152471 - RNA, 21 nt, Yersinia pestis
ccucugcgcuggcguuuuugu

SEQ ID NO: 4152472 - RNA, 11 nt, Yersinia pestis
ccucugcugcu

SEQ ID NO: 4152473 - RNA, 20 nt, Yersinia pestis
ccucugcugcugcccgcgaa

SEQ ID NO: 4152474 - RNA, 20 nt, Yersinia pestis
ccucuggauaaacaauaauc

SEQ ID NO: 4152475 - RNA, 23 nt, Yersinia pestis
ccucuguaaaacgauaguaagcu

SEQ ID NO: 4152476 - RNA, 21 nt, Yersinia pestis
ccucuuauuaaauggagggca

SEQ ID NO: 4152477 - RNA, 20 nt, Yersinia pestis
ccucuucagguaagccuuuc

SEQ ID NO: 4152478 - RNA, 13 nt, Yersinia pestis
ccucuucuuccgc

SEQ ID NO: 4152479 - RNA, 18 nt, Yersinia pestis
ccucuuggcguagcuuga

SEQ ID NO: 4152480 - RNA, 18 nt, Yersinia pestis
ccucuuguguaauuauau

SEQ ID NO: 4152481 - RNA, 14 nt, Yersinia pestis
ccucuuucuuaaua

SEQ ID NO: 4152482 - RNA, 14 nt, Yersinia pestis
ccucuuuuaucugu

SEQ ID NO: 4152483 - RNA, 20 nt, Yersinia pestis
ccugaaagucaggauuggag

SEQ ID NO: 4152484 - RNA, 19 nt, Yersinia pestis
ccugaaauacggaacgcag

SEQ ID NO: 4152485 - RNA, 19 nt, Yersinia pestis
ccugaacgccuugcccugc

SEQ ID NO: 4152486 - RNA, 17 nt, Yersinia pestis
ccugaaguugaucaaac

SEQ ID NO: 4152487 - RNA, 16 nt, Yersinia pestis
ccugaaucgauaaacc

SEQ ID NO: 4152488 - RNA, 18 nt, Yersinia pestis
ccugaaucucgcgcccug

SEQ ID NO: 4152489 - RNA, 19 nt, Yersinia pestis
ccugaaucucgcgcccugc

SEQ ID NO: 4152490 - RNA, 19 nt, Yersinia pestis
ccugaauggaaaaauuagc

SEQ ID NO: 4152491 - RNA, 20 nt, Yersinia pestis
ccugacaggcucuuuauacu

SEQ ID NO: 4152492 - RNA, 11 nt, Yersinia pestis
ccugacauuug

SEQ ID NO: 4152493 - RNA, 17 nt, Yersinia pestis
ccugacccccaauuuca

SEQ ID NO: 4152494 - RNA, 18 nt, Yersinia pestis
ccugaccuagcaaugaga

SEQ ID NO: 4152495 - RNA, 23 nt, Yersinia pestis
ccugacgaaauuuaagaaaucua

SEQ ID NO: 4152496 - RNA, 15 nt, Yersinia pestis
ccugacgcacagcac

SEQ ID NO: 4152497 - RNA, 21 nt, Yersinia pestis
ccugacgcggugacaaugaau

SEQ ID NO: 4152498 - RNA, 14 nt, Yersinia pestis
ccugacggccagca

SEQ ID NO: 4152499 - RNA, 15 nt, Yersinia pestis
ccugacucccugacu

SEQ ID NO: 4152500 - RNA, 18 nt, Yersinia pestis
ccugacuguggcugcucu

SEQ ID NO: 4152501 - RNA, 16 nt, Yersinia pestis
ccugagauuaaccgcg

SEQ ID NO: 4152502 - RNA, 20 nt, Yersinia pestis
ccugagauuauuggcgauuu

SEQ ID NO: 4152503 - RNA, 16 nt, Yersinia pestis
ccugagccgccaguug

SEQ ID NO: 4152504 - RNA, 22 nt, Yersinia pestis
ccugagcgaucaauacaccaga

SEQ ID NO: 4152505 - RNA, 23 nt, Yersinia pestis
ccugagggugaugacaaugcguu

SEQ ID NO: 4152506 - RNA, 15 nt, Yersinia pestis
ccugagucaguaauu

SEQ ID NO: 4152507 - RNA, 17 nt, Yersinia pestis
ccugagucaguaauuca

SEQ ID NO: 4152508 - RNA, 19 nt, Yersinia pestis
ccugagucaguaauucacc

SEQ ID NO: 4152509 - RNA, 21 nt, Yersinia pestis
ccugaguuaccuugugucacc

SEQ ID NO: 4152510 - RNA, 21 nt, Yersinia pestis
ccugaguuaucuguuucaaau

SEQ ID NO: 4152511 - RNA, 15 nt, Yersinia pestis
ccugauacaccauuu

SEQ ID NO: 4152512 - RNA, 14 nt, Yersinia pestis
ccugauaucaaccu

SEQ ID NO: 4152513 - RNA, 17 nt, Yersinia pestis
ccugauaucaaccuggc

SEQ ID NO: 4152514 - RNA, 15 nt, Yersinia pestis
ccugauccaguuuca

SEQ ID NO: 4152515 - RNA, 14 nt, Yersinia pestis
ccugaugauaagca

SEQ ID NO: 4152516 - RNA, 15 nt, Yersinia pestis
ccugaugaugaagca

SEQ ID NO: 4152517 - RNA, 18 nt, Yersinia pestis
ccugaugccccaugguua

SEQ ID NO: 4152518 - RNA, 15 nt, Yersinia pestis
ccugauguuuugcug

SEQ ID NO: 4152519 - RNA, 16 nt, Yersinia pestis
ccugauuuaguuuauu

SEQ ID NO: 4152520 - RNA, 19 nt, Yersinia pestis
ccugcaacucgaauuauuu

SEQ ID NO: 4152521 - RNA, 23 nt, Yersinia pestis
ccugcaauaccgccggcaacagc

SEQ ID NO: 4152522 - RNA, 15 nt, Yersinia pestis
ccugcaccagugcca

SEQ ID NO: 4152523 - RNA, 14 nt, Yersinia pestis
ccugcauaaaaaua

SEQ ID NO: 4152524 - RNA, 21 nt, Yersinia pestis
ccugcauccccggcaucccac

SEQ ID NO: 4152525 - RNA, 13 nt, Yersinia pestis
ccugccaaaaaau

SEQ ID NO: 4152526 - RNA, 14 nt, Yersinia pestis
ccugccaauaucca

SEQ ID NO: 4152527 - RNA, 18 nt, Yersinia pestis
ccugccagaaucagcccc

SEQ ID NO: 4152528 - RNA, 19 nt, Yersinia pestis
ccugccagaaucagcccca

SEQ ID NO: 4152529 - RNA, 15 nt, Yersinia pestis
ccugccugcugcucc

SEQ ID NO: 4152530 - RNA, 16 nt, Yersinia pestis
ccugccugcugcucca

SEQ ID NO: 4152531 - RNA, 14 nt, Yersinia pestis
ccugcgccagcagc

SEQ ID NO: 4152532 - RNA, 15 nt, Yersinia pestis
ccugcgcugcuuuuu

SEQ ID NO: 4152533 - RNA, 18 nt, Yersinia pestis
ccugcggcuucaaguacg

SEQ ID NO: 4152534 - RNA, 19 nt, Yersinia pestis
ccugcuacucgaauuauuu

SEQ ID NO: 4152535 - RNA, 16 nt, Yersinia pestis
ccugcucaacugcuca

SEQ ID NO: 4152536 - RNA, 21 nt, Yersinia pestis
ccugcucaacugcucaacugc

SEQ ID NO: 4152537 - RNA, 14 nt, Yersinia pestis
ccugcucacgcaaa

SEQ ID NO: 4152538 - RNA, 19 nt, Yersinia pestis
ccugcuccaaagcuuccaa

SEQ ID NO: 4152539 - RNA, 13 nt, Yersinia pestis
ccugcucuucugg

SEQ ID NO: 4152540 - RNA, 19 nt, Yersinia pestis
ccugcugaaaaaugaguca

SEQ ID NO: 4152541 - RNA, 12 nt, Yersinia pestis
ccugcugcucca

SEQ ID NO: 4152542 - RNA, 13 nt, Yersinia pestis
ccugcuguuagua

SEQ ID NO: 4152543 - RNA, 17 nt, Yersinia pestis
ccuggaaccaagcccgc

SEQ ID NO: 4152544 - RNA, 16 nt, Yersinia pestis
ccuggcaccggacaaa

SEQ ID NO: 4152545 - RNA, 14 nt, Yersinia pestis
ccuggcaggccagc

SEQ ID NO: 4152546 - RNA, 18 nt, Yersinia pestis
ccuggcaggccagcgaca

SEQ ID NO: 4152547 - RNA, 13 nt, Yersinia pestis
ccuggccaaagcc

SEQ ID NO: 4152548 - RNA, 19 nt, Yersinia pestis
ccuggcccuuggcugguga

SEQ ID NO: 4152549 - RNA, 22 nt, Yersinia pestis
ccuggcguaauauugcccccuc

SEQ ID NO: 4152550 - RNA, 15 nt, Yersinia pestis
ccuggcuaauuuuau

SEQ ID NO: 4152551 - RNA, 13 nt, Yersinia pestis
ccuggcucaaauu

SEQ ID NO: 4152552 - RNA, 14 nt, Yersinia pestis
ccuggcucaaauuu

SEQ ID NO: 4152553 - RNA, 20 nt, Yersinia pestis
ccugguuuuuuaaaaaagug

SEQ ID NO: 4152554 - RNA, 19 nt, Yersinia pestis
ccuguaacgcuaaacuaaa

SEQ ID NO: 4152555 - RNA, 13 nt, Yersinia pestis
ccuguaagacuca

SEQ ID NO: 4152556 - RNA, 14 nt, Yersinia pestis
ccuguaccaccacc

SEQ ID NO: 4152557 - RNA, 21 nt, Yersinia pestis
ccuguaccaccaccaacagca

SEQ ID NO: 4152558 - RNA, 16 nt, Yersinia pestis
ccuguaccgccuguuc

SEQ ID NO: 4152559 - RNA, 14 nt, Yersinia pestis
ccuguacuuuaacu

SEQ ID NO: 4152560 - RNA, 22 nt, Yersinia pestis
ccuguacuuugauucaaaaugc

SEQ ID NO: 4152561 - RNA, 13 nt, Yersinia pestis
ccuguauaaaaau

SEQ ID NO: 4152562 - RNA, 17 nt, Yersinia pestis
cgaagaaaaacacuuua

SEQ ID NO: 4152563 - RNA, 17 nt, Yersinia pestis
cgaagaaacggcucgau

SEQ ID NO: 4152564 - RNA, 17 nt, Yersinia pestis
cgaagggcgcagccccc

SEQ ID NO: 4152565 - RNA, 15 nt, Yersinia pestis
cgaaggggcguuuaa

SEQ ID NO: 4152566 - RNA, 22 nt, Yersinia pestis
cgaaggggcguuuaaugccccu

SEQ ID NO: 4152567 - RNA, 17 nt, Yersinia pestis
cgaaggguaucagcgac

SEQ ID NO: 4152568 - RNA, 17 nt, Yersinia pestis
cgaauaaacaccgugcu

SEQ ID NO: 4152569 - RNA, 18 nt, Yersinia pestis
cgaauaacucucaucuau

SEQ ID NO: 4152570 - RNA, 23 nt, Yersinia pestis
cgaauaagcucugggacgugcau

SEQ ID NO: 4152571 - RNA, 22 nt, Yersinia pestis
cgaauagagacggaaagagcca

SEQ ID NO: 4152572 - RNA, 15 nt, Yersinia pestis
cgaauagucuguuuc

SEQ ID NO: 4152573 - RNA, 17 nt, Yersinia pestis
cgaauauugcguuaccu

SEQ ID NO: 4152574 - RNA, 16 nt, Yersinia pestis
cgaaugagcaguaaua

SEQ ID NO: 4152575 - RNA, 21 nt, Yersinia pestis
cgaaugagcaguaauagcaaa

SEQ ID NO: 4152576 - RNA, 17 nt, Yersinia pestis
cgaaugaucagaggcug

SEQ ID NO: 4152577 - RNA, 21 nt, Yersinia pestis
cgaaugcgacaccugcuauca

SEQ ID NO: 4152578 - RNA, 16 nt, Yersinia pestis
cgaaugcuauaaaccg

SEQ ID NO: 4152579 - RNA, 17 nt, Yersinia pestis
cgaauggccgcugcagg

SEQ ID NO: 4152580 - RNA, 23 nt, Yersinia pestis
cgaauuauuugggguauauauuu

SEQ ID NO: 4152581 - RNA, 19 nt, Yersinia pestis
cgaauugacuuaacaguua

SEQ ID NO: 4152582 - RNA, 13 nt, Yersinia pestis
cgaauuuuauuca

SEQ ID NO: 4152583 - RNA, 17 nt, Yersinia pestis
cgacaaauuuuuccuuu

SEQ ID NO: 4152584 - RNA, 18 nt, Yersinia pestis
cgacaacuucaauaccaa

SEQ ID NO: 4152585 - RNA, 14 nt, Yersinia pestis
cgacaccaagaggc

SEQ ID NO: 4152586 - RNA, 16 nt, Yersinia pestis
cgacagcaacaacaaa

SEQ ID NO: 4152587 - RNA, 14 nt, Yersinia pestis
cgacagccaaauca

SEQ ID NO: 4152588 - RNA, 15 nt, Yersinia pestis
cgacaggcuaacaac

SEQ ID NO: 4152589 - RNA, 13 nt, Yersinia pestis
cgacagggacucc

SEQ ID NO: 4152590 - RNA, 23 nt, Yersinia pestis
cgacauagccggagguuuuucau

SEQ ID NO: 4152591 - RNA, 18 nt, Yersinia pestis
cgacauccaauucaguac

SEQ ID NO: 4152592 - RNA, 22 nt, Yersinia pestis
cgacauucauuacugcggauca

SEQ ID NO: 4152593 - RNA, 22 nt, Yersinia pestis
cgaccaacuggcaaucaugggc

SEQ ID NO: 4152594 - RNA, 17 nt, Yersinia pestis
cgaccaauucacgcagg

SEQ ID NO: 4152595 - RNA, 16 nt, Yersinia pestis
cgaccaauucaucagc

SEQ ID NO: 4152596 - RNA, 11 nt, Yersinia pestis
cgaccagcaga

SEQ ID NO: 4152597 - RNA, 12 nt, Yersinia pestis
cgaccagcagaa

SEQ ID NO: 4152598 - RNA, 15 nt, Yersinia pestis
cgaccgcucuucaca

SEQ ID NO: 4152599 - RNA, 17 nt, Yersinia pestis
cgaccggcugauguucu

SEQ ID NO: 4152600 - RNA, 17 nt, Yersinia pestis
cgaccugaugccccaug

SEQ ID NO: 4152601 - RNA, 22 nt, Yersinia pestis
cgacgauggaguggucaugcuc

SEQ ID NO: 4152602 - RNA, 13 nt, Yersinia pestis
cgacgcgccauaa

SEQ ID NO: 4152603 - RNA, 13 nt, Yersinia pestis
cgacggagagaac

SEQ ID NO: 4152604 - RNA, 21 nt, Yersinia pestis
cgacggaugaaaagugaucca

SEQ ID NO: 4152605 - RNA, 15 nt, Yersinia pestis
cgacgggaacgacgu

SEQ ID NO: 4152606 - RNA, 15 nt, Yersinia pestis
cgacuaaaaccugcu

SEQ ID NO: 4152607 - RNA, 14 nt, Yersinia pestis
cgacuaaauccuug

SEQ ID NO: 4152608 - RNA, 18 nt, Yersinia pestis
cgacuaaggcaaccugag

SEQ ID NO: 4152609 - RNA, 11 nt, Yersinia pestis
cgacucaauug

SEQ ID NO: 4152610 - RNA, 19 nt, Yersinia pestis
cgacucugcaugauagcuu

SEQ ID NO: 4152611 - RNA, 22 nt, Yersinia pestis
cgacugagaagcggaauuugcu

SEQ ID NO: 4152612 - RNA, 13 nt, Yersinia pestis
cgacugcaccuug

SEQ ID NO: 4152613 - RNA, 18 nt, Yersinia pestis
cgagaaggauugaccaau

SEQ ID NO: 4152614 - RNA, 18 nt, Yersinia pestis
cgagaauucagaggcugc

SEQ ID NO: 4152615 - RNA, 18 nt, Yersinia pestis
cgagacuaccggaaccgc

SEQ ID NO: 4152616 - RNA, 20 nt, Yersinia pestis
cgagagcgucccugaugggg

SEQ ID NO: 4152617 - RNA, 16 nt, Yersinia pestis
cgagauagucagcgac

SEQ ID NO: 4152618 - RNA, 15 nt, Yersinia pestis
cgagaugcugacccu

SEQ ID NO: 4152619 - RNA, 17 nt, Yersinia pestis
cgagauguauccaaggc

SEQ ID NO: 4152620 - RNA, 12 nt, Yersinia pestis
cgagcacugccc

SEQ ID NO: 4152621 - RNA, 13 nt, Yersinia pestis
cgagcacugcccc

SEQ ID NO: 4152622 - RNA, 14 nt, Yersinia pestis
cgagcacugccccg

SEQ ID NO: 4152623 - RNA, 13 nt, Yersinia pestis
cgagcccaggcga

SEQ ID NO: 4152624 - RNA, 17 nt, Yersinia pestis
cgagcccccagggaagg

SEQ ID NO: 4152625 - RNA, 15 nt, Yersinia pestis
cgagccgcgguuaag

SEQ ID NO: 4152626 - RNA, 14 nt, Yersinia pestis
cgagccuacaugga

SEQ ID NO: 4152627 - RNA, 17 nt, Yersinia pestis
cgagcgugcgguagacc

SEQ ID NO: 4152628 - RNA, 20 nt, Yersinia pestis
cgagcuguuugcuguaaaca

SEQ ID NO: 4152629 - RNA, 15 nt, Yersinia pestis
cgaggaauagccagc

SEQ ID NO: 4152630 - RNA, 17 nt, Yersinia pestis
cgaggccgcuacaagca

SEQ ID NO: 4152631 - RNA, 15 nt, Yersinia pestis
cgaggcuucucagca

SEQ ID NO: 4152632 - RNA, 15 nt, Yersinia pestis
cgagguuaccguuag

SEQ ID NO: 4152633 - RNA, 13 nt, Yersinia pestis
cgaguaaucagag

SEQ ID NO: 4152634 - RNA, 13 nt, Yersinia pestis
cgaguaaugaaau

SEQ ID NO: 4152635 - RNA, 16 nt, Yersinia pestis
cgaguaggucucgccg

SEQ ID NO: 4152636 - RNA, 22 nt, Yersinia pestis
cgagucgaucacggaaaucugc

SEQ ID NO: 4152637 - RNA, 15 nt, Yersinia pestis
cgagugccaacucag

SEQ ID NO: 4152638 - RNA, 17 nt, Yersinia pestis
cgagugugaugauggcg

SEQ ID NO: 4152639 - RNA, 23 nt, Yersinia pestis
cgaguuaacacgggcaugaacgu

SEQ ID NO: 4152640 - RNA, 23 nt, Yersinia pestis
cgaguuaggaaaaauuguuugac

SEQ ID NO: 4152641 - RNA, 20 nt, Yersinia pestis
cgaguuuauauugccacggc

SEQ ID NO: 4152642 - RNA, 16 nt, Yersinia pestis
cgaguuuccaguucaa

SEQ ID NO: 4152643 - RNA, 13 nt, Yersinia pestis
cgaguuucucugc

SEQ ID NO: 4152644 - RNA, 11 nt, Yersinia pestis
cgauaaaagau

SEQ ID NO: 4152645 - RNA, 14 nt, Yersinia pestis
cgauaaacuucaca

SEQ ID NO: 4152646 - RNA, 14 nt, Yersinia pestis
cgauaaagucaucc

SEQ ID NO: 4152647 - RNA, 22 nt, Yersinia pestis
cgauaaauacucccgccaagaa

SEQ ID NO: 4152648 - RNA, 19 nt, Yersinia pestis
cgauaaauucgauaaaagg

SEQ ID NO: 4152649 - RNA, 21 nt, Yersinia pestis
cgauaacagauauuacgcagc

SEQ ID NO: 4152650 - RNA, 16 nt, Yersinia pestis
cgauaaccaaaucacc

SEQ ID NO: 4152651 - RNA, 15 nt, Yersinia pestis
cgauaacgccccggc

SEQ ID NO: 4152652 - RNA, 20 nt, Yersinia pestis
cgauaacggcgguaccaguc

SEQ ID NO: 4152653 - RNA, 20 nt, Yersinia pestis
cgauaagccgcuaucacauc

SEQ ID NO: 4152654 - RNA, 22 nt, Yersinia pestis
cgauaauggaugaauauccacc

SEQ ID NO: 4152655 - RNA, 15 nt, Yersinia pestis
cgauacaccauuucc

SEQ ID NO: 4152656 - RNA, 19 nt, Yersinia pestis
cgauacaccauuuccaggc

SEQ ID NO: 4152657 - RNA, 21 nt, Yersinia pestis
cgauacaccauuuccaggcua

SEQ ID NO: 4152658 - RNA, 18 nt, Yersinia pestis
cgauacccauuuuaaucu

SEQ ID NO: 4152659 - RNA, 18 nt, Yersinia pestis
cgauacguugcaggucaa

SEQ ID NO: 4152660 - RNA, 22 nt, Yersinia pestis
cgauacucauugcaccucauug

SEQ ID NO: 4152661 - RNA, 14 nt, Yersinia pestis
cgauacugccauca

SEQ ID NO: 4152662 - RNA, 23 nt, Yersinia pestis
cgauagcccaaagcaauaaacuc

SEQ ID NO: 4152663 - RNA, 14 nt, Yersinia pestis
cgauagcggccgca

SEQ ID NO: 4152664 - RNA, 18 nt, Yersinia pestis
cgauaguauaaauaccug

SEQ ID NO: 4152665 - RNA, 21 nt, Yersinia pestis
cgauaguauaaauaccugugu

SEQ ID NO: 4152666 - RNA, 22 nt, Yersinia pestis
cgauagugcuuccaacucaccu

SEQ ID NO: 4152667 - RNA, 21 nt, Yersinia pestis
cgauauaaauaaaauagcgua

SEQ ID NO: 4152668 - RNA, 14 nt, Yersinia pestis
cgauauacacccca

SEQ ID NO: 4152669 - RNA, 13 nt, Yersinia pestis
cgauaucaauaaa

SEQ ID NO: 4152670 - RNA, 17 nt, Yersinia pestis
cgauauccagugccaaa

SEQ ID NO: 4152671 - RNA, 13 nt, Yersinia pestis
cgauaucugcaua

SEQ ID NO: 4152672 - RNA, 22 nt, Yersinia pestis
cgauaucugcguuuucugcaua

SEQ ID NO: 4152673 - RNA, 16 nt, Yersinia pestis
cgauaugaucagauuu

SEQ ID NO: 4152674 - RNA, 19 nt, Yersinia pestis
cgauauggcacaggcaaaa

SEQ ID NO: 4152675 - RNA, 11 nt, Yersinia pestis
cgauauugaua

SEQ ID NO: 4152676 - RNA, 12 nt, Yersinia pestis
cgaucaacagug

SEQ ID NO: 4152677 - RNA, 12 nt, Yersinia pestis
cgaucaauacac

SEQ ID NO: 4152678 - RNA, 16 nt, Yersinia pestis
cgaucacaugcucagu

SEQ ID NO: 4152679 - RNA, 20 nt, Yersinia pestis
cgaucacuuucccgcgucgu

SEQ ID NO: 4152680 - RNA, 17 nt, Yersinia pestis
cgaucagaacuaacacu

SEQ ID NO: 4152681 - RNA, 19 nt, Yersinia pestis
cgaucagcaauaugcugaa

SEQ ID NO: 4152682 - RNA, 16 nt, Yersinia pestis
cgaucauaaaucacaa

SEQ ID NO: 4152683 - RNA, 12 nt, Yersinia pestis
cgaucauuuucu

SEQ ID NO: 4152684 - RNA, 21 nt, Yersinia pestis
cgauccaaaacaucggccagc

SEQ ID NO: 4152685 - RNA, 17 nt, Yersinia pestis
cgcauucgugccauaaa

SEQ ID NO: 4152686 - RNA, 22 nt, Yersinia pestis
cgcauucuuuuuguuaaaauag

SEQ ID NO: 4152687 - RNA, 14 nt, Yersinia pestis
cgcauugaggucag

SEQ ID NO: 4152688 - RNA, 21 nt, Yersinia pestis
cgcauuggguaauaucaccau

SEQ ID NO: 4152689 - RNA, 20 nt, Yersinia pestis
cgcauugucacccacuaaug

SEQ ID NO: 4152690 - RNA, 22 nt, Yersinia pestis
cgcauuguuggguaaucaucag

SEQ ID NO: 4152691 - RNA, 20 nt, Yersinia pestis
cgcauuuauuuguagugacg

SEQ ID NO: 4152692 - RNA, 16 nt, Yersinia pestis
cgcauuucgucuugcu

SEQ ID NO: 4152693 - RNA, 13 nt, Yersinia pestis
cgcauuuuucucg

SEQ ID NO: 4152694 - RNA, 17 nt, Yersinia pestis
cgccaaaacgcgcgcca

SEQ ID NO: 4152695 - RNA, 16 nt, Yersinia pestis
cgccaaaccauggcuc

SEQ ID NO: 4152696 - RNA, 22 nt, Yersinia pestis
cgccaaauacaaaccguuugcc

SEQ ID NO: 4152697 - RNA, 22 nt, Yersinia pestis
cgccaacagagugaaucgccgu

SEQ ID NO: 4152698 - RNA, 15 nt, Yersinia pestis
cgccaacaggccuaa

SEQ ID NO: 4152699 - RNA, 18 nt, Yersinia pestis
cgccaaccggcgcgcuuu

SEQ ID NO: 4152700 - RNA, 21 nt, Yersinia pestis
cgccaauaaccgcagcaggca

SEQ ID NO: 4152701 - RNA, 18 nt, Yersinia pestis
cgccaaucauagccaucc

SEQ ID NO: 4152702 - RNA, 21 nt, Yersinia pestis
cgccaaucauagccaucccaa

SEQ ID NO: 4152703 - RNA, 22 nt, Yersinia pestis
cgccaauggggccauaagugca

SEQ ID NO: 4152704 - RNA, 13 nt, Yersinia pestis
cgccaauucacgc

SEQ ID NO: 4152705 - RNA, 19 nt, Yersinia pestis
cgccacaauauuccggcau

SEQ ID NO: 4152706 - RNA, 22 nt, Yersinia pestis
cgccacacaauacauagaagcu

SEQ ID NO: 4152707 - RNA, 23 nt, Yersinia pestis
cgccacagcaacaggguaauaac

SEQ ID NO: 4152708 - RNA, 21 nt, Yersinia pestis
cgccaccaaugcauccaagcc

SEQ ID NO: 4152709 - RNA, 14 nt, Yersinia pestis
cgccagauuaucca

SEQ ID NO: 4152710 - RNA, 16 nt, Yersinia pestis
cgccagauuauccagc

SEQ ID NO: 4152711 - RNA, 21 nt, Yersinia pestis
cgccagcaaaucacauuucaa

SEQ ID NO: 4152712 - RNA, 14 nt, Yersinia pestis
cgccagcacgguua

SEQ ID NO: 4152713 - RNA, 21 nt, Yersinia pestis
cgccagggguaagauccacca

SEQ ID NO: 4152714 - RNA, 23 nt, Yersinia pestis
cgccagguaagaaagagaugacc

SEQ ID NO: 4152715 - RNA, 18 nt, Yersinia pestis
cgccaguaaacagccagc

SEQ ID NO: 4152716 - RNA, 19 nt, Yersinia pestis
cgccaguaaacagccagca

SEQ ID NO: 4152717 - RNA, 19 nt, Yersinia pestis
cgccagugccgcggcggcc

SEQ ID NO: 4152718 - RNA, 17 nt, Yersinia pestis
cgccaguggcaucaaua

SEQ ID NO: 4152719 - RNA, 12 nt, Yersinia pestis
cgccaucaauaa

SEQ ID NO: 4152720 - RNA, 14 nt, Yersinia pestis
cgccaucaauaauu

SEQ ID NO: 4152721 - RNA, 15 nt, Yersinia pestis
cgccaucaauaauuu

SEQ ID NO: 4152722 - RNA, 21 nt, Yersinia pestis
cgccaucagcgccgccucuuc

SEQ ID NO: 4152723 - RNA, 13 nt, Yersinia pestis
cgccauccuuggc

SEQ ID NO: 4152724 - RNA, 19 nt, Yersinia pestis
cgccaucgucagccccugc

SEQ ID NO: 4152725 - RNA, 21 nt, Yersinia pestis
cgccaugagaaccaguucugg

SEQ ID NO: 4152726 - RNA, 18 nt, Yersinia pestis
cgccaugauaaccacaac

SEQ ID NO: 4152727 - RNA, 19 nt, Yersinia pestis
cgccauggcaugccaugca

SEQ ID NO: 4152728 - RNA, 19 nt, Yersinia pestis
cgccauugagucguuauaa

SEQ ID NO: 4152729 - RNA, 23 nt, Yersinia pestis
cgccauuuuuauguuuaucaccc

SEQ ID NO: 4152730 - RNA, 16 nt, Yersinia pestis
cgcccaacucuuuagc

SEQ ID NO: 4152731 - RNA, 22 nt, Yersinia pestis
cgcccacggggggucacgcgaa

SEQ ID NO: 4152732 - RNA, 11 nt, Yersinia pestis
cgcccaggcca

SEQ ID NO: 4152733 - RNA, 18 nt, Yersinia pestis
cgccccaacgguaacccg

SEQ ID NO: 4152734 - RNA, 19 nt, Yersinia pestis
cgccccacaaugucccguc

SEQ ID NO: 4152735 - RNA, 13 nt, Yersinia pestis
cgcccccgccagg

SEQ ID NO: 4152736 - RNA, 23 nt, Yersinia pestis
cgcccccgugguuguaucacaaa

SEQ ID NO: 4152737 - RNA, 19 nt, Yersinia pestis
cgccccgauaaaugucgcu

SEQ ID NO: 4152738 - RNA, 12 nt, Yersinia pestis
cgccccgccccu

SEQ ID NO: 4152739 - RNA, 18 nt, Yersinia pestis
cgccccugcgaucugccu

SEQ ID NO: 4152740 - RNA, 20 nt, Yersinia pestis
cgccccugcgaucugccuua

SEQ ID NO: 4152741 - RNA, 20 nt, Yersinia pestis
cgccccuuagcgcacgggga

SEQ ID NO: 4152742 - RNA, 17 nt, Yersinia pestis
cgcccgcgccagauguu

SEQ ID NO: 4152743 - RNA, 17 nt, Yersinia pestis
cgcccguuggccggcca

SEQ ID NO: 4152744 - RNA, 21 nt, Yersinia pestis
cgcccguuggccggccaacau

SEQ ID NO: 4152745 - RNA, 13 nt, Yersinia pestis
cgcccuguuucaa

SEQ ID NO: 4152746 - RNA, 14 nt, Yersinia pestis
cgcccuugucuggg

SEQ ID NO: 4152747 - RNA, 18 nt, Yersinia pestis
cgccgauggugugcagca

SEQ ID NO: 4152748 - RNA, 12 nt, Yersinia pestis
cgccgcagguau

SEQ ID NO: 4152749 - RNA, 15 nt, Yersinia pestis
cgccgccgcaccgcu

SEQ ID NO: 4152750 - RNA, 13 nt, Yersinia pestis
cgccgccgccagc

SEQ ID NO: 4152751 - RNA, 17 nt, Yersinia pestis
cgccgcuaaaucaucaa

SEQ ID NO: 4152752 - RNA, 13 nt, Yersinia pestis
cgccgcucaauua

SEQ ID NO: 4152753 - RNA, 18 nt, Yersinia pestis
cgccgcugaccuugcugg

SEQ ID NO: 4152754 - RNA, 23 nt, Yersinia pestis
cgccggaauugcgcuucgcgcag

SEQ ID NO: 4152755 - RNA, 17 nt, Yersinia pestis
cgccgguuaucaccuga

SEQ ID NO: 4152756 - RNA, 20 nt, Yersinia pestis
cgccgguuaucaccugauga

SEQ ID NO: 4152757 - RNA, 15 nt, Yersinia pestis
cgccguagcauucau

SEQ ID NO: 4152758 - RNA, 17 nt, Yersinia pestis
cgccguauuuguauuua

SEQ ID NO: 4152759 - RNA, 21 nt, Yersinia pestis
cgccgucaugcugaaucugua

SEQ ID NO: 4152760 - RNA, 19 nt, Yersinia pestis
cgccuaaaaaugauuucag

SEQ ID NO: 4152761 - RNA, 14 nt, Yersinia pestis
cgccuaccugccug

SEQ ID NO: 4152762 - RNA, 15 nt, Yersinia pestis
cgccuaccugccugc

SEQ ID NO: 4152763 - RNA, 17 nt, Yersinia pestis
cgccuccagucccccuc

SEQ ID NO: 4152764 - RNA, 20 nt, Yersinia pestis
cgccuccagucccccucaca

SEQ ID NO: 4152765 - RNA, 13 nt, Yersinia pestis
cgccucugcuccg

SEQ ID NO: 4152766 - RNA, 15 nt, Yersinia pestis
cgccucugcuccggu

SEQ ID NO: 4152767 - RNA, 22 nt, Yersinia pestis
cgccugacugcccgccugcuug

SEQ ID NO: 4152768 - RNA, 15 nt, Yersinia pestis
cgccugaucgauaac

SEQ ID NO: 4152769 - RNA, 17 nt, Yersinia pestis
cgccugaucgauaaccc

SEQ ID NO: 4152770 - RNA, 15 nt, Yersinia pestis
cgccugcgcuaauac

SEQ ID NO: 4152771 - RNA, 17 nt, Yersinia pestis
cgccuguauccagcagc

SEQ ID NO: 4152772 - RNA, 22 nt, Yersinia pestis
cgccuguauccagcagcgcugg

SEQ ID NO: 4152773 - RNA, 21 nt, Yersinia pestis
cgccuguuucggcaggcagaa

SEQ ID NO: 4152774 - RNA, 16 nt, Yersinia pestis
cgccuuaucagcgaaa

SEQ ID NO: 4152775 - RNA, 19 nt, Yersinia pestis
cgccuucagguaauuuaua

SEQ ID NO: 4152776 - RNA, 19 nt, Yersinia pestis
cgccuucaucgcgauugaa

SEQ ID NO: 4152777 - RNA, 16 nt, Yersinia pestis
cgccuucauguugcaa

SEQ ID NO: 4152778 - RNA, 19 nt, Yersinia pestis
cgccuucauguugcaacau

SEQ ID NO: 4152779 - RNA, 20 nt, Yersinia pestis
cgccuuuuuuauaauaaugg

SEQ ID NO: 4152780 - RNA, 12 nt, Yersinia pestis
cgcgaccagcag

SEQ ID NO: 4152781 - RNA, 17 nt, Yersinia pestis
cgcgacggagagaacag

SEQ ID NO: 4152782 - RNA, 14 nt, Yersinia pestis
cgcgagacggcgca

SEQ ID NO: 4152783 - RNA, 16 nt, Yersinia pestis
cgcgagucacauuuuu

SEQ ID NO: 4152784 - RNA, 20 nt, Yersinia pestis
cgcgauaacgguaucaguca

SEQ ID NO: 4152785 - RNA, 15 nt, Yersinia pestis
cgcgauagucacauc

SEQ ID NO: 4152786 - RNA, 23 nt, Yersinia pestis
cgcgcauauaggcgaaaggcgca

SEQ ID NO: 4152787 - RNA, 16 nt, Yersinia pestis
cgcgccaaccaucgga

SEQ ID NO: 4152788 - RNA, 14 nt, Yersinia pestis
cgcgccagggaggg

SEQ ID NO: 4152789 - RNA, 15 nt, Yersinia pestis
cgcgccauccuugcc

SEQ ID NO: 4152790 - RNA, 16 nt, Yersinia pestis
cgcgccauucgcauaa

SEQ ID NO: 4152791 - RNA, 21 nt, Yersinia pestis
cgcgcccauccgcaggaagca

SEQ ID NO: 4152792 - RNA, 15 nt, Yersinia pestis
cgcgcccucccuggc

SEQ ID NO: 4152793 - RNA, 13 nt, Yersinia pestis
cgcgcccugcgca

SEQ ID NO: 4152794 - RNA, 12 nt, Yersinia pestis
cgcgccgcggcu

SEQ ID NO: 4152795 - RNA, 17 nt, Yersinia pestis
cgcgccggauucaaggc

SEQ ID NO: 4152796 - RNA, 15 nt, Yersinia pestis
cgcgccuaccugccu

SEQ ID NO: 4152797 - RNA, 16 nt, Yersinia pestis
cgcgccuaccugccug

SEQ ID NO: 4152798 - RNA, 22 nt, Yersinia pestis
cgcgcgcccagacgccggccgg

SEQ ID NO: 4152799 - RNA, 18 nt, Yersinia pestis
cgcgcgugguuuccugga

SEQ ID NO: 4152800 - RNA, 13 nt, Yersinia pestis
cgcgcugcugcuc

SEQ ID NO: 4152801 - RNA, 20 nt, Yersinia pestis
cgcgcuguggcuaauaaugc

SEQ ID NO: 4152802 - RNA, 13 nt, Yersinia pestis
cgcgcuuccaggc

SEQ ID NO: 4152803 - RNA, 14 nt, Yersinia pestis
cgcgcuuccaggcu

SEQ ID NO: 4152804 - RNA, 15 nt, Yersinia pestis
cgcgcuucgagcccc

SEQ ID NO: 4152805 - RNA, 17 nt, Yersinia pestis
cgcgcuucgagccccca

SEQ ID NO: 4152806 - RNA, 21 nt, Yersinia pestis
cgcggacgcuuuacuccucug

SEQ ID NO: 4152807 - RNA, 19 nt, Yersinia pestis
cggaaucaccuuucuccau

SEQ ID NO: 4152808 - RNA, 16 nt, Yersinia pestis
cggacaccaacuggcg

SEQ ID NO: 4152809 - RNA, 14 nt, Yersinia pestis
cggacagcgcgcag

SEQ ID NO: 4152810 - RNA, 15 nt, Yersinia pestis
cggacagcgcgcagc

SEQ ID NO: 4152811 - RNA, 21 nt, Yersinia pestis
cggacauaagaugaccaccaa

SEQ ID NO: 4152812 - RNA, 22 nt, Yersinia pestis
cggacauaaugcauccacuuuu

SEQ ID NO: 4152813 - RNA, 21 nt, Yersinia pestis
cggacauuuuacucccugacu

SEQ ID NO: 4152814 - RNA, 23 nt, Yersinia pestis
cggacauuuuacucccugacucc

SEQ ID NO: 4152815 - RNA, 22 nt, Yersinia pestis
cggacgcuuuacuccccugccu

SEQ ID NO: 4152816 - RNA, 16 nt, Yersinia pestis
cggacgcuuuacuccu

SEQ ID NO: 4152817 - RNA, 22 nt, Yersinia pestis
cggacgcuuuacuccucugccu

SEQ ID NO: 4152818 - RNA, 17 nt, Yersinia pestis
cggacucauuccgccug

SEQ ID NO: 4152819 - RNA, 17 nt, Yersinia pestis
cggacuguugcaaccag

SEQ ID NO: 4152820 - RNA, 13 nt, Yersinia pestis
cggagaacuugaa

SEQ ID NO: 4152821 - RNA, 15 nt, Yersinia pestis
cggagaauaaaaaug

SEQ ID NO: 4152822 - RNA, 13 nt, Yersinia pestis
cggagccugauac

SEQ ID NO: 4152823 - RNA, 20 nt, Yersinia pestis
cggagcugacgucagaucgc

SEQ ID NO: 4152824 - RNA, 16 nt, Yersinia pestis
cggaggagauuucaga

SEQ ID NO: 4152825 - RNA, 17 nt, Yersinia pestis
cggaggauauuuauuau

SEQ ID NO: 4152826 - RNA, 22 nt, Yersinia pestis
cggaggauauuuauuuccgaau

SEQ ID NO: 4152827 - RNA, 19 nt, Yersinia pestis
cggaggauauuuauuuugg

SEQ ID NO: 4152828 - RNA, 15 nt, Yersinia pestis
cggagugaugaaacc

SEQ ID NO: 4152829 - RNA, 16 nt, Yersinia pestis
cggagugaugaaacca

SEQ ID NO: 4152830 - RNA, 13 nt, Yersinia pestis
cggauaaaacaau

SEQ ID NO: 4152831 - RNA, 18 nt, Yersinia pestis
cggauaacggcggcaaua

SEQ ID NO: 4152832 - RNA, 19 nt, Yersinia pestis
cggauagccaaugcgcaaa

SEQ ID NO: 4152833 - RNA, 22 nt, Yersinia pestis
cggauaggcuuaauaugccaaa

SEQ ID NO: 4152834 - RNA, 19 nt, Yersinia pestis
cggauagggggcaaccaua

SEQ ID NO: 4152835 - RNA, 17 nt, Yersinia pestis
cggauaucgggcggaua

SEQ ID NO: 4152836 - RNA, 14 nt, Yersinia pestis
cggauauucucaac

SEQ ID NO: 4152837 - RNA, 14 nt, Yersinia pestis
cggaucaaccgccc

SEQ ID NO: 4152838 - RNA, 18 nt, Yersinia pestis
cggaucauaaucgauuac

SEQ ID NO: 4152839 - RNA, 14 nt, Yersinia pestis
cggaucgcgacgaa

SEQ ID NO: 4152840 - RNA, 21 nt, Yersinia pestis
cggaugauauccacuaacccc

SEQ ID NO: 4152841 - RNA, 20 nt, Yersinia pestis
cggauggcgcgguucuagua

SEQ ID NO: 4152842 - RNA, 18 nt, Yersinia pestis
cggaugguauucgauaug

SEQ ID NO: 4152843 - RNA, 13 nt, Yersinia pestis
cggauucacccau

SEQ ID NO: 4152844 - RNA, 23 nt, Yersinia pestis
cggauucacccauuaauagacga

SEQ ID NO: 4152845 - RNA, 16 nt, Yersinia pestis
cggauugcaaauccgu

SEQ ID NO: 4152846 - RNA, 23 nt, Yersinia pestis
cggauuguucagcaaccgcauca

SEQ ID NO: 4152847 - RNA, 16 nt, Yersinia pestis
cggauuugucugccgc

SEQ ID NO: 4152848 - RNA, 23 nt, Yersinia pestis
cggcaaauuaaugucgccauaac

SEQ ID NO: 4152849 - RNA, 14 nt, Yersinia pestis
cggcaacagcgccu

SEQ ID NO: 4152850 - RNA, 23 nt, Yersinia pestis
cggcaacugccgcuucaguaaga

SEQ ID NO: 4152851 - RNA, 14 nt, Yersinia pestis
cggcaacuucuaca

SEQ ID NO: 4152852 - RNA, 15 nt, Yersinia pestis
cggcaaucccggcca

SEQ ID NO: 4152853 - RNA, 17 nt, Yersinia pestis
cggcaaucccggccauu

SEQ ID NO: 4152854 - RNA, 13 nt, Yersinia pestis
cggcaaugaccau

SEQ ID NO: 4152855 - RNA, 22 nt, Yersinia pestis
cggcaaugggucauugcgugca

SEQ ID NO: 4152856 - RNA, 16 nt, Yersinia pestis
cggcacaggcgcuggc

SEQ ID NO: 4152857 - RNA, 21 nt, Yersinia pestis
cggcacgcguugguuguccug

SEQ ID NO: 4152858 - RNA, 22 nt, Yersinia pestis
cggcacguuuccccuucauuug

SEQ ID NO: 4152859 - RNA, 16 nt, Yersinia pestis
cggcacugcaucugac

SEQ ID NO: 4152860 - RNA, 20 nt, Yersinia pestis
cggcagacguggucaagaau

SEQ ID NO: 4152861 - RNA, 17 nt, Yersinia pestis
cggcagauaugccaggc

SEQ ID NO: 4152862 - RNA, 17 nt, Yersinia pestis
cggcagcgagcacugcc

SEQ ID NO: 4152863 - RNA, 19 nt, Yersinia pestis
cggcagcgagcacugcccc

SEQ ID NO: 4152864 - RNA, 20 nt, Yersinia pestis
cggcagcgagcacugccccg

SEQ ID NO: 4152865 - RNA, 22 nt, Yersinia pestis
cggcagguuaaaguugauaaag

SEQ ID NO: 4152866 - RNA, 20 nt, Yersinia pestis
cggcagugaucgcacuucaa

SEQ ID NO: 4152867 - RNA, 18 nt, Yersinia pestis
cggcauacuccauuuuuu

SEQ ID NO: 4152868 - RNA, 14 nt, Yersinia pestis
cggcauagcaaaau

SEQ ID NO: 4152869 - RNA, 12 nt, Yersinia pestis
cggcaucaccaa

SEQ ID NO: 4152870 - RNA, 13 nt, Yersinia pestis
cggcaucaccaaa

SEQ ID NO: 4152871 - RNA, 16 nt, Yersinia pestis
cggcauccucagggcg

SEQ ID NO: 4152872 - RNA, 17 nt, Yersinia pestis
cggcauccucagggcga

SEQ ID NO: 4152873 - RNA, 15 nt, Yersinia pestis
cggcaucuuuugcua

SEQ ID NO: 4152874 - RNA, 17 nt, Yersinia pestis
cggcaugguguagcuga

SEQ ID NO: 4152875 - RNA, 14 nt, Yersinia pestis
cggcauuagugaau

SEQ ID NO: 4152876 - RNA, 13 nt, Yersinia pestis
cggccaauagcaa

SEQ ID NO: 4152877 - RNA, 15 nt, Yersinia pestis
cggccacccgccauc

SEQ ID NO: 4152878 - RNA, 15 nt, Yersinia pestis
cggccagaaaaacaa

SEQ ID NO: 4152879 - RNA, 16 nt, Yersinia pestis
cggccagccuugagcc

SEQ ID NO: 4152880 - RNA, 17 nt, Yersinia pestis
cggccaggcucccaagg

SEQ ID NO: 4152881 - RNA, 12 nt, Yersinia pestis
cggccaucccag

SEQ ID NO: 4152882 - RNA, 23 nt, Yersinia pestis
cggccaugucaggccaccaauca

SEQ ID NO: 4152883 - RNA, 20 nt, Yersinia pestis
cggccauuuuuuaccauuac

SEQ ID NO: 4152884 - RNA, 20 nt, Yersinia pestis
cggcccacuuuuugaauaau

SEQ ID NO: 4152885 - RNA, 12 nt, Yersinia pestis
cggccccagccc

SEQ ID NO: 4152886 - RNA, 17 nt, Yersinia pestis
cggcccgacuaaauccu

SEQ ID NO: 4152887 - RNA, 20 nt, Yersinia pestis
cggcccuuggcuuugcgcaa

SEQ ID NO: 4152888 - RNA, 12 nt, Yersinia pestis
cggccuauuucu

SEQ ID NO: 4152889 - RNA, 16 nt, Yersinia pestis
cggccuucaauaccuu

SEQ ID NO: 4152890 - RNA, 20 nt, Yersinia pestis
cggccuuucguuucugucug

SEQ ID NO: 4152891 - RNA, 16 nt, Yersinia pestis
cggcgaaauauaaaac

SEQ ID NO: 4152892 - RNA, 21 nt, Yersinia pestis
cggcgaaggcuucguggugcu

SEQ ID NO: 4152893 - RNA, 20 nt, Yersinia pestis
cggcgaagggcgcagccccc

SEQ ID NO: 4152894 - RNA, 15 nt, Yersinia pestis
cggcgagcacugccc

SEQ ID NO: 4152895 - RNA, 18 nt, Yersinia pestis
cggcgauaucacugauac

SEQ ID NO: 4152896 - RNA, 17 nt, Yersinia pestis
cggcgaugaaaaacaga

SEQ ID NO: 4152897 - RNA, 13 nt, Yersinia pestis
cggcgcaucgcca

SEQ ID NO: 4152898 - RNA, 13 nt, Yersinia pestis
cggcgccgucacg

SEQ ID NO: 4152899 - RNA, 21 nt, Yersinia pestis
cggcgcgcuugccacgccagu

SEQ ID NO: 4152900 - RNA, 20 nt, Yersinia pestis
cggcgcugacuggcaggaaa

SEQ ID NO: 4152901 - RNA, 15 nt, Yersinia pestis
cggcgcugauaguua

SEQ ID NO: 4152902 - RNA, 16 nt, Yersinia pestis
cggcggagagaaauag

SEQ ID NO: 4152903 - RNA, 17 nt, Yersinia pestis
cggcggcgagcacugcc

SEQ ID NO: 4152904 - RNA, 19 nt, Yersinia pestis
cggcggcgagcacugcccc

SEQ ID NO: 4152905 - RNA, 22 nt, Yersinia pestis
cggcggcgcuggcguaaaauau

SEQ ID NO: 4152906 - RNA, 14 nt, Yersinia pestis
cggcggcggaucaa

SEQ ID NO: 4152907 - RNA, 20 nt, Yersinia pestis
cggcgguaaccccggcggcu

SEQ ID NO: 4152908 - RNA, 14 nt, Yersinia pestis
cggcgguauacaga

SEQ ID NO: 4152909 - RNA, 14 nt, Yersinia pestis
cggcgucuuugcgu

SEQ ID NO: 4152910 - RNA, 19 nt, Yersinia pestis
cggcgugaguuccagcccc

SEQ ID NO: 4152911 - RNA, 22 nt, Yersinia pestis
cggcguuaauauaacaauguuu

SEQ ID NO: 4152912 - RNA, 18 nt, Yersinia pestis
cggcguuaaugccacccc

SEQ ID NO: 4152913 - RNA, 22 nt, Yersinia pestis
cggcguuaaugccacccccagu

SEQ ID NO: 4152914 - RNA, 22 nt, Yersinia pestis
cggcuaaagcguggcgcaggaa

SEQ ID NO: 4152915 - RNA, 16 nt, Yersinia pestis
cggcuaugccggagga

SEQ ID NO: 4152916 - RNA, 17 nt, Yersinia pestis
cggcucaccuggccucc

SEQ ID NO: 4152917 - RNA, 14 nt, Yersinia pestis
cggcucauccgcca

SEQ ID NO: 4152918 - RNA, 12 nt, Yersinia pestis
cggcuccugccg

SEQ ID NO: 4152919 - RNA, 21 nt, Yersinia pestis
cggcucgacucaauaaaucca

SEQ ID NO: 4152920 - RNA, 18 nt, Yersinia pestis
cggcucgcccacggcaca

SEQ ID NO: 4152921 - RNA, 20 nt, Yersinia pestis
cggcucuauuucaugauucu

SEQ ID NO: 4152922 - RNA, 17 nt, Yersinia pestis
cggcugaccacaaaaac

SEQ ID NO: 4152923 - RNA, 22 nt, Yersinia pestis
cggcugaccacaaaaacagugu

SEQ ID NO: 4152924 - RNA, 17 nt, Yersinia pestis
cggcugggaacccauca

SEQ ID NO: 4152925 - RNA, 17 nt, Yersinia pestis
cggcugguaacagagcc

SEQ ID NO: 4152926 - RNA, 18 nt, Yersinia pestis
cggcugguaacagagccu

SEQ ID NO: 4152927 - RNA, 14 nt, Yersinia pestis
cggcuucagcaccu

SEQ ID NO: 4152928 - RNA, 18 nt, Yersinia pestis
cggcuuucaggugacuga

SEQ ID NO: 4152929 - RNA, 11 nt, Yersinia pestis
cguaaagcacc

SEQ ID NO: 4152930 - RNA, 19 nt, Yersinia pestis
cguaaauaaaagcgccggu

SEQ ID NO: 4152931 - RNA, 17 nt, Yersinia pestis
cguaacccccagccaga

SEQ ID NO: 4152932 - RNA, 19 nt, Yersinia pestis
cguaacccccagccagaau

SEQ ID NO: 4152933 - RNA, 18 nt, Yersinia pestis
cguaacgaauucagcagc

SEQ ID NO: 4152934 - RNA, 20 nt, Yersinia pestis
cguaacgaauucagcagcgc

SEQ ID NO: 4152935 - RNA, 16 nt, Yersinia pestis
cguaacucaccgucug

SEQ ID NO: 4152936 - RNA, 23 nt, Yersinia pestis
cguaacuccuuuguuauuucugg

SEQ ID NO: 4152937 - RNA, 11 nt, Yersinia pestis
cguaacuucuu

SEQ ID NO: 4152938 - RNA, 21 nt, Yersinia pestis
cguaauacccucgacaccaaa

SEQ ID NO: 4152939 - RNA, 21 nt, Yersinia pestis
cguaauaguuaaucgcagcag

SEQ ID NO: 4152940 - RNA, 17 nt, Yersinia pestis
cguaauaucugccaccg

SEQ ID NO: 4152941 - RNA, 14 nt, Yersinia pestis
cguaaucagccgcg

SEQ ID NO: 4152942 - RNA, 19 nt, Yersinia pestis
cguaaugacugucugcggc

SEQ ID NO: 4152943 - RNA, 14 nt, Yersinia pestis
cguaauucagauaa

SEQ ID NO: 4152944 - RNA, 18 nt, Yersinia pestis
cguaauucguagcuaucu

SEQ ID NO: 4152945 - RNA, 16 nt, Yersinia pestis
cguaauuuuaagccgc

SEQ ID NO: 4152946 - RNA, 16 nt, Yersinia pestis
cguacauauaucacua

SEQ ID NO: 4152947 - RNA, 14 nt, Yersinia pestis
cguacaucagggug

SEQ ID NO: 4152948 - RNA, 13 nt, Yersinia pestis
cguacauuaaaug

SEQ ID NO: 4152949 - RNA, 17 nt, Yersinia pestis
cguacauuaaaugaaua

SEQ ID NO: 4152950 - RNA, 18 nt, Yersinia pestis
cguagaacgucaccgcca

SEQ ID NO: 4152951 - RNA, 21 nt, Yersinia pestis
cguagaguugcaguucaucaa

SEQ ID NO: 4152952 - RNA, 15 nt, Yersinia pestis
cguagauuuucucag

SEQ ID NO: 4152953 - RNA, 17 nt, Yersinia pestis
cguagcacacgacugag

SEQ ID NO: 4152954 - RNA, 16 nt, Yersinia pestis
cguagccguuaaauau

SEQ ID NO: 4152955 - RNA, 15 nt, Yersinia pestis
cguagccuucaaggu

SEQ ID NO: 4152956 - RNA, 15 nt, Yersinia pestis
cguagcgauaacaga

SEQ ID NO: 4152957 - RNA, 17 nt, Yersinia pestis
cguaggcuuggcgggcu

SEQ ID NO: 4152958 - RNA, 20 nt, Yersinia pestis
cguagguaauuaaacgcuca

SEQ ID NO: 4152959 - RNA, 18 nt, Yersinia pestis
cguagguuucagccucug

SEQ ID NO: 4152960 - RNA, 19 nt, Yersinia pestis
cguagguuucagccucuga

SEQ ID NO: 4152961 - RNA, 23 nt, Yersinia pestis
cguagugagucaggaaacuggcc

SEQ ID NO: 4152962 - RNA, 14 nt, Yersinia pestis
cguauaaaacugug

SEQ ID NO: 4152963 - RNA, 15 nt, Yersinia pestis
cguauaacauaauaa

SEQ ID NO: 4152964 - RNA, 22 nt, Yersinia pestis
cguauaucuuaccuucaguuua

SEQ ID NO: 4152965 - RNA, 13 nt, Yersinia pestis
cguaucagccccu

SEQ ID NO: 4152966 - RNA, 21 nt, Yersinia pestis
cguaucagccccuaaauccug

SEQ ID NO: 4152967 - RNA, 16 nt, Yersinia pestis
cguaucaucagugcua

SEQ ID NO: 4152968 - RNA, 16 nt, Yersinia pestis
cguauggcaugacuua

SEQ ID NO: 4152969 - RNA, 19 nt, Yersinia pestis
cguauguccucaccauuua

SEQ ID NO: 4152970 - RNA, 13 nt, Yersinia pestis
cguauuaucagua

SEQ ID NO: 4152971 - RNA, 21 nt, Yersinia pestis
cguauuaucaguaacgccgua

SEQ ID NO: 4152972 - RNA, 12 nt, Yersinia pestis
cguauuaucugc

SEQ ID NO: 4152973 - RNA, 18 nt, Yersinia pestis
cguauucggaucacgccc

SEQ ID NO: 4152974 - RNA, 19 nt, Yersinia pestis
cguauugccucggcaaguu

SEQ ID NO: 4152975 - RNA, 22 nt, Yersinia pestis
cguauuggccgacugacacaaa

SEQ ID NO: 4152976 - RNA, 18 nt, Yersinia pestis
cguauuuucauuuuaaca

SEQ ID NO: 4152977 - RNA, 23 nt, Yersinia pestis
cgucaaaccaucgcucuccugcc

SEQ ID NO: 4152978 - RNA, 19 nt, Yersinia pestis
cgucaaacgggugcgccaa

SEQ ID NO: 4152979 - RNA, 18 nt, Yersinia pestis
cgucaaauaacggaauuu

SEQ ID NO: 4152980 - RNA, 18 nt, Yersinia pestis
cgucaagacaacaaacag

SEQ ID NO: 4152981 - RNA, 17 nt, Yersinia pestis
cgucaagccaaccccca

SEQ ID NO: 4152982 - RNA, 20 nt, Yersinia pestis
cgucaagguacccauuauuc

SEQ ID NO: 4152983 - RNA, 16 nt, Yersinia pestis
cgucaaucauccaagc

SEQ ID NO: 4152984 - RNA, 13 nt, Yersinia pestis
cgucacagcaauu

SEQ ID NO: 4152985 - RNA, 19 nt, Yersinia pestis
cgucaccagaucuggguua

SEQ ID NO: 4152986 - RNA, 23 nt, Yersinia pestis
cgucaccagaucuggguuagaaa

SEQ ID NO: 4152987 - RNA, 18 nt, Yersinia pestis
cgucaccgccaaaauaaa

SEQ ID NO: 4152988 - RNA, 19 nt, Yersinia pestis
cgucaccgccaaaauaaac

SEQ ID NO: 4152989 - RNA, 12 nt, Yersinia pestis
cgucaccuuucu

SEQ ID NO: 4152990 - RNA, 13 nt, Yersinia pestis
cgucacgauagca

SEQ ID NO: 4152991 - RNA, 14 nt, Yersinia pestis
cgucacgauagcaa

SEQ ID NO: 4152992 - RNA, 12 nt, Yersinia pestis
cgucacguacug

SEQ ID NO: 4152993 - RNA, 14 nt, Yersinia pestis
cgucacuaaaucca

SEQ ID NO: 4152994 - RNA, 15 nt, Yersinia pestis
cgucacuggccaccc

SEQ ID NO: 4152995 - RNA, 14 nt, Yersinia pestis
cgucacuucucuga

SEQ ID NO: 4152996 - RNA, 18 nt, Yersinia pestis
cgucacuucucugacaca

SEQ ID NO: 4152997 - RNA, 18 nt, Yersinia pestis
cgucagaucgcgcccauc

SEQ ID NO: 4152998 - RNA, 15 nt, Yersinia pestis
cgucagccccugcca

SEQ ID NO: 4152999 - RNA, 19 nt, Yersinia pestis
cgucaggggguucacgccu

SEQ ID NO: 4153000 - RNA, 20 nt, Yersinia pestis
cgucagguaaguagaaugca

SEQ ID NO: 4153001 - RNA, 12 nt, Yersinia pestis
cgucaguugccc

SEQ ID NO: 4153002 - RNA, 21 nt, Yersinia pestis
cgucauaccauucucugucuu

SEQ ID NO: 4153003 - RNA, 18 nt, Yersinia pestis
cgucaucaggauaccuga

SEQ ID NO: 4153004 - RNA, 13 nt, Yersinia pestis
cgucaucaucuuc

SEQ ID NO: 4153005 - RNA, 21 nt, Yersinia pestis
cgucaucgggguuugucagcc

SEQ ID NO: 4153006 - RNA, 20 nt, Yersinia pestis
cgucaugauagacagcaaac

SEQ ID NO: 4153007 - RNA, 18 nt, Yersinia pestis
cgucaugcugaaucugua

SEQ ID NO: 4153008 - RNA, 21 nt, Yersinia pestis
cgucauugguguuacagcaag

SEQ ID NO: 4153009 - RNA, 21 nt, Yersinia pestis
cguccagaacaauaccgccaa

SEQ ID NO: 4153010 - RNA, 22 nt, Yersinia pestis
cguccagaacaauaccgccaau

SEQ ID NO: 4153011 - RNA, 12 nt, Yersinia pestis
cguccagaugcc

SEQ ID NO: 4153012 - RNA, 14 nt, Yersinia pestis
cguccagaugccaa

SEQ ID NO: 4153013 - RNA, 19 nt, Yersinia pestis
cguccagggcgcccuaaua

SEQ ID NO: 4153014 - RNA, 14 nt, Yersinia pestis
cgucccaagaaaag

SEQ ID NO: 4153015 - RNA, 22 nt, Yersinia pestis
cgucccaagaaaagcaccgcag

SEQ ID NO: 4153016 - RNA, 19 nt, Yersinia pestis
cgucccuaaagccaucgcc

SEQ ID NO: 4153017 - RNA, 17 nt, Yersinia pestis
cguccgcgccagggagg

SEQ ID NO: 4153018 - RNA, 20 nt, Yersinia pestis
cguccugaugaugaagcauu

SEQ ID NO: 4153019 - RNA, 16 nt, Yersinia pestis
cgucgaggaucaccac

SEQ ID NO: 4153020 - RNA, 13 nt, Yersinia pestis
cgucgcuguuacc

SEQ ID NO: 4153021 - RNA, 13 nt, Yersinia pestis
cgucgcuguuacu

SEQ ID NO: 4153022 - RNA, 16 nt, Yersinia pestis
cgucucaaggccuugu

SEQ ID NO: 4153023 - RNA, 16 nt, Yersinia pestis
cgucucuacgacgccc

SEQ ID NO: 4153024 - RNA, 20 nt, Yersinia pestis
cgucugcaucguucacggca

SEQ ID NO: 4153025 - RNA, 14 nt, Yersinia pestis
cgucuucagcuucc

SEQ ID NO: 4153026 - RNA, 17 nt, Yersinia pestis
cgucuucgcauucuuua

SEQ ID NO: 4153027 - RNA, 13 nt, Yersinia pestis
cgucuugaucaac

SEQ ID NO: 4153028 - RNA, 23 nt, Yersinia pestis
cgucuuguuggucaccacuugca

SEQ ID NO: 4153029 - RNA, 15 nt, Yersinia pestis
cgucuuuacgaucug

SEQ ID NO: 4153030 - RNA, 20 nt, Yersinia pestis
cgucuuuacgaucugccugu

SEQ ID NO: 4153031 - RNA, 23 nt, Yersinia pestis
cgucuuuacgaucugccuguucu

SEQ ID NO: 4153032 - RNA, 17 nt, Yersinia pestis
cgucuuuagauuucacc

SEQ ID NO: 4153033 - RNA, 22 nt, Yersinia pestis
cgugaaacgauaugcuccagau

SEQ ID NO: 4153034 - RNA, 15 nt, Yersinia pestis
cgugaacaucuggcg

SEQ ID NO: 4153035 - RNA, 13 nt, Yersinia pestis
cgugacggcagcg

SEQ ID NO: 4153036 - RNA, 16 nt, Yersinia pestis
cgugacggcagcgagc

SEQ ID NO: 4153037 - RNA, 21 nt, Yersinia pestis
cgugacggcagcgagcacugc

SEQ ID NO: 4153038 - RNA, 21 nt, Yersinia pestis
cgugacggcggcgagcacugc

SEQ ID NO: 4153039 - RNA, 23 nt, Yersinia pestis
cgugacggcggcgagcacugccc

SEQ ID NO: 4153040 - RNA, 19 nt, Yersinia pestis
cgugacguuaucucaacca

SEQ ID NO: 4153041 - RNA, 16 nt, Yersinia pestis
cgugagaauaauaauc

SEQ ID NO: 4153042 - RNA, 16 nt, Yersinia pestis
cgugagugaaggggug

SEQ ID NO: 4153043 - RNA, 18 nt, Yersinia pestis
cgugaguuuucgcuucuu

SEQ ID NO: 4153044 - RNA, 13 nt, Yersinia pestis
cgugauaucccca

SEQ ID NO: 4153045 - RNA, 21 nt, Yersinia pestis
cgugauaugaauauccgccgc

SEQ ID NO: 4153046 - RNA, 13 nt, Yersinia pestis
cgugaucgccgua

SEQ ID NO: 4153047 - RNA, 18 nt, Yersinia pestis
cgugaugccaguaauuca

SEQ ID NO: 4153048 - RNA, 18 nt, Yersinia pestis
cgugaugguaucaaucgc

SEQ ID NO: 4153049 - RNA, 16 nt, Yersinia pestis
cgugauuuuuauauuu

SEQ ID NO: 4153050 - RNA, 17 nt, Yersinia pestis
cgugauuuuuauauuuu

SEQ ID NO: 4153051 - RNA, 22 nt, Yersinia pestis
cuaaagcgccuuccuuuuauuu

SEQ ID NO: 4153052 - RNA, 13 nt, Yersinia pestis
cuaaauaaccaga

SEQ ID NO: 4153053 - RNA, 20 nt, Yersinia pestis
cuaaauaauaucugucugac

SEQ ID NO: 4153054 - RNA, 21 nt, Yersinia pestis
cuaaauaauccagaagcugag

SEQ ID NO: 4153055 - RNA, 12 nt, Yersinia pestis
cuaaauacugcu

SEQ ID NO: 4153056 - RNA, 23 nt, Yersinia pestis
cuaaauccuuguaaggugcuagu

SEQ ID NO: 4153057 - RNA, 17 nt, Yersinia pestis
cuaaauguugauacacc

SEQ ID NO: 4153058 - RNA, 23 nt, Yersinia pestis
cuaaauguugauacaccgucuca

SEQ ID NO: 4153059 - RNA, 20 nt, Yersinia pestis
cuaaauuaaaugcagcggcc

SEQ ID NO: 4153060 - RNA, 22 nt, Yersinia pestis
cuaaauuaauaucuuuaaauua

SEQ ID NO: 4153061 - RNA, 14 nt, Yersinia pestis
cuaaauuguacauu

SEQ ID NO: 4153062 - RNA, 16 nt, Yersinia pestis
cuaacaacaauuuacg

SEQ ID NO: 4153063 - RNA, 18 nt, Yersinia pestis
cuaacaacagucaauaua

SEQ ID NO: 4153064 - RNA, 16 nt, Yersinia pestis
cuaacaacuuccacac

SEQ ID NO: 4153065 - RNA, 13 nt, Yersinia pestis
cuaacagcagugc

SEQ ID NO: 4153066 - RNA, 23 nt, Yersinia pestis
cuaacaucaauguauuaauuugg

SEQ ID NO: 4153067 - RNA, 16 nt, Yersinia pestis
cuaacaugccacauag

SEQ ID NO: 4153068 - RNA, 17 nt, Yersinia pestis
cuaacauugagcggcga

SEQ ID NO: 4153069 - RNA, 14 nt, Yersinia pestis
cuaaccaaacauug

SEQ ID NO: 4153070 - RNA, 17 nt, Yersinia pestis
cuaaccaaacauuguca

SEQ ID NO: 4153071 - RNA, 21 nt, Yersinia pestis
cuaaccaaacauuguuaccua

SEQ ID NO: 4153072 - RNA, 18 nt, Yersinia pestis
cuaaccagugucuggcaa

SEQ ID NO: 4153073 - RNA, 15 nt, Yersinia pestis
cuaacccauugguuu

SEQ ID NO: 4153074 - RNA, 17 nt, Yersinia pestis
cuaaccccugcaucuug

SEQ ID NO: 4153075 - RNA, 24 nt, Yersinia pestis
cuaaccgcacugggucaucaccca

SEQ ID NO: 4153076 - RNA, 16 nt, Yersinia pestis
cuaaccuuaacugcau

SEQ ID NO: 4153077 - RNA, 20 nt, Yersinia pestis
cuaacgaaucccacacucug

SEQ ID NO: 4153078 - RNA, 21 nt, Yersinia pestis
cuaacgaaucccacacucugg

SEQ ID NO: 4153079 - RNA, 18 nt, Yersinia pestis
cuaacgaggcauaaucag

SEQ ID NO: 4153080 - RNA, 17 nt, Yersinia pestis
cuaacgcaauaggcuau

SEQ ID NO: 4153081 - RNA, 21 nt, Yersinia pestis
cuaacgcuuuuucgacaaaaa

SEQ ID NO: 4153082 - RNA, 20 nt, Yersinia pestis
cuaacgguggcauugaccaa

SEQ ID NO: 4153083 - RNA, 20 nt, Yersinia pestis
cuaacgucccauuccguuua

SEQ ID NO: 4153084 - RNA, 18 nt, Yersinia pestis
cuaacguccccugagcga

SEQ ID NO: 4153085 - RNA, 17 nt, Yersinia pestis
cuaacgucgcuguuacu

SEQ ID NO: 4153086 - RNA, 23 nt, Yersinia pestis
cuaacuaauaauaaucuuaagua

SEQ ID NO: 4153087 - RNA, 19 nt, Yersinia pestis
cuaacuggaauauggguaa

SEQ ID NO: 4153088 - RNA, 20 nt, Yersinia pestis
cuaacugugccaaugccucu

SEQ ID NO: 4153089 - RNA, 17 nt, Yersinia pestis
cuaagauucaaacagua

SEQ ID NO: 4153090 - RNA, 15 nt, Yersinia pestis
cuaagccggucuuuu

SEQ ID NO: 4153091 - RNA, 19 nt, Yersinia pestis
cuaagcgucucaaggccuu

SEQ ID NO: 4153092 - RNA, 23 nt, Yersinia pestis
cuaagcgucucaaggccuugugg

SEQ ID NO: 4153093 - RNA, 19 nt, Yersinia pestis
cuaagcucuuccaauagca

SEQ ID NO: 4153094 - RNA, 20 nt, Yersinia pestis
cuaaggaacccgaugaauuu

SEQ ID NO: 4153095 - RNA, 16 nt, Yersinia pestis
cuaaggccaucaauaa

SEQ ID NO: 4153096 - RNA, 14 nt, Yersinia pestis
cuaaguaaaacaaa

SEQ ID NO: 4153097 - RNA, 16 nt, Yersinia pestis
cuaaguacuaucuauu

SEQ ID NO: 4153098 - RNA, 14 nt, Yersinia pestis
cuaagugccaguua

SEQ ID NO: 4153099 - RNA, 16 nt, Yersinia pestis
cuaauaauaaucuuaa

SEQ ID NO: 4153100 - RNA, 18 nt, Yersinia pestis
cuaauaauuguucauaaa

SEQ ID NO: 4153101 - RNA, 15 nt, Yersinia pestis
cuaauaauuuauaca

SEQ ID NO: 4153102 - RNA, 17 nt, Yersinia pestis
cuaauacagcaccaccg

SEQ ID NO: 4153103 - RNA, 16 nt, Yersinia pestis
cuaauaccauuucuua

SEQ ID NO: 4153104 - RNA, 16 nt, Yersinia pestis
cuaauacgcuaucaac

SEQ ID NO: 4153105 - RNA, 15 nt, Yersinia pestis
cuaauagcauuuuuc

SEQ ID NO: 4153106 - RNA, 17 nt, Yersinia pestis
cuaauauuuauaaaaaa

SEQ ID NO: 4153107 - RNA, 13 nt, Yersinia pestis
cuaaucauaucca

SEQ ID NO: 4153108 - RNA, 11 nt, Yersinia pestis
cuaauccaagg

SEQ ID NO: 4153109 - RNA, 11 nt, Yersinia pestis
cuaaucccuuu

SEQ ID NO: 4153110 - RNA, 22 nt, Yersinia pestis
cuaaucgguaugaccagugaau

SEQ ID NO: 4153111 - RNA, 14 nt, Yersinia pestis
cuaaucuccucucc

SEQ ID NO: 4153112 - RNA, 14 nt, Yersinia pestis
cuaaugaacgagua

SEQ ID NO: 4153113 - RNA, 18 nt, Yersinia pestis
cuaaugccagacacaaga

SEQ ID NO: 4153114 - RNA, 22 nt, Yersinia pestis
cuaaugccgcgcccccagccau

SEQ ID NO: 4153115 - RNA, 23 nt, Yersinia pestis
cuaaugccgcgcccccagccauu

SEQ ID NO: 4153116 - RNA, 17 nt, Yersinia pestis
cuaaugcggaaacaccu

SEQ ID NO: 4153117 - RNA, 20 nt, Yersinia pestis
cuaauggccagacacugaca

SEQ ID NO: 4153118 - RNA, 17 nt, Yersinia pestis
cuaauggugcuauuucu

SEQ ID NO: 4153119 - RNA, 18 nt, Yersinia pestis
cuaauggugcuauuucug

SEQ ID NO: 4153120 - RNA, 14 nt, Yersinia pestis
cuaauguaauaauc

SEQ ID NO: 4153121 - RNA, 15 nt, Yersinia pestis
cuaauguaauaaucu

SEQ ID NO: 4153122 - RNA, 16 nt, Yersinia pestis
cuaaugucucuauuca

SEQ ID NO: 4153123 - RNA, 18 nt, Yersinia pestis
cuaauuaaagacgcauga

SEQ ID NO: 4153124 - RNA, 13 nt, Yersinia pestis
cuaauuaauuuaa

SEQ ID NO: 4153125 - RNA, 20 nt, Yersinia pestis
cuaauuaauuuaaacaacca

SEQ ID NO: 4153126 - RNA, 20 nt, Yersinia pestis
cuaauuagugacaguagaau

SEQ ID NO: 4153127 - RNA, 16 nt, Yersinia pestis
cuaauucaccaauugc

SEQ ID NO: 4153128 - RNA, 18 nt, Yersinia pestis
cuaauucaggcaaauucu

SEQ ID NO: 4153129 - RNA, 20 nt, Yersinia pestis
cuaauucaggcaaauucuca

SEQ ID NO: 4153130 - RNA, 16 nt, Yersinia pestis
cuaauuccucaucgaa

SEQ ID NO: 4153131 - RNA, 12 nt, Yersinia pestis
cuaauucuccuu

SEQ ID NO: 4153132 - RNA, 19 nt, Yersinia pestis
cuaauucuccuuucuuuuc

SEQ ID NO: 4153133 - RNA, 20 nt, Yersinia pestis
cuaauucuccuuucuuuucg

SEQ ID NO: 4153134 - RNA, 21 nt, Yersinia pestis
cuaauucuggguacaacacaa

SEQ ID NO: 4153135 - RNA, 15 nt, Yersinia pestis
cuaauucuuaggaua

SEQ ID NO: 4153136 - RNA, 13 nt, Yersinia pestis
cuaauugauauua

SEQ ID NO: 4153137 - RNA, 20 nt, Yersinia pestis
cuaauuucaucucaauaacu

SEQ ID NO: 4153138 - RNA, 22 nt, Yersinia pestis
cuaauuucaucucaauaacuau

SEQ ID NO: 4153139 - RNA, 14 nt, Yersinia pestis
cuaauuuucccugu

SEQ ID NO: 4153140 - RNA, 16 nt, Yersinia pestis
cuacaaccuaccaccu

SEQ ID NO: 4153141 - RNA, 16 nt, Yersinia pestis
cuacaagcaugugaug

SEQ ID NO: 4153142 - RNA, 13 nt, Yersinia pestis
cuacaauaucuuc

SEQ ID NO: 4153143 - RNA, 15 nt, Yersinia pestis
cuacaauaucuuccc

SEQ ID NO: 4153144 - RNA, 14 nt, Yersinia pestis
cuacaaucaucggc

SEQ ID NO: 4153145 - RNA, 13 nt, Yersinia pestis
cuacacacagcaa

SEQ ID NO: 4153146 - RNA, 22 nt, Yersinia pestis
cuacagaaaaauaacauccaug

SEQ ID NO: 4153147 - RNA, 21 nt, Yersinia pestis
cuacaggcgcaacugccaugg

SEQ ID NO: 4153148 - RNA, 20 nt, Yersinia pestis
cuacaucauaacgaaugagc

SEQ ID NO: 4153149 - RNA, 23 nt, Yersinia pestis
cuacaucgguuagcguuuuagca

SEQ ID NO: 4153150 - RNA, 19 nt, Yersinia pestis
cuaccaaccgcuuuaucgc

SEQ ID NO: 4153151 - RNA, 11 nt, Yersinia pestis
cuaccaccuac

SEQ ID NO: 4153152 - RNA, 16 nt, Yersinia pestis
cuaccaccuacaaccu

SEQ ID NO: 4153153 - RNA, 17 nt, Yersinia pestis
cuaccaccuacaaccua

SEQ ID NO: 4153154 - RNA, 21 nt, Yersinia pestis
cuaccaccuacaaccuaccac

SEQ ID NO: 4153155 - RNA, 13 nt, Yersinia pestis
cuaccaccuacca

SEQ ID NO: 4153156 - RNA, 16 nt, Yersinia pestis
cuaccaccuaccaccu

SEQ ID NO: 4153157 - RNA, 13 nt, Yersinia pestis
cuaccaggaagcg

SEQ ID NO: 4153158 - RNA, 15 nt, Yersinia pestis
cuaccggaaccaacg

SEQ ID NO: 4153159 - RNA, 23 nt, Yersinia pestis
cuaccggauaacguuucagggug

SEQ ID NO: 4153160 - RNA, 20 nt, Yersinia pestis
cuaccggcauuggcugguaa

SEQ ID NO: 4153161 - RNA, 22 nt, Yersinia pestis
cuaccggccauugauaccuuca

SEQ ID NO: 4153162 - RNA, 12 nt, Yersinia pestis
cuaccugaaugc

SEQ ID NO: 4153163 - RNA, 21 nt, Yersinia pestis
cuaccugaaugcgccgcggcc

SEQ ID NO: 4153164 - RNA, 17 nt, Yersinia pestis
cuaccugccugcugcug

SEQ ID NO: 4153165 - RNA, 17 nt, Yersinia pestis
cuaccuuuugcauauuu

SEQ ID NO: 4153166 - RNA, 23 nt, Yersinia pestis
cuacgccgucaucaucuucuuca

SEQ ID NO: 4153167 - RNA, 22 nt, Yersinia pestis
cuacgcuuucaggagugaauuu

SEQ ID NO: 4153168 - RNA, 13 nt, Yersinia pestis
cuacggauugcaa

SEQ ID NO: 4153169 - RNA, 17 nt, Yersinia pestis
cuacggcugaucugccc

SEQ ID NO: 4153170 - RNA, 18 nt, Yersinia pestis
cuacggcugaucugcccc

SEQ ID NO: 4153171 - RNA, 17 nt, Yersinia pestis
cuacguacuaucuauua

SEQ ID NO: 4153172 - RNA, 20 nt, Yersinia pestis
cuacguacuaucuauuauug

SEQ ID NO: 4153173 - RNA, 18 nt, Yersinia pestis
cuauuuuuauuucuccuu

SEQ ID NO: 4153174 - RNA, 19 nt, Yersinia pestis
cuauuuuuauuucuccuua

SEQ ID NO: 4153175 - RNA, 19 nt, Yersinia pestis
cuauuuuugacuuuaauua

SEQ ID NO: 4153176 - RNA, 23 nt, Yersinia pestis
cucaaaacaauuucgaaaacuca

SEQ ID NO: 4153177 - RNA, 15 nt, Yersinia pestis
cucaaaauuaucuaa

SEQ ID NO: 4153178 - RNA, 20 nt, Yersinia pestis
cucaaacaugagcgcaugcc

SEQ ID NO: 4153179 - RNA, 17 nt, Yersinia pestis
cucaaacugauaaagca

SEQ ID NO: 4153180 - RNA, 19 nt, Yersinia pestis
cucaaacugauaaagcaaa

SEQ ID NO: 4153181 - RNA, 22 nt, Yersinia pestis
cucaaagaccacaucaaccuga

SEQ ID NO: 4153182 - RNA, 22 nt, Yersinia pestis
cucaaauagauagcaaucaaua

SEQ ID NO: 4153183 - RNA, 19 nt, Yersinia pestis
cucaaauagcaagugugca

SEQ ID NO: 4153184 - RNA, 20 nt, Yersinia pestis
cucaacauauugcucugccg

SEQ ID NO: 4153185 - RNA, 14 nt, Yersinia pestis
cucaacauucuuua

SEQ ID NO: 4153186 - RNA, 20 nt, Yersinia pestis
cucaacauucuuuagcggcg

SEQ ID NO: 4153187 - RNA, 11 nt, Yersinia pestis
cucaacggcac

SEQ ID NO: 4153188 - RNA, 18 nt, Yersinia pestis
cucaacugcucaacugcu

SEQ ID NO: 4153189 - RNA, 21 nt, Yersinia pestis
cucaacugcucaacugcucaa

SEQ ID NO: 4153190 - RNA, 22 nt, Yersinia pestis
cucaagaaauuuaaaaacccuc

SEQ ID NO: 4153191 - RNA, 20 nt, Yersinia pestis
cucaagcguacaucagggug

SEQ ID NO: 4153192 - RNA, 16 nt, Yersinia pestis
cucaagggcacaguuu

SEQ ID NO: 4153193 - RNA, 21 nt, Yersinia pestis
cucaaggucuuucgcccacaa

SEQ ID NO: 4153194 - RNA, 19 nt, Yersinia pestis
cucaauaaauccaucaaua

SEQ ID NO: 4153195 - RNA, 19 nt, Yersinia pestis
cucaauaaauucauuagcu

SEQ ID NO: 4153196 - RNA, 14 nt, Yersinia pestis
cucaauacgguaau

SEQ ID NO: 4153197 - RNA, 17 nt, Yersinia pestis
cucaauagcuaauaauu

SEQ ID NO: 4153198 - RNA, 12 nt, Yersinia pestis
cucaauauuaau

SEQ ID NO: 4153199 - RNA, 14 nt, Yersinia pestis
cucaauauuaauaa

SEQ ID NO: 4153200 - RNA, 16 nt, Yersinia pestis
cucaauauuaauaaug

SEQ ID NO: 4153201 - RNA, 17 nt, Yersinia pestis
cucaauauuaauaaugc

SEQ ID NO: 4153202 - RNA, 20 nt, Yersinia pestis
cucaaucaccgaaucaccga

SEQ ID NO: 4153203 - RNA, 16 nt, Yersinia pestis
cucaaucgaaugcaau

SEQ ID NO: 4153204 - RNA, 18 nt, Yersinia pestis
cucaaugcaguaaagauu

SEQ ID NO: 4153205 - RNA, 16 nt, Yersinia pestis
cucaaugcgaaaaaau

SEQ ID NO: 4153206 - RNA, 19 nt, Yersinia pestis
cucaaugcgaaaaaauaua

SEQ ID NO: 4153207 - RNA, 24 nt, Yersinia pestis
cucaaugcgaaaaaauauauuccu

SEQ ID NO: 4153208 - RNA, 17 nt, Yersinia pestis
cucaaugcguuggcuca

SEQ ID NO: 4153209 - RNA, 18 nt, Yersinia pestis
cucaaugucaugcaauua

SEQ ID NO: 4153210 - RNA, 16 nt, Yersinia pestis
cucaauugucuuugga

SEQ ID NO: 4153211 - RNA, 17 nt, Yersinia pestis
cucacaaaauaacuggg

SEQ ID NO: 4153212 - RNA, 18 nt, Yersinia pestis
cucacaacccgcugaugc

SEQ ID NO: 4153213 - RNA, 22 nt, Yersinia pestis
cucacaacuuuuauuggcauua

SEQ ID NO: 4153214 - RNA, 18 nt, Yersinia pestis
cucacaagccacgccauu

SEQ ID NO: 4153215 - RNA, 17 nt, Yersinia pestis
cucacacacuaauaaua

SEQ ID NO: 4153216 - RNA, 14 nt, Yersinia pestis
cucacagcggcgga

SEQ ID NO: 4153217 - RNA, 15 nt, Yersinia pestis
cucacauaagaaagu

SEQ ID NO: 4153218 - RNA, 13 nt, Yersinia pestis
cucaccacgccca

SEQ ID NO: 4153219 - RNA, 20 nt, Yersinia pestis
cucacccaauaagauaaaca

SEQ ID NO: 4153220 - RNA, 17 nt, Yersinia pestis
cucaccccacuuuccac

SEQ ID NO: 4153221 - RNA, 19 nt, Yersinia pestis
cucaccccuauuagggaac

SEQ ID NO: 4153222 - RNA, 21 nt, Yersinia pestis
cucacccugcgugguauaccc

SEQ ID NO: 4153223 - RNA, 20 nt, Yersinia pestis
cucaccgagcauauuuuuua

SEQ ID NO: 4153224 - RNA, 12 nt, Yersinia pestis
cucaccgccuag

SEQ ID NO: 4153225 - RNA, 15 nt, Yersinia pestis
cucaccgucaaccca

SEQ ID NO: 4153226 - RNA, 21 nt, Yersinia pestis
cucaccucugcgaagccgcug

SEQ ID NO: 4153227 - RNA, 22 nt, Yersinia pestis
cucacgaauaguaucuggggua

SEQ ID NO: 4153228 - RNA, 20 nt, Yersinia pestis
cucacgguagugacucauca

SEQ ID NO: 4153229 - RNA, 19 nt, Yersinia pestis
cucacguuuagcccacugu

SEQ ID NO: 4153230 - RNA, 17 nt, Yersinia pestis
cucacuaaaccaggugu

SEQ ID NO: 4153231 - RNA, 14 nt, Yersinia pestis
cucacuccauucgu

SEQ ID NO: 4153232 - RNA, 17 nt, Yersinia pestis
cucacugucgggguaga

SEQ ID NO: 4153233 - RNA, 19 nt, Yersinia pestis
cucacuuuuauauccgcca

SEQ ID NO: 4153234 - RNA, 21 nt, Yersinia pestis
cucacuuuuugucaauaaaau

SEQ ID NO: 4153235 - RNA, 18 nt, Yersinia pestis
cucagacuucuuccaucu

SEQ ID NO: 4153236 - RNA, 19 nt, Yersinia pestis
cucagacuucuuccaucuu

SEQ ID NO: 4153237 - RNA, 21 nt, Yersinia pestis
cucagagacaucuuuaccagc

SEQ ID NO: 4153238 - RNA, 16 nt, Yersinia pestis
cucagaggccuguugg

SEQ ID NO: 4153239 - RNA, 18 nt, Yersinia pestis
cucagauaaauucaacuu

SEQ ID NO: 4153240 - RNA, 16 nt, Yersinia pestis
cucagaucccccugcu

SEQ ID NO: 4153241 - RNA, 19 nt, Yersinia pestis
cucagaugaaaaacugugc

SEQ ID NO: 4153242 - RNA, 17 nt, Yersinia pestis
cucagcacaaacauggc

SEQ ID NO: 4153243 - RNA, 15 nt, Yersinia pestis
cucagcaucaccgcc

SEQ ID NO: 4153244 - RNA, 13 nt, Yersinia pestis
cucagcaucuuca

SEQ ID NO: 4153245 - RNA, 15 nt, Yersinia pestis
cucagcaucuucaau

SEQ ID NO: 4153246 - RNA, 13 nt, Yersinia pestis
cucagccaucucu

SEQ ID NO: 4153247 - RNA, 14 nt, Yersinia pestis
cucagccucauuca

SEQ ID NO: 4153248 - RNA, 16 nt, Yersinia pestis
cucagccucauucaug

SEQ ID NO: 4153249 - RNA, 19 nt, Yersinia pestis
cucagcgccauauccaacu

SEQ ID NO: 4153250 - RNA, 23 nt, Yersinia pestis
cucagcgcuggcgagguaccgcu

SEQ ID NO: 4153251 - RNA, 16 nt, Yersinia pestis
cucagcuucaggccaa

SEQ ID NO: 4153252 - RNA, 23 nt, Yersinia pestis
cucagcuugguaaugcgcaccag

SEQ ID NO: 4153253 - RNA, 20 nt, Yersinia pestis
cucaggaucgcgcuauauug

SEQ ID NO: 4153254 - RNA, 21 nt, Yersinia pestis
cucaggauuagcuucugcuau

SEQ ID NO: 4153255 - RNA, 13 nt, Yersinia pestis
cucaggcccgcua

SEQ ID NO: 4153256 - RNA, 15 nt, Yersinia pestis
cucaggcucaucacc

SEQ ID NO: 4153257 - RNA, 13 nt, Yersinia pestis
cucagggccacuu

SEQ ID NO: 4153258 - RNA, 16 nt, Yersinia pestis
cucaggggagccgaag

SEQ ID NO: 4153259 - RNA, 15 nt, Yersinia pestis
cucaggggauaagcu

SEQ ID NO: 4153260 - RNA, 22 nt, Yersinia pestis
cucaguaaaagcggguuaccag

SEQ ID NO: 4153261 - RNA, 23 nt, Yersinia pestis
cucaguaaauauaauuucaaagu

SEQ ID NO: 4153262 - RNA, 16 nt, Yersinia pestis
cucaguagcaggcgca

SEQ ID NO: 4153263 - RNA, 17 nt, Yersinia pestis
cucagucaucgcuaacc

SEQ ID NO: 4153264 - RNA, 21 nt, Yersinia pestis
cucagugacugggggugagca

SEQ ID NO: 4153265 - RNA, 16 nt, Yersinia pestis
cucagugaggaucacc

SEQ ID NO: 4153266 - RNA, 16 nt, Yersinia pestis
cucaguguggaauaca

SEQ ID NO: 4153267 - RNA, 17 nt, Yersinia pestis
cucaguuaucagggccu

SEQ ID NO: 4153268 - RNA, 13 nt, Yersinia pestis
cucaguugaaacc

SEQ ID NO: 4153269 - RNA, 15 nt, Yersinia pestis
cucaguugaugcaaa

SEQ ID NO: 4153270 - RNA, 14 nt, Yersinia pestis
cucaguugauggcu

SEQ ID NO: 4153271 - RNA, 18 nt, Yersinia pestis
cucaguuggguaucuuug

SEQ ID NO: 4153272 - RNA, 13 nt, Yersinia pestis
cucauaauuuuga

SEQ ID NO: 4153273 - RNA, 17 nt, Yersinia pestis
cucauaugcagcaucca

SEQ ID NO: 4153274 - RNA, 22 nt, Yersinia pestis
cucauauuguccaaaggaaggg

SEQ ID NO: 4153275 - RNA, 14 nt, Yersinia pestis
cucaucaaaacaau

SEQ ID NO: 4153276 - RNA, 14 nt, Yersinia pestis
cucaucaaccucag

SEQ ID NO: 4153277 - RNA, 19 nt, Yersinia pestis
cucaucaaccucagccuca

SEQ ID NO: 4153278 - RNA, 11 nt, Yersinia pestis
cucaucacccg

SEQ ID NO: 4153279 - RNA, 13 nt, Yersinia pestis
cucaucaccuucc

SEQ ID NO: 4153280 - RNA, 15 nt, Yersinia pestis
cucaucaccuuccaa

SEQ ID NO: 4153281 - RNA, 13 nt, Yersinia pestis
cucaucagcgccc

SEQ ID NO: 4153282 - RNA, 19 nt, Yersinia pestis
cucauccaacguaaacauu

SEQ ID NO: 4153283 - RNA, 17 nt, Yersinia pestis
cucauccagcaacucaa

SEQ ID NO: 4153284 - RNA, 19 nt, Yersinia pestis
cucauccauaaguauuuau

SEQ ID NO: 4153285 - RNA, 20 nt, Yersinia pestis
cucauccauaaguauuuauu

SEQ ID NO: 4153286 - RNA, 22 nt, Yersinia pestis
cucaucccaaaauagccagccc

SEQ ID NO: 4153287 - RNA, 16 nt, Yersinia pestis
cucauccgccaagauu

SEQ ID NO: 4153288 - RNA, 15 nt, Yersinia pestis
cucauccguaaaaaa

SEQ ID NO: 4153289 - RNA, 12 nt, Yersinia pestis
cucaucgccaaa

SEQ ID NO: 4153290 - RNA, 19 nt, Yersinia pestis
cucaucgggauuaaugagc

SEQ ID NO: 4153291 - RNA, 22 nt, Yersinia pestis
cucaucgguaacuuacaggcug

SEQ ID NO: 4153292 - RNA, 14 nt, Yersinia pestis
cucaucugaacuau

SEQ ID NO: 4153293 - RNA, 16 nt, Yersinia pestis
cucaugaaugaggcug

SEQ ID NO: 4153294 - RNA, 17 nt, Yersinia pestis
cucaugaaugaggcuga

SEQ ID NO: 4153295 - RNA, 18 nt, Yersinia pestis
cucugaacccugcgauuu

SEQ ID NO: 4153296 - RNA, 17 nt, Yersinia pestis
cucugaagccuucaugu

SEQ ID NO: 4153297 - RNA, 15 nt, Yersinia pestis
cucugagccauccag

SEQ ID NO: 4153298 - RNA, 16 nt, Yersinia pestis
cucugaggauguaguc

SEQ ID NO: 4153299 - RNA, 21 nt, Yersinia pestis
cucugcaaucaugauggucgu

SEQ ID NO: 4153300 - RNA, 14 nt, Yersinia pestis
cucugcagcuugca

SEQ ID NO: 4153301 - RNA, 22 nt, Yersinia pestis
cucugccuauccucaccguuca

SEQ ID NO: 4153302 - RNA, 18 nt, Yersinia pestis
cucugcguacaacacauc

SEQ ID NO: 4153303 - RNA, 19 nt, Yersinia pestis
cucugcuaauacgcuauca

SEQ ID NO: 4153304 - RNA, 15 nt, Yersinia pestis
cucugcugggacaga

SEQ ID NO: 4153305 - RNA, 17 nt, Yersinia pestis
cucugcuuacucuucca

SEQ ID NO: 4153306 - RNA, 19 nt, Yersinia pestis
cucuggauggguaaugcau

SEQ ID NO: 4153307 - RNA, 16 nt, Yersinia pestis
cucuggcacuggcaau

SEQ ID NO: 4153308 - RNA, 20 nt, Yersinia pestis
cucuggccagcgucuucagu

SEQ ID NO: 4153309 - RNA, 22 nt, Yersinia pestis
cucuguauuuucaaucgcuuuc

SEQ ID NO: 4153310 - RNA, 18 nt, Yersinia pestis
cucugucaacgcuucagu

SEQ ID NO: 4153311 - RNA, 19 nt, Yersinia pestis
cucugucaacgcuucagua

SEQ ID NO: 4153312 - RNA, 23 nt, Yersinia pestis
cucugucagcccuaauauccuca

SEQ ID NO: 4153313 - RNA, 16 nt, Yersinia pestis
cucuguuuuaaaaaaa

SEQ ID NO: 4153314 - RNA, 23 nt, Yersinia pestis
cucuuaaagaaaauuuacccugc

SEQ ID NO: 4153315 - RNA, 18 nt, Yersinia pestis
cucuuacauaaagaccca

SEQ ID NO: 4153316 - RNA, 13 nt, Yersinia pestis
cucuuacucauuc

SEQ ID NO: 4153317 - RNA, 15 nt, Yersinia pestis
cucuuaguuucuacg

SEQ ID NO: 4153318 - RNA, 20 nt, Yersinia pestis
cucuucaauaccaacgguag

SEQ ID NO: 4153319 - RNA, 14 nt, Yersinia pestis
cucuucaauuucca

SEQ ID NO: 4153320 - RNA, 15 nt, Yersinia pestis
cucuucaauuuccau

SEQ ID NO: 4153321 - RNA, 17 nt, Yersinia pestis
cucuucaauuuccaucu

SEQ ID NO: 4153322 - RNA, 23 nt, Yersinia pestis
cucuucaccaaaggaagccgagc

SEQ ID NO: 4153323 - RNA, 18 nt, Yersinia pestis
cucuucagcaauuuuuag

SEQ ID NO: 4153324 - RNA, 17 nt, Yersinia pestis
cucuucagccuauccuc

SEQ ID NO: 4153325 - RNA, 18 nt, Yersinia pestis
cucuucagccuauccuca

SEQ ID NO: 4153326 - RNA, 21 nt, Yersinia pestis
cucuucaucuacagacuccaa

SEQ ID NO: 4153327 - RNA, 22 nt, Yersinia pestis
cucuuccgacaggcuaacaacu

SEQ ID NO: 4153328 - RNA, 11 nt, Yersinia pestis
cucuuccugua

SEQ ID NO: 4153329 - RNA, 13 nt, Yersinia pestis
cucuuccuguuca

SEQ ID NO: 4153330 - RNA, 20 nt, Yersinia pestis
cucuucuaaaaucgcacuga

SEQ ID NO: 4153331 - RNA, 18 nt, Yersinia pestis
cucuucugccuauccuca

SEQ ID NO: 4153332 - RNA, 23 nt, Yersinia pestis
cucuucuucgauuuuagcuuuga

SEQ ID NO: 4153333 - RNA, 11 nt, Yersinia pestis
cucuucuuuua

SEQ ID NO: 4153334 - RNA, 15 nt, Yersinia pestis
cucuugaacggugag

SEQ ID NO: 4153335 - RNA, 13 nt, Yersinia pestis
cucuugagaaaug

SEQ ID NO: 4153336 - RNA, 16 nt, Yersinia pestis
cucuugagaaaugaau

SEQ ID NO: 4153337 - RNA, 22 nt, Yersinia pestis
cucuugagaaaugaauauuagg

SEQ ID NO: 4153338 - RNA, 19 nt, Yersinia pestis
cucuugcacuuuuacuggu

SEQ ID NO: 4153339 - RNA, 17 nt, Yersinia pestis
cucuugcgcuccacgcc

SEQ ID NO: 4153340 - RNA, 16 nt, Yersinia pestis
cucuugcucuucgggu

SEQ ID NO: 4153341 - RNA, 14 nt, Yersinia pestis
cucuugggcgcagu

SEQ ID NO: 4153342 - RNA, 20 nt, Yersinia pestis
cucuugggcgcagucaucau

SEQ ID NO: 4153343 - RNA, 18 nt, Yersinia pestis
cucuuguguaauuauauu

SEQ ID NO: 4153344 - RNA, 22 nt, Yersinia pestis
cucuuguguaauuauauuuaau

SEQ ID NO: 4153345 - RNA, 18 nt, Yersinia pestis
cucuuguuaucaccuguc

SEQ ID NO: 4153346 - RNA, 19 nt, Yersinia pestis
cucuuuagccgcuacgugu

SEQ ID NO: 4153347 - RNA, 21 nt, Yersinia pestis
cucuuuauaaccgucaccaaa

SEQ ID NO: 4153348 - RNA, 12 nt, Yersinia pestis
cucuuucaacuu

SEQ ID NO: 4153349 - RNA, 17 nt, Yersinia pestis
cucuuucagcucuucaa

SEQ ID NO: 4153350 - RNA, 18 nt, Yersinia pestis
cucuuucagcucuucaau

SEQ ID NO: 4153351 - RNA, 20 nt, Yersinia pestis
cucuuucagcucuucaauuu

SEQ ID NO: 4153352 - RNA, 21 nt, Yersinia pestis
cucuuuccaacaguagcuuga

SEQ ID NO: 4153353 - RNA, 18 nt, Yersinia pestis
cucuuuccccauuuuuuu

SEQ ID NO: 4153354 - RNA, 12 nt, Yersinia pestis
cucuuucccuuc

SEQ ID NO: 4153355 - RNA, 19 nt, Yersinia pestis
cucuuuuauucucuuuuuu

SEQ ID NO: 4153356 - RNA, 16 nt, Yersinia pestis
cucuuuuuccacaccc

SEQ ID NO: 4153357 - RNA, 18 nt, Yersinia pestis
cugaaaccuacgccuaaa

SEQ ID NO: 4153358 - RNA, 17 nt, Yersinia pestis
cugaaacuucaaaauca

SEQ ID NO: 4153359 - RNA, 18 nt, Yersinia pestis
cugaaacuucaaaaucaa

SEQ ID NO: 4153360 - RNA, 13 nt, Yersinia pestis
cugaaacuuuuca

SEQ ID NO: 4153361 - RNA, 16 nt, Yersinia pestis
cugaaagugcccccug

SEQ ID NO: 4153362 - RNA, 20 nt, Yersinia pestis
cugaaaguguauuucucaaa

SEQ ID NO: 4153363 - RNA, 19 nt, Yersinia pestis
cugaaauaaacaagccauu

SEQ ID NO: 4153364 - RNA, 22 nt, Yersinia pestis
cugaaauacggaacgcagaacu

SEQ ID NO: 4153365 - RNA, 12 nt, Yersinia pestis
cugaaauccaaa

SEQ ID NO: 4153366 - RNA, 12 nt, Yersinia pestis
cugaaauuuuuu

SEQ ID NO: 4153367 - RNA, 23 nt, Yersinia pestis
cugaaauuuuuuaauuugcuccu

SEQ ID NO: 4153368 - RNA, 15 nt, Yersinia pestis
cugaacaaugccaua

SEQ ID NO: 4153369 - RNA, 20 nt, Yersinia pestis
cugaacaucgcggaugcgcg

SEQ ID NO: 4153370 - RNA, 14 nt, Yersinia pestis
cugaaccauuuuuu

SEQ ID NO: 4153371 - RNA, 18 nt, Yersinia pestis
cugaacccugacggccag

SEQ ID NO: 4153372 - RNA, 19 nt, Yersinia pestis
cugaacccugacggccagc

SEQ ID NO: 4153373 - RNA, 19 nt, Yersinia pestis
cugaaccuuggcauugucu

SEQ ID NO: 4153374 - RNA, 15 nt, Yersinia pestis
cugaacgaccagaau

SEQ ID NO: 4153375 - RNA, 18 nt, Yersinia pestis
cugaacgaggacuuccug

SEQ ID NO: 4153376 - RNA, 20 nt, Yersinia pestis
cugaacgaggacuuccugcc

SEQ ID NO: 4153377 - RNA, 16 nt, Yersinia pestis
cugaacgccucaaaaa

SEQ ID NO: 4153378 - RNA, 14 nt, Yersinia pestis
cugaacggauaccc

SEQ ID NO: 4153379 - RNA, 23 nt, Yersinia pestis
cugaacguaaaacaaucaccacc

SEQ ID NO: 4153380 - RNA, 19 nt, Yersinia pestis
cugaacuucugggaucauc

SEQ ID NO: 4153381 - RNA, 22 nt, Yersinia pestis
cugaacuucugggaucaucgcu

SEQ ID NO: 4153382 - RNA, 18 nt, Yersinia pestis
cugaacuuuaacuuccaa

SEQ ID NO: 4153383 - RNA, 23 nt, Yersinia pestis
cugaacuuuaccggugcacaggu

SEQ ID NO: 4153384 - RNA, 15 nt, Yersinia pestis
cugaacuuuacuuua

SEQ ID NO: 4153385 - RNA, 14 nt, Yersinia pestis
cugaagacccaagg

SEQ ID NO: 4153386 - RNA, 15 nt, Yersinia pestis
cugaagaugccaauc

SEQ ID NO: 4153387 - RNA, 20 nt, Yersinia pestis
cugaagaugccaaucaaaaa

SEQ ID NO: 4153388 - RNA, 21 nt, Yersinia pestis
cugaagaugccaaucaaaaaa

SEQ ID NO: 4153389 - RNA, 16 nt, Yersinia pestis
cugaagccagcaccgg

SEQ ID NO: 4153390 - RNA, 16 nt, Yersinia pestis
cugaaggcugauuaau

SEQ ID NO: 4153391 - RNA, 21 nt, Yersinia pestis
cugaaggguauugaagauacc

SEQ ID NO: 4153392 - RNA, 20 nt, Yersinia pestis
cugaaguuuaccgcaugaau

SEQ ID NO: 4153393 - RNA, 16 nt, Yersinia pestis
cugaauaaacggcaag

SEQ ID NO: 4153394 - RNA, 21 nt, Yersinia pestis
cugaauaaacggcaagcggug

SEQ ID NO: 4153395 - RNA, 23 nt, Yersinia pestis
cugaauaagagagacgggauaau

SEQ ID NO: 4153396 - RNA, 15 nt, Yersinia pestis
cugaauaauacuguc

SEQ ID NO: 4153397 - RNA, 11 nt, Yersinia pestis
cugaauaccau

SEQ ID NO: 4153398 - RNA, 18 nt, Yersinia pestis
cugaauaccggccugauu

SEQ ID NO: 4153399 - RNA, 21 nt, Yersinia pestis
cugaauaccguuuaggaugaa

SEQ ID NO: 4153400 - RNA, 20 nt, Yersinia pestis
cugaauaggggaauuuuuag

SEQ ID NO: 4153401 - RNA, 21 nt, Yersinia pestis
cugaauaggggaauuuuuagc

SEQ ID NO: 4153402 - RNA, 16 nt, Yersinia pestis
cugaauauaaauuuaa

SEQ ID NO: 4153403 - RNA, 19 nt, Yersinia pestis
cugaauaucaucuuuuucu

SEQ ID NO: 4153404 - RNA, 17 nt, Yersinia pestis
cugaaucgccgaaaucu

SEQ ID NO: 4153405 - RNA, 19 nt, Yersinia pestis
cugaaucgccgaaaucuca

SEQ ID NO: 4153406 - RNA, 17 nt, Yersinia pestis
cugaaucguacuucuua

SEQ ID NO: 4153407 - RNA, 15 nt, Yersinia pestis
cugaaugccauucaa

SEQ ID NO: 4153408 - RNA, 20 nt, Yersinia pestis
cugaauggcaacgcgcagug

SEQ ID NO: 4153409 - RNA, 15 nt, Yersinia pestis
cugaaugugaagagc

SEQ ID NO: 4153410 - RNA, 18 nt, Yersinia pestis
cugaauugaugcacagua

SEQ ID NO: 4153411 - RNA, 18 nt, Yersinia pestis
cugaauugauuuauuccu

SEQ ID NO: 4153412 - RNA, 21 nt, Yersinia pestis
cugaauugcuuauccagccgc

SEQ ID NO: 4153413 - RNA, 15 nt, Yersinia pestis
cugaauuggaagagc

SEQ ID NO: 4153414 - RNA, 19 nt, Yersinia pestis
cugaauuggaagagccuga

SEQ ID NO: 4153415 - RNA, 14 nt, Yersinia pestis
cugaauuucaauaa

SEQ ID NO: 4153416 - RNA, 16 nt, Yersinia pestis
cugcuuaccuuguuug

SEQ ID NO: 4153417 - RNA, 23 nt, Yersinia pestis
cugcuuaccuuguuuguuacugc

SEQ ID NO: 4153418 - RNA, 20 nt, Yersinia pestis
cugcuuauacgcuuccugcg

SEQ ID NO: 4153419 - RNA, 18 nt, Yersinia pestis
cugcuucuacccuggcgg

SEQ ID NO: 4153420 - RNA, 21 nt, Yersinia pestis
cugcuucugaaccaccguaaa

SEQ ID NO: 4153421 - RNA, 12 nt, Yersinia pestis
cugcuugaaagc

SEQ ID NO: 4153422 - RNA, 20 nt, Yersinia pestis
cugcuugaaagcaccgcccc

SEQ ID NO: 4153423 - RNA, 15 nt, Yersinia pestis
cugcuugauuugcug

SEQ ID NO: 4153424 - RNA, 19 nt, Yersinia pestis
cugcuugcgcgccuguuua

SEQ ID NO: 4153425 - RNA, 17 nt, Yersinia pestis
cugcuuuguuuuugugg

SEQ ID NO: 4153426 - RNA, 15 nt, Yersinia pestis
cugcuuuuaccgcag

SEQ ID NO: 4153427 - RNA, 16 nt, Yersinia pestis
cugcuuuucuaccuga

SEQ ID NO: 4153428 - RNA, 22 nt, Yersinia pestis
cugcuuuuuauugucucuacuc

SEQ ID NO: 4153429 - RNA, 16 nt, Yersinia pestis
cugcuuuuugcuuuuu

SEQ ID NO: 4153430 - RNA, 12 nt, Yersinia pestis
cuggaaaaccaa

SEQ ID NO: 4153431 - RNA, 17 nt, Yersinia pestis
cuggaaacaaaaccuaa

SEQ ID NO: 4153432 - RNA, 21 nt, Yersinia pestis
cuggaaaggaauaucugugau

SEQ ID NO: 4153433 - RNA, 17 nt, Yersinia pestis
cuggaacaagagaucuc

SEQ ID NO: 4153434 - RNA, 20 nt, Yersinia pestis
cuggaacguugcacccugcu

SEQ ID NO: 4153435 - RNA, 17 nt, Yersinia pestis
cuggaauccaaguucaa

SEQ ID NO: 4153436 - RNA, 14 nt, Yersinia pestis
cuggacgcaucaga

SEQ ID NO: 4153437 - RNA, 16 nt, Yersinia pestis
cuggacgcaucagauc

SEQ ID NO: 4153438 - RNA, 23 nt, Yersinia pestis
cuggacgcuggcagccuuuaucc

SEQ ID NO: 4153439 - RNA, 16 nt, Yersinia pestis
cuggacguuugcugcu

SEQ ID NO: 4153440 - RNA, 20 nt, Yersinia pestis
cuggagcaagauuuuguagc

SEQ ID NO: 4153441 - RNA, 21 nt, Yersinia pestis
cuggauaagugaauaacgcug

SEQ ID NO: 4153442 - RNA, 15 nt, Yersinia pestis
cuggauauauuuaca

SEQ ID NO: 4153443 - RNA, 17 nt, Yersinia pestis
cuggauauauuuacaaa

SEQ ID NO: 4153444 - RNA, 19 nt, Yersinia pestis
cuggauauucauauuucuu

SEQ ID NO: 4153445 - RNA, 18 nt, Yersinia pestis
cuggcaaaacucagguga

SEQ ID NO: 4153446 - RNA, 16 nt, Yersinia pestis
cuggcaaacgcugggc

SEQ ID NO: 4153447 - RNA, 17 nt, Yersinia pestis
cuggcaauccagcgccu

SEQ ID NO: 4153448 - RNA, 16 nt, Yersinia pestis
cuggcacccgaagagu

SEQ ID NO: 4153449 - RNA, 15 nt, Yersinia pestis
cuggcaccggacaaa

SEQ ID NO: 4153450 - RNA, 18 nt, Yersinia pestis
cuggcacugccaucaauc

SEQ ID NO: 4153451 - RNA, 12 nt, Yersinia pestis
cuggcacuggca

SEQ ID NO: 4153452 - RNA, 15 nt, Yersinia pestis
cuggcacuggcaaua

SEQ ID NO: 4153453 - RNA, 11 nt, Yersinia pestis
cuggcagccgg

SEQ ID NO: 4153454 - RNA, 19 nt, Yersinia pestis
cuggcaugcauuggaaaaa

SEQ ID NO: 4153455 - RNA, 23 nt, Yersinia pestis
cuggccaaagccgguaucaacuc

SEQ ID NO: 4153456 - RNA, 22 nt, Yersinia pestis
cuggcccaguagagcacuucau

SEQ ID NO: 4153457 - RNA, 17 nt, Yersinia pestis
cuggcccccaaugacac

SEQ ID NO: 4153458 - RNA, 23 nt, Yersinia pestis
cuggcgauccagugaaaucauca

SEQ ID NO: 4153459 - RNA, 14 nt, Yersinia pestis
cuggcgcaggguca

SEQ ID NO: 4153460 - RNA, 14 nt, Yersinia pestis
cuggcgcgcuuugg

SEQ ID NO: 4153461 - RNA, 21 nt, Yersinia pestis
cuggcgcugaucaucaucaau

SEQ ID NO: 4153462 - RNA, 14 nt, Yersinia pestis
cuggcggaagcacg

SEQ ID NO: 4153463 - RNA, 15 nt, Yersinia pestis
cuggcgguaauaaau

SEQ ID NO: 4153464 - RNA, 13 nt, Yersinia pestis
cuggcguaauauu

SEQ ID NO: 4153465 - RNA, 19 nt, Yersinia pestis
cuggcguagguaguggcug

SEQ ID NO: 4153466 - RNA, 22 nt, Yersinia pestis
cuggcguagguaguggcugaua

SEQ ID NO: 4153467 - RNA, 20 nt, Yersinia pestis
cuggcguuauucuuuauuua

SEQ ID NO: 4153468 - RNA, 15 nt, Yersinia pestis
cuggcucugcgacca

SEQ ID NO: 4153469 - RNA, 19 nt, Yersinia pestis
cuggcugaaauaguuaucc

SEQ ID NO: 4153470 - RNA, 18 nt, Yersinia pestis
cuggcugauucacuggca

SEQ ID NO: 4153471 - RNA, 21 nt, Yersinia pestis
cuggcuggcauauuucucuuu

SEQ ID NO: 4153472 - RNA, 22 nt, Yersinia pestis
cuggcuggcccaaugcugucac

SEQ ID NO: 4153473 - RNA, 22 nt, Yersinia pestis
cuggcuggcuuuggaacgcuca

SEQ ID NO: 4153474 - RNA, 22 nt, Yersinia pestis
cuggcuuagaucuuuggccccg

SEQ ID NO: 4153475 - RNA, 15 nt, Yersinia pestis
cuggcuucuuuuucg

SEQ ID NO: 4153476 - RNA, 13 nt, Yersinia pestis
cuggcuuucgcuu

SEQ ID NO: 4153477 - RNA, 17 nt, Yersinia pestis
cuggcuuucucccauuc

SEQ ID NO: 4153478 - RNA, 23 nt, Yersinia pestis
cuggcuuuuucacacgcccaggc

SEQ ID NO: 4153479 - RNA, 24 nt, Yersinia pestis
cuggcuuuuucacacgcccaggcc

SEQ ID NO: 4153480 - RNA, 23 nt, Yersinia pestis
cuggcuuuuuuguuuuuauauca

SEQ ID NO: 4153481 - RNA, 15 nt, Yersinia pestis
cugggcacaacaagc

SEQ ID NO: 4153482 - RNA, 19 nt, Yersinia pestis
cugggcacaacaagcggcc

SEQ ID NO: 4153483 - RNA, 22 nt, Yersinia pestis
cugggccgcuggcgauccccuu

SEQ ID NO: 4153484 - RNA, 17 nt, Yersinia pestis
cugggccuacuggugcc

SEQ ID NO: 4153485 - RNA, 19 nt, Yersinia pestis
cugggcugaacgugccugu

SEQ ID NO: 4153486 - RNA, 15 nt, Yersinia pestis
cugggcugcauagcg

SEQ ID NO: 4153487 - RNA, 21 nt, Yersinia pestis
cugggggcuagccgcgccauc

SEQ ID NO: 4153488 - RNA, 14 nt, Yersinia pestis
cugggguaucgauu

SEQ ID NO: 4153489 - RNA, 19 nt, Yersinia pestis
cugggguaucgauuuccau

SEQ ID NO: 4153490 - RNA, 21 nt, Yersinia pestis
cuggguaauucauuauuacuc

SEQ ID NO: 4153491 - RNA, 16 nt, Yersinia pestis
cuggguacaacacaaa

SEQ ID NO: 4153492 - RNA, 14 nt, Yersinia pestis
cugggucaucaccc

SEQ ID NO: 4153493 - RNA, 22 nt, Yersinia pestis
cugggucaucacccagcaaaau

SEQ ID NO: 4153494 - RNA, 20 nt, Yersinia pestis
cugggucgugagucaggugg

SEQ ID NO: 4153495 - RNA, 21 nt, Yersinia pestis
cugggucgugagucagguggc

SEQ ID NO: 4153496 - RNA, 21 nt, Yersinia pestis
cugggugacgcgaaacgccca

SEQ ID NO: 4153497 - RNA, 15 nt, Yersinia pestis
cugggugcugcuccc

SEQ ID NO: 4153498 - RNA, 15 nt, Yersinia pestis
cugggugugcguaca

SEQ ID NO: 4153499 - RNA, 17 nt, Yersinia pestis
cuggguuugaguaacaa

SEQ ID NO: 4153500 - RNA, 22 nt, Yersinia pestis
cuggguuuuauugcaacugggc

SEQ ID NO: 4153501 - RNA, 17 nt, Yersinia pestis
cugguaacagagccuua

SEQ ID NO: 4153502 - RNA, 22 nt, Yersinia pestis
cugguaacagagccuuauaggc

SEQ ID NO: 4153503 - RNA, 14 nt, Yersinia pestis
cugguaccaaucuc

SEQ ID NO: 4153504 - RNA, 21 nt, Yersinia pestis
cugguagucauauucaggcug

SEQ ID NO: 4153505 - RNA, 14 nt, Yersinia pestis
cuggucgauaagca

SEQ ID NO: 4153506 - RNA, 16 nt, Yersinia pestis
cuggucgcacccaaac

SEQ ID NO: 4153507 - RNA, 20 nt, Yersinia pestis
cuggucgggugcaggccauu

SEQ ID NO: 4153508 - RNA, 14 nt, Yersinia pestis
cuggucucaagguc

SEQ ID NO: 4153509 - RNA, 13 nt, Yersinia pestis
cuggugaacgaaa

SEQ ID NO: 4153510 - RNA, 13 nt, Yersinia pestis
cuggugacccuca

SEQ ID NO: 4153511 - RNA, 19 nt, Yersinia pestis
cuggugcggaacagcgccc

SEQ ID NO: 4153512 - RNA, 18 nt, Yersinia pestis
cuggugcuggugaauggu

SEQ ID NO: 4153513 - RNA, 20 nt, Yersinia pestis
cuggugguuuuguuaauauu

SEQ ID NO: 4153514 - RNA, 16 nt, Yersinia pestis
cuggugugagcgagga

SEQ ID NO: 4153515 - RNA, 20 nt, Yersinia pestis
cugguuagagcacagcacuc

SEQ ID NO: 4153516 - RNA, 18 nt, Yersinia pestis
cugguuaucacagcaaau

SEQ ID NO: 4153517 - RNA, 15 nt, Yersinia pestis
cugguugcuucauca

SEQ ID NO: 4153518 - RNA, 22 nt, Yersinia pestis
cugguugugagguuagaaaaca

SEQ ID NO: 4153519 - RNA, 13 nt, Yersinia pestis
cugguuuuuuaaa

SEQ ID NO: 4153520 - RNA, 16 nt, Yersinia pestis
cuguaaaaaucaccuc

SEQ ID NO: 4153521 - RNA, 13 nt, Yersinia pestis
cuguaaaggcaaa

SEQ ID NO: 4153522 - RNA, 14 nt, Yersinia pestis
cuguaaaggcaaag

SEQ ID NO: 4153523 - RNA, 19 nt, Yersinia pestis
cuguaacucaaauuauuuu

SEQ ID NO: 4153524 - RNA, 12 nt, Yersinia pestis
cuguaagacuca

SEQ ID NO: 4153525 - RNA, 16 nt, Yersinia pestis
cuguaaggcccgcagu

SEQ ID NO: 4153526 - RNA, 13 nt, Yersinia pestis
cuguaaucaccag

SEQ ID NO: 4153527 - RNA, 19 nt, Yersinia pestis
cuguaaucuuggcacucga

SEQ ID NO: 4153528 - RNA, 19 nt, Yersinia pestis
cuguaaugccccacuucac

SEQ ID NO: 4153529 - RNA, 17 nt, Yersinia pestis
cuguaauugcgucaggg

SEQ ID NO: 4153530 - RNA, 19 nt, Yersinia pestis
cuguaauugcgucagggca

SEQ ID NO: 4153531 - RNA, 16 nt, Yersinia pestis
cuguacauaaauuugu

SEQ ID NO: 4153532 - RNA, 17 nt, Yersinia pestis
cuguacauaaauuugug

SEQ ID NO: 4153533 - RNA, 15 nt, Yersinia pestis
cuguacauauauaau

SEQ ID NO: 4153534 - RNA, 20 nt, Yersinia pestis
cuguaccaccaccaacagca

SEQ ID NO: 4153535 - RNA, 19 nt, Yersinia pestis
cuguacugcugcaacucau

SEQ ID NO: 4153536 - RNA, 20 nt, Yersinia pestis
cuguacugcugcaacucauu

SEQ ID NO: 4153537 - RNA, 13 nt, Yersinia pestis
cuuaauuuuauca

SEQ ID NO: 4153538 - RNA, 17 nt, Yersinia pestis
cuuaauuuuaucacuua

SEQ ID NO: 4153539 - RNA, 16 nt, Yersinia pestis
cuuacaaagcauuuca

SEQ ID NO: 4153540 - RNA, 11 nt, Yersinia pestis
cuuacagugau

SEQ ID NO: 4153541 - RNA, 15 nt, Yersinia pestis
cuuacagugauaauc

SEQ ID NO: 4153542 - RNA, 23 nt, Yersinia pestis
cuuacauuucaucuugauuagcg

SEQ ID NO: 4153543 - RNA, 14 nt, Yersinia pestis
cuuaccccuuucaa

SEQ ID NO: 4153544 - RNA, 17 nt, Yersinia pestis
cuuacccgaaucacuua

SEQ ID NO: 4153545 - RNA, 23 nt, Yersinia pestis
cuuacguuuugagguuuuaccaa

SEQ ID NO: 4153546 - RNA, 16 nt, Yersinia pestis
cuuacuaaaauaucac

SEQ ID NO: 4153547 - RNA, 16 nt, Yersinia pestis
cuuacuaccgucuuug

SEQ ID NO: 4153548 - RNA, 14 nt, Yersinia pestis
cuuacuauuuuucu

SEQ ID NO: 4153549 - RNA, 17 nt, Yersinia pestis
cuuacucauucgaauga

SEQ ID NO: 4153550 - RNA, 16 nt, Yersinia pestis
cuuacuguaucaauac

SEQ ID NO: 4153551 - RNA, 22 nt, Yersinia pestis
cuuacuguaucaauaccuuacu

SEQ ID NO: 4153552 - RNA, 15 nt, Yersinia pestis
cuuagaccaccgcca

SEQ ID NO: 4153553 - RNA, 22 nt, Yersinia pestis
cuuagaguaaguaaaaaggaua

SEQ ID NO: 4153554 - RNA, 22 nt, Yersinia pestis
cuuagagucacgguaugugugu

SEQ ID NO: 4153555 - RNA, 13 nt, Yersinia pestis
cuuagcaggcccu

SEQ ID NO: 4153556 - RNA, 18 nt, Yersinia pestis
cuuagcgcacggggaaac

SEQ ID NO: 4153557 - RNA, 23 nt, Yersinia pestis
cuuaguuacaauaaaucaauucu

SEQ ID NO: 4153558 - RNA, 15 nt, Yersinia pestis
cuuaguuggugcuuu

SEQ ID NO: 4153559 - RNA, 18 nt, Yersinia pestis
cuuauaggcgcauaugaa

SEQ ID NO: 4153560 - RNA, 22 nt, Yersinia pestis
cuuauaggcgcauaugaaaaac

SEQ ID NO: 4153561 - RNA, 17 nt, Yersinia pestis
cuuaucacucgggauau

SEQ ID NO: 4153562 - RNA, 17 nt, Yersinia pestis
cuuaucagcgaaaaauu

SEQ ID NO: 4153563 - RNA, 20 nt, Yersinia pestis
cuuaucagcgguaucuagag

SEQ ID NO: 4153564 - RNA, 14 nt, Yersinia pestis
cuuauccacagcau

SEQ ID NO: 4153565 - RNA, 15 nt, Yersinia pestis
cuuauccacagcaug

SEQ ID NO: 4153566 - RNA, 14 nt, Yersinia pestis
cuuauccagcgcca

SEQ ID NO: 4153567 - RNA, 19 nt, Yersinia pestis
cuuauccagcgccaucagc

SEQ ID NO: 4153568 - RNA, 18 nt, Yersinia pestis
cuuauccccugagaaaca

SEQ ID NO: 4153569 - RNA, 22 nt, Yersinia pestis
cuuauccccugagaaacauccu

SEQ ID NO: 4153570 - RNA, 19 nt, Yersinia pestis
cuuaucccuccaucaagcc

SEQ ID NO: 4153571 - RNA, 16 nt, Yersinia pestis
cuuauccugcaaccca

SEQ ID NO: 4153572 - RNA, 19 nt, Yersinia pestis
cuuaucgacaccaaucuuu

SEQ ID NO: 4153573 - RNA, 20 nt, Yersinia pestis
cuuaucgaccaacuggcaau

SEQ ID NO: 4153574 - RNA, 16 nt, Yersinia pestis
cuuaucgguuuuuugg

SEQ ID NO: 4153575 - RNA, 13 nt, Yersinia pestis
cuuaucuaaaaaa

SEQ ID NO: 4153576 - RNA, 21 nt, Yersinia pestis
cuuaucuuccagauagcgaau

SEQ ID NO: 4153577 - RNA, 19 nt, Yersinia pestis
cuuaugagcagcccagucu

SEQ ID NO: 4153578 - RNA, 21 nt, Yersinia pestis
cuuaugaucuugaauaauauu

SEQ ID NO: 4153579 - RNA, 13 nt, Yersinia pestis
cuuaugcgaaaac

SEQ ID NO: 4153580 - RNA, 18 nt, Yersinia pestis
cuuauuaauuaaugaaau

SEQ ID NO: 4153581 - RNA, 21 nt, Yersinia pestis
cuuauucccacuuauuauaaa

SEQ ID NO: 4153582 - RNA, 18 nt, Yersinia pestis
cuuauuggaaguacuuau

SEQ ID NO: 4153583 - RNA, 14 nt, Yersinia pestis
cuuauuguuuuuac

SEQ ID NO: 4153584 - RNA, 16 nt, Yersinia pestis
cuuauuuaucacauuu

SEQ ID NO: 4153585 - RNA, 13 nt, Yersinia pestis
cuuauuugaaaca

SEQ ID NO: 4153586 - RNA, 21 nt, Yersinia pestis
cuucaaagaagacaucuggcu

SEQ ID NO: 4153587 - RNA, 24 nt, Yersinia pestis
cuucaacuaauauuaagucuaucg

SEQ ID NO: 4153588 - RNA, 20 nt, Yersinia pestis
cuucaacugucacuaaaccu

SEQ ID NO: 4153589 - RNA, 14 nt, Yersinia pestis
cuucaacuuuuuuc

SEQ ID NO: 4153590 - RNA, 22 nt, Yersinia pestis
cuucaacuuuuuucuuaaggac

SEQ ID NO: 4153591 - RNA, 13 nt, Yersinia pestis
cuucaagaugcag

SEQ ID NO: 4153592 - RNA, 14 nt, Yersinia pestis
cuucaagguacuga

SEQ ID NO: 4153593 - RNA, 17 nt, Yersinia pestis
cuucaaguugucuguag

SEQ ID NO: 4153594 - RNA, 14 nt, Yersinia pestis
cuucaauaauuuuu

SEQ ID NO: 4153595 - RNA, 17 nt, Yersinia pestis
cuucaauaccaaauuua

SEQ ID NO: 4153596 - RNA, 22 nt, Yersinia pestis
cuucaauacguucguagccacg

SEQ ID NO: 4153597 - RNA, 15 nt, Yersinia pestis
cuucaaucaacugaa

SEQ ID NO: 4153598 - RNA, 14 nt, Yersinia pestis
cuucaauuuugugg

SEQ ID NO: 4153599 - RNA, 12 nt, Yersinia pestis
cuucacaucaua

SEQ ID NO: 4153600 - RNA, 15 nt, Yersinia pestis
cuucacauuuucucc

SEQ ID NO: 4153601 - RNA, 14 nt, Yersinia pestis
cuucaccaaaaaaa

SEQ ID NO: 4153602 - RNA, 12 nt, Yersinia pestis
cuucaccaauac

SEQ ID NO: 4153603 - RNA, 16 nt, Yersinia pestis
cuucaccgcuuuucug

SEQ ID NO: 4153604 - RNA, 19 nt, Yersinia pestis
cuucaccgcuuuucuggua

SEQ ID NO: 4153605 - RNA, 17 nt, Yersinia pestis
cuucacgcucuugcucu

SEQ ID NO: 4153606 - RNA, 13 nt, Yersinia pestis
cuucacucagcgc

SEQ ID NO: 4153607 - RNA, 16 nt, Yersinia pestis
cuucacuuuuaaaacu

SEQ ID NO: 4153608 - RNA, 22 nt, Yersinia pestis
cuucagacaguaaauccugaug

SEQ ID NO: 4153609 - RNA, 23 nt, Yersinia pestis
cuucagacugaaaguagaaauaa

SEQ ID NO: 4153610 - RNA, 16 nt, Yersinia pestis
cuucagagccauagau

SEQ ID NO: 4153611 - RNA, 15 nt, Yersinia pestis
cuucagcccauggcu

SEQ ID NO: 4153612 - RNA, 19 nt, Yersinia pestis
cuucagcccauggcugaaa

SEQ ID NO: 4153613 - RNA, 13 nt, Yersinia pestis
cuucagcgguggc

SEQ ID NO: 4153614 - RNA, 22 nt, Yersinia pestis
cuucagcuuccgcuucaacuuc

SEQ ID NO: 4153615 - RNA, 15 nt, Yersinia pestis
cuucaggaauaaaca

SEQ ID NO: 4153616 - RNA, 20 nt, Yersinia pestis
cuucaggaauaaacagcagu

SEQ ID NO: 4153617 - RNA, 19 nt, Yersinia pestis
cuucaggccaagccugugc

SEQ ID NO: 4153618 - RNA, 19 nt, Yersinia pestis
cuucagguaccccauaaau

SEQ ID NO: 4153619 - RNA, 19 nt, Yersinia pestis
cuucaguaaagcgcaggaa

SEQ ID NO: 4153620 - RNA, 18 nt, Yersinia pestis
cuucagucaguguuucua

SEQ ID NO: 4153621 - RNA, 17 nt, Yersinia pestis
cuucaguggcuggaaag

SEQ ID NO: 4153622 - RNA, 18 nt, Yersinia pestis
cuucaguggcuggaaagg

SEQ ID NO: 4153623 - RNA, 17 nt, Yersinia pestis
cuucaguuuugcgggug

SEQ ID NO: 4153624 - RNA, 22 nt, Yersinia pestis
cuucauaagccagugcuauuca

SEQ ID NO: 4153625 - RNA, 20 nt, Yersinia pestis
cuucauauauugcauuuaug

SEQ ID NO: 4153626 - RNA, 18 nt, Yersinia pestis
cuucauaucggccaaguu

SEQ ID NO: 4153627 - RNA, 17 nt, Yersinia pestis
cuucaucagggaauuca

SEQ ID NO: 4153628 - RNA, 22 nt, Yersinia pestis
cuucaucagucacuaaaccauu

SEQ ID NO: 4153629 - RNA, 12 nt, Yersinia pestis
cuucauccgcuc

SEQ ID NO: 4153630 - RNA, 14 nt, Yersinia pestis
cuucauccgcucca

SEQ ID NO: 4153631 - RNA, 16 nt, Yersinia pestis
cuucaucuacagacuc

SEQ ID NO: 4153632 - RNA, 16 nt, Yersinia pestis
cuucaucuuucaagug

SEQ ID NO: 4153633 - RNA, 19 nt, Yersinia pestis
cuucauguuuaucaaacag

SEQ ID NO: 4153634 - RNA, 16 nt, Yersinia pestis
cuucauuaucauguaa

SEQ ID NO: 4153635 - RNA, 17 nt, Yersinia pestis
cuucauugccuucuauc

SEQ ID NO: 4153636 - RNA, 23 nt, Yersinia pestis
cuucauuggcuugguuguuucuu

SEQ ID NO: 4153637 - RNA, 14 nt, Yersinia pestis
cuucauuucaggua

SEQ ID NO: 4153638 - RNA, 16 nt, Yersinia pestis
cuucauuuucaucacu

SEQ ID NO: 4153639 - RNA, 14 nt, Yersinia pestis
cuuccaaaggaagg

SEQ ID NO: 4153640 - RNA, 15 nt, Yersinia pestis
cuuccaaaggaaggg

SEQ ID NO: 4153641 - RNA, 13 nt, Yersinia pestis
cuuccaacucauu

SEQ ID NO: 4153642 - RNA, 14 nt, Yersinia pestis
cuuccaacucauua

SEQ ID NO: 4153643 - RNA, 14 nt, Yersinia pestis
cuuccaauagcagu

SEQ ID NO: 4153644 - RNA, 22 nt, Yersinia pestis
cuuccaauguugccgcuucaua

SEQ ID NO: 4153645 - RNA, 23 nt, Yersinia pestis
cuuccaauguugccgcuucauau

SEQ ID NO: 4153646 - RNA, 23 nt, Yersinia pestis
cuuccacacaaacgcauucauau

SEQ ID NO: 4153647 - RNA, 11 nt, Yersinia pestis
cuuccaccauc

SEQ ID NO: 4153648 - RNA, 17 nt, Yersinia pestis
cuuccagcaacaugcca

SEQ ID NO: 4153649 - RNA, 14 nt, Yersinia pestis
cuuccagcaucagu

SEQ ID NO: 4153650 - RNA, 23 nt, Yersinia pestis
cuuccaggauauucacguuuuuc

SEQ ID NO: 4153651 - RNA, 12 nt, Yersinia pestis
cuuccaguggcu

SEQ ID NO: 4153652 - RNA, 22 nt, Yersinia pestis
cuuccaguggcucgacggccaa

SEQ ID NO: 4153653 - RNA, 23 nt, Yersinia pestis
cuuccauaaacggaacucaucuu

SEQ ID NO: 4153654 - RNA, 13 nt, Yersinia pestis
cuuccaucaggaa

SEQ ID NO: 4153655 - RNA, 14 nt, Yersinia pestis
cuuccaucaggaag

SEQ ID NO: 4153656 - RNA, 14 nt, Yersinia pestis
cuuccaugacacau

SEQ ID NO: 4153657 - RNA, 19 nt, Yersinia pestis
cuuccaugacacauauuuc

SEQ ID NO: 4153658 - RNA, 23 nt, Yersinia pestis
cuuccaugacacauauuucaggc

SEQ ID NO: 4153659 - RNA, 18 nt, Yersinia pestis
cuuggcaccuaauaagcu

SEQ ID NO: 4153660 - RNA, 18 nt, Yersinia pestis
cuuggcacucgaucaauc

SEQ ID NO: 4153661 - RNA, 14 nt, Yersinia pestis
cuuggcaucacaga

SEQ ID NO: 4153662 - RNA, 16 nt, Yersinia pestis
cuuggcauugucugcu

SEQ ID NO: 4153663 - RNA, 21 nt, Yersinia pestis
cuuggcauugucugcuggccu

SEQ ID NO: 4153664 - RNA, 16 nt, Yersinia pestis
cuuggcgauguuuugg

SEQ ID NO: 4153665 - RNA, 23 nt, Yersinia pestis
cuugggaucagccaucagcgccc

SEQ ID NO: 4153666 - RNA, 14 nt, Yersinia pestis
cuugggcagcgaca

SEQ ID NO: 4153667 - RNA, 16 nt, Yersinia pestis
cuuggggaaguggccc

SEQ ID NO: 4153668 - RNA, 17 nt, Yersinia pestis
cuuggggcaacucccca

SEQ ID NO: 4153669 - RNA, 16 nt, Yersinia pestis
cuuggggccucacucu

SEQ ID NO: 4153670 - RNA, 23 nt, Yersinia pestis
cuugggucaguuuuauuaccaua

SEQ ID NO: 4153671 - RNA, 16 nt, Yersinia pestis
cuuggguggucagcau

SEQ ID NO: 4153672 - RNA, 23 nt, Yersinia pestis
cuugguaaugcgcaccagcucaa

SEQ ID NO: 4153673 - RNA, 23 nt, Yersinia pestis
cuuggugauacccagcaggucac

SEQ ID NO: 4153674 - RNA, 15 nt, Yersinia pestis
cuugguggagccugu

SEQ ID NO: 4153675 - RNA, 18 nt, Yersinia pestis
cuugguggugucaugguc

SEQ ID NO: 4153676 - RNA, 20 nt, Yersinia pestis
cuugguuacgggcuugcugc

SEQ ID NO: 4153677 - RNA, 13 nt, Yersinia pestis
cuugguuaguucu

SEQ ID NO: 4153678 - RNA, 18 nt, Yersinia pestis
cuugguuaugggggcaaa

SEQ ID NO: 4153679 - RNA, 14 nt, Yersinia pestis
cuugguugcaagua

SEQ ID NO: 4153680 - RNA, 12 nt, Yersinia pestis
cuugguuguuuc

SEQ ID NO: 4153681 - RNA, 22 nt, Yersinia pestis
cuuguaagaccaauugguaaga

SEQ ID NO: 4153682 - RNA, 22 nt, Yersinia pestis
cuuguagguuaaauucacuuuc

SEQ ID NO: 4153683 - RNA, 23 nt, Yersinia pestis
cuugucaccguaaccauuggcac

SEQ ID NO: 4153684 - RNA, 17 nt, Yersinia pestis
cuugucaccugaguaau

SEQ ID NO: 4153685 - RNA, 20 nt, Yersinia pestis
cuugugagcgauauuuauca

SEQ ID NO: 4153686 - RNA, 16 nt, Yersinia pestis
cuuguggauccagcac

SEQ ID NO: 4153687 - RNA, 14 nt, Yersinia pestis
cuuguggugaugaa

SEQ ID NO: 4153688 - RNA, 18 nt, Yersinia pestis
cuuguguaauuauauuua

SEQ ID NO: 4153689 - RNA, 19 nt, Yersinia pestis
cuuguguugggcaguaacg

SEQ ID NO: 4153690 - RNA, 15 nt, Yersinia pestis
cuuguuaauuuaaac

SEQ ID NO: 4153691 - RNA, 16 nt, Yersinia pestis
cuuguuaauuuaaaca

SEQ ID NO: 4153692 - RNA, 16 nt, Yersinia pestis
cuuguucaaucagcau

SEQ ID NO: 4153693 - RNA, 14 nt, Yersinia pestis
cuuguucaccaauu

SEQ ID NO: 4153694 - RNA, 16 nt, Yersinia pestis
cuuguucacggcuuug

SEQ ID NO: 4153695 - RNA, 16 nt, Yersinia pestis
cuuguuggucaccacu

SEQ ID NO: 4153696 - RNA, 22 nt, Yersinia pestis
cuuguugugauguuuuugacca

SEQ ID NO: 4153697 - RNA, 20 nt, Yersinia pestis
cuuguuuaucggucacuuua

SEQ ID NO: 4153698 - RNA, 19 nt, Yersinia pestis
cuuguuucuggcacaagaa

SEQ ID NO: 4153699 - RNA, 20 nt, Yersinia pestis
cuuguuugcgccguaaacug

SEQ ID NO: 4153700 - RNA, 23 nt, Yersinia pestis
cuuguuugcgccguaaacugccg

SEQ ID NO: 4153701 - RNA, 18 nt, Yersinia pestis
cuuuaaaaaaauuaucau

SEQ ID NO: 4153702 - RNA, 13 nt, Yersinia pestis
cuuuaaaaucuug

SEQ ID NO: 4153703 - RNA, 16 nt, Yersinia pestis
cuuuaaagccaaauug

SEQ ID NO: 4153704 - RNA, 22 nt, Yersinia pestis
cuuuaaauacccagcuucuuuu

SEQ ID NO: 4153705 - RNA, 13 nt, Yersinia pestis
cuuuaacaacaac

SEQ ID NO: 4153706 - RNA, 23 nt, Yersinia pestis
cuuuaagauccaguucaguccag

SEQ ID NO: 4153707 - RNA, 24 nt, Yersinia pestis
cuuuaagauccaguucaguccagc

SEQ ID NO: 4153708 - RNA, 13 nt, Yersinia pestis
cuuuaauaaaauc

SEQ ID NO: 4153709 - RNA, 21 nt, Yersinia pestis
cuuuaaucccaccggggagca

SEQ ID NO: 4153710 - RNA, 13 nt, Yersinia pestis
cuuuaauuaaaaa

SEQ ID NO: 4153711 - RNA, 15 nt, Yersinia pestis
cuuuaauuaaaaaua

SEQ ID NO: 4153712 - RNA, 22 nt, Yersinia pestis
cuuuaccagccccgguuaaauu

SEQ ID NO: 4153713 - RNA, 21 nt, Yersinia pestis
cuuuaccagcgucaaaccauu

SEQ ID NO: 4153714 - RNA, 16 nt, Yersinia pestis
cuuuaccccauugcac

SEQ ID NO: 4153715 - RNA, 18 nt, Yersinia pestis
cuuuacgaucugccuguu

SEQ ID NO: 4153716 - RNA, 23 nt, Yersinia pestis
cuuuacgcagcuuguugauauca

SEQ ID NO: 4153717 - RNA, 16 nt, Yersinia pestis
cuuuacgcgcaccgga

SEQ ID NO: 4153718 - RNA, 23 nt, Yersinia pestis
cuuuacggccgcuaguuugacgc

SEQ ID NO: 4153719 - RNA, 18 nt, Yersinia pestis
cuuuacuccccugccuau

SEQ ID NO: 4153720 - RNA, 23 nt, Yersinia pestis
cuuuacuccccugccuauccuca

SEQ ID NO: 4153721 - RNA, 15 nt, Yersinia pestis
cuuuacuccucugcc

SEQ ID NO: 4153722 - RNA, 17 nt, Yersinia pestis
cuuuacuccucugccua

SEQ ID NO: 4153723 - RNA, 23 nt, Yersinia pestis
cuuuacuccucugccuauccuca

SEQ ID NO: 4153724 - RNA, 14 nt, Yersinia pestis
cuuuagcauugcag

SEQ ID NO: 4153725 - RNA, 15 nt, Yersinia pestis
cuuuagcuauuacua

SEQ ID NO: 4153726 - RNA, 13 nt, Yersinia pestis
cuuuaggaaagcc

SEQ ID NO: 4153727 - RNA, 18 nt, Yersinia pestis
cuuuagggcggccuuaau

SEQ ID NO: 4153728 - RNA, 23 nt, Yersinia pestis
cuuuauauccccuguaguugcag

SEQ ID NO: 4153729 - RNA, 17 nt, Yersinia pestis
cuuuaucaauuuauacc

SEQ ID NO: 4153730 - RNA, 21 nt, Yersinia pestis
cuuuaucauugaguucugauc

SEQ ID NO: 4153731 - RNA, 21 nt, Yersinia pestis
cuuuaucuaaaauaucuuuca

SEQ ID NO: 4153732 - RNA, 12 nt, Yersinia pestis
cuuuaucugcca

SEQ ID NO: 4153733 - RNA, 19 nt, Yersinia pestis
cuuuauguaacacauauuu

SEQ ID NO: 4153734 - RNA, 12 nt, Yersinia pestis
cuuuauuauaug

SEQ ID NO: 4153735 - RNA, 13 nt, Yersinia pestis
cuuuauucaauac

SEQ ID NO: 4153736 - RNA, 14 nt, Yersinia pestis
cuuuauucaauacu

SEQ ID NO: 4153737 - RNA, 17 nt, Yersinia pestis
cuuuauugcuccuuacu

SEQ ID NO: 4153738 - RNA, 22 nt, Yersinia pestis
cuuucaacaaauucaccagcaa

SEQ ID NO: 4153739 - RNA, 16 nt, Yersinia pestis
cuuucaccaaaccauc

SEQ ID NO: 4153740 - RNA, 21 nt, Yersinia pestis
cuuucaccaaaccaucagcga

SEQ ID NO: 4153741 - RNA, 12 nt, Yersinia pestis
cuuucaccaacc

SEQ ID NO: 4153742 - RNA, 21 nt, Yersinia pestis
cuuucaccaaccaaccaucac

SEQ ID NO: 4153743 - RNA, 15 nt, Yersinia pestis
cuuucaccacugcca

SEQ ID NO: 4153744 - RNA, 21 nt, Yersinia pestis
cuuucaccgcuguagguguca

SEQ ID NO: 4153745 - RNA, 18 nt, Yersinia pestis
cuuucacgcuccacaccc

SEQ ID NO: 4153746 - RNA, 19 nt, Yersinia pestis
cuuucagaauugugccccu

SEQ ID NO: 4153747 - RNA, 18 nt, Yersinia pestis
cuuucagacaacgcuugg

SEQ ID NO: 4153748 - RNA, 21 nt, Yersinia pestis
cuuucagacaagccagugacu

SEQ ID NO: 4153749 - RNA, 20 nt, Yersinia pestis
cuuucagauaaugccuaagc

SEQ ID NO: 4153750 - RNA, 18 nt, Yersinia pestis
cuuucagcacgcuuucca

SEQ ID NO: 4153751 - RNA, 17 nt, Yersinia pestis
cuuucagcucuucaauu

SEQ ID NO: 4153752 - RNA, 19 nt, Yersinia pestis
cuuucaggccacgcaauuc

SEQ ID NO: 4153753 - RNA, 23 nt, Yersinia pestis
cuuucagggaguaacuugacgac

SEQ ID NO: 4153754 - RNA, 12 nt, Yersinia pestis
cuuucaguaauc

SEQ ID NO: 4153755 - RNA, 15 nt, Yersinia pestis
cuuucauacaucauu

SEQ ID NO: 4153756 - RNA, 13 nt, Yersinia pestis
cuuucaucgaaaa

SEQ ID NO: 4153757 - RNA, 17 nt, Yersinia pestis
cuuucaucgauugcugg

SEQ ID NO: 4153758 - RNA, 16 nt, Yersinia pestis
cuuucaucuucuucuu

SEQ ID NO: 4153759 - RNA, 12 nt, Yersinia pestis
cuuuccccagau

SEQ ID NO: 4153760 - RNA, 22 nt, Yersinia pestis
cuuuccccauuuuuuuauaauc

SEQ ID NO: 4153761 - RNA, 24 nt, Yersinia pestis
cuuucccccauaauucugccgacu

SEQ ID NO: 4153762 - RNA, 14 nt, Yersinia pestis
cuuuccuuccucuu

SEQ ID NO: 4153763 - RNA, 14 nt, Yersinia pestis
cuuucgacacauuu

SEQ ID NO: 4153764 - RNA, 14 nt, Yersinia pestis
cuuucgcccacaac

SEQ ID NO: 4153765 - RNA, 16 nt, Yersinia pestis
cuuucgcccacaacca

SEQ ID NO: 4153766 - RNA, 17 nt, Yersinia pestis
cuuucgggcaaaaaaau

SEQ ID NO: 4153767 - RNA, 15 nt, Yersinia pestis
cuuucuauaucacuu

SEQ ID NO: 4153768 - RNA, 16 nt, Yersinia pestis
cuuucucauuagcguc

SEQ ID NO: 4153769 - RNA, 17 nt, Yersinia pestis
cuuucuccuuugauuug

SEQ ID NO: 4153770 - RNA, 19 nt, Yersinia pestis
cuuucucgauacaauuuuu

SEQ ID NO: 4153771 - RNA, 18 nt, Yersinia pestis
cuuucucuccuuauacua

SEQ ID NO: 4153772 - RNA, 14 nt, Yersinia pestis
cuuucugcaauagc

SEQ ID NO: 4153773 - RNA, 21 nt, Yersinia pestis
cuuucuggcgagucaucaggc

SEQ ID NO: 4153774 - RNA, 16 nt, Yersinia pestis
cuuucuguucaucaau

SEQ ID NO: 4153775 - RNA, 16 nt, Yersinia pestis
cuuucuuaauaauauc

SEQ ID NO: 4153776 - RNA, 19 nt, Yersinia pestis
cuuucuuaauaauaucaaa

SEQ ID NO: 4153777 - RNA, 22 nt, Yersinia pestis
cuuucuuuucgcuauuucucuc

SEQ ID NO: 4153778 - RNA, 16 nt, Yersinia pestis
cuuugaacugcacccc

SEQ ID NO: 4153779 - RNA, 13 nt, Yersinia pestis
cuuugacagcauc

SEQ ID NO: 4153780 - RNA, 15 nt, Yersinia pestis
gaaagaaaaauagac

SEQ ID NO: 4153781 - RNA, 19 nt, Yersinia pestis
gaaagaaauaaaagaaaac

SEQ ID NO: 4153782 - RNA, 14 nt, Yersinia pestis
gaaagaagacauau

SEQ ID NO: 4153783 - RNA, 14 nt, Yersinia pestis
gaaagacguggcac

SEQ ID NO: 4153784 - RNA, 14 nt, Yersinia pestis
gaaagcaggucgcc

SEQ ID NO: 4153785 - RNA, 18 nt, Yersinia pestis
gaaagcaggucgccaaac

SEQ ID NO: 4153786 - RNA, 19 nt, Yersinia pestis
gaaagcauggcagguauca

SEQ ID NO: 4153787 - RNA, 14 nt, Yersinia pestis
gaaagcgccugugg

SEQ ID NO: 4153788 - RNA, 21 nt, Yersinia pestis
gaaagcgccugugggcggcuu

SEQ ID NO: 4153789 - RNA, 13 nt, Yersinia pestis
gaaagcuaauauu

SEQ ID NO: 4153790 - RNA, 13 nt, Yersinia pestis
gaaagcuucaacu

SEQ ID NO: 4153791 - RNA, 17 nt, Yersinia pestis
gaaaggaacaaaagaga

SEQ ID NO: 4153792 - RNA, 17 nt, Yersinia pestis
gaaagggaaguuucuua

SEQ ID NO: 4153793 - RNA, 17 nt, Yersinia pestis
gaaagguaugugccaaa

SEQ ID NO: 4153794 - RNA, 13 nt, Yersinia pestis
gaaaguggccacu

SEQ ID NO: 4153795 - RNA, 15 nt, Yersinia pestis
gaaaguuuauaugcu

SEQ ID NO: 4153796 - RNA, 18 nt, Yersinia pestis
gaaauaaaaaccgcagca

SEQ ID NO: 4153797 - RNA, 13 nt, Yersinia pestis
gaaauaaauaagu

SEQ ID NO: 4153798 - RNA, 18 nt, Yersinia pestis
gaaauaaauaaguucaga

SEQ ID NO: 4153799 - RNA, 19 nt, Yersinia pestis
gaaauaaaugacuaucccu

SEQ ID NO: 4153800 - RNA, 17 nt, Yersinia pestis
gaaauaaauucaucuca

SEQ ID NO: 4153801 - RNA, 17 nt, Yersinia pestis
gaaauaacugccagggc

SEQ ID NO: 4153802 - RNA, 20 nt, Yersinia pestis
gaaauaaucauaucaaaaua

SEQ ID NO: 4153803 - RNA, 12 nt, Yersinia pestis
gaaauaaugguu

SEQ ID NO: 4153804 - RNA, 20 nt, Yersinia pestis
gaaauacaggcuauauugcu

SEQ ID NO: 4153805 - RNA, 14 nt, Yersinia pestis
gaaauaccccucac

SEQ ID NO: 4153806 - RNA, 22 nt, Yersinia pestis
gaaauaccgauuagaaaucgcu

SEQ ID NO: 4153807 - RNA, 20 nt, Yersinia pestis
gaaauacuuauuugaaacag

SEQ ID NO: 4153808 - RNA, 12 nt, Yersinia pestis
gaaauagcacca

SEQ ID NO: 4153809 - RNA, 21 nt, Yersinia pestis
gaaauagcugcuucugaacca

SEQ ID NO: 4153810 - RNA, 16 nt, Yersinia pestis
gaaauagucgcgcugu

SEQ ID NO: 4153811 - RNA, 12 nt, Yersinia pestis
gaaauaguuacu

SEQ ID NO: 4153812 - RNA, 17 nt, Yersinia pestis
gaaauauggugauaacu

SEQ ID NO: 4153813 - RNA, 19 nt, Yersinia pestis
gaaauauggugauaacugc

SEQ ID NO: 4153814 - RNA, 14 nt, Yersinia pestis
gaaauauucgcauu

SEQ ID NO: 4153815 - RNA, 16 nt, Yersinia pestis
gaaauauugugcuccc

SEQ ID NO: 4153816 - RNA, 20 nt, Yersinia pestis
gaaaucagccauaucaaaau

SEQ ID NO: 4153817 - RNA, 16 nt, Yersinia pestis
gaaaucagcuucauua

SEQ ID NO: 4153818 - RNA, 13 nt, Yersinia pestis
gaaauccaaaucu

SEQ ID NO: 4153819 - RNA, 15 nt, Yersinia pestis
gaaaucgaaauuaag

SEQ ID NO: 4153820 - RNA, 18 nt, Yersinia pestis
gaaaucgcggcgaaggcu

SEQ ID NO: 4153821 - RNA, 17 nt, Yersinia pestis
gaaaucuucauaaacca

SEQ ID NO: 4153822 - RNA, 17 nt, Yersinia pestis
gaaaugccgauaaaaac

SEQ ID NO: 4153823 - RNA, 19 nt, Yersinia pestis
gaaaugccgauaaaaacua

SEQ ID NO: 4153824 - RNA, 16 nt, Yersinia pestis
gaaauuagaagguuua

SEQ ID NO: 4153825 - RNA, 17 nt, Yersinia pestis
gaaauucauaccuuaau

SEQ ID NO: 4153826 - RNA, 23 nt, Yersinia pestis
gaaauucuguagaguaaaacuga

SEQ ID NO: 4153827 - RNA, 18 nt, Yersinia pestis
gaaauuuaaaaacccucu

SEQ ID NO: 4153828 - RNA, 17 nt, Yersinia pestis
gaaauuuauuugcugca

SEQ ID NO: 4153829 - RNA, 14 nt, Yersinia pestis
gaaauuuuuagaaa

SEQ ID NO: 4153830 - RNA, 16 nt, Yersinia pestis
gaacaacagcauccgc

SEQ ID NO: 4153831 - RNA, 16 nt, Yersinia pestis
gaacaagacuuucccc

SEQ ID NO: 4153832 - RNA, 16 nt, Yersinia pestis
gaacaccaacaccaca

SEQ ID NO: 4153833 - RNA, 15 nt, Yersinia pestis
gaacaccauacuuuu

SEQ ID NO: 4153834 - RNA, 21 nt, Yersinia pestis
gaacacgauaagcgggguuaa

SEQ ID NO: 4153835 - RNA, 21 nt, Yersinia pestis
gaacacuuaauuccaugcaaa

SEQ ID NO: 4153836 - RNA, 23 nt, Yersinia pestis
gaacagagaacccuuguuuaucu

SEQ ID NO: 4153837 - RNA, 16 nt, Yersinia pestis
gaacagcagaauaauu

SEQ ID NO: 4153838 - RNA, 17 nt, Yersinia pestis
gaacagcauuuaugcug

SEQ ID NO: 4153839 - RNA, 14 nt, Yersinia pestis
gaacagccccaacc

SEQ ID NO: 4153840 - RNA, 22 nt, Yersinia pestis
gaacaggcagcaaauaaagccg

SEQ ID NO: 4153841 - RNA, 17 nt, Yersinia pestis
gaacagugccaacagcg

SEQ ID NO: 4153842 - RNA, 15 nt, Yersinia pestis
gaacauaaaaaugca

SEQ ID NO: 4153843 - RNA, 19 nt, Yersinia pestis
gaacauaacuuugccagug

SEQ ID NO: 4153844 - RNA, 19 nt, Yersinia pestis
gaacaucuggcgauuuugc

SEQ ID NO: 4153845 - RNA, 18 nt, Yersinia pestis
gaacauuuaucuaucugu

SEQ ID NO: 4153846 - RNA, 20 nt, Yersinia pestis
gaacauuuaucuaucuguuc

SEQ ID NO: 4153847 - RNA, 23 nt, Yersinia pestis
gaaccaacggcaaugaccaucaa

SEQ ID NO: 4153848 - RNA, 18 nt, Yersinia pestis
gaaccaauuuuucuguau

SEQ ID NO: 4153849 - RNA, 13 nt, Yersinia pestis
gaaccaucaacaa

SEQ ID NO: 4153850 - RNA, 22 nt, Yersinia pestis
gaaccauuuuuuguagugaaag

SEQ ID NO: 4153851 - RNA, 15 nt, Yersinia pestis
gaacccauucaucaa

SEQ ID NO: 4153852 - RNA, 18 nt, Yersinia pestis
gaacccccgcgaacagca

SEQ ID NO: 4153853 - RNA, 17 nt, Yersinia pestis
gaaccccuagccagcca

SEQ ID NO: 4153854 - RNA, 22 nt, Yersinia pestis
gaaccccugcguauugcuguuc

SEQ ID NO: 4153855 - RNA, 18 nt, Yersinia pestis
gaacccgcuaacaugcca

SEQ ID NO: 4153856 - RNA, 13 nt, Yersinia pestis
gaacccuucagca

SEQ ID NO: 4153857 - RNA, 19 nt, Yersinia pestis
gaaccgcagacauaucuga

SEQ ID NO: 4153858 - RNA, 16 nt, Yersinia pestis
gaaccgcuaucugcug

SEQ ID NO: 4153859 - RNA, 13 nt, Yersinia pestis
gaaccggcugaca

SEQ ID NO: 4153860 - RNA, 15 nt, Yersinia pestis
gaaccuccaaaugaa

SEQ ID NO: 4153861 - RNA, 20 nt, Yersinia pestis
gaaccuguuacaucagagcu

SEQ ID NO: 4153862 - RNA, 22 nt, Yersinia pestis
gaaccuguuacaucagagcuca

SEQ ID NO: 4153863 - RNA, 23 nt, Yersinia pestis
gaaccuuggcauugucugcuggc

SEQ ID NO: 4153864 - RNA, 22 nt, Yersinia pestis
gaacgaagucgauaugagucag

SEQ ID NO: 4153865 - RNA, 14 nt, Yersinia pestis
gaacgaaucaggca

SEQ ID NO: 4153866 - RNA, 21 nt, Yersinia pestis
gaacgaguaaaaagauggccu

SEQ ID NO: 4153867 - RNA, 19 nt, Yersinia pestis
gaacgccaaguaugcaggc

SEQ ID NO: 4153868 - RNA, 17 nt, Yersinia pestis
gaacgccucaaaaaccu

SEQ ID NO: 4153869 - RNA, 20 nt, Yersinia pestis
gaacgcgccuacagaggccg

SEQ ID NO: 4153870 - RNA, 18 nt, Yersinia pestis
gaacgcgucacuggccac

SEQ ID NO: 4153871 - RNA, 20 nt, Yersinia pestis
gaacgcuuguggaaauagaa

SEQ ID NO: 4153872 - RNA, 21 nt, Yersinia pestis
gaacggacauuuuacucccug

SEQ ID NO: 4153873 - RNA, 22 nt, Yersinia pestis
gaacggacauuuuacucccuga

SEQ ID NO: 4153874 - RNA, 13 nt, Yersinia pestis
gaacggagaugau

SEQ ID NO: 4153875 - RNA, 20 nt, Yersinia pestis
gaacuaccgugcggcuucuu

SEQ ID NO: 4153876 - RNA, 21 nt, Yersinia pestis
gaacuacuccauccccaacuc

SEQ ID NO: 4153877 - RNA, 18 nt, Yersinia pestis
gaacucagacuucuucca

SEQ ID NO: 4153878 - RNA, 15 nt, Yersinia pestis
gaacucauauguggu

SEQ ID NO: 4153879 - RNA, 15 nt, Yersinia pestis
gaacucgauaauaaa

SEQ ID NO: 4153880 - RNA, 14 nt, Yersinia pestis
gaacugauacccac

SEQ ID NO: 4153881 - RNA, 13 nt, Yersinia pestis
gaacuucgaaaga

SEQ ID NO: 4153882 - RNA, 21 nt, Yersinia pestis
gaacuuuaacuuccaauuucu

SEQ ID NO: 4153883 - RNA, 22 nt, Yersinia pestis
gaagaaaagagucgcuuuggga

SEQ ID NO: 4153884 - RNA, 22 nt, Yersinia pestis
gaagaaaccuaaugccagacac

SEQ ID NO: 4153885 - RNA, 17 nt, Yersinia pestis
gaagaaacggcucgauu

SEQ ID NO: 4153886 - RNA, 19 nt, Yersinia pestis
gaagaaucaccgaaagaag

SEQ ID NO: 4153887 - RNA, 21 nt, Yersinia pestis
gaagaauccacauaaaaagaa

SEQ ID NO: 4153888 - RNA, 12 nt, Yersinia pestis
gaagaauugcag

SEQ ID NO: 4153889 - RNA, 17 nt, Yersinia pestis
gaagacaacucuucuau

SEQ ID NO: 4153890 - RNA, 17 nt, Yersinia pestis
gaagacagauccugccg

SEQ ID NO: 4153891 - RNA, 18 nt, Yersinia pestis
gaagacgaguaaugaaau

SEQ ID NO: 4153892 - RNA, 21 nt, Yersinia pestis
gaagacuuccagcaccacuaa

SEQ ID NO: 4153893 - RNA, 15 nt, Yersinia pestis
gaagagaaaagcaga

SEQ ID NO: 4153894 - RNA, 13 nt, Yersinia pestis
gaagagcgccuca

SEQ ID NO: 4153895 - RNA, 21 nt, Yersinia pestis
gaagaguugauccgauaaacu

SEQ ID NO: 4153896 - RNA, 16 nt, Yersinia pestis
gaagaucgcuucacgg

SEQ ID NO: 4153897 - RNA, 22 nt, Yersinia pestis
gaagaugccaaucaaaaaaccg

SEQ ID NO: 4153898 - RNA, 16 nt, Yersinia pestis
gaagcaaucaggaaau

SEQ ID NO: 4153899 - RNA, 13 nt, Yersinia pestis
gaagcagcggggg

SEQ ID NO: 4153900 - RNA, 18 nt, Yersinia pestis
gaagcccguuauggcaag

SEQ ID NO: 4153901 - RNA, 17 nt, Yersinia pestis
gaagccgacgaucuugc

SEQ ID NO: 4153902 - RNA, 18 nt, Yersinia pestis
gacaacgccggaucauca

SEQ ID NO: 4153903 - RNA, 16 nt, Yersinia pestis
gacaacgucacuucca

SEQ ID NO: 4153904 - RNA, 20 nt, Yersinia pestis
gacaacuuagguucaaucgg

SEQ ID NO: 4153905 - RNA, 20 nt, Yersinia pestis
gacaagagcaauggcgauga

SEQ ID NO: 4153906 - RNA, 16 nt, Yersinia pestis
gacaagauugccaccu

SEQ ID NO: 4153907 - RNA, 23 nt, Yersinia pestis
gacaagauugccaccuucaccgu

SEQ ID NO: 4153908 - RNA, 23 nt, Yersinia pestis
gacaauaacggaaaaucaucgcu

SEQ ID NO: 4153909 - RNA, 21 nt, Yersinia pestis
gacaauaccgccacacaauac

SEQ ID NO: 4153910 - RNA, 15 nt, Yersinia pestis
gacaauaguguugcu

SEQ ID NO: 4153911 - RNA, 14 nt, Yersinia pestis
gacaauauaauaau

SEQ ID NO: 4153912 - RNA, 15 nt, Yersinia pestis
gacaaugaucgucaa

SEQ ID NO: 4153913 - RNA, 23 nt, Yersinia pestis
gacaaugucuauuuagucaucau

SEQ ID NO: 4153914 - RNA, 14 nt, Yersinia pestis
gacaauuaacacuu

SEQ ID NO: 4153915 - RNA, 21 nt, Yersinia pestis
gacaauuauagccaaaucugg

SEQ ID NO: 4153916 - RNA, 13 nt, Yersinia pestis
gacacaauucccg

SEQ ID NO: 4153917 - RNA, 13 nt, Yersinia pestis
gacacaucccaac

SEQ ID NO: 4153918 - RNA, 14 nt, Yersinia pestis
gacacaucccaacg

SEQ ID NO: 4153919 - RNA, 17 nt, Yersinia pestis
gacaccaagaggcugcg

SEQ ID NO: 4153920 - RNA, 17 nt, Yersinia pestis
gacacccguacgaauuu

SEQ ID NO: 4153921 - RNA, 18 nt, Yersinia pestis
gacacccguuccuucagc

SEQ ID NO: 4153922 - RNA, 22 nt, Yersinia pestis
gacacccguuccuucagccacc

SEQ ID NO: 4153923 - RNA, 16 nt, Yersinia pestis
gacaccggggauccau

SEQ ID NO: 4153924 - RNA, 23 nt, Yersinia pestis
gacacguaaaacagggagccgcc

SEQ ID NO: 4153925 - RNA, 14 nt, Yersinia pestis
gacacuaaccagac

SEQ ID NO: 4153926 - RNA, 19 nt, Yersinia pestis
gacacucagaucccccugc

SEQ ID NO: 4153927 - RNA, 15 nt, Yersinia pestis
gacagaaaaaucaca

SEQ ID NO: 4153928 - RNA, 20 nt, Yersinia pestis
gacagaaaacaaucuggcag

SEQ ID NO: 4153929 - RNA, 16 nt, Yersinia pestis
gacagaacugauuuca

SEQ ID NO: 4153930 - RNA, 18 nt, Yersinia pestis
gacagaacugauuucagg

SEQ ID NO: 4153931 - RNA, 16 nt, Yersinia pestis
gacagaauuauuuaua

SEQ ID NO: 4153932 - RNA, 13 nt, Yersinia pestis
gacagacccuguu

SEQ ID NO: 4153933 - RNA, 20 nt, Yersinia pestis
gacagauuauuguuauccac

SEQ ID NO: 4153934 - RNA, 20 nt, Yersinia pestis
gacagauuauuucagcuuca

SEQ ID NO: 4153935 - RNA, 21 nt, Yersinia pestis
gacagcauacauccuaaauaa

SEQ ID NO: 4153936 - RNA, 22 nt, Yersinia pestis
gacagcauacauccuaaauaau

SEQ ID NO: 4153937 - RNA, 22 nt, Yersinia pestis
gacagcaucugcaauggcuggc

SEQ ID NO: 4153938 - RNA, 14 nt, Yersinia pestis
gacaggcaaagacu

SEQ ID NO: 4153939 - RNA, 17 nt, Yersinia pestis
gacaggcaaagacuaca

SEQ ID NO: 4153940 - RNA, 18 nt, Yersinia pestis
gacaggcaauuauccauc

SEQ ID NO: 4153941 - RNA, 22 nt, Yersinia pestis
gacaggcuaacaacuaacgauu

SEQ ID NO: 4153942 - RNA, 17 nt, Yersinia pestis
gacaguauuugcagcgg

SEQ ID NO: 4153943 - RNA, 20 nt, Yersinia pestis
gacagugagguuauugacaa

SEQ ID NO: 4153944 - RNA, 13 nt, Yersinia pestis
gacauaagaugac

SEQ ID NO: 4153945 - RNA, 18 nt, Yersinia pestis
gacauaaugccggcggcc

SEQ ID NO: 4153946 - RNA, 17 nt, Yersinia pestis
gacauaucacaguuaaa

SEQ ID NO: 4153947 - RNA, 20 nt, Yersinia pestis
gacauaucuugaaccaauuu

SEQ ID NO: 4153948 - RNA, 19 nt, Yersinia pestis
gacaucagguuguauuuug

SEQ ID NO: 4153949 - RNA, 15 nt, Yersinia pestis
gacaucgccagauuc

SEQ ID NO: 4153950 - RNA, 14 nt, Yersinia pestis
gacaucuggcuggc

SEQ ID NO: 4153951 - RNA, 17 nt, Yersinia pestis
gacaugagacagcgcgg

SEQ ID NO: 4153952 - RNA, 21 nt, Yersinia pestis
gacaugcaccguaacuucuuc

SEQ ID NO: 4153953 - RNA, 19 nt, Yersinia pestis
gacaugggcagugcacagu

SEQ ID NO: 4153954 - RNA, 21 nt, Yersinia pestis
gacauggggguguuuuuccaa

SEQ ID NO: 4153955 - RNA, 22 nt, Yersinia pestis
gacaugucucgguuaaagacau

SEQ ID NO: 4153956 - RNA, 17 nt, Yersinia pestis
gacaugugaguggugua

SEQ ID NO: 4153957 - RNA, 20 nt, Yersinia pestis
gacaugugagugguguaaga

SEQ ID NO: 4153958 - RNA, 12 nt, Yersinia pestis
gacauuaagcau

SEQ ID NO: 4153959 - RNA, 19 nt, Yersinia pestis
gacauuaucgccagcaacu

SEQ ID NO: 4153960 - RNA, 13 nt, Yersinia pestis
gacauuauguucu

SEQ ID NO: 4153961 - RNA, 14 nt, Yersinia pestis
gacauuucggccac

SEQ ID NO: 4153962 - RNA, 18 nt, Yersinia pestis
gacauuuuucuauuucug

SEQ ID NO: 4153963 - RNA, 20 nt, Yersinia pestis
gaccaaaagccaccgcauca

SEQ ID NO: 4153964 - RNA, 17 nt, Yersinia pestis
gaccaaauagcaagcca

SEQ ID NO: 4153965 - RNA, 15 nt, Yersinia pestis
gaccaaccuguuuca

SEQ ID NO: 4153966 - RNA, 17 nt, Yersinia pestis
gaccaacuggcaaucau

SEQ ID NO: 4153967 - RNA, 19 nt, Yersinia pestis
gaccaauugguaagaaugg

SEQ ID NO: 4153968 - RNA, 16 nt, Yersinia pestis
gaccaauuucaauaau

SEQ ID NO: 4153969 - RNA, 21 nt, Yersinia pestis
gaccacagauaaauaaaauaa

SEQ ID NO: 4153970 - RNA, 20 nt, Yersinia pestis
gaccacaucaaccugaucau

SEQ ID NO: 4153971 - RNA, 13 nt, Yersinia pestis
gaccaccgccauu

SEQ ID NO: 4153972 - RNA, 20 nt, Yersinia pestis
gaccacgauuuaaugguuuc

SEQ ID NO: 4153973 - RNA, 20 nt, Yersinia pestis
gaccacuugcugaugcccau

SEQ ID NO: 4153974 - RNA, 21 nt, Yersinia pestis
gaccacuuuuuguguuuuggc

SEQ ID NO: 4153975 - RNA, 21 nt, Yersinia pestis
gaccagacaacagucacacca

SEQ ID NO: 4153976 - RNA, 14 nt, Yersinia pestis
gaccagauaaucgc

SEQ ID NO: 4153977 - RNA, 16 nt, Yersinia pestis
gaccagauaaucgcca

SEQ ID NO: 4153978 - RNA, 17 nt, Yersinia pestis
gaccagauaaucgccaa

SEQ ID NO: 4153979 - RNA, 13 nt, Yersinia pestis
gaccagugagcca

SEQ ID NO: 4153980 - RNA, 23 nt, Yersinia pestis
gaccagugcacccagcucgguga

SEQ ID NO: 4153981 - RNA, 14 nt, Yersinia pestis
gaccauaaaaggau

SEQ ID NO: 4153982 - RNA, 17 nt, Yersinia pestis
gaccauaaaaggauggc

SEQ ID NO: 4153983 - RNA, 23 nt, Yersinia pestis
gaccaucccccauggggccaccu

SEQ ID NO: 4153984 - RNA, 13 nt, Yersinia pestis
gaccaugccauca

SEQ ID NO: 4153985 - RNA, 12 nt, Yersinia pestis
gaccauuucucu

SEQ ID NO: 4153986 - RNA, 13 nt, Yersinia pestis
gaccauuucucug

SEQ ID NO: 4153987 - RNA, 14 nt, Yersinia pestis
gacccacaucggcc

SEQ ID NO: 4153988 - RNA, 14 nt, Yersinia pestis
gacccauuauauag

SEQ ID NO: 4153989 - RNA, 13 nt, Yersinia pestis
gacccgauuucaa

SEQ ID NO: 4153990 - RNA, 16 nt, Yersinia pestis
gacccggcugcacgcc

SEQ ID NO: 4153991 - RNA, 19 nt, Yersinia pestis
gacccgugaacaucuggcg

SEQ ID NO: 4153992 - RNA, 15 nt, Yersinia pestis
gacccguuuauaaag

SEQ ID NO: 4153993 - RNA, 14 nt, Yersinia pestis
gacccugcaccacg

SEQ ID NO: 4153994 - RNA, 16 nt, Yersinia pestis
gacccugcaccacgcc

SEQ ID NO: 4153995 - RNA, 18 nt, Yersinia pestis
gacccuggcacuaaaaua

SEQ ID NO: 4153996 - RNA, 12 nt, Yersinia pestis
gaccgagaagcu

SEQ ID NO: 4153997 - RNA, 18 nt, Yersinia pestis
gaccgaguguaaaaagca

SEQ ID NO: 4153998 - RNA, 17 nt, Yersinia pestis
gaccgauaaacgccagu

SEQ ID NO: 4153999 - RNA, 19 nt, Yersinia pestis
gaccgauaaacgccaguca

SEQ ID NO: 4154000 - RNA, 15 nt, Yersinia pestis
gaccgauugaaucaa

SEQ ID NO: 4154001 - RNA, 14 nt, Yersinia pestis
gaccgcucuucaca

SEQ ID NO: 4154002 - RNA, 15 nt, Yersinia pestis
gaccgcucuucacau

SEQ ID NO: 4154003 - RNA, 12 nt, Yersinia pestis
gaccggccgcuu

SEQ ID NO: 4154004 - RNA, 22 nt, Yersinia pestis
gaccggggaucaauaaacgcuu

SEQ ID NO: 4154005 - RNA, 22 nt, Yersinia pestis
gaccggguaacucccggcaggc

SEQ ID NO: 4154006 - RNA, 14 nt, Yersinia pestis
gaccguacaucugg

SEQ ID NO: 4154007 - RNA, 16 nt, Yersinia pestis
gaccgucaccaaauag

SEQ ID NO: 4154008 - RNA, 14 nt, Yersinia pestis
gaccuagcaaugag

SEQ ID NO: 4154009 - RNA, 16 nt, Yersinia pestis
gaccuccguaggccaa

SEQ ID NO: 4154010 - RNA, 21 nt, Yersinia pestis
gaccuguacgugaaagucucu

SEQ ID NO: 4154011 - RNA, 18 nt, Yersinia pestis
gaccuuacagugauaauc

SEQ ID NO: 4154012 - RNA, 15 nt, Yersinia pestis
gaccuuccauaacuc

SEQ ID NO: 4154013 - RNA, 22 nt, Yersinia pestis
gaccuucccucuuuuaucugug

SEQ ID NO: 4154014 - RNA, 13 nt, Yersinia pestis
gaccuugguaucu

SEQ ID NO: 4154015 - RNA, 19 nt, Yersinia pestis
gacgaaauagcgccugccc

SEQ ID NO: 4154016 - RNA, 13 nt, Yersinia pestis
gacgaacagcccc

SEQ ID NO: 4154017 - RNA, 23 nt, Yersinia pestis
gacgacacaaaugcugugccaug

SEQ ID NO: 4154018 - RNA, 13 nt, Yersinia pestis
gacgacagauuau

SEQ ID NO: 4154019 - RNA, 19 nt, Yersinia pestis
gacgacggaaccgaauaau

SEQ ID NO: 4154020 - RNA, 22 nt, Yersinia pestis
gacgagucuauugaaaaaauaa

SEQ ID NO: 4154021 - RNA, 14 nt, Yersinia pestis
gacgauaaauucaa

SEQ ID NO: 4154022 - RNA, 12 nt, Yersinia pestis
gacgaucuugcc

SEQ ID NO: 4154023 - RNA, 19 nt, Yersinia pestis
gacgaugucggcaggcaac

SEQ ID NO: 4154024 - RNA, 21 nt, Yersinia pestis
gagcaaaaauauacccgacua

SEQ ID NO: 4154025 - RNA, 23 nt, Yersinia pestis
gagcaaaaauauacccgacuaau

SEQ ID NO: 4154026 - RNA, 14 nt, Yersinia pestis
gagcaaacgccuga

SEQ ID NO: 4154027 - RNA, 13 nt, Yersinia pestis
gagcaaaucgaua

SEQ ID NO: 4154028 - RNA, 16 nt, Yersinia pestis
gagcaacucacugaau

SEQ ID NO: 4154029 - RNA, 14 nt, Yersinia pestis
gagcaauaacgugu

SEQ ID NO: 4154030 - RNA, 21 nt, Yersinia pestis
gagcaauaccaaaaaucucuu

SEQ ID NO: 4154031 - RNA, 13 nt, Yersinia pestis
gagcaaucaaaag

SEQ ID NO: 4154032 - RNA, 18 nt, Yersinia pestis
gagcaaucuggcggccgc

SEQ ID NO: 4154033 - RNA, 11 nt, Yersinia pestis
gagcaccagaa

SEQ ID NO: 4154034 - RNA, 19 nt, Yersinia pestis
gagcacgcagagaugaaua

SEQ ID NO: 4154035 - RNA, 12 nt, Yersinia pestis
gagcacugcccc

SEQ ID NO: 4154036 - RNA, 21 nt, Yersinia pestis
gagcacugccccgaagcucaa

SEQ ID NO: 4154037 - RNA, 20 nt, Yersinia pestis
gagcaguaauagcaaaaaaa

SEQ ID NO: 4154038 - RNA, 15 nt, Yersinia pestis
gagcagugcagcaaa

SEQ ID NO: 4154039 - RNA, 15 nt, Yersinia pestis
gagcagugcgcggcg

SEQ ID NO: 4154040 - RNA, 16 nt, Yersinia pestis
gagcagugcgcggcgc

SEQ ID NO: 4154041 - RNA, 21 nt, Yersinia pestis
gagcauaacugguggcaggcc

SEQ ID NO: 4154042 - RNA, 22 nt, Yersinia pestis
gagcauaacugguggcaggccc

SEQ ID NO: 4154043 - RNA, 22 nt, Yersinia pestis
gagcauacuguuggcaauuuca

SEQ ID NO: 4154044 - RNA, 21 nt, Yersinia pestis
gagccaaacgugcuacuuaau

SEQ ID NO: 4154045 - RNA, 12 nt, Yersinia pestis
gagccacacauu

SEQ ID NO: 4154046 - RNA, 23 nt, Yersinia pestis
gagccacuuuaauauuucaaaug

SEQ ID NO: 4154047 - RNA, 19 nt, Yersinia pestis
gagccauugauuggcuccu

SEQ ID NO: 4154048 - RNA, 14 nt, Yersinia pestis
gagcccccagggaa

SEQ ID NO: 4154049 - RNA, 18 nt, Yersinia pestis
gagccgcgccauccuugg

SEQ ID NO: 4154050 - RNA, 18 nt, Yersinia pestis
gagccggcugagaagagg

SEQ ID NO: 4154051 - RNA, 21 nt, Yersinia pestis
gagccuacauggauguauuua

SEQ ID NO: 4154052 - RNA, 18 nt, Yersinia pestis
gagccuacuacauggaug

SEQ ID NO: 4154053 - RNA, 16 nt, Yersinia pestis
gagccuguccauaauu

SEQ ID NO: 4154054 - RNA, 22 nt, Yersinia pestis
gagccuuauaggcgcauaugaa

SEQ ID NO: 4154055 - RNA, 19 nt, Yersinia pestis
gagcgacucaauaauaugg

SEQ ID NO: 4154056 - RNA, 14 nt, Yersinia pestis
gagcgacucaauug

SEQ ID NO: 4154057 - RNA, 21 nt, Yersinia pestis
gagcgacuuaauggucuucuu

SEQ ID NO: 4154058 - RNA, 20 nt, Yersinia pestis
gagcgauaacauuuuuucuu

SEQ ID NO: 4154059 - RNA, 13 nt, Yersinia pestis
gagcgcagacguu

SEQ ID NO: 4154060 - RNA, 23 nt, Yersinia pestis
gagcgccccgccuaucaggcaca

SEQ ID NO: 4154061 - RNA, 17 nt, Yersinia pestis
gagcggaugauucgcca

SEQ ID NO: 4154062 - RNA, 15 nt, Yersinia pestis
gagcggggcaaaaau

SEQ ID NO: 4154063 - RNA, 12 nt, Yersinia pestis
gagcguaaucug

SEQ ID NO: 4154064 - RNA, 14 nt, Yersinia pestis
gagcguagacuaaa

SEQ ID NO: 4154065 - RNA, 13 nt, Yersinia pestis
gagcgucaagcca

SEQ ID NO: 4154066 - RNA, 15 nt, Yersinia pestis
gagcgugaagagcga

SEQ ID NO: 4154067 - RNA, 23 nt, Yersinia pestis
gagcuaacgcgucaaucggguua

SEQ ID NO: 4154068 - RNA, 14 nt, Yersinia pestis
gagcuaaugcuauc

SEQ ID NO: 4154069 - RNA, 19 nt, Yersinia pestis
gagcucgcuagucaucacu

SEQ ID NO: 4154070 - RNA, 17 nt, Yersinia pestis
gagcugaucugccagua

SEQ ID NO: 4154071 - RNA, 22 nt, Yersinia pestis
gagcuuauggaaguaauccaga

SEQ ID NO: 4154072 - RNA, 17 nt, Yersinia pestis
gagcuucuucaaaagca

SEQ ID NO: 4154073 - RNA, 12 nt, Yersinia pestis
gaggaaauaaau

SEQ ID NO: 4154074 - RNA, 21 nt, Yersinia pestis
gaggaaggcgguuaucuggaa

SEQ ID NO: 4154075 - RNA, 20 nt, Yersinia pestis
gaggaauaugcccuuuuagc

SEQ ID NO: 4154076 - RNA, 13 nt, Yersinia pestis
gaggaaucaaaga

SEQ ID NO: 4154077 - RNA, 14 nt, Yersinia pestis
gaggacggcggccu

SEQ ID NO: 4154078 - RNA, 14 nt, Yersinia pestis
gaggacuauucaau

SEQ ID NO: 4154079 - RNA, 19 nt, Yersinia pestis
gaggacuuccugcccagcg

SEQ ID NO: 4154080 - RNA, 16 nt, Yersinia pestis
gaggagauuucagacu

SEQ ID NO: 4154081 - RNA, 19 nt, Yersinia pestis
gaggagauuucagacugcu

SEQ ID NO: 4154082 - RNA, 14 nt, Yersinia pestis
gaggauagggugcc

SEQ ID NO: 4154083 - RNA, 19 nt, Yersinia pestis
gaggauauuagggcugaca

SEQ ID NO: 4154084 - RNA, 22 nt, Yersinia pestis
gaggauauuuauuaaaacacau

SEQ ID NO: 4154085 - RNA, 17 nt, Yersinia pestis
gaggauauuuauuuucc

SEQ ID NO: 4154086 - RNA, 21 nt, Yersinia pestis
gaggaucccuucugaaacuuc

SEQ ID NO: 4154087 - RNA, 12 nt, Yersinia pestis
gaggaucuuccu

SEQ ID NO: 4154088 - RNA, 14 nt, Yersinia pestis
gaggauucaagaac

SEQ ID NO: 4154089 - RNA, 18 nt, Yersinia pestis
gaggauuuuccgcagcuc

SEQ ID NO: 4154090 - RNA, 14 nt, Yersinia pestis
gaggcauaaucagc

SEQ ID NO: 4154091 - RNA, 22 nt, Yersinia pestis
gaggcaucaagggcggggucaa

SEQ ID NO: 4154092 - RNA, 14 nt, Yersinia pestis
gaggcgaucugcuu

SEQ ID NO: 4154093 - RNA, 22 nt, Yersinia pestis
gaggcucauuaauccccaggug

SEQ ID NO: 4154094 - RNA, 23 nt, Yersinia pestis
gaggcucuggucacuaaaacuga

SEQ ID NO: 4154095 - RNA, 15 nt, Yersinia pestis
gaggcucuucugggc

SEQ ID NO: 4154096 - RNA, 22 nt, Yersinia pestis
gaggcugcguguucuucucacc

SEQ ID NO: 4154097 - RNA, 19 nt, Yersinia pestis
gagggacgcgaaucccccc

SEQ ID NO: 4154098 - RNA, 17 nt, Yersinia pestis
gagggaguuauucugau

SEQ ID NO: 4154099 - RNA, 17 nt, Yersinia pestis
gagggcgguuaaauaca

SEQ ID NO: 4154100 - RNA, 22 nt, Yersinia pestis
gagggcgguuaaauacagcacc

SEQ ID NO: 4154101 - RNA, 17 nt, Yersinia pestis
gagggcucaaucucugc

SEQ ID NO: 4154102 - RNA, 13 nt, Yersinia pestis
gagggcuucuggc

SEQ ID NO: 4154103 - RNA, 22 nt, Yersinia pestis
gaggguaaccgccgcaggccau

SEQ ID NO: 4154104 - RNA, 15 nt, Yersinia pestis
gagggugaugacaau

SEQ ID NO: 4154105 - RNA, 16 nt, Yersinia pestis
gagggugaugacaaug

SEQ ID NO: 4154106 - RNA, 18 nt, Yersinia pestis
gaggguuagcgaugacug

SEQ ID NO: 4154107 - RNA, 15 nt, Yersinia pestis
gaggguugucagcag

SEQ ID NO: 4154108 - RNA, 17 nt, Yersinia pestis
gagguagacguaucaug

SEQ ID NO: 4154109 - RNA, 15 nt, Yersinia pestis
gagguggccauuacg

SEQ ID NO: 4154110 - RNA, 21 nt, Yersinia pestis
gaggugguaaaaucccccacg

SEQ ID NO: 4154111 - RNA, 14 nt, Yersinia pestis
gagguuaucagccu

SEQ ID NO: 4154112 - RNA, 21 nt, Yersinia pestis
gagguuauugacaaagagccc

SEQ ID NO: 4154113 - RNA, 23 nt, Yersinia pestis
gagguuuugggcuaaaagggagu

SEQ ID NO: 4154114 - RNA, 12 nt, Yersinia pestis
gaguaaacagag

SEQ ID NO: 4154115 - RNA, 16 nt, Yersinia pestis
gaguaaacagagcacc

SEQ ID NO: 4154116 - RNA, 21 nt, Yersinia pestis
gaguaaaccguacauuaaaug

SEQ ID NO: 4154117 - RNA, 21 nt, Yersinia pestis
gaguaaagcaggccuucuaac

SEQ ID NO: 4154118 - RNA, 15 nt, Yersinia pestis
gaguaaagcguccgc

SEQ ID NO: 4154119 - RNA, 11 nt, Yersinia pestis
gaguaaauaca

SEQ ID NO: 4154120 - RNA, 20 nt, Yersinia pestis
gaguaaauucgggcuuuaau

SEQ ID NO: 4154121 - RNA, 20 nt, Yersinia pestis
gaguaacacuucagacugaa

SEQ ID NO: 4154122 - RNA, 12 nt, Yersinia pestis
gaguaaucagag

SEQ ID NO: 4154123 - RNA, 14 nt, Yersinia pestis
gaguaaugaaaucu

SEQ ID NO: 4154124 - RNA, 15 nt, Yersinia pestis
gaguacgaacagaga

SEQ ID NO: 4154125 - RNA, 22 nt, Yersinia pestis
gaguagagcuuccagugcauua

SEQ ID NO: 4154126 - RNA, 20 nt, Yersinia pestis
gaguagcaggccgacaauac

SEQ ID NO: 4154127 - RNA, 20 nt, Yersinia pestis
gaguagcugugaacguacuu

SEQ ID NO: 4154128 - RNA, 14 nt, Yersinia pestis
gaguaggaaauaca

SEQ ID NO: 4154129 - RNA, 16 nt, Yersinia pestis
gaguaggaaauacagg

SEQ ID NO: 4154130 - RNA, 19 nt, Yersinia pestis
gaguauacggucaaaagcu

SEQ ID NO: 4154131 - RNA, 14 nt, Yersinia pestis
gaguauacuaaaac

SEQ ID NO: 4154132 - RNA, 17 nt, Yersinia pestis
gaguaucaauauugugc

SEQ ID NO: 4154133 - RNA, 22 nt, Yersinia pestis
gaguauguauccaucugaugag

SEQ ID NO: 4154134 - RNA, 17 nt, Yersinia pestis
gagucagggagucaggg

SEQ ID NO: 4154135 - RNA, 19 nt, Yersinia pestis
gagucaguaauucacccuu

SEQ ID NO: 4154136 - RNA, 21 nt, Yersinia pestis
gagucaguacggagaauauag

SEQ ID NO: 4154137 - RNA, 16 nt, Yersinia pestis
gagucagucaggguga

SEQ ID NO: 4154138 - RNA, 15 nt, Yersinia pestis
gagucaucgggguuu

SEQ ID NO: 4154139 - RNA, 14 nt, Yersinia pestis
gagucgaugaaaca

SEQ ID NO: 4154140 - RNA, 16 nt, Yersinia pestis
gagucgcuccucagcc

SEQ ID NO: 4154141 - RNA, 21 nt, Yersinia pestis
gagucgguguacguauggcau

SEQ ID NO: 4154142 - RNA, 21 nt, Yersinia pestis
gagucuaucugcaguauuugc

SEQ ID NO: 4154143 - RNA, 17 nt, Yersinia pestis
gagucuauugaaaaaau

SEQ ID NO: 4154144 - RNA, 18 nt, Yersinia pestis
gagucuauugaaaaaaua

SEQ ID NO: 4154145 - RNA, 15 nt, Yersinia pestis
gagucucagggguga

SEQ ID NO: 4154146 - RNA, 18 nt, Yersinia pestis
gauauaaauaaaauagcg

SEQ ID NO: 4154147 - RNA, 13 nt, Yersinia pestis
gauauaacucaac

SEQ ID NO: 4154148 - RNA, 14 nt, Yersinia pestis
gauauacaccccau

SEQ ID NO: 4154149 - RNA, 17 nt, Yersinia pestis
gauauacccaccagaga

SEQ ID NO: 4154150 - RNA, 14 nt, Yersinia pestis
gauauagccuucuu

SEQ ID NO: 4154151 - RNA, 15 nt, Yersinia pestis
gauauagcgcaccac

SEQ ID NO: 4154152 - RNA, 16 nt, Yersinia pestis
gauaucagccagugcu

SEQ ID NO: 4154153 - RNA, 17 nt, Yersinia pestis
gauauccagugccaaaa

SEQ ID NO: 4154154 - RNA, 21 nt, Yersinia pestis
gauaucgccaacguguauucc

SEQ ID NO: 4154155 - RNA, 21 nt, Yersinia pestis
gauaucuaaguccaagacaga

SEQ ID NO: 4154156 - RNA, 12 nt, Yersinia pestis
gauaucucuuua

SEQ ID NO: 4154157 - RNA, 14 nt, Yersinia pestis
gauaucugcgguga

SEQ ID NO: 4154158 - RNA, 17 nt, Yersinia pestis
gauaucugcggugauca

SEQ ID NO: 4154159 - RNA, 12 nt, Yersinia pestis
gauaucugcuca

SEQ ID NO: 4154160 - RNA, 20 nt, Yersinia pestis
gauaucuucggcggcuaaag

SEQ ID NO: 4154161 - RNA, 19 nt, Yersinia pestis
gauaucuugauugccuaca

SEQ ID NO: 4154162 - RNA, 20 nt, Yersinia pestis
gauaugacagaaaaaucaca

SEQ ID NO: 4154163 - RNA, 17 nt, Yersinia pestis
gauaugacuaaacugau

SEQ ID NO: 4154164 - RNA, 20 nt, Yersinia pestis
gauaugcauuauugauguua

SEQ ID NO: 4154165 - RNA, 20 nt, Yersinia pestis
gauaugccggggauauuuug

SEQ ID NO: 4154166 - RNA, 16 nt, Yersinia pestis
gauauuacgcagccau

SEQ ID NO: 4154167 - RNA, 13 nt, Yersinia pestis
gauauuacuucuu

SEQ ID NO: 4154168 - RNA, 21 nt, Yersinia pestis
gauauuagggcugacagagcg

SEQ ID NO: 4154169 - RNA, 17 nt, Yersinia pestis
gauauuauuagccaaau

SEQ ID NO: 4154170 - RNA, 20 nt, Yersinia pestis
gauauuauuuauuuuauaau

SEQ ID NO: 4154171 - RNA, 18 nt, Yersinia pestis
gauauucacguuuuucca

SEQ ID NO: 4154172 - RNA, 20 nt, Yersinia pestis
gauauucacguuuuuccauu

SEQ ID NO: 4154173 - RNA, 18 nt, Yersinia pestis
gauauucauauuucuuug

SEQ ID NO: 4154174 - RNA, 20 nt, Yersinia pestis
gauauugagaaucagugguc

SEQ ID NO: 4154175 - RNA, 13 nt, Yersinia pestis
gauauugaugacg

SEQ ID NO: 4154176 - RNA, 14 nt, Yersinia pestis
gauauugaugacgc

SEQ ID NO: 4154177 - RNA, 17 nt, Yersinia pestis
gauauugcgcaguaaau

SEQ ID NO: 4154178 - RNA, 16 nt, Yersinia pestis
gauauuuauuaaaaca

SEQ ID NO: 4154179 - RNA, 19 nt, Yersinia pestis
gauauuuauuuauuuccgc

SEQ ID NO: 4154180 - RNA, 17 nt, Yersinia pestis
gauauuuauuuccagau

SEQ ID NO: 4154181 - RNA, 15 nt, Yersinia pestis
gauauuuauuucugc

SEQ ID NO: 4154182 - RNA, 18 nt, Yersinia pestis
gauauuucacguucauca

SEQ ID NO: 4154183 - RNA, 20 nt, Yersinia pestis
gauauuucacguucaucaau

SEQ ID NO: 4154184 - RNA, 20 nt, Yersinia pestis
gaucaaaccagagaaagguu

SEQ ID NO: 4154185 - RNA, 18 nt, Yersinia pestis
gaucaaacggauaaucgc

SEQ ID NO: 4154186 - RNA, 19 nt, Yersinia pestis
gaucaaaggcgaccaaugg

SEQ ID NO: 4154187 - RNA, 14 nt, Yersinia pestis
gaucaacagugagg

SEQ ID NO: 4154188 - RNA, 18 nt, Yersinia pestis
gaucaacgccucacaacu

SEQ ID NO: 4154189 - RNA, 19 nt, Yersinia pestis
gaucaauaaaaaagucacu

SEQ ID NO: 4154190 - RNA, 22 nt, Yersinia pestis
gaucaauaaacgcuuuugcugc

SEQ ID NO: 4154191 - RNA, 21 nt, Yersinia pestis
gaucaauaucccgagaaacaa

SEQ ID NO: 4154192 - RNA, 18 nt, Yersinia pestis
gaucaauguuaucgccaa

SEQ ID NO: 4154193 - RNA, 20 nt, Yersinia pestis
gaucaauuugauagauuucu

SEQ ID NO: 4154194 - RNA, 20 nt, Yersinia pestis
gaucacaauacagcaaauag

SEQ ID NO: 4154195 - RNA, 15 nt, Yersinia pestis
gaucacaaugcaaau

SEQ ID NO: 4154196 - RNA, 19 nt, Yersinia pestis
gaucacagcucucugagcc

SEQ ID NO: 4154197 - RNA, 20 nt, Yersinia pestis
gaucacaucacagugccaaa

SEQ ID NO: 4154198 - RNA, 22 nt, Yersinia pestis
gaucacaucacagugccaaaag

SEQ ID NO: 4154199 - RNA, 23 nt, Yersinia pestis
gaucaccaaucggaucgagcugu

SEQ ID NO: 4154200 - RNA, 19 nt, Yersinia pestis
gaucaccaccgcauuuuca

SEQ ID NO: 4154201 - RNA, 16 nt, Yersinia pestis
gaucacuggcauugca

SEQ ID NO: 4154202 - RNA, 20 nt, Yersinia pestis
gaucagacggcccacgauua

SEQ ID NO: 4154203 - RNA, 17 nt, Yersinia pestis
gaucagccaucagcgcc

SEQ ID NO: 4154204 - RNA, 17 nt, Yersinia pestis
gaucagcgccugcuguu

SEQ ID NO: 4154205 - RNA, 17 nt, Yersinia pestis
gaucagcguauaaaacu

SEQ ID NO: 4154206 - RNA, 22 nt, Yersinia pestis
gaucagguuguccgaagagaaa

SEQ ID NO: 4154207 - RNA, 15 nt, Yersinia pestis
gaucagugccaguaa

SEQ ID NO: 4154208 - RNA, 22 nt, Yersinia pestis
gaucaguggcuuaauugaagca

SEQ ID NO: 4154209 - RNA, 13 nt, Yersinia pestis
gaucaguggggua

SEQ ID NO: 4154210 - RNA, 15 nt, Yersinia pestis
gaucaguuugccuug

SEQ ID NO: 4154211 - RNA, 15 nt, Yersinia pestis
gaucaucaaccagaa

SEQ ID NO: 4154212 - RNA, 14 nt, Yersinia pestis
gaucaucaucaaug

SEQ ID NO: 4154213 - RNA, 21 nt, Yersinia pestis
gaucauccgcucagcaaaaau

SEQ ID NO: 4154214 - RNA, 13 nt, Yersinia pestis
gaucaucugguga

SEQ ID NO: 4154215 - RNA, 22 nt, Yersinia pestis
gaucaucugguuuuuuuauaaa

SEQ ID NO: 4154216 - RNA, 22 nt, Yersinia pestis
gaucauggcuugugcagcaaua

SEQ ID NO: 4154217 - RNA, 16 nt, Yersinia pestis
gaucaugguagagcug

SEQ ID NO: 4154218 - RNA, 12 nt, Yersinia pestis
gaucauucuagc

SEQ ID NO: 4154219 - RNA, 20 nt, Yersinia pestis
gaucauuucccccaccugau

SEQ ID NO: 4154220 - RNA, 16 nt, Yersinia pestis
gauccacauucugugu

SEQ ID NO: 4154221 - RNA, 14 nt, Yersinia pestis
gauccaccacauca

SEQ ID NO: 4154222 - RNA, 16 nt, Yersinia pestis
gauccacuacuuauuu

SEQ ID NO: 4154223 - RNA, 18 nt, Yersinia pestis
gauccagaauuucauugu

SEQ ID NO: 4154224 - RNA, 14 nt, Yersinia pestis
gauccagugaaauc

SEQ ID NO: 4154225 - RNA, 15 nt, Yersinia pestis
gauccagugaaauca

SEQ ID NO: 4154226 - RNA, 17 nt, Yersinia pestis
gauccaguucaguccag

SEQ ID NO: 4154227 - RNA, 15 nt, Yersinia pestis
gauccaguuucagug

SEQ ID NO: 4154228 - RNA, 20 nt, Yersinia pestis
gauccaguuucaguggcuuc

SEQ ID NO: 4154229 - RNA, 14 nt, Yersinia pestis
gauccauaggaucu

SEQ ID NO: 4154230 - RNA, 16 nt, Yersinia pestis
gaucccaagcaggaaa

SEQ ID NO: 4154231 - RNA, 19 nt, Yersinia pestis
gaucccagagauggcgauc

SEQ ID NO: 4154232 - RNA, 23 nt, Yersinia pestis
gaucccgguauaaguacuuucaa

SEQ ID NO: 4154233 - RNA, 20 nt, Yersinia pestis
gaucccucggugauaaguuu

SEQ ID NO: 4154234 - RNA, 21 nt, Yersinia pestis
gauccgauaaacuucacaaug

SEQ ID NO: 4154235 - RNA, 21 nt, Yersinia pestis
gauccgauaauaauuccauga

SEQ ID NO: 4154236 - RNA, 14 nt, Yersinia pestis
gauccgccugcugg

SEQ ID NO: 4154237 - RNA, 16 nt, Yersinia pestis
gauccguuuaaucagu

SEQ ID NO: 4154238 - RNA, 18 nt, Yersinia pestis
gauccuaggcggugaggg

SEQ ID NO: 4154239 - RNA, 14 nt, Yersinia pestis
gaucgaaugaucag

SEQ ID NO: 4154240 - RNA, 13 nt, Yersinia pestis
gaucgccaaauaa

SEQ ID NO: 4154241 - RNA, 17 nt, Yersinia pestis
gaucgccgccaauguuu

SEQ ID NO: 4154242 - RNA, 16 nt, Yersinia pestis
gaucguaaagacgccg

SEQ ID NO: 4154243 - RNA, 17 nt, Yersinia pestis
gaucguccggcagggug

SEQ ID NO: 4154244 - RNA, 14 nt, Yersinia pestis
gaucuaaaaaauau

SEQ ID NO: 4154245 - RNA, 19 nt, Yersinia pestis
gaucuaacguccccugagc

SEQ ID NO: 4154246 - RNA, 18 nt, Yersinia pestis
gaucuauuugcuguugua

SEQ ID NO: 4154247 - RNA, 15 nt, Yersinia pestis
gaucuccuccagaau

SEQ ID NO: 4154248 - RNA, 16 nt, Yersinia pestis
gaucucuuuauauuca

SEQ ID NO: 4154249 - RNA, 17 nt, Yersinia pestis
gaucucuuuauauucaa

SEQ ID NO: 4154250 - RNA, 19 nt, Yersinia pestis
gaucugaaacggugaggau

SEQ ID NO: 4154251 - RNA, 20 nt, Yersinia pestis
gaucugacauuugcaucuau

SEQ ID NO: 4154252 - RNA, 22 nt, Yersinia pestis
gaucugcccccccuuucaccaa

SEQ ID NO: 4154253 - RNA, 20 nt, Yersinia pestis
gaucugccccuggcucagua

SEQ ID NO: 4154254 - RNA, 23 nt, Yersinia pestis
gaucugccccuggcucaguagca

SEQ ID NO: 4154255 - RNA, 18 nt, Yersinia pestis
gaucugccuguucucucc

SEQ ID NO: 4154256 - RNA, 13 nt, Yersinia pestis
gaucuggcaaaau

SEQ ID NO: 4154257 - RNA, 21 nt, Yersinia pestis
gaucuggcuuucucaacagca

SEQ ID NO: 4154258 - RNA, 16 nt, Yersinia pestis
gaucuucauugccuuc

SEQ ID NO: 4154259 - RNA, 17 nt, Yersinia pestis
gaucuucauugccuucu

SEQ ID NO: 4154260 - RNA, 15 nt, Yersinia pestis
gaucuuguucaccaa

SEQ ID NO: 4154261 - RNA, 22 nt, Yersinia pestis
gaucuuuggccccgcgcuaacc

SEQ ID NO: 4154262 - RNA, 13 nt, Yersinia pestis
gaugaaaaacugu

SEQ ID NO: 4154263 - RNA, 11 nt, Yersinia pestis
gaugaaaaaua

SEQ ID NO: 4154264 - RNA, 13 nt, Yersinia pestis
gaugaaacacaac

SEQ ID NO: 4154265 - RNA, 20 nt, Yersinia pestis
gaugaaauccagaucagcgc

SEQ ID NO: 4154266 - RNA, 24 nt, Yersinia pestis
gaugaaauuuuauucgcguuucau

SEQ ID NO: 4154267 - RNA, 14 nt, Yersinia pestis
gaugaacacagaaa

SEQ ID NO: 4154268 - RNA, 19 nt, Yersinia pestis
gauuuucaugauccacaau

SEQ ID NO: 4154269 - RNA, 14 nt, Yersinia pestis
gauuuuccgcagcu

SEQ ID NO: 4154270 - RNA, 10 nt, Yersinia pestis
gauuuugcug

SEQ ID NO: 4154271 - RNA, 14 nt, Yersinia pestis
gauuuuuuugcuuu

SEQ ID NO: 4154272 - RNA, 17 nt, Yersinia pestis
gcaaaaaaagacacuaa

SEQ ID NO: 4154273 - RNA, 21 nt, Yersinia pestis
gcaaaaacaaauaauuaggau

SEQ ID NO: 4154274 - RNA, 20 nt, Yersinia pestis
gcaaaaacagucauuaacac

SEQ ID NO: 4154275 - RNA, 21 nt, Yersinia pestis
gcaaaaacagucauuaacaca

SEQ ID NO: 4154276 - RNA, 17 nt, Yersinia pestis
gcaaaacacucagauca

SEQ ID NO: 4154277 - RNA, 23 nt, Yersinia pestis
gcaaaacggccaguaaucaaaca

SEQ ID NO: 4154278 - RNA, 20 nt, Yersinia pestis
gcaaaacugggcuugagagu

SEQ ID NO: 4154279 - RNA, 17 nt, Yersinia pestis
gcaaaaucccagcagca

SEQ ID NO: 4154280 - RNA, 13 nt, Yersinia pestis
gcaaaaugccaac

SEQ ID NO: 4154281 - RNA, 20 nt, Yersinia pestis
gcaaacaggcccacugcaac

SEQ ID NO: 4154282 - RNA, 18 nt, Yersinia pestis
gcaaaccugguuugcgcc

SEQ ID NO: 4154283 - RNA, 15 nt, Yersinia pestis
gcaaacgaacgaaua

SEQ ID NO: 4154284 - RNA, 23 nt, Yersinia pestis
gcaaacgccgcucuucagcauca

SEQ ID NO: 4154285 - RNA, 21 nt, Yersinia pestis
gcaaagacuuuuccaacggcu

SEQ ID NO: 4154286 - RNA, 21 nt, Yersinia pestis
gcaaaggcccgcuaucacuag

SEQ ID NO: 4154287 - RNA, 14 nt, Yersinia pestis
gcaaagggcaacaa

SEQ ID NO: 4154288 - RNA, 22 nt, Yersinia pestis
gcaaaguauuuauacauaccac

SEQ ID NO: 4154289 - RNA, 14 nt, Yersinia pestis
gcaaagucaucaaa

SEQ ID NO: 4154290 - RNA, 15 nt, Yersinia pestis
gcaaauaaacaaaau

SEQ ID NO: 4154291 - RNA, 14 nt, Yersinia pestis
gcaaaucaaacaaa

SEQ ID NO: 4154292 - RNA, 18 nt, Yersinia pestis
gcaaaucauaaaucaagg

SEQ ID NO: 4154293 - RNA, 23 nt, Yersinia pestis
gcaaaucgauacugccaucauca

SEQ ID NO: 4154294 - RNA, 19 nt, Yersinia pestis
gcaaauuaacacaucaaaa

SEQ ID NO: 4154295 - RNA, 15 nt, Yersinia pestis
gcaaauuaccaccac

SEQ ID NO: 4154296 - RNA, 15 nt, Yersinia pestis
gcaaauucccaccau

SEQ ID NO: 4154297 - RNA, 12 nt, Yersinia pestis
gcaaauuuaucc

SEQ ID NO: 4154298 - RNA, 14 nt, Yersinia pestis
gcaaauuuauccaa

SEQ ID NO: 4154299 - RNA, 23 nt, Yersinia pestis
gcaaauuuaugcgcuuucucgac

SEQ ID NO: 4154300 - RNA, 18 nt, Yersinia pestis
gcaacaaacagccgauca

SEQ ID NO: 4154301 - RNA, 15 nt, Yersinia pestis
gcaacaaccccauga

SEQ ID NO: 4154302 - RNA, 15 nt, Yersinia pestis
gcaacaauaaagcgg

SEQ ID NO: 4154303 - RNA, 16 nt, Yersinia pestis
gcaacaauaaagcggu

SEQ ID NO: 4154304 - RNA, 17 nt, Yersinia pestis
gcaacacaucuuccagu

SEQ ID NO: 4154305 - RNA, 20 nt, Yersinia pestis
gcaacagcguaauaccacua

SEQ ID NO: 4154306 - RNA, 22 nt, Yersinia pestis
gcaacaucaggccuucuuuucu

SEQ ID NO: 4154307 - RNA, 21 nt, Yersinia pestis
gcaaccaaucguugcugguua

SEQ ID NO: 4154308 - RNA, 16 nt, Yersinia pestis
gcaaccacuuauccag

SEQ ID NO: 4154309 - RNA, 15 nt, Yersinia pestis
gcaaccauauuaaac

SEQ ID NO: 4154310 - RNA, 21 nt, Yersinia pestis
gcaacgaaaugucgaaagaua

SEQ ID NO: 4154311 - RNA, 13 nt, Yersinia pestis
gcaacgguaaaag

SEQ ID NO: 4154312 - RNA, 24 nt, Yersinia pestis
gcaacucacugaauauccguucag

SEQ ID NO: 4154313 - RNA, 18 nt, Yersinia pestis
gcaacuccuuaccacugc

SEQ ID NO: 4154314 - RNA, 21 nt, Yersinia pestis
gcaacucuagcgccagcaauu

SEQ ID NO: 4154315 - RNA, 19 nt, Yersinia pestis
gcaacuguaaugccccacu

SEQ ID NO: 4154316 - RNA, 23 nt, Yersinia pestis
gcaacuguaaugccccacuucac

SEQ ID NO: 4154317 - RNA, 17 nt, Yersinia pestis
gcaacuucuacauagaa

SEQ ID NO: 4154318 - RNA, 22 nt, Yersinia pestis
gcaagaaacucccuucaaucaa

SEQ ID NO: 4154319 - RNA, 20 nt, Yersinia pestis
gcaagaaacuucauuucagg

SEQ ID NO: 4154320 - RNA, 21 nt, Yersinia pestis
gcaagaaagaaaaauagacuc

SEQ ID NO: 4154321 - RNA, 20 nt, Yersinia pestis
gcaagaacaauccauccggu

SEQ ID NO: 4154322 - RNA, 21 nt, Yersinia pestis
gcaagaacauuuccacaauca

SEQ ID NO: 4154323 - RNA, 14 nt, Yersinia pestis
gcaagaauaacugg

SEQ ID NO: 4154324 - RNA, 14 nt, Yersinia pestis
gcaagcugugccug

SEQ ID NO: 4154325 - RNA, 13 nt, Yersinia pestis
gcaaggaagucca

SEQ ID NO: 4154326 - RNA, 20 nt, Yersinia pestis
gcaaggauaccaaucccuac

SEQ ID NO: 4154327 - RNA, 20 nt, Yersinia pestis
gcaaggauuccccccaguca

SEQ ID NO: 4154328 - RNA, 17 nt, Yersinia pestis
gcaaggcguacaucucu

SEQ ID NO: 4154329 - RNA, 21 nt, Yersinia pestis
gcaaguggggggagugugccg

SEQ ID NO: 4154330 - RNA, 19 nt, Yersinia pestis
gcaauaaacucauaccgaa

SEQ ID NO: 4154331 - RNA, 20 nt, Yersinia pestis
gcaauaaagcgucagaugcu

SEQ ID NO: 4154332 - RNA, 14 nt, Yersinia pestis
gcaauaaauucaaa

SEQ ID NO: 4154333 - RNA, 22 nt, Yersinia pestis
gcaauaacaaacacauccagga

SEQ ID NO: 4154334 - RNA, 15 nt, Yersinia pestis
gcaauaacaccagca

SEQ ID NO: 4154335 - RNA, 15 nt, Yersinia pestis
gcaauaaccaacggg

SEQ ID NO: 4154336 - RNA, 18 nt, Yersinia pestis
gcaauaacgugaugguau

SEQ ID NO: 4154337 - RNA, 18 nt, Yersinia pestis
gcaauaacguuuaccgcu

SEQ ID NO: 4154338 - RNA, 20 nt, Yersinia pestis
gcaauaaggugccacacaga

SEQ ID NO: 4154339 - RNA, 19 nt, Yersinia pestis
gcaauaauuagauugacac

SEQ ID NO: 4154340 - RNA, 14 nt, Yersinia pestis
gcaauaccagccga

SEQ ID NO: 4154341 - RNA, 20 nt, Yersinia pestis
gcaauagcgaucacggguuu

SEQ ID NO: 4154342 - RNA, 22 nt, Yersinia pestis
gcaauagcgaucacggguuuuu

SEQ ID NO: 4154343 - RNA, 17 nt, Yersinia pestis
gcaauauaauaaucuau

SEQ ID NO: 4154344 - RNA, 21 nt, Yersinia pestis
gcaauauugucuuaugauaua

SEQ ID NO: 4154345 - RNA, 14 nt, Yersinia pestis
gcaaucaauaagcu

SEQ ID NO: 4154346 - RNA, 21 nt, Yersinia pestis
gcaaucaauguauugcuccag

SEQ ID NO: 4154347 - RNA, 22 nt, Yersinia pestis
gcaaucaauguauugcuccaga

SEQ ID NO: 4154348 - RNA, 14 nt, Yersinia pestis
gcaauccgcugaca

SEQ ID NO: 4154349 - RNA, 19 nt, Yersinia pestis
gcaauccgcugacauugcc

SEQ ID NO: 4154350 - RNA, 18 nt, Yersinia pestis
gcaaucuccaguaaaucu

SEQ ID NO: 4154351 - RNA, 12 nt, Yersinia pestis
gcaaugaaagug

SEQ ID NO: 4154352 - RNA, 22 nt, Yersinia pestis
gcaaugagacaagagcaauggc

SEQ ID NO: 4154353 - RNA, 17 nt, Yersinia pestis
gcaaugcagauaaccgu

SEQ ID NO: 4154354 - RNA, 20 nt, Yersinia pestis
gcaaugcuccagcaacugaa

SEQ ID NO: 4154355 - RNA, 17 nt, Yersinia pestis
gcaaugcuuauuucaca

SEQ ID NO: 4154356 - RNA, 21 nt, Yersinia pestis
gcaaugcuuauuucacacugu

SEQ ID NO: 4154357 - RNA, 14 nt, Yersinia pestis
gcaauggcgaugag

SEQ ID NO: 4154358 - RNA, 16 nt, Yersinia pestis
gcaauggcgauugugc

SEQ ID NO: 4154359 - RNA, 19 nt, Yersinia pestis
gcaauggcgcgucaucgcg

SEQ ID NO: 4154360 - RNA, 17 nt, Yersinia pestis
gcaauggcguuccaaua

SEQ ID NO: 4154361 - RNA, 17 nt, Yersinia pestis
gcaauggcuaauuagau

SEQ ID NO: 4154362 - RNA, 20 nt, Yersinia pestis
gcaauggcucaggcucauca

SEQ ID NO: 4154363 - RNA, 13 nt, Yersinia pestis
gcaauuaauacaa

SEQ ID NO: 4154364 - RNA, 17 nt, Yersinia pestis
gcaauuauaagcacaac

SEQ ID NO: 4154365 - RNA, 18 nt, Yersinia pestis
gcaauuaugacguucagu

SEQ ID NO: 4154366 - RNA, 18 nt, Yersinia pestis
gcaauucagccucauaca

SEQ ID NO: 4154367 - RNA, 12 nt, Yersinia pestis
gcaauuucucug

SEQ ID NO: 4154368 - RNA, 23 nt, Yersinia pestis
gcaauuucuguuaccagaaaacc

SEQ ID NO: 4154369 - RNA, 12 nt, Yersinia pestis
gcaauuugccgc

SEQ ID NO: 4154370 - RNA, 16 nt, Yersinia pestis
gcaauuuuuagccaaa

SEQ ID NO: 4154371 - RNA, 19 nt, Yersinia pestis
gcacaaagcuuacuguuca

SEQ ID NO: 4154372 - RNA, 18 nt, Yersinia pestis
gcacaacaaauggguuau

SEQ ID NO: 4154373 - RNA, 21 nt, Yersinia pestis
gcacaacgcucuaacgucaga

SEQ ID NO: 4154374 - RNA, 14 nt, Yersinia pestis
gcacaaucagggca

SEQ ID NO: 4154375 - RNA, 21 nt, Yersinia pestis
gcacaauccaauuuaccacua

SEQ ID NO: 4154376 - RNA, 24 nt, Yersinia pestis
gcacaaucucguuaucagccacau

SEQ ID NO: 4154377 - RNA, 23 nt, Yersinia pestis
gcacaaugacuuaacugaaagcc

SEQ ID NO: 4154378 - RNA, 19 nt, Yersinia pestis
gcacaaugccuaaaauggc

SEQ ID NO: 4154379 - RNA, 13 nt, Yersinia pestis
gcacaaugguuga

SEQ ID NO: 4154380 - RNA, 22 nt, Yersinia pestis
gcacaauuugguagaacugcgg

SEQ ID NO: 4154381 - RNA, 16 nt, Yersinia pestis
gcacacacagccuacg

SEQ ID NO: 4154382 - RNA, 19 nt, Yersinia pestis
gcacacagaugcuggcuuu

SEQ ID NO: 4154383 - RNA, 14 nt, Yersinia pestis
gcacacagcccugc

SEQ ID NO: 4154384 - RNA, 20 nt, Yersinia pestis
gcacacaguuauuaggcauu

SEQ ID NO: 4154385 - RNA, 14 nt, Yersinia pestis
gcacacaucugucg

SEQ ID NO: 4154386 - RNA, 14 nt, Yersinia pestis
gcacaccagaaccg

SEQ ID NO: 4154387 - RNA, 19 nt, Yersinia pestis
gcacaccgcuacaggcgca

SEQ ID NO: 4154388 - RNA, 14 nt, Yersinia pestis
gcacacgauuaccu

SEQ ID NO: 4154389 - RNA, 16 nt, Yersinia pestis
gcagauguaaccaccc

SEQ ID NO: 4154390 - RNA, 16 nt, Yersinia pestis
gcagcaaaaccaagcu

SEQ ID NO: 4154391 - RNA, 20 nt, Yersinia pestis
gcagcaaaagguaucgcagu

SEQ ID NO: 4154392 - RNA, 22 nt, Yersinia pestis
gcagcaaacgcacaacaaaugg

SEQ ID NO: 4154393 - RNA, 13 nt, Yersinia pestis
gcagcagagaaug

SEQ ID NO: 4154394 - RNA, 13 nt, Yersinia pestis
gcagcaggucucg

SEQ ID NO: 4154395 - RNA, 13 nt, Yersinia pestis
gcagcauccagcu

SEQ ID NO: 4154396 - RNA, 18 nt, Yersinia pestis
gcagcaucccaaugaaua

SEQ ID NO: 4154397 - RNA, 17 nt, Yersinia pestis
gcagccaauuacgcugc

SEQ ID NO: 4154398 - RNA, 15 nt, Yersinia pestis
gcagcccuuauucaa

SEQ ID NO: 4154399 - RNA, 20 nt, Yersinia pestis
gcagcccuuauucaaagaau

SEQ ID NO: 4154400 - RNA, 10 nt, Yersinia pestis
gcagccgccg

SEQ ID NO: 4154401 - RNA, 19 nt, Yersinia pestis
gcagccuuuauccaaccac

SEQ ID NO: 4154402 - RNA, 15 nt, Yersinia pestis
gcagcgagcacugcc

SEQ ID NO: 4154403 - RNA, 18 nt, Yersinia pestis
gcagcggcuagcagcagg

SEQ ID NO: 4154404 - RNA, 17 nt, Yersinia pestis
gcagcguauucaguaaa

SEQ ID NO: 4154405 - RNA, 22 nt, Yersinia pestis
gcagcguuuuuagugcugccag

SEQ ID NO: 4154406 - RNA, 16 nt, Yersinia pestis
gcagcucaaaaucuuc

SEQ ID NO: 4154407 - RNA, 14 nt, Yersinia pestis
gcaggaaacaugcu

SEQ ID NO: 4154408 - RNA, 18 nt, Yersinia pestis
gcaggaagauaucgcuac

SEQ ID NO: 4154409 - RNA, 11 nt, Yersinia pestis
gcaggaagcaa

SEQ ID NO: 4154410 - RNA, 16 nt, Yersinia pestis
gcaggaagcaaugaaa

SEQ ID NO: 4154411 - RNA, 17 nt, Yersinia pestis
gcaggaguugguggcac

SEQ ID NO: 4154412 - RNA, 20 nt, Yersinia pestis
gcaggaucuggauuuuccag

SEQ ID NO: 4154413 - RNA, 12 nt, Yersinia pestis
gcaggcaaacaa

SEQ ID NO: 4154414 - RNA, 22 nt, Yersinia pestis
gcaggcaaacaaugugccgcgc

SEQ ID NO: 4154415 - RNA, 18 nt, Yersinia pestis
gcaggcacugcagaaaau

SEQ ID NO: 4154416 - RNA, 20 nt, Yersinia pestis
gcaggccagcgacauggcgc

SEQ ID NO: 4154417 - RNA, 23 nt, Yersinia pestis
gcaggccauuggcaaaggccagc

SEQ ID NO: 4154418 - RNA, 21 nt, Yersinia pestis
gcaggccccaucauaaaggcu

SEQ ID NO: 4154419 - RNA, 16 nt, Yersinia pestis
gcaggcugucaggaac

SEQ ID NO: 4154420 - RNA, 15 nt, Yersinia pestis
gcaggcuucaacuac

SEQ ID NO: 4154421 - RNA, 12 nt, Yersinia pestis
gcaggcuuucac

SEQ ID NO: 4154422 - RNA, 21 nt, Yersinia pestis
gcagggccgcccagauaaaga

SEQ ID NO: 4154423 - RNA, 19 nt, Yersinia pestis
gcagggccgguuaauugaa

SEQ ID NO: 4154424 - RNA, 14 nt, Yersinia pestis
gcagggcgacauua

SEQ ID NO: 4154425 - RNA, 15 nt, Yersinia pestis
gcagguaaugcauuc

SEQ ID NO: 4154426 - RNA, 21 nt, Yersinia pestis
gcaggucaaagaagcgcagga

SEQ ID NO: 4154427 - RNA, 22 nt, Yersinia pestis
gcaggucucgcaaugaaagugg

SEQ ID NO: 4154428 - RNA, 13 nt, Yersinia pestis
gcaggucugcaug

SEQ ID NO: 4154429 - RNA, 12 nt, Yersinia pestis
gcagguggaucc

SEQ ID NO: 4154430 - RNA, 13 nt, Yersinia pestis
gcaggugguuaaa

SEQ ID NO: 4154431 - RNA, 17 nt, Yersinia pestis
gcaggugguuaaacuga

SEQ ID NO: 4154432 - RNA, 22 nt, Yersinia pestis
gcaggugguuaaacugacauua

SEQ ID NO: 4154433 - RNA, 15 nt, Yersinia pestis
gcagguguaaauuuc

SEQ ID NO: 4154434 - RNA, 20 nt, Yersinia pestis
gcagguucggcgcaaucaua

SEQ ID NO: 4154435 - RNA, 15 nt, Yersinia pestis
gcaguaacgccauaa

SEQ ID NO: 4154436 - RNA, 20 nt, Yersinia pestis
gcaguaacggaauucagaac

SEQ ID NO: 4154437 - RNA, 15 nt, Yersinia pestis
gcaguaauagcaaaa

SEQ ID NO: 4154438 - RNA, 18 nt, Yersinia pestis
gcaguaucccuggcucau

SEQ ID NO: 4154439 - RNA, 20 nt, Yersinia pestis
gcagucaccuuuuuagcgag

SEQ ID NO: 4154440 - RNA, 21 nt, Yersinia pestis
gcagucagcaugguagccugc

SEQ ID NO: 4154441 - RNA, 13 nt, Yersinia pestis
gcaguccaaaaaa

SEQ ID NO: 4154442 - RNA, 16 nt, Yersinia pestis
gcagucuccaucacuc

SEQ ID NO: 4154443 - RNA, 23 nt, Yersinia pestis
gcagucugacagauacuuucggg

SEQ ID NO: 4154444 - RNA, 20 nt, Yersinia pestis
gcagucugagccucaugaau

SEQ ID NO: 4154445 - RNA, 17 nt, Yersinia pestis
gcagucugaggagccau

SEQ ID NO: 4154446 - RNA, 12 nt, Yersinia pestis
gcagucugaggc

SEQ ID NO: 4154447 - RNA, 18 nt, Yersinia pestis
gcagucugaggcccgcua

SEQ ID NO: 4154448 - RNA, 21 nt, Yersinia pestis
gcagucugagggccacuucgg

SEQ ID NO: 4154449 - RNA, 21 nt, Yersinia pestis
gcagugaaaagguuaacugca

SEQ ID NO: 4154450 - RNA, 15 nt, Yersinia pestis
gcagugacgcaguga

SEQ ID NO: 4154451 - RNA, 17 nt, Yersinia pestis
gcagugacgcagugacg

SEQ ID NO: 4154452 - RNA, 16 nt, Yersinia pestis
gcagugacgcagugau

SEQ ID NO: 4154453 - RNA, 22 nt, Yersinia pestis
gcagugauaaggccuuuuucug

SEQ ID NO: 4154454 - RNA, 17 nt, Yersinia pestis
gcagugaucaaugacuu

SEQ ID NO: 4154455 - RNA, 17 nt, Yersinia pestis
gcagugcagccaagauc

SEQ ID NO: 4154456 - RNA, 23 nt, Yersinia pestis
gcagugcaucuuccaauucauaa

SEQ ID NO: 4154457 - RNA, 19 nt, Yersinia pestis
gcagugcauugcagaaagc

SEQ ID NO: 4154458 - RNA, 19 nt, Yersinia pestis
gcagugcgcggcgccguca

SEQ ID NO: 4154459 - RNA, 15 nt, Yersinia pestis
gcagugcgggcaaca

SEQ ID NO: 4154460 - RNA, 20 nt, Yersinia pestis
gcagugcguaaucagccgcg

SEQ ID NO: 4154461 - RNA, 20 nt, Yersinia pestis
gcaguuaacgacgccccacu

SEQ ID NO: 4154462 - RNA, 18 nt, Yersinia pestis
gcaguuaagguuagcuau

SEQ ID NO: 4154463 - RNA, 14 nt, Yersinia pestis
gcaguuaaugacau

SEQ ID NO: 4154464 - RNA, 20 nt, Yersinia pestis
gcaguugccaaacaaacgcu

SEQ ID NO: 4154465 - RNA, 14 nt, Yersinia pestis
gcauaaaacgauuu

SEQ ID NO: 4154466 - RNA, 12 nt, Yersinia pestis
gcauaaacugaa

SEQ ID NO: 4154467 - RNA, 18 nt, Yersinia pestis
gcauaaacugaaguuaaa

SEQ ID NO: 4154468 - RNA, 20 nt, Yersinia pestis
gcauaaacugaaguuaaaaa

SEQ ID NO: 4154469 - RNA, 16 nt, Yersinia pestis
gcauaaagguuugcca

SEQ ID NO: 4154470 - RNA, 17 nt, Yersinia pestis
gcauaaagguuugccag

SEQ ID NO: 4154471 - RNA, 21 nt, Yersinia pestis
gcauaaauacgguucaaauca

SEQ ID NO: 4154472 - RNA, 20 nt, Yersinia pestis
gcauaaauauucauuaaaaa

SEQ ID NO: 4154473 - RNA, 21 nt, Yersinia pestis
gcauaaauauucauuaaaaaa

SEQ ID NO: 4154474 - RNA, 17 nt, Yersinia pestis
gcauaaccaaucaucac

SEQ ID NO: 4154475 - RNA, 21 nt, Yersinia pestis
gcauaaccgguaccggcuggg

SEQ ID NO: 4154476 - RNA, 17 nt, Yersinia pestis
gcauaagcgguuucaug

SEQ ID NO: 4154477 - RNA, 22 nt, Yersinia pestis
gcauaaguuaucgucacuggca

SEQ ID NO: 4154478 - RNA, 20 nt, Yersinia pestis
gcauaaucgcguucagagca

SEQ ID NO: 4154479 - RNA, 21 nt, Yersinia pestis
gcauaaucgcguucagagcag

SEQ ID NO: 4154480 - RNA, 16 nt, Yersinia pestis
gcauacaccuucuuaa

SEQ ID NO: 4154481 - RNA, 16 nt, Yersinia pestis
gcauacguugccagcc

SEQ ID NO: 4154482 - RNA, 11 nt, Yersinia pestis
gcauacucagg

SEQ ID NO: 4154483 - RNA, 15 nt, Yersinia pestis
gcauacuguuggcaa

SEQ ID NO: 4154484 - RNA, 24 nt, Yersinia pestis
gcauagccggagguuuuucauaug

SEQ ID NO: 4154485 - RNA, 17 nt, Yersinia pestis
gcauagcuaaccuuaac

SEQ ID NO: 4154486 - RNA, 23 nt, Yersinia pestis
gcauauacuggagcuauggaaga

SEQ ID NO: 4154487 - RNA, 12 nt, Yersinia pestis
gcauaugaaaaa

SEQ ID NO: 4154488 - RNA, 16 nt, Yersinia pestis
gcauaugaaaaaccuc

SEQ ID NO: 4154489 - RNA, 22 nt, Yersinia pestis
gcauaugaaaaaccuccggcua

SEQ ID NO: 4154490 - RNA, 15 nt, Yersinia pestis
gcauauguagccaga

SEQ ID NO: 4154491 - RNA, 17 nt, Yersinia pestis
gcauauuacccaguacu

SEQ ID NO: 4154492 - RNA, 19 nt, Yersinia pestis
gcauauuacccaguacugu

SEQ ID NO: 4154493 - RNA, 18 nt, Yersinia pestis
gcauauuguaaacuucca

SEQ ID NO: 4154494 - RNA, 17 nt, Yersinia pestis
gcauauuuuuagucuau

SEQ ID NO: 4154495 - RNA, 20 nt, Yersinia pestis
gcaucaaacggcaacuucua

SEQ ID NO: 4154496 - RNA, 16 nt, Yersinia pestis
gcaucaaccaagacau

SEQ ID NO: 4154497 - RNA, 14 nt, Yersinia pestis
gcaucaauaaaauu

SEQ ID NO: 4154498 - RNA, 16 nt, Yersinia pestis
gcaucaauaaauagag

SEQ ID NO: 4154499 - RNA, 15 nt, Yersinia pestis
gcaucaauaauaacg

SEQ ID NO: 4154500 - RNA, 14 nt, Yersinia pestis
gcaucaccaaagau

SEQ ID NO: 4154501 - RNA, 16 nt, Yersinia pestis
gcaucacuucauacac

SEQ ID NO: 4154502 - RNA, 22 nt, Yersinia pestis
gcaucacuucauacacggcggc

SEQ ID NO: 4154503 - RNA, 17 nt, Yersinia pestis
gcaucagacggcagcaa

SEQ ID NO: 4154504 - RNA, 13 nt, Yersinia pestis
gcaucagccagcc

SEQ ID NO: 4154505 - RNA, 13 nt, Yersinia pestis
gcaucagcccauu

SEQ ID NO: 4154506 - RNA, 19 nt, Yersinia pestis
gcaucaguaacuucucucc

SEQ ID NO: 4154507 - RNA, 12 nt, Yersinia pestis
gcaucauacuga

SEQ ID NO: 4154508 - RNA, 21 nt, Yersinia pestis
gcaucaucaguauugacgaug

SEQ ID NO: 4154509 - RNA, 22 nt, Yersinia pestis
gcaucauccagcucaacgaccc

SEQ ID NO: 4154510 - RNA, 17 nt, Yersinia pestis
gcaucauuaagaugcau

SEQ ID NO: 4154511 - RNA, 16 nt, Yersinia pestis
gccacugggcuacccg

SEQ ID NO: 4154512 - RNA, 21 nt, Yersinia pestis
gccacugguccgucuauccua

SEQ ID NO: 4154513 - RNA, 19 nt, Yersinia pestis
gccacuguucagaagcuga

SEQ ID NO: 4154514 - RNA, 18 nt, Yersinia pestis
gccacuucgguggcccug

SEQ ID NO: 4154515 - RNA, 22 nt, Yersinia pestis
gccacuucuuucacuaaugagg

SEQ ID NO: 4154516 - RNA, 18 nt, Yersinia pestis
gccacuuguagguuaaau

SEQ ID NO: 4154517 - RNA, 19 nt, Yersinia pestis
gccagaagaaaaucacuuc

SEQ ID NO: 4154518 - RNA, 18 nt, Yersinia pestis
gccagaauaucguggaga

SEQ ID NO: 4154519 - RNA, 23 nt, Yersinia pestis
gccagaaucacugucaaaaagca

SEQ ID NO: 4154520 - RNA, 15 nt, Yersinia pestis
gccagaaucagcccc

SEQ ID NO: 4154521 - RNA, 13 nt, Yersinia pestis
gccagacacaaug

SEQ ID NO: 4154522 - RNA, 19 nt, Yersinia pestis
gccagacacugacaucauc

SEQ ID NO: 4154523 - RNA, 23 nt, Yersinia pestis
gccagagaauuauuucucguggc

SEQ ID NO: 4154524 - RNA, 23 nt, Yersinia pestis
gccagagacauaaagcccgcuuc

SEQ ID NO: 4154525 - RNA, 21 nt, Yersinia pestis
gccagauaacgauaacuccag

SEQ ID NO: 4154526 - RNA, 16 nt, Yersinia pestis
gccagauagucaucuu

SEQ ID NO: 4154527 - RNA, 14 nt, Yersinia pestis
gccagauaucacuc

SEQ ID NO: 4154528 - RNA, 17 nt, Yersinia pestis
gccagaucaaugugguu

SEQ ID NO: 4154529 - RNA, 19 nt, Yersinia pestis
gccagauccguaccaccac

SEQ ID NO: 4154530 - RNA, 19 nt, Yersinia pestis
gccagauccucuuuauugg

SEQ ID NO: 4154531 - RNA, 17 nt, Yersinia pestis
gccagaugucccagaaa

SEQ ID NO: 4154532 - RNA, 21 nt, Yersinia pestis
gccagauucgcaaagcgggcc

SEQ ID NO: 4154533 - RNA, 13 nt, Yersinia pestis
gccagauucuagc

SEQ ID NO: 4154534 - RNA, 20 nt, Yersinia pestis
gccagauugccaaucagaac

SEQ ID NO: 4154535 - RNA, 19 nt, Yersinia pestis
gccagauugugcggcuggc

SEQ ID NO: 4154536 - RNA, 13 nt, Yersinia pestis
gccagcaaagaca

SEQ ID NO: 4154537 - RNA, 14 nt, Yersinia pestis
gccagcaaaucaca

SEQ ID NO: 4154538 - RNA, 21 nt, Yersinia pestis
gccagcaauguguugaaugac

SEQ ID NO: 4154539 - RNA, 18 nt, Yersinia pestis
gccagcaauuggccuucc

SEQ ID NO: 4154540 - RNA, 18 nt, Yersinia pestis
gccagcagaguaaagcag

SEQ ID NO: 4154541 - RNA, 19 nt, Yersinia pestis
gccagcagcaaguuagcga

SEQ ID NO: 4154542 - RNA, 21 nt, Yersinia pestis
gccagcagcaaguuagcgaua

SEQ ID NO: 4154543 - RNA, 18 nt, Yersinia pestis
gccagcagcauaaccagu

SEQ ID NO: 4154544 - RNA, 23 nt, Yersinia pestis
gccagcagcauaauacgaucagc

SEQ ID NO: 4154545 - RNA, 22 nt, Yersinia pestis
gccagccgcaaauaggggcacc

SEQ ID NO: 4154546 - RNA, 20 nt, Yersinia pestis
gccagccggugauuggggcu

SEQ ID NO: 4154547 - RNA, 14 nt, Yersinia pestis
gccagccucugcgc

SEQ ID NO: 4154548 - RNA, 17 nt, Yersinia pestis
gccagccuuaacugcau

SEQ ID NO: 4154549 - RNA, 23 nt, Yersinia pestis
gccagcgaaagucggugacucgg

SEQ ID NO: 4154550 - RNA, 19 nt, Yersinia pestis
gccagcgccccaucaauuu

SEQ ID NO: 4154551 - RNA, 13 nt, Yersinia pestis
gccagcgucauca

SEQ ID NO: 4154552 - RNA, 23 nt, Yersinia pestis
gccaggcacuguccgucaaacca

SEQ ID NO: 4154553 - RNA, 16 nt, Yersinia pestis
gccagggagggcgcgc

SEQ ID NO: 4154554 - RNA, 17 nt, Yersinia pestis
gccagggguaagaucca

SEQ ID NO: 4154555 - RNA, 23 nt, Yersinia pestis
gccagggguaagauccaccacau

SEQ ID NO: 4154556 - RNA, 17 nt, Yersinia pestis
gccagggucauucacgu

SEQ ID NO: 4154557 - RNA, 15 nt, Yersinia pestis
gccagguaagaaaga

SEQ ID NO: 4154558 - RNA, 21 nt, Yersinia pestis
gccagguaagaaagagaugac

SEQ ID NO: 4154559 - RNA, 14 nt, Yersinia pestis
gccaggucaggaag

SEQ ID NO: 4154560 - RNA, 21 nt, Yersinia pestis
gccaguaaacagccagcauca

SEQ ID NO: 4154561 - RNA, 22 nt, Yersinia pestis
gccaguaaacugcgcuuccagc

SEQ ID NO: 4154562 - RNA, 15 nt, Yersinia pestis
gccaguaaucaaaca

SEQ ID NO: 4154563 - RNA, 17 nt, Yersinia pestis
gccaguaauuaaugcca

SEQ ID NO: 4154564 - RNA, 21 nt, Yersinia pestis
gccaguagcaauaaggugcca

SEQ ID NO: 4154565 - RNA, 22 nt, Yersinia pestis
gccagugaaucagccagagaau

SEQ ID NO: 4154566 - RNA, 21 nt, Yersinia pestis
gccagugcaaaaugcucuuca

SEQ ID NO: 4154567 - RNA, 17 nt, Yersinia pestis
gccagugccgcggcggc

SEQ ID NO: 4154568 - RNA, 14 nt, Yersinia pestis
gccagugcuauuca

SEQ ID NO: 4154569 - RNA, 17 nt, Yersinia pestis
gccagugcuggcaacag

SEQ ID NO: 4154570 - RNA, 20 nt, Yersinia pestis
gccagugggauaucugcggu

SEQ ID NO: 4154571 - RNA, 15 nt, Yersinia pestis
gccaguuaauaccag

SEQ ID NO: 4154572 - RNA, 23 nt, Yersinia pestis
gccaguuuuagucucgcagccgc

SEQ ID NO: 4154573 - RNA, 12 nt, Yersinia pestis
gccauaaauaaa

SEQ ID NO: 4154574 - RNA, 16 nt, Yersinia pestis
gccauaaauaccaauu

SEQ ID NO: 4154575 - RNA, 14 nt, Yersinia pestis
gccauaacaucguu

SEQ ID NO: 4154576 - RNA, 14 nt, Yersinia pestis
gccauaaccagagc

SEQ ID NO: 4154577 - RNA, 17 nt, Yersinia pestis
gccauaaguaaagcgau

SEQ ID NO: 4154578 - RNA, 17 nt, Yersinia pestis
gccauaagugcacugaa

SEQ ID NO: 4154579 - RNA, 18 nt, Yersinia pestis
gccauaauccagaagcca

SEQ ID NO: 4154580 - RNA, 14 nt, Yersinia pestis
gccauacaguuaau

SEQ ID NO: 4154581 - RNA, 17 nt, Yersinia pestis
gccauacaucgcuggac

SEQ ID NO: 4154582 - RNA, 14 nt, Yersinia pestis
gccauaccaggcca

SEQ ID NO: 4154583 - RNA, 13 nt, Yersinia pestis
gccauagcugcug

SEQ ID NO: 4154584 - RNA, 12 nt, Yersinia pestis
gccaucaauaaa

SEQ ID NO: 4154585 - RNA, 17 nt, Yersinia pestis
gccaucaauaaagcugg

SEQ ID NO: 4154586 - RNA, 15 nt, Yersinia pestis
gccaucaggcaaaag

SEQ ID NO: 4154587 - RNA, 19 nt, Yersinia pestis
gccaucaggccgcugcgca

SEQ ID NO: 4154588 - RNA, 23 nt, Yersinia pestis
gccaucaucuucaaccuggaacc

SEQ ID NO: 4154589 - RNA, 15 nt, Yersinia pestis
gccauccugccaacg

SEQ ID NO: 4154590 - RNA, 21 nt, Yersinia pestis
gccauccuucagacugcugac

SEQ ID NO: 4154591 - RNA, 13 nt, Yersinia pestis
gccauccuuggcg

SEQ ID NO: 4154592 - RNA, 16 nt, Yersinia pestis
gccauccuuuugacug

SEQ ID NO: 4154593 - RNA, 21 nt, Yersinia pestis
gccaucgcaccaaacggaaug

SEQ ID NO: 4154594 - RNA, 20 nt, Yersinia pestis
gccaucgccgacaaaauccc

SEQ ID NO: 4154595 - RNA, 20 nt, Yersinia pestis
gccaugagaaccaguucugg

SEQ ID NO: 4154596 - RNA, 14 nt, Yersinia pestis
gccaugagguuuau

SEQ ID NO: 4154597 - RNA, 20 nt, Yersinia pestis
gccauggaauuuaugcacca

SEQ ID NO: 4154598 - RNA, 14 nt, Yersinia pestis
gccauggucaguuu

SEQ ID NO: 4154599 - RNA, 15 nt, Yersinia pestis
gccaugucgaucaug

SEQ ID NO: 4154600 - RNA, 21 nt, Yersinia pestis
gccauguguuuguuuggauaa

SEQ ID NO: 4154601 - RNA, 21 nt, Yersinia pestis
gccauuaaccuaaaaacguca

SEQ ID NO: 4154602 - RNA, 17 nt, Yersinia pestis
gccauuaugucgggagu

SEQ ID NO: 4154603 - RNA, 13 nt, Yersinia pestis
gccauucagcagc

SEQ ID NO: 4154604 - RNA, 16 nt, Yersinia pestis
gccauucuggcgcagg

SEQ ID NO: 4154605 - RNA, 22 nt, Yersinia pestis
gccauugagugcggccacacgg

SEQ ID NO: 4154606 - RNA, 16 nt, Yersinia pestis
gccauugauuggcucc

SEQ ID NO: 4154607 - RNA, 20 nt, Yersinia pestis
gccauugccgaaccugcaug

SEQ ID NO: 4154608 - RNA, 12 nt, Yersinia pestis
gccauugcucau

SEQ ID NO: 4154609 - RNA, 18 nt, Yersinia pestis
gccauuggcaaaggccag

SEQ ID NO: 4154610 - RNA, 19 nt, Yersinia pestis
gccauuggguauggucagc

SEQ ID NO: 4154611 - RNA, 18 nt, Yersinia pestis
gccauuguugaauaccaa

SEQ ID NO: 4154612 - RNA, 19 nt, Yersinia pestis
gccauuuacccgucauccu

SEQ ID NO: 4154613 - RNA, 16 nt, Yersinia pestis
gccauuucaaaacgcc

SEQ ID NO: 4154614 - RNA, 20 nt, Yersinia pestis
gccauuucaccaauauguuc

SEQ ID NO: 4154615 - RNA, 12 nt, Yersinia pestis
gccauuucuuag

SEQ ID NO: 4154616 - RNA, 21 nt, Yersinia pestis
gccauuugaacaaaccccacu

SEQ ID NO: 4154617 - RNA, 12 nt, Yersinia pestis
gccauuuugcug

SEQ ID NO: 4154618 - RNA, 14 nt, Yersinia pestis
gccauuuuggguuu

SEQ ID NO: 4154619 - RNA, 16 nt, Yersinia pestis
gcccaaaugagcagca

SEQ ID NO: 4154620 - RNA, 18 nt, Yersinia pestis
gcccaaaugagcagcaau

SEQ ID NO: 4154621 - RNA, 22 nt, Yersinia pestis
gcccaaccccccauugccaaau

SEQ ID NO: 4154622 - RNA, 23 nt, Yersinia pestis
gcccaacgucauuuccguuaacc

SEQ ID NO: 4154623 - RNA, 23 nt, Yersinia pestis
gcccaagauacuggaagaaaccc

SEQ ID NO: 4154624 - RNA, 16 nt, Yersinia pestis
gcccaauaagugaaac

SEQ ID NO: 4154625 - RNA, 21 nt, Yersinia pestis
gcccaauacggcacucaaaua

SEQ ID NO: 4154626 - RNA, 19 nt, Yersinia pestis
gcccacauaaagauagcca

SEQ ID NO: 4154627 - RNA, 20 nt, Yersinia pestis
gcccacauaaagauagccac

SEQ ID NO: 4154628 - RNA, 17 nt, Yersinia pestis
gcccagacgccggccgg

SEQ ID NO: 4154629 - RNA, 12 nt, Yersinia pestis
gcccagauggca

SEQ ID NO: 4154630 - RNA, 18 nt, Yersinia pestis
gcccagcaaggcgggcaa

SEQ ID NO: 4154631 - RNA, 14 nt, Yersinia pestis
gcccagccucugga

SEQ ID NO: 4154632 - RNA, 17 nt, Yersinia pestis
gccggaggauauuuauu

SEQ ID NO: 4154633 - RNA, 22 nt, Yersinia pestis
gccggagucuaucugcaguauu

SEQ ID NO: 4154634 - RNA, 20 nt, Yersinia pestis
gccggauuauuauucauagu

SEQ ID NO: 4154635 - RNA, 10 nt, Yersinia pestis
gccggcggcc

SEQ ID NO: 4154636 - RNA, 14 nt, Yersinia pestis
gccggcggcccaua

SEQ ID NO: 4154637 - RNA, 19 nt, Yersinia pestis
gccggcguuaaugccaccc

SEQ ID NO: 4154638 - RNA, 20 nt, Yersinia pestis
gccggcguuaaugccacccc

SEQ ID NO: 4154639 - RNA, 14 nt, Yersinia pestis
gccgggaugaucaa

SEQ ID NO: 4154640 - RNA, 13 nt, Yersinia pestis
gccgggcagcaag

SEQ ID NO: 4154641 - RNA, 13 nt, Yersinia pestis
gccgggucaggaa

SEQ ID NO: 4154642 - RNA, 18 nt, Yersinia pestis
gccgggucaggaagagaa

SEQ ID NO: 4154643 - RNA, 17 nt, Yersinia pestis
gccguaaauacauccau

SEQ ID NO: 4154644 - RNA, 13 nt, Yersinia pestis
gccguacaacaau

SEQ ID NO: 4154645 - RNA, 23 nt, Yersinia pestis
gccguaucuucugccagccccaa

SEQ ID NO: 4154646 - RNA, 22 nt, Yersinia pestis
gccgugagcaaucuggcggccg

SEQ ID NO: 4154647 - RNA, 15 nt, Yersinia pestis
gccgugggcaauaac

SEQ ID NO: 4154648 - RNA, 17 nt, Yersinia pestis
gccgugucggaugccgc

SEQ ID NO: 4154649 - RNA, 18 nt, Yersinia pestis
gccgugucgggccaauaa

SEQ ID NO: 4154650 - RNA, 19 nt, Yersinia pestis
gccguguugcaucauuggc

SEQ ID NO: 4154651 - RNA, 15 nt, Yersinia pestis
gccguuaaaaugagc

SEQ ID NO: 4154652 - RNA, 20 nt, Yersinia pestis
gccguuacccccgacgacuu

SEQ ID NO: 4154653 - RNA, 14 nt, Yersinia pestis
gccguuaucaauaa

SEQ ID NO: 4154654 - RNA, 18 nt, Yersinia pestis
gccguucucgauagagaa

SEQ ID NO: 4154655 - RNA, 11 nt, Yersinia pestis
gccguuggcaa

SEQ ID NO: 4154656 - RNA, 21 nt, Yersinia pestis
gccguuggcuaaauaaccaga

SEQ ID NO: 4154657 - RNA, 18 nt, Yersinia pestis
gccguuuacucgcaauac

SEQ ID NO: 4154658 - RNA, 20 nt, Yersinia pestis
gccguuuugcucgggcucuc

SEQ ID NO: 4154659 - RNA, 15 nt, Yersinia pestis
gccuaacaacacgcu

SEQ ID NO: 4154660 - RNA, 14 nt, Yersinia pestis
gccuaccugccugc

SEQ ID NO: 4154661 - RNA, 16 nt, Yersinia pestis
gccuacguucaggccc

SEQ ID NO: 4154662 - RNA, 20 nt, Yersinia pestis
gccuaggaucgaaugaucag

SEQ ID NO: 4154663 - RNA, 23 nt, Yersinia pestis
gccuauaaggcucuguuaccagc

SEQ ID NO: 4154664 - RNA, 17 nt, Yersinia pestis
gccuaucugaaugaauu

SEQ ID NO: 4154665 - RNA, 22 nt, Yersinia pestis
gccuauuaagauaauuauccau

SEQ ID NO: 4154666 - RNA, 23 nt, Yersinia pestis
gccuauuaagauaauuauccauu

SEQ ID NO: 4154667 - RNA, 21 nt, Yersinia pestis
gccuauuggauagguuggguu

SEQ ID NO: 4154668 - RNA, 22 nt, Yersinia pestis
gccuauuguuuaugaguucugc

SEQ ID NO: 4154669 - RNA, 15 nt, Yersinia pestis
gccuauuucagggcg

SEQ ID NO: 4154670 - RNA, 17 nt, Yersinia pestis
gccuauuugcagaaagu

SEQ ID NO: 4154671 - RNA, 19 nt, Yersinia pestis
gccuauuugcagaaaguaa

SEQ ID NO: 4154672 - RNA, 13 nt, Yersinia pestis
gccucaaaaaccu

SEQ ID NO: 4154673 - RNA, 17 nt, Yersinia pestis
gccucaacgcaccccac

SEQ ID NO: 4154674 - RNA, 21 nt, Yersinia pestis
gccucacaacuuucccaguca

SEQ ID NO: 4154675 - RNA, 19 nt, Yersinia pestis
gccucacggcuaccagcag

SEQ ID NO: 4154676 - RNA, 18 nt, Yersinia pestis
gccucaucguaaccccca

SEQ ID NO: 4154677 - RNA, 17 nt, Yersinia pestis
gccucaucucaugacaa

SEQ ID NO: 4154678 - RNA, 19 nt, Yersinia pestis
gccucaugaaugaggcuga

SEQ ID NO: 4154679 - RNA, 20 nt, Yersinia pestis
gccuccaacuuaucacugga

SEQ ID NO: 4154680 - RNA, 17 nt, Yersinia pestis
gccucgaugcucaggcc

SEQ ID NO: 4154681 - RNA, 19 nt, Yersinia pestis
gccucgcggaaaucagcuu

SEQ ID NO: 4154682 - RNA, 16 nt, Yersinia pestis
gccucgcuuacuggua

SEQ ID NO: 4154683 - RNA, 17 nt, Yersinia pestis
gccucgcuuacugguac

SEQ ID NO: 4154684 - RNA, 20 nt, Yersinia pestis
gccucugaucauucgauccu

SEQ ID NO: 4154685 - RNA, 21 nt, Yersinia pestis
gccucugaucauucgauccua

SEQ ID NO: 4154686 - RNA, 12 nt, Yersinia pestis
gccucugcuccg

SEQ ID NO: 4154687 - RNA, 17 nt, Yersinia pestis
gccucugcugcugcccg

SEQ ID NO: 4154688 - RNA, 18 nt, Yersinia pestis
gccucuggccucgcccuu

SEQ ID NO: 4154689 - RNA, 13 nt, Yersinia pestis
gccucuucugucg

SEQ ID NO: 4154690 - RNA, 21 nt, Yersinia pestis
gccucuucugucggagccuga

SEQ ID NO: 4154691 - RNA, 17 nt, Yersinia pestis
gccugacugcccgccug

SEQ ID NO: 4154692 - RNA, 15 nt, Yersinia pestis
gccugagaacccaug

SEQ ID NO: 4154693 - RNA, 19 nt, Yersinia pestis
gccugagguucccaacggc

SEQ ID NO: 4154694 - RNA, 21 nt, Yersinia pestis
gccugagguucccaacggcag

SEQ ID NO: 4154695 - RNA, 21 nt, Yersinia pestis
gccugauaaaauuaccgcccc

SEQ ID NO: 4154696 - RNA, 14 nt, Yersinia pestis
gccugauacaccau

SEQ ID NO: 4154697 - RNA, 20 nt, Yersinia pestis
gccugaucgauaacccccaa

SEQ ID NO: 4154698 - RNA, 17 nt, Yersinia pestis
gccugcccagucuggcu

SEQ ID NO: 4154699 - RNA, 23 nt, Yersinia pestis
gccugcgcuaauacggcuugcaa

SEQ ID NO: 4154700 - RNA, 13 nt, Yersinia pestis
gccugcggcggcu

SEQ ID NO: 4154701 - RNA, 16 nt, Yersinia pestis
gccugcucaccgccga

SEQ ID NO: 4154702 - RNA, 15 nt, Yersinia pestis
gccuggaagcaaaag

SEQ ID NO: 4154703 - RNA, 15 nt, Yersinia pestis
gccuggcaggaagcc

SEQ ID NO: 4154704 - RNA, 21 nt, Yersinia pestis
gccuggcgcauaguuucaaua

SEQ ID NO: 4154705 - RNA, 22 nt, Yersinia pestis
gccuggcgcauaguuucaauau

SEQ ID NO: 4154706 - RNA, 23 nt, Yersinia pestis
gccugguugcccugaagcaacga

SEQ ID NO: 4154707 - RNA, 14 nt, Yersinia pestis
gccuguaccaccac

SEQ ID NO: 4154708 - RNA, 16 nt, Yersinia pestis
gccuguaccaccacca

SEQ ID NO: 4154709 - RNA, 23 nt, Yersinia pestis
gccuguaccaccaccaacagcau

SEQ ID NO: 4154710 - RNA, 19 nt, Yersinia pestis
gccuguauuauuaauguac

SEQ ID NO: 4154711 - RNA, 17 nt, Yersinia pestis
gccugucuuaggugaca

SEQ ID NO: 4154712 - RNA, 14 nt, Yersinia pestis
gccugugcgcuggu

SEQ ID NO: 4154713 - RNA, 18 nt, Yersinia pestis
gccuguuagggcgcggcu

SEQ ID NO: 4154714 - RNA, 19 nt, Yersinia pestis
gccuguuagggcgcggcug

SEQ ID NO: 4154715 - RNA, 23 nt, Yersinia pestis
gccuguuagggcgcggcugguaa

SEQ ID NO: 4154716 - RNA, 22 nt, Yersinia pestis
gccuuaaaugcguagagucagu

SEQ ID NO: 4154717 - RNA, 14 nt, Yersinia pestis
gccuuaaccaagca

SEQ ID NO: 4154718 - RNA, 22 nt, Yersinia pestis
gccuuaacccgcgggagucagu

SEQ ID NO: 4154719 - RNA, 23 nt, Yersinia pestis
gccuuaacugcauagcuaaccuu

SEQ ID NO: 4154720 - RNA, 23 nt, Yersinia pestis
gccuuagcacguuuuucagcuuc

SEQ ID NO: 4154721 - RNA, 15 nt, Yersinia pestis
gccuuauaggcgcau

SEQ ID NO: 4154722 - RNA, 19 nt, Yersinia pestis
gccuuauaggcgcauauga

SEQ ID NO: 4154723 - RNA, 17 nt, Yersinia pestis
gccuuaucagcgaaaaa

SEQ ID NO: 4154724 - RNA, 23 nt, Yersinia pestis
gccuuaucagcgaaaaauuucac

SEQ ID NO: 4154725 - RNA, 21 nt, Yersinia pestis
gccuucagcgauacaaccggc

SEQ ID NO: 4154726 - RNA, 20 nt, Yersinia pestis
gccuucagguaauuuauaga

SEQ ID NO: 4154727 - RNA, 15 nt, Yersinia pestis
gccuucauccagggu

SEQ ID NO: 4154728 - RNA, 17 nt, Yersinia pestis
gccuucccgcuugguua

SEQ ID NO: 4154729 - RNA, 17 nt, Yersinia pestis
gccuucguuugucaaug

SEQ ID NO: 4154730 - RNA, 13 nt, Yersinia pestis
gccuucugaaacc

SEQ ID NO: 4154731 - RNA, 14 nt, Yersinia pestis
gccuugaaucaaaa

SEQ ID NO: 4154732 - RNA, 11 nt, Yersinia pestis
gccuugccgcu

SEQ ID NO: 4154733 - RNA, 15 nt, Yersinia pestis
gccuuggucucagaa

SEQ ID NO: 4154734 - RNA, 22 nt, Yersinia pestis
gccuuguccaucacgcagcuuu

SEQ ID NO: 4154735 - RNA, 18 nt, Yersinia pestis
gccuugugggcaucuguc

SEQ ID NO: 4154736 - RNA, 13 nt, Yersinia pestis
gccuuuauucauu

SEQ ID NO: 4154737 - RNA, 14 nt, Yersinia pestis
gccuuuauucauuc

SEQ ID NO: 4154738 - RNA, 13 nt, Yersinia pestis
gccuuucccugaa

SEQ ID NO: 4154739 - RNA, 17 nt, Yersinia pestis
gccuuucguuucugucu

SEQ ID NO: 4154740 - RNA, 12 nt, Yersinia pestis
gccuuucugggc

SEQ ID NO: 4154741 - RNA, 16 nt, Yersinia pestis
gccuuuuaauuuucag

SEQ ID NO: 4154742 - RNA, 19 nt, Yersinia pestis
gcgaaaaauuucacuggca

SEQ ID NO: 4154743 - RNA, 15 nt, Yersinia pestis
gcgaaagacggauga

SEQ ID NO: 4154744 - RNA, 14 nt, Yersinia pestis
gcgaaaggaacaaa

SEQ ID NO: 4154745 - RNA, 11 nt, Yersinia pestis
gcgaacagcag

SEQ ID NO: 4154746 - RNA, 13 nt, Yersinia pestis
gcgaacaucaucc

SEQ ID NO: 4154747 - RNA, 21 nt, Yersinia pestis
gcgaacgaagucgauaugagu

SEQ ID NO: 4154748 - RNA, 23 nt, Yersinia pestis
gcgaagaacaacgggccguuuac

SEQ ID NO: 4154749 - RNA, 13 nt, Yersinia pestis
gcgaagaagagau

SEQ ID NO: 4154750 - RNA, 16 nt, Yersinia pestis
gcgaauaauggcagcc

SEQ ID NO: 4154751 - RNA, 15 nt, Yersinia pestis
gcgaaucacaucauu

SEQ ID NO: 4154752 - RNA, 18 nt, Yersinia pestis
gcgaauccccccauucac

SEQ ID NO: 4154753 - RNA, 21 nt, Yersinia pestis
gcgaaugcccugcuaauuuga

SEQ ID NO: 4154754 - RNA, 21 nt, Yersinia pestis
gcggccgucacugagcguggu

SEQ ID NO: 4154755 - RNA, 21 nt, Yersinia pestis
gcggccuuaauggccgccauu

SEQ ID NO: 4154756 - RNA, 22 nt, Yersinia pestis
gcggcgccgucacguacugggu

SEQ ID NO: 4154757 - RNA, 15 nt, Yersinia pestis
gcggcggccauccca

SEQ ID NO: 4154758 - RNA, 15 nt, Yersinia pestis
gcggcuacucgcucg

SEQ ID NO: 4154759 - RNA, 16 nt, Yersinia pestis
gcggcuccaggcauua

SEQ ID NO: 4154760 - RNA, 15 nt, Yersinia pestis
gcggcugguaacaga

SEQ ID NO: 4154761 - RNA, 18 nt, Yersinia pestis
gcggcugguaacagagcc

SEQ ID NO: 4154762 - RNA, 21 nt, Yersinia pestis
gcggcugguaacagagccuua

SEQ ID NO: 4154763 - RNA, 16 nt, Yersinia pestis
gcggcuuaccgccgcc

SEQ ID NO: 4154764 - RNA, 13 nt, Yersinia pestis
gcggcuucagcac

SEQ ID NO: 4154765 - RNA, 22 nt, Yersinia pestis
gcgggaguuugucgcucugggu

SEQ ID NO: 4154766 - RNA, 18 nt, Yersinia pestis
gcgggaucuccagaagca

SEQ ID NO: 4154767 - RNA, 19 nt, Yersinia pestis
gcgggcaguaacgccauaa

SEQ ID NO: 4154768 - RNA, 15 nt, Yersinia pestis
gcgggccagcaacca

SEQ ID NO: 4154769 - RNA, 13 nt, Yersinia pestis
gcgggccugaggu

SEQ ID NO: 4154770 - RNA, 12 nt, Yersinia pestis
gcgggcgcgcug

SEQ ID NO: 4154771 - RNA, 14 nt, Yersinia pestis
gcgggcuggccaca

SEQ ID NO: 4154772 - RNA, 19 nt, Yersinia pestis
gcgggggaacguggguggu

SEQ ID NO: 4154773 - RNA, 18 nt, Yersinia pestis
gcgggguauuuuacugau

SEQ ID NO: 4154774 - RNA, 20 nt, Yersinia pestis
gcggguuaucacauaaauaa

SEQ ID NO: 4154775 - RNA, 14 nt, Yersinia pestis
gcgguagugaugca

SEQ ID NO: 4154776 - RNA, 13 nt, Yersinia pestis
gcgguaguucagu

SEQ ID NO: 4154777 - RNA, 20 nt, Yersinia pestis
gcgguauuccgagcaaucaa

SEQ ID NO: 4154778 - RNA, 21 nt, Yersinia pestis
gcgguauugaucacgcucugu

SEQ ID NO: 4154779 - RNA, 13 nt, Yersinia pestis
gcggucacgcuga

SEQ ID NO: 4154780 - RNA, 18 nt, Yersinia pestis
gcggucacgcugauucaa

SEQ ID NO: 4154781 - RNA, 16 nt, Yersinia pestis
gcgguccuacccuuug

SEQ ID NO: 4154782 - RNA, 15 nt, Yersinia pestis
gcggugacaaugaau

SEQ ID NO: 4154783 - RNA, 18 nt, Yersinia pestis
gcggugaucaccagauca

SEQ ID NO: 4154784 - RNA, 22 nt, Yersinia pestis
gcgguggccagagcauagacga

SEQ ID NO: 4154785 - RNA, 14 nt, Yersinia pestis
gcgguggccgccuu

SEQ ID NO: 4154786 - RNA, 21 nt, Yersinia pestis
gcgguggucaauaucaccagu

SEQ ID NO: 4154787 - RNA, 18 nt, Yersinia pestis
gcgguuacguucaccuaa

SEQ ID NO: 4154788 - RNA, 19 nt, Yersinia pestis
gcgguuacguucaccuaaa

SEQ ID NO: 4154789 - RNA, 15 nt, Yersinia pestis
gcgguuaucuggaau

SEQ ID NO: 4154790 - RNA, 18 nt, Yersinia pestis
gcgguuccaaagcaccaa

SEQ ID NO: 4154791 - RNA, 15 nt, Yersinia pestis
gcgguugcgcuguug

SEQ ID NO: 4154792 - RNA, 15 nt, Yersinia pestis
gcgguugcuguggca

SEQ ID NO: 4154793 - RNA, 18 nt, Yersinia pestis
gcgguuggcccuuuucaa

SEQ ID NO: 4154794 - RNA, 20 nt, Yersinia pestis
gcgguugucggcauaacagg

SEQ ID NO: 4154795 - RNA, 23 nt, Yersinia pestis
gcgguuucaaccccuucuucacc

SEQ ID NO: 4154796 - RNA, 16 nt, Yersinia pestis
gcgguuucauggcugg

SEQ ID NO: 4154797 - RNA, 16 nt, Yersinia pestis
gcgguuuuaucaauag

SEQ ID NO: 4154798 - RNA, 18 nt, Yersinia pestis
gcguaaaauuagagcaaa

SEQ ID NO: 4154799 - RNA, 12 nt, Yersinia pestis
gcguaaagcacc

SEQ ID NO: 4154800 - RNA, 12 nt, Yersinia pestis
gcguaaauaaaa

SEQ ID NO: 4154801 - RNA, 14 nt, Yersinia pestis
gcguaacuccuuug

SEQ ID NO: 4154802 - RNA, 17 nt, Yersinia pestis
gcguaagccuucaaccu

SEQ ID NO: 4154803 - RNA, 16 nt, Yersinia pestis
gcguaauaggcugcgc

SEQ ID NO: 4154804 - RNA, 21 nt, Yersinia pestis
gcguacaucucuugggcgcag

SEQ ID NO: 4154805 - RNA, 22 nt, Yersinia pestis
gcguaccauaguuuuucuccua

SEQ ID NO: 4154806 - RNA, 13 nt, Yersinia pestis
gcguagagucagu

SEQ ID NO: 4154807 - RNA, 16 nt, Yersinia pestis
gcguagguuucagccu

SEQ ID NO: 4154808 - RNA, 19 nt, Yersinia pestis
gcguagguuucagccucug

SEQ ID NO: 4154809 - RNA, 13 nt, Yersinia pestis
gcguauaaacaga

SEQ ID NO: 4154810 - RNA, 14 nt, Yersinia pestis
gcguauaaacagag

SEQ ID NO: 4154811 - RNA, 20 nt, Yersinia pestis
gcgucaucagcauccgccaa

SEQ ID NO: 4154812 - RNA, 15 nt, Yersinia pestis
gcgucaucgcggcgc

SEQ ID NO: 4154813 - RNA, 13 nt, Yersinia pestis
gcguccgcgccaa

SEQ ID NO: 4154814 - RNA, 13 nt, Yersinia pestis
gcgucgccacccc

SEQ ID NO: 4154815 - RNA, 18 nt, Yersinia pestis
gcgucgccaccccauuac

SEQ ID NO: 4154816 - RNA, 18 nt, Yersinia pestis
gcgucgccguaaauugcu

SEQ ID NO: 4154817 - RNA, 22 nt, Yersinia pestis
gcgucucuacgacgcccgcaga

SEQ ID NO: 4154818 - RNA, 15 nt, Yersinia pestis
gcgucugauaaccgu

SEQ ID NO: 4154819 - RNA, 12 nt, Yersinia pestis
gcgucuucagug

SEQ ID NO: 4154820 - RNA, 18 nt, Yersinia pestis
gcgucuuuagauuucacc

SEQ ID NO: 4154821 - RNA, 18 nt, Yersinia pestis
gcgucuuuaucgccagcu

SEQ ID NO: 4154822 - RNA, 22 nt, Yersinia pestis
gcgugaaacgauaugcuccaga

SEQ ID NO: 4154823 - RNA, 22 nt, Yersinia pestis
gcgugauuccgguacugugcug

SEQ ID NO: 4154824 - RNA, 15 nt, Yersinia pestis
gcguggaugaccagu

SEQ ID NO: 4154825 - RNA, 16 nt, Yersinia pestis
gcguggugcgguaguu

SEQ ID NO: 4154826 - RNA, 15 nt, Yersinia pestis
gcguuaaccaguagc

SEQ ID NO: 4154827 - RNA, 14 nt, Yersinia pestis
gcguuauugagaag

SEQ ID NO: 4154828 - RNA, 20 nt, Yersinia pestis
gcguuauugcgacauaaagc

SEQ ID NO: 4154829 - RNA, 22 nt, Yersinia pestis
gcguucaauacaugguaccugu

SEQ ID NO: 4154830 - RNA, 21 nt, Yersinia pestis
gcguucagagcagcauuuuua

SEQ ID NO: 4154831 - RNA, 18 nt, Yersinia pestis
gcguuccaaucugcgccc

SEQ ID NO: 4154832 - RNA, 19 nt, Yersinia pestis
gcguuccuggauauucaua

SEQ ID NO: 4154833 - RNA, 16 nt, Yersinia pestis
gcguucugcaaacccu

SEQ ID NO: 4154834 - RNA, 20 nt, Yersinia pestis
gcguucuucugauucaauuu

SEQ ID NO: 4154835 - RNA, 20 nt, Yersinia pestis
gcguugagacacaaaaaaga

SEQ ID NO: 4154836 - RNA, 16 nt, Yersinia pestis
gcguugauccauccau

SEQ ID NO: 4154837 - RNA, 16 nt, Yersinia pestis
gcguugucagccaugc

SEQ ID NO: 4154838 - RNA, 23 nt, Yersinia pestis
gcguuuacucgcuccgagcgugc

SEQ ID NO: 4154839 - RNA, 22 nt, Yersinia pestis
gcguuucauuuuaacaauuuua

SEQ ID NO: 4154840 - RNA, 17 nt, Yersinia pestis
gcuaaacauccguucaa

SEQ ID NO: 4154841 - RNA, 16 nt, Yersinia pestis
gcuaaacguaaugcga

SEQ ID NO: 4154842 - RNA, 21 nt, Yersinia pestis
gcuaaagcguaagugcaauua

SEQ ID NO: 4154843 - RNA, 16 nt, Yersinia pestis
gcuaaauaaccagaga

SEQ ID NO: 4154844 - RNA, 14 nt, Yersinia pestis
gcuaaauacugcug

SEQ ID NO: 4154845 - RNA, 15 nt, Yersinia pestis
gcuaaauacugcugg

SEQ ID NO: 4154846 - RNA, 22 nt, Yersinia pestis
gcuaaauacugcuggaacguug

SEQ ID NO: 4154847 - RNA, 13 nt, Yersinia pestis
gcuaaaucaucaa

SEQ ID NO: 4154848 - RNA, 23 nt, Yersinia pestis
gcuaaauuaaccgccagucugaa

SEQ ID NO: 4154849 - RNA, 18 nt, Yersinia pestis
gcuaacaacuaacgauug

SEQ ID NO: 4154850 - RNA, 18 nt, Yersinia pestis
gcuaacaucaauguauua

SEQ ID NO: 4154851 - RNA, 16 nt, Yersinia pestis
gcuaaccaccgucacc

SEQ ID NO: 4154852 - RNA, 17 nt, Yersinia pestis
gcuaaccaccgucacca

SEQ ID NO: 4154853 - RNA, 12 nt, Yersinia pestis
gcuaaccagugu

SEQ ID NO: 4154854 - RNA, 23 nt, Yersinia pestis
gcuaaccagugucuggcaaucca

SEQ ID NO: 4154855 - RNA, 17 nt, Yersinia pestis
gcuaaccccugcaucuu

SEQ ID NO: 4154856 - RNA, 17 nt, Yersinia pestis
gcuaaccuuaacugcau

SEQ ID NO: 4154857 - RNA, 14 nt, Yersinia pestis
gcuaacgaagguaa

SEQ ID NO: 4154858 - RNA, 20 nt, Yersinia pestis
gcuaacgaggcauaaucagc

SEQ ID NO: 4154859 - RNA, 21 nt, Yersinia pestis
gcuaacgcuuucagguuguua

SEQ ID NO: 4154860 - RNA, 22 nt, Yersinia pestis
gcuaacguuuauuuauaagaac

SEQ ID NO: 4154861 - RNA, 21 nt, Yersinia pestis
gcuaacuggcggggcaaauag

SEQ ID NO: 4154862 - RNA, 17 nt, Yersinia pestis
gcuaaggugugauugaa

SEQ ID NO: 4154863 - RNA, 15 nt, Yersinia pestis
gcuaaguaugugcug

SEQ ID NO: 4154864 - RNA, 15 nt, Yersinia pestis
gcuaauauuuauaaa

SEQ ID NO: 4154865 - RNA, 19 nt, Yersinia pestis
gcuaauauuuauaaaaaau

SEQ ID NO: 4154866 - RNA, 20 nt, Yersinia pestis
gcuaaucguggugaagaaua

SEQ ID NO: 4154867 - RNA, 21 nt, Yersinia pestis
gcuaaugaguagcuaauaaaa

SEQ ID NO: 4154868 - RNA, 15 nt, Yersinia pestis
gcuaaugcuauccac

SEQ ID NO: 4154869 - RNA, 18 nt, Yersinia pestis
gcuaaugcucgcucauca

SEQ ID NO: 4154870 - RNA, 21 nt, Yersinia pestis
gcuaauuauuuuauuuaaaau

SEQ ID NO: 4154871 - RNA, 23 nt, Yersinia pestis
gcuaauucugcgccuauaccugc

SEQ ID NO: 4154872 - RNA, 14 nt, Yersinia pestis
gcuaauugucacag

SEQ ID NO: 4154873 - RNA, 17 nt, Yersinia pestis
gcuacaagcaugugaug

SEQ ID NO: 4154874 - RNA, 13 nt, Yersinia pestis
gcuacagcagcag

SEQ ID NO: 4154875 - RNA, 13 nt, Yersinia pestis
gcuacagcgucag

SEQ ID NO: 4154876 - RNA, 15 nt, Yersinia pestis
gcucgugaucagcag

SEQ ID NO: 4154877 - RNA, 14 nt, Yersinia pestis
gcucguuaucugua

SEQ ID NO: 4154878 - RNA, 17 nt, Yersinia pestis
gcucguuggccggaugc

SEQ ID NO: 4154879 - RNA, 20 nt, Yersinia pestis
gcucuacaacguccagaaca

SEQ ID NO: 4154880 - RNA, 21 nt, Yersinia pestis
gcucuacacaggcguaauaug

SEQ ID NO: 4154881 - RNA, 20 nt, Yersinia pestis
gcucuaucgauaaagucauc

SEQ ID NO: 4154882 - RNA, 13 nt, Yersinia pestis
gcucuaucucccg

SEQ ID NO: 4154883 - RNA, 19 nt, Yersinia pestis
gcucuaucucccgcuacac

SEQ ID NO: 4154884 - RNA, 22 nt, Yersinia pestis
gcucuauuucaugauucucuau

SEQ ID NO: 4154885 - RNA, 20 nt, Yersinia pestis
gcucucacccaauaagauaa

SEQ ID NO: 4154886 - RNA, 15 nt, Yersinia pestis
gcucuccacucgguc

SEQ ID NO: 4154887 - RNA, 22 nt, Yersinia pestis
gcucuccacucggucaaccguu

SEQ ID NO: 4154888 - RNA, 16 nt, Yersinia pestis
gcucucgcuccagcuc

SEQ ID NO: 4154889 - RNA, 13 nt, Yersinia pestis
gcucucugagcca

SEQ ID NO: 4154890 - RNA, 19 nt, Yersinia pestis
gcucucugaguaccagcaa

SEQ ID NO: 4154891 - RNA, 15 nt, Yersinia pestis
gcucucuuuuuucuc

SEQ ID NO: 4154892 - RNA, 17 nt, Yersinia pestis
gcucugauaguauuaga

SEQ ID NO: 4154893 - RNA, 14 nt, Yersinia pestis
gcucugccaauaaa

SEQ ID NO: 4154894 - RNA, 13 nt, Yersinia pestis
gcucugccgcagu

SEQ ID NO: 4154895 - RNA, 19 nt, Yersinia pestis
gcucugcguuuuucccugu

SEQ ID NO: 4154896 - RNA, 16 nt, Yersinia pestis
gcucugcuccgccuuc

SEQ ID NO: 4154897 - RNA, 20 nt, Yersinia pestis
gcucuggccagcgucuucag

SEQ ID NO: 4154898 - RNA, 19 nt, Yersinia pestis
gcucugggacgugcauaaa

SEQ ID NO: 4154899 - RNA, 21 nt, Yersinia pestis
gcucugggacgugcauaaaac

SEQ ID NO: 4154900 - RNA, 23 nt, Yersinia pestis
gcucuggguuaaauugcgggcug

SEQ ID NO: 4154901 - RNA, 14 nt, Yersinia pestis
gcucuggucacuaa

SEQ ID NO: 4154902 - RNA, 23 nt, Yersinia pestis
gcucuguggauuaacuucuuccg

SEQ ID NO: 4154903 - RNA, 19 nt, Yersinia pestis
gcucuuacguuucauaugu

SEQ ID NO: 4154904 - RNA, 18 nt, Yersinia pestis
gcucuucaauuuccaucu

SEQ ID NO: 4154905 - RNA, 16 nt, Yersinia pestis
gcucuucaccaaagga

SEQ ID NO: 4154906 - RNA, 18 nt, Yersinia pestis
gcucuucaccaaaggaag

SEQ ID NO: 4154907 - RNA, 19 nt, Yersinia pestis
gcucuucaucaucaaauga

SEQ ID NO: 4154908 - RNA, 22 nt, Yersinia pestis
gcugaaaaaugagucauuaucu

SEQ ID NO: 4154909 - RNA, 23 nt, Yersinia pestis
gcugaaaaauggugagaaacgug

SEQ ID NO: 4154910 - RNA, 16 nt, Yersinia pestis
gcugaaaaucaugaaa

SEQ ID NO: 4154911 - RNA, 16 nt, Yersinia pestis
gcugaacaauugccag

SEQ ID NO: 4154912 - RNA, 15 nt, Yersinia pestis
gcugaacuucuggga

SEQ ID NO: 4154913 - RNA, 13 nt, Yersinia pestis
gcugaagccagca

SEQ ID NO: 4154914 - RNA, 17 nt, Yersinia pestis
gcugaagucuuuagccu

SEQ ID NO: 4154915 - RNA, 19 nt, Yersinia pestis
gcugaauaaacggcaagcg

SEQ ID NO: 4154916 - RNA, 21 nt, Yersinia pestis
gcugaauaucaucuuuuucug

SEQ ID NO: 4154917 - RNA, 16 nt, Yersinia pestis
gcugaauugauuuauu

SEQ ID NO: 4154918 - RNA, 15 nt, Yersinia pestis
gcugaauugcuuauc

SEQ ID NO: 4154919 - RNA, 17 nt, Yersinia pestis
gcugaauuggaagagcc

SEQ ID NO: 4154920 - RNA, 15 nt, Yersinia pestis
gcugacaaacagaua

SEQ ID NO: 4154921 - RNA, 13 nt, Yersinia pestis
gcugacauugccc

SEQ ID NO: 4154922 - RNA, 16 nt, Yersinia pestis
gcugacauuuucuauc

SEQ ID NO: 4154923 - RNA, 14 nt, Yersinia pestis
gcugaccacaaaaa

SEQ ID NO: 4154924 - RNA, 22 nt, Yersinia pestis
gcugaccacaaaaacaguguca

SEQ ID NO: 4154925 - RNA, 23 nt, Yersinia pestis
gcugacgauaacuuuuggcagca

SEQ ID NO: 4154926 - RNA, 17 nt, Yersinia pestis
gcugacggcgguauaca

SEQ ID NO: 4154927 - RNA, 22 nt, Yersinia pestis
gcugacgguuauugugcugccg

SEQ ID NO: 4154928 - RNA, 20 nt, Yersinia pestis
gcugacuaaaucgcuuaucu

SEQ ID NO: 4154929 - RNA, 16 nt, Yersinia pestis
gcugacuggcaggaaa

SEQ ID NO: 4154930 - RNA, 15 nt, Yersinia pestis
gcugagagccgcuau

SEQ ID NO: 4154931 - RNA, 15 nt, Yersinia pestis
gcugagcgggcggca

SEQ ID NO: 4154932 - RNA, 16 nt, Yersinia pestis
gcugaggggcacacuu

SEQ ID NO: 4154933 - RNA, 18 nt, Yersinia pestis
gcugaggucagugcugca

SEQ ID NO: 4154934 - RNA, 14 nt, Yersinia pestis
gcugaguaaauuaa

SEQ ID NO: 4154935 - RNA, 15 nt, Yersinia pestis
gcugagugaagacau

SEQ ID NO: 4154936 - RNA, 17 nt, Yersinia pestis
gcugauaacuuccuuug

SEQ ID NO: 4154937 - RNA, 23 nt, Yersinia pestis
gcugauagaaaguugagcagcaa

SEQ ID NO: 4154938 - RNA, 15 nt, Yersinia pestis
gcugauaugaaaaau

SEQ ID NO: 4154939 - RNA, 19 nt, Yersinia pestis
gcugaucaucaucaaugga

SEQ ID NO: 4154940 - RNA, 20 nt, Yersinia pestis
gcugauggucauggagagca

SEQ ID NO: 4154941 - RNA, 23 nt, Yersinia pestis
gcugauguuucuuugcgccauac

SEQ ID NO: 4154942 - RNA, 21 nt, Yersinia pestis
gcugauuaccugcaucaagcc

SEQ ID NO: 4154943 - RNA, 13 nt, Yersinia pestis
gcugauucaacac

SEQ ID NO: 4154944 - RNA, 17 nt, Yersinia pestis
gcugauucacuggcaaa

SEQ ID NO: 4154945 - RNA, 20 nt, Yersinia pestis
gcugcaaacaggcccacugc

SEQ ID NO: 4154946 - RNA, 19 nt, Yersinia pestis
gcugcaacuccuuaccacu

SEQ ID NO: 4154947 - RNA, 17 nt, Yersinia pestis
gcugcaagcaauguuca

SEQ ID NO: 4154948 - RNA, 21 nt, Yersinia pestis
gcugcaagcaauguucaaauc

SEQ ID NO: 4154949 - RNA, 15 nt, Yersinia pestis
gcugcaauaagccag

SEQ ID NO: 4154950 - RNA, 15 nt, Yersinia pestis
gcugcacaucauuua

SEQ ID NO: 4154951 - RNA, 18 nt, Yersinia pestis
gcugcaccucugcugaug

SEQ ID NO: 4154952 - RNA, 19 nt, Yersinia pestis
gcugcacgcaggcggcggc

SEQ ID NO: 4154953 - RNA, 13 nt, Yersinia pestis
gcugcagcaucaa

SEQ ID NO: 4154954 - RNA, 19 nt, Yersinia pestis
gcugcagccgggaugauca

SEQ ID NO: 4154955 - RNA, 19 nt, Yersinia pestis
gcugcagcgugauuagcag

SEQ ID NO: 4154956 - RNA, 12 nt, Yersinia pestis
gcugccaucagc

SEQ ID NO: 4154957 - RNA, 23 nt, Yersinia pestis
gcugcccaaccgcaucgugcucc

SEQ ID NO: 4154958 - RNA, 23 nt, Yersinia pestis
gcugcccacauaaagauagccac

SEQ ID NO: 4154959 - RNA, 17 nt, Yersinia pestis
gcugcccgaguaagcgc

SEQ ID NO: 4154960 - RNA, 12 nt, Yersinia pestis
gcugccugccug

SEQ ID NO: 4154961 - RNA, 23 nt, Yersinia pestis
gcugccugccugagguucccaac

SEQ ID NO: 4154962 - RNA, 18 nt, Yersinia pestis
gcugccugccugcugcuc

SEQ ID NO: 4154963 - RNA, 16 nt, Yersinia pestis
gcugccuugcugcaac

SEQ ID NO: 4154964 - RNA, 17 nt, Yersinia pestis
gcugcgauaauccgcca

SEQ ID NO: 4154965 - RNA, 18 nt, Yersinia pestis
gcugcgcaagcgcugcuu

SEQ ID NO: 4154966 - RNA, 17 nt, Yersinia pestis
gcugcgccaauacccgu

SEQ ID NO: 4154967 - RNA, 23 nt, Yersinia pestis
gcugcgucuuuaucgccagcugc

SEQ ID NO: 4154968 - RNA, 18 nt, Yersinia pestis
gcugcguucuuugauuug

SEQ ID NO: 4154969 - RNA, 9 nt, Yersinia pestis
gcugcucac

SEQ ID NO: 4154970 - RNA, 20 nt, Yersinia pestis
gcugcugcaagaguccagca

SEQ ID NO: 4154971 - RNA, 11 nt, Yersinia pestis
gcugcugcucg

SEQ ID NO: 4154972 - RNA, 12 nt, Yersinia pestis
gcugcuuccugc

SEQ ID NO: 4154973 - RNA, 13 nt, Yersinia pestis
gcugcuuccugcu

SEQ ID NO: 4154974 - RNA, 23 nt, Yersinia pestis
gcugcuugcgcguuaaucugcug

SEQ ID NO: 4154975 - RNA, 20 nt, Yersinia pestis
gcugcuuuucagugaaaucg

SEQ ID NO: 4154976 - RNA, 13 nt, Yersinia pestis
gcuggaauccaag

SEQ ID NO: 4154977 - RNA, 17 nt, Yersinia pestis
gcuggaauccaaguuca

SEQ ID NO: 4154978 - RNA, 18 nt, Yersinia pestis
gcuggaauccaaguucaa

SEQ ID NO: 4154979 - RNA, 15 nt, Yersinia pestis
gcuggaucagcagac

SEQ ID NO: 4154980 - RNA, 16 nt, Yersinia pestis
gcuggaucagcagacu

SEQ ID NO: 4154981 - RNA, 21 nt, Yersinia pestis
gcuggcaaccgguaacauaua

SEQ ID NO: 4154982 - RNA, 19 nt, Yersinia pestis
gcuggcagcgcuugcaaca

SEQ ID NO: 4154983 - RNA, 13 nt, Yersinia pestis
gcuggcauacuga

SEQ ID NO: 4154984 - RNA, 12 nt, Yersinia pestis
gcuggcauuuuu

SEQ ID NO: 4154985 - RNA, 22 nt, Yersinia pestis
gcuggcauuuuuauuuaccgaa

SEQ ID NO: 4154986 - RNA, 19 nt, Yersinia pestis
gcuggccaacugcgccuuc

SEQ ID NO: 4154987 - RNA, 13 nt, Yersinia pestis
gcuggccuaggcu

SEQ ID NO: 4154988 - RNA, 16 nt, Yersinia pestis
gcuggcuaucaucccu

SEQ ID NO: 4154989 - RNA, 17 nt, Yersinia pestis
gcugggcguaacagccg

SEQ ID NO: 4154990 - RNA, 20 nt, Yersinia pestis
gcugggcugguaggugcuca

SEQ ID NO: 4154991 - RNA, 20 nt, Yersinia pestis
gcugguaauccacccggcau

SEQ ID NO: 4154992 - RNA, 17 nt, Yersinia pestis
gcugguaggugcucauc

SEQ ID NO: 4154993 - RNA, 18 nt, Yersinia pestis
gcugguagugauccccca

SEQ ID NO: 4154994 - RNA, 21 nt, Yersinia pestis
gcuggucagcggagcagauca

SEQ ID NO: 4154995 - RNA, 15 nt, Yersinia pestis
gcuggugaaugguca

SEQ ID NO: 4154996 - RNA, 19 nt, Yersinia pestis
gcugguguaacggcugcug

SEQ ID NO: 4154997 - RNA, 22 nt, Yersinia pestis
gcugguugagauuaucagccca

SEQ ID NO: 4154998 - RNA, 12 nt, Yersinia pestis
gcuuuuugcuuu

SEQ ID NO: 4154999 - RNA, 17 nt, Yersinia pestis
gcuuuuugcuuuuugcu

SEQ ID NO: 4155000 - RNA, 13 nt, Yersinia pestis
gcuuuuuuguuuu

SEQ ID NO: 4155001 - RNA, 15 nt, Yersinia pestis
ggaaaaaaucuuccu

SEQ ID NO: 4155002 - RNA, 20 nt, Yersinia pestis
ggaaaaacugaaaaaggcac

SEQ ID NO: 4155003 - RNA, 14 nt, Yersinia pestis
ggaaaaggcagaga

SEQ ID NO: 4155004 - RNA, 18 nt, Yersinia pestis
ggaaaauuaacuuauuga

SEQ ID NO: 4155005 - RNA, 12 nt, Yersinia pestis
ggaaacuggcca

SEQ ID NO: 4155006 - RNA, 16 nt, Yersinia pestis
ggaaaguagccauuuu

SEQ ID NO: 4155007 - RNA, 22 nt, Yersinia pestis
ggaaauccguuuuuugguggcu

SEQ ID NO: 4155008 - RNA, 22 nt, Yersinia pestis
ggaaaucgaaauuaaggaaaag

SEQ ID NO: 4155009 - RNA, 18 nt, Yersinia pestis
ggaaaugccgauaaaaac

SEQ ID NO: 4155010 - RNA, 20 nt, Yersinia pestis
ggaaauuucccccucacauu

SEQ ID NO: 4155011 - RNA, 16 nt, Yersinia pestis
ggaacagcgccuccag

SEQ ID NO: 4155012 - RNA, 15 nt, Yersinia pestis
ggaacagcucggcca

SEQ ID NO: 4155013 - RNA, 21 nt, Yersinia pestis
ggaacagcucggccagcauuc

SEQ ID NO: 4155014 - RNA, 21 nt, Yersinia pestis
ggaacaguugcuugagagaac

SEQ ID NO: 4155015 - RNA, 21 nt, Yersinia pestis
ggaaccaacggcaaugaccau

SEQ ID NO: 4155016 - RNA, 21 nt, Yersinia pestis
ggaacccauuugcacagcauu

SEQ ID NO: 4155017 - RNA, 16 nt, Yersinia pestis
ggaaccuccaaaugaa

SEQ ID NO: 4155018 - RNA, 18 nt, Yersinia pestis
ggaacgaagccgcagaga

SEQ ID NO: 4155019 - RNA, 22 nt, Yersinia pestis
ggaacgguugcccguuaauauu

SEQ ID NO: 4155020 - RNA, 21 nt, Yersinia pestis
ggaacgucugcaauagcucau

SEQ ID NO: 4155021 - RNA, 14 nt, Yersinia pestis
ggaagaaucaccga

SEQ ID NO: 4155022 - RNA, 21 nt, Yersinia pestis
ggaagagauaaaucggcggcc

SEQ ID NO: 4155023 - RNA, 15 nt, Yersinia pestis
ggaagcaagaaacug

SEQ ID NO: 4155024 - RNA, 16 nt, Yersinia pestis
ggaagcaagaaacugu

SEQ ID NO: 4155025 - RNA, 20 nt, Yersinia pestis
ggaagccggcgucuuuacga

SEQ ID NO: 4155026 - RNA, 13 nt, Yersinia pestis
ggaagcggccagg

SEQ ID NO: 4155027 - RNA, 16 nt, Yersinia pestis
ggaaggcccagccggg

SEQ ID NO: 4155028 - RNA, 17 nt, Yersinia pestis
ggaagggguucuuccaa

SEQ ID NO: 4155029 - RNA, 21 nt, Yersinia pestis
ggaaggguuuugugggagagg

SEQ ID NO: 4155030 - RNA, 14 nt, Yersinia pestis
ggaagguauccaau

SEQ ID NO: 4155031 - RNA, 21 nt, Yersinia pestis
ggaaguacuuauuugaaacac

SEQ ID NO: 4155032 - RNA, 22 nt, Yersinia pestis
ggaagucugcuuuauuggagug

SEQ ID NO: 4155033 - RNA, 21 nt, Yersinia pestis
ggaauaaucaauuaaucaauu

SEQ ID NO: 4155034 - RNA, 16 nt, Yersinia pestis
ggaauagagccucuau

SEQ ID NO: 4155035 - RNA, 12 nt, Yersinia pestis
ggaaucaaagag

SEQ ID NO: 4155036 - RNA, 14 nt, Yersinia pestis
ggaaucaaagagcg

SEQ ID NO: 4155037 - RNA, 13 nt, Yersinia pestis
ggaaucagccaga

SEQ ID NO: 4155038 - RNA, 20 nt, Yersinia pestis
ggaaucagcguuuuauucgu

SEQ ID NO: 4155039 - RNA, 16 nt, Yersinia pestis
ggaaucauaaaagccc

SEQ ID NO: 4155040 - RNA, 18 nt, Yersinia pestis
ggaaugaguugcccuaaa

SEQ ID NO: 4155041 - RNA, 21 nt, Yersinia pestis
ggaauuaagaagccucaugaa

SEQ ID NO: 4155042 - RNA, 12 nt, Yersinia pestis
ggaauuaauauc

SEQ ID NO: 4155043 - RNA, 19 nt, Yersinia pestis
ggaauugugucaucgcgga

SEQ ID NO: 4155044 - RNA, 20 nt, Yersinia pestis
ggaauuugccucugcuagca

SEQ ID NO: 4155045 - RNA, 15 nt, Yersinia pestis
ggacaaaccagcccu

SEQ ID NO: 4155046 - RNA, 20 nt, Yersinia pestis
ggacagaaaacaaucuggca

SEQ ID NO: 4155047 - RNA, 23 nt, Yersinia pestis
ggacagaaaacaaucuggcagcc

SEQ ID NO: 4155048 - RNA, 19 nt, Yersinia pestis
ggacagauuauuucagcuu

SEQ ID NO: 4155049 - RNA, 15 nt, Yersinia pestis
ggacaggcuccuccu

SEQ ID NO: 4155050 - RNA, 12 nt, Yersinia pestis
ggacaucugcuu

SEQ ID NO: 4155051 - RNA, 16 nt, Yersinia pestis
ggacgacggguauauu

SEQ ID NO: 4155052 - RNA, 14 nt, Yersinia pestis
ggacgcaucagauc

SEQ ID NO: 4155053 - RNA, 15 nt, Yersinia pestis
ggacgcuuuacuccu

SEQ ID NO: 4155054 - RNA, 19 nt, Yersinia pestis
ggacggcggccuuauuggg

SEQ ID NO: 4155055 - RNA, 19 nt, Yersinia pestis
ggacuaauacggguuucug

SEQ ID NO: 4155056 - RNA, 20 nt, Yersinia pestis
ggacuaauacggguuucugc

SEQ ID NO: 4155057 - RNA, 14 nt, Yersinia pestis
ggacugccgcgcca

SEQ ID NO: 4155058 - RNA, 21 nt, Yersinia pestis
ggacuucugcgaccugaucca

SEQ ID NO: 4155059 - RNA, 14 nt, Yersinia pestis
ggagaaacauuaaa

SEQ ID NO: 4155060 - RNA, 21 nt, Yersinia pestis
ggagaacaaugguucaucauu

SEQ ID NO: 4155061 - RNA, 22 nt, Yersinia pestis
ggagaagguuccccuucuucuc

SEQ ID NO: 4155062 - RNA, 23 nt, Yersinia pestis
ggagacgccuucacggguucgcg

SEQ ID NO: 4155063 - RNA, 14 nt, Yersinia pestis
ggagagaacaggca

SEQ ID NO: 4155064 - RNA, 15 nt, Yersinia pestis
ggagaggagauuaga

SEQ ID NO: 4155065 - RNA, 17 nt, Yersinia pestis
ggagauaguuaucuccc

SEQ ID NO: 4155066 - RNA, 17 nt, Yersinia pestis
ggagauuucagacugcu

SEQ ID NO: 4155067 - RNA, 12 nt, Yersinia pestis
ggagcguacacg

SEQ ID NO: 4155068 - RNA, 16 nt, Yersinia pestis
ggaggagguagcaaca

SEQ ID NO: 4155069 - RNA, 11 nt, Yersinia pestis
ggaggauauuu

SEQ ID NO: 4155070 - RNA, 20 nt, Yersinia pestis
ggaggauauuuauuuauccu

SEQ ID NO: 4155071 - RNA, 18 nt, Yersinia pestis
ggaggauauuuauuuuua

SEQ ID NO: 4155072 - RNA, 19 nt, Yersinia pestis
ggaggcacgugccgcuggg

SEQ ID NO: 4155073 - RNA, 12 nt, Yersinia pestis
ggaguaaagcgu

SEQ ID NO: 4155074 - RNA, 16 nt, Yersinia pestis
ggaguaauuaauaauc

SEQ ID NO: 4155075 - RNA, 21 nt, Yersinia pestis
ggagucagaugccgcuuuagu

SEQ ID NO: 4155076 - RNA, 16 nt, Yersinia pestis
ggagucgcuccucagc

SEQ ID NO: 4155077 - RNA, 19 nt, Yersinia pestis
ggagugaugaaaccaaaac

SEQ ID NO: 4155078 - RNA, 17 nt, Yersinia pestis
ggagugcccgguaaagu

SEQ ID NO: 4155079 - RNA, 23 nt, Yersinia pestis
ggaguuacucagcauccuccuga

SEQ ID NO: 4155080 - RNA, 22 nt, Yersinia pestis
ggaguugguggcacaaggcugg

SEQ ID NO: 4155081 - RNA, 17 nt, Yersinia pestis
ggauaaaucgcccaacc

SEQ ID NO: 4155082 - RNA, 13 nt, Yersinia pestis
ggauaaauggcaa

SEQ ID NO: 4155083 - RNA, 13 nt, Yersinia pestis
ggauaaccuauua

SEQ ID NO: 4155084 - RNA, 23 nt, Yersinia pestis
ggauacaaaucaucaucuugaaa

SEQ ID NO: 4155085 - RNA, 23 nt, Yersinia pestis
ggauaccaaucccuacggcaauc

SEQ ID NO: 4155086 - RNA, 14 nt, Yersinia pestis
ggauagcaacugcc

SEQ ID NO: 4155087 - RNA, 15 nt, Yersinia pestis
ggauagguuggguuu

SEQ ID NO: 4155088 - RNA, 18 nt, Yersinia pestis
ggauauccacaucacacu

SEQ ID NO: 4155089 - RNA, 16 nt, Yersinia pestis
ggauaucgauggcaac

SEQ ID NO: 4155090 - RNA, 15 nt, Yersinia pestis
ggauaucuucaauca

SEQ ID NO: 4155091 - RNA, 17 nt, Yersinia pestis
ggauauucucaacuuca

SEQ ID NO: 4155092 - RNA, 14 nt, Yersinia pestis
ggaucaaauguccc

SEQ ID NO: 4155093 - RNA, 11 nt, Yersinia pestis
ggaucaacaug

SEQ ID NO: 4155094 - RNA, 15 nt, Yersinia pestis
ggaucacaaugcaaa

SEQ ID NO: 4155095 - RNA, 23 nt, Yersinia pestis
ggaucaccaggcucucauauccc

SEQ ID NO: 4155096 - RNA, 18 nt, Yersinia pestis
ggaucacgcuguucaccg

SEQ ID NO: 4155097 - RNA, 16 nt, Yersinia pestis
ggaucaggaucaccag

SEQ ID NO: 4155098 - RNA, 17 nt, Yersinia pestis
ggaucaggaucaccagc

SEQ ID NO: 4155099 - RNA, 18 nt, Yersinia pestis
ggauccgguugccagcca

SEQ ID NO: 4155100 - RNA, 22 nt, Yersinia pestis
ggaucgagcuguuugcuguaaa

SEQ ID NO: 4155101 - RNA, 20 nt, Yersinia pestis
ggaucgggcuaucaucaaag

SEQ ID NO: 4155102 - RNA, 13 nt, Yersinia pestis
ggaucgggcugau

SEQ ID NO: 4155103 - RNA, 14 nt, Yersinia pestis
ggaucucacccaca

SEQ ID NO: 4155104 - RNA, 21 nt, Yersinia pestis
ggaucucacccacacgacaug

SEQ ID NO: 4155105 - RNA, 10 nt, Yersinia pestis
ggaucuccaa

SEQ ID NO: 4155106 - RNA, 18 nt, Yersinia pestis
ggaugaucaacagugagg

SEQ ID NO: 4155107 - RNA, 20 nt, Yersinia pestis
ggaugaucggcauaaauggc

SEQ ID NO: 4155108 - RNA, 13 nt, Yersinia pestis
ggaugcccacacu

SEQ ID NO: 4155109 - RNA, 20 nt, Yersinia pestis
ggaugcccacacugccgaca

SEQ ID NO: 4155110 - RNA, 22 nt, Yersinia pestis
ggaugcgcucgcuugcugccuu

SEQ ID NO: 4155111 - RNA, 19 nt, Yersinia pestis
ggauuaaauucuaccuggc

SEQ ID NO: 4155112 - RNA, 23 nt, Yersinia pestis
ggauuaacuuuucuucauugcug

SEQ ID NO: 4155113 - RNA, 16 nt, Yersinia pestis
ggauuagcuucugcua

SEQ ID NO: 4155114 - RNA, 14 nt, Yersinia pestis
ggauugaaaucaga

SEQ ID NO: 4155115 - RNA, 16 nt, Yersinia pestis
ggauugcaaauccguc

SEQ ID NO: 4155116 - RNA, 20 nt, Yersinia pestis
ggauuggagucaugaggcag

SEQ ID NO: 4155117 - RNA, 12 nt, Yersinia pestis
ggauuucuucau

SEQ ID NO: 4155118 - RNA, 15 nt, Yersinia pestis
ggauuuuccgcagcu

SEQ ID NO: 4155119 - RNA, 23 nt, Yersinia pestis
ggcaaaaacagucauuaacacau

SEQ ID NO: 4155120 - RNA, 22 nt, Yersinia pestis
ggcccacgauuacguuuucuuu

SEQ ID NO: 4155121 - RNA, 13 nt, Yersinia pestis
ggccccuaaugcg

SEQ ID NO: 4155122 - RNA, 13 nt, Yersinia pestis
ggcccgcuaguga

SEQ ID NO: 4155123 - RNA, 23 nt, Yersinia pestis
ggcccgcuaucacuagcgggccu

SEQ ID NO: 4155124 - RNA, 13 nt, Yersinia pestis
ggcccggccaggc

SEQ ID NO: 4155125 - RNA, 23 nt, Yersinia pestis
ggcccugagguugcucagcgggc

SEQ ID NO: 4155126 - RNA, 15 nt, Yersinia pestis
ggccgacucugcaug

SEQ ID NO: 4155127 - RNA, 19 nt, Yersinia pestis
ggccgacucugcaugauag

SEQ ID NO: 4155128 - RNA, 18 nt, Yersinia pestis
ggccgagacaccauguug

SEQ ID NO: 4155129 - RNA, 20 nt, Yersinia pestis
ggccgaucaacaggccaccu

SEQ ID NO: 4155130 - RNA, 16 nt, Yersinia pestis
ggccgcaugcaacaga

SEQ ID NO: 4155131 - RNA, 12 nt, Yersinia pestis
ggccgccaaaua

SEQ ID NO: 4155132 - RNA, 22 nt, Yersinia pestis
ggccgcccagauaaagaugaag

SEQ ID NO: 4155133 - RNA, 19 nt, Yersinia pestis
ggccgccgcggugaagaac

SEQ ID NO: 4155134 - RNA, 18 nt, Yersinia pestis
ggccgcuaagucacgcac

SEQ ID NO: 4155135 - RNA, 22 nt, Yersinia pestis
ggccggucaugguuggcccaau

SEQ ID NO: 4155136 - RNA, 23 nt, Yersinia pestis
ggccgugcgggaugacucggccu

SEQ ID NO: 4155137 - RNA, 20 nt, Yersinia pestis
ggccguuugcccuuuuugcg

SEQ ID NO: 4155138 - RNA, 21 nt, Yersinia pestis
ggccuaaugccgcgcccccag

SEQ ID NO: 4155139 - RNA, 20 nt, Yersinia pestis
ggccuacuggugccugacug

SEQ ID NO: 4155140 - RNA, 22 nt, Yersinia pestis
ggccuaucaucaccauucaaga

SEQ ID NO: 4155141 - RNA, 17 nt, Yersinia pestis
ggccuauugaauaacag

SEQ ID NO: 4155142 - RNA, 12 nt, Yersinia pestis
ggccugccgggu

SEQ ID NO: 4155143 - RNA, 20 nt, Yersinia pestis
ggccuggguagacauggcaa

SEQ ID NO: 4155144 - RNA, 22 nt, Yersinia pestis
ggccuguaccaccaccaacagc

SEQ ID NO: 4155145 - RNA, 22 nt, Yersinia pestis
ggccuguuugcagcgaauugac

SEQ ID NO: 4155146 - RNA, 16 nt, Yersinia pestis
ggccuucaauaccuug

SEQ ID NO: 4155147 - RNA, 13 nt, Yersinia pestis
ggccuucuaacuc

SEQ ID NO: 4155148 - RNA, 16 nt, Yersinia pestis
ggccuugaaacagcag

SEQ ID NO: 4155149 - RNA, 18 nt, Yersinia pestis
ggccuugcuucugaacga

SEQ ID NO: 4155150 - RNA, 18 nt, Yersinia pestis
ggccuuucggcaaauuaa

SEQ ID NO: 4155151 - RNA, 21 nt, Yersinia pestis
ggccuuucguuucugucugag

SEQ ID NO: 4155152 - RNA, 20 nt, Yersinia pestis
ggcgaaagcauggcagguau

SEQ ID NO: 4155153 - RNA, 23 nt, Yersinia pestis
ggcgaaauugacuuuaaaaaaau

SEQ ID NO: 4155154 - RNA, 12 nt, Yersinia pestis
ggcgaacagaaa

SEQ ID NO: 4155155 - RNA, 15 nt, Yersinia pestis
ggcgacaaucaaugg

SEQ ID NO: 4155156 - RNA, 21 nt, Yersinia pestis
ggcgacaaucaauggccagcg

SEQ ID NO: 4155157 - RNA, 17 nt, Yersinia pestis
ggcgacugugcuuugcc

SEQ ID NO: 4155158 - RNA, 21 nt, Yersinia pestis
ggcgauacaacguaggccgag

SEQ ID NO: 4155159 - RNA, 14 nt, Yersinia pestis
ggcgauaucacuga

SEQ ID NO: 4155160 - RNA, 16 nt, Yersinia pestis
ggcgauccagugaaau

SEQ ID NO: 4155161 - RNA, 14 nt, Yersinia pestis
ggcgaucucuucgg

SEQ ID NO: 4155162 - RNA, 12 nt, Yersinia pestis
ggcgauuucagc

SEQ ID NO: 4155163 - RNA, 17 nt, Yersinia pestis
ggcgauuucagcugcuu

SEQ ID NO: 4155164 - RNA, 14 nt, Yersinia pestis
ggcgcaauggaaga

SEQ ID NO: 4155165 - RNA, 20 nt, Yersinia pestis
ggcgcacgaauaucuagcaa

SEQ ID NO: 4155166 - RNA, 22 nt, Yersinia pestis
ggcgcagacccgugaacaucug

SEQ ID NO: 4155167 - RNA, 19 nt, Yersinia pestis
ggcgcauauccugauagga

SEQ ID NO: 4155168 - RNA, 23 nt, Yersinia pestis
ggcgcauaugaaaaaccuccggc

SEQ ID NO: 4155169 - RNA, 13 nt, Yersinia pestis
ggcgcauccccac

SEQ ID NO: 4155170 - RNA, 14 nt, Yersinia pestis
ggcgcggcucgagc

SEQ ID NO: 4155171 - RNA, 19 nt, Yersinia pestis
ggcgcgucaucgcggcgca

SEQ ID NO: 4155172 - RNA, 22 nt, Yersinia pestis
ggcgcguuacaccgaaauuaga

SEQ ID NO: 4155173 - RNA, 23 nt, Yersinia pestis
ggcgcguuucuuagcugauuuga

SEQ ID NO: 4155174 - RNA, 21 nt, Yersinia pestis
ggcgcucaauguuccucagga

SEQ ID NO: 4155175 - RNA, 13 nt, Yersinia pestis
ggcgcucggcagc

SEQ ID NO: 4155176 - RNA, 17 nt, Yersinia pestis
ggcggaaauaaggcgca

SEQ ID NO: 4155177 - RNA, 20 nt, Yersinia pestis
ggcggcaaaagaacgugcug

SEQ ID NO: 4155178 - RNA, 14 nt, Yersinia pestis
ggcggcagcacaga

SEQ ID NO: 4155179 - RNA, 12 nt, Yersinia pestis
ggcggccagcaa

SEQ ID NO: 4155180 - RNA, 19 nt, Yersinia pestis
ggcggccagcaagagcagc

SEQ ID NO: 4155181 - RNA, 23 nt, Yersinia pestis
ggcggccagugauguuggcaggu

SEQ ID NO: 4155182 - RNA, 13 nt, Yersinia pestis
ggcggccucugcu

SEQ ID NO: 4155183 - RNA, 16 nt, Yersinia pestis
ggcgggagaguggcgg

SEQ ID NO: 4155184 - RNA, 22 nt, Yersinia pestis
ggcgguccuccugccccuacgg

SEQ ID NO: 4155185 - RNA, 22 nt, Yersinia pestis
ggcggucugagucagucagggu

SEQ ID NO: 4155186 - RNA, 22 nt, Yersinia pestis
ggcgguuaaccgugauguucaa

SEQ ID NO: 4155187 - RNA, 20 nt, Yersinia pestis
ggcgguuaauaacugccaau

SEQ ID NO: 4155188 - RNA, 11 nt, Yersinia pestis
ggcguaaguac

SEQ ID NO: 4155189 - RNA, 23 nt, Yersinia pestis
ggcguagguaguggcugauacuc

SEQ ID NO: 4155190 - RNA, 19 nt, Yersinia pestis
ggcguauaucguuggugcg

SEQ ID NO: 4155191 - RNA, 15 nt, Yersinia pestis
ggcgucaagguaccc

SEQ ID NO: 4155192 - RNA, 23 nt, Yersinia pestis
ggcgugaguuccagccccaaaca

SEQ ID NO: 4155193 - RNA, 15 nt, Yersinia pestis
ggcguuaucggcgca

SEQ ID NO: 4155194 - RNA, 14 nt, Yersinia pestis
ggcguuauguaaaa

SEQ ID NO: 4155195 - RNA, 17 nt, Yersinia pestis
ggcguuauugagaagaa

SEQ ID NO: 4155196 - RNA, 16 nt, Yersinia pestis
ggcguucuaguuuggu

SEQ ID NO: 4155197 - RNA, 12 nt, Yersinia pestis
ggcguucuguca

SEQ ID NO: 4155198 - RNA, 20 nt, Yersinia pestis
ggcuaaccagugucuggcaa

SEQ ID NO: 4155199 - RNA, 22 nt, Yersinia pestis
ggcuaaccagugucuggcaauc

SEQ ID NO: 4155200 - RNA, 17 nt, Yersinia pestis
ggcuaaccugcacgccu

SEQ ID NO: 4155201 - RNA, 18 nt, Yersinia pestis
ggcuaacgguaaauaagu

SEQ ID NO: 4155202 - RNA, 21 nt, Yersinia pestis
ggcuaauagcgucagucuugc

SEQ ID NO: 4155203 - RNA, 18 nt, Yersinia pestis
ggcuacugguagcagcca

SEQ ID NO: 4155204 - RNA, 21 nt, Yersinia pestis
ggcuauagaucggccaguaag

SEQ ID NO: 4155205 - RNA, 15 nt, Yersinia pestis
ggcuauauugcugag

SEQ ID NO: 4155206 - RNA, 17 nt, Yersinia pestis
ggcuaucaucaaaggca

SEQ ID NO: 4155207 - RNA, 18 nt, Yersinia pestis
ggcuaucggguaacggcu

SEQ ID NO: 4155208 - RNA, 20 nt, Yersinia pestis
ggcuaucuuaugacgcugca

SEQ ID NO: 4155209 - RNA, 18 nt, Yersinia pestis
ggcuauuacugucaaugc

SEQ ID NO: 4155210 - RNA, 17 nt, Yersinia pestis
ggcucaauccaaaugac

SEQ ID NO: 4155211 - RNA, 21 nt, Yersinia pestis
ggcucagauaauaacgauccg

SEQ ID NO: 4155212 - RNA, 14 nt, Yersinia pestis
ggcucagcauggaa

SEQ ID NO: 4155213 - RNA, 15 nt, Yersinia pestis
ggcucaucaaaggag

SEQ ID NO: 4155214 - RNA, 20 nt, Yersinia pestis
ggcucaucgcuaaccgccag

SEQ ID NO: 4155215 - RNA, 14 nt, Yersinia pestis
ggcucaugcagcau

SEQ ID NO: 4155216 - RNA, 18 nt, Yersinia pestis
ggcucccccuugauucac

SEQ ID NO: 4155217 - RNA, 12 nt, Yersinia pestis
ggcucgaaccug

SEQ ID NO: 4155218 - RNA, 16 nt, Yersinia pestis
ggcucgacucaauaaa

SEQ ID NO: 4155219 - RNA, 20 nt, Yersinia pestis
ggcucgagccuacauggaug

SEQ ID NO: 4155220 - RNA, 18 nt, Yersinia pestis
ggcucgcccacggcacau

SEQ ID NO: 4155221 - RNA, 16 nt, Yersinia pestis
ggcucgcgauaucugc

SEQ ID NO: 4155222 - RNA, 17 nt, Yersinia pestis
ggcucgcugguggcuug

SEQ ID NO: 4155223 - RNA, 18 nt, Yersinia pestis
ggcucgcugguggcuuga

SEQ ID NO: 4155224 - RNA, 17 nt, Yersinia pestis
ggcucucuucagcgcuu

SEQ ID NO: 4155225 - RNA, 14 nt, Yersinia pestis
ggcucuggagcucu

SEQ ID NO: 4155226 - RNA, 20 nt, Yersinia pestis
ggcucuggcaauggcuagcu

SEQ ID NO: 4155227 - RNA, 20 nt, Yersinia pestis
ggcucuucucgaauaaacgg

SEQ ID NO: 4155228 - RNA, 21 nt, Yersinia pestis
ggcugacggugccagauagac

SEQ ID NO: 4155229 - RNA, 21 nt, Yersinia pestis
ggcugagagccgcuauaaccu

SEQ ID NO: 4155230 - RNA, 12 nt, Yersinia pestis
ggcugaugguca

SEQ ID NO: 4155231 - RNA, 17 nt, Yersinia pestis
ggcugauguucugccaa

SEQ ID NO: 4155232 - RNA, 18 nt, Yersinia pestis
ggcugauucacuggcaaa

SEQ ID NO: 4155233 - RNA, 19 nt, Yersinia pestis
ggcugauucacuggcaaaa

SEQ ID NO: 4155234 - RNA, 15 nt, Yersinia pestis
ggcugcauggguaaa

SEQ ID NO: 4155235 - RNA, 13 nt, Yersinia pestis
ggcugccugccug

SEQ ID NO: 4155236 - RNA, 22 nt, Yersinia pestis
ggcugcgcaccacugucagggc

SEQ ID NO: 4155237 - RNA, 16 nt, Yersinia pestis
ggcugcugcagccggg

SEQ ID NO: 4155238 - RNA, 18 nt, Yersinia pestis
ggcuggaaaaaauaaugg

SEQ ID NO: 4155239 - RNA, 21 nt, Yersinia pestis
ggcuggaaaaaauaauggcca

SEQ ID NO: 4155240 - RNA, 22 nt, Yersinia pestis
ggcuggaaaaaauaauggccaa

SEQ ID NO: 4155241 - RNA, 16 nt, Yersinia pestis
gguaaccccggcggcu

SEQ ID NO: 4155242 - RNA, 12 nt, Yersinia pestis
gguaacccuuug

SEQ ID NO: 4155243 - RNA, 21 nt, Yersinia pestis
gguaaccugaaagucaggauu

SEQ ID NO: 4155244 - RNA, 18 nt, Yersinia pestis
gguaacuuacaggcugcc

SEQ ID NO: 4155245 - RNA, 13 nt, Yersinia pestis
gguaagccuuucu

SEQ ID NO: 4155246 - RNA, 11 nt, Yersinia pestis
gguaagcuggc

SEQ ID NO: 4155247 - RNA, 22 nt, Yersinia pestis
gguaaggccgcgauaaaaaaua

SEQ ID NO: 4155248 - RNA, 18 nt, Yersinia pestis
gguaaguaauugaagugg

SEQ ID NO: 4155249 - RNA, 12 nt, Yersinia pestis
gguaauaaauca

SEQ ID NO: 4155250 - RNA, 15 nt, Yersinia pestis
gguaauaccaaugcu

SEQ ID NO: 4155251 - RNA, 21 nt, Yersinia pestis
gguaauaccggggagcggaua

SEQ ID NO: 4155252 - RNA, 15 nt, Yersinia pestis
gguaaucagacugcu

SEQ ID NO: 4155253 - RNA, 16 nt, Yersinia pestis
gguaaucccgaaucaa

SEQ ID NO: 4155254 - RNA, 20 nt, Yersinia pestis
gguaaucgacggaaacagca

SEQ ID NO: 4155255 - RNA, 23 nt, Yersinia pestis
gguaaugcgcaccagcucaauac

SEQ ID NO: 4155256 - RNA, 19 nt, Yersinia pestis
gguaaugguaaaaaauggc

SEQ ID NO: 4155257 - RNA, 21 nt, Yersinia pestis
gguaaugucacguuaaguuca

SEQ ID NO: 4155258 - RNA, 21 nt, Yersinia pestis
gguaauuaauauauaaaauaa

SEQ ID NO: 4155259 - RNA, 15 nt, Yersinia pestis
gguaccgcaggucag

SEQ ID NO: 4155260 - RNA, 17 nt, Yersinia pestis
gguaccugaucagcauu

SEQ ID NO: 4155261 - RNA, 16 nt, Yersinia pestis
gguaccugcaucauca

SEQ ID NO: 4155262 - RNA, 16 nt, Yersinia pestis
gguacguugucaauaa

SEQ ID NO: 4155263 - RNA, 16 nt, Yersinia pestis
gguagaccaccaacuc

SEQ ID NO: 4155264 - RNA, 23 nt, Yersinia pestis
gguagccugcacggcucaggugc

SEQ ID NO: 4155265 - RNA, 17 nt, Yersinia pestis
gguaguaggcaaagaga

SEQ ID NO: 4155266 - RNA, 21 nt, Yersinia pestis
gguagucauauucaggcuggg

SEQ ID NO: 4155267 - RNA, 15 nt, Yersinia pestis
gguagugacucauca

SEQ ID NO: 4155268 - RNA, 17 nt, Yersinia pestis
gguagugacucaucaaa

SEQ ID NO: 4155269 - RNA, 17 nt, Yersinia pestis
gguauagagugcaucca

SEQ ID NO: 4155270 - RNA, 14 nt, Yersinia pestis
gguauagcggcggg

SEQ ID NO: 4155271 - RNA, 21 nt, Yersinia pestis
gguauagcuaucacgacuacc

SEQ ID NO: 4155272 - RNA, 13 nt, Yersinia pestis
gguauaugacugu

SEQ ID NO: 4155273 - RNA, 23 nt, Yersinia pestis
gguauccaccuuccacaaguaac

SEQ ID NO: 4155274 - RNA, 22 nt, Yersinia pestis
gguauccauugaugcaguacuc

SEQ ID NO: 4155275 - RNA, 15 nt, Yersinia pestis
gguaucgauaugaac

SEQ ID NO: 4155276 - RNA, 18 nt, Yersinia pestis
gguaucuaggugcaguaa

SEQ ID NO: 4155277 - RNA, 20 nt, Yersinia pestis
gguaucucccgcaaagccug

SEQ ID NO: 4155278 - RNA, 18 nt, Yersinia pestis
gguauucagccaaaucau

SEQ ID NO: 4155279 - RNA, 13 nt, Yersinia pestis
gguauucaggaug

SEQ ID NO: 4155280 - RNA, 15 nt, Yersinia pestis
gguauucaucagcaa

SEQ ID NO: 4155281 - RNA, 15 nt, Yersinia pestis
gguauuggagcugaa

SEQ ID NO: 4155282 - RNA, 17 nt, Yersinia pestis
gguauuggcuaacuggc

SEQ ID NO: 4155283 - RNA, 20 nt, Yersinia pestis
gguauuugaacuucaaaucg

SEQ ID NO: 4155284 - RNA, 16 nt, Yersinia pestis
gguauuuuacugauga

SEQ ID NO: 4155285 - RNA, 22 nt, Yersinia pestis
ggucaaaaacacagguucucca

SEQ ID NO: 4155286 - RNA, 19 nt, Yersinia pestis
ggucaaccguuguguauca

SEQ ID NO: 4155287 - RNA, 14 nt, Yersinia pestis
ggucaagaugcaua

SEQ ID NO: 4155288 - RNA, 15 nt, Yersinia pestis
ggucaauaaaauuaa

SEQ ID NO: 4155289 - RNA, 18 nt, Yersinia pestis
ggucacccucaagagcga

SEQ ID NO: 4155290 - RNA, 20 nt, Yersinia pestis
ggucacuuuaauacuggcau

SEQ ID NO: 4155291 - RNA, 22 nt, Yersinia pestis
ggucagagauauaaacgacuuc

SEQ ID NO: 4155292 - RNA, 23 nt, Yersinia pestis
ggucaguugaauauuccauuugu

SEQ ID NO: 4155293 - RNA, 21 nt, Yersinia pestis
ggucaguuuagcgagaaaguc

SEQ ID NO: 4155294 - RNA, 19 nt, Yersinia pestis
ggucauauaccgccacuuu

SEQ ID NO: 4155295 - RNA, 21 nt, Yersinia pestis
ggucauauucccuacgggaaa

SEQ ID NO: 4155296 - RNA, 14 nt, Yersinia pestis
ggucaucaaggugc

SEQ ID NO: 4155297 - RNA, 17 nt, Yersinia pestis
ggucaucacccagcaaa

SEQ ID NO: 4155298 - RNA, 14 nt, Yersinia pestis
ggucaugcacaguu

SEQ ID NO: 4155299 - RNA, 13 nt, Yersinia pestis
ggucaugcggccu

SEQ ID NO: 4155300 - RNA, 14 nt, Yersinia pestis
ggucauggagagca

SEQ ID NO: 4155301 - RNA, 14 nt, Yersinia pestis
ggucauuagccguu

SEQ ID NO: 4155302 - RNA, 19 nt, Yersinia pestis
ggucauugcgugcaauaaa

SEQ ID NO: 4155303 - RNA, 20 nt, Yersinia pestis
ggucauugcgugcaauaaag

SEQ ID NO: 4155304 - RNA, 16 nt, Yersinia pestis
ggucauuguagauggc

SEQ ID NO: 4155305 - RNA, 19 nt, Yersinia pestis
ggucgcacccaaacugucu

SEQ ID NO: 4155306 - RNA, 18 nt, Yersinia pestis
ggucgcacugugagcggc

SEQ ID NO: 4155307 - RNA, 22 nt, Yersinia pestis
ggucgcgcccugcgcauugaua

SEQ ID NO: 4155308 - RNA, 21 nt, Yersinia pestis
ggucgcugggccuacuggugc

SEQ ID NO: 4155309 - RNA, 19 nt, Yersinia pestis
ggucgggcgcugagcgggc

SEQ ID NO: 4155310 - RNA, 15 nt, Yersinia pestis
ggucgguaaccugaa

SEQ ID NO: 4155311 - RNA, 16 nt, Yersinia pestis
ggucgguaagcuggcu

SEQ ID NO: 4155312 - RNA, 14 nt, Yersinia pestis
ggucucaaugcagu

SEQ ID NO: 4155313 - RNA, 20 nt, Yersinia pestis
ggucucuuucgggcaaaaaa

SEQ ID NO: 4155314 - RNA, 13 nt, Yersinia pestis
ggucuugaaaacc

SEQ ID NO: 4155315 - RNA, 17 nt, Yersinia pestis
ggugaaagcuaauauuc

SEQ ID NO: 4155316 - RNA, 17 nt, Yersinia pestis
ggugaacauuuaucuau

SEQ ID NO: 4155317 - RNA, 15 nt, Yersinia pestis
ggugaagaaaccuaa

SEQ ID NO: 4155318 - RNA, 23 nt, Yersinia pestis
ggugacauccgcuugcagcaaca

SEQ ID NO: 4155319 - RNA, 20 nt, Yersinia pestis
ggugacggcuuuauaguccu

SEQ ID NO: 4155320 - RNA, 19 nt, Yersinia pestis
ggugagacagugagguuau

SEQ ID NO: 4155321 - RNA, 16 nt, Yersinia pestis
ggugagcugaucugcc

SEQ ID NO: 4155322 - RNA, 15 nt, Yersinia pestis
ggugagggcaauuaa

SEQ ID NO: 4155323 - RNA, 12 nt, Yersinia pestis
ggugagugagcg

SEQ ID NO: 4155324 - RNA, 21 nt, Yersinia pestis
ggugaguuacgugagcaucug

SEQ ID NO: 4155325 - RNA, 14 nt, Yersinia pestis
ggugauacaucucg

SEQ ID NO: 4155326 - RNA, 16 nt, Yersinia pestis
ggugaucgcugccacc

SEQ ID NO: 4155327 - RNA, 23 nt, Yersinia pestis
ggugaugccccgcuauugcccau

SEQ ID NO: 4155328 - RNA, 24 nt, Yersinia pestis
ggugaugugacgucacugaugcuu

SEQ ID NO: 4155329 - RNA, 19 nt, Yersinia pestis
ggugcaguuucacccucug

SEQ ID NO: 4155330 - RNA, 12 nt, Yersinia pestis
ggugccaacgca

SEQ ID NO: 4155331 - RNA, 16 nt, Yersinia pestis
ggugccaacgcaauuc

SEQ ID NO: 4155332 - RNA, 23 nt, Yersinia pestis
ggugccacacagaaucaccaaca

SEQ ID NO: 4155333 - RNA, 13 nt, Yersinia pestis
ggugccagcagca

SEQ ID NO: 4155334 - RNA, 14 nt, Yersinia pestis
ggugccucaacgca

SEQ ID NO: 4155335 - RNA, 15 nt, Yersinia pestis
ggugcgccaguggca

SEQ ID NO: 4155336 - RNA, 13 nt, Yersinia pestis
ggugcuauuucug

SEQ ID NO: 4155337 - RNA, 20 nt, Yersinia pestis
ggugcuggugggccugcugc

SEQ ID NO: 4155338 - RNA, 14 nt, Yersinia pestis
gguggauuaccggc

SEQ ID NO: 4155339 - RNA, 20 nt, Yersinia pestis
gguggcagauagccaguggg

SEQ ID NO: 4155340 - RNA, 14 nt, Yersinia pestis
gguggccaguaacg

SEQ ID NO: 4155341 - RNA, 23 nt, Yersinia pestis
gguggcgauaaagagugaaauau

SEQ ID NO: 4155342 - RNA, 20 nt, Yersinia pestis
gguggcgucaaagcgguggu

SEQ ID NO: 4155343 - RNA, 15 nt, Yersinia pestis
ggugggccgugcggg

SEQ ID NO: 4155344 - RNA, 15 nt, Yersinia pestis
ggugggucgugcggg

SEQ ID NO: 4155345 - RNA, 23 nt, Yersinia pestis
gguguaccgcuucgcgcccgccc

SEQ ID NO: 4155346 - RNA, 13 nt, Yersinia pestis
gguguguggcaau

SEQ ID NO: 4155347 - RNA, 20 nt, Yersinia pestis
gguguuauuuacaccgugca

SEQ ID NO: 4155348 - RNA, 17 nt, Yersinia pestis
gguguugcagucuccau

SEQ ID NO: 4155349 - RNA, 14 nt, Yersinia pestis
gguguuuggugaag

SEQ ID NO: 4155350 - RNA, 16 nt, Yersinia pestis
gguguuuuguaaaugc

SEQ ID NO: 4155351 - RNA, 13 nt, Yersinia pestis
gguuaaacugacc

SEQ ID NO: 4155352 - RNA, 18 nt, Yersinia pestis
gguuaaacuucuuuaucu

SEQ ID NO: 4155353 - RNA, 12 nt, Yersinia pestis
gguuaaagacau

SEQ ID NO: 4155354 - RNA, 22 nt, Yersinia pestis
gguuaaaguugauaaagcugga

SEQ ID NO: 4155355 - RNA, 20 nt, Yersinia pestis
gguuaccguuagcaauguga

SEQ ID NO: 4155356 - RNA, 23 nt, Yersinia pestis
gguuacgauacguugcaggucaa

SEQ ID NO: 4155357 - RNA, 21 nt, Yersinia pestis
gguuacgggcuugcugcaacc

SEQ ID NO: 4155358 - RNA, 16 nt, Yersinia pestis
gguuacgucauauccc

SEQ ID NO: 4155359 - RNA, 19 nt, Yersinia pestis
gguuagagcggaugauucg

SEQ ID NO: 4155360 - RNA, 17 nt, Yersinia pestis
gguuagauuacagccua

SEQ ID NO: 4155361 - RNA, 12 nt, Yersinia pestis
gguuagcgccuu

SEQ ID NO: 4155362 - RNA, 22 nt, Yersinia pestis
gguuagcucccccguguucuga

SEQ ID NO: 4155363 - RNA, 20 nt, Yersinia pestis
guaauacccucgacaccaaa

SEQ ID NO: 4155364 - RNA, 15 nt, Yersinia pestis
guaauaccggcacca

SEQ ID NO: 4155365 - RNA, 17 nt, Yersinia pestis
guaauaccggcaccaau

SEQ ID NO: 4155366 - RNA, 18 nt, Yersinia pestis
guaauagcaaaaaaaaag

SEQ ID NO: 4155367 - RNA, 13 nt, Yersinia pestis
guaauaucaccau

SEQ ID NO: 4155368 - RNA, 13 nt, Yersinia pestis
guaauauuauuca

SEQ ID NO: 4155369 - RNA, 20 nt, Yersinia pestis
guaaucaacacauaaaauca

SEQ ID NO: 4155370 - RNA, 16 nt, Yersinia pestis
guaaucaucagggaau

SEQ ID NO: 4155371 - RNA, 21 nt, Yersinia pestis
guaaucccgauauaaauaaaa

SEQ ID NO: 4155372 - RNA, 15 nt, Yersinia pestis
guaaucuaucaacgc

SEQ ID NO: 4155373 - RNA, 18 nt, Yersinia pestis
guaaucuuugagcaccgc

SEQ ID NO: 4155374 - RNA, 19 nt, Yersinia pestis
guaaugauuugcggcauga

SEQ ID NO: 4155375 - RNA, 13 nt, Yersinia pestis
guaaugcgcacca

SEQ ID NO: 4155376 - RNA, 22 nt, Yersinia pestis
guaaugcuguuguagcgccagg

SEQ ID NO: 4155377 - RNA, 20 nt, Yersinia pestis
guaauuaauauauaaaauaa

SEQ ID NO: 4155378 - RNA, 22 nt, Yersinia pestis
guaauuaauauauaaaauaaau

SEQ ID NO: 4155379 - RNA, 20 nt, Yersinia pestis
guaauuaauuaguaauaaga

SEQ ID NO: 4155380 - RNA, 18 nt, Yersinia pestis
guaauuacgcaauaccga

SEQ ID NO: 4155381 - RNA, 13 nt, Yersinia pestis
guaauucagauaa

SEQ ID NO: 4155382 - RNA, 18 nt, Yersinia pestis
guaauucagauaagaucu

SEQ ID NO: 4155383 - RNA, 18 nt, Yersinia pestis
guaauucauuauuacuca

SEQ ID NO: 4155384 - RNA, 19 nt, Yersinia pestis
guaauuggcgcauaaucgc

SEQ ID NO: 4155385 - RNA, 20 nt, Yersinia pestis
guaauuucagauaaaaauaa

SEQ ID NO: 4155386 - RNA, 15 nt, Yersinia pestis
guacaacaagauccc

SEQ ID NO: 4155387 - RNA, 14 nt, Yersinia pestis
guacaacaauaaua

SEQ ID NO: 4155388 - RNA, 20 nt, Yersinia pestis
guacaacacaaaaaccggcg

SEQ ID NO: 4155389 - RNA, 18 nt, Yersinia pestis
guacaaucucugggugcu

SEQ ID NO: 4155390 - RNA, 22 nt, Yersinia pestis
guacaaucucugggugcugcuc

SEQ ID NO: 4155391 - RNA, 16 nt, Yersinia pestis
guacacauuauuuaua

SEQ ID NO: 4155392 - RNA, 15 nt, Yersinia pestis
guacauauaucacua

SEQ ID NO: 4155393 - RNA, 18 nt, Yersinia pestis
guaccaccaccaacagca

SEQ ID NO: 4155394 - RNA, 16 nt, Yersinia pestis
guaccaccaccacaaa

SEQ ID NO: 4155395 - RNA, 14 nt, Yersinia pestis
guacccauuauucu

SEQ ID NO: 4155396 - RNA, 18 nt, Yersinia pestis
guaccgcauaagacacca

SEQ ID NO: 4155397 - RNA, 17 nt, Yersinia pestis
guaccggcuccugccgc

SEQ ID NO: 4155398 - RNA, 23 nt, Yersinia pestis
guaccggcuccugccgcauccca

SEQ ID NO: 4155399 - RNA, 23 nt, Yersinia pestis
guaccgggccauagcccaugauu

SEQ ID NO: 4155400 - RNA, 18 nt, Yersinia pestis
guaccugaucagcauuuc

SEQ ID NO: 4155401 - RNA, 18 nt, Yersinia pestis
guaccugauguaacucag

SEQ ID NO: 4155402 - RNA, 18 nt, Yersinia pestis
guaccugcacugagccag

SEQ ID NO: 4155403 - RNA, 16 nt, Yersinia pestis
guaccugcaucaucac

SEQ ID NO: 4155404 - RNA, 23 nt, Yersinia pestis
guaccuugacgccgaugaauaua

SEQ ID NO: 4155405 - RNA, 17 nt, Yersinia pestis
guacgaaggggauaaau

SEQ ID NO: 4155406 - RNA, 21 nt, Yersinia pestis
guacgacgccagauagcauca

SEQ ID NO: 4155407 - RNA, 17 nt, Yersinia pestis
guacgccgaacuucauc

SEQ ID NO: 4155408 - RNA, 17 nt, Yersinia pestis
guacgcugauagccaau

SEQ ID NO: 4155409 - RNA, 22 nt, Yersinia pestis
guacgugacggcagcgagcacu

SEQ ID NO: 4155410 - RNA, 22 nt, Yersinia pestis
guacgugacggcggcgagcacu

SEQ ID NO: 4155411 - RNA, 17 nt, Yersinia pestis
guacuagaucacagacg

SEQ ID NO: 4155412 - RNA, 13 nt, Yersinia pestis
guacuaucuauua

SEQ ID NO: 4155413 - RNA, 14 nt, Yersinia pestis
guacugcauguacg

SEQ ID NO: 4155414 - RNA, 21 nt, Yersinia pestis
guacuggaucacaaugcaaau

SEQ ID NO: 4155415 - RNA, 20 nt, Yersinia pestis
guacuggcgcgcuuuggauc

SEQ ID NO: 4155416 - RNA, 16 nt, Yersinia pestis
guacuguuaacucaug

SEQ ID NO: 4155417 - RNA, 18 nt, Yersinia pestis
guacuucagguaauaacg

SEQ ID NO: 4155418 - RNA, 23 nt, Yersinia pestis
guacuuccaauaagugauucgag

SEQ ID NO: 4155419 - RNA, 16 nt, Yersinia pestis
guacuugacgcugcag

SEQ ID NO: 4155420 - RNA, 16 nt, Yersinia pestis
guacuuggucacugua

SEQ ID NO: 4155421 - RNA, 18 nt, Yersinia pestis
guagaaaaucguuguauu

SEQ ID NO: 4155422 - RNA, 19 nt, Yersinia pestis
guagaacuuauggggcacu

SEQ ID NO: 4155423 - RNA, 15 nt, Yersinia pestis
guagacauggcaacg

SEQ ID NO: 4155424 - RNA, 14 nt, Yersinia pestis
guagaccaccaacu

SEQ ID NO: 4155425 - RNA, 19 nt, Yersinia pestis
guagaccaccaacuccugc

SEQ ID NO: 4155426 - RNA, 19 nt, Yersinia pestis
guagacuuuguacuucgaa

SEQ ID NO: 4155427 - RNA, 19 nt, Yersinia pestis
guagagcacuucauuuucu

SEQ ID NO: 4155428 - RNA, 22 nt, Yersinia pestis
guagagcacuucauuuucucgc

SEQ ID NO: 4155429 - RNA, 15 nt, Yersinia pestis
guagagccuuuacgg

SEQ ID NO: 4155430 - RNA, 14 nt, Yersinia pestis
guagaguugcaguu

SEQ ID NO: 4155431 - RNA, 18 nt, Yersinia pestis
guagauggccaucucaau

SEQ ID NO: 4155432 - RNA, 18 nt, Yersinia pestis
guagcagcccaacacuuu

SEQ ID NO: 4155433 - RNA, 21 nt, Yersinia pestis
guagcauggcuuuaugaccaa

SEQ ID NO: 4155434 - RNA, 17 nt, Yersinia pestis
guagccaauagacaaaa

SEQ ID NO: 4155435 - RNA, 19 nt, Yersinia pestis
guagccgcaggcgaugcaa

SEQ ID NO: 4155436 - RNA, 14 nt, Yersinia pestis
guagcucagccugu

SEQ ID NO: 4155437 - RNA, 22 nt, Yersinia pestis
guagcucgccuucauuaucaug

SEQ ID NO: 4155438 - RNA, 20 nt, Yersinia pestis
guagcucggccccuaacuga

SEQ ID NO: 4155439 - RNA, 19 nt, Yersinia pestis
guagcuuuuuaaauaccag

SEQ ID NO: 4155440 - RNA, 16 nt, Yersinia pestis
guaggacggugccaug

SEQ ID NO: 4155441 - RNA, 16 nt, Yersinia pestis
guaggcaaagagauua

SEQ ID NO: 4155442 - RNA, 21 nt, Yersinia pestis
guaggcuaaagacuucagccc

SEQ ID NO: 4155443 - RNA, 22 nt, Yersinia pestis
guaggcuuauuaugacaacuga

SEQ ID NO: 4155444 - RNA, 13 nt, Yersinia pestis
guagggauaaauc

SEQ ID NO: 4155445 - RNA, 21 nt, Yersinia pestis
guagggauaaaucgcccaacc

SEQ ID NO: 4155446 - RNA, 12 nt, Yersinia pestis
guaguaaaaccu

SEQ ID NO: 4155447 - RNA, 22 nt, Yersinia pestis
guaguaaaaccuagcugcugca

SEQ ID NO: 4155448 - RNA, 18 nt, Yersinia pestis
guaguaagcaugccaucc

SEQ ID NO: 4155449 - RNA, 20 nt, Yersinia pestis
guaguacuggaucacaaugc

SEQ ID NO: 4155450 - RNA, 21 nt, Yersinia pestis
guagucauacaaaaugagccu

SEQ ID NO: 4155451 - RNA, 22 nt, Yersinia pestis
guagugacguaaaaaggcagug

SEQ ID NO: 4155452 - RNA, 21 nt, Yersinia pestis
guagugccgccagugcuuccg

SEQ ID NO: 4155453 - RNA, 11 nt, Yersinia pestis
guaguggggcu

SEQ ID NO: 4155454 - RNA, 18 nt, Yersinia pestis
guaguuaagguuagcuau

SEQ ID NO: 4155455 - RNA, 22 nt, Yersinia pestis
guaguucagucgcgauaaaauu

SEQ ID NO: 4155456 - RNA, 20 nt, Yersinia pestis
guauaaaaaagauaauaaaa

SEQ ID NO: 4155457 - RNA, 12 nt, Yersinia pestis
guauaaaaauag

SEQ ID NO: 4155458 - RNA, 12 nt, Yersinia pestis
guauaaauaccu

SEQ ID NO: 4155459 - RNA, 12 nt, Yersinia pestis
guauaacucauc

SEQ ID NO: 4155460 - RNA, 18 nt, Yersinia pestis
guauacaauugccugauu

SEQ ID NO: 4155461 - RNA, 16 nt, Yersinia pestis
guauacggucaaaagc

SEQ ID NO: 4155462 - RNA, 17 nt, Yersinia pestis
guauacggucaaaagcu

SEQ ID NO: 4155463 - RNA, 16 nt, Yersinia pestis
guauacgugucacauu

SEQ ID NO: 4155464 - RNA, 18 nt, Yersinia pestis
guauacuggcuagccugc

SEQ ID NO: 4155465 - RNA, 17 nt, Yersinia pestis
guauaucacuauuucag

SEQ ID NO: 4155466 - RNA, 17 nt, Yersinia pestis
guauaugccuauagccg

SEQ ID NO: 4155467 - RNA, 17 nt, Yersinia pestis
guauaugcugauaaaau

SEQ ID NO: 4155468 - RNA, 19 nt, Yersinia pestis
guauauguugggaaauaac

SEQ ID NO: 4155469 - RNA, 23 nt, Yersinia pestis
guauauugcucuggauucggcuu

SEQ ID NO: 4155470 - RNA, 17 nt, Yersinia pestis
guaucaacaauuuccau

SEQ ID NO: 4155471 - RNA, 16 nt, Yersinia pestis
guaucaauaccuuacu

SEQ ID NO: 4155472 - RNA, 14 nt, Yersinia pestis
guaucaaugaaaau

SEQ ID NO: 4155473 - RNA, 20 nt, Yersinia pestis
guaucaaugaaaauuagcug

SEQ ID NO: 4155474 - RNA, 22 nt, Yersinia pestis
guaucagaaauacgcuuuccaa

SEQ ID NO: 4155475 - RNA, 22 nt, Yersinia pestis
guaucagccccuaaauccugca

SEQ ID NO: 4155476 - RNA, 22 nt, Yersinia pestis
guaucauauguucgaucaaaac

SEQ ID NO: 4155477 - RNA, 20 nt, Yersinia pestis
guaucauuuuccugcauauu

SEQ ID NO: 4155478 - RNA, 19 nt, Yersinia pestis
guauccagugucaugcgca

SEQ ID NO: 4155479 - RNA, 19 nt, Yersinia pestis
guaucccggugaucaucgc

SEQ ID NO: 4155480 - RNA, 22 nt, Yersinia pestis
guaucccuggcucaucaaagga

SEQ ID NO: 4155481 - RNA, 23 nt, Yersinia pestis
guauccuggccguguuuuucccu

SEQ ID NO: 4155482 - RNA, 21 nt, Yersinia pestis
guaucgaugugguggauaaaa

SEQ ID NO: 4155483 - RNA, 19 nt, Yersinia pestis
guaucgcaguuaaagacau

SEQ ID NO: 4155484 - RNA, 17 nt, Yersinia pestis
gucaucaugacgaugac

SEQ ID NO: 4155485 - RNA, 23 nt, Yersinia pestis
gucaucgaacccgcuaacaugcc

SEQ ID NO: 4155486 - RNA, 23 nt, Yersinia pestis
gucaucggggguugucugcagaa

SEQ ID NO: 4155487 - RNA, 19 nt, Yersinia pestis
gucaucgucggcccggcca

SEQ ID NO: 4155488 - RNA, 19 nt, Yersinia pestis
gucaugauagacagcaaac

SEQ ID NO: 4155489 - RNA, 18 nt, Yersinia pestis
gucaugaugaauacgaua

SEQ ID NO: 4155490 - RNA, 19 nt, Yersinia pestis
gucaugaugaauacgauaa

SEQ ID NO: 4155491 - RNA, 17 nt, Yersinia pestis
gucauggagagcagggc

SEQ ID NO: 4155492 - RNA, 22 nt, Yersinia pestis
gucaugucgcuguagcgccagg

SEQ ID NO: 4155493 - RNA, 18 nt, Yersinia pestis
gucauguugaccaaacag

SEQ ID NO: 4155494 - RNA, 20 nt, Yersinia pestis
gucauguugaccaaacagaa

SEQ ID NO: 4155495 - RNA, 13 nt, Yersinia pestis
gucauuaacacau

SEQ ID NO: 4155496 - RNA, 22 nt, Yersinia pestis
gucauuaacguuguuauuucug

SEQ ID NO: 4155497 - RNA, 15 nt, Yersinia pestis
gucauuaccaauggu

SEQ ID NO: 4155498 - RNA, 13 nt, Yersinia pestis
gucauucacugug

SEQ ID NO: 4155499 - RNA, 22 nt, Yersinia pestis
gucauuccaaccuuguaacuuu

SEQ ID NO: 4155500 - RNA, 20 nt, Yersinia pestis
gucauucuugguggagccug

SEQ ID NO: 4155501 - RNA, 18 nt, Yersinia pestis
gucauugccugcucaccg

SEQ ID NO: 4155502 - RNA, 12 nt, Yersinia pestis
gucauuggaguc

SEQ ID NO: 4155503 - RNA, 17 nt, Yersinia pestis
gucauuguagauggcca

SEQ ID NO: 4155504 - RNA, 17 nt, Yersinia pestis
gucauuuuauuagacau

SEQ ID NO: 4155505 - RNA, 18 nt, Yersinia pestis
guccaacaucuccgccaa

SEQ ID NO: 4155506 - RNA, 17 nt, Yersinia pestis
guccaacucccaaauau

SEQ ID NO: 4155507 - RNA, 17 nt, Yersinia pestis
guccacagucaguucau

SEQ ID NO: 4155508 - RNA, 22 nt, Yersinia pestis
guccagaacaauaccgccaaua

SEQ ID NO: 4155509 - RNA, 12 nt, Yersinia pestis
guccagaugcca

SEQ ID NO: 4155510 - RNA, 20 nt, Yersinia pestis
guccaugggccucaucugcg

SEQ ID NO: 4155511 - RNA, 18 nt, Yersinia pestis
gucccaagaaaagcaccg

SEQ ID NO: 4155512 - RNA, 12 nt, Yersinia pestis
gucccccucaca

SEQ ID NO: 4155513 - RNA, 21 nt, Yersinia pestis
gucccuaaagccaucgccauc

SEQ ID NO: 4155514 - RNA, 14 nt, Yersinia pestis
gucccugauggggc

SEQ ID NO: 4155515 - RNA, 20 nt, Yersinia pestis
guccgcgccaaggauggcgc

SEQ ID NO: 4155516 - RNA, 17 nt, Yersinia pestis
guccggguuuacccagc

SEQ ID NO: 4155517 - RNA, 16 nt, Yersinia pestis
guccgucuuguauuua

SEQ ID NO: 4155518 - RNA, 14 nt, Yersinia pestis
guccguguuggcaa

SEQ ID NO: 4155519 - RNA, 15 nt, Yersinia pestis
guccucaaacccaca

SEQ ID NO: 4155520 - RNA, 11 nt, Yersinia pestis
guccuccugcc

SEQ ID NO: 4155521 - RNA, 19 nt, Yersinia pestis
guccucugauuguaacaau

SEQ ID NO: 4155522 - RNA, 23 nt, Yersinia pestis
guccugauucgcgaccagcagaa

SEQ ID NO: 4155523 - RNA, 15 nt, Yersinia pestis
guccuuuaacucaau

SEQ ID NO: 4155524 - RNA, 12 nt, Yersinia pestis
gucgaaagcuca

SEQ ID NO: 4155525 - RNA, 14 nt, Yersinia pestis
gucgaacauaaaaa

SEQ ID NO: 4155526 - RNA, 18 nt, Yersinia pestis
gucgaacauaaaaaugca

SEQ ID NO: 4155527 - RNA, 20 nt, Yersinia pestis
gucgaaggguaucagcgacc

SEQ ID NO: 4155528 - RNA, 16 nt, Yersinia pestis
gucgacaaaaugugaa

SEQ ID NO: 4155529 - RNA, 15 nt, Yersinia pestis
gucgaccgcucuuca

SEQ ID NO: 4155530 - RNA, 16 nt, Yersinia pestis
gucgaccgcucuucac

SEQ ID NO: 4155531 - RNA, 15 nt, Yersinia pestis
gucgaggaucaccac

SEQ ID NO: 4155532 - RNA, 20 nt, Yersinia pestis
gucgauaagcacuccacugg

SEQ ID NO: 4155533 - RNA, 18 nt, Yersinia pestis
gucgauccgauaauaauu

SEQ ID NO: 4155534 - RNA, 13 nt, Yersinia pestis
gucgcacccaaac

SEQ ID NO: 4155535 - RNA, 16 nt, Yersinia pestis
gucgcacugauagcaa

SEQ ID NO: 4155536 - RNA, 13 nt, Yersinia pestis
gucgcagaaccca

SEQ ID NO: 4155537 - RNA, 16 nt, Yersinia pestis
gucgcagaacccaggg

SEQ ID NO: 4155538 - RNA, 20 nt, Yersinia pestis
gucgcagaacccagggcgau

SEQ ID NO: 4155539 - RNA, 13 nt, Yersinia pestis
gucgccaccccau

SEQ ID NO: 4155540 - RNA, 19 nt, Yersinia pestis
gucgccaguugcagcaagc

SEQ ID NO: 4155541 - RNA, 22 nt, Yersinia pestis
gucgcccugaauuucaauaaca

SEQ ID NO: 4155542 - RNA, 14 nt, Yersinia pestis
gucgccucuggggc

SEQ ID NO: 4155543 - RNA, 19 nt, Yersinia pestis
gucgcgggcacuuugucaa

SEQ ID NO: 4155544 - RNA, 13 nt, Yersinia pestis
gucgcucaagccu

SEQ ID NO: 4155545 - RNA, 22 nt, Yersinia pestis
gucgcugaaaugcuauggguaa

SEQ ID NO: 4155546 - RNA, 19 nt, Yersinia pestis
gucgcuguagcgccaggua

SEQ ID NO: 4155547 - RNA, 12 nt, Yersinia pestis
gucgcuguuacu

SEQ ID NO: 4155548 - RNA, 21 nt, Yersinia pestis
gucggcagaaaucguauuauc

SEQ ID NO: 4155549 - RNA, 13 nt, Yersinia pestis
gucggccaguucg

SEQ ID NO: 4155550 - RNA, 14 nt, Yersinia pestis
gucgggccaauaaa

SEQ ID NO: 4155551 - RNA, 14 nt, Yersinia pestis
gucgguaaccugaa

SEQ ID NO: 4155552 - RNA, 14 nt, Yersinia pestis
gucgguaagcuggc

SEQ ID NO: 4155553 - RNA, 22 nt, Yersinia pestis
gucgucgaauccaugaugacaa

SEQ ID NO: 4155554 - RNA, 15 nt, Yersinia pestis
gucgucuucagcuuc

SEQ ID NO: 4155555 - RNA, 11 nt, Yersinia pestis
gucuaaacgcc

SEQ ID NO: 4155556 - RNA, 14 nt, Yersinia pestis
gucuaacaacuggu

SEQ ID NO: 4155557 - RNA, 22 nt, Yersinia pestis
gucuaacaguuguuucaauaaa

SEQ ID NO: 4155558 - RNA, 14 nt, Yersinia pestis
gucuaaugacagac

SEQ ID NO: 4155559 - RNA, 20 nt, Yersinia pestis
gucuacuggcugagagccgc

SEQ ID NO: 4155560 - RNA, 16 nt, Yersinia pestis
gucuauagugccuaau

SEQ ID NO: 4155561 - RNA, 17 nt, Yersinia pestis
gucuauugaaaaaauaa

SEQ ID NO: 4155562 - RNA, 22 nt, Yersinia pestis
gucuauugaaaaaauaaugucc

SEQ ID NO: 4155563 - RNA, 14 nt, Yersinia pestis
gucuauugcccguu

SEQ ID NO: 4155564 - RNA, 13 nt, Yersinia pestis
gucuauuuucauu

SEQ ID NO: 4155565 - RNA, 23 nt, Yersinia pestis
gucucaaggucuuucgcccacaa

SEQ ID NO: 4155566 - RNA, 14 nt, Yersinia pestis
gucucaaugcagua

SEQ ID NO: 4155567 - RNA, 22 nt, Yersinia pestis
gucucacccgcuugucuugaaa

SEQ ID NO: 4155568 - RNA, 14 nt, Yersinia pestis
gucucgcaaugaaa

SEQ ID NO: 4155569 - RNA, 18 nt, Yersinia pestis
gucucuacgacgcccgca

SEQ ID NO: 4155570 - RNA, 14 nt, Yersinia pestis
gucucuuugccaag

SEQ ID NO: 4155571 - RNA, 16 nt, Yersinia pestis
gucucuuuuucaucuu

SEQ ID NO: 4155572 - RNA, 14 nt, Yersinia pestis
gucugaauauaaau

SEQ ID NO: 4155573 - RNA, 13 nt, Yersinia pestis
gucugacagauac

SEQ ID NO: 4155574 - RNA, 15 nt, Yersinia pestis
gucugagccucauga

SEQ ID NO: 4155575 - RNA, 21 nt, Yersinia pestis
gucugauaaccguuuuuucaa

SEQ ID NO: 4155576 - RNA, 21 nt, Yersinia pestis
gucugccagaauuuugcagcg

SEQ ID NO: 4155577 - RNA, 15 nt, Yersinia pestis
gucugccauugcuca

SEQ ID NO: 4155578 - RNA, 18 nt, Yersinia pestis
gucuggcaauccagcgcc

SEQ ID NO: 4155579 - RNA, 21 nt, Yersinia pestis
gucugguggugaacggccauc

SEQ ID NO: 4155580 - RNA, 22 nt, Yersinia pestis
gucuguagcguuggccacgugc

SEQ ID NO: 4155581 - RNA, 16 nt, Yersinia pestis
gucuguuaugcccaac

SEQ ID NO: 4155582 - RNA, 20 nt, Yersinia pestis
gucuguuugucacggcggcc

SEQ ID NO: 4155583 - RNA, 14 nt, Yersinia pestis
gucuuacggagaag

SEQ ID NO: 4155584 - RNA, 15 nt, Yersinia pestis
gucuuagacgucaga

SEQ ID NO: 4155585 - RNA, 19 nt, Yersinia pestis
gucuuaucauaauccaacu

SEQ ID NO: 4155586 - RNA, 12 nt, Yersinia pestis
gucuucagcuuc

SEQ ID NO: 4155587 - RNA, 15 nt, Yersinia pestis
gucuucagcuuccgc

SEQ ID NO: 4155588 - RNA, 17 nt, Yersinia pestis
gucuucaguggcuggaa

SEQ ID NO: 4155589 - RNA, 23 nt, Yersinia pestis
gucuucaguggcuggaaaggaau

SEQ ID NO: 4155590 - RNA, 13 nt, Yersinia pestis
gucuucaucaucc

SEQ ID NO: 4155591 - RNA, 20 nt, Yersinia pestis
gucuuccaugacaaaauacg

SEQ ID NO: 4155592 - RNA, 21 nt, Yersinia pestis
gucuugacgguucgaaaauaa

SEQ ID NO: 4155593 - RNA, 17 nt, Yersinia pestis
gucuugaucaacucacg

SEQ ID NO: 4155594 - RNA, 17 nt, Yersinia pestis
gucuugcaccugaucgu

SEQ ID NO: 4155595 - RNA, 18 nt, Yersinia pestis
gucuuguuggucaccacu

SEQ ID NO: 4155596 - RNA, 18 nt, Yersinia pestis
gucuuuaauaaaaucaaa

SEQ ID NO: 4155597 - RNA, 17 nt, Yersinia pestis
gucuuuaccuccauaua

SEQ ID NO: 4155598 - RNA, 23 nt, Yersinia pestis
gucuuuucaaccaacacuccucu

SEQ ID NO: 4155599 - RNA, 17 nt, Yersinia pestis
gucuuuuuaauauguga

SEQ ID NO: 4155600 - RNA, 14 nt, Yersinia pestis
gugaaacaaauaca

SEQ ID NO: 4155601 - RNA, 15 nt, Yersinia pestis
gugaaacauaauuaa

SEQ ID NO: 4155602 - RNA, 22 nt, Yersinia pestis
gugaaacccgcgcagccuaaaa

SEQ ID NO: 4155603 - RNA, 14 nt, Yersinia pestis
gugaaaucaucaca

SEQ ID NO: 4155604 - RNA, 20 nt, Yersinia pestis
gugaacaggccccaaaauag

SEQ ID NO: 4155605 - RNA, 14 nt, Yersinia pestis
gugaacaugaugaa

SEQ ID NO: 4155606 - RNA, 18 nt, Yersinia pestis
guggcguucccgcaggcg

SEQ ID NO: 4155607 - RNA, 22 nt, Yersinia pestis
guggcuaauaaugcaccaauca

SEQ ID NO: 4155608 - RNA, 14 nt, Yersinia pestis
guggcuaccaauua

SEQ ID NO: 4155609 - RNA, 14 nt, Yersinia pestis
guggcuaucugaaa

SEQ ID NO: 4155610 - RNA, 22 nt, Yersinia pestis
guggcucaauccaaaugacacu

SEQ ID NO: 4155611 - RNA, 15 nt, Yersinia pestis
guggcugagacuucu

SEQ ID NO: 4155612 - RNA, 20 nt, Yersinia pestis
gugggccuguuugcagcgaa

SEQ ID NO: 4155613 - RNA, 17 nt, Yersinia pestis
guggggggagugugccg

SEQ ID NO: 4155614 - RNA, 23 nt, Yersinia pestis
guggguucuucaaagugguggca

SEQ ID NO: 4155615 - RNA, 18 nt, Yersinia pestis
gugguaucaaacaccggu

SEQ ID NO: 4155616 - RNA, 16 nt, Yersinia pestis
gugguauggauauuuu

SEQ ID NO: 4155617 - RNA, 20 nt, Yersinia pestis
guggucaugcucacaaucau

SEQ ID NO: 4155618 - RNA, 14 nt, Yersinia pestis
guggucauuuuguu

SEQ ID NO: 4155619 - RNA, 18 nt, Yersinia pestis
gugguccccagagcgcaa

SEQ ID NO: 4155620 - RNA, 13 nt, Yersinia pestis
guggucgcuggca

SEQ ID NO: 4155621 - RNA, 14 nt, Yersinia pestis
guggugaugaugac

SEQ ID NO: 4155622 - RNA, 12 nt, Yersinia pestis
gugguguuaucc

SEQ ID NO: 4155623 - RNA, 17 nt, Yersinia pestis
gugguguuggcuguggu

SEQ ID NO: 4155624 - RNA, 14 nt, Yersinia pestis
gugguuaacagcgu

SEQ ID NO: 4155625 - RNA, 19 nt, Yersinia pestis
gugguuaacagcgugcgcu

SEQ ID NO: 4155626 - RNA, 20 nt, Yersinia pestis
gugguuagcagauaauaaau

SEQ ID NO: 4155627 - RNA, 15 nt, Yersinia pestis
gugguucaaccaccg

SEQ ID NO: 4155628 - RNA, 21 nt, Yersinia pestis
gugguucuggcccuaaauggg

SEQ ID NO: 4155629 - RNA, 14 nt, Yersinia pestis
gugguuuggugguu

SEQ ID NO: 4155630 - RNA, 15 nt, Yersinia pestis
guguaaaaccuucgc

SEQ ID NO: 4155631 - RNA, 19 nt, Yersinia pestis
guguacucucccuuuucca

SEQ ID NO: 4155632 - RNA, 16 nt, Yersinia pestis
guguagauagccuugc

SEQ ID NO: 4155633 - RNA, 21 nt, Yersinia pestis
guguaggcaccaccaugauga

SEQ ID NO: 4155634 - RNA, 21 nt, Yersinia pestis
guguauaaaccggucauacau

SEQ ID NO: 4155635 - RNA, 15 nt, Yersinia pestis
guguauuuaaaagau

SEQ ID NO: 4155636 - RNA, 15 nt, Yersinia pestis
gugucagaccaaaua

SEQ ID NO: 4155637 - RNA, 18 nt, Yersinia pestis
gugucagaccaaauagca

SEQ ID NO: 4155638 - RNA, 17 nt, Yersinia pestis
gugucaggaugaugaau

SEQ ID NO: 4155639 - RNA, 19 nt, Yersinia pestis
gugucuggcaauccagcgc

SEQ ID NO: 4155640 - RNA, 15 nt, Yersinia pestis
gugugacuuucaauc

SEQ ID NO: 4155641 - RNA, 13 nt, Yersinia pestis
gugugauuuccau

SEQ ID NO: 4155642 - RNA, 14 nt, Yersinia pestis
gugugauuuccauc

SEQ ID NO: 4155643 - RNA, 17 nt, Yersinia pestis
gugugcagcaagaacaa

SEQ ID NO: 4155644 - RNA, 15 nt, Yersinia pestis
gugugcguacaggua

SEQ ID NO: 4155645 - RNA, 16 nt, Yersinia pestis
gugugcucacaaucuu

SEQ ID NO: 4155646 - RNA, 13 nt, Yersinia pestis
gugugcugggugu

SEQ ID NO: 4155647 - RNA, 17 nt, Yersinia pestis
gugugcuguaagaaaaa

SEQ ID NO: 4155648 - RNA, 18 nt, Yersinia pestis
guguggcaccaugcugcu

SEQ ID NO: 4155649 - RNA, 14 nt, Yersinia pestis
guguguaauuuuua

SEQ ID NO: 4155650 - RNA, 19 nt, Yersinia pestis
guguguggcaauaaaggca

SEQ ID NO: 4155651 - RNA, 16 nt, Yersinia pestis
guguguucaaaaaaua

SEQ ID NO: 4155652 - RNA, 18 nt, Yersinia pestis
guguuaaccgccccaaca

SEQ ID NO: 4155653 - RNA, 19 nt, Yersinia pestis
guguuacacaguuauuccc

SEQ ID NO: 4155654 - RNA, 11 nt, Yersinia pestis
guguuagcauc

SEQ ID NO: 4155655 - RNA, 13 nt, Yersinia pestis
guguugaaugacg

SEQ ID NO: 4155656 - RNA, 22 nt, Yersinia pestis
guguugacucaccggcugccug

SEQ ID NO: 4155657 - RNA, 16 nt, Yersinia pestis
guguuggaguaucaga

SEQ ID NO: 4155658 - RNA, 12 nt, Yersinia pestis
guguuggcaaaa

SEQ ID NO: 4155659 - RNA, 17 nt, Yersinia pestis
guguuguuuucaugaug

SEQ ID NO: 4155660 - RNA, 17 nt, Yersinia pestis
guguuuuggcuaaacca

SEQ ID NO: 4155661 - RNA, 15 nt, Yersinia pestis
guuaaaaaauucauc

SEQ ID NO: 4155662 - RNA, 22 nt, Yersinia pestis
guuaaaaaauucaucuuuaaca

SEQ ID NO: 4155663 - RNA, 22 nt, Yersinia pestis
guuaaaaugagcacggacagca

SEQ ID NO: 4155664 - RNA, 17 nt, Yersinia pestis
guuaaacgguaaccauc

SEQ ID NO: 4155665 - RNA, 17 nt, Yersinia pestis
guuaaacuucuuuaucu

SEQ ID NO: 4155666 - RNA, 20 nt, Yersinia pestis
guuaacaccaucaacauggg

SEQ ID NO: 4155667 - RNA, 11 nt, Yersinia pestis
guuaacccaaa

SEQ ID NO: 4155668 - RNA, 12 nt, Yersinia pestis
guuaacccaaag

SEQ ID NO: 4155669 - RNA, 20 nt, Yersinia pestis
guuaacugcaguaaaaauau

SEQ ID NO: 4155670 - RNA, 13 nt, Yersinia pestis
guuaagacaauua

SEQ ID NO: 4155671 - RNA, 19 nt, Yersinia pestis
guuaagagaucccgugcca

SEQ ID NO: 4155672 - RNA, 18 nt, Yersinia pestis
guuaagccgugcggcacu

SEQ ID NO: 4155673 - RNA, 12 nt, Yersinia pestis
guuaaguuucau

SEQ ID NO: 4155674 - RNA, 23 nt, Yersinia pestis
guuaauaccagaugcauauacug

SEQ ID NO: 4155675 - RNA, 16 nt, Yersinia pestis
guuaauaccugcacca

SEQ ID NO: 4155676 - RNA, 15 nt, Yersinia pestis
guuaaucaagccauc

SEQ ID NO: 4155677 - RNA, 15 nt, Yersinia pestis
guuaaugacauaucu

SEQ ID NO: 4155678 - RNA, 16 nt, Yersinia pestis
guuaaugccaccccca

SEQ ID NO: 4155679 - RNA, 14 nt, Yersinia pestis
guuaaugcggaucg

SEQ ID NO: 4155680 - RNA, 14 nt, Yersinia pestis
guuaauuuaaacag

SEQ ID NO: 4155681 - RNA, 17 nt, Yersinia pestis
guuaauuuucaccguau

SEQ ID NO: 4155682 - RNA, 23 nt, Yersinia pestis
guuacaacgagggcucaaucucu

SEQ ID NO: 4155683 - RNA, 17 nt, Yersinia pestis
guuacaccgaaauuaga

SEQ ID NO: 4155684 - RNA, 19 nt, Yersinia pestis
guuacaccgaaauuagaag

SEQ ID NO: 4155685 - RNA, 17 nt, Yersinia pestis
guuacagcaaggcggca

SEQ ID NO: 4155686 - RNA, 20 nt, Yersinia pestis
guuacaucaugaguaaaaga

SEQ ID NO: 4155687 - RNA, 19 nt, Yersinia pestis
guuaccagacccugcacca

SEQ ID NO: 4155688 - RNA, 16 nt, Yersinia pestis
guuaccuaaccaaaca

SEQ ID NO: 4155689 - RNA, 24 nt, Yersinia pestis
guuaccuauaaacuugauucacca

SEQ ID NO: 4155690 - RNA, 21 nt, Yersinia pestis
guuacgauacguugcagguca

SEQ ID NO: 4155691 - RNA, 16 nt, Yersinia pestis
guuacgggcuugcugc

SEQ ID NO: 4155692 - RNA, 18 nt, Yersinia pestis
guuacgggcuugcugcaa

SEQ ID NO: 4155693 - RNA, 15 nt, Yersinia pestis
guuacgugagcaucu

SEQ ID NO: 4155694 - RNA, 19 nt, Yersinia pestis
guuacgugagcaucuggcg

SEQ ID NO: 4155695 - RNA, 14 nt, Yersinia pestis
guuacucagcaucc

SEQ ID NO: 4155696 - RNA, 15 nt, Yersinia pestis
guuacuguaagauaa

SEQ ID NO: 4155697 - RNA, 19 nt, Yersinia pestis
guuacuguaagauaauucg

SEQ ID NO: 4155698 - RNA, 19 nt, Yersinia pestis
guuagacgacuagccuaac

SEQ ID NO: 4155699 - RNA, 21 nt, Yersinia pestis
guuagcgacgucuaauuguua

SEQ ID NO: 4155700 - RNA, 15 nt, Yersinia pestis
guuagcgaugacuga

SEQ ID NO: 4155701 - RNA, 14 nt, Yersinia pestis
guuaguucagacgu

SEQ ID NO: 4155702 - RNA, 20 nt, Yersinia pestis
guuauaaccaugaugacaau

SEQ ID NO: 4155703 - RNA, 23 nt, Yersinia pestis
guuauaacuauauucucauugcc

SEQ ID NO: 4155704 - RNA, 19 nt, Yersinia pestis
guuauaaggcuaacaccuu

SEQ ID NO: 4155705 - RNA, 14 nt, Yersinia pestis
guuauacacuugcu

SEQ ID NO: 4155706 - RNA, 23 nt, Yersinia pestis
guuauacugugcggacaauugau

SEQ ID NO: 4155707 - RNA, 20 nt, Yersinia pestis
guuauagaucuccugcaacg

SEQ ID NO: 4155708 - RNA, 17 nt, Yersinia pestis
guuauaggccuaaaccc

SEQ ID NO: 4155709 - RNA, 23 nt, Yersinia pestis
guuaucaagaucaaaagcagaga

SEQ ID NO: 4155710 - RNA, 14 nt, Yersinia pestis
guuaucacaucauc

SEQ ID NO: 4155711 - RNA, 16 nt, Yersinia pestis
guuaucgcuacguacu

SEQ ID NO: 4155712 - RNA, 19 nt, Yersinia pestis
guuaucgguauuuuugucg

SEQ ID NO: 4155713 - RNA, 23 nt, Yersinia pestis
guuaucggugcugacaaacagau

SEQ ID NO: 4155714 - RNA, 17 nt, Yersinia pestis
guuaucuuuuauuuaug

SEQ ID NO: 4155715 - RNA, 11 nt, Yersinia pestis
guuaugacacc

SEQ ID NO: 4155716 - RNA, 18 nt, Yersinia pestis
guuaugaggggaggcugu

SEQ ID NO: 4155717 - RNA, 20 nt, Yersinia pestis
guuaugaugaguaacauaau

SEQ ID NO: 4155718 - RNA, 18 nt, Yersinia pestis
guuauggcuuuacggcuc

SEQ ID NO: 4155719 - RNA, 14 nt, Yersinia pestis
guuauuaacuucaa

SEQ ID NO: 4155720 - RNA, 20 nt, Yersinia pestis
guuauuacugucauugcugu

SEQ ID NO: 4155721 - RNA, 12 nt, Yersinia pestis
guuauuaucaug

SEQ ID NO: 4155722 - RNA, 14 nt, Yersinia pestis
guuauuaucaugaa

SEQ ID NO: 4155723 - RNA, 15 nt, Yersinia pestis
guuauuaucaugaag

SEQ ID NO: 4155724 - RNA, 20 nt, Yersinia pestis
guuauucuuuauuuauuuua

SEQ ID NO: 4155725 - RNA, 21 nt, Yersinia pestis
guuauugaauauuuaaauuac

SEQ ID NO: 4155726 - RNA, 22 nt, Yersinia pestis
guuauuuaucauaaauaaaaga

SEQ ID NO: 4155727 - RNA, 19 nt, Yersinia pestis
guuauuugccguauucagc

SEQ ID NO: 4155728 - RNA, 14 nt, Yersinia pestis
guugugcauauauu

SEQ ID NO: 4155729 - RNA, 17 nt, Yersinia pestis
guuguuauuucuguucc

SEQ ID NO: 4155730 - RNA, 18 nt, Yersinia pestis
guuguucaacgccauagc

SEQ ID NO: 4155731 - RNA, 16 nt, Yersinia pestis
guuguucgugaaagca

SEQ ID NO: 4155732 - RNA, 21 nt, Yersinia pestis
guuguugaccucaaaauacau

SEQ ID NO: 4155733 - RNA, 15 nt, Yersinia pestis
guuguuucugaaggg

SEQ ID NO: 4155734 - RNA, 14 nt, Yersinia pestis
guuuaaaaaauauc

SEQ ID NO: 4155735 - RNA, 23 nt, Yersinia pestis
guuuaaaucuuucuccaguaaaa

SEQ ID NO: 4155736 - RNA, 15 nt, Yersinia pestis
guuuaacuaggcgag

SEQ ID NO: 4155737 - RNA, 14 nt, Yersinia pestis
guuuaacucaaaua

SEQ ID NO: 4155738 - RNA, 16 nt, Yersinia pestis
guuuaacucaaauaaa

SEQ ID NO: 4155739 - RNA, 20 nt, Yersinia pestis
guuuaacucaaauaaaccaa

SEQ ID NO: 4155740 - RNA, 14 nt, Yersinia pestis
guuuaaugccccuu

SEQ ID NO: 4155741 - RNA, 15 nt, Yersinia pestis
guuuaauuucacuuc

SEQ ID NO: 4155742 - RNA, 21 nt, Yersinia pestis
guuuaauuucacuuccauucc

SEQ ID NO: 4155743 - RNA, 16 nt, Yersinia pestis
guuuacccagccaaga

SEQ ID NO: 4155744 - RNA, 19 nt, Yersinia pestis
guuuaccgcugcagggccu

SEQ ID NO: 4155745 - RNA, 11 nt, Yersinia pestis
guuuaccggca

SEQ ID NO: 4155746 - RNA, 13 nt, Yersinia pestis
guuuaccuauugc

SEQ ID NO: 4155747 - RNA, 20 nt, Yersinia pestis
guuuaccuggaguaaugagg

SEQ ID NO: 4155748 - RNA, 20 nt, Yersinia pestis
guuuacgcacguugagugau

SEQ ID NO: 4155749 - RNA, 13 nt, Yersinia pestis
guuuacguaaaua

SEQ ID NO: 4155750 - RNA, 14 nt, Yersinia pestis
guuuacucgcuccg

SEQ ID NO: 4155751 - RNA, 12 nt, Yersinia pestis
guuuacugcuua

SEQ ID NO: 4155752 - RNA, 14 nt, Yersinia pestis
guuuagcucucaga

SEQ ID NO: 4155753 - RNA, 15 nt, Yersinia pestis
guuuauaaauuaaaa

SEQ ID NO: 4155754 - RNA, 15 nt, Yersinia pestis
guuuaucaaacagca

SEQ ID NO: 4155755 - RNA, 16 nt, Yersinia pestis
guuuaucaaacagcac

SEQ ID NO: 4155756 - RNA, 22 nt, Yersinia pestis
guuuaucaaacagcacaucgcc

SEQ ID NO: 4155757 - RNA, 21 nt, Yersinia pestis
guuuauccuuuuuauuuaagc

SEQ ID NO: 4155758 - RNA, 22 nt, Yersinia pestis
guuuauccuuuuuauuuaagca

SEQ ID NO: 4155759 - RNA, 16 nt, Yersinia pestis
guuuaucuucuacuua

SEQ ID NO: 4155760 - RNA, 12 nt, Yersinia pestis
guuuauuauuca

SEQ ID NO: 4155761 - RNA, 17 nt, Yersinia pestis
guuucaaauaaguauuu

SEQ ID NO: 4155762 - RNA, 16 nt, Yersinia pestis
guuucaaauaguagau

SEQ ID NO: 4155763 - RNA, 18 nt, Yersinia pestis
guuucaacauccaguucg

SEQ ID NO: 4155764 - RNA, 17 nt, Yersinia pestis
guuucaauaaaucccgc

SEQ ID NO: 4155765 - RNA, 15 nt, Yersinia pestis
guuucagacuccugc

SEQ ID NO: 4155766 - RNA, 17 nt, Yersinia pestis
guuucagcuugcaacaa

SEQ ID NO: 4155767 - RNA, 12 nt, Yersinia pestis
guuucagggugg

SEQ ID NO: 4155768 - RNA, 16 nt, Yersinia pestis
guuucaguaagauacu

SEQ ID NO: 4155769 - RNA, 18 nt, Yersinia pestis
guuucaguauuguauaca

SEQ ID NO: 4155770 - RNA, 18 nt, Yersinia pestis
guuucaucgacucuuuuu

SEQ ID NO: 4155771 - RNA, 17 nt, Yersinia pestis
guuucauuugcuguggc

SEQ ID NO: 4155772 - RNA, 18 nt, Yersinia pestis
guuucauuugcuguggcg

SEQ ID NO: 4155773 - RNA, 21 nt, Yersinia pestis
guuuccaaaacucauguccag

SEQ ID NO: 4155774 - RNA, 17 nt, Yersinia pestis
guuuccaguacugacca

SEQ ID NO: 4155775 - RNA, 21 nt, Yersinia pestis
guuucccuucgcgcaguaaac

SEQ ID NO: 4155776 - RNA, 14 nt, Yersinia pestis
guuuccuucaccaa

SEQ ID NO: 4155777 - RNA, 20 nt, Yersinia pestis
guuucgcaucaggcuuauau

SEQ ID NO: 4155778 - RNA, 21 nt, Yersinia pestis
guuucgccaaaucuucggcuu

SEQ ID NO: 4155779 - RNA, 16 nt, Yersinia pestis
guuucguuaaauauga

SEQ ID NO: 4155780 - RNA, 16 nt, Yersinia pestis
guuucguuuacugccu

SEQ ID NO: 4155781 - RNA, 22 nt, Yersinia pestis
guuucuauccgaaaaauauucu

SEQ ID NO: 4155782 - RNA, 18 nt, Yersinia pestis
guuucuccgguaauaguu

SEQ ID NO: 4155783 - RNA, 20 nt, Yersinia pestis
guuucucugccgccagauuu

SEQ ID NO: 4155784 - RNA, 22 nt, Yersinia pestis
guuucuucguuugcuaaugcgg

SEQ ID NO: 4155785 - RNA, 14 nt, Yersinia pestis
guuucuucuggaau

SEQ ID NO: 4155786 - RNA, 18 nt, Yersinia pestis
guuugaugcgcugagcaa

SEQ ID NO: 4155787 - RNA, 17 nt, Yersinia pestis
guuugccagugcaugca

SEQ ID NO: 4155788 - RNA, 23 nt, Yersinia pestis
guuugccagugcaugcaggucaa

SEQ ID NO: 4155789 - RNA, 17 nt, Yersinia pestis
guuuguaucgaugauca

SEQ ID NO: 4155790 - RNA, 17 nt, Yersinia pestis
guuuguuacgggcacug

SEQ ID NO: 4155791 - RNA, 19 nt, Yersinia pestis
guuuguuucucugccgcca

SEQ ID NO: 4155792 - RNA, 17 nt, Yersinia pestis
guuuuaaaaaaaaagaa

SEQ ID NO: 4155793 - RNA, 13 nt, Yersinia pestis
guuuuaaauuacg

SEQ ID NO: 4155794 - RNA, 20 nt, Yersinia pestis
guuuuaacguacccucccag

SEQ ID NO: 4155795 - RNA, 17 nt, Yersinia pestis
guuuuaauaucugccgc

SEQ ID NO: 4155796 - RNA, 22 nt, Yersinia pestis
guuuuacgcgaccauucauccc

SEQ ID NO: 4155797 - RNA, 15 nt, Yersinia pestis
guuuuaucaauaggu

SEQ ID NO: 4155798 - RNA, 22 nt, Yersinia pestis
guuuuaucaauaggucaguggu

SEQ ID NO: 4155799 - RNA, 17 nt, Yersinia pestis
guuuuauugcaacuggg

SEQ ID NO: 4155800 - RNA, 21 nt, Yersinia pestis
guuuucccgacagaacugauu

SEQ ID NO: 4155801 - RNA, 21 nt, Yersinia pestis
guuuucccugcgccagcagca

SEQ ID NO: 4155802 - RNA, 18 nt, Yersinia pestis
guuuucuccacaccaacg

SEQ ID NO: 4155803 - RNA, 18 nt, Yersinia pestis
guuuucuggcaauuucug

SEQ ID NO: 4155804 - RNA, 17 nt, Yersinia pestis
guuuugcaucaagcucu

SEQ ID NO: 4155805 - RNA, 13 nt, Yersinia pestis
guuuugcucugca

SEQ ID NO: 4155806 - RNA, 13 nt, Yersinia pestis
guuuuuaacaaaa

SEQ ID NO: 4155807 - RNA, 12 nt, Yersinia pestis
guuuuuaaggac

SEQ ID NO: 4155808 - RNA, 20 nt, Yersinia pestis
guuuuuacgugauauaccac

SEQ ID NO: 4155809 - RNA, 16 nt, Yersinia pestis
guuuuuagcuuaacau

SEQ ID NO: 4155810 - RNA, 23 nt, Yersinia pestis
guuuuuauauuuaccugcucaac

SEQ ID NO: 4155811 - RNA, 16 nt, Yersinia pestis
guuuuuauuacagagu

SEQ ID NO: 4155812 - RNA, 20 nt, Yersinia pestis
guuuuucccguaggcugacc

SEQ ID NO: 4155813 - RNA, 23 nt, Yersinia pestis
guuuuugaccaugcuuauugcca

SEQ ID NO: 4155814 - RNA, 13 nt, Yersinia pestis
guuuuuuaaaaaa

SEQ ID NO: 4155815 - RNA, 15 nt, Yersinia pestis
guuuuuucaacuggc

SEQ ID NO: 4155816 - RNA, 14 nt, Yersinia pestis
guuuuuucuuucuu

SEQ ID NO: 4155817 - RNA, 12 nt, Yersinia pestis
guuuuuuugcca

SEQ ID NO: 4155818 - RNA, 17 nt, Yersinia pestis
guuuuuuuuaucagccc

SEQ ID NO: 4155819 - RNA, 23 nt, Yersinia pestis
guuuuuuuuauuauuuuuugggg

SEQ ID NO: 4155820 - RNA, 15 nt, Yersinia pestis
uaaaaaaaaagaaaa

SEQ ID NO: 4155821 - RNA, 13 nt, Yersinia pestis
uaaaaaaaaauaa

SEQ ID NO: 4155822 - RNA, 16 nt, Yersinia pestis
uaaaaaaaaauaaaau

SEQ ID NO: 4155823 - RNA, 19 nt, Yersinia pestis
uaaaaaaauuaaaauaaug

SEQ ID NO: 4155824 - RNA, 21 nt, Yersinia pestis
uaaaaaaauucugagaucuaa

SEQ ID NO: 4155825 - RNA, 15 nt, Yersinia pestis
uaaaaaacgggcuug

SEQ ID NO: 4155826 - RNA, 16 nt, Yersinia pestis
uaaaaaaggguaauca

SEQ ID NO: 4155827 - RNA, 22 nt, Yersinia pestis
uaaaaaagguggccauuacgcc

SEQ ID NO: 4155828 - RNA, 17 nt, Yersinia pestis
uaaaaaaucuauugauu

SEQ ID NO: 4155829 - RNA, 22 nt, Yersinia pestis
uaaaaaaucuauugauugcuua

SEQ ID NO: 4155830 - RNA, 13 nt, Yersinia pestis
uaaaaaauuauua

SEQ ID NO: 4155831 - RNA, 15 nt, Yersinia pestis
uaaaaaauuauuaaa

SEQ ID NO: 4155832 - RNA, 17 nt, Yersinia pestis
uaaaaaauuauuaaaua

SEQ ID NO: 4155833 - RNA, 22 nt, Yersinia pestis
uaaaaaauuauuaaauaagaag

SEQ ID NO: 4155834 - RNA, 12 nt, Yersinia pestis
uaaaaacauuga

SEQ ID NO: 4155835 - RNA, 17 nt, Yersinia pestis
uaaaaaccaauggaaaa

SEQ ID NO: 4155836 - RNA, 22 nt, Yersinia pestis
uaaaaaccaauggaaaauacac

SEQ ID NO: 4155837 - RNA, 21 nt, Yersinia pestis
uaaaaaccaucugaugcaggu

SEQ ID NO: 4155838 - RNA, 17 nt, Yersinia pestis
uaaaaacccauaagucc

SEQ ID NO: 4155839 - RNA, 20 nt, Yersinia pestis
uaaaaacccauaaguccuua

SEQ ID NO: 4155840 - RNA, 22 nt, Yersinia pestis
uaaaaacccucucauccugcua

SEQ ID NO: 4155841 - RNA, 18 nt, Yersinia pestis
uaaaaacccucuucaauc

SEQ ID NO: 4155842 - RNA, 23 nt, Yersinia pestis
uaaaaaccgcagcagacaacuga

SEQ ID NO: 4155843 - RNA, 18 nt, Yersinia pestis
uaaaaacuaaggggccaa

SEQ ID NO: 4155844 - RNA, 19 nt, Yersinia pestis
uaaaaacuuaucuaaaaaa

SEQ ID NO: 4155845 - RNA, 21 nt, Yersinia pestis
uaaaaacuuaucuaaaaaacc

SEQ ID NO: 4155846 - RNA, 23 nt, Yersinia pestis
uaaaaagaucugcauugauuaaa

SEQ ID NO: 4155847 - RNA, 18 nt, Yersinia pestis
uaaaaagcagcaaacgaa

SEQ ID NO: 4155848 - RNA, 13 nt, Yersinia pestis
uaaaaagucagcu

SEQ ID NO: 4155849 - RNA, 17 nt, Yersinia pestis
uaaaaauaaauucuuua

SEQ ID NO: 4155850 - RNA, 21 nt, Yersinia pestis
uaaagauuucaucauucaaua

SEQ ID NO: 4155851 - RNA, 17 nt, Yersinia pestis
uaaagauuuuaagcacu

SEQ ID NO: 4155852 - RNA, 16 nt, Yersinia pestis
uaaagcaaacgccgcu

SEQ ID NO: 4155853 - RNA, 18 nt, Yersinia pestis
uaaagcacccacaccgca

SEQ ID NO: 4155854 - RNA, 20 nt, Yersinia pestis
uaaagcaggccuucuaacuc

SEQ ID NO: 4155855 - RNA, 21 nt, Yersinia pestis
uaaagcagguaguuacagcaa

SEQ ID NO: 4155856 - RNA, 15 nt, Yersinia pestis
uaaagccauucagca

SEQ ID NO: 4155857 - RNA, 16 nt, Yersinia pestis
uaaagccauucagcag

SEQ ID NO: 4155858 - RNA, 15 nt, Yersinia pestis
uaaagccauuucagu

SEQ ID NO: 4155859 - RNA, 14 nt, Yersinia pestis
uaaagcccgcuuca

SEQ ID NO: 4155860 - RNA, 13 nt, Yersinia pestis
uaaagccuugucc

SEQ ID NO: 4155861 - RNA, 17 nt, Yersinia pestis
uaaagccuuucagcgcu

SEQ ID NO: 4155862 - RNA, 23 nt, Yersinia pestis
uaaagcgauaaauacucccgcca

SEQ ID NO: 4155863 - RNA, 15 nt, Yersinia pestis
uaaagcgccuuccuu

SEQ ID NO: 4155864 - RNA, 16 nt, Yersinia pestis
uaaagcgguaaauggc

SEQ ID NO: 4155865 - RNA, 23 nt, Yersinia pestis
uaaagcguccgcgccaaggaagg

SEQ ID NO: 4155866 - RNA, 13 nt, Yersinia pestis
uaaagcuggagcc

SEQ ID NO: 4155867 - RNA, 13 nt, Yersinia pestis
uaaaggcaaagaa

SEQ ID NO: 4155868 - RNA, 22 nt, Yersinia pestis
uaaaggcaacgaaggcaacaac

SEQ ID NO: 4155869 - RNA, 14 nt, Yersinia pestis
uaaaggcaucucac

SEQ ID NO: 4155870 - RNA, 19 nt, Yersinia pestis
uaaaggcccaaucuugcaa

SEQ ID NO: 4155871 - RNA, 18 nt, Yersinia pestis
uaaaggcgagucagcaca

SEQ ID NO: 4155872 - RNA, 22 nt, Yersinia pestis
uaaaggggggaaacgguuuuaa

SEQ ID NO: 4155873 - RNA, 18 nt, Yersinia pestis
uaaagguauagcgauaga

SEQ ID NO: 4155874 - RNA, 14 nt, Yersinia pestis
uaaaggugauauca

SEQ ID NO: 4155875 - RNA, 15 nt, Yersinia pestis
uaaagucaucccgca

SEQ ID NO: 4155876 - RNA, 15 nt, Yersinia pestis
uaaagugcguaggca

SEQ ID NO: 4155877 - RNA, 20 nt, Yersinia pestis
uaaagugcuucucugccgcu

SEQ ID NO: 4155878 - RNA, 21 nt, Yersinia pestis
uaaaguguacuguuaacucau

SEQ ID NO: 4155879 - RNA, 15 nt, Yersinia pestis
uaaaguuaucaccaa

SEQ ID NO: 4155880 - RNA, 18 nt, Yersinia pestis
uaaaguuauguuuuuccu

SEQ ID NO: 4155881 - RNA, 15 nt, Yersinia pestis
uaaaguugaaccaau

SEQ ID NO: 4155882 - RNA, 21 nt, Yersinia pestis
uaaaguuuuuuauuuauagaa

SEQ ID NO: 4155883 - RNA, 15 nt, Yersinia pestis
uaaauaaaauaauaa

SEQ ID NO: 4155884 - RNA, 19 nt, Yersinia pestis
uaaauaaagugcuucucug

SEQ ID NO: 4155885 - RNA, 15 nt, Yersinia pestis
uaaauaacagcuaaa

SEQ ID NO: 4155886 - RNA, 12 nt, Yersinia pestis
uaaauaagaagu

SEQ ID NO: 4155887 - RNA, 14 nt, Yersinia pestis
uaaauaaguaggca

SEQ ID NO: 4155888 - RNA, 16 nt, Yersinia pestis
uaaauaauaucaauga

SEQ ID NO: 4155889 - RNA, 13 nt, Yersinia pestis
uaaauaauugggg

SEQ ID NO: 4155890 - RNA, 22 nt, Yersinia pestis
uaaauacaaaauuaacggcuca

SEQ ID NO: 4155891 - RNA, 16 nt, Yersinia pestis
uaaauacagcaccauu

SEQ ID NO: 4155892 - RNA, 23 nt, Yersinia pestis
uaaauacagcaccauucaaugua

SEQ ID NO: 4155893 - RNA, 15 nt, Yersinia pestis
uaaauacauggcgau

SEQ ID NO: 4155894 - RNA, 18 nt, Yersinia pestis
uaaauaccaauuucauac

SEQ ID NO: 4155895 - RNA, 22 nt, Yersinia pestis
uaaauaccaauuucauacaggc

SEQ ID NO: 4155896 - RNA, 18 nt, Yersinia pestis
uaaauacccgguuuccag

SEQ ID NO: 4155897 - RNA, 19 nt, Yersinia pestis
uaaauaccgccaaauacaa

SEQ ID NO: 4155898 - RNA, 18 nt, Yersinia pestis
uaaauacucuugagaaau

SEQ ID NO: 4155899 - RNA, 23 nt, Yersinia pestis
uaaauagagugaaguaucaccac

SEQ ID NO: 4155900 - RNA, 18 nt, Yersinia pestis
uaaauagcaaaacugagg

SEQ ID NO: 4155901 - RNA, 15 nt, Yersinia pestis
uaaauagccaaacac

SEQ ID NO: 4155902 - RNA, 14 nt, Yersinia pestis
uaaauagcggccau

SEQ ID NO: 4155903 - RNA, 16 nt, Yersinia pestis
uaaauagucauauauu

SEQ ID NO: 4155904 - RNA, 18 nt, Yersinia pestis
uaaauagugggcuaaaac

SEQ ID NO: 4155905 - RNA, 20 nt, Yersinia pestis
uaaauaguuagugaguuauu

SEQ ID NO: 4155906 - RNA, 13 nt, Yersinia pestis
uaaauauaaaaua

SEQ ID NO: 4155907 - RNA, 16 nt, Yersinia pestis
uaaauauaaaauaaua

SEQ ID NO: 4155908 - RNA, 19 nt, Yersinia pestis
uaaauauaaccaaagucau

SEQ ID NO: 4155909 - RNA, 14 nt, Yersinia pestis
uaaauauaauuuca

SEQ ID NO: 4155910 - RNA, 22 nt, Yersinia pestis
uaaauaucagugacaccauuga

SEQ ID NO: 4155911 - RNA, 19 nt, Yersinia pestis
uaaauauccucggccagug

SEQ ID NO: 4155912 - RNA, 21 nt, Yersinia pestis
uaaauauccugcucagcuaaa

SEQ ID NO: 4155913 - RNA, 21 nt, Yersinia pestis
uaaauaugcugaccacugcuu

SEQ ID NO: 4155914 - RNA, 16 nt, Yersinia pestis
uaaauauuauuuaauu

SEQ ID NO: 4155915 - RNA, 17 nt, Yersinia pestis
uaaauauuauuuaauua

SEQ ID NO: 4155916 - RNA, 23 nt, Yersinia pestis
uaaauauuauuuaauuaaaugua

SEQ ID NO: 4155917 - RNA, 16 nt, Yersinia pestis
uaaauauucauuaaaa

SEQ ID NO: 4155918 - RNA, 18 nt, Yersinia pestis
uaaaucaguacuauucac

SEQ ID NO: 4155919 - RNA, 22 nt, Yersinia pestis
uaaaucagugaaggaugaauaa

SEQ ID NO: 4155920 - RNA, 12 nt, Yersinia pestis
uaaaucagugua

SEQ ID NO: 4155921 - RNA, 11 nt, Yersinia pestis
uaaaucaucaa

SEQ ID NO: 4155922 - RNA, 13 nt, Yersinia pestis
uaaaucaucaaau

SEQ ID NO: 4155923 - RNA, 14 nt, Yersinia pestis
uaaaucaucaaauu

SEQ ID NO: 4155924 - RNA, 12 nt, Yersinia pestis
uaaauccaaaug

SEQ ID NO: 4155925 - RNA, 15 nt, Yersinia pestis
uaaauccaaaugccc

SEQ ID NO: 4155926 - RNA, 16 nt, Yersinia pestis
uaaauccaaaugccca

SEQ ID NO: 4155927 - RNA, 14 nt, Yersinia pestis
uaaauccaaggcgg

SEQ ID NO: 4155928 - RNA, 13 nt, Yersinia pestis
uaaauccuucugg

SEQ ID NO: 4155929 - RNA, 20 nt, Yersinia pestis
uaaauccuuguaaggugcua

SEQ ID NO: 4155930 - RNA, 11 nt, Yersinia pestis
uaaaucggcgg

SEQ ID NO: 4155931 - RNA, 17 nt, Yersinia pestis
uaaaucuacuuuauuca

SEQ ID NO: 4155932 - RNA, 22 nt, Yersinia pestis
uaaaucucuuaccccuuucaau

SEQ ID NO: 4155933 - RNA, 18 nt, Yersinia pestis
uaaaucuuguuuaaucac

SEQ ID NO: 4155934 - RNA, 14 nt, Yersinia pestis
uaaaucuuucucca

SEQ ID NO: 4155935 - RNA, 23 nt, Yersinia pestis
uaaaugaaauugggggucagggc

SEQ ID NO: 4155936 - RNA, 21 nt, Yersinia pestis
uaaaugacuaucccuucaauc

SEQ ID NO: 4155937 - RNA, 22 nt, Yersinia pestis
uaaaugacuaucccuucaauca

SEQ ID NO: 4155938 - RNA, 20 nt, Yersinia pestis
uaaaugagggauauacccua

SEQ ID NO: 4155939 - RNA, 18 nt, Yersinia pestis
uaaaugcuggcggaaaua

SEQ ID NO: 4155940 - RNA, 16 nt, Yersinia pestis
uaaaugcuguaagaau

SEQ ID NO: 4155941 - RNA, 18 nt, Yersinia pestis
uaaaugcuuuuugcgcug

SEQ ID NO: 4155942 - RNA, 21 nt, Yersinia pestis
uaaauggcgaaaggaacaaaa

SEQ ID NO: 4155943 - RNA, 15 nt, Yersinia pestis
uaaauguacagucau

SEQ ID NO: 4155944 - RNA, 19 nt, Yersinia pestis
uaaaugucacuugcccuga

SEQ ID NO: 4155945 - RNA, 17 nt, Yersinia pestis
uaaaugucgcuaauagg

SEQ ID NO: 4155946 - RNA, 13 nt, Yersinia pestis
uaaauuaaaaaga

SEQ ID NO: 4155947 - RNA, 14 nt, Yersinia pestis
uaaauuaaaacuga

SEQ ID NO: 4155948 - RNA, 15 nt, Yersinia pestis
uaaauuaauaucuuu

SEQ ID NO: 4155949 - RNA, 13 nt, Yersinia pestis
uaaauuaauauuu

SEQ ID NO: 4155950 - RNA, 15 nt, Yersinia pestis
uaaauuagccacugg

SEQ ID NO: 4155951 - RNA, 22 nt, Yersinia pestis
uaaauuauugaguaacauuaau

SEQ ID NO: 4155952 - RNA, 23 nt, Yersinia pestis
uaaauucaaaauagaggaaauaa

SEQ ID NO: 4155953 - RNA, 15 nt, Yersinia pestis
uaaauucaaauauca

SEQ ID NO: 4155954 - RNA, 16 nt, Yersinia pestis
uaaauucaaauaucau

SEQ ID NO: 4155955 - RNA, 15 nt, Yersinia pestis
uaaauucacuuuccc

SEQ ID NO: 4155956 - RNA, 19 nt, Yersinia pestis
uaaauucauuagcucaaau

SEQ ID NO: 4155957 - RNA, 21 nt, Yersinia pestis
uaaauucauuagcucaaauau

SEQ ID NO: 4155958 - RNA, 17 nt, Yersinia pestis
uaaauuccguaccaguu

SEQ ID NO: 4155959 - RNA, 21 nt, Yersinia pestis
uaaauuccuauaaauuuuaag

SEQ ID NO: 4155960 - RNA, 15 nt, Yersinia pestis
uaaauucuagcaaca

SEQ ID NO: 4155961 - RNA, 11 nt, Yersinia pestis
uaaauuggccg

SEQ ID NO: 4155962 - RNA, 15 nt, Yersinia pestis
uaaauuuaauaugac

SEQ ID NO: 4155963 - RNA, 17 nt, Yersinia pestis
uaaauuucuucaauaau

SEQ ID NO: 4155964 - RNA, 19 nt, Yersinia pestis
uaaauuuuguacaacuucu

SEQ ID NO: 4155965 - RNA, 22 nt, Yersinia pestis
uaaauuuuguacaacuucuuca

SEQ ID NO: 4155966 - RNA, 19 nt, Yersinia pestis
uaacaaaaaauuaaugagu

SEQ ID NO: 4155967 - RNA, 12 nt, Yersinia pestis
uaacaaaaccgg

SEQ ID NO: 4155968 - RNA, 20 nt, Yersinia pestis
uaacaaaauggaauaagcca

SEQ ID NO: 4155969 - RNA, 15 nt, Yersinia pestis
uaacaaacguucauu

SEQ ID NO: 4155970 - RNA, 19 nt, Yersinia pestis
uaacaaacuguuuuuuaaa

SEQ ID NO: 4155971 - RNA, 14 nt, Yersinia pestis
uaacaacagucaau

SEQ ID NO: 4155972 - RNA, 22 nt, Yersinia pestis
uaacuauuuuugacuuuaauua

SEQ ID NO: 4155973 - RNA, 14 nt, Yersinia pestis
uaacucaaauuauu

SEQ ID NO: 4155974 - RNA, 15 nt, Yersinia pestis
uaacucaauaaauuc

SEQ ID NO: 4155975 - RNA, 18 nt, Yersinia pestis
uaacucaauaaauucauu

SEQ ID NO: 4155976 - RNA, 18 nt, Yersinia pestis
uaacucaggauccucguc

SEQ ID NO: 4155977 - RNA, 16 nt, Yersinia pestis
uaacucgccacucaca

SEQ ID NO: 4155978 - RNA, 16 nt, Yersinia pestis
uaacucuucuggcaaa

SEQ ID NO: 4155979 - RNA, 15 nt, Yersinia pestis
uaacucuuuuuaaac

SEQ ID NO: 4155980 - RNA, 12 nt, Yersinia pestis
uaacugaaagcc

SEQ ID NO: 4155981 - RNA, 17 nt, Yersinia pestis
uaacugcacaauuuggu

SEQ ID NO: 4155982 - RNA, 13 nt, Yersinia pestis
uaacugcauagcu

SEQ ID NO: 4155983 - RNA, 16 nt, Yersinia pestis
uaacugcauagcuaac

SEQ ID NO: 4155984 - RNA, 18 nt, Yersinia pestis
uaacuggcgguuauugaa

SEQ ID NO: 4155985 - RNA, 18 nt, Yersinia pestis
uaacuggcuggcuuugga

SEQ ID NO: 4155986 - RNA, 10 nt, Yersinia pestis
uaacuggucu

SEQ ID NO: 4155987 - RNA, 16 nt, Yersinia pestis
uaacugguggcaggcc

SEQ ID NO: 4155988 - RNA, 15 nt, Yersinia pestis
uaacuguaaggccaa

SEQ ID NO: 4155989 - RNA, 16 nt, Yersinia pestis
uaacugugcagcccau

SEQ ID NO: 4155990 - RNA, 21 nt, Yersinia pestis
uaacuuaaaauauggcaggua

SEQ ID NO: 4155991 - RNA, 15 nt, Yersinia pestis
uaacuuaauggcacc

SEQ ID NO: 4155992 - RNA, 17 nt, Yersinia pestis
uaacuuacgguaagcac

SEQ ID NO: 4155993 - RNA, 21 nt, Yersinia pestis
uaacuuacugcucuaucucuu

SEQ ID NO: 4155994 - RNA, 21 nt, Yersinia pestis
uaacuuaucgaccaacuggca

SEQ ID NO: 4155995 - RNA, 23 nt, Yersinia pestis
uaacuuauuacaccuuaaaacag

SEQ ID NO: 4155996 - RNA, 18 nt, Yersinia pestis
uaacuucagguucaccuu

SEQ ID NO: 4155997 - RNA, 15 nt, Yersinia pestis
uaacuucauuuuucu

SEQ ID NO: 4155998 - RNA, 15 nt, Yersinia pestis
uaacuucuuccgcaa

SEQ ID NO: 4155999 - RNA, 21 nt, Yersinia pestis
uaacuugccguaaaauuuaaa

SEQ ID NO: 4156000 - RNA, 15 nt, Yersinia pestis
uaacuuuaucagucu

SEQ ID NO: 4156001 - RNA, 16 nt, Yersinia pestis
uaacuuuaucagucug

SEQ ID NO: 4156002 - RNA, 21 nt, Yersinia pestis
uaacuuuggguauaugacugu

SEQ ID NO: 4156003 - RNA, 15 nt, Yersinia pestis
uaacuuuucuucauu

SEQ ID NO: 4156004 - RNA, 16 nt, Yersinia pestis
uaacuuuucuucauug

SEQ ID NO: 4156005 - RNA, 21 nt, Yersinia pestis
uaacuuuucuucauugcugcu

SEQ ID NO: 4156006 - RNA, 16 nt, Yersinia pestis
uaacuuuuuauuucuu

SEQ ID NO: 4156007 - RNA, 17 nt, Yersinia pestis
uaacuuuuuauuucuuu

SEQ ID NO: 4156008 - RNA, 16 nt, Yersinia pestis
uaagaagccucaugaa

SEQ ID NO: 4156009 - RNA, 17 nt, Yersinia pestis
uaagaagccucaugaau

SEQ ID NO: 4156010 - RNA, 14 nt, Yersinia pestis
uaagaauaaauaau

SEQ ID NO: 4156011 - RNA, 22 nt, Yersinia pestis
uaagaauaaggguagguucaau

SEQ ID NO: 4156012 - RNA, 18 nt, Yersinia pestis
uaagacuauuaauuuuau

SEQ ID NO: 4156013 - RNA, 15 nt, Yersinia pestis
uaagagucacagcau

SEQ ID NO: 4156014 - RNA, 21 nt, Yersinia pestis
uaagaguccuuaaaaacccau

SEQ ID NO: 4156015 - RNA, 23 nt, Yersinia pestis
uaagauaacccaaugccauagcu

SEQ ID NO: 4156016 - RNA, 14 nt, Yersinia pestis
uaagauaccagcga

SEQ ID NO: 4156017 - RNA, 17 nt, Yersinia pestis
uaagauccaccacauca

SEQ ID NO: 4156018 - RNA, 20 nt, Yersinia pestis
uaagauccagaacaccaaca

SEQ ID NO: 4156019 - RNA, 20 nt, Yersinia pestis
uaagauccaguucaguccag

SEQ ID NO: 4156020 - RNA, 24 nt, Yersinia pestis
uaagaugcaucccacgcagauacu

SEQ ID NO: 4156021 - RNA, 13 nt, Yersinia pestis
uaagauucgccgc

SEQ ID NO: 4156022 - RNA, 19 nt, Yersinia pestis
uaagauucgccgcaaggca

SEQ ID NO: 4156023 - RNA, 21 nt, Yersinia pestis
uaagauucgccgcaaggcaaa

SEQ ID NO: 4156024 - RNA, 13 nt, Yersinia pestis
uaagcaauaccga

SEQ ID NO: 4156025 - RNA, 21 nt, Yersinia pestis
uaagcaccagcaccaacaaua

SEQ ID NO: 4156026 - RNA, 18 nt, Yersinia pestis
uaagcagcaccaauauca

SEQ ID NO: 4156027 - RNA, 18 nt, Yersinia pestis
uaagcaggaagauaucgc

SEQ ID NO: 4156028 - RNA, 18 nt, Yersinia pestis
uaagcaugaaacacagug

SEQ ID NO: 4156029 - RNA, 17 nt, Yersinia pestis
uaagcaugccgccagau

SEQ ID NO: 4156030 - RNA, 19 nt, Yersinia pestis
uaagccagugcuauucaua

SEQ ID NO: 4156031 - RNA, 12 nt, Yersinia pestis
uaagccagugug

SEQ ID NO: 4156032 - RNA, 18 nt, Yersinia pestis
uaagccgcaauaaauggc

SEQ ID NO: 4156033 - RNA, 18 nt, Yersinia pestis
uaagccgcagaugccaga

SEQ ID NO: 4156034 - RNA, 21 nt, Yersinia pestis
uaagccgcagaugccagacuu

SEQ ID NO: 4156035 - RNA, 22 nt, Yersinia pestis
uaagccggucuuuuuacaagca

SEQ ID NO: 4156036 - RNA, 19 nt, Yersinia pestis
uaagccgguguauaacgcc

SEQ ID NO: 4156037 - RNA, 15 nt, Yersinia pestis
uaagccgucagcuua

SEQ ID NO: 4156038 - RNA, 17 nt, Yersinia pestis
uaagcgacgacauuaau

SEQ ID NO: 4156039 - RNA, 18 nt, Yersinia pestis
uaagcggcguauuaucag

SEQ ID NO: 4156040 - RNA, 18 nt, Yersinia pestis
uaagcgggcuuuaauagc

SEQ ID NO: 4156041 - RNA, 21 nt, Yersinia pestis
uaagcguauuuugucaugaaa

SEQ ID NO: 4156042 - RNA, 16 nt, Yersinia pestis
uaagcuaucauuaaau

SEQ ID NO: 4156043 - RNA, 13 nt, Yersinia pestis
uaagcucaucuaa

SEQ ID NO: 4156044 - RNA, 18 nt, Yersinia pestis
uaagcucaucuaacucau

SEQ ID NO: 4156045 - RNA, 22 nt, Yersinia pestis
uaagcugaaauuuuuuaauuug

SEQ ID NO: 4156046 - RNA, 12 nt, Yersinia pestis
uaagcuggcuuc

SEQ ID NO: 4156047 - RNA, 16 nt, Yersinia pestis
uaagcuggcuucuuuu

SEQ ID NO: 4156048 - RNA, 20 nt, Yersinia pestis
uaagcuguuggcuuuaucuc

SEQ ID NO: 4156049 - RNA, 13 nt, Yersinia pestis
uaaggaaacucau

SEQ ID NO: 4156050 - RNA, 14 nt, Yersinia pestis
uaaggagugccauc

SEQ ID NO: 4156051 - RNA, 22 nt, Yersinia pestis
uaaggcccauuugucgcgccug

SEQ ID NO: 4156052 - RNA, 23 nt, Yersinia pestis
uaaggccgcgauaaaaaauaaag

SEQ ID NO: 4156053 - RNA, 20 nt, Yersinia pestis
uaaggcguuacccacauuaa

SEQ ID NO: 4156054 - RNA, 18 nt, Yersinia pestis
uaaggcuaacaccuuuac

SEQ ID NO: 4156055 - RNA, 13 nt, Yersinia pestis
uaagggggacccc

SEQ ID NO: 4156056 - RNA, 19 nt, Yersinia pestis
uaaggugaugaaugacugg

SEQ ID NO: 4156057 - RNA, 14 nt, Yersinia pestis
uaaggugccacaca

SEQ ID NO: 4156058 - RNA, 20 nt, Yersinia pestis
uaagguguuacaacaugaaa

SEQ ID NO: 4156059 - RNA, 16 nt, Yersinia pestis
uaagguuagcuaugca

SEQ ID NO: 4156060 - RNA, 15 nt, Yersinia pestis
uaaguaauaacucag

SEQ ID NO: 4156061 - RNA, 13 nt, Yersinia pestis
uaaguacuaucua

SEQ ID NO: 4156062 - RNA, 13 nt, Yersinia pestis
uaaguacuuucaa

SEQ ID NO: 4156063 - RNA, 14 nt, Yersinia pestis
uaaguagucagcaa

SEQ ID NO: 4156064 - RNA, 23 nt, Yersinia pestis
uaaguagucagcaacgcgaugca

SEQ ID NO: 4156065 - RNA, 15 nt, Yersinia pestis
uaaguauuucaaaua

SEQ ID NO: 4156066 - RNA, 16 nt, Yersinia pestis
uaaguauuucaaauaa

SEQ ID NO: 4156067 - RNA, 14 nt, Yersinia pestis
uaagucaaauuuaa

SEQ ID NO: 4156068 - RNA, 16 nt, Yersinia pestis
uaagucaaauuuaaag

SEQ ID NO: 4156069 - RNA, 18 nt, Yersinia pestis
uaagucaaauuuaaaguu

SEQ ID NO: 4156070 - RNA, 21 nt, Yersinia pestis
uaagucagugcuauucauaaa

SEQ ID NO: 4156071 - RNA, 15 nt, Yersinia pestis
uaaguccaagacaga

SEQ ID NO: 4156072 - RNA, 18 nt, Yersinia pestis
uaagugaaacaaauacac

SEQ ID NO: 4156073 - RNA, 16 nt, Yersinia pestis
uaagugaauaacgcug

SEQ ID NO: 4156074 - RNA, 17 nt, Yersinia pestis
uaagugcaaacuuaaaa

SEQ ID NO: 4156075 - RNA, 14 nt, Yersinia pestis
uaagugcuaaucau

SEQ ID NO: 4156076 - RNA, 22 nt, Yersinia pestis
uaaguguauucgcaucuuccaa

SEQ ID NO: 4156077 - RNA, 16 nt, Yersinia pestis
uaaguuacgucagaaa

SEQ ID NO: 4156078 - RNA, 22 nt, Yersinia pestis
uaaguuaucgucacuggcacca

SEQ ID NO: 4156079 - RNA, 23 nt, Yersinia pestis
uaaguucagguugaaauaaauaa

SEQ ID NO: 4156080 - RNA, 14 nt, Yersinia pestis
uaauaaaaaaaaau

SEQ ID NO: 4156081 - RNA, 15 nt, Yersinia pestis
uaauaaaaaaaaaua

SEQ ID NO: 4156082 - RNA, 20 nt, Yersinia pestis
uaauaaaaaaaaauaaaauu

SEQ ID NO: 4156083 - RNA, 23 nt, Yersinia pestis
uaauaaaaacacaauuuuuagag

SEQ ID NO: 4156084 - RNA, 20 nt, Yersinia pestis
uaauaaaaccuuuacaauua

SEQ ID NO: 4156085 - RNA, 12 nt, Yersinia pestis
uaauaaaacucu

SEQ ID NO: 4156086 - RNA, 18 nt, Yersinia pestis
uaauaaacaugaauaaca

SEQ ID NO: 4156087 - RNA, 13 nt, Yersinia pestis
uaauaaauaauuu

SEQ ID NO: 4156088 - RNA, 22 nt, Yersinia pestis
uaauaaauaauuuguauucuca

SEQ ID NO: 4156089 - RNA, 14 nt, Yersinia pestis
uaauaacaguaaua

SEQ ID NO: 4156090 - RNA, 17 nt, Yersinia pestis
uaauaacaguaauaccc

SEQ ID NO: 4156091 - RNA, 18 nt, Yersinia pestis
uaauaaccauuuauauaa

SEQ ID NO: 4156092 - RNA, 23 nt, Yersinia pestis
uaauaagccgcaggcaaacaaug

SEQ ID NO: 4156093 - RNA, 14 nt, Yersinia pestis
uaauaagggcgcau

SEQ ID NO: 4156094 - RNA, 17 nt, Yersinia pestis
uaauuaaauguauaaaa

SEQ ID NO: 4156095 - RNA, 21 nt, Yersinia pestis
uaauuaaauguauaaaaaaga

SEQ ID NO: 4156096 - RNA, 20 nt, Yersinia pestis
uaauuaacacccaauaauaa

SEQ ID NO: 4156097 - RNA, 18 nt, Yersinia pestis
uaauuaacagcaucacug

SEQ ID NO: 4156098 - RNA, 14 nt, Yersinia pestis
uaauuaauuauuca

SEQ ID NO: 4156099 - RNA, 22 nt, Yersinia pestis
uaauuaauucaaucggcagauu

SEQ ID NO: 4156100 - RNA, 14 nt, Yersinia pestis
uaauuaauuuaaac

SEQ ID NO: 4156101 - RNA, 18 nt, Yersinia pestis
uaauuaauuuaaacaacc

SEQ ID NO: 4156102 - RNA, 23 nt, Yersinia pestis
uaauuacacccaacuuuuuuacc

SEQ ID NO: 4156103 - RNA, 23 nt, Yersinia pestis
uaauuacuuuauuuaaaauuaau

SEQ ID NO: 4156104 - RNA, 16 nt, Yersinia pestis
uaauuaggauuuauuu

SEQ ID NO: 4156105 - RNA, 14 nt, Yersinia pestis
uaauuagugacagu

SEQ ID NO: 4156106 - RNA, 21 nt, Yersinia pestis
uaauuauaauccacugaaaua

SEQ ID NO: 4156107 - RNA, 17 nt, Yersinia pestis
uaauuauaccuacccuu

SEQ ID NO: 4156108 - RNA, 16 nt, Yersinia pestis
uaauuauagugaaaac

SEQ ID NO: 4156109 - RNA, 15 nt, Yersinia pestis
uaauuauauuuaauu

SEQ ID NO: 4156110 - RNA, 13 nt, Yersinia pestis
uaauuauuucucu

SEQ ID NO: 4156111 - RNA, 14 nt, Yersinia pestis
uaauucaaaaugua

SEQ ID NO: 4156112 - RNA, 17 nt, Yersinia pestis
uaauucacugcuuaauc

SEQ ID NO: 4156113 - RNA, 18 nt, Yersinia pestis
uaauucacugcuuaaucc

SEQ ID NO: 4156114 - RNA, 14 nt, Yersinia pestis
uaauucagauguua

SEQ ID NO: 4156115 - RNA, 19 nt, Yersinia pestis
uaauucaggcaaauucuca

SEQ ID NO: 4156116 - RNA, 16 nt, Yersinia pestis
uaauucauuauuacuc

SEQ ID NO: 4156117 - RNA, 17 nt, Yersinia pestis
uaauuccaugcaaaaua

SEQ ID NO: 4156118 - RNA, 23 nt, Yersinia pestis
uaauucugcuauuaauuauuauu

SEQ ID NO: 4156119 - RNA, 15 nt, Yersinia pestis
uaauugaagauuuaa

SEQ ID NO: 4156120 - RNA, 16 nt, Yersinia pestis
uaauugaagauuuaaa

SEQ ID NO: 4156121 - RNA, 20 nt, Yersinia pestis
uaauugaagauuuaaauaac

SEQ ID NO: 4156122 - RNA, 18 nt, Yersinia pestis
uaauugauauuauuuaua

SEQ ID NO: 4156123 - RNA, 20 nt, Yersinia pestis
uaauuggcaauaaugucacc

SEQ ID NO: 4156124 - RNA, 20 nt, Yersinia pestis
uaauuggcccauaacaauua

SEQ ID NO: 4156125 - RNA, 15 nt, Yersinia pestis
uaauugguuagcgcc

SEQ ID NO: 4156126 - RNA, 15 nt, Yersinia pestis
uaauugguuuauaac

SEQ ID NO: 4156127 - RNA, 20 nt, Yersinia pestis
uaauuuaaacaaccaaaaau

SEQ ID NO: 4156128 - RNA, 11 nt, Yersinia pestis
uaauuuaaacu

SEQ ID NO: 4156129 - RNA, 13 nt, Yersinia pestis
uaauuuaaauaaa

SEQ ID NO: 4156130 - RNA, 14 nt, Yersinia pestis
uaauuuaaauaaaa

SEQ ID NO: 4156131 - RNA, 20 nt, Yersinia pestis
uaauuuaaauaaaauaaauu

SEQ ID NO: 4156132 - RNA, 21 nt, Yersinia pestis
uaauuuaaauaagauccagaa

SEQ ID NO: 4156133 - RNA, 18 nt, Yersinia pestis
uaauuuaggugaaaauaa

SEQ ID NO: 4156134 - RNA, 21 nt, Yersinia pestis
uaauuuaggugaaaauaauaa

SEQ ID NO: 4156135 - RNA, 22 nt, Yersinia pestis
uaauuuauacauaucagaacag

SEQ ID NO: 4156136 - RNA, 18 nt, Yersinia pestis
uaauuuaucaguagucaa

SEQ ID NO: 4156137 - RNA, 20 nt, Yersinia pestis
uaauuucaaguggucuauca

SEQ ID NO: 4156138 - RNA, 21 nt, Yersinia pestis
uaauuucacuuccauuccguu

SEQ ID NO: 4156139 - RNA, 18 nt, Yersinia pestis
uaauuucagauaaaaaua

SEQ ID NO: 4156140 - RNA, 22 nt, Yersinia pestis
uaauuucaucucaauaacuauu

SEQ ID NO: 4156141 - RNA, 23 nt, Yersinia pestis
uaauuucaucucaauaacuauuu

SEQ ID NO: 4156142 - RNA, 19 nt, Yersinia pestis
uaauuucggaucagcgccu

SEQ ID NO: 4156143 - RNA, 21 nt, Yersinia pestis
uaauuucuacgccgucaucau

SEQ ID NO: 4156144 - RNA, 22 nt, Yersinia pestis
uaauuugcuccuggcaugcauu

SEQ ID NO: 4156145 - RNA, 14 nt, Yersinia pestis
uaauuuguaaauuu

SEQ ID NO: 4156146 - RNA, 15 nt, Yersinia pestis
uaauuuuauuaccaa

SEQ ID NO: 4156147 - RNA, 14 nt, Yersinia pestis
uaauuuugaugcua

SEQ ID NO: 4156148 - RNA, 13 nt, Yersinia pestis
uaauuuuucccuu

SEQ ID NO: 4156149 - RNA, 16 nt, Yersinia pestis
uacaaaaaacaaaccg

SEQ ID NO: 4156150 - RNA, 21 nt, Yersinia pestis
uacaaacagggcagccaauua

SEQ ID NO: 4156151 - RNA, 22 nt, Yersinia pestis
uacaaacagggcagccaauuac

SEQ ID NO: 4156152 - RNA, 16 nt, Yersinia pestis
uacaaaccguuugccg

SEQ ID NO: 4156153 - RNA, 21 nt, Yersinia pestis
uacaaagcagcguuuuuagug

SEQ ID NO: 4156154 - RNA, 19 nt, Yersinia pestis
uacaaaguccacgugcuua

SEQ ID NO: 4156155 - RNA, 23 nt, Yersinia pestis
uacaaauaguaauaauuaaucua

SEQ ID NO: 4156156 - RNA, 16 nt, Yersinia pestis
uacaaaucaucaucuu

SEQ ID NO: 4156157 - RNA, 19 nt, Yersinia pestis
uacaaauuugacauuuccu

SEQ ID NO: 4156158 - RNA, 23 nt, Yersinia pestis
uacaaauuuuuuauauuccacau

SEQ ID NO: 4156159 - RNA, 20 nt, Yersinia pestis
uacaacaacgggucacagcc

SEQ ID NO: 4156160 - RNA, 14 nt, Yersinia pestis
uacaaccaacaaac

SEQ ID NO: 4156161 - RNA, 16 nt, Yersinia pestis
uacaaccaacaaacaa

SEQ ID NO: 4156162 - RNA, 16 nt, Yersinia pestis
uacaaccacugaacac

SEQ ID NO: 4156163 - RNA, 17 nt, Yersinia pestis
uacaaccggcuaauacc

SEQ ID NO: 4156164 - RNA, 21 nt, Yersinia pestis
uacaaccguuacgauaaucuc

SEQ ID NO: 4156165 - RNA, 16 nt, Yersinia pestis
uacaaccuaccaccua

SEQ ID NO: 4156166 - RNA, 18 nt, Yersinia pestis
uacaagcacucaauguca

SEQ ID NO: 4156167 - RNA, 16 nt, Yersinia pestis
uacaagcagcguucaa

SEQ ID NO: 4156168 - RNA, 20 nt, Yersinia pestis
uacaagccgugaccaaagug

SEQ ID NO: 4156169 - RNA, 20 nt, Yersinia pestis
uacaagugccaaauggaaua

SEQ ID NO: 4156170 - RNA, 21 nt, Yersinia pestis
uacaaucucugggugcugcuc

SEQ ID NO: 4156171 - RNA, 18 nt, Yersinia pestis
uacaauuuuuggucguau

SEQ ID NO: 4156172 - RNA, 23 nt, Yersinia pestis
uacacaauaggcuauuuuacuug

SEQ ID NO: 4156173 - RNA, 23 nt, Yersinia pestis
uacacacccucaacucaaaacaa

SEQ ID NO: 4156174 - RNA, 14 nt, Yersinia pestis
uacacacucaguac

SEQ ID NO: 4156175 - RNA, 18 nt, Yersinia pestis
uacacaggcguaauaugu

SEQ ID NO: 4156176 - RNA, 14 nt, Yersinia pestis
uacacagucccgca

SEQ ID NO: 4156177 - RNA, 15 nt, Yersinia pestis
uacaccaacgcaaug

SEQ ID NO: 4156178 - RNA, 19 nt, Yersinia pestis
uacaccaacgcaauggugc

SEQ ID NO: 4156179 - RNA, 16 nt, Yersinia pestis
uacaccaauaaucggg

SEQ ID NO: 4156180 - RNA, 22 nt, Yersinia pestis
uacaccaccgccgcaacaauaa

SEQ ID NO: 4156181 - RNA, 14 nt, Yersinia pestis
uacaccauguucuu

SEQ ID NO: 4156182 - RNA, 14 nt, Yersinia pestis
uacaccauuuucaa

SEQ ID NO: 4156183 - RNA, 19 nt, Yersinia pestis
uacacccaacuuuuuuacc

SEQ ID NO: 4156184 - RNA, 14 nt, Yersinia pestis
uacaccccaucagc

SEQ ID NO: 4156185 - RNA, 19 nt, Yersinia pestis
uacacccgaaggccauugc

SEQ ID NO: 4156186 - RNA, 14 nt, Yersinia pestis
uacacgauaaaaua

SEQ ID NO: 4156187 - RNA, 21 nt, Yersinia pestis
uacacgcaguacgugacggca

SEQ ID NO: 4156188 - RNA, 17 nt, Yersinia pestis
uacacugucgcauaaga

SEQ ID NO: 4156189 - RNA, 22 nt, Yersinia pestis
uacacuuucuuugaugcauaug

SEQ ID NO: 4156190 - RNA, 21 nt, Yersinia pestis
uacagacaaaucacaacguug

SEQ ID NO: 4156191 - RNA, 19 nt, Yersinia pestis
uacagacgccgacgcggcu

SEQ ID NO: 4156192 - RNA, 13 nt, Yersinia pestis
uacagaucauuag

SEQ ID NO: 4156193 - RNA, 18 nt, Yersinia pestis
uacagcaaacaucgguaa

SEQ ID NO: 4156194 - RNA, 14 nt, Yersinia pestis
uacagcaaauaccg

SEQ ID NO: 4156195 - RNA, 17 nt, Yersinia pestis
uacagcaaauagguuuu

SEQ ID NO: 4156196 - RNA, 14 nt, Yersinia pestis
uacagcaccauuca

SEQ ID NO: 4156197 - RNA, 12 nt, Yersinia pestis
uacagccacgau

SEQ ID NO: 4156198 - RNA, 15 nt, Yersinia pestis
uacagcccaagagaa

SEQ ID NO: 4156199 - RNA, 19 nt, Yersinia pestis
uacagcccgguaucaccuu

SEQ ID NO: 4156200 - RNA, 17 nt, Yersinia pestis
uacagccggauaggcuu

SEQ ID NO: 4156201 - RNA, 22 nt, Yersinia pestis
uacagccggauaggcuuaauau

SEQ ID NO: 4156202 - RNA, 23 nt, Yersinia pestis
uacagcgcaucggaucaauuuga

SEQ ID NO: 4156203 - RNA, 15 nt, Yersinia pestis
uacagcucaucacca

SEQ ID NO: 4156204 - RNA, 21 nt, Yersinia pestis
uacaggccgcuuccgauaacc

SEQ ID NO: 4156205 - RNA, 15 nt, Yersinia pestis
uacagggaagccggc

SEQ ID NO: 4156206 - RNA, 19 nt, Yersinia pestis
uacagggcgaauggaagau

SEQ ID NO: 4156207 - RNA, 14 nt, Yersinia pestis
uacaggguaaauua

SEQ ID NO: 4156208 - RNA, 18 nt, Yersinia pestis
uacaguagugaagauaau

SEQ ID NO: 4156209 - RNA, 21 nt, Yersinia pestis
uacagucccugugcgcccacg

SEQ ID NO: 4156210 - RNA, 17 nt, Yersinia pestis
uacagucgcugcuguug

SEQ ID NO: 4156211 - RNA, 22 nt, Yersinia pestis
uacagugaaaaugguuuccagc

SEQ ID NO: 4156212 - RNA, 15 nt, Yersinia pestis
uacagugauaaucac

SEQ ID NO: 4156213 - RNA, 19 nt, Yersinia pestis
uacaguuccuguuuuugaa

SEQ ID NO: 4156214 - RNA, 23 nt, Yersinia pestis
uacauaaaccgugugcuuccacc

SEQ ID NO: 4156215 - RNA, 20 nt, Yersinia pestis
uacgccaccuucuuauuuau

SEQ ID NO: 4156216 - RNA, 22 nt, Yersinia pestis
uacgccaccuucuuauuuauca

SEQ ID NO: 4156217 - RNA, 15 nt, Yersinia pestis
uacgccauccacuca

SEQ ID NO: 4156218 - RNA, 15 nt, Yersinia pestis
uacgccaugcagcua

SEQ ID NO: 4156219 - RNA, 13 nt, Yersinia pestis
uacgccugggcau

SEQ ID NO: 4156220 - RNA, 19 nt, Yersinia pestis
uacgccugggcauacuguu

SEQ ID NO: 4156221 - RNA, 16 nt, Yersinia pestis
uacgcgccgcagcagu

SEQ ID NO: 4156222 - RNA, 23 nt, Yersinia pestis
uacgcucgguuguucagcaccag

SEQ ID NO: 4156223 - RNA, 14 nt, Yersinia pestis
uacggagaagagga

SEQ ID NO: 4156224 - RNA, 21 nt, Yersinia pestis
uacggauucagcgucagucaa

SEQ ID NO: 4156225 - RNA, 15 nt, Yersinia pestis
uacggcauuagugaa

SEQ ID NO: 4156226 - RNA, 20 nt, Yersinia pestis
uacggcgacuugccguggcu

SEQ ID NO: 4156227 - RNA, 15 nt, Yersinia pestis
uacggcggccaucau

SEQ ID NO: 4156228 - RNA, 20 nt, Yersinia pestis
uacggcugcgcgacaaaacc

SEQ ID NO: 4156229 - RNA, 20 nt, Yersinia pestis
uacggcuuuucgcucagacu

SEQ ID NO: 4156230 - RNA, 23 nt, Yersinia pestis
uacgggccucgcggaaaucagcu

SEQ ID NO: 4156231 - RNA, 18 nt, Yersinia pestis
uacgggugugcugggugu

SEQ ID NO: 4156232 - RNA, 18 nt, Yersinia pestis
uacgguagcgauauccuu

SEQ ID NO: 4156233 - RNA, 20 nt, Yersinia pestis
uacgguagcgauauccuuac

SEQ ID NO: 4156234 - RNA, 16 nt, Yersinia pestis
uacggugccagcagca

SEQ ID NO: 4156235 - RNA, 17 nt, Yersinia pestis
uacggugccagcagcaa

SEQ ID NO: 4156236 - RNA, 13 nt, Yersinia pestis
uacguacuaucua

SEQ ID NO: 4156237 - RNA, 14 nt, Yersinia pestis
uacguacuucuaca

SEQ ID NO: 4156238 - RNA, 17 nt, Yersinia pestis
uacguagacauaaauuu

SEQ ID NO: 4156239 - RNA, 16 nt, Yersinia pestis
uacguauggcaugacu

SEQ ID NO: 4156240 - RNA, 21 nt, Yersinia pestis
uacguauuucgugauuuucuu

SEQ ID NO: 4156241 - RNA, 18 nt, Yersinia pestis
uacgucagaaauaaauuc

SEQ ID NO: 4156242 - RNA, 12 nt, Yersinia pestis
uacgugacggca

SEQ ID NO: 4156243 - RNA, 22 nt, Yersinia pestis
uacgugacggcagcgagcacug

SEQ ID NO: 4156244 - RNA, 12 nt, Yersinia pestis
uacgugacggcg

SEQ ID NO: 4156245 - RNA, 22 nt, Yersinia pestis
uacgugacggcggcgagcacug

SEQ ID NO: 4156246 - RNA, 19 nt, Yersinia pestis
uacgugagcaucuggcgca

SEQ ID NO: 4156247 - RNA, 15 nt, Yersinia pestis
uacguguaaaaccuu

SEQ ID NO: 4156248 - RNA, 17 nt, Yersinia pestis
uacguucaccuaaauuu

SEQ ID NO: 4156249 - RNA, 13 nt, Yersinia pestis
uacguuguaccag

SEQ ID NO: 4156250 - RNA, 19 nt, Yersinia pestis
uacuaaagguguacucucc

SEQ ID NO: 4156251 - RNA, 17 nt, Yersinia pestis
uacuaaauuagaaaaca

SEQ ID NO: 4156252 - RNA, 16 nt, Yersinia pestis
uacuaccuuuugcaua

SEQ ID NO: 4156253 - RNA, 12 nt, Yersinia pestis
uacuacuucaua

SEQ ID NO: 4156254 - RNA, 12 nt, Yersinia pestis
uacuaucuauua

SEQ ID NO: 4156255 - RNA, 18 nt, Yersinia pestis
uacuaucuuuauugcucc

SEQ ID NO: 4156256 - RNA, 20 nt, Yersinia pestis
uacuaugauagauuaaucga

SEQ ID NO: 4156257 - RNA, 22 nt, Yersinia pestis
uacuaugauagauuaaucgaaa

SEQ ID NO: 4156258 - RNA, 13 nt, Yersinia pestis
uacuauuuguagu

SEQ ID NO: 4156259 - RNA, 20 nt, Yersinia pestis
uacuauuuguaguuuuucau

SEQ ID NO: 4156260 - RNA, 17 nt, Yersinia pestis
uacuauuuucauuguuc

SEQ ID NO: 4156261 - RNA, 17 nt, Yersinia pestis
uacucaccccacuuucc

SEQ ID NO: 4156262 - RNA, 16 nt, Yersinia pestis
uacucagggaugcgcc

SEQ ID NO: 4156263 - RNA, 14 nt, Yersinia pestis
uacucauccagauu

SEQ ID NO: 4156264 - RNA, 21 nt, Yersinia pestis
uacucauuauggauaauuuaa

SEQ ID NO: 4156265 - RNA, 21 nt, Yersinia pestis
uacuccauuuuuuugaugcau

SEQ ID NO: 4156266 - RNA, 17 nt, Yersinia pestis
uacuccccaaagccuac

SEQ ID NO: 4156267 - RNA, 23 nt, Yersinia pestis
uacuccccaaagccuacgagaga

SEQ ID NO: 4156268 - RNA, 15 nt, Yersinia pestis
uacucccgccaagaa

SEQ ID NO: 4156269 - RNA, 15 nt, Yersinia pestis
uacucccggcagcac

SEQ ID NO: 4156270 - RNA, 16 nt, Yersinia pestis
uacucccggcagcacu

SEQ ID NO: 4156271 - RNA, 14 nt, Yersinia pestis
uacuccuacaccau

SEQ ID NO: 4156272 - RNA, 12 nt, Yersinia pestis
uacuccucugcc

SEQ ID NO: 4156273 - RNA, 14 nt, Yersinia pestis
uacuccucugccua

SEQ ID NO: 4156274 - RNA, 16 nt, Yersinia pestis
uacuccucugccuauc

SEQ ID NO: 4156275 - RNA, 20 nt, Yersinia pestis
uacuccuuaaucguccgguc

SEQ ID NO: 4156276 - RNA, 16 nt, Yersinia pestis
uacucguauaaaaaau

SEQ ID NO: 4156277 - RNA, 17 nt, Yersinia pestis
uacucuuccuguacguu

SEQ ID NO: 4156278 - RNA, 20 nt, Yersinia pestis
uacucuucugccuacacuca

SEQ ID NO: 4156279 - RNA, 14 nt, Yersinia pestis
uacucuugagaaau

SEQ ID NO: 4156280 - RNA, 15 nt, Yersinia pestis
uacugaaauauacac

SEQ ID NO: 4156281 - RNA, 21 nt, Yersinia pestis
uacugaaauauacacaaguca

SEQ ID NO: 4156282 - RNA, 23 nt, Yersinia pestis
uacugaacgucauaauugccaaa

SEQ ID NO: 4156283 - RNA, 22 nt, Yersinia pestis
uacugcauugagacccguuacu

SEQ ID NO: 4156284 - RNA, 20 nt, Yersinia pestis
uacugccaaucgcugccaaa

SEQ ID NO: 4156285 - RNA, 17 nt, Yersinia pestis
uacugccgcacugccac

SEQ ID NO: 4156286 - RNA, 16 nt, Yersinia pestis
uacugcguucuucuug

SEQ ID NO: 4156287 - RNA, 13 nt, Yersinia pestis
uacugcuuuucua

SEQ ID NO: 4156288 - RNA, 23 nt, Yersinia pestis
uacuggcauacagcucaucacca

SEQ ID NO: 4156289 - RNA, 21 nt, Yersinia pestis
uacuggccuggcauuuuacug

SEQ ID NO: 4156290 - RNA, 18 nt, Yersinia pestis
uacuggguaacaauucaa

SEQ ID NO: 4156291 - RNA, 14 nt, Yersinia pestis
uacugguaccaaac

SEQ ID NO: 4156292 - RNA, 14 nt, Yersinia pestis
uacugguagcagcc

SEQ ID NO: 4156293 - RNA, 20 nt, Yersinia pestis
uacuguaucaauaccuuacu

SEQ ID NO: 4156294 - RNA, 14 nt, Yersinia pestis
uacugucaaugcuc

SEQ ID NO: 4156295 - RNA, 18 nt, Yersinia pestis
uacugucgauaauaaauu

SEQ ID NO: 4156296 - RNA, 20 nt, Yersinia pestis
uacuguuaguucagacguac

SEQ ID NO: 4156297 - RNA, 18 nt, Yersinia pestis
uacuguuggcaauuucac

SEQ ID NO: 4156298 - RNA, 21 nt, Yersinia pestis
uacuguuuucauuauuuucac

SEQ ID NO: 4156299 - RNA, 13 nt, Yersinia pestis
uacuguuuugguu

SEQ ID NO: 4156300 - RNA, 18 nt, Yersinia pestis
uacuuaacaaucagugca

SEQ ID NO: 4156301 - RNA, 18 nt, Yersinia pestis
uacuuacccgaaucacuu

SEQ ID NO: 4156302 - RNA, 24 nt, Yersinia pestis
uacuuauugggcgcgauaaaagau

SEQ ID NO: 4156303 - RNA, 17 nt, Yersinia pestis
uacuucaggccaauagc

SEQ ID NO: 4156304 - RNA, 20 nt, Yersinia pestis
uacuugauaaggcaaggccg

SEQ ID NO: 4156305 - RNA, 21 nt, Yersinia pestis
uacuuuaacuuuaguuucuuu

SEQ ID NO: 4156306 - RNA, 15 nt, Yersinia pestis
uacuuuauuuaaaau

SEQ ID NO: 4156307 - RNA, 16 nt, Yersinia pestis
uacuuuccuuccucuu

SEQ ID NO: 4156308 - RNA, 18 nt, Yersinia pestis
uacuuuuaauacaggcug

SEQ ID NO: 4156309 - RNA, 13 nt, Yersinia pestis
uacuuuuuauuaa

SEQ ID NO: 4156310 - RNA, 13 nt, Yersinia pestis
uagaaaacaaaaa

SEQ ID NO: 4156311 - RNA, 14 nt, Yersinia pestis
uagaaaacaaaaag

SEQ ID NO: 4156312 - RNA, 22 nt, Yersinia pestis
uagaaaccaauagaccguagaa

SEQ ID NO: 4156313 - RNA, 21 nt, Yersinia pestis
uagaaaccaucaccgaggaua

SEQ ID NO: 4156314 - RNA, 19 nt, Yersinia pestis
uagaaacccggauucacca

SEQ ID NO: 4156315 - RNA, 23 nt, Yersinia pestis
uagaaaguauugcuaucaggcuc

SEQ ID NO: 4156316 - RNA, 23 nt, Yersinia pestis
uagaaauagcugcuucugaacca

SEQ ID NO: 4156317 - RNA, 22 nt, Yersinia pestis
uagaacugagaauaaucacagg

SEQ ID NO: 4156318 - RNA, 12 nt, Yersinia pestis
uagaagcccuga

SEQ ID NO: 4156319 - RNA, 14 nt, Yersinia pestis
uagaagcucauaug

SEQ ID NO: 4156320 - RNA, 21 nt, Yersinia pestis
uagaagguaaucagacugcug

SEQ ID NO: 4156321 - RNA, 19 nt, Yersinia pestis
uagaauacaggguaaauua

SEQ ID NO: 4156322 - RNA, 13 nt, Yersinia pestis
uagaaucugcugc

SEQ ID NO: 4156323 - RNA, 14 nt, Yersinia pestis
uagaaucugcugca

SEQ ID NO: 4156324 - RNA, 15 nt, Yersinia pestis
uagaauuuaccucca

SEQ ID NO: 4156325 - RNA, 22 nt, Yersinia pestis
uagacagcaguuaaugcuuaag

SEQ ID NO: 4156326 - RNA, 16 nt, Yersinia pestis
uagacaguaacuaaag

SEQ ID NO: 4156327 - RNA, 13 nt, Yersinia pestis
uagaccaccaacu

SEQ ID NO: 4156328 - RNA, 18 nt, Yersinia pestis
uagaccugaggauaaaaa

SEQ ID NO: 4156329 - RNA, 19 nt, Yersinia pestis
uagacgacacaaaugcugu

SEQ ID NO: 4156330 - RNA, 21 nt, Yersinia pestis
uagacgcaucgaccacccgua

SEQ ID NO: 4156331 - RNA, 13 nt, Yersinia pestis
uagacuaaaugua

SEQ ID NO: 4156332 - RNA, 16 nt, Yersinia pestis
uagacuguuuuauuau

SEQ ID NO: 4156333 - RNA, 21 nt, Yersinia pestis
uagacuuggcuuuuucuucca

SEQ ID NO: 4156334 - RNA, 18 nt, Yersinia pestis
uagagauacuuccuucaa

SEQ ID NO: 4156335 - RNA, 14 nt, Yersinia pestis
uagagcacagcacu

SEQ ID NO: 4156336 - RNA, 13 nt, Yersinia pestis
uagagcagugcag

SEQ ID NO: 4156337 - RNA, 15 nt, Yersinia pestis
uaggacggugccaug

SEQ ID NO: 4156338 - RNA, 23 nt, Yersinia pestis
uaggaggguguuuuuuugucuuu

SEQ ID NO: 4156339 - RNA, 16 nt, Yersinia pestis
uaggauguuauggauu

SEQ ID NO: 4156340 - RNA, 16 nt, Yersinia pestis
uaggcauaaauaauaa

SEQ ID NO: 4156341 - RNA, 13 nt, Yersinia pestis
uaggcaucucuga

SEQ ID NO: 4156342 - RNA, 15 nt, Yersinia pestis
uaggccaccucuucc

SEQ ID NO: 4156343 - RNA, 15 nt, Yersinia pestis
uaggccuaaacccca

SEQ ID NO: 4156344 - RNA, 18 nt, Yersinia pestis
uaggccuaaaccccacag

SEQ ID NO: 4156345 - RNA, 20 nt, Yersinia pestis
uaggcgaaauugacuuuaaa

SEQ ID NO: 4156346 - RNA, 16 nt, Yersinia pestis
uaggcgcauaugaaaa

SEQ ID NO: 4156347 - RNA, 23 nt, Yersinia pestis
uaggcggugagggagucagggag

SEQ ID NO: 4156348 - RNA, 16 nt, Yersinia pestis
uaggcuauugacaaag

SEQ ID NO: 4156349 - RNA, 22 nt, Yersinia pestis
uaggcuauugacaaaguaccua

SEQ ID NO: 4156350 - RNA, 13 nt, Yersinia pestis
uaggcucccagac

SEQ ID NO: 4156351 - RNA, 16 nt, Yersinia pestis
uagggaacgccagcgg

SEQ ID NO: 4156352 - RNA, 19 nt, Yersinia pestis
uagggcacuuucaucgccg

SEQ ID NO: 4156353 - RNA, 13 nt, Yersinia pestis
uagggccaccaga

SEQ ID NO: 4156354 - RNA, 14 nt, Yersinia pestis
uagggcgcggcugg

SEQ ID NO: 4156355 - RNA, 23 nt, Yersinia pestis
uagggcugucagccaccgugucc

SEQ ID NO: 4156356 - RNA, 21 nt, Yersinia pestis
uaggggaagguaaaaaagaau

SEQ ID NO: 4156357 - RNA, 22 nt, Yersinia pestis
uaggggccaccaaauaaaacaa

SEQ ID NO: 4156358 - RNA, 16 nt, Yersinia pestis
uagggucauacccaaa

SEQ ID NO: 4156359 - RNA, 20 nt, Yersinia pestis
uaggguuguuggucagcaga

SEQ ID NO: 4156360 - RNA, 16 nt, Yersinia pestis
uagguaauaccaaugc

SEQ ID NO: 4156361 - RNA, 20 nt, Yersinia pestis
uagguacggguauagcggcg

SEQ ID NO: 4156362 - RNA, 13 nt, Yersinia pestis
uaggucagugguu

SEQ ID NO: 4156363 - RNA, 17 nt, Yersinia pestis
uaggucaucccagcaca

SEQ ID NO: 4156364 - RNA, 16 nt, Yersinia pestis
uaggugcgcaaaccug

SEQ ID NO: 4156365 - RNA, 15 nt, Yersinia pestis
uagguuaaauucacu

SEQ ID NO: 4156366 - RNA, 18 nt, Yersinia pestis
uagguuacgucauauccc

SEQ ID NO: 4156367 - RNA, 13 nt, Yersinia pestis
uagguuucugggc

SEQ ID NO: 4156368 - RNA, 18 nt, Yersinia pestis
uaguaaaaaaucuauuga

SEQ ID NO: 4156369 - RNA, 20 nt, Yersinia pestis
uaguaaacuuaucgaucucc

SEQ ID NO: 4156370 - RNA, 14 nt, Yersinia pestis
uaguaacaccagca

SEQ ID NO: 4156371 - RNA, 15 nt, Yersinia pestis
uaguaagcaugccau

SEQ ID NO: 4156372 - RNA, 11 nt, Yersinia pestis
uaguaauaauu

SEQ ID NO: 4156373 - RNA, 20 nt, Yersinia pestis
uaguaaugacgcuauggaua

SEQ ID NO: 4156374 - RNA, 14 nt, Yersinia pestis
uaguacuugccaca

SEQ ID NO: 4156375 - RNA, 20 nt, Yersinia pestis
uaguaggucacauagcucga

SEQ ID NO: 4156376 - RNA, 21 nt, Yersinia pestis
uaguauugcggaauggcaacg

SEQ ID NO: 4156377 - RNA, 15 nt, Yersinia pestis
uaguauuuaacgcca

SEQ ID NO: 4156378 - RNA, 14 nt, Yersinia pestis
uaguauuuguagug

SEQ ID NO: 4156379 - RNA, 17 nt, Yersinia pestis
uagucaaaacaauaucu

SEQ ID NO: 4156380 - RNA, 22 nt, Yersinia pestis
uagucacgcggcggcgucaaau

SEQ ID NO: 4156381 - RNA, 20 nt, Yersinia pestis
uagucacgggguguguggca

SEQ ID NO: 4156382 - RNA, 22 nt, Yersinia pestis
uagucacgucuucaccaaugau

SEQ ID NO: 4156383 - RNA, 16 nt, Yersinia pestis
uagucacucaagccag

SEQ ID NO: 4156384 - RNA, 14 nt, Yersinia pestis
uagucagcuucacu

SEQ ID NO: 4156385 - RNA, 15 nt, Yersinia pestis
uagucauauauuuuu

SEQ ID NO: 4156386 - RNA, 18 nt, Yersinia pestis
uagucauauauuuuucuu

SEQ ID NO: 4156387 - RNA, 18 nt, Yersinia pestis
uagucaucaugacgauga

SEQ ID NO: 4156388 - RNA, 19 nt, Yersinia pestis
uagucccucaagaccugcc

SEQ ID NO: 4156389 - RNA, 16 nt, Yersinia pestis
uagucucuugggcagc

SEQ ID NO: 4156390 - RNA, 18 nt, Yersinia pestis
uagugaaguaauaaaaau

SEQ ID NO: 4156391 - RNA, 15 nt, Yersinia pestis
uagugacguaaaaag

SEQ ID NO: 4156392 - RNA, 21 nt, Yersinia pestis
uagugacuaauuguuugcuuu

SEQ ID NO: 4156393 - RNA, 14 nt, Yersinia pestis
uagugacucaucaa

SEQ ID NO: 4156394 - RNA, 15 nt, Yersinia pestis
uagugacucaucaaa

SEQ ID NO: 4156395 - RNA, 21 nt, Yersinia pestis
uagugaguuauucgccccuua

SEQ ID NO: 4156396 - RNA, 13 nt, Yersinia pestis
uagugaugcagua

SEQ ID NO: 4156397 - RNA, 21 nt, Yersinia pestis
uagugaugcaguaaauagucu

SEQ ID NO: 4156398 - RNA, 21 nt, Yersinia pestis
uagugaugggggcaauugauu

SEQ ID NO: 4156399 - RNA, 15 nt, Yersinia pestis
uagugauuauuuaaa

SEQ ID NO: 4156400 - RNA, 20 nt, Yersinia pestis
uagugcaaaauuccaccauu

SEQ ID NO: 4156401 - RNA, 16 nt, Yersinia pestis
uagugcuacagcagca

SEQ ID NO: 4156402 - RNA, 11 nt, Yersinia pestis
uagugcuucca

SEQ ID NO: 4156403 - RNA, 17 nt, Yersinia pestis
uaguggcacaaauaaaa

SEQ ID NO: 4156404 - RNA, 16 nt, Yersinia pestis
uaguggugagcgccau

SEQ ID NO: 4156405 - RNA, 21 nt, Yersinia pestis
uaguguaaaaaccaucugaug

SEQ ID NO: 4156406 - RNA, 18 nt, Yersinia pestis
uaguguguguauuuaaaa

SEQ ID NO: 4156407 - RNA, 21 nt, Yersinia pestis
uaguuaacacgaaaagcagca

SEQ ID NO: 4156408 - RNA, 19 nt, Yersinia pestis
uaguuaagguuagcuaugc

SEQ ID NO: 4156409 - RNA, 16 nt, Yersinia pestis
uaguuacaauaaauca

SEQ ID NO: 4156410 - RNA, 17 nt, Yersinia pestis
uaguuaccgggcgaaca

SEQ ID NO: 4156411 - RNA, 14 nt, Yersinia pestis
uaguuauauaaggu

SEQ ID NO: 4156412 - RNA, 20 nt, Yersinia pestis
uaguuaucucccauuaauua

SEQ ID NO: 4156413 - RNA, 14 nt, Yersinia pestis
uaguucaaugguca

SEQ ID NO: 4156414 - RNA, 19 nt, Yersinia pestis
uaguucacgauggaaaaaa

SEQ ID NO: 4156415 - RNA, 20 nt, Yersinia pestis
uaguucacgauggaaaaaau

SEQ ID NO: 4156416 - RNA, 23 nt, Yersinia pestis
uaguucacgauggaaaaaauaca

SEQ ID NO: 4156417 - RNA, 11 nt, Yersinia pestis
uaguucagucg

SEQ ID NO: 4156418 - RNA, 13 nt, Yersinia pestis
uaguucauuuugu

SEQ ID NO: 4156419 - RNA, 18 nt, Yersinia pestis
uaguugaacucgccuuca

SEQ ID NO: 4156420 - RNA, 21 nt, Yersinia pestis
uaguugaccuugguaaauacc

SEQ ID NO: 4156421 - RNA, 18 nt, Yersinia pestis
uaguuggcaagacgguau

SEQ ID NO: 4156422 - RNA, 22 nt, Yersinia pestis
uaguuuagauagaaaucacuga

SEQ ID NO: 4156423 - RNA, 13 nt, Yersinia pestis
uaguuuuucuccu

SEQ ID NO: 4156424 - RNA, 20 nt, Yersinia pestis
uauaaaacacgcauaugaau

SEQ ID NO: 4156425 - RNA, 18 nt, Yersinia pestis
uauaaaaccacugaccua

SEQ ID NO: 4156426 - RNA, 22 nt, Yersinia pestis
uauaaaauaauaagauucagcu

SEQ ID NO: 4156427 - RNA, 14 nt, Yersinia pestis
uauaaacauaaaaa

SEQ ID NO: 4156428 - RNA, 15 nt, Yersinia pestis
uauaaaccagccagu

SEQ ID NO: 4156429 - RNA, 20 nt, Yersinia pestis
uauaaagauuuuaagcacug

SEQ ID NO: 4156430 - RNA, 14 nt, Yersinia pestis
uauaaagcauuuau

SEQ ID NO: 4156431 - RNA, 23 nt, Yersinia pestis
uauaaagccauuggucaaucuag

SEQ ID NO: 4156432 - RNA, 14 nt, Yersinia pestis
uauaaauaaaauag

SEQ ID NO: 4156433 - RNA, 12 nt, Yersinia pestis
uauaaauuuaau

SEQ ID NO: 4156434 - RNA, 13 nt, Yersinia pestis
uauaaauuuaaua

SEQ ID NO: 4156435 - RNA, 15 nt, Yersinia pestis
uauaaauuuaauaaa

SEQ ID NO: 4156436 - RNA, 19 nt, Yersinia pestis
uauaaauuuaauaaaaacc

SEQ ID NO: 4156437 - RNA, 14 nt, Yersinia pestis
uauaaccaaaguca

SEQ ID NO: 4156438 - RNA, 17 nt, Yersinia pestis
uauaaccaugaugacaa

SEQ ID NO: 4156439 - RNA, 17 nt, Yersinia pestis
uauaaccauuaacaaua

SEQ ID NO: 4156440 - RNA, 19 nt, Yersinia pestis
uauaaccccccugcugaua

SEQ ID NO: 4156441 - RNA, 18 nt, Yersinia pestis
uauaaccgucaccaaaau

SEQ ID NO: 4156442 - RNA, 17 nt, Yersinia pestis
uauaacgcucgccacga

SEQ ID NO: 4156443 - RNA, 16 nt, Yersinia pestis
uauaagcaauaccgac

SEQ ID NO: 4156444 - RNA, 14 nt, Yersinia pestis
uauaaggaauauac

SEQ ID NO: 4156445 - RNA, 16 nt, Yersinia pestis
uauaaggaauauacuu

SEQ ID NO: 4156446 - RNA, 17 nt, Yersinia pestis
uauaaggaauauacuuu

SEQ ID NO: 4156447 - RNA, 11 nt, Yersinia pestis
uauaauaaugg

SEQ ID NO: 4156448 - RNA, 19 nt, Yersinia pestis
uauaauacgaaauacuuau

SEQ ID NO: 4156449 - RNA, 22 nt, Yersinia pestis
uauaauagcuggcggauaaaaa

SEQ ID NO: 4156450 - RNA, 23 nt, Yersinia pestis
uauaauagcuggcggauaaaaau

SEQ ID NO: 4156451 - RNA, 14 nt, Yersinia pestis
uauaauauuaaaau

SEQ ID NO: 4156452 - RNA, 20 nt, Yersinia pestis
uauaaugagaauguaaauuu

SEQ ID NO: 4156453 - RNA, 15 nt, Yersinia pestis
uauaauuauuucucu

SEQ ID NO: 4156454 - RNA, 13 nt, Yersinia pestis
uauaauucauuuu

SEQ ID NO: 4156455 - RNA, 18 nt, Yersinia pestis
uauaauuucaaaguaaaa

SEQ ID NO: 4156456 - RNA, 14 nt, Yersinia pestis
uauacaccccauca

SEQ ID NO: 4156457 - RNA, 22 nt, Yersinia pestis
uauacagcccgguaucaccuuu

SEQ ID NO: 4156458 - RNA, 21 nt, Yersinia pestis
uauacagucaauugagaauaa

SEQ ID NO: 4156459 - RNA, 13 nt, Yersinia pestis
uaucgaaacacau

SEQ ID NO: 4156460 - RNA, 17 nt, Yersinia pestis
uaucgaaacacauacaa

SEQ ID NO: 4156461 - RNA, 13 nt, Yersinia pestis
uaucgaauugauc

SEQ ID NO: 4156462 - RNA, 15 nt, Yersinia pestis
uaucgaccaugaaua

SEQ ID NO: 4156463 - RNA, 16 nt, Yersinia pestis
uaucgauaugaacugu

SEQ ID NO: 4156464 - RNA, 14 nt, Yersinia pestis
uaucgcaauuucag

SEQ ID NO: 4156465 - RNA, 23 nt, Yersinia pestis
uaucgccaacacuauuguggaua

SEQ ID NO: 4156466 - RNA, 15 nt, Yersinia pestis
uaucgccaagccagu

SEQ ID NO: 4156467 - RNA, 19 nt, Yersinia pestis
uaucgcgaaaaugaagcga

SEQ ID NO: 4156468 - RNA, 14 nt, Yersinia pestis
uaucggcggagaga

SEQ ID NO: 4156469 - RNA, 19 nt, Yersinia pestis
uaucggugcugacaaacag

SEQ ID NO: 4156470 - RNA, 22 nt, Yersinia pestis
uaucggugcugacaaacagaua

SEQ ID NO: 4156471 - RNA, 13 nt, Yersinia pestis
uaucguccagcag

SEQ ID NO: 4156472 - RNA, 16 nt, Yersinia pestis
uaucgugaauaaaaau

SEQ ID NO: 4156473 - RNA, 15 nt, Yersinia pestis
uaucuaaaacugccu

SEQ ID NO: 4156474 - RNA, 14 nt, Yersinia pestis
uaucuaaaauaucu

SEQ ID NO: 4156475 - RNA, 12 nt, Yersinia pestis
uaucuacuucua

SEQ ID NO: 4156476 - RNA, 13 nt, Yersinia pestis
uaucuaucuguuc

SEQ ID NO: 4156477 - RNA, 12 nt, Yersinia pestis
uaucuauuucca

SEQ ID NO: 4156478 - RNA, 14 nt, Yersinia pestis
uaucuauuuccauc

SEQ ID NO: 4156479 - RNA, 17 nt, Yersinia pestis
uaucucaucgcuugcca

SEQ ID NO: 4156480 - RNA, 20 nt, Yersinia pestis
uaucucccauuaauuaauca

SEQ ID NO: 4156481 - RNA, 21 nt, Yersinia pestis
uaucuccguugaaaccuacau

SEQ ID NO: 4156482 - RNA, 18 nt, Yersinia pestis
uaucucucuaaucgcgca

SEQ ID NO: 4156483 - RNA, 22 nt, Yersinia pestis
uaucucuuuuccggcuuucuau

SEQ ID NO: 4156484 - RNA, 19 nt, Yersinia pestis
uaucugacugcuugccaaa

SEQ ID NO: 4156485 - RNA, 18 nt, Yersinia pestis
uaucugcucuugcucagu

SEQ ID NO: 4156486 - RNA, 15 nt, Yersinia pestis
uaucuggcuuuccug

SEQ ID NO: 4156487 - RNA, 16 nt, Yersinia pestis
uaucuguccgcuuaua

SEQ ID NO: 4156488 - RNA, 18 nt, Yersinia pestis
uaucuuaugagcagccca

SEQ ID NO: 4156489 - RNA, 20 nt, Yersinia pestis
uaucuuccacuugaucggcg

SEQ ID NO: 4156490 - RNA, 15 nt, Yersinia pestis
uaucuugaaccaauu

SEQ ID NO: 4156491 - RNA, 21 nt, Yersinia pestis
uaucuugaaccaauuuuucug

SEQ ID NO: 4156492 - RNA, 14 nt, Yersinia pestis
uaucuugcauacaa

SEQ ID NO: 4156493 - RNA, 19 nt, Yersinia pestis
uaucuuguaaauagucaua

SEQ ID NO: 4156494 - RNA, 13 nt, Yersinia pestis
uaucuuuaauuuu

SEQ ID NO: 4156495 - RNA, 13 nt, Yersinia pestis
uaucuuuacccac

SEQ ID NO: 4156496 - RNA, 15 nt, Yersinia pestis
uaucuuuauuaucaa

SEQ ID NO: 4156497 - RNA, 16 nt, Yersinia pestis
uaucuuuauugcuccu

SEQ ID NO: 4156498 - RNA, 21 nt, Yersinia pestis
uaucuuucaaguccugcuuca

SEQ ID NO: 4156499 - RNA, 22 nt, Yersinia pestis
uaucuuucaaguccugcuucaa

SEQ ID NO: 4156500 - RNA, 18 nt, Yersinia pestis
uaucuuuuauuuaugaua

SEQ ID NO: 4156501 - RNA, 17 nt, Yersinia pestis
uaugaaaaaccuccggc

SEQ ID NO: 4156502 - RNA, 13 nt, Yersinia pestis
uaugaaauuucac

SEQ ID NO: 4156503 - RNA, 13 nt, Yersinia pestis
uaugaauuaauuu

SEQ ID NO: 4156504 - RNA, 23 nt, Yersinia pestis
uaugaauuaauuuauuuucauua

SEQ ID NO: 4156505 - RNA, 20 nt, Yersinia pestis
uaugacaacugaaaauacua

SEQ ID NO: 4156506 - RNA, 16 nt, Yersinia pestis
uaugacagcauacauc

SEQ ID NO: 4156507 - RNA, 15 nt, Yersinia pestis
uaugauaauaguuca

SEQ ID NO: 4156508 - RNA, 18 nt, Yersinia pestis
uaugaucuugauaaacau

SEQ ID NO: 4156509 - RNA, 18 nt, Yersinia pestis
uaugcaaaauaauauuaa

SEQ ID NO: 4156510 - RNA, 12 nt, Yersinia pestis
uaugcagcucaa

SEQ ID NO: 4156511 - RNA, 17 nt, Yersinia pestis
uaugcagcucaaucaca

SEQ ID NO: 4156512 - RNA, 14 nt, Yersinia pestis
uaugcauuauugau

SEQ ID NO: 4156513 - RNA, 19 nt, Yersinia pestis
uaugccggaggauauuuau

SEQ ID NO: 4156514 - RNA, 20 nt, Yersinia pestis
uaugccggaggauauuuauu

SEQ ID NO: 4156515 - RNA, 20 nt, Yersinia pestis
uaugccuuggcaaagagacu

SEQ ID NO: 4156516 - RNA, 13 nt, Yersinia pestis
uaugccuuuucuu

SEQ ID NO: 4156517 - RNA, 13 nt, Yersinia pestis
uaugcguggguuc

SEQ ID NO: 4156518 - RNA, 19 nt, Yersinia pestis
uaugcguggguucuucaaa

SEQ ID NO: 4156519 - RNA, 16 nt, Yersinia pestis
uaugcguguugccacc

SEQ ID NO: 4156520 - RNA, 17 nt, Yersinia pestis
uaugcguuuucaccgug

SEQ ID NO: 4156521 - RNA, 12 nt, Yersinia pestis
uaugcucugcug

SEQ ID NO: 4156522 - RNA, 20 nt, Yersinia pestis
uaugcugaauaaacggcaag

SEQ ID NO: 4156523 - RNA, 18 nt, Yersinia pestis
uaugcugaccacugcuuc

SEQ ID NO: 4156524 - RNA, 15 nt, Yersinia pestis
uaugcuuaauuuggc

SEQ ID NO: 4156525 - RNA, 16 nt, Yersinia pestis
uauggaaguaauccag

SEQ ID NO: 4156526 - RNA, 19 nt, Yersinia pestis
uauggaaguaauccagaug

SEQ ID NO: 4156527 - RNA, 20 nt, Yersinia pestis
uauggacaagggcuauuuuu

SEQ ID NO: 4156528 - RNA, 20 nt, Yersinia pestis
uauggauaaauccugaacau

SEQ ID NO: 4156529 - RNA, 15 nt, Yersinia pestis
uauggauaauuuaau

SEQ ID NO: 4156530 - RNA, 17 nt, Yersinia pestis
uauggauaauuuaauua

SEQ ID NO: 4156531 - RNA, 15 nt, Yersinia pestis
uauggauacacggcu

SEQ ID NO: 4156532 - RNA, 16 nt, Yersinia pestis
uauggaugaugcacag

SEQ ID NO: 4156533 - RNA, 20 nt, Yersinia pestis
uauggcagaaaucagccaua

SEQ ID NO: 4156534 - RNA, 13 nt, Yersinia pestis
uauggcgaagaga

SEQ ID NO: 4156535 - RNA, 22 nt, Yersinia pestis
uauggcgaugaugauuauuuua

SEQ ID NO: 4156536 - RNA, 19 nt, Yersinia pestis
uauggggaugauuguuuua

SEQ ID NO: 4156537 - RNA, 21 nt, Yersinia pestis
uaugguauagacuguuuuauu

SEQ ID NO: 4156538 - RNA, 13 nt, Yersinia pestis
uauggucagcaau

SEQ ID NO: 4156539 - RNA, 13 nt, Yersinia pestis
uaugguuaaucua

SEQ ID NO: 4156540 - RNA, 16 nt, Yersinia pestis
uaugguuaaucuaccc

SEQ ID NO: 4156541 - RNA, 16 nt, Yersinia pestis
uauguaacacauauuu

SEQ ID NO: 4156542 - RNA, 16 nt, Yersinia pestis
uauguacacauuauuu

SEQ ID NO: 4156543 - RNA, 18 nt, Yersinia pestis
uauguagccagauaaaac

SEQ ID NO: 4156544 - RNA, 23 nt, Yersinia pestis
uauguagggguacagcagggauu

SEQ ID NO: 4156545 - RNA, 15 nt, Yersinia pestis
uauguaguuaaucua

SEQ ID NO: 4156546 - RNA, 15 nt, Yersinia pestis
uaugugccaaaaaaa

SEQ ID NO: 4156547 - RNA, 19 nt, Yersinia pestis
uaugugcugguuauuggcc

SEQ ID NO: 4156548 - RNA, 21 nt, Yersinia pestis
uaugugcuugcggaauuucuu

SEQ ID NO: 4156549 - RNA, 13 nt, Yersinia pestis
uauguuaaaucag

SEQ ID NO: 4156550 - RNA, 15 nt, Yersinia pestis
uauguuucuuuaaua

SEQ ID NO: 4156551 - RNA, 12 nt, Yersinia pestis
uauguuuuuaac

SEQ ID NO: 4156552 - RNA, 15 nt, Yersinia pestis
uauguuuuuaacaaa

SEQ ID NO: 4156553 - RNA, 16 nt, Yersinia pestis
uauguuuuuaacaaaa

SEQ ID NO: 4156554 - RNA, 13 nt, Yersinia pestis
uauuaaaacacau

SEQ ID NO: 4156555 - RNA, 18 nt, Yersinia pestis
uauuaaacuugcucuuuc

SEQ ID NO: 4156556 - RNA, 12 nt, Yersinia pestis
uauuaaagccau

SEQ ID NO: 4156557 - RNA, 20 nt, Yersinia pestis
uauuaaagccauucagcagc

SEQ ID NO: 4156558 - RNA, 22 nt, Yersinia pestis
uauuaaagcccgcuuaaauacg

SEQ ID NO: 4156559 - RNA, 18 nt, Yersinia pestis
uauuaaaugcauuauaag

SEQ ID NO: 4156560 - RNA, 12 nt, Yersinia pestis
uauuaacauuaa

SEQ ID NO: 4156561 - RNA, 17 nt, Yersinia pestis
uauuaacgauuauuaaa

SEQ ID NO: 4156562 - RNA, 13 nt, Yersinia pestis
uauuaacugcagu

SEQ ID NO: 4156563 - RNA, 18 nt, Yersinia pestis
uauuaacugcagugaaaa

SEQ ID NO: 4156564 - RNA, 22 nt, Yersinia pestis
uauuaauaggaggguguuuuuu

SEQ ID NO: 4156565 - RNA, 18 nt, Yersinia pestis
uauuaauauaauacuuaa

SEQ ID NO: 4156566 - RNA, 20 nt, Yersinia pestis
uauuaauauaauacuuaagu

SEQ ID NO: 4156567 - RNA, 22 nt, Yersinia pestis
uauuaauaucgagguucgacua

SEQ ID NO: 4156568 - RNA, 17 nt, Yersinia pestis
uauuaaucaacagauau

SEQ ID NO: 4156569 - RNA, 13 nt, Yersinia pestis
uauuaaugaaauu

SEQ ID NO: 4156570 - RNA, 15 nt, Yersinia pestis
uauuaaugaaauuag

SEQ ID NO: 4156571 - RNA, 13 nt, Yersinia pestis
uauuacaacggcu

SEQ ID NO: 4156572 - RNA, 15 nt, Yersinia pestis
uauuaccaauaugaa

SEQ ID NO: 4156573 - RNA, 18 nt, Yersinia pestis
uauuaccugcuauuuuau

SEQ ID NO: 4156574 - RNA, 19 nt, Yersinia pestis
uauuacgcagccauaccca

SEQ ID NO: 4156575 - RNA, 14 nt, Yersinia pestis
uauuacuaucgaaa

SEQ ID NO: 4156576 - RNA, 16 nt, Yersinia pestis
uauuacugucaaugcu

SEQ ID NO: 4156577 - RNA, 15 nt, Yersinia pestis
uauuacugucacugu

SEQ ID NO: 4156578 - RNA, 16 nt, Yersinia pestis
uauuacugucauugcu

SEQ ID NO: 4156579 - RNA, 13 nt, Yersinia pestis
uauuacuugauau

SEQ ID NO: 4156580 - RNA, 22 nt, Yersinia pestis
uauuagaauguguaguugaagu

SEQ ID NO: 4156581 - RNA, 22 nt, Yersinia pestis
uauuagcgauagccugaugaga

SEQ ID NO: 4156582 - RNA, 13 nt, Yersinia pestis
uauuucauuagau

SEQ ID NO: 4156583 - RNA, 16 nt, Yersinia pestis
uauuuccgcugacuua

SEQ ID NO: 4156584 - RNA, 15 nt, Yersinia pestis
uauuucgugauuuuc

SEQ ID NO: 4156585 - RNA, 16 nt, Yersinia pestis
uauuucuuagagagag

SEQ ID NO: 4156586 - RNA, 13 nt, Yersinia pestis
uauuucuucauac

SEQ ID NO: 4156587 - RNA, 21 nt, Yersinia pestis
uauuugaaauacuuauuugaa

SEQ ID NO: 4156588 - RNA, 16 nt, Yersinia pestis
uauuugaacuucaaau

SEQ ID NO: 4156589 - RNA, 15 nt, Yersinia pestis
uauuugagauauagg

SEQ ID NO: 4156590 - RNA, 14 nt, Yersinia pestis
uauuugaguuuuag

SEQ ID NO: 4156591 - RNA, 13 nt, Yersinia pestis
uauuugcagaaag

SEQ ID NO: 4156592 - RNA, 18 nt, Yersinia pestis
uauuugcagaaaguaauc

SEQ ID NO: 4156593 - RNA, 22 nt, Yersinia pestis
uauuugcagcggaugauaaaua

SEQ ID NO: 4156594 - RNA, 15 nt, Yersinia pestis
uauuugcgugaaaac

SEQ ID NO: 4156595 - RNA, 22 nt, Yersinia pestis
uauuuggauuaaguccaagaag

SEQ ID NO: 4156596 - RNA, 17 nt, Yersinia pestis
uauuugggguauauauu

SEQ ID NO: 4156597 - RNA, 18 nt, Yersinia pestis
uauuugggguauauauuu

SEQ ID NO: 4156598 - RNA, 14 nt, Yersinia pestis
uauuuguaguuuuu

SEQ ID NO: 4156599 - RNA, 18 nt, Yersinia pestis
uauuuguaucaaugaaaa

SEQ ID NO: 4156600 - RNA, 18 nt, Yersinia pestis
uauuugucgcauuuauuu

SEQ ID NO: 4156601 - RNA, 13 nt, Yersinia pestis
uauuuuaaauaug

SEQ ID NO: 4156602 - RNA, 13 nt, Yersinia pestis
uauuuuacuugcc

SEQ ID NO: 4156603 - RNA, 16 nt, Yersinia pestis
uauuuuacuugccauu

SEQ ID NO: 4156604 - RNA, 23 nt, Yersinia pestis
uauuuuaucccaaaagaagacaa

SEQ ID NO: 4156605 - RNA, 22 nt, Yersinia pestis
uauuuuaucuuuuagugagggg

SEQ ID NO: 4156606 - RNA, 21 nt, Yersinia pestis
uauuuucaucccaagagaacg

SEQ ID NO: 4156607 - RNA, 14 nt, Yersinia pestis
uauuuucauuauuu

SEQ ID NO: 4156608 - RNA, 22 nt, Yersinia pestis
uauuuuccgggucaaacucagc

SEQ ID NO: 4156609 - RNA, 15 nt, Yersinia pestis
uauuuucuaaccagg

SEQ ID NO: 4156610 - RNA, 14 nt, Yersinia pestis
uauuuucuauacca

SEQ ID NO: 4156611 - RNA, 21 nt, Yersinia pestis
uauuuugaaccguaugcuuuc

SEQ ID NO: 4156612 - RNA, 18 nt, Yersinia pestis
uauuuugaauauuuuuaa

SEQ ID NO: 4156613 - RNA, 19 nt, Yersinia pestis
uauuuugaauauuuuuaau

SEQ ID NO: 4156614 - RNA, 19 nt, Yersinia pestis
uauuuuggaguauacauua

SEQ ID NO: 4156615 - RNA, 18 nt, Yersinia pestis
uauuuuggguauauaguu

SEQ ID NO: 4156616 - RNA, 16 nt, Yersinia pestis
uauuuuugacuuuaau

SEQ ID NO: 4156617 - RNA, 19 nt, Yersinia pestis
uauuuuugacuuuaauuaa

SEQ ID NO: 4156618 - RNA, 20 nt, Yersinia pestis
uauuuuugacuuuaauuaaa

SEQ ID NO: 4156619 - RNA, 23 nt, Yersinia pestis
uauuuuuucuuucaccagugguc

SEQ ID NO: 4156620 - RNA, 16 nt, Yersinia pestis
ucaaaaaaaauacauu

SEQ ID NO: 4156621 - RNA, 11 nt, Yersinia pestis
ucaaaaaauag

SEQ ID NO: 4156622 - RNA, 20 nt, Yersinia pestis
ucaaaaacccauuaaaaaca

SEQ ID NO: 4156623 - RNA, 12 nt, Yersinia pestis
ucaaaaaccugu

SEQ ID NO: 4156624 - RNA, 14 nt, Yersinia pestis
ucaaaacaaucacu

SEQ ID NO: 4156625 - RNA, 16 nt, Yersinia pestis
ucaaaacaaucacuga

SEQ ID NO: 4156626 - RNA, 13 nt, Yersinia pestis
ucaaaacuaauau

SEQ ID NO: 4156627 - RNA, 15 nt, Yersinia pestis
ucaaaacuaauauuu

SEQ ID NO: 4156628 - RNA, 16 nt, Yersinia pestis
ucaaaacugauuaaua

SEQ ID NO: 4156629 - RNA, 19 nt, Yersinia pestis
ucaaaaggauggcccaagc

SEQ ID NO: 4156630 - RNA, 20 nt, Yersinia pestis
ucaaaaggauggcccaagcc

SEQ ID NO: 4156631 - RNA, 14 nt, Yersinia pestis
ucaaaauaaaaauu

SEQ ID NO: 4156632 - RNA, 15 nt, Yersinia pestis
ucaaaauaaaucagu

SEQ ID NO: 4156633 - RNA, 11 nt, Yersinia pestis
ucaaaauaccc

SEQ ID NO: 4156634 - RNA, 13 nt, Yersinia pestis
ucaaaauacccau

SEQ ID NO: 4156635 - RNA, 22 nt, Yersinia pestis
ucaaaauacuuaacaaucagug

SEQ ID NO: 4156636 - RNA, 17 nt, Yersinia pestis
ucaaaaucugauacuga

SEQ ID NO: 4156637 - RNA, 15 nt, Yersinia pestis
ucaaaaucuucggca

SEQ ID NO: 4156638 - RNA, 11 nt, Yersinia pestis
ucaaacaaaua

SEQ ID NO: 4156639 - RNA, 13 nt, Yersinia pestis
ucaaacaaaucuu

SEQ ID NO: 4156640 - RNA, 23 nt, Yersinia pestis
ucaaacaaaucuuaaauugaaga

SEQ ID NO: 4156641 - RNA, 13 nt, Yersinia pestis
ucaaacauagaca

SEQ ID NO: 4156642 - RNA, 20 nt, Yersinia pestis
ucaaaccaagcccuuuggca

SEQ ID NO: 4156643 - RNA, 21 nt, Yersinia pestis
ucaaaccgccagccacgcaga

SEQ ID NO: 4156644 - RNA, 17 nt, Yersinia pestis
ucaaacggcuuuuuaaa

SEQ ID NO: 4156645 - RNA, 17 nt, Yersinia pestis
ucaaacggugugcaaug

SEQ ID NO: 4156646 - RNA, 13 nt, Yersinia pestis
ucaaacuauucau

SEQ ID NO: 4156647 - RNA, 15 nt, Yersinia pestis
ucaaacucagcauca

SEQ ID NO: 4156648 - RNA, 18 nt, Yersinia pestis
ucaaacuccccuggcagg

SEQ ID NO: 4156649 - RNA, 19 nt, Yersinia pestis
ucaaacucggccgggcuga

SEQ ID NO: 4156650 - RNA, 21 nt, Yersinia pestis
ucaaacucuucagccauaacu

SEQ ID NO: 4156651 - RNA, 19 nt, Yersinia pestis
ucaaacucuuuacaggcca

SEQ ID NO: 4156652 - RNA, 17 nt, Yersinia pestis
ucaaacugauaaagcaa

SEQ ID NO: 4156653 - RNA, 14 nt, Yersinia pestis
ucaaagaauaacug

SEQ ID NO: 4156654 - RNA, 19 nt, Yersinia pestis
ucaaagacuaaccucugca

SEQ ID NO: 4156655 - RNA, 13 nt, Yersinia pestis
ucaaagauuucau

SEQ ID NO: 4156656 - RNA, 13 nt, Yersinia pestis
ucaaaguaaaaua

SEQ ID NO: 4156657 - RNA, 15 nt, Yersinia pestis
ucaaauaacggaauu

SEQ ID NO: 4156658 - RNA, 17 nt, Yersinia pestis
ucaaauaaguguuucaa

SEQ ID NO: 4156659 - RNA, 20 nt, Yersinia pestis
ucaaauaaguguuucaaaua

SEQ ID NO: 4156660 - RNA, 12 nt, Yersinia pestis
ucaaauacugug

SEQ ID NO: 4156661 - RNA, 17 nt, Yersinia pestis
ucaaauaguagaucuau

SEQ ID NO: 4156662 - RNA, 20 nt, Yersinia pestis
ucaaauaguagaucuauuag

SEQ ID NO: 4156663 - RNA, 22 nt, Yersinia pestis
ucaaaucagaggcuucauucgu

SEQ ID NO: 4156664 - RNA, 16 nt, Yersinia pestis
ucaaaucaguuccuga

SEQ ID NO: 4156665 - RNA, 20 nt, Yersinia pestis
ucaaaucaguuccugauucg

SEQ ID NO: 4156666 - RNA, 21 nt, Yersinia pestis
ucaaauccggauuucuaccag

SEQ ID NO: 4156667 - RNA, 20 nt, Yersinia pestis
ucaaaucgccaaacugcuca

SEQ ID NO: 4156668 - RNA, 21 nt, Yersinia pestis
ucaaaucugcuccaucaauaa

SEQ ID NO: 4156669 - RNA, 21 nt, Yersinia pestis
ucaaaugauucagugauaaca

SEQ ID NO: 4156670 - RNA, 12 nt, Yersinia pestis
ucaaaugucccc

SEQ ID NO: 4156671 - RNA, 21 nt, Yersinia pestis
ucaaauucagguugaucagua

SEQ ID NO: 4156672 - RNA, 22 nt, Yersinia pestis
ucaaauugcacaugcagcauuu

SEQ ID NO: 4156673 - RNA, 16 nt, Yersinia pestis
ucaaauuuaaaguuuu

SEQ ID NO: 4156674 - RNA, 22 nt, Yersinia pestis
ucaaauuuaaaguuuuuuauuu

SEQ ID NO: 4156675 - RNA, 21 nt, Yersinia pestis
ucaacaaaaaagggggcccug

SEQ ID NO: 4156676 - RNA, 20 nt, Yersinia pestis
ucaacaaaacgaacacugca

SEQ ID NO: 4156677 - RNA, 21 nt, Yersinia pestis
ucaacaaaacgaacacugcaa

SEQ ID NO: 4156678 - RNA, 18 nt, Yersinia pestis
ucaacaaauucaccagca

SEQ ID NO: 4156679 - RNA, 15 nt, Yersinia pestis
ucaacaaucaaucac

SEQ ID NO: 4156680 - RNA, 16 nt, Yersinia pestis
ucaacaaucaaucacc

SEQ ID NO: 4156681 - RNA, 23 nt, Yersinia pestis
ucaacagauaugcauuauugaug

SEQ ID NO: 4156682 - RNA, 12 nt, Yersinia pestis
ucaacaggagca

SEQ ID NO: 4156683 - RNA, 19 nt, Yersinia pestis
ucaacaggagcaaccauuu

SEQ ID NO: 4156684 - RNA, 19 nt, Yersinia pestis
ucaacauacugauacaaca

SEQ ID NO: 4156685 - RNA, 15 nt, Yersinia pestis
ucaacauuccauacc

SEQ ID NO: 4156686 - RNA, 15 nt, Yersinia pestis
ucaaccaagacauaa

SEQ ID NO: 4156687 - RNA, 22 nt, Yersinia pestis
ucaaccaauuauccaucccuau

SEQ ID NO: 4156688 - RNA, 20 nt, Yersinia pestis
ucaaccacgaagagcgccuc

SEQ ID NO: 4156689 - RNA, 20 nt, Yersinia pestis
ucaaccacgguuuaaucaau

SEQ ID NO: 4156690 - RNA, 14 nt, Yersinia pestis
ucaaccaguugaug

SEQ ID NO: 4156691 - RNA, 21 nt, Yersinia pestis
ucaacccgcagacugaaauaa

SEQ ID NO: 4156692 - RNA, 13 nt, Yersinia pestis
ucaaccucagccu

SEQ ID NO: 4156693 - RNA, 14 nt, Yersinia pestis
ucaaccucagccuc

SEQ ID NO: 4156694 - RNA, 15 nt, Yersinia pestis
ucaaccucagccuca

SEQ ID NO: 4156695 - RNA, 20 nt, Yersinia pestis
ucaaccucagccucauucau

SEQ ID NO: 4156696 - RNA, 11 nt, Yersinia pestis
ucaaccugaau

SEQ ID NO: 4156697 - RNA, 17 nt, Yersinia pestis
ucaaccugaucaucaaa

SEQ ID NO: 4156698 - RNA, 22 nt, Yersinia pestis
ucaaccugccagccugaucguu

SEQ ID NO: 4156699 - RNA, 23 nt, Yersinia pestis
ucaaccuggcaccggacaaacca

SEQ ID NO: 4156700 - RNA, 17 nt, Yersinia pestis
ucaacgacaacaucaau

SEQ ID NO: 4156701 - RNA, 14 nt, Yersinia pestis
ucaacgacggauga

SEQ ID NO: 4156702 - RNA, 18 nt, Yersinia pestis
ucaacgcaccauccagca

SEQ ID NO: 4156703 - RNA, 19 nt, Yersinia pestis
ucaacgcaccauccagcaa

SEQ ID NO: 4156704 - RNA, 16 nt, Yersinia pestis
ucacacuggugcugcc

SEQ ID NO: 4156705 - RNA, 23 nt, Yersinia pestis
ucacacuggugcugcccaaaauc

SEQ ID NO: 4156706 - RNA, 17 nt, Yersinia pestis
ucacagaggaaucaaag

SEQ ID NO: 4156707 - RNA, 13 nt, Yersinia pestis
ucacagauaaaca

SEQ ID NO: 4156708 - RNA, 18 nt, Yersinia pestis
ucacagauaaacaaggca

SEQ ID NO: 4156709 - RNA, 16 nt, Yersinia pestis
ucacagcaauugagua

SEQ ID NO: 4156710 - RNA, 19 nt, Yersinia pestis
ucacagccacguaauacca

SEQ ID NO: 4156711 - RNA, 20 nt, Yersinia pestis
ucacagccacguaauaccac

SEQ ID NO: 4156712 - RNA, 19 nt, Yersinia pestis
ucacagcggcggauaaauu

SEQ ID NO: 4156713 - RNA, 20 nt, Yersinia pestis
ucacagcggcggauaaauuc

SEQ ID NO: 4156714 - RNA, 14 nt, Yersinia pestis
ucacaggggcaauu

SEQ ID NO: 4156715 - RNA, 14 nt, Yersinia pestis
ucacaguuaaaaau

SEQ ID NO: 4156716 - RNA, 20 nt, Yersinia pestis
ucacauccaauggcaaugga

SEQ ID NO: 4156717 - RNA, 18 nt, Yersinia pestis
ucacauccgaucagccag

SEQ ID NO: 4156718 - RNA, 17 nt, Yersinia pestis
ucacaucggucaauacc

SEQ ID NO: 4156719 - RNA, 22 nt, Yersinia pestis
ucacaucucggcguaaacaauc

SEQ ID NO: 4156720 - RNA, 19 nt, Yersinia pestis
ucacaugcucaguuguauu

SEQ ID NO: 4156721 - RNA, 20 nt, Yersinia pestis
ucacauuaacuucagguuca

SEQ ID NO: 4156722 - RNA, 22 nt, Yersinia pestis
ucacauucagucaaucgcucuu

SEQ ID NO: 4156723 - RNA, 21 nt, Yersinia pestis
ucacauuugaaaugcauuggu

SEQ ID NO: 4156724 - RNA, 18 nt, Yersinia pestis
ucacauuuuuaauaaugu

SEQ ID NO: 4156725 - RNA, 23 nt, Yersinia pestis
ucaccaaaaaaaccaccaaaaua

SEQ ID NO: 4156726 - RNA, 14 nt, Yersinia pestis
ucaccaaaauccca

SEQ ID NO: 4156727 - RNA, 15 nt, Yersinia pestis
ucaccaaaggaagcc

SEQ ID NO: 4156728 - RNA, 15 nt, Yersinia pestis
ucaccaacaccacca

SEQ ID NO: 4156729 - RNA, 20 nt, Yersinia pestis
ucaccaacaccaccaucacu

SEQ ID NO: 4156730 - RNA, 18 nt, Yersinia pestis
ucaccaagaggaaaugcc

SEQ ID NO: 4156731 - RNA, 19 nt, Yersinia pestis
ucaccaagaggaaaugccg

SEQ ID NO: 4156732 - RNA, 17 nt, Yersinia pestis
ucaccaagauaccgagu

SEQ ID NO: 4156733 - RNA, 15 nt, Yersinia pestis
ucaccaagcuuuuau

SEQ ID NO: 4156734 - RNA, 16 nt, Yersinia pestis
ucaccaagcuuuuauc

SEQ ID NO: 4156735 - RNA, 14 nt, Yersinia pestis
ucaccaaucggauc

SEQ ID NO: 4156736 - RNA, 22 nt, Yersinia pestis
ucaccacaaaggucagcauggu

SEQ ID NO: 4156737 - RNA, 15 nt, Yersinia pestis
ucaccacacauacca

SEQ ID NO: 4156738 - RNA, 12 nt, Yersinia pestis
ucaccaccacca

SEQ ID NO: 4156739 - RNA, 12 nt, Yersinia pestis
ucaccaccauua

SEQ ID NO: 4156740 - RNA, 18 nt, Yersinia pestis
ucaccaccgcauuuucaa

SEQ ID NO: 4156741 - RNA, 21 nt, Yersinia pestis
ucaccacgauuagccauaaga

SEQ ID NO: 4156742 - RNA, 16 nt, Yersinia pestis
ucaccagaucuggguu

SEQ ID NO: 4156743 - RNA, 16 nt, Yersinia pestis
ucaccagaugccgcac

SEQ ID NO: 4156744 - RNA, 15 nt, Yersinia pestis
ucaccagauggcgau

SEQ ID NO: 4156745 - RNA, 15 nt, Yersinia pestis
ucaccagcaaaggcc

SEQ ID NO: 4156746 - RNA, 20 nt, Yersinia pestis
ucaccaggccacuugggcug

SEQ ID NO: 4156747 - RNA, 15 nt, Yersinia pestis
ucaccagguccgccc

SEQ ID NO: 4156748 - RNA, 18 nt, Yersinia pestis
ucaccagguuucgguacu

SEQ ID NO: 4156749 - RNA, 18 nt, Yersinia pestis
ucaccaguagcccagccg

SEQ ID NO: 4156750 - RNA, 19 nt, Yersinia pestis
ucaccaguagcccagccgg

SEQ ID NO: 4156751 - RNA, 22 nt, Yersinia pestis
ucaccaguggucaucaccguuu

SEQ ID NO: 4156752 - RNA, 13 nt, Yersinia pestis
ucaccauaaauuc

SEQ ID NO: 4156753 - RNA, 16 nt, Yersinia pestis
ucaccauaacugcugc

SEQ ID NO: 4156754 - RNA, 17 nt, Yersinia pestis
ucaccauaacugcugcu

SEQ ID NO: 4156755 - RNA, 21 nt, Yersinia pestis
ucaccauccggguuuauccca

SEQ ID NO: 4156756 - RNA, 20 nt, Yersinia pestis
ucaccaucgccuuuagcuuu

SEQ ID NO: 4156757 - RNA, 18 nt, Yersinia pestis
ucaccaucggcaauaaua

SEQ ID NO: 4156758 - RNA, 15 nt, Yersinia pestis
ucaccauuauguuca

SEQ ID NO: 4156759 - RNA, 14 nt, Yersinia pestis
ucaccauugaccag

SEQ ID NO: 4156760 - RNA, 14 nt, Yersinia pestis
ucaccauuuauugc

SEQ ID NO: 4156761 - RNA, 20 nt, Yersinia pestis
ucacccacacgacaugugua

SEQ ID NO: 4156762 - RNA, 12 nt, Yersinia pestis
ucacccagcaaa

SEQ ID NO: 4156763 - RNA, 20 nt, Yersinia pestis
ucacccagcaaaauagcaca

SEQ ID NO: 4156764 - RNA, 16 nt, Yersinia pestis
ucacccauaccaacca

SEQ ID NO: 4156765 - RNA, 15 nt, Yersinia pestis
ucacccauuuuaucc

SEQ ID NO: 4156766 - RNA, 18 nt, Yersinia pestis
ucaccccaacgcuggcug

SEQ ID NO: 4156767 - RNA, 12 nt, Yersinia pestis
ucaccccagcaa

SEQ ID NO: 4156768 - RNA, 15 nt, Yersinia pestis
ucacccccacaucag

SEQ ID NO: 4156769 - RNA, 18 nt, Yersinia pestis
ucacccgcacguagcaca

SEQ ID NO: 4156770 - RNA, 15 nt, Yersinia pestis
ucacccucugcagcu

SEQ ID NO: 4156771 - RNA, 12 nt, Yersinia pestis
ucacccucugcg

SEQ ID NO: 4156772 - RNA, 12 nt, Yersinia pestis
ucacccucuuuc

SEQ ID NO: 4156773 - RNA, 21 nt, Yersinia pestis
ucacccuuuaaaucuagcccu

SEQ ID NO: 4156774 - RNA, 14 nt, Yersinia pestis
ucaccgagaucacc

SEQ ID NO: 4156775 - RNA, 14 nt, Yersinia pestis
ucaccgcaaccugu

SEQ ID NO: 4156776 - RNA, 21 nt, Yersinia pestis
ucaccgccggauuucaauccg

SEQ ID NO: 4156777 - RNA, 21 nt, Yersinia pestis
ucaccgcuguaggugucacca

SEQ ID NO: 4156778 - RNA, 16 nt, Yersinia pestis
ucaccgcuuuucuggu

SEQ ID NO: 4156779 - RNA, 19 nt, Yersinia pestis
ucaccggcaaucgcuucca

SEQ ID NO: 4156780 - RNA, 13 nt, Yersinia pestis
ucaccguagaacg

SEQ ID NO: 4156781 - RNA, 16 nt, Yersinia pestis
ucaccguauacgcuga

SEQ ID NO: 4156782 - RNA, 20 nt, Yersinia pestis
ucaccguauacgcugaauga

SEQ ID NO: 4156783 - RNA, 16 nt, Yersinia pestis
ucaccguuacucaggg

SEQ ID NO: 4156784 - RNA, 16 nt, Yersinia pestis
ucaccuaaaucaauaa

SEQ ID NO: 4156785 - RNA, 14 nt, Yersinia pestis
ucaccuaaaucaua

SEQ ID NO: 4156786 - RNA, 17 nt, Yersinia pestis
ucaccuaaauuucgucc

SEQ ID NO: 4156787 - RNA, 13 nt, Yersinia pestis
ucaccuaccaccu

SEQ ID NO: 4156788 - RNA, 14 nt, Yersinia pestis
ucaccuaccaccua

SEQ ID NO: 4156789 - RNA, 15 nt, Yersinia pestis
ucaccuagauaauca

SEQ ID NO: 4156790 - RNA, 15 nt, Yersinia pestis
ucaccucaaccugcc

SEQ ID NO: 4156791 - RNA, 23 nt, Yersinia pestis
ucaccucuugcauacucaggccc

SEQ ID NO: 4156792 - RNA, 23 nt, Yersinia pestis
ucaccugcgggauagcauaaaua

SEQ ID NO: 4156793 - RNA, 17 nt, Yersinia pestis
ucaccugucaccuacca

SEQ ID NO: 4156794 - RNA, 18 nt, Yersinia pestis
ucaccugucaccuaccac

SEQ ID NO: 4156795 - RNA, 17 nt, Yersinia pestis
ucaccugucaccuguca

SEQ ID NO: 4156796 - RNA, 17 nt, Yersinia pestis
ucaccuuccaaacuuug

SEQ ID NO: 4156797 - RNA, 22 nt, Yersinia pestis
ucaccuuccgucccaagaaaag

SEQ ID NO: 4156798 - RNA, 17 nt, Yersinia pestis
ucaccuuggauggcgaa

SEQ ID NO: 4156799 - RNA, 14 nt, Yersinia pestis
ucaccuuugaucau

SEQ ID NO: 4156800 - RNA, 15 nt, Yersinia pestis
ucacgaauagcggua

SEQ ID NO: 4156801 - RNA, 20 nt, Yersinia pestis
ucacgacaagucaugguaca

SEQ ID NO: 4156802 - RNA, 14 nt, Yersinia pestis
ucacgacgcgaugc

SEQ ID NO: 4156803 - RNA, 20 nt, Yersinia pestis
ucacgagcuaacgcgucaau

SEQ ID NO: 4156804 - RNA, 17 nt, Yersinia pestis
ucacgauacgacuucuu

SEQ ID NO: 4156805 - RNA, 23 nt, Yersinia pestis
ucacgcacucgaaucacuuauug

SEQ ID NO: 4156806 - RNA, 18 nt, Yersinia pestis
ucacgccaugccgguuga

SEQ ID NO: 4156807 - RNA, 12 nt, Yersinia pestis
ucacgccuaucu

SEQ ID NO: 4156808 - RNA, 15 nt, Yersinia pestis
ucacgcuaccggaac

SEQ ID NO: 4156809 - RNA, 17 nt, Yersinia pestis
ucacgcucuugcucuuc

SEQ ID NO: 4156810 - RNA, 17 nt, Yersinia pestis
ucacgggcuuccaucag

SEQ ID NO: 4156811 - RNA, 20 nt, Yersinia pestis
ucacgggcuuccaucaggaa

SEQ ID NO: 4156812 - RNA, 17 nt, Yersinia pestis
ucacgguaguaauaauu

SEQ ID NO: 4156813 - RNA, 18 nt, Yersinia pestis
ucacgguaguaauaauuu

SEQ ID NO: 4156814 - RNA, 20 nt, Yersinia pestis
ucacguaaacaaugaccauc

SEQ ID NO: 4156815 - RNA, 20 nt, Yersinia pestis
ucacgucgauaguccuucgu

SEQ ID NO: 4156816 - RNA, 22 nt, Yersinia pestis
ucacgucuucaccaaugauuaa

SEQ ID NO: 4156817 - RNA, 16 nt, Yersinia pestis
ucacguuuaccggcaa

SEQ ID NO: 4156818 - RNA, 17 nt, Yersinia pestis
ucacguuuaccggcaac

SEQ ID NO: 4156819 - RNA, 16 nt, Yersinia pestis
ucacguuuagcccacu

SEQ ID NO: 4156820 - RNA, 21 nt, Yersinia pestis
ucacuaaauccaaaugcccau

SEQ ID NO: 4156821 - RNA, 18 nt, Yersinia pestis
ucacuagcgggccuuuua

SEQ ID NO: 4156822 - RNA, 21 nt, Yersinia pestis
ucacuagcgggccuuuuaccu

SEQ ID NO: 4156823 - RNA, 13 nt, Yersinia pestis
ucacuauaauuau

SEQ ID NO: 4156824 - RNA, 20 nt, Yersinia pestis
ucacuauaauuauuucucug

SEQ ID NO: 4156825 - RNA, 13 nt, Yersinia pestis
ucacuauucccau

SEQ ID NO: 4156826 - RNA, 21 nt, Yersinia pestis
ucagcuugcaacaaaauggcc

SEQ ID NO: 4156827 - RNA, 18 nt, Yersinia pestis
ucaggaaaugcagacucu

SEQ ID NO: 4156828 - RNA, 15 nt, Yersinia pestis
ucaggaucaccagca

SEQ ID NO: 4156829 - RNA, 17 nt, Yersinia pestis
ucaggaucaccagcaaa

SEQ ID NO: 4156830 - RNA, 11 nt, Yersinia pestis
ucaggaugaac

SEQ ID NO: 4156831 - RNA, 14 nt, Yersinia pestis
ucaggccaccaauc

SEQ ID NO: 4156832 - RNA, 13 nt, Yersinia pestis
ucaggcccugaga

SEQ ID NO: 4156833 - RNA, 20 nt, Yersinia pestis
ucaggccgguauucagccaa

SEQ ID NO: 4156834 - RNA, 15 nt, Yersinia pestis
ucaggcucaucaccu

SEQ ID NO: 4156835 - RNA, 19 nt, Yersinia pestis
ucaggcucaucaccuucca

SEQ ID NO: 4156836 - RNA, 21 nt, Yersinia pestis
ucaggcucaucaccuuccaaa

SEQ ID NO: 4156837 - RNA, 18 nt, Yersinia pestis
ucagggaauucaccggca

SEQ ID NO: 4156838 - RNA, 19 nt, Yersinia pestis
ucagggaugaagcucauua

SEQ ID NO: 4156839 - RNA, 19 nt, Yersinia pestis
ucagggcauaagcgcccug

SEQ ID NO: 4156840 - RNA, 18 nt, Yersinia pestis
ucagggccagcauaguaa

SEQ ID NO: 4156841 - RNA, 21 nt, Yersinia pestis
ucagggcguauaaacagagcc

SEQ ID NO: 4156842 - RNA, 18 nt, Yersinia pestis
ucagggcgucucuacgac

SEQ ID NO: 4156843 - RNA, 19 nt, Yersinia pestis
ucagggcgucucuacgacg

SEQ ID NO: 4156844 - RNA, 14 nt, Yersinia pestis
ucagggugaaagcc

SEQ ID NO: 4156845 - RNA, 14 nt, Yersinia pestis
ucagguaauuuaua

SEQ ID NO: 4156846 - RNA, 11 nt, Yersinia pestis
ucaggucgcaa

SEQ ID NO: 4156847 - RNA, 21 nt, Yersinia pestis
ucaggugaacgcacaaguaca

SEQ ID NO: 4156848 - RNA, 20 nt, Yersinia pestis
ucagguguuacacaguuauu

SEQ ID NO: 4156849 - RNA, 18 nt, Yersinia pestis
ucagguugaaauaaauaa

SEQ ID NO: 4156850 - RNA, 19 nt, Yersinia pestis
ucagguugaaauaaauaag

SEQ ID NO: 4156851 - RNA, 22 nt, Yersinia pestis
ucagguugaaauaaauaaguuc

SEQ ID NO: 4156852 - RNA, 15 nt, Yersinia pestis
ucagguuguuccgcu

SEQ ID NO: 4156853 - RNA, 18 nt, Yersinia pestis
ucaguaaacgcuaaacca

SEQ ID NO: 4156854 - RNA, 17 nt, Yersinia pestis
ucaguaaagcgcaggaa

SEQ ID NO: 4156855 - RNA, 22 nt, Yersinia pestis
ucaguaaagcgcaggaaagcau

SEQ ID NO: 4156856 - RNA, 20 nt, Yersinia pestis
ucaguaacuucucucccgcc

SEQ ID NO: 4156857 - RNA, 13 nt, Yersinia pestis
ucaguaauucacc

SEQ ID NO: 4156858 - RNA, 23 nt, Yersinia pestis
ucaguacagcgcaucggaucaau

SEQ ID NO: 4156859 - RNA, 14 nt, Yersinia pestis
ucaguaccaccacc

SEQ ID NO: 4156860 - RNA, 18 nt, Yersinia pestis
ucaguaguggcuccacua

SEQ ID NO: 4156861 - RNA, 14 nt, Yersinia pestis
ucaguaucaccaga

SEQ ID NO: 4156862 - RNA, 17 nt, Yersinia pestis
ucagucagggugaaagc

SEQ ID NO: 4156863 - RNA, 20 nt, Yersinia pestis
ucagucgccuuaaaugcgua

SEQ ID NO: 4156864 - RNA, 18 nt, Yersinia pestis
ucagucgcgauaaaauuc

SEQ ID NO: 4156865 - RNA, 15 nt, Yersinia pestis
ucagugaagagauaa

SEQ ID NO: 4156866 - RNA, 18 nt, Yersinia pestis
ucagugauaacaacccua

SEQ ID NO: 4156867 - RNA, 22 nt, Yersinia pestis
ucagugauucgggugagugagc

SEQ ID NO: 4156868 - RNA, 18 nt, Yersinia pestis
ucagugauuuuaaccacu

SEQ ID NO: 4156869 - RNA, 22 nt, Yersinia pestis
ucagugcacggcagugaucaau

SEQ ID NO: 4156870 - RNA, 13 nt, Yersinia pestis
ucagugcuauuca

SEQ ID NO: 4156871 - RNA, 15 nt, Yersinia pestis
ucagugcuauucaua

SEQ ID NO: 4156872 - RNA, 16 nt, Yersinia pestis
ucagugggcuauuuau

SEQ ID NO: 4156873 - RNA, 19 nt, Yersinia pestis
ucagugguuuuauaaauaa

SEQ ID NO: 4156874 - RNA, 20 nt, Yersinia pestis
ucagugucaguucgacaccu

SEQ ID NO: 4156875 - RNA, 21 nt, Yersinia pestis
ucagugucaguucgacaccuu

SEQ ID NO: 4156876 - RNA, 20 nt, Yersinia pestis
ucaguguguuauuuuucucu

SEQ ID NO: 4156877 - RNA, 15 nt, Yersinia pestis
ucaguuaaucaagcc

SEQ ID NO: 4156878 - RNA, 16 nt, Yersinia pestis
ucaguuaaucaagcca

SEQ ID NO: 4156879 - RNA, 13 nt, Yersinia pestis
ucaguucaguauu

SEQ ID NO: 4156880 - RNA, 12 nt, Yersinia pestis
ucaguucgcguu

SEQ ID NO: 4156881 - RNA, 20 nt, Yersinia pestis
ucaguucgguugccaaaauu

SEQ ID NO: 4156882 - RNA, 13 nt, Yersinia pestis
ucaguugaaaccc

SEQ ID NO: 4156883 - RNA, 18 nt, Yersinia pestis
ucaguugugggucgccuu

SEQ ID NO: 4156884 - RNA, 15 nt, Yersinia pestis
ucaguuuacaugauu

SEQ ID NO: 4156885 - RNA, 14 nt, Yersinia pestis
ucaguuuagcgaga

SEQ ID NO: 4156886 - RNA, 13 nt, Yersinia pestis
ucaguuuuaauuu

SEQ ID NO: 4156887 - RNA, 20 nt, Yersinia pestis
ucaguuuuaauuuaugaaca

SEQ ID NO: 4156888 - RNA, 16 nt, Yersinia pestis
ucauaaauaaaagaua

SEQ ID NO: 4156889 - RNA, 15 nt, Yersinia pestis
ucauaaauaaagaua

SEQ ID NO: 4156890 - RNA, 12 nt, Yersinia pestis
ucauaaauauug

SEQ ID NO: 4156891 - RNA, 16 nt, Yersinia pestis
ucauaaaucacaauuu

SEQ ID NO: 4156892 - RNA, 18 nt, Yersinia pestis
ucauaaauuaaaacugaa

SEQ ID NO: 4156893 - RNA, 21 nt, Yersinia pestis
ucauaagccagugcuauucau

SEQ ID NO: 4156894 - RNA, 22 nt, Yersinia pestis
ucauaagucagugcuauucaua

SEQ ID NO: 4156895 - RNA, 21 nt, Yersinia pestis
ucauaauucagcaaacucagc

SEQ ID NO: 4156896 - RNA, 23 nt, Yersinia pestis
ucauacacuaagugcaucaaucg

SEQ ID NO: 4156897 - RNA, 21 nt, Yersinia pestis
ucauacccaaauuacggcuca

SEQ ID NO: 4156898 - RNA, 22 nt, Yersinia pestis
ucauaccggcggcacacuggau

SEQ ID NO: 4156899 - RNA, 16 nt, Yersinia pestis
ucauacucccccauuu

SEQ ID NO: 4156900 - RNA, 21 nt, Yersinia pestis
ucauacucccccauuuccugu

SEQ ID NO: 4156901 - RNA, 22 nt, Yersinia pestis
ucauacugacggggaguuuuua

SEQ ID NO: 4156902 - RNA, 23 nt, Yersinia pestis
ucauagaaggcggagaauguuaa

SEQ ID NO: 4156903 - RNA, 18 nt, Yersinia pestis
ucauagcgaauaauggca

SEQ ID NO: 4156904 - RNA, 17 nt, Yersinia pestis
ucauaguuaagacaauu

SEQ ID NO: 4156905 - RNA, 20 nt, Yersinia pestis
ucauaucccagcgucuucug

SEQ ID NO: 4156906 - RNA, 22 nt, Yersinia pestis
ucauaucccccccaagagaaac

SEQ ID NO: 4156907 - RNA, 20 nt, Yersinia pestis
ucauauccuaucuuuaccca

SEQ ID NO: 4156908 - RNA, 17 nt, Yersinia pestis
ucauaucgaugacagca

SEQ ID NO: 4156909 - RNA, 19 nt, Yersinia pestis
ucauaucgcuaaaacacag

SEQ ID NO: 4156910 - RNA, 18 nt, Yersinia pestis
ucauaugacaaauaaggc

SEQ ID NO: 4156911 - RNA, 19 nt, Yersinia pestis
ucauaugcgccuauaaggc

SEQ ID NO: 4156912 - RNA, 19 nt, Yersinia pestis
ucauaugcgcgucaaucca

SEQ ID NO: 4156913 - RNA, 22 nt, Yersinia pestis
ucauauguucgaucaaaacaau

SEQ ID NO: 4156914 - RNA, 13 nt, Yersinia pestis
ucauauugaauaa

SEQ ID NO: 4156915 - RNA, 22 nt, Yersinia pestis
ucaucaaaacugaugguuuccu

SEQ ID NO: 4156916 - RNA, 15 nt, Yersinia pestis
ucaucaaacuauuca

SEQ ID NO: 4156917 - RNA, 17 nt, Yersinia pestis
ucaucaaaggcaauacc

SEQ ID NO: 4156918 - RNA, 19 nt, Yersinia pestis
ucaucaaaggcaauaccgg

SEQ ID NO: 4156919 - RNA, 18 nt, Yersinia pestis
ucaucaaccucagccuca

SEQ ID NO: 4156920 - RNA, 15 nt, Yersinia pestis
ucaucaacgcgccuu

SEQ ID NO: 4156921 - RNA, 16 nt, Yersinia pestis
ucaucaacuucugcaa

SEQ ID NO: 4156922 - RNA, 23 nt, Yersinia pestis
ucaucaagauggucauaaauagg

SEQ ID NO: 4156923 - RNA, 16 nt, Yersinia pestis
ucaucaagccaauggc

SEQ ID NO: 4156924 - RNA, 11 nt, Yersinia pestis
ucaucaauacc

SEQ ID NO: 4156925 - RNA, 20 nt, Yersinia pestis
ucaucaauggauucuugcug

SEQ ID NO: 4156926 - RNA, 22 nt, Yersinia pestis
ucaucaauggauucuugcugca

SEQ ID NO: 4156927 - RNA, 17 nt, Yersinia pestis
ucaucaccauucaagau

SEQ ID NO: 4156928 - RNA, 23 nt, Yersinia pestis
ucaucacccaacguggcuucaau

SEQ ID NO: 4156929 - RNA, 18 nt, Yersinia pestis
ucaucacccagcaaaaua

SEQ ID NO: 4156930 - RNA, 15 nt, Yersinia pestis
ucaucacugaaagug

SEQ ID NO: 4156931 - RNA, 21 nt, Yersinia pestis
ucaucacugccgucaaugccu

SEQ ID NO: 4156932 - RNA, 12 nt, Yersinia pestis
ucaucagcagag

SEQ ID NO: 4156933 - RNA, 13 nt, Yersinia pestis
ucaucagcagaga

SEQ ID NO: 4156934 - RNA, 19 nt, Yersinia pestis
ucaucaggcggguaacugu

SEQ ID NO: 4156935 - RNA, 22 nt, Yersinia pestis
ucaucagggaauucaccggcaa

SEQ ID NO: 4156936 - RNA, 14 nt, Yersinia pestis
ucaucaucaaugga

SEQ ID NO: 4156937 - RNA, 16 nt, Yersinia pestis
ucaucaucacaaauaa

SEQ ID NO: 4156938 - RNA, 14 nt, Yersinia pestis
ucaucaucgguacc

SEQ ID NO: 4156939 - RNA, 14 nt, Yersinia pestis
ucaucaucuucuuc

SEQ ID NO: 4156940 - RNA, 15 nt, Yersinia pestis
ucaucaucuucuuca

SEQ ID NO: 4156941 - RNA, 19 nt, Yersinia pestis
ucaucaucuuuaauaauag

SEQ ID NO: 4156942 - RNA, 13 nt, Yersinia pestis
ucaucaugacgau

SEQ ID NO: 4156943 - RNA, 18 nt, Yersinia pestis
ucaucauggauaaagccu

SEQ ID NO: 4156944 - RNA, 17 nt, Yersinia pestis
ucaucauuauuguccgc

SEQ ID NO: 4156945 - RNA, 20 nt, Yersinia pestis
ucaucauuauuguccgcgcg

SEQ ID NO: 4156946 - RNA, 22 nt, Yersinia pestis
ucaucauucauuuuaaaaaaau

SEQ ID NO: 4156947 - RNA, 23 nt, Yersinia pestis
uccaacaguagcuugaucggaua

SEQ ID NO: 4156948 - RNA, 18 nt, Yersinia pestis
uccaacauguugaaaucu

SEQ ID NO: 4156949 - RNA, 23 nt, Yersinia pestis
uccaacccgcacguucagcagcg

SEQ ID NO: 4156950 - RNA, 17 nt, Yersinia pestis
uccaacgcacugguugc

SEQ ID NO: 4156951 - RNA, 16 nt, Yersinia pestis
uccaacguaaacauug

SEQ ID NO: 4156952 - RNA, 21 nt, Yersinia pestis
uccaacuaaacagggcagaaa

SEQ ID NO: 4156953 - RNA, 23 nt, Yersinia pestis
uccaacuaaacagggcagaaaau

SEQ ID NO: 4156954 - RNA, 16 nt, Yersinia pestis
uccaacucaccauuua

SEQ ID NO: 4156955 - RNA, 15 nt, Yersinia pestis
uccaacucaccuaaa

SEQ ID NO: 4156956 - RNA, 13 nt, Yersinia pestis
uccaacucaccuu

SEQ ID NO: 4156957 - RNA, 18 nt, Yersinia pestis
uccaacucauuacucagc

SEQ ID NO: 4156958 - RNA, 22 nt, Yersinia pestis
uccaacuucgcacgcccaucaa

SEQ ID NO: 4156959 - RNA, 14 nt, Yersinia pestis
uccaacuucuucca

SEQ ID NO: 4156960 - RNA, 15 nt, Yersinia pestis
uccaacuuuucauug

SEQ ID NO: 4156961 - RNA, 12 nt, Yersinia pestis
uccaagaugaua

SEQ ID NO: 4156962 - RNA, 18 nt, Yersinia pestis
uccaagcacacugguuga

SEQ ID NO: 4156963 - RNA, 12 nt, Yersinia pestis
uccaauaacuaa

SEQ ID NO: 4156964 - RNA, 14 nt, Yersinia pestis
uccaauaacuaaca

SEQ ID NO: 4156965 - RNA, 19 nt, Yersinia pestis
uccaauaagucacuuuccu

SEQ ID NO: 4156966 - RNA, 19 nt, Yersinia pestis
uccaauaggauaagggcca

SEQ ID NO: 4156967 - RNA, 23 nt, Yersinia pestis
uccaaucuugguuaauagcauuu

SEQ ID NO: 4156968 - RNA, 16 nt, Yersinia pestis
uccaauucauaauagc

SEQ ID NO: 4156969 - RNA, 17 nt, Yersinia pestis
uccaauucauaauagcg

SEQ ID NO: 4156970 - RNA, 15 nt, Yersinia pestis
uccaauuuaccacua

SEQ ID NO: 4156971 - RNA, 14 nt, Yersinia pestis
uccaauuucucaaa

SEQ ID NO: 4156972 - RNA, 23 nt, Yersinia pestis
uccacaaacucaugcucuucaua

SEQ ID NO: 4156973 - RNA, 20 nt, Yersinia pestis
uccacaaauuuuuaccuucu

SEQ ID NO: 4156974 - RNA, 18 nt, Yersinia pestis
uccacaagcguucgagga

SEQ ID NO: 4156975 - RNA, 15 nt, Yersinia pestis
uccacaaucagcccg

SEQ ID NO: 4156976 - RNA, 11 nt, Yersinia pestis
uccacacaaaa

SEQ ID NO: 4156977 - RNA, 20 nt, Yersinia pestis
uccacacagcauucugcuuc

SEQ ID NO: 4156978 - RNA, 20 nt, Yersinia pestis
uccacacaguauucugcuuc

SEQ ID NO: 4156979 - RNA, 13 nt, Yersinia pestis
uccacacccgcca

SEQ ID NO: 4156980 - RNA, 17 nt, Yersinia pestis
uccacagucaguucauu

SEQ ID NO: 4156981 - RNA, 20 nt, Yersinia pestis
uccacauaaaauagcccagu

SEQ ID NO: 4156982 - RNA, 23 nt, Yersinia pestis
uccacauaaaauagcccagugcg

SEQ ID NO: 4156983 - RNA, 19 nt, Yersinia pestis
uccacauauauagagaaau

SEQ ID NO: 4156984 - RNA, 21 nt, Yersinia pestis
uccacauauauagagaaaucu

SEQ ID NO: 4156985 - RNA, 16 nt, Yersinia pestis
uccaccaaugauuuug

SEQ ID NO: 4156986 - RNA, 19 nt, Yersinia pestis
uccaccacugauaggucau

SEQ ID NO: 4156987 - RNA, 22 nt, Yersinia pestis
uccaccguuuuacucaggauua

SEQ ID NO: 4156988 - RNA, 14 nt, Yersinia pestis
uccacgguauuagu

SEQ ID NO: 4156989 - RNA, 23 nt, Yersinia pestis
uccacguuuguagcaaacccaca

SEQ ID NO: 4156990 - RNA, 12 nt, Yersinia pestis
uccacuaacccc

SEQ ID NO: 4156991 - RNA, 18 nt, Yersinia pestis
uccacuacucaguugcag

SEQ ID NO: 4156992 - RNA, 15 nt, Yersinia pestis
uccacuagguccaua

SEQ ID NO: 4156993 - RNA, 14 nt, Yersinia pestis
uccacucucugcuu

SEQ ID NO: 4156994 - RNA, 23 nt, Yersinia pestis
uccacucucugcuuacucuucca

SEQ ID NO: 4156995 - RNA, 20 nt, Yersinia pestis
uccacucuuugaguagcagg

SEQ ID NO: 4156996 - RNA, 21 nt, Yersinia pestis
uccacuuuucagauagcccau

SEQ ID NO: 4156997 - RNA, 14 nt, Yersinia pestis
uccagaacaauacc

SEQ ID NO: 4156998 - RNA, 19 nt, Yersinia pestis
uccagaauagagaaaucaa

SEQ ID NO: 4156999 - RNA, 16 nt, Yersinia pestis
uccagaauauaaaagc

SEQ ID NO: 4157000 - RNA, 17 nt, Yersinia pestis
uccagaauaucuucaac

SEQ ID NO: 4157001 - RNA, 15 nt, Yersinia pestis
uccagacaaagugag

SEQ ID NO: 4157002 - RNA, 20 nt, Yersinia pestis
uccagauaacauacaccauc

SEQ ID NO: 4157003 - RNA, 15 nt, Yersinia pestis
uccagaucggcaaau

SEQ ID NO: 4157004 - RNA, 14 nt, Yersinia pestis
uccagaugccaaau

SEQ ID NO: 4157005 - RNA, 15 nt, Yersinia pestis
uccagcaaaagccuc

SEQ ID NO: 4157006 - RNA, 16 nt, Yersinia pestis
uccagcaaaagccucu

SEQ ID NO: 4157007 - RNA, 22 nt, Yersinia pestis
uccagcaaauuagacacgccgg

SEQ ID NO: 4157008 - RNA, 20 nt, Yersinia pestis
uccagcaacucaagccacuc

SEQ ID NO: 4157009 - RNA, 21 nt, Yersinia pestis
uccagcaccacaauggcagag

SEQ ID NO: 4157010 - RNA, 18 nt, Yersinia pestis
uccagccccaaacacuua

SEQ ID NO: 4157011 - RNA, 19 nt, Yersinia pestis
uccagcgccuguuccaacg

SEQ ID NO: 4157012 - RNA, 17 nt, Yersinia pestis
uccagcggcguaucaaa

SEQ ID NO: 4157013 - RNA, 23 nt, Yersinia pestis
uccagcgguguuaccagacccug

SEQ ID NO: 4157014 - RNA, 13 nt, Yersinia pestis
uccagcguaaaca

SEQ ID NO: 4157015 - RNA, 20 nt, Yersinia pestis
uccagcguaaacaguagcag

SEQ ID NO: 4157016 - RNA, 17 nt, Yersinia pestis
uccagcucauauaauca

SEQ ID NO: 4157017 - RNA, 18 nt, Yersinia pestis
uccaggacauccagcggu

SEQ ID NO: 4157018 - RNA, 22 nt, Yersinia pestis
uccaggauauucacguuuuucc

SEQ ID NO: 4157019 - RNA, 20 nt, Yersinia pestis
uccaggcaagaaacuucauu

SEQ ID NO: 4157020 - RNA, 16 nt, Yersinia pestis
uccaggcuaccaaggc

SEQ ID NO: 4157021 - RNA, 21 nt, Yersinia pestis
uccaggcuaugcuuaauuugg

SEQ ID NO: 4157022 - RNA, 16 nt, Yersinia pestis
uccaggguaauaagug

SEQ ID NO: 4157023 - RNA, 16 nt, Yersinia pestis
uccaggucaaucaauu

SEQ ID NO: 4157024 - RNA, 13 nt, Yersinia pestis
uccaguaaaaaaa

SEQ ID NO: 4157025 - RNA, 14 nt, Yersinia pestis
uccaguaaaaaaau

SEQ ID NO: 4157026 - RNA, 18 nt, Yersinia pestis
uccaguaaaagaauaaau

SEQ ID NO: 4157027 - RNA, 22 nt, Yersinia pestis
uccaguaaaagaauaaauguca

SEQ ID NO: 4157028 - RNA, 13 nt, Yersinia pestis
uccaguaacggcc

SEQ ID NO: 4157029 - RNA, 14 nt, Yersinia pestis
uccaguaacggccu

SEQ ID NO: 4157030 - RNA, 16 nt, Yersinia pestis
uccaguaacggccuuc

SEQ ID NO: 4157031 - RNA, 12 nt, Yersinia pestis
uccaguaagcug

SEQ ID NO: 4157032 - RNA, 13 nt, Yersinia pestis
uccaguaauaccu

SEQ ID NO: 4157033 - RNA, 15 nt, Yersinia pestis
uccagucccccucac

SEQ ID NO: 4157034 - RNA, 18 nt, Yersinia pestis
uccagugcgcgauaaacg

SEQ ID NO: 4157035 - RNA, 16 nt, Yersinia pestis
uccaguucaacaccaa

SEQ ID NO: 4157036 - RNA, 22 nt, Yersinia pestis
uccauaaaaucgaacccuucag

SEQ ID NO: 4157037 - RNA, 17 nt, Yersinia pestis
uccauacgaauuuuucc

SEQ ID NO: 4157038 - RNA, 18 nt, Yersinia pestis
uccauagauacacuccau

SEQ ID NO: 4157039 - RNA, 22 nt, Yersinia pestis
uccauagugauuauuuaaacaa

SEQ ID NO: 4157040 - RNA, 15 nt, Yersinia pestis
uccauauagccccaa

SEQ ID NO: 4157041 - RNA, 12 nt, Yersinia pestis
uccauauuuaau

SEQ ID NO: 4157042 - RNA, 19 nt, Yersinia pestis
uccauauuuuagcggccuc

SEQ ID NO: 4157043 - RNA, 15 nt, Yersinia pestis
uccaucaaaggagaa

SEQ ID NO: 4157044 - RNA, 11 nt, Yersinia pestis
uccaucaauag

SEQ ID NO: 4157045 - RNA, 21 nt, Yersinia pestis
uccaucacgcagcuuuuucuc

SEQ ID NO: 4157046 - RNA, 15 nt, Yersinia pestis
uccaucagacauauu

SEQ ID NO: 4157047 - RNA, 13 nt, Yersinia pestis
uccaucccugggu

SEQ ID NO: 4157048 - RNA, 16 nt, Yersinia pestis
uccaugacacauauuu

SEQ ID NO: 4157049 - RNA, 19 nt, Yersinia pestis
uccaugagcgcuauuuauc

SEQ ID NO: 4157050 - RNA, 19 nt, Yersinia pestis
uccaugauauaucagucuu

SEQ ID NO: 4157051 - RNA, 14 nt, Yersinia pestis
uccaugaugcuguc

SEQ ID NO: 4157052 - RNA, 14 nt, Yersinia pestis
uccaugcaaaauau

SEQ ID NO: 4157053 - RNA, 22 nt, Yersinia pestis
uccaugccagcccaucaccauu

SEQ ID NO: 4157054 - RNA, 13 nt, Yersinia pestis
uccaugccauucu

SEQ ID NO: 4157055 - RNA, 23 nt, Yersinia pestis
uccaugcccagcguuggcagaaa

SEQ ID NO: 4157056 - RNA, 13 nt, Yersinia pestis
uccauguaggcuc

SEQ ID NO: 4157057 - RNA, 15 nt, Yersinia pestis
uccauguaggcucga

SEQ ID NO: 4157058 - RNA, 20 nt, Yersinia pestis
uccauguuaggauaggguuu

SEQ ID NO: 4157059 - RNA, 20 nt, Yersinia pestis
uccauuagcguauuaaacca

SEQ ID NO: 4157060 - RNA, 20 nt, Yersinia pestis
uccauuccguuauuaaacag

SEQ ID NO: 4157061 - RNA, 20 nt, Yersinia pestis
uccauuguauugcucagggc

SEQ ID NO: 4157062 - RNA, 17 nt, Yersinia pestis
uccauuucaaucacugc

SEQ ID NO: 4157063 - RNA, 18 nt, Yersinia pestis
uccauuuucaucguauga

SEQ ID NO: 4157064 - RNA, 19 nt, Yersinia pestis
ucccaaaauagccagcccc

SEQ ID NO: 4157065 - RNA, 15 nt, Yersinia pestis
ucccaaacucuggau

SEQ ID NO: 4157066 - RNA, 21 nt, Yersinia pestis
ucccaagaaaagcaccgcagu

SEQ ID NO: 4157067 - RNA, 23 nt, Yersinia pestis
ucccaaggguauaacucaucagu

SEQ ID NO: 4157068 - RNA, 21 nt, Yersinia pestis
ucccaaucaaugcuuuuguac

SEQ ID NO: 4157069 - RNA, 16 nt, Yersinia pestis
uccuauucagcagcau

SEQ ID NO: 4157070 - RNA, 14 nt, Yersinia pestis
uccucaaacccaca

SEQ ID NO: 4157071 - RNA, 14 nt, Yersinia pestis
uccucaagaccgau

SEQ ID NO: 4157072 - RNA, 22 nt, Yersinia pestis
uccucaagaccgauuuguaagc

SEQ ID NO: 4157073 - RNA, 19 nt, Yersinia pestis
uccucaccauuuauugcca

SEQ ID NO: 4157074 - RNA, 11 nt, Yersinia pestis
uccucaccguu

SEQ ID NO: 4157075 - RNA, 12 nt, Yersinia pestis
uccucagccuuu

SEQ ID NO: 4157076 - RNA, 12 nt, Yersinia pestis
uccucaugauuu

SEQ ID NO: 4157077 - RNA, 21 nt, Yersinia pestis
uccuccauauccucaagaccg

SEQ ID NO: 4157078 - RNA, 23 nt, Yersinia pestis
uccuccggcauagccggagguuu

SEQ ID NO: 4157079 - RNA, 19 nt, Yersinia pestis
uccuccuuggggccucacu

SEQ ID NO: 4157080 - RNA, 18 nt, Yersinia pestis
uccucgccguagcauuca

SEQ ID NO: 4157081 - RNA, 16 nt, Yersinia pestis
uccucuacgucaaucu

SEQ ID NO: 4157082 - RNA, 22 nt, Yersinia pestis
uccucuacgucaaucucaccgc

SEQ ID NO: 4157083 - RNA, 20 nt, Yersinia pestis
uccucuccccuaccucaucc

SEQ ID NO: 4157084 - RNA, 13 nt, Yersinia pestis
uccucugccuauc

SEQ ID NO: 4157085 - RNA, 12 nt, Yersinia pestis
uccucuuccaau

SEQ ID NO: 4157086 - RNA, 12 nt, Yersinia pestis
uccucuucuucu

SEQ ID NO: 4157087 - RNA, 17 nt, Yersinia pestis
uccucuuucuuaauaau

SEQ ID NO: 4157088 - RNA, 13 nt, Yersinia pestis
uccugaaauaaag

SEQ ID NO: 4157089 - RNA, 22 nt, Yersinia pestis
uccugaacgaggacuuccugcc

SEQ ID NO: 4157090 - RNA, 20 nt, Yersinia pestis
uccugacgaugauaaaucag

SEQ ID NO: 4157091 - RNA, 12 nt, Yersinia pestis
uccugaucaacu

SEQ ID NO: 4157092 - RNA, 21 nt, Yersinia pestis
uccugaucaacugcuguuggc

SEQ ID NO: 4157093 - RNA, 18 nt, Yersinia pestis
uccugaucuucauugccu

SEQ ID NO: 4157094 - RNA, 19 nt, Yersinia pestis
uccugaucuucauugccuu

SEQ ID NO: 4157095 - RNA, 21 nt, Yersinia pestis
uccugauucgcgaccagcaga

SEQ ID NO: 4157096 - RNA, 14 nt, Yersinia pestis
uccugauuuaaccu

SEQ ID NO: 4157097 - RNA, 16 nt, Yersinia pestis
uccugcaauaacacca

SEQ ID NO: 4157098 - RNA, 16 nt, Yersinia pestis
uccugccgccucugcu

SEQ ID NO: 4157099 - RNA, 15 nt, Yersinia pestis
uccugcgguggccag

SEQ ID NO: 4157100 - RNA, 20 nt, Yersinia pestis
uccugcgguggccagagcau

SEQ ID NO: 4157101 - RNA, 16 nt, Yersinia pestis
uccugcucaaacauga

SEQ ID NO: 4157102 - RNA, 16 nt, Yersinia pestis
uccuggaaccagugaa

SEQ ID NO: 4157103 - RNA, 19 nt, Yersinia pestis
uccuggaacgaagccgcag

SEQ ID NO: 4157104 - RNA, 15 nt, Yersinia pestis
uccuggauauucaua

SEQ ID NO: 4157105 - RNA, 14 nt, Yersinia pestis
uccuggccaaagcc

SEQ ID NO: 4157106 - RNA, 19 nt, Yersinia pestis
uccuggccguguuuuuccc

SEQ ID NO: 4157107 - RNA, 20 nt, Yersinia pestis
uccuggccguguuuuucccu

SEQ ID NO: 4157108 - RNA, 21 nt, Yersinia pestis
uccuggccguguuuuucccua

SEQ ID NO: 4157109 - RNA, 15 nt, Yersinia pestis
uccuggcgauccagu

SEQ ID NO: 4157110 - RNA, 21 nt, Yersinia pestis
uccuggcgguaauaaaucaug

SEQ ID NO: 4157111 - RNA, 15 nt, Yersinia pestis
uccuggcuauuuauu

SEQ ID NO: 4157112 - RNA, 19 nt, Yersinia pestis
uccuguacauauauaauac

SEQ ID NO: 4157113 - RNA, 15 nt, Yersinia pestis
uccugugcaaagugc

SEQ ID NO: 4157114 - RNA, 21 nt, Yersinia pestis
uccuguugcuggccaguuuua

SEQ ID NO: 4157115 - RNA, 16 nt, Yersinia pestis
uccuuacuccaacagu

SEQ ID NO: 4157116 - RNA, 17 nt, Yersinia pestis
uccuucaguucuuuauc

SEQ ID NO: 4157117 - RNA, 18 nt, Yersinia pestis
uccuucucgaugccuucu

SEQ ID NO: 4157118 - RNA, 16 nt, Yersinia pestis
uccuuggaacuuacuc

SEQ ID NO: 4157119 - RNA, 23 nt, Yersinia pestis
uccuuggcgcggacgcuuuacuc

SEQ ID NO: 4157120 - RNA, 17 nt, Yersinia pestis
uccuuuacuccccugcc

SEQ ID NO: 4157121 - RNA, 20 nt, Yersinia pestis
uccuuuacuccccugccuau

SEQ ID NO: 4157122 - RNA, 22 nt, Yersinia pestis
uccuuuacuccccugccuauuc

SEQ ID NO: 4157123 - RNA, 17 nt, Yersinia pestis
uccuuuccauuuucauc

SEQ ID NO: 4157124 - RNA, 20 nt, Yersinia pestis
uccuuucucuccuuauacua

SEQ ID NO: 4157125 - RNA, 18 nt, Yersinia pestis
uccuuucuguuccaugau

SEQ ID NO: 4157126 - RNA, 22 nt, Yersinia pestis
uccuuucuuuucgcuauuucuc

SEQ ID NO: 4157127 - RNA, 19 nt, Yersinia pestis
uccuuugcccuuacuauuu

SEQ ID NO: 4157128 - RNA, 14 nt, Yersinia pestis
uccuuuuauuuaga

SEQ ID NO: 4157129 - RNA, 15 nt, Yersinia pestis
uccuuuugacugguc

SEQ ID NO: 4157130 - RNA, 22 nt, Yersinia pestis
uccuuuuuauuuaagcaguuca

SEQ ID NO: 4157131 - RNA, 15 nt, Yersinia pestis
uccuuuuuucugcaa

SEQ ID NO: 4157132 - RNA, 20 nt, Yersinia pestis
ucgaaaaaaauacuaucauc

SEQ ID NO: 4157133 - RNA, 18 nt, Yersinia pestis
ucgaaaagcgccuuuuau

SEQ ID NO: 4157134 - RNA, 19 nt, Yersinia pestis
ucgaaagauagcaaaagaa

SEQ ID NO: 4157135 - RNA, 17 nt, Yersinia pestis
ucgaacccauucaucaa

SEQ ID NO: 4157136 - RNA, 11 nt, Yersinia pestis
ucgaaccgaua

SEQ ID NO: 4157137 - RNA, 12 nt, Yersinia pestis
ucgaaccugaac

SEQ ID NO: 4157138 - RNA, 15 nt, Yersinia pestis
ucgaacugacgauug

SEQ ID NO: 4157139 - RNA, 21 nt, Yersinia pestis
ucgaagggauaucucaccgcc

SEQ ID NO: 4157140 - RNA, 21 nt, Yersinia pestis
ucgaauaaacggauuugucug

SEQ ID NO: 4157141 - RNA, 17 nt, Yersinia pestis
ucgaaucacuuauugga

SEQ ID NO: 4157142 - RNA, 18 nt, Yersinia pestis
ucgaaucacuuauuggaa

SEQ ID NO: 4157143 - RNA, 19 nt, Yersinia pestis
ucgaauguucugcggaagu

SEQ ID NO: 4157144 - RNA, 23 nt, Yersinia pestis
ucgaauuauuuagagucuauaau

SEQ ID NO: 4157145 - RNA, 17 nt, Yersinia pestis
ucgacaaaaaagcggcu

SEQ ID NO: 4157146 - RNA, 17 nt, Yersinia pestis
ucgacaccaagacugaa

SEQ ID NO: 4157147 - RNA, 22 nt, Yersinia pestis
ucgacaccauguccauguuagg

SEQ ID NO: 4157148 - RNA, 19 nt, Yersinia pestis
ucgacaccuucaaucauug

SEQ ID NO: 4157149 - RNA, 18 nt, Yersinia pestis
ucgacagaaagcugaucg

SEQ ID NO: 4157150 - RNA, 20 nt, Yersinia pestis
ucgacagucacuaauaccug

SEQ ID NO: 4157151 - RNA, 17 nt, Yersinia pestis
ucgacaguguaaaaagc

SEQ ID NO: 4157152 - RNA, 18 nt, Yersinia pestis
ucgacggccaauuucagu

SEQ ID NO: 4157153 - RNA, 16 nt, Yersinia pestis
ucgacuaaggcaaccu

SEQ ID NO: 4157154 - RNA, 14 nt, Yersinia pestis
ucgacuacuggcug

SEQ ID NO: 4157155 - RNA, 14 nt, Yersinia pestis
ucgacucaauaaau

SEQ ID NO: 4157156 - RNA, 15 nt, Yersinia pestis
ucgacucugggccgu

SEQ ID NO: 4157157 - RNA, 19 nt, Yersinia pestis
ucgagaacgggcacagcau

SEQ ID NO: 4157158 - RNA, 16 nt, Yersinia pestis
ucgagaugcugacccu

SEQ ID NO: 4157159 - RNA, 19 nt, Yersinia pestis
ucgagauguauccaaggca

SEQ ID NO: 4157160 - RNA, 16 nt, Yersinia pestis
ucgagcaacuuuuacu

SEQ ID NO: 4157161 - RNA, 14 nt, Yersinia pestis
ucgagcaucaccgg

SEQ ID NO: 4157162 - RNA, 14 nt, Yersinia pestis
ucgaggaucaccac

SEQ ID NO: 4157163 - RNA, 17 nt, Yersinia pestis
ucgaguccguuaaaaaa

SEQ ID NO: 4157164 - RNA, 18 nt, Yersinia pestis
ucgauaaaaggcuauuua

SEQ ID NO: 4157165 - RNA, 20 nt, Yersinia pestis
ucgauaaaaggcuauuuaaa

SEQ ID NO: 4157166 - RNA, 21 nt, Yersinia pestis
ucgauaaaaggcuauuuaaau

SEQ ID NO: 4157167 - RNA, 20 nt, Yersinia pestis
ucgauaaacaucaugacaaa

SEQ ID NO: 4157168 - RNA, 23 nt, Yersinia pestis
ucgauaacgcuaagcgucucaag

SEQ ID NO: 4157169 - RNA, 13 nt, Yersinia pestis
ucgauacaauuuu

SEQ ID NO: 4157170 - RNA, 21 nt, Yersinia pestis
ucgauacccuucaucuuucaa

SEQ ID NO: 4157171 - RNA, 22 nt, Yersinia pestis
ucgauagagaacuccacauuuu

SEQ ID NO: 4157172 - RNA, 15 nt, Yersinia pestis
ucgauaguccuucgu

SEQ ID NO: 4157173 - RNA, 16 nt, Yersinia pestis
ucgauaugagucaguu

SEQ ID NO: 4157174 - RNA, 20 nt, Yersinia pestis
ucgaucaaaacaauaaaaag

SEQ ID NO: 4157175 - RNA, 23 nt, Yersinia pestis
ucgaucaaaacaauaaaaagauc

SEQ ID NO: 4157176 - RNA, 13 nt, Yersinia pestis
ucgaucaaaccag

SEQ ID NO: 4157177 - RNA, 12 nt, Yersinia pestis
ucgaucagauac

SEQ ID NO: 4157178 - RNA, 15 nt, Yersinia pestis
ucgaucgcuuuuuac

SEQ ID NO: 4157179 - RNA, 18 nt, Yersinia pestis
ucgaugccuucuuucaaa

SEQ ID NO: 4157180 - RNA, 20 nt, Yersinia pestis
ucgauugaccggucacacca

SEQ ID NO: 4157181 - RNA, 18 nt, Yersinia pestis
ucgauugauauauagaaa

SEQ ID NO: 4157182 - RNA, 15 nt, Yersinia pestis
ucgauuuccauauua

SEQ ID NO: 4157183 - RNA, 14 nt, Yersinia pestis
ucgauuugcucuuu

SEQ ID NO: 4157184 - RNA, 14 nt, Yersinia pestis
ucgcaaaacuucac

SEQ ID NO: 4157185 - RNA, 21 nt, Yersinia pestis
ucgcaaagcguuucgccaaau

SEQ ID NO: 4157186 - RNA, 18 nt, Yersinia pestis
ucgcaaccgccaaccagc

SEQ ID NO: 4157187 - RNA, 12 nt, Yersinia pestis
ucgcaagcaaua

SEQ ID NO: 4157188 - RNA, 15 nt, Yersinia pestis
ucgcacaguuuucuu

SEQ ID NO: 4157189 - RNA, 22 nt, Yersinia pestis
ucgcacccacgguaucugcuuu

SEQ ID NO: 4157190 - RNA, 21 nt, Yersinia pestis
ucgcacgggcuuuaaugagua

SEQ ID NO: 4157191 - RNA, 20 nt, Yersinia pestis
ucgugcgggauucgaaccug

SEQ ID NO: 4157192 - RNA, 20 nt, Yersinia pestis
ucguggaguagagcuuccag

SEQ ID NO: 4157193 - RNA, 20 nt, Yersinia pestis
ucguggcguucccgcaggcg

SEQ ID NO: 4157194 - RNA, 14 nt, Yersinia pestis
ucguggugaugaug

SEQ ID NO: 4157195 - RNA, 18 nt, Yersinia pestis
ucguguaacacgaggcgc

SEQ ID NO: 4157196 - RNA, 19 nt, Yersinia pestis
ucguguauaucacuauuuc

SEQ ID NO: 4157197 - RNA, 21 nt, Yersinia pestis
ucguuaaacauuauuuuucac

SEQ ID NO: 4157198 - RNA, 23 nt, Yersinia pestis
ucguuagugaaguaauaaaaauc

SEQ ID NO: 4157199 - RNA, 13 nt, Yersinia pestis
ucguuauaauauu

SEQ ID NO: 4157200 - RNA, 22 nt, Yersinia pestis
ucguucacucccguugccgccu

SEQ ID NO: 4157201 - RNA, 18 nt, Yersinia pestis
ucguucgcccuucuucca

SEQ ID NO: 4157202 - RNA, 11 nt, Yersinia pestis
ucguugccaaa

SEQ ID NO: 4157203 - RNA, 15 nt, Yersinia pestis
ucguugcuaccagca

SEQ ID NO: 4157204 - RNA, 14 nt, Yersinia pestis
ucguuguauuagcc

SEQ ID NO: 4157205 - RNA, 15 nt, Yersinia pestis
ucguuuccagcggcg

SEQ ID NO: 4157206 - RNA, 15 nt, Yersinia pestis
ucguuucucuaaaau

SEQ ID NO: 4157207 - RNA, 17 nt, Yersinia pestis
ucguuuuaauuugccuu

SEQ ID NO: 4157208 - RNA, 16 nt, Yersinia pestis
ucuaaaauaucuuuca

SEQ ID NO: 4157209 - RNA, 15 nt, Yersinia pestis
ucuaaaaucgcacug

SEQ ID NO: 4157210 - RNA, 17 nt, Yersinia pestis
ucuaaaccgaguucaga

SEQ ID NO: 4157211 - RNA, 21 nt, Yersinia pestis
ucuaaacgaccaauuucaaua

SEQ ID NO: 4157212 - RNA, 17 nt, Yersinia pestis
ucuaaauccugcaaauu

SEQ ID NO: 4157213 - RNA, 15 nt, Yersinia pestis
ucuaacauacucaga

SEQ ID NO: 4157214 - RNA, 19 nt, Yersinia pestis
ucuaaccaggugcagauaa

SEQ ID NO: 4157215 - RNA, 14 nt, Yersinia pestis
ucuaacucauucau

SEQ ID NO: 4157216 - RNA, 15 nt, Yersinia pestis
ucuaacucauucaua

SEQ ID NO: 4157217 - RNA, 19 nt, Yersinia pestis
ucuaacugauguauucccu

SEQ ID NO: 4157218 - RNA, 12 nt, Yersinia pestis
ucuaaguccaag

SEQ ID NO: 4157219 - RNA, 15 nt, Yersinia pestis
ucuaauaaugagcca

SEQ ID NO: 4157220 - RNA, 21 nt, Yersinia pestis
ucuaauagggccuccaacugc

SEQ ID NO: 4157221 - RNA, 20 nt, Yersinia pestis
ucuaaucgcgcauuucuucu

SEQ ID NO: 4157222 - RNA, 18 nt, Yersinia pestis
ucuaauguaauaaucuaa

SEQ ID NO: 4157223 - RNA, 16 nt, Yersinia pestis
ucuaauuguuauuauu

SEQ ID NO: 4157224 - RNA, 11 nt, Yersinia pestis
ucuacaacauc

SEQ ID NO: 4157225 - RNA, 20 nt, Yersinia pestis
ucuaccgaucaaacagguaa

SEQ ID NO: 4157226 - RNA, 17 nt, Yersinia pestis
ucuaccugaaugcgccg

SEQ ID NO: 4157227 - RNA, 20 nt, Yersinia pestis
ucuaccuucaggccuuuacu

SEQ ID NO: 4157228 - RNA, 16 nt, Yersinia pestis
ucuacgacgcccgauu

SEQ ID NO: 4157229 - RNA, 19 nt, Yersinia pestis
ucuacuuacgagcuaaugc

SEQ ID NO: 4157230 - RNA, 18 nt, Yersinia pestis
ucuacuuuauucaauacu

SEQ ID NO: 4157231 - RNA, 21 nt, Yersinia pestis
ucuagaccugaggauaaaaac

SEQ ID NO: 4157232 - RNA, 23 nt, Yersinia pestis
ucuagaccugaggauaaaaacua

SEQ ID NO: 4157233 - RNA, 19 nt, Yersinia pestis
ucuagcaacacaucgguau

SEQ ID NO: 4157234 - RNA, 14 nt, Yersinia pestis
ucuagcucuuccag

SEQ ID NO: 4157235 - RNA, 19 nt, Yersinia pestis
ucuagcuguagcaauauau

SEQ ID NO: 4157236 - RNA, 14 nt, Yersinia pestis
ucuaggguuauuuu

SEQ ID NO: 4157237 - RNA, 13 nt, Yersinia pestis
ucuauaaaaccgu

SEQ ID NO: 4157238 - RNA, 21 nt, Yersinia pestis
ucuauagagugcaauuuuauu

SEQ ID NO: 4157239 - RNA, 13 nt, Yersinia pestis
ucuaucaauauau

SEQ ID NO: 4157240 - RNA, 20 nt, Yersinia pestis
ucuaucagaccuuuaggaaa

SEQ ID NO: 4157241 - RNA, 21 nt, Yersinia pestis
ucuaucaggucaaucuuauug

SEQ ID NO: 4157242 - RNA, 13 nt, Yersinia pestis
ucuaucauccuug

SEQ ID NO: 4157243 - RNA, 16 nt, Yersinia pestis
ucuauccgaaaaauau

SEQ ID NO: 4157244 - RNA, 16 nt, Yersinia pestis
ucuaucgauaaaguca

SEQ ID NO: 4157245 - RNA, 13 nt, Yersinia pestis
ucuaucucaggcu

SEQ ID NO: 4157246 - RNA, 18 nt, Yersinia pestis
ucuaucucaucuuaauca

SEQ ID NO: 4157247 - RNA, 11 nt, Yersinia pestis
ucuaucugcag

SEQ ID NO: 4157248 - RNA, 20 nt, Yersinia pestis
ucuaucuugucguuauuuuc

SEQ ID NO: 4157249 - RNA, 16 nt, Yersinia pestis
ucuauuaccucaauac

SEQ ID NO: 4157250 - RNA, 13 nt, Yersinia pestis
ucuauuauuaaag

SEQ ID NO: 4157251 - RNA, 21 nt, Yersinia pestis
ucuauucccugcaauugcaga

SEQ ID NO: 4157252 - RNA, 15 nt, Yersinia pestis
ucuauucugcuuuuu

SEQ ID NO: 4157253 - RNA, 18 nt, Yersinia pestis
ucuauuguuacuuuuaau

SEQ ID NO: 4157254 - RNA, 18 nt, Yersinia pestis
ucuauuuauuuauaaaac

SEQ ID NO: 4157255 - RNA, 11 nt, Yersinia pestis
ucuauuuccac

SEQ ID NO: 4157256 - RNA, 12 nt, Yersinia pestis
ucuauuuccauc

SEQ ID NO: 4157257 - RNA, 14 nt, Yersinia pestis
ucuauuuuuauaau

SEQ ID NO: 4157258 - RNA, 23 nt, Yersinia pestis
ucuauuuuuauuucuccuuacua

SEQ ID NO: 4157259 - RNA, 14 nt, Yersinia pestis
ucucaaacucguuu

SEQ ID NO: 4157260 - RNA, 16 nt, Yersinia pestis
ucucaauauuaauaau

SEQ ID NO: 4157261 - RNA, 17 nt, Yersinia pestis
ucucaauauuaauaaug

SEQ ID NO: 4157262 - RNA, 19 nt, Yersinia pestis
ucucaauauuaauaaugcc

SEQ ID NO: 4157263 - RNA, 17 nt, Yersinia pestis
ucucaauggcuuuuuua

SEQ ID NO: 4157264 - RNA, 14 nt, Yersinia pestis
ucucacaaaauaau

SEQ ID NO: 4157265 - RNA, 17 nt, Yersinia pestis
ucucacaaaauaauaau

SEQ ID NO: 4157266 - RNA, 12 nt, Yersinia pestis
ucucacaacuuu

SEQ ID NO: 4157267 - RNA, 12 nt, Yersinia pestis
ucucacccuucu

SEQ ID NO: 4157268 - RNA, 15 nt, Yersinia pestis
ucucacgaugccuuu

SEQ ID NO: 4157269 - RNA, 15 nt, Yersinia pestis
ucucacuuacuauga

SEQ ID NO: 4157270 - RNA, 21 nt, Yersinia pestis
ucucacuuggguagcagccca

SEQ ID NO: 4157271 - RNA, 16 nt, Yersinia pestis
ucucagaacaagacag

SEQ ID NO: 4157272 - RNA, 21 nt, Yersinia pestis
ucucaggugugagguuauuga

SEQ ID NO: 4157273 - RNA, 15 nt, Yersinia pestis
ucucaguugaaaccc

SEQ ID NO: 4157274 - RNA, 17 nt, Yersinia pestis
ucucaucaauaccgaaa

SEQ ID NO: 4157275 - RNA, 16 nt, Yersinia pestis
ucucauccauguuaga

SEQ ID NO: 4157276 - RNA, 14 nt, Yersinia pestis
ucucauccugcuau

SEQ ID NO: 4157277 - RNA, 23 nt, Yersinia pestis
ucucauccugcuauuuaacaaaa

SEQ ID NO: 4157278 - RNA, 15 nt, Yersinia pestis
ucucaucggcauacu

SEQ ID NO: 4157279 - RNA, 23 nt, Yersinia pestis
ucucaucggcauacuccuuaauc

SEQ ID NO: 4157280 - RNA, 14 nt, Yersinia pestis
ucucauuauuuauu

SEQ ID NO: 4157281 - RNA, 15 nt, Yersinia pestis
ucucauuccauaauu

SEQ ID NO: 4157282 - RNA, 23 nt, Yersinia pestis
ucucauuuagcauuauucuucac

SEQ ID NO: 4157283 - RNA, 19 nt, Yersinia pestis
ucucauuucgucuuaauuu

SEQ ID NO: 4157284 - RNA, 12 nt, Yersinia pestis
ucuccaagcaca

SEQ ID NO: 4157285 - RNA, 12 nt, Yersinia pestis
ucuccagccugc

SEQ ID NO: 4157286 - RNA, 20 nt, Yersinia pestis
ucuccaguaaaagaauaaau

SEQ ID NO: 4157287 - RNA, 16 nt, Yersinia pestis
ucuccagugcaaauuu

SEQ ID NO: 4157288 - RNA, 21 nt, Yersinia pestis
ucuccaguuggcgcacguucc

SEQ ID NO: 4157289 - RNA, 21 nt, Yersinia pestis
ucuccaugauauaucagucuu

SEQ ID NO: 4157290 - RNA, 21 nt, Yersinia pestis
ucuccauggucaaacguucug

SEQ ID NO: 4157291 - RNA, 19 nt, Yersinia pestis
ucucccauuaauuaaucag

SEQ ID NO: 4157292 - RNA, 18 nt, Yersinia pestis
ucuccccuaccucauccg

SEQ ID NO: 4157293 - RNA, 13 nt, Yersinia pestis
ucuccccuuaugc

SEQ ID NO: 4157294 - RNA, 20 nt, Yersinia pestis
ucuccgucgcgggcacuuug

SEQ ID NO: 4157295 - RNA, 15 nt, Yersinia pestis
ucuccguugaaaccu

SEQ ID NO: 4157296 - RNA, 21 nt, Yersinia pestis
ucuccguugaaaccuacauca

SEQ ID NO: 4157297 - RNA, 15 nt, Yersinia pestis
ucuccuaaaaucuau

SEQ ID NO: 4157298 - RNA, 17 nt, Yersinia pestis
ucuccuaaaaucuaucg

SEQ ID NO: 4157299 - RNA, 19 nt, Yersinia pestis
ucuccuauccacugugauu

SEQ ID NO: 4157300 - RNA, 15 nt, Yersinia pestis
ucuccuuauacuaaa

SEQ ID NO: 4157301 - RNA, 18 nt, Yersinia pestis
ucucgacaaauccuuuua

SEQ ID NO: 4157302 - RNA, 21 nt, Yersinia pestis
ucucgacaaauccuuuuaaaa

SEQ ID NO: 4157303 - RNA, 20 nt, Yersinia pestis
ucucgacauccaauucagua

SEQ ID NO: 4157304 - RNA, 21 nt, Yersinia pestis
ucucgagguguuuuccccaau

SEQ ID NO: 4157305 - RNA, 14 nt, Yersinia pestis
ucucgccuaaguuu

SEQ ID NO: 4157306 - RNA, 15 nt, Yersinia pestis
ucucggcuuucaggu

SEQ ID NO: 4157307 - RNA, 20 nt, Yersinia pestis
ucucguggggucauaccggc

SEQ ID NO: 4157308 - RNA, 15 nt, Yersinia pestis
ucucuagauuaaccu

SEQ ID NO: 4157309 - RNA, 18 nt, Yersinia pestis
ucucuauagagugcaauu

SEQ ID NO: 4157310 - RNA, 18 nt, Yersinia pestis
ucucuaucaauauauacc

SEQ ID NO: 4157311 - RNA, 13 nt, Yersinia pestis
ucucuauucacua

SEQ ID NO: 4157312 - RNA, 14 nt, Yersinia pestis
ucucuauucugcuu

SEQ ID NO: 4157313 - RNA, 14 nt, Yersinia pestis
ucucuccagugcaa

SEQ ID NO: 4157314 - RNA, 18 nt, Yersinia pestis
ucugugccagucuaaaau

SEQ ID NO: 4157315 - RNA, 21 nt, Yersinia pestis
ucuguggauuaacuucuuccg

SEQ ID NO: 4157316 - RNA, 16 nt, Yersinia pestis
ucuguggauugccaaa

SEQ ID NO: 4157317 - RNA, 18 nt, Yersinia pestis
ucuguggcagggcgcuuu

SEQ ID NO: 4157318 - RNA, 15 nt, Yersinia pestis
ucuguggugccauaa

SEQ ID NO: 4157319 - RNA, 19 nt, Yersinia pestis
ucugugucaguaccugaug

SEQ ID NO: 4157320 - RNA, 22 nt, Yersinia pestis
ucuguguuuagcgucgcugaug

SEQ ID NO: 4157321 - RNA, 20 nt, Yersinia pestis
ucuguuaauccuaaugaaca

SEQ ID NO: 4157322 - RNA, 23 nt, Yersinia pestis
ucuguuaucgcuacguacuaucu

SEQ ID NO: 4157323 - RNA, 21 nt, Yersinia pestis
ucuguucagcauaaauauuca

SEQ ID NO: 4157324 - RNA, 20 nt, Yersinia pestis
ucuguugauaaaaaucuuuu

SEQ ID NO: 4157325 - RNA, 18 nt, Yersinia pestis
ucuguuucaaauaaguau

SEQ ID NO: 4157326 - RNA, 14 nt, Yersinia pestis
ucuguuuuugccac

SEQ ID NO: 4157327 - RNA, 13 nt, Yersinia pestis
ucuguuuuuuauc

SEQ ID NO: 4157328 - RNA, 15 nt, Yersinia pestis
ucuguuuuuuuuaaa

SEQ ID NO: 4157329 - RNA, 15 nt, Yersinia pestis
ucuuaaaaauaacuu

SEQ ID NO: 4157330 - RNA, 22 nt, Yersinia pestis
ucuuaagcguacacuuucuacu

SEQ ID NO: 4157331 - RNA, 20 nt, Yersinia pestis
ucuuaaggacccguuuauaa

SEQ ID NO: 4157332 - RNA, 14 nt, Yersinia pestis
ucuuaauaccuaaa

SEQ ID NO: 4157333 - RNA, 18 nt, Yersinia pestis
ucuuaauaccuaaaauua

SEQ ID NO: 4157334 - RNA, 18 nt, Yersinia pestis
ucuuaaucuuuaauucau

SEQ ID NO: 4157335 - RNA, 19 nt, Yersinia pestis
ucuuaaucuuuaauucauc

SEQ ID NO: 4157336 - RNA, 22 nt, Yersinia pestis
ucuuaaucuuuaauucaucaga

SEQ ID NO: 4157337 - RNA, 22 nt, Yersinia pestis
ucuuaauucccagccacucaca

SEQ ID NO: 4157338 - RNA, 21 nt, Yersinia pestis
ucuuaauuuaaauaagaucca

SEQ ID NO: 4157339 - RNA, 18 nt, Yersinia pestis
ucuuaauuuggcuuaaaa

SEQ ID NO: 4157340 - RNA, 20 nt, Yersinia pestis
ucuuacaagaaugcagauau

SEQ ID NO: 4157341 - RNA, 18 nt, Yersinia pestis
ucuuagaccaccgccauu

SEQ ID NO: 4157342 - RNA, 18 nt, Yersinia pestis
ucuuaggguaaccaaugu

SEQ ID NO: 4157343 - RNA, 15 nt, Yersinia pestis
ucuuauauaaaucca

SEQ ID NO: 4157344 - RNA, 17 nt, Yersinia pestis
ucuuauauaaauccagc

SEQ ID NO: 4157345 - RNA, 18 nt, Yersinia pestis
ucuuauauuauuaacgau

SEQ ID NO: 4157346 - RNA, 20 nt, Yersinia pestis
ucuuaucaaucaaaaaauaa

SEQ ID NO: 4157347 - RNA, 21 nt, Yersinia pestis
ucuucaaccuggaaccaagcc

SEQ ID NO: 4157348 - RNA, 14 nt, Yersinia pestis
ucuucagccuaucc

SEQ ID NO: 4157349 - RNA, 21 nt, Yersinia pestis
ucuucagccuauccucaccgu

SEQ ID NO: 4157350 - RNA, 22 nt, Yersinia pestis
ucuucaucuagcgguuucacga

SEQ ID NO: 4157351 - RNA, 14 nt, Yersinia pestis
ucuuccaaaggaag

SEQ ID NO: 4157352 - RNA, 20 nt, Yersinia pestis
ucuuccaauagcaguggcca

SEQ ID NO: 4157353 - RNA, 19 nt, Yersinia pestis
ucuuccacucuuucaauga

SEQ ID NO: 4157354 - RNA, 18 nt, Yersinia pestis
ucuuccagcaacaugcca

SEQ ID NO: 4157355 - RNA, 18 nt, Yersinia pestis
ucuucggccuaucaucac

SEQ ID NO: 4157356 - RNA, 20 nt, Yersinia pestis
ucuucggccuaucaucacca

SEQ ID NO: 4157357 - RNA, 22 nt, Yersinia pestis
ucuucggcggcuaaagcugcuu

SEQ ID NO: 4157358 - RNA, 16 nt, Yersinia pestis
ucuucgggaggaggua

SEQ ID NO: 4157359 - RNA, 23 nt, Yersinia pestis
ucuucguugccccaucagcacuc

SEQ ID NO: 4157360 - RNA, 14 nt, Yersinia pestis
ucuucuacuuacga

SEQ ID NO: 4157361 - RNA, 14 nt, Yersinia pestis
ucuucuagcucuuc

SEQ ID NO: 4157362 - RNA, 12 nt, Yersinia pestis
ucuucucacccc

SEQ ID NO: 4157363 - RNA, 22 nt, Yersinia pestis
ucuucugagauauguagcagca

SEQ ID NO: 4157364 - RNA, 17 nt, Yersinia pestis
ucuucugauaaaacagu

SEQ ID NO: 4157365 - RNA, 13 nt, Yersinia pestis
ucuucuguugccc

SEQ ID NO: 4157366 - RNA, 13 nt, Yersinia pestis
ucuucuuuuauug

SEQ ID NO: 4157367 - RNA, 14 nt, Yersinia pestis
ucuugaacggugag

SEQ ID NO: 4157368 - RNA, 15 nt, Yersinia pestis
ucuugaauaauauuc

SEQ ID NO: 4157369 - RNA, 19 nt, Yersinia pestis
ucuugauuaccaauaauua

SEQ ID NO: 4157370 - RNA, 15 nt, Yersinia pestis
ucuuguaaauaguca

SEQ ID NO: 4157371 - RNA, 23 nt, Yersinia pestis
ucuuguaaauagucauauauuuu

SEQ ID NO: 4157372 - RNA, 15 nt, Yersinia pestis
ucuuguaguaaccac

SEQ ID NO: 4157373 - RNA, 12 nt, Yersinia pestis
ucuugucgucac

SEQ ID NO: 4157374 - RNA, 17 nt, Yersinia pestis
ucuugugacaucaccuu

SEQ ID NO: 4157375 - RNA, 22 nt, Yersinia pestis
ucuugugaugcauauuauuaau

SEQ ID NO: 4157376 - RNA, 16 nt, Yersinia pestis
ucuuguuaauuuaaac

SEQ ID NO: 4157377 - RNA, 21 nt, Yersinia pestis
ucuuguuaucaccugucaccu

SEQ ID NO: 4157378 - RNA, 16 nt, Yersinia pestis
ucuuguucuaauaaua

SEQ ID NO: 4157379 - RNA, 12 nt, Yersinia pestis
ucuuguugagug

SEQ ID NO: 4157380 - RNA, 13 nt, Yersinia pestis
ucuuuaaaaucuu

SEQ ID NO: 4157381 - RNA, 14 nt, Yersinia pestis
ucuuuaaaaucuug

SEQ ID NO: 4157382 - RNA, 13 nt, Yersinia pestis
ucuuuaaagacuu

SEQ ID NO: 4157383 - RNA, 16 nt, Yersinia pestis
ucuuuaacaacaacca

SEQ ID NO: 4157384 - RNA, 12 nt, Yersinia pestis
ucuuuaauaaua

SEQ ID NO: 4157385 - RNA, 16 nt, Yersinia pestis
ucuuuaaucaccucaa

SEQ ID NO: 4157386 - RNA, 12 nt, Yersinia pestis
ucuuuaauuuuu

SEQ ID NO: 4157387 - RNA, 14 nt, Yersinia pestis
ucuuuacaggccac

SEQ ID NO: 4157388 - RNA, 14 nt, Yersinia pestis
ucuuuacgaucugc

SEQ ID NO: 4157389 - RNA, 16 nt, Yersinia pestis
ucuuuacgaucugccu

SEQ ID NO: 4157390 - RNA, 21 nt, Yersinia pestis
ucuuuacgguuaaaacaguaa

SEQ ID NO: 4157391 - RNA, 14 nt, Yersinia pestis
ucuuuagauuucac

SEQ ID NO: 4157392 - RNA, 18 nt, Yersinia pestis
ucuuuagauuucaccuau

SEQ ID NO: 4157393 - RNA, 14 nt, Yersinia pestis
ucuuuauauucaau

SEQ ID NO: 4157394 - RNA, 18 nt, Yersinia pestis
ucuuuauauucaauauca

SEQ ID NO: 4157395 - RNA, 17 nt, Yersinia pestis
ucuuuauuaucaauggc

SEQ ID NO: 4157396 - RNA, 18 nt, Yersinia pestis
ucuuuauuuauuuuacug

SEQ ID NO: 4157397 - RNA, 18 nt, Yersinia pestis
ucuuucaccacugccaca

SEQ ID NO: 4157398 - RNA, 21 nt, Yersinia pestis
ucuuucaccaguggucaucac

SEQ ID NO: 4157399 - RNA, 18 nt, Yersinia pestis
ucuuucacuaaugaggaa

SEQ ID NO: 4157400 - RNA, 13 nt, Yersinia pestis
ucuuucaggccac

SEQ ID NO: 4157401 - RNA, 15 nt, Yersinia pestis
ucuuucauaucaaaa

SEQ ID NO: 4157402 - RNA, 13 nt, Yersinia pestis
ucuuuccagcaaa

SEQ ID NO: 4157403 - RNA, 16 nt, Yersinia pestis
ucuuuccagcaaaagc

SEQ ID NO: 4157404 - RNA, 16 nt, Yersinia pestis
ucuuuccuacacuggc

SEQ ID NO: 4157405 - RNA, 13 nt, Yersinia pestis
ucuuucggcuaaa

SEQ ID NO: 4157406 - RNA, 22 nt, Yersinia pestis
ucuuucuggcuaaacgaucaga

SEQ ID NO: 4157407 - RNA, 14 nt, Yersinia pestis
ucuuugaccgaacc

SEQ ID NO: 4157408 - RNA, 18 nt, Yersinia pestis
ucuuugacucaauauugu

SEQ ID NO: 4157409 - RNA, 16 nt, Yersinia pestis
ucuuugccuauuucag

SEQ ID NO: 4157410 - RNA, 16 nt, Yersinia pestis
ucuuugcguucugucu

SEQ ID NO: 4157411 - RNA, 16 nt, Yersinia pestis
ucuuugcuucaggcac

SEQ ID NO: 4157412 - RNA, 15 nt, Yersinia pestis
ucuuugucaauaacc

SEQ ID NO: 4157413 - RNA, 14 nt, Yersinia pestis
ucuuuuaaagaaga

SEQ ID NO: 4157414 - RNA, 14 nt, Yersinia pestis
ucuuuuacaaauuu

SEQ ID NO: 4157415 - RNA, 22 nt, Yersinia pestis
ucuuuuaguaacaaaaugcggu

SEQ ID NO: 4157416 - RNA, 14 nt, Yersinia pestis
ucuuuucuuuaugu

SEQ ID NO: 4157417 - RNA, 13 nt, Yersinia pestis
ucuuuuguauaug

SEQ ID NO: 4157418 - RNA, 16 nt, Yersinia pestis
ucuuuuuccacacccu

SEQ ID NO: 4157419 - RNA, 20 nt, Yersinia pestis
ucuuuuucggcaauauuggc

SEQ ID NO: 4157420 - RNA, 16 nt, Yersinia pestis
ucuuuuucugccugag

SEQ ID NO: 4157421 - RNA, 23 nt, Yersinia pestis
ugaaaaaauaaaugcucucgaga

SEQ ID NO: 4157422 - RNA, 13 nt, Yersinia pestis
ugaaaaacugugc

SEQ ID NO: 4157423 - RNA, 18 nt, Yersinia pestis
ugaaaacguuaacugcag

SEQ ID NO: 4157424 - RNA, 20 nt, Yersinia pestis
ugaaaagugauccacuuaua

SEQ ID NO: 4157425 - RNA, 12 nt, Yersinia pestis
ugaaaauaauaa

SEQ ID NO: 4157426 - RNA, 16 nt, Yersinia pestis
ugaaaaugguuuccag

SEQ ID NO: 4157427 - RNA, 17 nt, Yersinia pestis
ugaaacacuuauuugaa

SEQ ID NO: 4157428 - RNA, 11 nt, Yersinia pestis
ugaaacagcag

SEQ ID NO: 4157429 - RNA, 17 nt, Yersinia pestis
ugaaacauaauuaaaua

SEQ ID NO: 4157430 - RNA, 17 nt, Yersinia pestis
ugaaaccgaucacuaua

SEQ ID NO: 4157431 - RNA, 21 nt, Yersinia pestis
ugaaaccuacaucacacccag

SEQ ID NO: 4157432 - RNA, 11 nt, Yersinia pestis
ugaaacucaac

SEQ ID NO: 4157433 - RNA, 19 nt, Yersinia pestis
ugaaacuucaaaaucaagu

SEQ ID NO: 4157434 - RNA, 21 nt, Yersinia pestis
ugaaacuuuucaguuuuaauu

SEQ ID NO: 4157435 - RNA, 20 nt, Yersinia pestis
ugaaagcuucaacuuccagu

SEQ ID NO: 4157436 - RNA, 18 nt, Yersinia pestis
ugaauggauugaaaccgc

SEQ ID NO: 4157437 - RNA, 21 nt, Yersinia pestis
ugaauggcaacgcgcagugcc

SEQ ID NO: 4157438 - RNA, 14 nt, Yersinia pestis
ugaaugugaagagc

SEQ ID NO: 4157439 - RNA, 17 nt, Yersinia pestis
ugaauguuccggacuuc

SEQ ID NO: 4157440 - RNA, 13 nt, Yersinia pestis
ugaauuaauuuau

SEQ ID NO: 4157441 - RNA, 19 nt, Yersinia pestis
ugaauuaauuuauuuucau

SEQ ID NO: 4157442 - RNA, 15 nt, Yersinia pestis
ugaauuauuagauga

SEQ ID NO: 4157443 - RNA, 12 nt, Yersinia pestis
ugaauugccccc

SEQ ID NO: 4157444 - RNA, 19 nt, Yersinia pestis
ugaauuuuagucaaaacaa

SEQ ID NO: 4157445 - RNA, 22 nt, Yersinia pestis
ugacaaaaacagcacuaucccc

SEQ ID NO: 4157446 - RNA, 20 nt, Yersinia pestis
ugacaaaaugcuaucggcgg

SEQ ID NO: 4157447 - RNA, 16 nt, Yersinia pestis
ugacaaacagauacau

SEQ ID NO: 4157448 - RNA, 19 nt, Yersinia pestis
ugacaaaccccgaugacuc

SEQ ID NO: 4157449 - RNA, 22 nt, Yersinia pestis
ugacaaaccccgaugacucacu

SEQ ID NO: 4157450 - RNA, 16 nt, Yersinia pestis
ugacaaagagcccgca

SEQ ID NO: 4157451 - RNA, 15 nt, Yersinia pestis
ugacaaagugcccgc

SEQ ID NO: 4157452 - RNA, 16 nt, Yersinia pestis
ugacaaaguuaaauga

SEQ ID NO: 4157453 - RNA, 17 nt, Yersinia pestis
ugacaaaguuaaaugaa

SEQ ID NO: 4157454 - RNA, 12 nt, Yersinia pestis
ugacaacaccgu

SEQ ID NO: 4157455 - RNA, 19 nt, Yersinia pestis
ugacaacaccguaacgccc

SEQ ID NO: 4157456 - RNA, 16 nt, Yersinia pestis
ugacaacaucaaauga

SEQ ID NO: 4157457 - RNA, 14 nt, Yersinia pestis
ugacaaccacuaaa

SEQ ID NO: 4157458 - RNA, 17 nt, Yersinia pestis
ugacaaccacuaaacca

SEQ ID NO: 4157459 - RNA, 20 nt, Yersinia pestis
ugacaaccacuaaaccacau

SEQ ID NO: 4157460 - RNA, 11 nt, Yersinia pestis
ugacaacgugu

SEQ ID NO: 4157461 - RNA, 15 nt, Yersinia pestis
ugacaauaucaacgc

SEQ ID NO: 4157462 - RNA, 13 nt, Yersinia pestis
ugacacaauuccc

SEQ ID NO: 4157463 - RNA, 20 nt, Yersinia pestis
ugacacaucccaacgcaggc

SEQ ID NO: 4157464 - RNA, 21 nt, Yersinia pestis
ugacaccauugauaauaauau

SEQ ID NO: 4157465 - RNA, 19 nt, Yersinia pestis
ugacaccggggauccauag

SEQ ID NO: 4157466 - RNA, 18 nt, Yersinia pestis
ugacacgagagauaauag

SEQ ID NO: 4157467 - RNA, 22 nt, Yersinia pestis
ugacacggguauuggcugcuug

SEQ ID NO: 4157468 - RNA, 21 nt, Yersinia pestis
ugacagaaaaaucacaugcgg

SEQ ID NO: 4157469 - RNA, 22 nt, Yersinia pestis
ugacagacccuguucguuagca

SEQ ID NO: 4157470 - RNA, 21 nt, Yersinia pestis
ugacaggggauagcaacugcc

SEQ ID NO: 4157471 - RNA, 19 nt, Yersinia pestis
ugacaguauuuguagugga

SEQ ID NO: 4157472 - RNA, 13 nt, Yersinia pestis
ugacauaaacacg

SEQ ID NO: 4157473 - RNA, 14 nt, Yersinia pestis
ugacauaaacacgc

SEQ ID NO: 4157474 - RNA, 14 nt, Yersinia pestis
ugacauacaguggc

SEQ ID NO: 4157475 - RNA, 17 nt, Yersinia pestis
ugacaucccgcaccaac

SEQ ID NO: 4157476 - RNA, 13 nt, Yersinia pestis
ugacauccgcuug

SEQ ID NO: 4157477 - RNA, 15 nt, Yersinia pestis
ugacauccgcuugca

SEQ ID NO: 4157478 - RNA, 19 nt, Yersinia pestis
ugacauccuuauuuuccgc

SEQ ID NO: 4157479 - RNA, 23 nt, Yersinia pestis
ugacaucgcccgguaagcgguau

SEQ ID NO: 4157480 - RNA, 18 nt, Yersinia pestis
ugacaucggccugcgcug

SEQ ID NO: 4157481 - RNA, 14 nt, Yersinia pestis
ugacauguuccagu

SEQ ID NO: 4157482 - RNA, 15 nt, Yersinia pestis
ugacauuuucuaucu

SEQ ID NO: 4157483 - RNA, 13 nt, Yersinia pestis
ugaccaaacauug

SEQ ID NO: 4157484 - RNA, 18 nt, Yersinia pestis
ugaccaaagcaguaaaca

SEQ ID NO: 4157485 - RNA, 21 nt, Yersinia pestis
ugaccaaagcaguaaacauuu

SEQ ID NO: 4157486 - RNA, 17 nt, Yersinia pestis
ugaccaauaauaacggu

SEQ ID NO: 4157487 - RNA, 14 nt, Yersinia pestis
ugaccaauagucac

SEQ ID NO: 4157488 - RNA, 18 nt, Yersinia pestis
ugaccacaaaaacagugu

SEQ ID NO: 4157489 - RNA, 19 nt, Yersinia pestis
ugaccacgcaucaauaaua

SEQ ID NO: 4157490 - RNA, 21 nt, Yersinia pestis
ugaccacgcaucaauaauaac

SEQ ID NO: 4157491 - RNA, 20 nt, Yersinia pestis
ugaccacugcuucugucagu

SEQ ID NO: 4157492 - RNA, 15 nt, Yersinia pestis
ugaccagauaggcuu

SEQ ID NO: 4157493 - RNA, 22 nt, Yersinia pestis
ugaccagcgaaucaaacagguu

SEQ ID NO: 4157494 - RNA, 15 nt, Yersinia pestis
ugaccagggcuaaaa

SEQ ID NO: 4157495 - RNA, 17 nt, Yersinia pestis
ugaccagggcuaaaaug

SEQ ID NO: 4157496 - RNA, 17 nt, Yersinia pestis
ugaccagugaauaaguu

SEQ ID NO: 4157497 - RNA, 21 nt, Yersinia pestis
ugaccaugcuuauugccaugc

SEQ ID NO: 4157498 - RNA, 13 nt, Yersinia pestis
ugaccauggcgau

SEQ ID NO: 4157499 - RNA, 18 nt, Yersinia pestis
ugaccauggcgaucaaag

SEQ ID NO: 4157500 - RNA, 22 nt, Yersinia pestis
ugaccauuuguuuuugaaucau

SEQ ID NO: 4157501 - RNA, 13 nt, Yersinia pestis
ugaccccaaauuu

SEQ ID NO: 4157502 - RNA, 23 nt, Yersinia pestis
ugacccuggcacuaaaauaucaa

SEQ ID NO: 4157503 - RNA, 17 nt, Yersinia pestis
ugaccgaaccaccgcag

SEQ ID NO: 4157504 - RNA, 17 nt, Yersinia pestis
ugaccgauugaaucaag

SEQ ID NO: 4157505 - RNA, 15 nt, Yersinia pestis
ugaccgcuguuugau

SEQ ID NO: 4157506 - RNA, 13 nt, Yersinia pestis
ugaccgguauaga

SEQ ID NO: 4157507 - RNA, 19 nt, Yersinia pestis
ugaccggugacguuggauc

SEQ ID NO: 4157508 - RNA, 21 nt, Yersinia pestis
ugaccuauugauaaaaccacu

SEQ ID NO: 4157509 - RNA, 21 nt, Yersinia pestis
ugacgaaauuuaagaaaucua

SEQ ID NO: 4157510 - RNA, 14 nt, Yersinia pestis
ugacgacaauauaa

SEQ ID NO: 4157511 - RNA, 16 nt, Yersinia pestis
ugacgaccaauaucau

SEQ ID NO: 4157512 - RNA, 21 nt, Yersinia pestis
ugacgauaguauaaauaccug

SEQ ID NO: 4157513 - RNA, 21 nt, Yersinia pestis
ugacgauaucaauaaagaacg

SEQ ID NO: 4157514 - RNA, 15 nt, Yersinia pestis
ugacgaugauaaauc

SEQ ID NO: 4157515 - RNA, 16 nt, Yersinia pestis
ugacgauggucgucgu

SEQ ID NO: 4157516 - RNA, 15 nt, Yersinia pestis
ugacgcagcaggcgu

SEQ ID NO: 4157517 - RNA, 16 nt, Yersinia pestis
ugacgccgccgcguga

SEQ ID NO: 4157518 - RNA, 14 nt, Yersinia pestis
ugacgcgaucgucg

SEQ ID NO: 4157519 - RNA, 21 nt, Yersinia pestis
ugacgcguugcccuucuucag

SEQ ID NO: 4157520 - RNA, 22 nt, Yersinia pestis
ugacgcuaaccaccgucaccaa

SEQ ID NO: 4157521 - RNA, 15 nt, Yersinia pestis
ugacgcugcaccgcu

SEQ ID NO: 4157522 - RNA, 14 nt, Yersinia pestis
ugacgcuugaauau

SEQ ID NO: 4157523 - RNA, 14 nt, Yersinia pestis
ugacggcagcgagc

SEQ ID NO: 4157524 - RNA, 17 nt, Yersinia pestis
ugacggcggcggaucaa

SEQ ID NO: 4157525 - RNA, 18 nt, Yersinia pestis
ugacggggaguuuuuauu

SEQ ID NO: 4157526 - RNA, 20 nt, Yersinia pestis
ugacgggucagcugacgcag

SEQ ID NO: 4157527 - RNA, 19 nt, Yersinia pestis
ugacgguuucaacauccag

SEQ ID NO: 4157528 - RNA, 16 nt, Yersinia pestis
ugacgguuuucugaau

SEQ ID NO: 4157529 - RNA, 16 nt, Yersinia pestis
ugacguaaaaaggcag

SEQ ID NO: 4157530 - RNA, 19 nt, Yersinia pestis
ugacguguuuaacgccgcu

SEQ ID NO: 4157531 - RNA, 18 nt, Yersinia pestis
ugacguuaucucaaccag

SEQ ID NO: 4157532 - RNA, 19 nt, Yersinia pestis
ugacguugaguaauccucu

SEQ ID NO: 4157533 - RNA, 23 nt, Yersinia pestis
ugacuaaaauucaaacaaauauu

SEQ ID NO: 4157534 - RNA, 19 nt, Yersinia pestis
ugacuaaaucgcuuaucuu

SEQ ID NO: 4157535 - RNA, 12 nt, Yersinia pestis
ugacuaaauuuc

SEQ ID NO: 4157536 - RNA, 19 nt, Yersinia pestis
ugacuaacucuucuggcaa

SEQ ID NO: 4157537 - RNA, 22 nt, Yersinia pestis
ugacuaauuguuugcuuucaga

SEQ ID NO: 4157538 - RNA, 17 nt, Yersinia pestis
ugacuaucgcgcuuuuu

SEQ ID NO: 4157539 - RNA, 15 nt, Yersinia pestis
ugacucacguauuuu

SEQ ID NO: 4157540 - RNA, 22 nt, Yersinia pestis
ugacucacguauuuucauuuua

SEQ ID NO: 4157541 - RNA, 16 nt, Yersinia pestis
ugacucaucaaaacaa

SEQ ID NO: 4157542 - RNA, 21 nt, Yersinia pestis
ugacucccugacucccugacu

SEQ ID NO: 4157543 - RNA, 20 nt, Yersinia pestis
ugacucccuguucguuuccc

SEQ ID NO: 4157544 - RNA, 18 nt, Yersinia pestis
ugacucgauaacccaaag

SEQ ID NO: 4157545 - RNA, 12 nt, Yersinia pestis
ugacugaacauc

SEQ ID NO: 4157546 - RNA, 19 nt, Yersinia pestis
ugacugaccauaaaaggau

SEQ ID NO: 4157547 - RNA, 18 nt, Yersinia pestis
ugacugauguaagcucau

SEQ ID NO: 4157548 - RNA, 16 nt, Yersinia pestis
ugacuggaauauucca

SEQ ID NO: 4157549 - RNA, 14 nt, Yersinia pestis
ugacuggcaggaaa

SEQ ID NO: 4157550 - RNA, 19 nt, Yersinia pestis
ugacuggcaggaaaucuuc

SEQ ID NO: 4157551 - RNA, 20 nt, Yersinia pestis
ugacuggggugaacgaaagc

SEQ ID NO: 4157552 - RNA, 13 nt, Yersinia pestis
ugacuguaaauau

SEQ ID NO: 4157553 - RNA, 22 nt, Yersinia pestis
ugacugucugcggccuaccguu

SEQ ID NO: 4157554 - RNA, 17 nt, Yersinia pestis
ugacuguuaacauccag

SEQ ID NO: 4157555 - RNA, 22 nt, Yersinia pestis
ugacuuaugacgcgcugcuuug

SEQ ID NO: 4157556 - RNA, 15 nt, Yersinia pestis
ugacuugacucaggg

SEQ ID NO: 4157557 - RNA, 12 nt, Yersinia pestis
ugacuugauuaa

SEQ ID NO: 4157558 - RNA, 14 nt, Yersinia pestis
ugauauaagcagca

SEQ ID NO: 4157559 - RNA, 15 nt, Yersinia pestis
ugauauauagaaaua

SEQ ID NO: 4157560 - RNA, 16 nt, Yersinia pestis
ugauaucucuuuauca

SEQ ID NO: 4157561 - RNA, 21 nt, Yersinia pestis
ugauaucuucggcggcuaaag

SEQ ID NO: 4157562 - RNA, 17 nt, Yersinia pestis
ugauaugaaaaaucuga

SEQ ID NO: 4157563 - RNA, 18 nt, Yersinia pestis
ugauaugagcgaggaggu

SEQ ID NO: 4157564 - RNA, 22 nt, Yersinia pestis
ugauaugccugaaguugaucaa

SEQ ID NO: 4157565 - RNA, 18 nt, Yersinia pestis
ugauaugcuucacaucau

SEQ ID NO: 4157566 - RNA, 16 nt, Yersinia pestis
ugauaugggaacgucu

SEQ ID NO: 4157567 - RNA, 15 nt, Yersinia pestis
ugauauuaauaucag

SEQ ID NO: 4157568 - RNA, 23 nt, Yersinia pestis
ugauauuaaucagccuucagggu

SEQ ID NO: 4157569 - RNA, 19 nt, Yersinia pestis
ugauauucucaccugcuua

SEQ ID NO: 4157570 - RNA, 22 nt, Yersinia pestis
ugaucaauaaaaaagucacuua

SEQ ID NO: 4157571 - RNA, 21 nt, Yersinia pestis
ugaucaauaucccgagaaaca

SEQ ID NO: 4157572 - RNA, 16 nt, Yersinia pestis
ugaucacuggcauugc

SEQ ID NO: 4157573 - RNA, 19 nt, Yersinia pestis
ugaucagcaguggcuuggc

SEQ ID NO: 4157574 - RNA, 20 nt, Yersinia pestis
ugaucagcauuucggcuauu

SEQ ID NO: 4157575 - RNA, 20 nt, Yersinia pestis
ugaucagccgauguuugagc

SEQ ID NO: 4157576 - RNA, 20 nt, Yersinia pestis
ugaucagcuaacaaaaccgg

SEQ ID NO: 4157577 - RNA, 18 nt, Yersinia pestis
ugaucaggggacaaccag

SEQ ID NO: 4157578 - RNA, 19 nt, Yersinia pestis
ugaucaguggcuuaauuga

SEQ ID NO: 4157579 - RNA, 21 nt, Yersinia pestis
ugaucaucgauacaaaccguu

SEQ ID NO: 4157580 - RNA, 12 nt, Yersinia pestis
ugaucaucuuuu

SEQ ID NO: 4157581 - RNA, 20 nt, Yersinia pestis
ugaucauggcuugugcagca

SEQ ID NO: 4157582 - RNA, 14 nt, Yersinia pestis
ugauccaggggucg

SEQ ID NO: 4157583 - RNA, 14 nt, Yersinia pestis
ugaucccccaaauu

SEQ ID NO: 4157584 - RNA, 20 nt, Yersinia pestis
ugauccccgcuaacugcuga

SEQ ID NO: 4157585 - RNA, 17 nt, Yersinia pestis
ugauccgccaaggccag

SEQ ID NO: 4157586 - RNA, 16 nt, Yersinia pestis
ugauccgguuuccuua

SEQ ID NO: 4157587 - RNA, 15 nt, Yersinia pestis
ugaucgccguacuug

SEQ ID NO: 4157588 - RNA, 15 nt, Yersinia pestis
ugaucgcucaggcgg

SEQ ID NO: 4157589 - RNA, 15 nt, Yersinia pestis
ugaucggcauaaaug

SEQ ID NO: 4157590 - RNA, 20 nt, Yersinia pestis
ugaucgguuagcuacugaug

SEQ ID NO: 4157591 - RNA, 18 nt, Yersinia pestis
ugaucguuacggcugcgc

SEQ ID NO: 4157592 - RNA, 18 nt, Yersinia pestis
ugaucguuuuauggcgau

SEQ ID NO: 4157593 - RNA, 16 nt, Yersinia pestis
ugaucugaguuucauu

SEQ ID NO: 4157594 - RNA, 17 nt, Yersinia pestis
ugaucuggcuuucucaa

SEQ ID NO: 4157595 - RNA, 14 nt, Yersinia pestis
ugaucuugaauaau

SEQ ID NO: 4157596 - RNA, 19 nt, Yersinia pestis
ugaucuugaauaauauuca

SEQ ID NO: 4157597 - RNA, 22 nt, Yersinia pestis
ugaucuugaauaauauucaaua

SEQ ID NO: 4157598 - RNA, 13 nt, Yersinia pestis
ugaucuuuauuau

SEQ ID NO: 4157599 - RNA, 13 nt, Yersinia pestis
ugaugaaguuauu

SEQ ID NO: 4157600 - RNA, 20 nt, Yersinia pestis
ugaugaaguuauuuuuauua

SEQ ID NO: 4157601 - RNA, 19 nt, Yersinia pestis
ugaugaauaccaccaucac

SEQ ID NO: 4157602 - RNA, 13 nt, Yersinia pestis
ugaugaaugcgaa

SEQ ID NO: 4157603 - RNA, 13 nt, Yersinia pestis
ugaugacaaugcg

SEQ ID NO: 4157604 - RNA, 15 nt, Yersinia pestis
ugaugacaaugcguu

SEQ ID NO: 4157605 - RNA, 16 nt, Yersinia pestis
ugaugacaaugcguua

SEQ ID NO: 4157606 - RNA, 19 nt, Yersinia pestis
ugaugacgccguacaaaua

SEQ ID NO: 4157607 - RNA, 15 nt, Yersinia pestis
ugaugacuuuuauua

SEQ ID NO: 4157608 - RNA, 12 nt, Yersinia pestis
ugaugauaucac

SEQ ID NO: 4157609 - RNA, 20 nt, Yersinia pestis
ugaugaugacggugaugucc

SEQ ID NO: 4157610 - RNA, 21 nt, Yersinia pestis
ugaugaugagaaguaaaacgu

SEQ ID NO: 4157611 - RNA, 16 nt, Yersinia pestis
ugaugccgaucaucuc

SEQ ID NO: 4157612 - RNA, 22 nt, Yersinia pestis
ugaugcguguaaugcgcaucug

SEQ ID NO: 4157613 - RNA, 21 nt, Yersinia pestis
ugaugcucauuuaaaauacuc

SEQ ID NO: 4157614 - RNA, 18 nt, Yersinia pestis
ugaugcugcuggcguuau

SEQ ID NO: 4157615 - RNA, 14 nt, Yersinia pestis
ugaugcuggguaua

SEQ ID NO: 4157616 - RNA, 16 nt, Yersinia pestis
ugaugcuuuucuuucc

SEQ ID NO: 4157617 - RNA, 22 nt, Yersinia pestis
ugauggcaccgugggcaaagaa

SEQ ID NO: 4157618 - RNA, 14 nt, Yersinia pestis
ugauggccuugaau

SEQ ID NO: 4157619 - RNA, 17 nt, Yersinia pestis
ugauggccuugaaucaa

SEQ ID NO: 4157620 - RNA, 19 nt, Yersinia pestis
ugauggcgcagacccguga

SEQ ID NO: 4157621 - RNA, 18 nt, Yersinia pestis
ugauggcgugauggcgca

SEQ ID NO: 4157622 - RNA, 22 nt, Yersinia pestis
ugauggcuaauuaauuuaaaca

SEQ ID NO: 4157623 - RNA, 14 nt, Yersinia pestis
ugauggcuuuaucc

SEQ ID NO: 4157624 - RNA, 18 nt, Yersinia pestis
ugaugggaggaaacugcc

SEQ ID NO: 4157625 - RNA, 19 nt, Yersinia pestis
ugaugguucagccaccauu

SEQ ID NO: 4157626 - RNA, 18 nt, Yersinia pestis
ugauguaacucaggaucc

SEQ ID NO: 4157627 - RNA, 22 nt, Yersinia pestis
ugauguagcagaucuauuugcu

SEQ ID NO: 4157628 - RNA, 16 nt, Yersinia pestis
ugaugucaauuaaaaa

SEQ ID NO: 4157629 - RNA, 23 nt, Yersinia pestis
ugaugucagccguuuacgauaag

SEQ ID NO: 4157630 - RNA, 14 nt, Yersinia pestis
ugaugucagugcuc

SEQ ID NO: 4157631 - RNA, 20 nt, Yersinia pestis
ugaugucaucuuccgucagu

SEQ ID NO: 4157632 - RNA, 21 nt, Yersinia pestis
ugaugugaacgcccuguaaug

SEQ ID NO: 4157633 - RNA, 20 nt, Yersinia pestis
ugaugugacgucacugaugc

SEQ ID NO: 4157634 - RNA, 21 nt, Yersinia pestis
ugaugugacgucacugaugcu

SEQ ID NO: 4157635 - RNA, 20 nt, Yersinia pestis
ugaugugcucugcuccgccu

SEQ ID NO: 4157636 - RNA, 14 nt, Yersinia pestis
ugauuaaaagucaa

SEQ ID NO: 4157637 - RNA, 17 nt, Yersinia pestis
ugauuaaaagucaacug

SEQ ID NO: 4157638 - RNA, 21 nt, Yersinia pestis
ugauuaaauggugguuuucuu

SEQ ID NO: 4157639 - RNA, 24 nt, Yersinia pestis
ugauuaagcguuaauaaacaugaa

SEQ ID NO: 4157640 - RNA, 16 nt, Yersinia pestis
ugauuaauacacgcuu

SEQ ID NO: 4157641 - RNA, 12 nt, Yersinia pestis
ugauuaauauca

SEQ ID NO: 4157642 - RNA, 13 nt, Yersinia pestis
ugauuaauaucaa

SEQ ID NO: 4157643 - RNA, 17 nt, Yersinia pestis
ugauuaccaauaauuaa

SEQ ID NO: 4157644 - RNA, 21 nt, Yersinia pestis
ugauuaccaauaauuaauuuc

SEQ ID NO: 4157645 - RNA, 17 nt, Yersinia pestis
ugauuaggcaugauaag

SEQ ID NO: 4157646 - RNA, 22 nt, Yersinia pestis
ugauuaucaaguuaaauacugc

SEQ ID NO: 4157647 - RNA, 19 nt, Yersinia pestis
ugauuaugccacggcgaga

SEQ ID NO: 4157648 - RNA, 13 nt, Yersinia pestis
ugauucaauuucg

SEQ ID NO: 4157649 - RNA, 17 nt, Yersinia pestis
ugauucacugauuagcc

SEQ ID NO: 4157650 - RNA, 17 nt, Yersinia pestis
ugauucacuggcaaaaa

SEQ ID NO: 4157651 - RNA, 14 nt, Yersinia pestis
ugauucagccaaca

SEQ ID NO: 4157652 - RNA, 17 nt, Yersinia pestis
ugauucagugauaacaa

SEQ ID NO: 4157653 - RNA, 21 nt, Yersinia pestis
ugauucauaccuguacuuuga

SEQ ID NO: 4157654 - RNA, 19 nt, Yersinia pestis
ugauuccauguucucuccu

SEQ ID NO: 4157655 - RNA, 12 nt, Yersinia pestis
ugauucgccauu

SEQ ID NO: 4157656 - RNA, 19 nt, Yersinia pestis
ugauucgggugagugagcg

SEQ ID NO: 4157657 - RNA, 19 nt, Yersinia pestis
ugauucgguuauucuucua

SEQ ID NO: 4157658 - RNA, 15 nt, Yersinia pestis
ugauucgucugccau

SEQ ID NO: 4157659 - RNA, 16 nt, Yersinia pestis
ugauucgucugccauu

SEQ ID NO: 4157660 - RNA, 18 nt, Yersinia pestis
ugauucgucugccauugc

SEQ ID NO: 4157661 - RNA, 19 nt, Yersinia pestis
ugauucgucugccauugcu

SEQ ID NO: 4157662 - RNA, 23 nt, Yersinia pestis
ugauucucauuaauagaaucugc

SEQ ID NO: 4157663 - RNA, 17 nt, Yersinia pestis
ugauucucuauucugcu

SEQ ID NO: 4157664 - RNA, 16 nt, Yersinia pestis
ugauugaaaaacagag

SEQ ID NO: 4157665 - RNA, 17 nt, Yersinia pestis
ugauugaaaaucaguuu

SEQ ID NO: 4157666 - RNA, 23 nt, Yersinia pestis
ugauugaaaaucaguuuacauga

SEQ ID NO: 4157667 - RNA, 16 nt, Yersinia pestis
ugauugagaucauauu

SEQ ID NO: 4157668 - RNA, 13 nt, Yersinia pestis
ugauugauuauca

SEQ ID NO: 4157669 - RNA, 17 nt, Yersinia pestis
ugauuggauaaaauauu

SEQ ID NO: 4157670 - RNA, 22 nt, Yersinia pestis
ugauuggcacccucuagcagcg

SEQ ID NO: 4157671 - RNA, 22 nt, Yersinia pestis
ugauuggcgaugcgcuccgcca

SEQ ID NO: 4157672 - RNA, 23 nt, Yersinia pestis
ugauuggcucaugcuuaaagccu

SEQ ID NO: 4157673 - RNA, 14 nt, Yersinia pestis
ugauuggcuccuau

SEQ ID NO: 4157674 - RNA, 20 nt, Yersinia pestis
ugauuggcuccuauagcuca

SEQ ID NO: 4157675 - RNA, 17 nt, Yersinia pestis
ugauuguugugcauaua

SEQ ID NO: 4157676 - RNA, 18 nt, Yersinia pestis
ugauuguuuuauggcgau

SEQ ID NO: 4157677 - RNA, 23 nt, Yersinia pestis
ugauuguuuuuauuacagaguaa

SEQ ID NO: 4157678 - RNA, 12 nt, Yersinia pestis
ugauuuaaauau

SEQ ID NO: 4157679 - RNA, 21 nt, Yersinia pestis
ugcauuaucuuuaauuuuucc

SEQ ID NO: 4157680 - RNA, 13 nt, Yersinia pestis
ugcauucugcugg

SEQ ID NO: 4157681 - RNA, 21 nt, Yersinia pestis
ugcauugcagaaagcugaacu

SEQ ID NO: 4157682 - RNA, 12 nt, Yersinia pestis
ugcauuggaaaa

SEQ ID NO: 4157683 - RNA, 13 nt, Yersinia pestis
ugcauuggaaaaa

SEQ ID NO: 4157684 - RNA, 16 nt, Yersinia pestis
ugcauugguugcggau

SEQ ID NO: 4157685 - RNA, 21 nt, Yersinia pestis
ugcauuucaauucguucaaau

SEQ ID NO: 4157686 - RNA, 15 nt, Yersinia pestis
ugcauuuuuucauuc

SEQ ID NO: 4157687 - RNA, 23 nt, Yersinia pestis
ugccaaaaugccuaccguuagca

SEQ ID NO: 4157688 - RNA, 16 nt, Yersinia pestis
ugccaaauaucuuuca

SEQ ID NO: 4157689 - RNA, 18 nt, Yersinia pestis
ugccaaauaucuuucagc

SEQ ID NO: 4157690 - RNA, 12 nt, Yersinia pestis
ugccaaauauug

SEQ ID NO: 4157691 - RNA, 16 nt, Yersinia pestis
ugccaaauauugcaca

SEQ ID NO: 4157692 - RNA, 15 nt, Yersinia pestis
ugccaaauuauucau

SEQ ID NO: 4157693 - RNA, 22 nt, Yersinia pestis
ugccaacaacuggguggccagu

SEQ ID NO: 4157694 - RNA, 23 nt, Yersinia pestis
ugccaaccggauaaaacaauagc

SEQ ID NO: 4157695 - RNA, 20 nt, Yersinia pestis
ugccaacgcaauucaauaua

SEQ ID NO: 4157696 - RNA, 18 nt, Yersinia pestis
ugccaaggccgaucaaca

SEQ ID NO: 4157697 - RNA, 21 nt, Yersinia pestis
ugccaagguucgaaaaaacau

SEQ ID NO: 4157698 - RNA, 22 nt, Yersinia pestis
ugccaagguucgaaaaaacauc

SEQ ID NO: 4157699 - RNA, 15 nt, Yersinia pestis
ugccaauauaccggg

SEQ ID NO: 4157700 - RNA, 18 nt, Yersinia pestis
ugccaauaugguauucaa

SEQ ID NO: 4157701 - RNA, 19 nt, Yersinia pestis
ugccaauauguuagcagca

SEQ ID NO: 4157702 - RNA, 19 nt, Yersinia pestis
ugccaauccccaccaaaag

SEQ ID NO: 4157703 - RNA, 18 nt, Yersinia pestis
ugccaaugccucuucaau

SEQ ID NO: 4157704 - RNA, 15 nt, Yersinia pestis
ugccaauuauucucu

SEQ ID NO: 4157705 - RNA, 22 nt, Yersinia pestis
ugccaauuccauauuuaaugua

SEQ ID NO: 4157706 - RNA, 22 nt, Yersinia pestis
ugccaauugaguaacugauuaa

SEQ ID NO: 4157707 - RNA, 20 nt, Yersinia pestis
ugccacacagaaucaccaac

SEQ ID NO: 4157708 - RNA, 21 nt, Yersinia pestis
ugccacacagaaucaccaaca

SEQ ID NO: 4157709 - RNA, 20 nt, Yersinia pestis
ugccaccaaaugcucagcca

SEQ ID NO: 4157710 - RNA, 15 nt, Yersinia pestis
ugccaccuuggcggc

SEQ ID NO: 4157711 - RNA, 21 nt, Yersinia pestis
ugccacgccaguaaacagcca

SEQ ID NO: 4157712 - RNA, 17 nt, Yersinia pestis
ugccacggauauccaac

SEQ ID NO: 4157713 - RNA, 21 nt, Yersinia pestis
ugccacggauauccaacggua

SEQ ID NO: 4157714 - RNA, 14 nt, Yersinia pestis
ugccacgucaucga

SEQ ID NO: 4157715 - RNA, 16 nt, Yersinia pestis
ugccagacaaugauga

SEQ ID NO: 4157716 - RNA, 17 nt, Yersinia pestis
ugccagacacaagauaa

SEQ ID NO: 4157717 - RNA, 15 nt, Yersinia pestis
ugccagagcaauaac

SEQ ID NO: 4157718 - RNA, 18 nt, Yersinia pestis
ugccagcaaagacaauaa

SEQ ID NO: 4157719 - RNA, 17 nt, Yersinia pestis
ugccagcagcaaguuag

SEQ ID NO: 4157720 - RNA, 22 nt, Yersinia pestis
ugccagggcguuuaccauccag

SEQ ID NO: 4157721 - RNA, 18 nt, Yersinia pestis
ugccaguaacggcuuauu

SEQ ID NO: 4157722 - RNA, 21 nt, Yersinia pestis
ugccaguaauucacugcuuaa

SEQ ID NO: 4157723 - RNA, 17 nt, Yersinia pestis
ugccaguagccguuaca

SEQ ID NO: 4157724 - RNA, 16 nt, Yersinia pestis
ugccagucuaaaaugg

SEQ ID NO: 4157725 - RNA, 13 nt, Yersinia pestis
ugccagugcaauc

SEQ ID NO: 4157726 - RNA, 19 nt, Yersinia pestis
ugccagugggauaucugcg

SEQ ID NO: 4157727 - RNA, 16 nt, Yersinia pestis
ugccauaaaugggaag

SEQ ID NO: 4157728 - RNA, 23 nt, Yersinia pestis
ugccauaagcggacauggcaaca

SEQ ID NO: 4157729 - RNA, 14 nt, Yersinia pestis
ugccauaccaggcc

SEQ ID NO: 4157730 - RNA, 23 nt, Yersinia pestis
ugccauagcugcugcuuucagug

SEQ ID NO: 4157731 - RNA, 22 nt, Yersinia pestis
ugccauaggggggaaagcaaua

SEQ ID NO: 4157732 - RNA, 18 nt, Yersinia pestis
ugccaucaauaccaauaa

SEQ ID NO: 4157733 - RNA, 19 nt, Yersinia pestis
ugccaucaauaccaauaaa

SEQ ID NO: 4157734 - RNA, 20 nt, Yersinia pestis
ugccaucccccuuuggccgc

SEQ ID NO: 4157735 - RNA, 23 nt, Yersinia pestis
ugccaucgcuuuggcuucuggau

SEQ ID NO: 4157736 - RNA, 15 nt, Yersinia pestis
ugccaucgggcaauu

SEQ ID NO: 4157737 - RNA, 22 nt, Yersinia pestis
ugccauggaauuuaugcaccaa

SEQ ID NO: 4157738 - RNA, 22 nt, Yersinia pestis
ugccauggcgaaaauccuucau

SEQ ID NO: 4157739 - RNA, 15 nt, Yersinia pestis
ugccauggucaguuu

SEQ ID NO: 4157740 - RNA, 15 nt, Yersinia pestis
ugccaugucggcagg

SEQ ID NO: 4157741 - RNA, 20 nt, Yersinia pestis
ugccauugcucauguucgca

SEQ ID NO: 4157742 - RNA, 23 nt, Yersinia pestis
ugccauuuauugcggcuuagcca

SEQ ID NO: 4157743 - RNA, 18 nt, Yersinia pestis
ugcccaauggcaaaacag

SEQ ID NO: 4157744 - RNA, 16 nt, Yersinia pestis
ugcccagccucuggau

SEQ ID NO: 4157745 - RNA, 17 nt, Yersinia pestis
ugcccagccugguuuuu

SEQ ID NO: 4157746 - RNA, 21 nt, Yersinia pestis
ugcccagucacuaccgcucag

SEQ ID NO: 4157747 - RNA, 19 nt, Yersinia pestis
ugcccaguuuaccauccac

SEQ ID NO: 4157748 - RNA, 12 nt, Yersinia pestis
ugcccaucaacc

SEQ ID NO: 4157749 - RNA, 21 nt, Yersinia pestis
ugcccaucacaucgcccugag

SEQ ID NO: 4157750 - RNA, 18 nt, Yersinia pestis
ugcccaucuuuuaguaac

SEQ ID NO: 4157751 - RNA, 21 nt, Yersinia pestis
ugccccaaugaugacuugauu

SEQ ID NO: 4157752 - RNA, 22 nt, Yersinia pestis
ugccccauggcuaacauaugaa

SEQ ID NO: 4157753 - RNA, 18 nt, Yersinia pestis
ugccccuucaaagccgcu

SEQ ID NO: 4157754 - RNA, 20 nt, Yersinia pestis
ugccccuuuuuucuauuuau

SEQ ID NO: 4157755 - RNA, 21 nt, Yersinia pestis
ugcccgaucaggugaugucag

SEQ ID NO: 4157756 - RNA, 17 nt, Yersinia pestis
ugcccgcgcuuccaggc

SEQ ID NO: 4157757 - RNA, 17 nt, Yersinia pestis
ugcccguuaauauuaau

SEQ ID NO: 4157758 - RNA, 20 nt, Yersinia pestis
ugcccguuagccaugcauua

SEQ ID NO: 4157759 - RNA, 13 nt, Yersinia pestis
ugcccuaauacca

SEQ ID NO: 4157760 - RNA, 17 nt, Yersinia pestis
ugcccuaauaccaauac

SEQ ID NO: 4157761 - RNA, 17 nt, Yersinia pestis
ugcccugccugguauuu

SEQ ID NO: 4157762 - RNA, 18 nt, Yersinia pestis
ugcccuuacuauuuuucu

SEQ ID NO: 4157763 - RNA, 13 nt, Yersinia pestis
ugcccuucuucag

SEQ ID NO: 4157764 - RNA, 20 nt, Yersinia pestis
ugcccuuucucgccuaaguu

SEQ ID NO: 4157765 - RNA, 14 nt, Yersinia pestis
ugcccuuuuagccu

SEQ ID NO: 4157766 - RNA, 17 nt, Yersinia pestis
ugcccuuuuugguuuuc

SEQ ID NO: 4157767 - RNA, 14 nt, Yersinia pestis
ugccgacaaccaac

SEQ ID NO: 4157768 - RNA, 16 nt, Yersinia pestis
ugccgaugucaauaaa

SEQ ID NO: 4157769 - RNA, 21 nt, Yersinia pestis
ugccgcccugcucaaucgaau

SEQ ID NO: 4157770 - RNA, 23 nt, Yersinia pestis
ugccgcccugcucaaucgaaugc

SEQ ID NO: 4157771 - RNA, 13 nt, Yersinia pestis
ugccgccucugcu

SEQ ID NO: 4157772 - RNA, 14 nt, Yersinia pestis
ugccgccucugcuc

SEQ ID NO: 4157773 - RNA, 19 nt, Yersinia pestis
ugccgccucugcuccggua

SEQ ID NO: 4157774 - RNA, 18 nt, Yersinia pestis
ugccgcggcggccagcgg

SEQ ID NO: 4157775 - RNA, 19 nt, Yersinia pestis
ugccgcuaccauaguugaa

SEQ ID NO: 4157776 - RNA, 15 nt, Yersinia pestis
ugccgcucaugcccc

SEQ ID NO: 4157777 - RNA, 17 nt, Yersinia pestis
ugccgcuucaguaagaa

SEQ ID NO: 4157778 - RNA, 14 nt, Yersinia pestis
ugccgcuugcuuug

SEQ ID NO: 4157779 - RNA, 18 nt, Yersinia pestis
ugccgcuuguugccaccc

SEQ ID NO: 4157780 - RNA, 20 nt, Yersinia pestis
ugccgcuuguugccacccua

SEQ ID NO: 4157781 - RNA, 20 nt, Yersinia pestis
ugccggaagagaagcagcgg

SEQ ID NO: 4157782 - RNA, 21 nt, Yersinia pestis
ugccggcguuaaugccacccc

SEQ ID NO: 4157783 - RNA, 21 nt, Yersinia pestis
ugccguaaaauuuaaaguaaa

SEQ ID NO: 4157784 - RNA, 14 nt, Yersinia pestis
ugccguacaacaau

SEQ ID NO: 4157785 - RNA, 16 nt, Yersinia pestis
ugccguacaacaauaa

SEQ ID NO: 4157786 - RNA, 18 nt, Yersinia pestis
ugccguacaacaauaaua

SEQ ID NO: 4157787 - RNA, 22 nt, Yersinia pestis
ugccguaucuuguaguaaccac

SEQ ID NO: 4157788 - RNA, 20 nt, Yersinia pestis
ugccguauucagcaguguga

SEQ ID NO: 4157789 - RNA, 15 nt, Yersinia pestis
ugccgugucuuccag

SEQ ID NO: 4157790 - RNA, 15 nt, Yersinia pestis
ugccguuaaaggccc

SEQ ID NO: 4157791 - RNA, 16 nt, Yersinia pestis
ugccuacgcuggcgca

SEQ ID NO: 4157792 - RNA, 16 nt, Yersinia pestis
ugccuacuggccacuu

SEQ ID NO: 4157793 - RNA, 13 nt, Yersinia pestis
ugccucggucuga

SEQ ID NO: 4157794 - RNA, 15 nt, Yersinia pestis
ugccugcaccagugc

SEQ ID NO: 4157795 - RNA, 16 nt, Yersinia pestis
ugccugcaccagugcc

SEQ ID NO: 4157796 - RNA, 17 nt, Yersinia pestis
ugccugccugcugcucc

SEQ ID NO: 4157797 - RNA, 21 nt, Yersinia pestis
ugccugguauuuucuauacca

SEQ ID NO: 4157798 - RNA, 15 nt, Yersinia pestis
ugccuggugcaaccg

SEQ ID NO: 4157799 - RNA, 18 nt, Yersinia pestis
ugccugugccauaucgcc

SEQ ID NO: 4157800 - RNA, 14 nt, Yersinia pestis
ugcucauuuaaaau

SEQ ID NO: 4157801 - RNA, 22 nt, Yersinia pestis
ugcuccagaggguaugacauuc

SEQ ID NO: 4157802 - RNA, 21 nt, Yersinia pestis
ugcuccaguugauacaggaaa

SEQ ID NO: 4157803 - RNA, 21 nt, Yersinia pestis
ugcuccaucuuuuacaaauuu

SEQ ID NO: 4157804 - RNA, 17 nt, Yersinia pestis
ugcuccgcaauuugccc

SEQ ID NO: 4157805 - RNA, 16 nt, Yersinia pestis
ugcuccgccuuccgcc

SEQ ID NO: 4157806 - RNA, 18 nt, Yersinia pestis
ugcuccuuacuauuuuca

SEQ ID NO: 4157807 - RNA, 21 nt, Yersinia pestis
ugcuccuuacuauuuucauug

SEQ ID NO: 4157808 - RNA, 14 nt, Yersinia pestis
ugcucgagcaccag

SEQ ID NO: 4157809 - RNA, 19 nt, Yersinia pestis
ugcucgcccaagcggcugg

SEQ ID NO: 4157810 - RNA, 16 nt, Yersinia pestis
ugcucggcuaaacggu

SEQ ID NO: 4157811 - RNA, 21 nt, Yersinia pestis
ugcucucgagaaauaaauacu

SEQ ID NO: 4157812 - RNA, 16 nt, Yersinia pestis
ugcucuucaccaaagg

SEQ ID NO: 4157813 - RNA, 20 nt, Yersinia pestis
ugcucuucaccaaaggaagc

SEQ ID NO: 4157814 - RNA, 17 nt, Yersinia pestis
ugcucuucauaagccag

SEQ ID NO: 4157815 - RNA, 23 nt, Yersinia pestis
ugcucuucauaagccagugcuau

SEQ ID NO: 4157816 - RNA, 20 nt, Yersinia pestis
ugcucuugaguguccacaua

SEQ ID NO: 4157817 - RNA, 15 nt, Yersinia pestis
ugcugaaaaaugagu

SEQ ID NO: 4157818 - RNA, 17 nt, Yersinia pestis
ugcugaaaaucaugaaa

SEQ ID NO: 4157819 - RNA, 19 nt, Yersinia pestis
ugcugaaaaucaugaaauu

SEQ ID NO: 4157820 - RNA, 13 nt, Yersinia pestis
ugcugaacuugcu

SEQ ID NO: 4157821 - RNA, 13 nt, Yersinia pestis
ugcugacaaaccc

SEQ ID NO: 4157822 - RNA, 21 nt, Yersinia pestis
ugcugacaaaguuaaaugaag

SEQ ID NO: 4157823 - RNA, 22 nt, Yersinia pestis
ugcugacaaaguuaaaugaagg

SEQ ID NO: 4157824 - RNA, 15 nt, Yersinia pestis
ugcugagugaagaca

SEQ ID NO: 4157825 - RNA, 17 nt, Yersinia pestis
ugcugagugaagacauc

SEQ ID NO: 4157826 - RNA, 21 nt, Yersinia pestis
ugcugaucaccgugccaaaaa

SEQ ID NO: 4157827 - RNA, 16 nt, Yersinia pestis
ugcugaugauuuuggu

SEQ ID NO: 4157828 - RNA, 14 nt, Yersinia pestis
ugcugaugcccauc

SEQ ID NO: 4157829 - RNA, 22 nt, Yersinia pestis
ugcugcaagaguccagcacugg

SEQ ID NO: 4157830 - RNA, 16 nt, Yersinia pestis
ugcugcaccucugcug

SEQ ID NO: 4157831 - RNA, 16 nt, Yersinia pestis
ugcugcccaaccgcau

SEQ ID NO: 4157832 - RNA, 17 nt, Yersinia pestis
ugcugccugcaccagug

SEQ ID NO: 4157833 - RNA, 16 nt, Yersinia pestis
ugcugccugccugcug

SEQ ID NO: 4157834 - RNA, 14 nt, Yersinia pestis
ugcugccuugcugc

SEQ ID NO: 4157835 - RNA, 16 nt, Yersinia pestis
ugcugcgggcacuauc

SEQ ID NO: 4157836 - RNA, 20 nt, Yersinia pestis
ugcugcuguggcacuaucug

SEQ ID NO: 4157837 - RNA, 12 nt, Yersinia pestis
ugcugcuguuau

SEQ ID NO: 4157838 - RNA, 13 nt, Yersinia pestis
ugcugcuguuauu

SEQ ID NO: 4157839 - RNA, 13 nt, Yersinia pestis
ugcugcuuccugc

SEQ ID NO: 4157840 - RNA, 14 nt, Yersinia pestis
ugcugcuuccugcu

SEQ ID NO: 4157841 - RNA, 19 nt, Yersinia pestis
ugcuggaaugcagugccac

SEQ ID NO: 4157842 - RNA, 21 nt, Yersinia pestis
ugcuggagcauugcgcucuga

SEQ ID NO: 4157843 - RNA, 16 nt, Yersinia pestis
ugcuggaggcuggcag

SEQ ID NO: 4157844 - RNA, 13 nt, Yersinia pestis
ugcuggcaacagc

SEQ ID NO: 4157845 - RNA, 20 nt, Yersinia pestis
ugcuggcaguggcggcaaaa

SEQ ID NO: 4157846 - RNA, 16 nt, Yersinia pestis
ugcuggccaacugcgc

SEQ ID NO: 4157847 - RNA, 22 nt, Yersinia pestis
ugcuggcggauaacggcggcaa

SEQ ID NO: 4157848 - RNA, 12 nt, Yersinia pestis
ugcuggcggcuu

SEQ ID NO: 4157849 - RNA, 17 nt, Yersinia pestis
ugcuggcggcuuuuauc

SEQ ID NO: 4157850 - RNA, 17 nt, Yersinia pestis
ugcuggggacuuuucuu

SEQ ID NO: 4157851 - RNA, 17 nt, Yersinia pestis
ugcuggugggccugcug

SEQ ID NO: 4157852 - RNA, 14 nt, Yersinia pestis
ugcuggugucacaa

SEQ ID NO: 4157853 - RNA, 22 nt, Yersinia pestis
ugcugucauuggugcugaugau

SEQ ID NO: 4157854 - RNA, 16 nt, Yersinia pestis
ugcugugcgauuucac

SEQ ID NO: 4157855 - RNA, 20 nt, Yersinia pestis
ugcugugguugauccgaguu

SEQ ID NO: 4157856 - RNA, 18 nt, Yersinia pestis
ugcuguuacgcacaaaca

SEQ ID NO: 4157857 - RNA, 23 nt, Yersinia pestis
ugcuguuaguaacuguaaggcca

SEQ ID NO: 4157858 - RNA, 14 nt, Yersinia pestis
ugcuguuauuacug

SEQ ID NO: 4157859 - RNA, 13 nt, Yersinia pestis
ugcuguuccaacc

SEQ ID NO: 4157860 - RNA, 12 nt, Yersinia pestis
ugcuuaaaacag

SEQ ID NO: 4157861 - RNA, 13 nt, Yersinia pestis
ugcuuaaaacagg

SEQ ID NO: 4157862 - RNA, 23 nt, Yersinia pestis
ugcuuaaaacaggcgaguuuccc

SEQ ID NO: 4157863 - RNA, 13 nt, Yersinia pestis
ugcuuaccuuguu

SEQ ID NO: 4157864 - RNA, 22 nt, Yersinia pestis
ugcuuaccuuguuuguuacugc

SEQ ID NO: 4157865 - RNA, 18 nt, Yersinia pestis
ugcuuacuggccuggcau

SEQ ID NO: 4157866 - RNA, 13 nt, Yersinia pestis
ugcuuauccagcc

SEQ ID NO: 4157867 - RNA, 19 nt, Yersinia pestis
ugcuucaaagaagacaucu

SEQ ID NO: 4157868 - RNA, 19 nt, Yersinia pestis
ugcuucaaauccucggguu

SEQ ID NO: 4157869 - RNA, 13 nt, Yersinia pestis
ugcuucacaucau

SEQ ID NO: 4157870 - RNA, 11 nt, Yersinia pestis
ugcuucagaca

SEQ ID NO: 4157871 - RNA, 14 nt, Yersinia pestis
ugcuuccaacucac

SEQ ID NO: 4157872 - RNA, 18 nt, Yersinia pestis
ugcuuccaacucaccuaa

SEQ ID NO: 4157873 - RNA, 21 nt, Yersinia pestis
ugcuugaaagcaccgcccccu

SEQ ID NO: 4157874 - RNA, 15 nt, Yersinia pestis
ugcuugauggcauca

SEQ ID NO: 4157875 - RNA, 14 nt, Yersinia pestis
ugcuugauguuuuc

SEQ ID NO: 4157876 - RNA, 22 nt, Yersinia pestis
ugcuugcgcguuaaucugcugc

SEQ ID NO: 4157877 - RNA, 11 nt, Yersinia pestis
ugcuugcugcc

SEQ ID NO: 4157878 - RNA, 12 nt, Yersinia pestis
ugcuugcugccu

SEQ ID NO: 4157879 - RNA, 21 nt, Yersinia pestis
ugcuugcugccugccugcugc

SEQ ID NO: 4157880 - RNA, 22 nt, Yersinia pestis
ugcuuggauuccgucgccaaca

SEQ ID NO: 4157881 - RNA, 22 nt, Yersinia pestis
ugcuugguuacgggcuugcugc

SEQ ID NO: 4157882 - RNA, 23 nt, Yersinia pestis
ugcuugguuacgggcuugcugca

SEQ ID NO: 4157883 - RNA, 13 nt, Yersinia pestis
ugcuuguuauuuu

SEQ ID NO: 4157884 - RNA, 14 nt, Yersinia pestis
ugcuuuaaaggcuu

SEQ ID NO: 4157885 - RNA, 21 nt, Yersinia pestis
ugcuuuaaugaguuggcauuc

SEQ ID NO: 4157886 - RNA, 18 nt, Yersinia pestis
ugcuuuauuggcuacagg

SEQ ID NO: 4157887 - RNA, 17 nt, Yersinia pestis
ugcuuucagauaaugcc

SEQ ID NO: 4157888 - RNA, 14 nt, Yersinia pestis
ugcuuuucugccua

SEQ ID NO: 4157889 - RNA, 21 nt, Yersinia pestis
ugcuuuuuauugucucuacuc

SEQ ID NO: 4157890 - RNA, 19 nt, Yersinia pestis
ugcuuuuugcaucgcuucu

SEQ ID NO: 4157891 - RNA, 18 nt, Yersinia pestis
ugcuuuuugccagugguu

SEQ ID NO: 4157892 - RNA, 16 nt, Yersinia pestis
ugcuuuuugcgcugcg

SEQ ID NO: 4157893 - RNA, 20 nt, Yersinia pestis
ugcuuuuugcuguucuaucu

SEQ ID NO: 4157894 - RNA, 13 nt, Yersinia pestis
ugcuuuuugcuuu

SEQ ID NO: 4157895 - RNA, 18 nt, Yersinia pestis
ugcuuuuugcuuuuugcu

SEQ ID NO: 4157896 - RNA, 13 nt, Yersinia pestis
uggaaaaacugaa

SEQ ID NO: 4157897 - RNA, 21 nt, Yersinia pestis
uggaaaaauuagccaagcaac

SEQ ID NO: 4157898 - RNA, 18 nt, Yersinia pestis
uggaaacucuaaggguaa

SEQ ID NO: 4157899 - RNA, 20 nt, Yersinia pestis
uggaacgaagccgcagagau

SEQ ID NO: 4157900 - RNA, 18 nt, Yersinia pestis
uggaacguugcacccugc

SEQ ID NO: 4157901 - RNA, 14 nt, Yersinia pestis
uggaagaccagaua

SEQ ID NO: 4157902 - RNA, 12 nt, Yersinia pestis
uggaagagccug

SEQ ID NO: 4157903 - RNA, 21 nt, Yersinia pestis
uggaauaguguguguauuuaa

SEQ ID NO: 4157904 - RNA, 14 nt, Yersinia pestis
uggaauccaaguuc

SEQ ID NO: 4157905 - RNA, 14 nt, Yersinia pestis
uggaaugaguuuaa

SEQ ID NO: 4157906 - RNA, 16 nt, Yersinia pestis
uggaaugaguuuaagu

SEQ ID NO: 4157907 - RNA, 17 nt, Yersinia pestis
uggaaugaguuuaaguc

SEQ ID NO: 4157908 - RNA, 13 nt, Yersinia pestis
uggaauuaauauc

SEQ ID NO: 4157909 - RNA, 16 nt, Yersinia pestis
uggaauucgacaauga

SEQ ID NO: 4157910 - RNA, 16 nt, Yersinia pestis
uggaauuuaugcacca

SEQ ID NO: 4157911 - RNA, 14 nt, Yersinia pestis
uggacaucugcuuu

SEQ ID NO: 4157912 - RNA, 19 nt, Yersinia pestis
uggacccgucaccacaaag

SEQ ID NO: 4157913 - RNA, 18 nt, Yersinia pestis
uggacgcuggcagccuuu

SEQ ID NO: 4157914 - RNA, 18 nt, Yersinia pestis
uggacggaacacguuuaa

SEQ ID NO: 4157915 - RNA, 15 nt, Yersinia pestis
uggacguuugcugcu

SEQ ID NO: 4157916 - RNA, 19 nt, Yersinia pestis
uggacuacacagacuggug

SEQ ID NO: 4157917 - RNA, 12 nt, Yersinia pestis
uggagagcaggg

SEQ ID NO: 4157918 - RNA, 21 nt, Yersinia pestis
uggagagcagggcccgccauu

SEQ ID NO: 4157919 - RNA, 18 nt, Yersinia pestis
uggagcaaaugaacgcga

SEQ ID NO: 4157920 - RNA, 20 nt, Yersinia pestis
uggagccauaaguaaagcga

SEQ ID NO: 4157921 - RNA, 16 nt, Yersinia pestis
uggagcuauggaagaa

SEQ ID NO: 4157922 - RNA, 19 nt, Yersinia pestis
uggcuuuuuuguuuuuaua

SEQ ID NO: 4157923 - RNA, 23 nt, Yersinia pestis
uggcuuuuuuguuuuuauaucaa

SEQ ID NO: 4157924 - RNA, 21 nt, Yersinia pestis
ugggaaaaguggcuaucugaa

SEQ ID NO: 4157925 - RNA, 22 nt, Yersinia pestis
ugggaaaaguggcuaucugaaa

SEQ ID NO: 4157926 - RNA, 12 nt, Yersinia pestis
ugggaacaacag

SEQ ID NO: 4157927 - RNA, 16 nt, Yersinia pestis
ugggacuuuaucugcc

SEQ ID NO: 4157928 - RNA, 12 nt, Yersinia pestis
ugggauaucugc

SEQ ID NO: 4157929 - RNA, 21 nt, Yersinia pestis
ugggaucucacuaaaccaggu

SEQ ID NO: 4157930 - RNA, 19 nt, Yersinia pestis
ugggauuaauaaugguggg

SEQ ID NO: 4157931 - RNA, 17 nt, Yersinia pestis
ugggcaaagaauugagg

SEQ ID NO: 4157932 - RNA, 16 nt, Yersinia pestis
ugggcaagcucugggc

SEQ ID NO: 4157933 - RNA, 14 nt, Yersinia pestis
ugggcaaucuccag

SEQ ID NO: 4157934 - RNA, 19 nt, Yersinia pestis
ugggcagggcgcaauggcg

SEQ ID NO: 4157935 - RNA, 21 nt, Yersinia pestis
ugggccacgaugugaagcaau

SEQ ID NO: 4157936 - RNA, 17 nt, Yersinia pestis
ugggccgacucugcaug

SEQ ID NO: 4157937 - RNA, 14 nt, Yersinia pestis
ugggccucaucugc

SEQ ID NO: 4157938 - RNA, 22 nt, Yersinia pestis
ugggcgacaaucaauggccagc

SEQ ID NO: 4157939 - RNA, 21 nt, Yersinia pestis
ugggcgcauaaaaugagccug

SEQ ID NO: 4157940 - RNA, 16 nt, Yersinia pestis
ugggcgggaucuccag

SEQ ID NO: 4157941 - RNA, 17 nt, Yersinia pestis
ugggcgggcaccaugcc

SEQ ID NO: 4157942 - RNA, 20 nt, Yersinia pestis
ugggcgguaguauuuguagu

SEQ ID NO: 4157943 - RNA, 19 nt, Yersinia pestis
ugggcguauccacacccuc

SEQ ID NO: 4157944 - RNA, 20 nt, Yersinia pestis
ugggcuaaaacucaaauaga

SEQ ID NO: 4157945 - RNA, 21 nt, Yersinia pestis
ugggcuaaccagugucuggca

SEQ ID NO: 4157946 - RNA, 18 nt, Yersinia pestis
ugggcuaucgccuucauc

SEQ ID NO: 4157947 - RNA, 20 nt, Yersinia pestis
ugggcuucacauccaauggc

SEQ ID NO: 4157948 - RNA, 15 nt, Yersinia pestis
ugggcuugagcagug

SEQ ID NO: 4157949 - RNA, 18 nt, Yersinia pestis
uggggacaggcuccuccu

SEQ ID NO: 4157950 - RNA, 15 nt, Yersinia pestis
uggggagaucagugc

SEQ ID NO: 4157951 - RNA, 11 nt, Yersinia pestis
uggggccaccu

SEQ ID NO: 4157952 - RNA, 21 nt, Yersinia pestis
uggggccaccuaauccaaggc

SEQ ID NO: 4157953 - RNA, 20 nt, Yersinia pestis
uggggcugccaguaaaauca

SEQ ID NO: 4157954 - RNA, 14 nt, Yersinia pestis
ugggggucagggcg

SEQ ID NO: 4157955 - RNA, 19 nt, Yersinia pestis
ugggguauauauuuuuaau

SEQ ID NO: 4157956 - RNA, 15 nt, Yersinia pestis
uggguaaaccaauca

SEQ ID NO: 4157957 - RNA, 21 nt, Yersinia pestis
uggguaaaccaaucaagcaua

SEQ ID NO: 4157958 - RNA, 18 nt, Yersinia pestis
uggguaaaccuugcugau

SEQ ID NO: 4157959 - RNA, 23 nt, Yersinia pestis
uggguaacauguagcacacuacc

SEQ ID NO: 4157960 - RNA, 15 nt, Yersinia pestis
uggguagacauggca

SEQ ID NO: 4157961 - RNA, 17 nt, Yersinia pestis
uggguagcagcccaaca

SEQ ID NO: 4157962 - RNA, 23 nt, Yersinia pestis
uggguauauaguuuauuuuauuu

SEQ ID NO: 4157963 - RNA, 15 nt, Yersinia pestis
uggguauaugacugu

SEQ ID NO: 4157964 - RNA, 15 nt, Yersinia pestis
uggguauggucagca

SEQ ID NO: 4157965 - RNA, 22 nt, Yersinia pestis
uggguauggucagcaauaacca

SEQ ID NO: 4157966 - RNA, 15 nt, Yersinia pestis
ugggucaucacccag

SEQ ID NO: 4157967 - RNA, 13 nt, Yersinia pestis
ugggucgccuugc

SEQ ID NO: 4157968 - RNA, 22 nt, Yersinia pestis
ugggucgccuugccgcuguugu

SEQ ID NO: 4157969 - RNA, 15 nt, Yersinia pestis
ugggugaaagcuaau

SEQ ID NO: 4157970 - RNA, 16 nt, Yersinia pestis
ugggugaaagcuaaua

SEQ ID NO: 4157971 - RNA, 18 nt, Yersinia pestis
ugggugauguccuguugu

SEQ ID NO: 4157972 - RNA, 17 nt, Yersinia pestis
ugggugaugugacguca

SEQ ID NO: 4157973 - RNA, 22 nt, Yersinia pestis
ugggugccucaacgcaccccac

SEQ ID NO: 4157974 - RNA, 17 nt, Yersinia pestis
ugggugcugcucccgua

SEQ ID NO: 4157975 - RNA, 12 nt, Yersinia pestis
uggguggccagu

SEQ ID NO: 4157976 - RNA, 18 nt, Yersinia pestis
ugggugucaggaagcaag

SEQ ID NO: 4157977 - RNA, 17 nt, Yersinia pestis
uggguuaaaaacuuuua

SEQ ID NO: 4157978 - RNA, 21 nt, Yersinia pestis
uggguuaaauugcgggcuggg

SEQ ID NO: 4157979 - RNA, 13 nt, Yersinia pestis
uggguuaaugcug

SEQ ID NO: 4157980 - RNA, 17 nt, Yersinia pestis
uggguuacauccugaau

SEQ ID NO: 4157981 - RNA, 20 nt, Yersinia pestis
uggguuaccgccagaacacu

SEQ ID NO: 4157982 - RNA, 22 nt, Yersinia pestis
uggguuugguuauuaugauugg

SEQ ID NO: 4157983 - RNA, 20 nt, Yersinia pestis
ugguaaauuccuauaaauuu

SEQ ID NO: 4157984 - RNA, 15 nt, Yersinia pestis
ugguaacagagccuu

SEQ ID NO: 4157985 - RNA, 17 nt, Yersinia pestis
ugguaacagagccuuau

SEQ ID NO: 4157986 - RNA, 20 nt, Yersinia pestis
ugguaaccgguuugggcagg

SEQ ID NO: 4157987 - RNA, 21 nt, Yersinia pestis
ugguaacguucgcguggcaga

SEQ ID NO: 4157988 - RNA, 15 nt, Yersinia pestis
ugguaagguuucaaa

SEQ ID NO: 4157989 - RNA, 13 nt, Yersinia pestis
ugguaagucuuau

SEQ ID NO: 4157990 - RNA, 22 nt, Yersinia pestis
ugguaaugcgcaccagcucaau

SEQ ID NO: 4157991 - RNA, 18 nt, Yersinia pestis
ugguaccaaacaacaaca

SEQ ID NO: 4157992 - RNA, 21 nt, Yersinia pestis
ugguaccccgugcuuugccuu

SEQ ID NO: 4157993 - RNA, 17 nt, Yersinia pestis
ugguaccgauaaaagua

SEQ ID NO: 4157994 - RNA, 18 nt, Yersinia pestis
ugguaccugcaucaucac

SEQ ID NO: 4157995 - RNA, 15 nt, Yersinia pestis
ugguacuugacgcug

SEQ ID NO: 4157996 - RNA, 17 nt, Yersinia pestis
ugguauagacuguuuua

SEQ ID NO: 4157997 - RNA, 20 nt, Yersinia pestis
ugguauagacuguuuuauua

SEQ ID NO: 4157998 - RNA, 22 nt, Yersinia pestis
ugguauagacuguuuuauuaua

SEQ ID NO: 4157999 - RNA, 17 nt, Yersinia pestis
uggucaauaaaauuaac

SEQ ID NO: 4158000 - RNA, 22 nt, Yersinia pestis
uggucacuguaguaaagcagca

SEQ ID NO: 4158001 - RNA, 24 nt, Yersinia pestis
uggucacuguaguaaagcagcauc

SEQ ID NO: 4158002 - RNA, 21 nt, Yersinia pestis
uggucagcaauaaccaacggg

SEQ ID NO: 4158003 - RNA, 16 nt, Yersinia pestis
uggucagcacaaacag

SEQ ID NO: 4158004 - RNA, 19 nt, Yersinia pestis
uggucaguauaaauugccc

SEQ ID NO: 4158005 - RNA, 18 nt, Yersinia pestis
uggucaguugaauauucc

SEQ ID NO: 4158006 - RNA, 17 nt, Yersinia pestis
uggucauauaccgccac

SEQ ID NO: 4158007 - RNA, 13 nt, Yersinia pestis
uggucauccacaa

SEQ ID NO: 4158008 - RNA, 18 nt, Yersinia pestis
uggucauccacaaccaga

SEQ ID NO: 4158009 - RNA, 14 nt, Yersinia pestis
uggucaugcacagu

SEQ ID NO: 4158010 - RNA, 14 nt, Yersinia pestis
uggucauuuuuccc

SEQ ID NO: 4158011 - RNA, 16 nt, Yersinia pestis
uggucauuuuucccuu

SEQ ID NO: 4158012 - RNA, 15 nt, Yersinia pestis
ugguccccagagcgc

SEQ ID NO: 4158013 - RNA, 21 nt, Yersinia pestis
uggucgccagauugacauuca

SEQ ID NO: 4158014 - RNA, 17 nt, Yersinia pestis
uggucuuggucauaccg

SEQ ID NO: 4158015 - RNA, 13 nt, Yersinia pestis
uggugaaaaauga

SEQ ID NO: 4158016 - RNA, 17 nt, Yersinia pestis
uggugaaccagauaaca

SEQ ID NO: 4158017 - RNA, 17 nt, Yersinia pestis
uggugacccgucagcgu

SEQ ID NO: 4158018 - RNA, 17 nt, Yersinia pestis
uggugaguaaaugcccc

SEQ ID NO: 4158019 - RNA, 20 nt, Yersinia pestis
uggugaguaaaugccccauu

SEQ ID NO: 4158020 - RNA, 15 nt, Yersinia pestis
uggugauaccacccg

SEQ ID NO: 4158021 - RNA, 15 nt, Yersinia pestis
uggugauacccagca

SEQ ID NO: 4158022 - RNA, 20 nt, Yersinia pestis
uggugaugaugacggugaug

SEQ ID NO: 4158023 - RNA, 15 nt, Yersinia pestis
uggugaugcugcugg

SEQ ID NO: 4158024 - RNA, 11 nt, Yersinia pestis
uggugcaaccg

SEQ ID NO: 4158025 - RNA, 20 nt, Yersinia pestis
ugguggauaaaaaacgggcu

SEQ ID NO: 4158026 - RNA, 20 nt, Yersinia pestis
ugguggcgucaaagcggugg

SEQ ID NO: 4158027 - RNA, 13 nt, Yersinia pestis
ugguggcugagac

SEQ ID NO: 4158028 - RNA, 19 nt, Yersinia pestis
ugguggcuugggcuucaca

SEQ ID NO: 4158029 - RNA, 14 nt, Yersinia pestis
uggugggaucucac

SEQ ID NO: 4158030 - RNA, 21 nt, Yersinia pestis
uggugguaccugcaucaucac

SEQ ID NO: 4158031 - RNA, 13 nt, Yersinia pestis
uggugguggccug

SEQ ID NO: 4158032 - RNA, 14 nt, Yersinia pestis
ugguuaacagcgug

SEQ ID NO: 4158033 - RNA, 18 nt, Yersinia pestis
ugguuaacuuauagcuca

SEQ ID NO: 4158034 - RNA, 13 nt, Yersinia pestis
ugguuaaucuacc

SEQ ID NO: 4158035 - RNA, 15 nt, Yersinia pestis
ugguuaaucuacccg

SEQ ID NO: 4158036 - RNA, 20 nt, Yersinia pestis
ugguucacggaaaguagcca

SEQ ID NO: 4158037 - RNA, 22 nt, Yersinia pestis
ugguucacggaaaguagccauu

SEQ ID NO: 4158038 - RNA, 22 nt, Yersinia pestis
ugguucauuuuccaguuucauc

SEQ ID NO: 4158039 - RNA, 15 nt, Yersinia pestis
ugguugaguuuaugg

SEQ ID NO: 4158040 - RNA, 16 nt, Yersinia pestis
ugguugccagauaaug

SEQ ID NO: 4158041 - RNA, 18 nt, Yersinia pestis
ugguugccagauaauguu

SEQ ID NO: 4158042 - RNA, 15 nt, Yersinia pestis
ugguuggcaccacgg

SEQ ID NO: 4158043 - RNA, 15 nt, Yersinia pestis
ugucagggcaauaac

SEQ ID NO: 4158044 - RNA, 22 nt, Yersinia pestis
ugucagggcuaagcaggaagau

SEQ ID NO: 4158045 - RNA, 17 nt, Yersinia pestis
ugucaucgcuaaauacu

SEQ ID NO: 4158046 - RNA, 14 nt, Yersinia pestis
ugucaugcaauuac

SEQ ID NO: 4158047 - RNA, 19 nt, Yersinia pestis
ugucauguugaccaaacag

SEQ ID NO: 4158048 - RNA, 18 nt, Yersinia pestis
ugucauuuccuccgcuuu

SEQ ID NO: 4158049 - RNA, 20 nt, Yersinia pestis
ugucauuuccuguauuuccu

SEQ ID NO: 4158050 - RNA, 14 nt, Yersinia pestis
uguccaaaggaagg

SEQ ID NO: 4158051 - RNA, 12 nt, Yersinia pestis
uguccaagaagc

SEQ ID NO: 4158052 - RNA, 14 nt, Yersinia pestis
uguccacauagcug

SEQ ID NO: 4158053 - RNA, 18 nt, Yersinia pestis
uguccacugaccagcggu

SEQ ID NO: 4158054 - RNA, 13 nt, Yersinia pestis
uguccaguuauca

SEQ ID NO: 4158055 - RNA, 15 nt, Yersinia pestis
ugucccgaugauugc

SEQ ID NO: 4158056 - RNA, 18 nt, Yersinia pestis
uguccggagagagacuuu

SEQ ID NO: 4158057 - RNA, 19 nt, Yersinia pestis
uguccggguuuacccagcc

SEQ ID NO: 4158058 - RNA, 15 nt, Yersinia pestis
uguccguguuggcaa

SEQ ID NO: 4158059 - RNA, 18 nt, Yersinia pestis
uguccuuuuuucugcaaa

SEQ ID NO: 4158060 - RNA, 19 nt, Yersinia pestis
ugucgauccgauaauaauu

SEQ ID NO: 4158061 - RNA, 21 nt, Yersinia pestis
ugucgauccgauaauaauucc

SEQ ID NO: 4158062 - RNA, 18 nt, Yersinia pestis
ugucgcccgucuggcagg

SEQ ID NO: 4158063 - RNA, 14 nt, Yersinia pestis
ugucgcuauuuccg

SEQ ID NO: 4158064 - RNA, 19 nt, Yersinia pestis
ugucggcagguaaugcauu

SEQ ID NO: 4158065 - RNA, 18 nt, Yersinia pestis
ugucggcgaugaaaaaca

SEQ ID NO: 4158066 - RNA, 18 nt, Yersinia pestis
ugucgggccaauaaaacg

SEQ ID NO: 4158067 - RNA, 22 nt, Yersinia pestis
ugucgggugguugucuauguuu

SEQ ID NO: 4158068 - RNA, 14 nt, Yersinia pestis
ugucgucacccauu

SEQ ID NO: 4158069 - RNA, 14 nt, Yersinia pestis
ugucgucccaggcc

SEQ ID NO: 4158070 - RNA, 18 nt, Yersinia pestis
ugucguuucugcuuaacu

SEQ ID NO: 4158071 - RNA, 20 nt, Yersinia pestis
ugucuaggguuauuuuauug

SEQ ID NO: 4158072 - RNA, 14 nt, Yersinia pestis
ugucuauuuucauu

SEQ ID NO: 4158073 - RNA, 20 nt, Yersinia pestis
ugucucuacucucuguuuug

SEQ ID NO: 4158074 - RNA, 19 nt, Yersinia pestis
ugucugagucgauagcuuu

SEQ ID NO: 4158075 - RNA, 13 nt, Yersinia pestis
ugucugauaaccu

SEQ ID NO: 4158076 - RNA, 19 nt, Yersinia pestis
ugucugccgcucaugcccc

SEQ ID NO: 4158077 - RNA, 13 nt, Yersinia pestis
ugucugcuguugc

SEQ ID NO: 4158078 - RNA, 14 nt, Yersinia pestis
ugucuggcaaucca

SEQ ID NO: 4158079 - RNA, 21 nt, Yersinia pestis
ugucuuaggugacaggcaaag

SEQ ID NO: 4158080 - RNA, 21 nt, Yersinia pestis
ugucuuaucauuaaccgccgc

SEQ ID NO: 4158081 - RNA, 22 nt, Yersinia pestis
ugucuuaugauauagcuguuug

SEQ ID NO: 4158082 - RNA, 23 nt, Yersinia pestis
ugucuugccagcggcggccaucc

SEQ ID NO: 4158083 - RNA, 16 nt, Yersinia pestis
ugucuuuaauaaaauc

SEQ ID NO: 4158084 - RNA, 16 nt, Yersinia pestis
ugucuuuggacagucu

SEQ ID NO: 4158085 - RNA, 16 nt, Yersinia pestis
ugucuuuuucuuuuua

SEQ ID NO: 4158086 - RNA, 13 nt, Yersinia pestis
ugugaaauaccga

SEQ ID NO: 4158087 - RNA, 21 nt, Yersinia pestis
ugugaacguacuuugguugug

SEQ ID NO: 4158088 - RNA, 24 nt, Yersinia pestis
ugugaacguacuuugguugugauc

SEQ ID NO: 4158089 - RNA, 24 nt, Yersinia pestis
ugugaagugugcaaauaaacgcga

SEQ ID NO: 4158090 - RNA, 18 nt, Yersinia pestis
ugugaaucuuuuugcuga

SEQ ID NO: 4158091 - RNA, 22 nt, Yersinia pestis
ugugaauuagguaacuuuccau

SEQ ID NO: 4158092 - RNA, 19 nt, Yersinia pestis
ugugaauuuaucaggcuaa

SEQ ID NO: 4158093 - RNA, 16 nt, Yersinia pestis
ugugacgcuugaauau

SEQ ID NO: 4158094 - RNA, 14 nt, Yersinia pestis
ugugagagugaaug

SEQ ID NO: 4158095 - RNA, 14 nt, Yersinia pestis
ugugauaaacuguu

SEQ ID NO: 4158096 - RNA, 18 nt, Yersinia pestis
ugugauaaccguucaaga

SEQ ID NO: 4158097 - RNA, 13 nt, Yersinia pestis
ugugaucagugug

SEQ ID NO: 4158098 - RNA, 16 nt, Yersinia pestis
ugugauccagguaucc

SEQ ID NO: 4158099 - RNA, 17 nt, Yersinia pestis
ugugaugcauauuauua

SEQ ID NO: 4158100 - RNA, 16 nt, Yersinia pestis
ugugauuaagcguuaa

SEQ ID NO: 4158101 - RNA, 20 nt, Yersinia pestis
ugugauuuccaucuagcuca

SEQ ID NO: 4158102 - RNA, 15 nt, Yersinia pestis
ugugcaaaauacaaa

SEQ ID NO: 4158103 - RNA, 15 nt, Yersinia pestis
ugugcaaucaagggc

SEQ ID NO: 4158104 - RNA, 20 nt, Yersinia pestis
ugugcacucguuguauuuuc

SEQ ID NO: 4158105 - RNA, 18 nt, Yersinia pestis
ugugcauguagcugcagc

SEQ ID NO: 4158106 - RNA, 23 nt, Yersinia pestis
ugugccauaucgccagucuuucg

SEQ ID NO: 4158107 - RNA, 15 nt, Yersinia pestis
ugugcggauggcugc

SEQ ID NO: 4158108 - RNA, 15 nt, Yersinia pestis
ugugcguaaagaaaa

SEQ ID NO: 4158109 - RNA, 21 nt, Yersinia pestis
ugugcucacaaucuucuucag

SEQ ID NO: 4158110 - RNA, 17 nt, Yersinia pestis
ugugcucuauuuuuuua

SEQ ID NO: 4158111 - RNA, 19 nt, Yersinia pestis
ugugcugcuaauauuuaua

SEQ ID NO: 4158112 - RNA, 12 nt, Yersinia pestis
ugugcuucauau

SEQ ID NO: 4158113 - RNA, 17 nt, Yersinia pestis
ugugcuuuuuggcaaac

SEQ ID NO: 4158114 - RNA, 21 nt, Yersinia pestis
uguggaacaacaggcgcuuca

SEQ ID NO: 4158115 - RNA, 13 nt, Yersinia pestis
uguggaggaaggc

SEQ ID NO: 4158116 - RNA, 18 nt, Yersinia pestis
uguggaucagaccuuuac

SEQ ID NO: 4158117 - RNA, 23 nt, Yersinia pestis
uguggaucagaccuuuacaggac

SEQ ID NO: 4158118 - RNA, 16 nt, Yersinia pestis
uguggcaccaugcugc

SEQ ID NO: 4158119 - RNA, 18 nt, Yersinia pestis
uguggcaccaugcugcuu

SEQ ID NO: 4158120 - RNA, 15 nt, Yersinia pestis
uguggcgauaaaccg

SEQ ID NO: 4158121 - RNA, 18 nt, Yersinia pestis
uguggcgauuuaauccaa

SEQ ID NO: 4158122 - RNA, 16 nt, Yersinia pestis
uguggcuaauaaugca

SEQ ID NO: 4158123 - RNA, 15 nt, Yersinia pestis
ugugggcacucgcaa

SEQ ID NO: 4158124 - RNA, 19 nt, Yersinia pestis
uguggguucaucgaggaau

SEQ ID NO: 4158125 - RNA, 14 nt, Yersinia pestis
ugugguauagguau

SEQ ID NO: 4158126 - RNA, 18 nt, Yersinia pestis
ugugguuguuuuuuccca

SEQ ID NO: 4158127 - RNA, 19 nt, Yersinia pestis
uguguaauuauauuuaauu

SEQ ID NO: 4158128 - RNA, 22 nt, Yersinia pestis
uguguaauuauauuuaauuuaa

SEQ ID NO: 4158129 - RNA, 17 nt, Yersinia pestis
ugugucaauaccuuacu

SEQ ID NO: 4158130 - RNA, 16 nt, Yersinia pestis
ugugucgcuauuuccg

SEQ ID NO: 4158131 - RNA, 23 nt, Yersinia pestis
ugugugagagcgguuuauauuuu

SEQ ID NO: 4158132 - RNA, 14 nt, Yersinia pestis
uguguuuaaaucuu

SEQ ID NO: 4158133 - RNA, 13 nt, Yersinia pestis
uguguuuuggcua

SEQ ID NO: 4158134 - RNA, 21 nt, Yersinia pestis
uguguuuuugucauuuaauua

SEQ ID NO: 4158135 - RNA, 12 nt, Yersinia pestis
uguuaaaccccc

SEQ ID NO: 4158136 - RNA, 20 nt, Yersinia pestis
uguuaacauccagaccuuca

SEQ ID NO: 4158137 - RNA, 17 nt, Yersinia pestis
uguuaauccuaaugaac

SEQ ID NO: 4158138 - RNA, 14 nt, Yersinia pestis
uguuaauuuaaaca

SEQ ID NO: 4158139 - RNA, 17 nt, Yersinia pestis
uguuaccaaaaccggca

SEQ ID NO: 4158140 - RNA, 18 nt, Yersinia pestis
uguuacccgcgaucauuu

SEQ ID NO: 4158141 - RNA, 20 nt, Yersinia pestis
uguuaccuaaccaaacauug

SEQ ID NO: 4158142 - RNA, 15 nt, Yersinia pestis
uguuacugcuuaccu

SEQ ID NO: 4158143 - RNA, 13 nt, Yersinia pestis
uguuacuuuuaau

SEQ ID NO: 4158144 - RNA, 17 nt, Yersinia pestis
uguuagagagcggucuc

SEQ ID NO: 4158145 - RNA, 16 nt, Yersinia pestis
uguuagaugcuaucug

SEQ ID NO: 4158146 - RNA, 14 nt, Yersinia pestis
uguuagucuuauga

SEQ ID NO: 4158147 - RNA, 14 nt, Yersinia pestis
uguuaucaccuguc

SEQ ID NO: 4158148 - RNA, 15 nt, Yersinia pestis
uguuaucaccuguca

SEQ ID NO: 4158149 - RNA, 18 nt, Yersinia pestis
uguuauccagcgucaccg

SEQ ID NO: 4158150 - RNA, 21 nt, Yersinia pestis
uguuauccagcgucaccgaua

SEQ ID NO: 4158151 - RNA, 21 nt, Yersinia pestis
uguuaucgcuacguacuaucu

SEQ ID NO: 4158152 - RNA, 16 nt, Yersinia pestis
uguuauuaaugauaac

SEQ ID NO: 4158153 - RNA, 13 nt, Yersinia pestis
uguuauuaucaug

SEQ ID NO: 4158154 - RNA, 19 nt, Yersinia pestis
uguuauugaccaccuuauu

SEQ ID NO: 4158155 - RNA, 12 nt, Yersinia pestis
uguuauuuuucu

SEQ ID NO: 4158156 - RNA, 14 nt, Yersinia pestis
uguuauuuuucucu

SEQ ID NO: 4158157 - RNA, 14 nt, Yersinia pestis
uguucaaaaacgca

SEQ ID NO: 4158158 - RNA, 22 nt, Yersinia pestis
uguucaaaaacgcacgaaaaca

SEQ ID NO: 4158159 - RNA, 23 nt, Yersinia pestis
uguucaaaaacgcacgaaaacac

SEQ ID NO: 4158160 - RNA, 21 nt, Yersinia pestis
uguucaaaucugcuccaucaa

SEQ ID NO: 4158161 - RNA, 13 nt, Yersinia pestis
uguucacggcuuu

SEQ ID NO: 4158162 - RNA, 19 nt, Yersinia pestis
uguucagcauaaauauuca

SEQ ID NO: 4158163 - RNA, 13 nt, Yersinia pestis
uguucauaaauua

SEQ ID NO: 4158164 - RNA, 14 nt, Yersinia pestis
uguucauaaauuaa

SEQ ID NO: 4158165 - RNA, 17 nt, Yersinia pestis
uuaacacaucaaaauua

SEQ ID NO: 4158166 - RNA, 20 nt, Yersinia pestis
uuaacacauuccaguaaaaa

SEQ ID NO: 4158167 - RNA, 21 nt, Yersinia pestis
uuaacacauuccaguaaaaaa

SEQ ID NO: 4158168 - RNA, 21 nt, Yersinia pestis
uuaacacccaauaauaaaaaa

SEQ ID NO: 4158169 - RNA, 15 nt, Yersinia pestis
uuaacacgggcauga

SEQ ID NO: 4158170 - RNA, 18 nt, Yersinia pestis
uuaacagccccgucucaa

SEQ ID NO: 4158171 - RNA, 13 nt, Yersinia pestis
uuaaccaacauga

SEQ ID NO: 4158172 - RNA, 15 nt, Yersinia pestis
uuaacccaaagccau

SEQ ID NO: 4158173 - RNA, 17 nt, Yersinia pestis
uuaacccggcgacgauc

SEQ ID NO: 4158174 - RNA, 21 nt, Yersinia pestis
uuaacccuucucgugucacag

SEQ ID NO: 4158175 - RNA, 21 nt, Yersinia pestis
uuaaccgcuuggggucgcgca

SEQ ID NO: 4158176 - RNA, 17 nt, Yersinia pestis
uuaaccugcacuuucau

SEQ ID NO: 4158177 - RNA, 22 nt, Yersinia pestis
uuaacgaugaccgugacauuuu

SEQ ID NO: 4158178 - RNA, 14 nt, Yersinia pestis
uuaacgcuuuaaug

SEQ ID NO: 4158179 - RNA, 15 nt, Yersinia pestis
uuaacucaauuuugg

SEQ ID NO: 4158180 - RNA, 20 nt, Yersinia pestis
uuaacucauuuaucuaaaac

SEQ ID NO: 4158181 - RNA, 11 nt, Yersinia pestis
uuaacugcacg

SEQ ID NO: 4158182 - RNA, 11 nt, Yersinia pestis
uuaacugcagu

SEQ ID NO: 4158183 - RNA, 15 nt, Yersinia pestis
uuaacugcaguaaaa

SEQ ID NO: 4158184 - RNA, 19 nt, Yersinia pestis
uuaacugcauagcuaaccu

SEQ ID NO: 4158185 - RNA, 22 nt, Yersinia pestis
uuaacugcauagcuaaccuuaa

SEQ ID NO: 4158186 - RNA, 21 nt, Yersinia pestis
uuaacuggccaauuaacggau

SEQ ID NO: 4158187 - RNA, 12 nt, Yersinia pestis
uuaacuguuuua

SEQ ID NO: 4158188 - RNA, 17 nt, Yersinia pestis
uuaacuguuuuauauuu

SEQ ID NO: 4158189 - RNA, 18 nt, Yersinia pestis
uuaacuuuaaauccaucg

SEQ ID NO: 4158190 - RNA, 17 nt, Yersinia pestis
uuaagaaaucuauuaau

SEQ ID NO: 4158191 - RNA, 13 nt, Yersinia pestis
uuaagaagccuca

SEQ ID NO: 4158192 - RNA, 21 nt, Yersinia pestis
uuaagaauccucugaauaaaa

SEQ ID NO: 4158193 - RNA, 22 nt, Yersinia pestis
uuaagaauccucugaauaaaaa

SEQ ID NO: 4158194 - RNA, 20 nt, Yersinia pestis
uuaagacguaucgcaguuaa

SEQ ID NO: 4158195 - RNA, 14 nt, Yersinia pestis
uuaagagagaugca

SEQ ID NO: 4158196 - RNA, 16 nt, Yersinia pestis
uuaagauaauuaucca

SEQ ID NO: 4158197 - RNA, 20 nt, Yersinia pestis
uuaagauaggcagaaaagca

SEQ ID NO: 4158198 - RNA, 22 nt, Yersinia pestis
uuaagauuacguagacauaaau

SEQ ID NO: 4158199 - RNA, 21 nt, Yersinia pestis
uuaagccgcaaggauaaacga

SEQ ID NO: 4158200 - RNA, 17 nt, Yersinia pestis
uuaagcgggcuuuaaua

SEQ ID NO: 4158201 - RNA, 17 nt, Yersinia pestis
uuaagcuaauucugggu

SEQ ID NO: 4158202 - RNA, 21 nt, Yersinia pestis
uuaaggaaaaguagccaauag

SEQ ID NO: 4158203 - RNA, 15 nt, Yersinia pestis
uuaaggaaacucaug

SEQ ID NO: 4158204 - RNA, 20 nt, Yersinia pestis
uuaaggacccguuuauaaag

SEQ ID NO: 4158205 - RNA, 12 nt, Yersinia pestis
uuaaggacucuu

SEQ ID NO: 4158206 - RNA, 16 nt, Yersinia pestis
uuaaggacucuuaguu

SEQ ID NO: 4158207 - RNA, 19 nt, Yersinia pestis
uuaaggagcccucugucau

SEQ ID NO: 4158208 - RNA, 21 nt, Yersinia pestis
uuaaggauggucaacauugcu

SEQ ID NO: 4158209 - RNA, 13 nt, Yersinia pestis
uuaaggcgcgacu

SEQ ID NO: 4158210 - RNA, 15 nt, Yersinia pestis
uuaagguaacggcau

SEQ ID NO: 4158211 - RNA, 16 nt, Yersinia pestis
uuaaggucaacaacua

SEQ ID NO: 4158212 - RNA, 15 nt, Yersinia pestis
uuaagguuagcuaug

SEQ ID NO: 4158213 - RNA, 23 nt, Yersinia pestis
uuaaguaaguuuaaacuguuauu

SEQ ID NO: 4158214 - RNA, 14 nt, Yersinia pestis
uuaaguagucagca

SEQ ID NO: 4158215 - RNA, 14 nt, Yersinia pestis
uuaauaauaucaaa

SEQ ID NO: 4158216 - RNA, 20 nt, Yersinia pestis
uuaauaaucgauaaaaagaa

SEQ ID NO: 4158217 - RNA, 19 nt, Yersinia pestis
uuaauacaggcugacauuu

SEQ ID NO: 4158218 - RNA, 18 nt, Yersinia pestis
uuaauacaucaucaaaac

SEQ ID NO: 4158219 - RNA, 19 nt, Yersinia pestis
uuaauaccuuguucccgca

SEQ ID NO: 4158220 - RNA, 16 nt, Yersinia pestis
uuaauaucaaaacuga

SEQ ID NO: 4158221 - RNA, 22 nt, Yersinia pestis
uuaauaucuuuaaauuauugag

SEQ ID NO: 4158222 - RNA, 16 nt, Yersinia pestis
uuaauaugcaaaaaaa

SEQ ID NO: 4158223 - RNA, 11 nt, Yersinia pestis
uuaauauuaau

SEQ ID NO: 4158224 - RNA, 13 nt, Yersinia pestis
uuaauauuuaucu

SEQ ID NO: 4158225 - RNA, 22 nt, Yersinia pestis
uuaauauuuaucugcauuaaaa

SEQ ID NO: 4158226 - RNA, 15 nt, Yersinia pestis
uuaaucaauuaaaua

SEQ ID NO: 4158227 - RNA, 15 nt, Yersinia pestis
uuaaucaauuaauca

SEQ ID NO: 4158228 - RNA, 12 nt, Yersinia pestis
uuaaucagugac

SEQ ID NO: 4158229 - RNA, 17 nt, Yersinia pestis
uuaaucagugacaagaa

SEQ ID NO: 4158230 - RNA, 18 nt, Yersinia pestis
uuaaucaguucuuuaauc

SEQ ID NO: 4158231 - RNA, 19 nt, Yersinia pestis
uuaaucauauuuuccugca

SEQ ID NO: 4158232 - RNA, 18 nt, Yersinia pestis
uuaaucaucgacuugaug

SEQ ID NO: 4158233 - RNA, 21 nt, Yersinia pestis
uuaauccacuuuucagauagc

SEQ ID NO: 4158234 - RNA, 21 nt, Yersinia pestis
uuaauccauagugauuauuua

SEQ ID NO: 4158235 - RNA, 22 nt, Yersinia pestis
uuaaucccaccggggagcacua

SEQ ID NO: 4158236 - RNA, 22 nt, Yersinia pestis
uuaauccccaggugcuuauuua

SEQ ID NO: 4158237 - RNA, 23 nt, Yersinia pestis
uuaauccucucuugaaaugauaa

SEQ ID NO: 4158238 - RNA, 15 nt, Yersinia pestis
uuaauccuucacuua

SEQ ID NO: 4158239 - RNA, 18 nt, Yersinia pestis
uuaaucgcagcagagaau

SEQ ID NO: 4158240 - RNA, 19 nt, Yersinia pestis
uuaaucggauggucaucca

SEQ ID NO: 4158241 - RNA, 15 nt, Yersinia pestis
uuaaucguuauaaua

SEQ ID NO: 4158242 - RNA, 17 nt, Yersinia pestis
uuaaucguuauaauauu

SEQ ID NO: 4158243 - RNA, 13 nt, Yersinia pestis
uuaaucuauuaau

SEQ ID NO: 4158244 - RNA, 21 nt, Yersinia pestis
uuaaucugcccagccugguuu

SEQ ID NO: 4158245 - RNA, 12 nt, Yersinia pestis
uuaaucugcugc

SEQ ID NO: 4158246 - RNA, 13 nt, Yersinia pestis
uuaaucuuuaauu

SEQ ID NO: 4158247 - RNA, 17 nt, Yersinia pestis
uuaaugauugauuauca

SEQ ID NO: 4158248 - RNA, 11 nt, Yersinia pestis
uuaaugccccu

SEQ ID NO: 4158249 - RNA, 16 nt, Yersinia pestis
uuaaugccgcugauca

SEQ ID NO: 4158250 - RNA, 22 nt, Yersinia pestis
uuaauggcaccguggauaaaca

SEQ ID NO: 4158251 - RNA, 18 nt, Yersinia pestis
uuaaugguuuccauaaug

SEQ ID NO: 4158252 - RNA, 19 nt, Yersinia pestis
uuaauguaugguuguauuu

SEQ ID NO: 4158253 - RNA, 22 nt, Yersinia pestis
uuaauguaugguuguauuuuga

SEQ ID NO: 4158254 - RNA, 15 nt, Yersinia pestis
uuaauguuuauauug

SEQ ID NO: 4158255 - RNA, 13 nt, Yersinia pestis
uuaauuaaaaaua

SEQ ID NO: 4158256 - RNA, 16 nt, Yersinia pestis
uuaauuaaauguauaa

SEQ ID NO: 4158257 - RNA, 21 nt, Yersinia pestis
uuaauuacuuuauuuaaaauu

SEQ ID NO: 4158258 - RNA, 19 nt, Yersinia pestis
uuaauuaguuuaucaguug

SEQ ID NO: 4158259 - RNA, 16 nt, Yersinia pestis
uuaauuauuauuggug

SEQ ID NO: 4158260 - RNA, 22 nt, Yersinia pestis
uuaauucaucagauuguuuaua

SEQ ID NO: 4158261 - RNA, 12 nt, Yersinia pestis
uuaauuccaugc

SEQ ID NO: 4158262 - RNA, 21 nt, Yersinia pestis
uuaauucuggccgaugcgaca

SEQ ID NO: 4158263 - RNA, 18 nt, Yersinia pestis
uuaauuggcccauaacaa

SEQ ID NO: 4158264 - RNA, 16 nt, Yersinia pestis
uuaauuuaaacucuuu

SEQ ID NO: 4158265 - RNA, 13 nt, Yersinia pestis
uuaauuuaaauaa

SEQ ID NO: 4158266 - RNA, 17 nt, Yersinia pestis
uuaauuuaaauaaaaua

SEQ ID NO: 4158267 - RNA, 18 nt, Yersinia pestis
uuaauuuaaauaaaauaa

SEQ ID NO: 4158268 - RNA, 14 nt, Yersinia pestis
uuaauuucacuucc

SEQ ID NO: 4158269 - RNA, 22 nt, Yersinia pestis
uuaauuucagucaauaaacauu

SEQ ID NO: 4158270 - RNA, 18 nt, Yersinia pestis
uuaauuuuucauaauaau

SEQ ID NO: 4158271 - RNA, 13 nt, Yersinia pestis
uuacaauaaauca

SEQ ID NO: 4158272 - RNA, 16 nt, Yersinia pestis
uuacaauucggcuggc

SEQ ID NO: 4158273 - RNA, 23 nt, Yersinia pestis
uuacacuauaggcuauuuuacuu

SEQ ID NO: 4158274 - RNA, 22 nt, Yersinia pestis
uuacacugucgacugcuuuuca

SEQ ID NO: 4158275 - RNA, 16 nt, Yersinia pestis
uuacagacgaucggca

SEQ ID NO: 4158276 - RNA, 18 nt, Yersinia pestis
uuacagcaaggcagcaag

SEQ ID NO: 4158277 - RNA, 15 nt, Yersinia pestis
uuacagcgcaauaac

SEQ ID NO: 4158278 - RNA, 23 nt, Yersinia pestis
uuacagcuaaaggguaaccccau

SEQ ID NO: 4158279 - RNA, 19 nt, Yersinia pestis
uuacaggccccuucuggug

SEQ ID NO: 4158280 - RNA, 22 nt, Yersinia pestis
uuacauaacaccaauugcaggc

SEQ ID NO: 4158281 - RNA, 19 nt, Yersinia pestis
uuacaucaugaguaaaaga

SEQ ID NO: 4158282 - RNA, 23 nt, Yersinia pestis
uuacauugaauggugcuguauuu

SEQ ID NO: 4158283 - RNA, 10 nt, Yersinia pestis
uuacauuuug

SEQ ID NO: 4158284 - RNA, 13 nt, Yersinia pestis
uuaccaaaaagca

SEQ ID NO: 4158285 - RNA, 16 nt, Yersinia pestis
uuaccaaacauuuuca

SEQ ID NO: 4158286 - RNA, 17 nt, Yersinia pestis
uuaccacauuuccuaug

SEQ ID NO: 4158287 - RNA, 17 nt, Yersinia pestis
uuauauauccaaaauaa

SEQ ID NO: 4158288 - RNA, 12 nt, Yersinia pestis
uuauauccgcca

SEQ ID NO: 4158289 - RNA, 22 nt, Yersinia pestis
uuauauccgccauccuucaaga

SEQ ID NO: 4158290 - RNA, 15 nt, Yersinia pestis
uuauaucgaucugau

SEQ ID NO: 4158291 - RNA, 19 nt, Yersinia pestis
uuauaugcgcuggcucuau

SEQ ID NO: 4158292 - RNA, 21 nt, Yersinia pestis
uuauaugcuugacugcguucu

SEQ ID NO: 4158293 - RNA, 12 nt, Yersinia pestis
uuauauuccaca

SEQ ID NO: 4158294 - RNA, 18 nt, Yersinia pestis
uuauauugauaaaaauca

SEQ ID NO: 4158295 - RNA, 22 nt, Yersinia pestis
uuauauugaugugaaacauaau

SEQ ID NO: 4158296 - RNA, 16 nt, Yersinia pestis
uuauauugcucaguuc

SEQ ID NO: 4158297 - RNA, 20 nt, Yersinia pestis
uuaucaaagugcuuaaccca

SEQ ID NO: 4158298 - RNA, 13 nt, Yersinia pestis
uuaucaacgaaga

SEQ ID NO: 4158299 - RNA, 14 nt, Yersinia pestis
uuaucaacgaagaa

SEQ ID NO: 4158300 - RNA, 19 nt, Yersinia pestis
uuaucaagaucaaaagcag

SEQ ID NO: 4158301 - RNA, 22 nt, Yersinia pestis
uuaucaagccaaugaaucaaca

SEQ ID NO: 4158302 - RNA, 16 nt, Yersinia pestis
uuaucaauagggcaga

SEQ ID NO: 4158303 - RNA, 14 nt, Yersinia pestis
uuaucaaucaaaaa

SEQ ID NO: 4158304 - RNA, 15 nt, Yersinia pestis
uuaucaaucaaaaaa

SEQ ID NO: 4158305 - RNA, 15 nt, Yersinia pestis
uuaucaaucagcuga

SEQ ID NO: 4158306 - RNA, 13 nt, Yersinia pestis
uuaucacaucauc

SEQ ID NO: 4158307 - RNA, 18 nt, Yersinia pestis
uuaucacaucauccacua

SEQ ID NO: 4158308 - RNA, 13 nt, Yersinia pestis
uuaucacauuucg

SEQ ID NO: 4158309 - RNA, 21 nt, Yersinia pestis
uuaucaccaacguuuauaucc

SEQ ID NO: 4158310 - RNA, 23 nt, Yersinia pestis
uuaucaccuuccgucccaagaaa

SEQ ID NO: 4158311 - RNA, 16 nt, Yersinia pestis
uuaucacgguugccgc

SEQ ID NO: 4158312 - RNA, 17 nt, Yersinia pestis
uuaucacgguugccgcg

SEQ ID NO: 4158313 - RNA, 19 nt, Yersinia pestis
uuaucagcccaucuuugau

SEQ ID NO: 4158314 - RNA, 21 nt, Yersinia pestis
uuaucaguugguuuauccuuu

SEQ ID NO: 4158315 - RNA, 20 nt, Yersinia pestis
uuaucauaaauaaaagauaa

SEQ ID NO: 4158316 - RNA, 16 nt, Yersinia pestis
uuaucauauucaucaa

SEQ ID NO: 4158317 - RNA, 22 nt, Yersinia pestis
uuaucaucauuacacugaauug

SEQ ID NO: 4158318 - RNA, 17 nt, Yersinia pestis
uuaucauugaguucuga

SEQ ID NO: 4158319 - RNA, 13 nt, Yersinia pestis
uuauccacagcau

SEQ ID NO: 4158320 - RNA, 19 nt, Yersinia pestis
uuauccagcccuacuggcc

SEQ ID NO: 4158321 - RNA, 17 nt, Yersinia pestis
uuauccauuuucugcca

SEQ ID NO: 4158322 - RNA, 18 nt, Yersinia pestis
uuauccauuuucugccaa

SEQ ID NO: 4158323 - RNA, 21 nt, Yersinia pestis
uuauccccgccucgacaagca

SEQ ID NO: 4158324 - RNA, 13 nt, Yersinia pestis
uuauccccuucga

SEQ ID NO: 4158325 - RNA, 15 nt, Yersinia pestis
uuaucccuccaucaa

SEQ ID NO: 4158326 - RNA, 17 nt, Yersinia pestis
uuaucccuccaucaagc

SEQ ID NO: 4158327 - RNA, 21 nt, Yersinia pestis
uuaucccuccaucaagccacc

SEQ ID NO: 4158328 - RNA, 15 nt, Yersinia pestis
uuauccguuaaccca

SEQ ID NO: 4158329 - RNA, 13 nt, Yersinia pestis
uuauccuuuuuau

SEQ ID NO: 4158330 - RNA, 15 nt, Yersinia pestis
uuauccuuuuuauuu

SEQ ID NO: 4158331 - RNA, 18 nt, Yersinia pestis
uuaucgccaagccaguaa

SEQ ID NO: 4158332 - RNA, 22 nt, Yersinia pestis
uuaucgccaagccaguaauuaa

SEQ ID NO: 4158333 - RNA, 13 nt, Yersinia pestis
uuaucgccagcug

SEQ ID NO: 4158334 - RNA, 21 nt, Yersinia pestis
uuaucgcuacguacuaucuau

SEQ ID NO: 4158335 - RNA, 22 nt, Yersinia pestis
uuaucgcuacguacuaucuauu

SEQ ID NO: 4158336 - RNA, 14 nt, Yersinia pestis
uuaucuaaccguca

SEQ ID NO: 4158337 - RNA, 18 nt, Yersinia pestis
uuaucuaaccgucaugcu

SEQ ID NO: 4158338 - RNA, 14 nt, Yersinia pestis
uuaucuagcgucca

SEQ ID NO: 4158339 - RNA, 21 nt, Yersinia pestis
uuaucucccauuaauuaauca

SEQ ID NO: 4158340 - RNA, 15 nt, Yersinia pestis
uuaucugcauuaaaa

SEQ ID NO: 4158341 - RNA, 18 nt, Yersinia pestis
uuaucugcauuaaaauaa

SEQ ID NO: 4158342 - RNA, 13 nt, Yersinia pestis
uuaugaauaaacc

SEQ ID NO: 4158343 - RNA, 21 nt, Yersinia pestis
uuaugacacccguacgaauuu

SEQ ID NO: 4158344 - RNA, 13 nt, Yersinia pestis
uuaugaguucugc

SEQ ID NO: 4158345 - RNA, 16 nt, Yersinia pestis
uuaugaucuugaauaa

SEQ ID NO: 4158346 - RNA, 14 nt, Yersinia pestis
uuaugccgugacug

SEQ ID NO: 4158347 - RNA, 13 nt, Yersinia pestis
uuaugcgcugcug

SEQ ID NO: 4158348 - RNA, 17 nt, Yersinia pestis
uuauggcauaaacugaa

SEQ ID NO: 4158349 - RNA, 22 nt, Yersinia pestis
uuauggguaccguuuauuuacu

SEQ ID NO: 4158350 - RNA, 16 nt, Yersinia pestis
uuaugggugguuagca

SEQ ID NO: 4158351 - RNA, 22 nt, Yersinia pestis
uuaugguuuuuaacgauauagg

SEQ ID NO: 4158352 - RNA, 18 nt, Yersinia pestis
uuauguacguucagguau

SEQ ID NO: 4158353 - RNA, 19 nt, Yersinia pestis
uuauguaguuaaucuaccc

SEQ ID NO: 4158354 - RNA, 21 nt, Yersinia pestis
uuauguucauucucuacugaa

SEQ ID NO: 4158355 - RNA, 21 nt, Yersinia pestis
uuauuaaauaagaaguagaau

SEQ ID NO: 4158356 - RNA, 23 nt, Yersinia pestis
uuauuaacgauuauuaaacuauu

SEQ ID NO: 4158357 - RNA, 19 nt, Yersinia pestis
uuauuaaguuuuucauaau

SEQ ID NO: 4158358 - RNA, 12 nt, Yersinia pestis
uuauuacucagc

SEQ ID NO: 4158359 - RNA, 16 nt, Yersinia pestis
uuauuacugucacugu

SEQ ID NO: 4158360 - RNA, 14 nt, Yersinia pestis
uuauuacugucauu

SEQ ID NO: 4158361 - RNA, 19 nt, Yersinia pestis
uuauuaggcauugagucac

SEQ ID NO: 4158362 - RNA, 19 nt, Yersinia pestis
uuauuauauauuuugaaua

SEQ ID NO: 4158363 - RNA, 16 nt, Yersinia pestis
uuauuauaugaucagu

SEQ ID NO: 4158364 - RNA, 22 nt, Yersinia pestis
uuauuaugacaacugaaaauac

SEQ ID NO: 4158365 - RNA, 12 nt, Yersinia pestis
uuauuauugauu

SEQ ID NO: 4158366 - RNA, 13 nt, Yersinia pestis
uuauucaauacug

SEQ ID NO: 4158367 - RNA, 11 nt, Yersinia pestis
uuauucauuca

SEQ ID NO: 4158368 - RNA, 15 nt, Yersinia pestis
uuauucccacuuauu

SEQ ID NO: 4158369 - RNA, 23 nt, Yersinia pestis
uuauucguggugaugaugacggu

SEQ ID NO: 4158370 - RNA, 15 nt, Yersinia pestis
uuauucuaauugaua

SEQ ID NO: 4158371 - RNA, 23 nt, Yersinia pestis
uuauucucaauugacuguauaua

SEQ ID NO: 4158372 - RNA, 21 nt, Yersinia pestis
uuauucuuauuucgcgacuca

SEQ ID NO: 4158373 - RNA, 14 nt, Yersinia pestis
uuauugagaagaaa

SEQ ID NO: 4158374 - RNA, 17 nt, Yersinia pestis
uuauugaguaacauuaa

SEQ ID NO: 4158375 - RNA, 18 nt, Yersinia pestis
uuauugaguaacauuaau

SEQ ID NO: 4158376 - RNA, 21 nt, Yersinia pestis
uuauugcuaaguacuaucuau

SEQ ID NO: 4158377 - RNA, 22 nt, Yersinia pestis
uuauugcuaaguacuaucuauu

SEQ ID NO: 4158378 - RNA, 18 nt, Yersinia pestis
uuauuggaaguacuuauu

SEQ ID NO: 4158379 - RNA, 15 nt, Yersinia pestis
uuauuggaugccaau

SEQ ID NO: 4158380 - RNA, 19 nt, Yersinia pestis
uuauuggggacaggcuccu

SEQ ID NO: 4158381 - RNA, 16 nt, Yersinia pestis
uuauugguuauuuuau

SEQ ID NO: 4158382 - RNA, 16 nt, Yersinia pestis
uuauugucuuuaauaa

SEQ ID NO: 4158383 - RNA, 21 nt, Yersinia pestis
uuauugucuuuaauaaaauca

SEQ ID NO: 4158384 - RNA, 21 nt, Yersinia pestis
uuauuuaaacaaugaaauugc

SEQ ID NO: 4158385 - RNA, 17 nt, Yersinia pestis
uuauuuaauuaaaugua

SEQ ID NO: 4158386 - RNA, 18 nt, Yersinia pestis
uuauuuacaaaccauauu

SEQ ID NO: 4158387 - RNA, 23 nt, Yersinia pestis
uuauuuaggcuacagcuacugca

SEQ ID NO: 4158388 - RNA, 13 nt, Yersinia pestis
uuauuuauaaaac

SEQ ID NO: 4158389 - RNA, 14 nt, Yersinia pestis
uuauuuauagguau

SEQ ID NO: 4158390 - RNA, 23 nt, Yersinia pestis
uuauuucacacuguuuaguucac

SEQ ID NO: 4158391 - RNA, 19 nt, Yersinia pestis
uuauuucacgcuaauuauu

SEQ ID NO: 4158392 - RNA, 15 nt, Yersinia pestis
uuauuucucugauga

SEQ ID NO: 4158393 - RNA, 18 nt, Yersinia pestis
uuauuucuguuccaggca

SEQ ID NO: 4158394 - RNA, 18 nt, Yersinia pestis
uuauuugaaauacuuauu

SEQ ID NO: 4158395 - RNA, 13 nt, Yersinia pestis
uuauuugcuauca

SEQ ID NO: 4158396 - RNA, 13 nt, Yersinia pestis
uuauuugcuaucg

SEQ ID NO: 4158397 - RNA, 23 nt, Yersinia pestis
uuauuugucgccaacauuuauuu

SEQ ID NO: 4158398 - RNA, 12 nt, Yersinia pestis
uuauuuuaauug

SEQ ID NO: 4158399 - RNA, 17 nt, Yersinia pestis
uuauuuucaaccaguua

SEQ ID NO: 4158400 - RNA, 21 nt, Yersinia pestis
uuauuuuggaguauacauuau

SEQ ID NO: 4158401 - RNA, 21 nt, Yersinia pestis
uucaaaaaagcccccuuuuuc

SEQ ID NO: 4158402 - RNA, 20 nt, Yersinia pestis
uucaaaaacgcacgaaaaca

SEQ ID NO: 4158403 - RNA, 16 nt, Yersinia pestis
uucaaaaauuaaauua

SEQ ID NO: 4158404 - RNA, 20 nt, Yersinia pestis
uucaaaaggugcaagcagcu

SEQ ID NO: 4158405 - RNA, 19 nt, Yersinia pestis
uucaaaauagaggaaauaa

SEQ ID NO: 4158406 - RNA, 15 nt, Yersinia pestis
uucaaaaucaaaaau

SEQ ID NO: 4158407 - RNA, 21 nt, Yersinia pestis
uucaaacaguacuucagguaa

SEQ ID NO: 4158408 - RNA, 12 nt, Yersinia pestis
uucaaacaucgu

SEQ ID NO: 4158409 - RNA, 21 nt, Yersinia pestis
uucauacugccgaccauaucu

SEQ ID NO: 4158410 - RNA, 16 nt, Yersinia pestis
uucauauauugcauuu

SEQ ID NO: 4158411 - RNA, 21 nt, Yersinia pestis
uucauauccgaugauauaccc

SEQ ID NO: 4158412 - RNA, 19 nt, Yersinia pestis
uucauaucgauaccgauaa

SEQ ID NO: 4158413 - RNA, 17 nt, Yersinia pestis
uucauaucguccaaagg

SEQ ID NO: 4158414 - RNA, 18 nt, Yersinia pestis
uucauaucuuuaccuguu

SEQ ID NO: 4158415 - RNA, 13 nt, Yersinia pestis
uucauaugacaaa

SEQ ID NO: 4158416 - RNA, 19 nt, Yersinia pestis
uucauaugcgccuauaagg

SEQ ID NO: 4158417 - RNA, 14 nt, Yersinia pestis
uucauauuucuuug

SEQ ID NO: 4158418 - RNA, 22 nt, Yersinia pestis
uucaucaauagguguugccggc

SEQ ID NO: 4158419 - RNA, 18 nt, Yersinia pestis
uucaucaccagucagccu

SEQ ID NO: 4158420 - RNA, 13 nt, Yersinia pestis
uucaucacuuagu

SEQ ID NO: 4158421 - RNA, 17 nt, Yersinia pestis
uucaucagagucuguca

SEQ ID NO: 4158422 - RNA, 21 nt, Yersinia pestis
uucaucagucacuaaaccauu

SEQ ID NO: 4158423 - RNA, 15 nt, Yersinia pestis
uucaucauccauaaa

SEQ ID NO: 4158424 - RNA, 12 nt, Yersinia pestis
uucaucauuauu

SEQ ID NO: 4158425 - RNA, 15 nt, Yersinia pestis
uucaucauuauuaug

SEQ ID NO: 4158426 - RNA, 14 nt, Yersinia pestis
uucaucauucaaua

SEQ ID NO: 4158427 - RNA, 15 nt, Yersinia pestis
uucaucauucaauac

SEQ ID NO: 4158428 - RNA, 13 nt, Yersinia pestis
uucauccaacuua

SEQ ID NO: 4158429 - RNA, 17 nt, Yersinia pestis
uucaucccaagagaacg

SEQ ID NO: 4158430 - RNA, 18 nt, Yersinia pestis
uucaucccauaugcuaua

SEQ ID NO: 4158431 - RNA, 24 nt, Yersinia pestis
uucauccuaaagauaauuaauuca

SEQ ID NO: 4158432 - RNA, 21 nt, Yersinia pestis
uucauccuguaccgcgcuuuu

SEQ ID NO: 4158433 - RNA, 15 nt, Yersinia pestis
uucaucgaaaaaaau

SEQ ID NO: 4158434 - RNA, 18 nt, Yersinia pestis
uucaucgaaaaaaauacu

SEQ ID NO: 4158435 - RNA, 14 nt, Yersinia pestis
uucaucgacucuuu

SEQ ID NO: 4158436 - RNA, 17 nt, Yersinia pestis
uucaucgcauaggccaa

SEQ ID NO: 4158437 - RNA, 16 nt, Yersinia pestis
uucaucgcccuguaac

SEQ ID NO: 4158438 - RNA, 22 nt, Yersinia pestis
uucaucgcccuguaacuuuauu

SEQ ID NO: 4158439 - RNA, 21 nt, Yersinia pestis
uucaucgcgaccaauucauca

SEQ ID NO: 4158440 - RNA, 13 nt, Yersinia pestis
uucaucgcuuaac

SEQ ID NO: 4158441 - RNA, 16 nt, Yersinia pestis
uucaucggcaaaaaca

SEQ ID NO: 4158442 - RNA, 17 nt, Yersinia pestis
uucaucucaauaacuau

SEQ ID NO: 4158443 - RNA, 23 nt, Yersinia pestis
uucaucucaauaacuauuuuuga

SEQ ID NO: 4158444 - RNA, 20 nt, Yersinia pestis
uucaucugaccaaacauugu

SEQ ID NO: 4158445 - RNA, 20 nt, Yersinia pestis
uucaucuuuaacaacaacca

SEQ ID NO: 4158446 - RNA, 16 nt, Yersinia pestis
uucaugacgaaaaaca

SEQ ID NO: 4158447 - RNA, 17 nt, Yersinia pestis
uucaugacgaaaaacac

SEQ ID NO: 4158448 - RNA, 22 nt, Yersinia pestis
uucaugaggcucagacugcuga

SEQ ID NO: 4158449 - RNA, 17 nt, Yersinia pestis
uucaugcaucuccacuc

SEQ ID NO: 4158450 - RNA, 21 nt, Yersinia pestis
uucaugccuugaaacucaacg

SEQ ID NO: 4158451 - RNA, 16 nt, Yersinia pestis
uucaugcuaauaccac

SEQ ID NO: 4158452 - RNA, 14 nt, Yersinia pestis
uucauggguuucua

SEQ ID NO: 4158453 - RNA, 19 nt, Yersinia pestis
uucaugguaaauuccuaua

SEQ ID NO: 4158454 - RNA, 15 nt, Yersinia pestis
uucauuaaaaaauaa

SEQ ID NO: 4158455 - RNA, 17 nt, Yersinia pestis
uucauuaaaaaauaauu

SEQ ID NO: 4158456 - RNA, 20 nt, Yersinia pestis
uucauuaauuaauaagccca

SEQ ID NO: 4158457 - RNA, 20 nt, Yersinia pestis
uucauuaucauguaaggcaa

SEQ ID NO: 4158458 - RNA, 14 nt, Yersinia pestis
uucauuauuugaua

SEQ ID NO: 4158459 - RNA, 13 nt, Yersinia pestis
uucauuccagagu

SEQ ID NO: 4158460 - RNA, 18 nt, Yersinia pestis
uucauuccccaucgccaa

SEQ ID NO: 4158461 - RNA, 12 nt, Yersinia pestis
uucauuuaacug

SEQ ID NO: 4158462 - RNA, 14 nt, Yersinia pestis
uucauuugcugugg

SEQ ID NO: 4158463 - RNA, 12 nt, Yersinia pestis
uucauuuuaaaa

SEQ ID NO: 4158464 - RNA, 13 nt, Yersinia pestis
uucauuuuaaaaa

SEQ ID NO: 4158465 - RNA, 14 nt, Yersinia pestis
uucauuuuaaaaaa

SEQ ID NO: 4158466 - RNA, 16 nt, Yersinia pestis
uucauuuuaaaaaaau

SEQ ID NO: 4158467 - RNA, 23 nt, Yersinia pestis
uucauuuuaacaacccauuuccc

SEQ ID NO: 4158468 - RNA, 15 nt, Yersinia pestis
uucauuuucaucacu

SEQ ID NO: 4158469 - RNA, 14 nt, Yersinia pestis
uucauuuugaccag

SEQ ID NO: 4158470 - RNA, 13 nt, Yersinia pestis
uucauuuuucucc

SEQ ID NO: 4158471 - RNA, 16 nt, Yersinia pestis
uuccaaaggaagggau

SEQ ID NO: 4158472 - RNA, 23 nt, Yersinia pestis
uuccaaaugacagcaucaauauc

SEQ ID NO: 4158473 - RNA, 20 nt, Yersinia pestis
uuccaacugauaauucagug

SEQ ID NO: 4158474 - RNA, 16 nt, Yersinia pestis
uuccaaucugcgcccu

SEQ ID NO: 4158475 - RNA, 16 nt, Yersinia pestis
uuccaauuggugcuuu

SEQ ID NO: 4158476 - RNA, 20 nt, Yersinia pestis
uuccaauuggugcuuuaugu

SEQ ID NO: 4158477 - RNA, 13 nt, Yersinia pestis
uuccacagaguau

SEQ ID NO: 4158478 - RNA, 22 nt, Yersinia pestis
uuccacauggcugcucagccac

SEQ ID NO: 4158479 - RNA, 17 nt, Yersinia pestis
uuccacgcccaacucuu

SEQ ID NO: 4158480 - RNA, 18 nt, Yersinia pestis
uuccacucucugcuuacu

SEQ ID NO: 4158481 - RNA, 21 nt, Yersinia pestis
uuccacucuuucaaugauggc

SEQ ID NO: 4158482 - RNA, 21 nt, Yersinia pestis
uuccagacaaagugagggaua

SEQ ID NO: 4158483 - RNA, 20 nt, Yersinia pestis
uuccagauagcgaaucacau

SEQ ID NO: 4158484 - RNA, 11 nt, Yersinia pestis
uuccagaucuu

SEQ ID NO: 4158485 - RNA, 18 nt, Yersinia pestis
uuccagcaccccuucacc

SEQ ID NO: 4158486 - RNA, 19 nt, Yersinia pestis
uuccagugccaauugagua

SEQ ID NO: 4158487 - RNA, 19 nt, Yersinia pestis
uuccauaugaacaucaaac

SEQ ID NO: 4158488 - RNA, 18 nt, Yersinia pestis
uuccaucacugcauuauc

SEQ ID NO: 4158489 - RNA, 15 nt, Yersinia pestis
uuccaucgucaauuc

SEQ ID NO: 4158490 - RNA, 18 nt, Yersinia pestis
uuccauuuuauuuaacgu

SEQ ID NO: 4158491 - RNA, 19 nt, Yersinia pestis
uucccaccauaaugugccu

SEQ ID NO: 4158492 - RNA, 13 nt, Yersinia pestis
uucccagccacuc

SEQ ID NO: 4158493 - RNA, 20 nt, Yersinia pestis
uucccaguaagcucuacuaa

SEQ ID NO: 4158494 - RNA, 18 nt, Yersinia pestis
uucccagucauaaauauc

SEQ ID NO: 4158495 - RNA, 24 nt, Yersinia pestis
uucccauagcuggcuucaaaauca

SEQ ID NO: 4158496 - RNA, 13 nt, Yersinia pestis
uucccauuuaugg

SEQ ID NO: 4158497 - RNA, 13 nt, Yersinia pestis
uuccccaucgcca

SEQ ID NO: 4158498 - RNA, 18 nt, Yersinia pestis
uucccgacagaacugauu

SEQ ID NO: 4158499 - RNA, 20 nt, Yersinia pestis
uucccgaggagagaaaauuu

SEQ ID NO: 4158500 - RNA, 21 nt, Yersinia pestis
uucccgcacaauuccaggguu

SEQ ID NO: 4158501 - RNA, 18 nt, Yersinia pestis
uucccuaccguaucaacg

SEQ ID NO: 4158502 - RNA, 20 nt, Yersinia pestis
uucccuagcgaaguauuaau

SEQ ID NO: 4158503 - RNA, 14 nt, Yersinia pestis
uucccucugccuga

SEQ ID NO: 4158504 - RNA, 12 nt, Yersinia pestis
uucccugcauaa

SEQ ID NO: 4158505 - RNA, 20 nt, Yersinia pestis
uucccuguucucuguuucca

SEQ ID NO: 4158506 - RNA, 18 nt, Yersinia pestis
uucccuuguuugcgccgu

SEQ ID NO: 4158507 - RNA, 17 nt, Yersinia pestis
uuccgagcaaucaaaag

SEQ ID NO: 4158508 - RNA, 18 nt, Yersinia pestis
uuccgccgccaacaguga

SEQ ID NO: 4158509 - RNA, 21 nt, Yersinia pestis
uuccgccucuuuuuccacacc

SEQ ID NO: 4158510 - RNA, 18 nt, Yersinia pestis
uuccgcgccguguaguuu

SEQ ID NO: 4158511 - RNA, 21 nt, Yersinia pestis
uuccgcuucacauuugaaaug

SEQ ID NO: 4158512 - RNA, 20 nt, Yersinia pestis
uuccuacaacgugguuuauu

SEQ ID NO: 4158513 - RNA, 20 nt, Yersinia pestis
uuccuacuaugcguugagac

SEQ ID NO: 4158514 - RNA, 16 nt, Yersinia pestis
uuccucccagaauaau

SEQ ID NO: 4158515 - RNA, 21 nt, Yersinia pestis
uuccucgccguagcauucauu

SEQ ID NO: 4158516 - RNA, 23 nt, Yersinia pestis
uuccugaaucgccgaaaucucac

SEQ ID NO: 4158517 - RNA, 19 nt, Yersinia pestis
uuccugaauggcaucaccg

SEQ ID NO: 4158518 - RNA, 20 nt, Yersinia pestis
uuccugauggccguaucaug

SEQ ID NO: 4158519 - RNA, 18 nt, Yersinia pestis
uuccugcacaucaaguac

SEQ ID NO: 4158520 - RNA, 15 nt, Yersinia pestis
uuccuggcggcaaca

SEQ ID NO: 4158521 - RNA, 12 nt, Yersinia pestis
uuccuguuuauu

SEQ ID NO: 4158522 - RNA, 18 nt, Yersinia pestis
uuccuuauaaauccgcua

SEQ ID NO: 4158523 - RNA, 14 nt, Yersinia pestis
uuccuucagccacc

SEQ ID NO: 4158524 - RNA, 21 nt, Yersinia pestis
uuccuuuauuuuucauucuau

SEQ ID NO: 4158525 - RNA, 22 nt, Yersinia pestis
uuccuuugcccuuacuauuuuu

SEQ ID NO: 4158526 - RNA, 15 nt, Yersinia pestis
uucgaaaauaaugaa

SEQ ID NO: 4158527 - RNA, 19 nt, Yersinia pestis
uucgaaacugaucacuggc

SEQ ID NO: 4158528 - RNA, 20 nt, Yersinia pestis
uucgaaacugaucacuggca

SEQ ID NO: 4158529 - RNA, 15 nt, Yersinia pestis
uucgaaagaaauaaa

SEQ ID NO: 4158530 - RNA, 21 nt, Yersinia pestis
uucgaaagaaauaaaagaaaa

SEQ ID NO: 4158531 - RNA, 14 nt, Yersinia pestis
uucuuuaugacaag

SEQ ID NO: 4158532 - RNA, 14 nt, Yersinia pestis
uucuuucaccagug

SEQ ID NO: 4158533 - RNA, 13 nt, Yersinia pestis
uucuuucacuaau

SEQ ID NO: 4158534 - RNA, 17 nt, Yersinia pestis
uucuuugacucaaugua

SEQ ID NO: 4158535 - RNA, 21 nt, Yersinia pestis
uucuuuucucccuuucacuuu

SEQ ID NO: 4158536 - RNA, 14 nt, Yersinia pestis
uucuuuuucggcaa

SEQ ID NO: 4158537 - RNA, 23 nt, Yersinia pestis
uugaaaaccgucgacuguaacag

SEQ ID NO: 4158538 - RNA, 15 nt, Yersinia pestis
uugaaaaguuuuuug

SEQ ID NO: 4158539 - RNA, 20 nt, Yersinia pestis
uugaaaccgcugauaaccag

SEQ ID NO: 4158540 - RNA, 17 nt, Yersinia pestis
uugaaacucaacgaucu

SEQ ID NO: 4158541 - RNA, 21 nt, Yersinia pestis
uugaaagcgugacgcugaaca

SEQ ID NO: 4158542 - RNA, 19 nt, Yersinia pestis
uugaaaguuuauaugcuug

SEQ ID NO: 4158543 - RNA, 12 nt, Yersinia pestis
uugaaauaccac

SEQ ID NO: 4158544 - RNA, 16 nt, Yersinia pestis
uugaaaucagaucaac

SEQ ID NO: 4158545 - RNA, 16 nt, Yersinia pestis
uugaaaucauugcucu

SEQ ID NO: 4158546 - RNA, 14 nt, Yersinia pestis
uugaacaaacccca

SEQ ID NO: 4158547 - RNA, 22 nt, Yersinia pestis
uugaacaaaccccacuaacgcu

SEQ ID NO: 4158548 - RNA, 20 nt, Yersinia pestis
uugaacaacgcuaugcagcc

SEQ ID NO: 4158549 - RNA, 17 nt, Yersinia pestis
uugaacauucaucuuuu

SEQ ID NO: 4158550 - RNA, 11 nt, Yersinia pestis
uugaaccauaa

SEQ ID NO: 4158551 - RNA, 18 nt, Yersinia pestis
uugaaccgcuaucugcug

SEQ ID NO: 4158552 - RNA, 13 nt, Yersinia pestis
uugaacgacaugu

SEQ ID NO: 4158553 - RNA, 16 nt, Yersinia pestis
uugaacggugaggaua

SEQ ID NO: 4158554 - RNA, 15 nt, Yersinia pestis
uugaacgugccccaa

SEQ ID NO: 4158555 - RNA, 22 nt, Yersinia pestis
uugaacuguggcaugacugaug

SEQ ID NO: 4158556 - RNA, 16 nt, Yersinia pestis
uugaacuucgaaagaa

SEQ ID NO: 4158557 - RNA, 11 nt, Yersinia pestis
uugaagauacc

SEQ ID NO: 4158558 - RNA, 18 nt, Yersinia pestis
uugaagauucaaccaauu

SEQ ID NO: 4158559 - RNA, 14 nt, Yersinia pestis
uugaauaacuucuc

SEQ ID NO: 4158560 - RNA, 12 nt, Yersinia pestis
uugaauaauccg

SEQ ID NO: 4158561 - RNA, 13 nt, Yersinia pestis
uugaauaucacca

SEQ ID NO: 4158562 - RNA, 23 nt, Yersinia pestis
uugaauauuuuuaaucugcccag

SEQ ID NO: 4158563 - RNA, 17 nt, Yersinia pestis
uugaaucagauacggcu

SEQ ID NO: 4158564 - RNA, 13 nt, Yersinia pestis
uugaauuaaaaac

SEQ ID NO: 4158565 - RNA, 19 nt, Yersinia pestis
uugaauucaagaaggccgu

SEQ ID NO: 4158566 - RNA, 22 nt, Yersinia pestis
uugaauucaccaaauugcagaa

SEQ ID NO: 4158567 - RNA, 21 nt, Yersinia pestis
uugacaaaguaccuauggcga

SEQ ID NO: 4158568 - RNA, 18 nt, Yersinia pestis
uugacacaucccaacgca

SEQ ID NO: 4158569 - RNA, 16 nt, Yersinia pestis
uugacauaaacacgca

SEQ ID NO: 4158570 - RNA, 22 nt, Yersinia pestis
uugaccgcuguuugauuaaaac

SEQ ID NO: 4158571 - RNA, 13 nt, Yersinia pestis
uugaccugaagaa

SEQ ID NO: 4158572 - RNA, 20 nt, Yersinia pestis
uugacguccccggucaugag

SEQ ID NO: 4158573 - RNA, 16 nt, Yersinia pestis
uugacuaaauuucucg

SEQ ID NO: 4158574 - RNA, 18 nt, Yersinia pestis
uugacuaauuaauaacca

SEQ ID NO: 4158575 - RNA, 15 nt, Yersinia pestis
uugacuggucacucg

SEQ ID NO: 4158576 - RNA, 14 nt, Yersinia pestis
uugacuuaacaguu

SEQ ID NO: 4158577 - RNA, 15 nt, Yersinia pestis
uugacuuaacaguua

SEQ ID NO: 4158578 - RNA, 15 nt, Yersinia pestis
uugacuuugucagca

SEQ ID NO: 4158579 - RNA, 22 nt, Yersinia pestis
uugagacacaaaaaagaaauuu

SEQ ID NO: 4158580 - RNA, 20 nt, Yersinia pestis
uugagagaacguucaaccaa

SEQ ID NO: 4158581 - RNA, 14 nt, Yersinia pestis
uugagaguucacuu

SEQ ID NO: 4158582 - RNA, 17 nt, Yersinia pestis
uugagauuaucagccca

SEQ ID NO: 4158583 - RNA, 17 nt, Yersinia pestis
uugagauuuucccagug

SEQ ID NO: 4158584 - RNA, 21 nt, Yersinia pestis
uugagcaggcucuucucugag

SEQ ID NO: 4158585 - RNA, 17 nt, Yersinia pestis
uugagcagugcgcggcg

SEQ ID NO: 4158586 - RNA, 21 nt, Yersinia pestis
uugagccaccgcauuccagcg

SEQ ID NO: 4158587 - RNA, 23 nt, Yersinia pestis
uugagcggugaauacguucaaau

SEQ ID NO: 4158588 - RNA, 19 nt, Yersinia pestis
uugaggauauuagggcuga

SEQ ID NO: 4158589 - RNA, 19 nt, Yersinia pestis
uugagggcgucucuacgac

SEQ ID NO: 4158590 - RNA, 16 nt, Yersinia pestis
uugaggguugucagca

SEQ ID NO: 4158591 - RNA, 16 nt, Yersinia pestis
uugagguuauugacaa

SEQ ID NO: 4158592 - RNA, 13 nt, Yersinia pestis
uugagguuuucug

SEQ ID NO: 4158593 - RNA, 18 nt, Yersinia pestis
uugaguaacaagaacacc

SEQ ID NO: 4158594 - RNA, 17 nt, Yersinia pestis
uugaguggcagacugcu

SEQ ID NO: 4158595 - RNA, 22 nt, Yersinia pestis
uugaguuuaugguugcaaacca

SEQ ID NO: 4158596 - RNA, 15 nt, Yersinia pestis
uugauaaaaaucaau

SEQ ID NO: 4158597 - RNA, 18 nt, Yersinia pestis
uugauaaaaaucuuuuaa

SEQ ID NO: 4158598 - RNA, 23 nt, Yersinia pestis
uugauaacgccggauaaauuaau

SEQ ID NO: 4158599 - RNA, 20 nt, Yersinia pestis
uugauacggccuauuucuug

SEQ ID NO: 4158600 - RNA, 20 nt, Yersinia pestis
uugauaugcuucacaucaua

SEQ ID NO: 4158601 - RNA, 15 nt, Yersinia pestis
uugauauuauuuaua

SEQ ID NO: 4158602 - RNA, 18 nt, Yersinia pestis
uugaucaaacgaaacuaa

SEQ ID NO: 4158603 - RNA, 19 nt, Yersinia pestis
uugaucaucaaacuauuca

SEQ ID NO: 4158604 - RNA, 23 nt, Yersinia pestis
uugauccaccguuuuacucagga

SEQ ID NO: 4158605 - RNA, 13 nt, Yersinia pestis
uugauccauccau

SEQ ID NO: 4158606 - RNA, 22 nt, Yersinia pestis
uugauccgauaaacuucacaau

SEQ ID NO: 4158607 - RNA, 17 nt, Yersinia pestis
uugaucgauaacgcuaa

SEQ ID NO: 4158608 - RNA, 21 nt, Yersinia pestis
uugaucggauagcuuagccca

SEQ ID NO: 4158609 - RNA, 11 nt, Yersinia pestis
uugaucuaccu

SEQ ID NO: 4158610 - RNA, 22 nt, Yersinia pestis
uugaucugaguuucauuaguca

SEQ ID NO: 4158611 - RNA, 14 nt, Yersinia pestis
uugaugaguaaaca

SEQ ID NO: 4158612 - RNA, 10 nt, Yersinia pestis
uugaugauga

SEQ ID NO: 4158613 - RNA, 16 nt, Yersinia pestis
uugaugauuugaccga

SEQ ID NO: 4158614 - RNA, 17 nt, Yersinia pestis
uugaugcaaaaccguac

SEQ ID NO: 4158615 - RNA, 15 nt, Yersinia pestis
uugaugcauauguag

SEQ ID NO: 4158616 - RNA, 20 nt, Yersinia pestis
uugauggccuugaaucaaaa

SEQ ID NO: 4158617 - RNA, 20 nt, Yersinia pestis
uugauggcgcaguaacugug

SEQ ID NO: 4158618 - RNA, 12 nt, Yersinia pestis
uugaugguucag

SEQ ID NO: 4158619 - RNA, 18 nt, Yersinia pestis
uugauguagcagaucuau

SEQ ID NO: 4158620 - RNA, 20 nt, Yersinia pestis
uugaugugaaacauaauuaa

SEQ ID NO: 4158621 - RNA, 16 nt, Yersinia pestis
uugauuaauuuuucau

SEQ ID NO: 4158622 - RNA, 18 nt, Yersinia pestis
uugauuaccaauaauuaa

SEQ ID NO: 4158623 - RNA, 19 nt, Yersinia pestis
uugauuaucaaguuaaaua

SEQ ID NO: 4158624 - RNA, 15 nt, Yersinia pestis
uugauucucauuaau

SEQ ID NO: 4158625 - RNA, 21 nt, Yersinia pestis
uugcaaacaucacaucggcga

SEQ ID NO: 4158626 - RNA, 22 nt, Yersinia pestis
uugcaacgcaggcacugcagaa

SEQ ID NO: 4158627 - RNA, 14 nt, Yersinia pestis
uugcaagguauuuu

SEQ ID NO: 4158628 - RNA, 17 nt, Yersinia pestis
uugcaauugggguaaau

SEQ ID NO: 4158629 - RNA, 20 nt, Yersinia pestis
uugcacaaagcuuacuguuc

SEQ ID NO: 4158630 - RNA, 22 nt, Yersinia pestis
uugcacaaagcuuacuguucac

SEQ ID NO: 4158631 - RNA, 23 nt, Yersinia pestis
uugcacgguguaaauaacaccca

SEQ ID NO: 4158632 - RNA, 14 nt, Yersinia pestis
uugcagaaaguaau

SEQ ID NO: 4158633 - RNA, 17 nt, Yersinia pestis
uugcagaucggcauuau

SEQ ID NO: 4158634 - RNA, 23 nt, Yersinia pestis
uugcaggauaauagugucauaau

SEQ ID NO: 4158635 - RNA, 21 nt, Yersinia pestis
uugcaggcacuuugucaauaa

SEQ ID NO: 4158636 - RNA, 13 nt, Yersinia pestis
uugcaggcuuuca

SEQ ID NO: 4158637 - RNA, 15 nt, Yersinia pestis
uugcaggucugcaug

SEQ ID NO: 4158638 - RNA, 14 nt, Yersinia pestis
uugcaguauuuugg

SEQ ID NO: 4158639 - RNA, 20 nt, Yersinia pestis
uugcagucuccaucacucuu

SEQ ID NO: 4158640 - RNA, 14 nt, Yersinia pestis
uugcagugcguaau

SEQ ID NO: 4158641 - RNA, 17 nt, Yersinia pestis
uugcauacaaccguuac

SEQ ID NO: 4158642 - RNA, 13 nt, Yersinia pestis
uugcauacucagg

SEQ ID NO: 4158643 - RNA, 17 nt, Yersinia pestis
uugcauacucaggcccu

SEQ ID NO: 4158644 - RNA, 15 nt, Yersinia pestis
uugcauaucagcaau

SEQ ID NO: 4158645 - RNA, 19 nt, Yersinia pestis
uugccaaaauccaccagcg

SEQ ID NO: 4158646 - RNA, 14 nt, Yersinia pestis
uugccaaaauuuua

SEQ ID NO: 4158647 - RNA, 14 nt, Yersinia pestis
uugccaaaugcaaa

SEQ ID NO: 4158648 - RNA, 21 nt, Yersinia pestis
uugccaaccggauaaaacaau

SEQ ID NO: 4158649 - RNA, 13 nt, Yersinia pestis
uugccacauuucc

SEQ ID NO: 4158650 - RNA, 13 nt, Yersinia pestis
uugccaccagcgu

SEQ ID NO: 4158651 - RNA, 21 nt, Yersinia pestis
uugccacccuaucugcucuug

SEQ ID NO: 4158652 - RNA, 11 nt, Yersinia pestis
uugccaccuga

SEQ ID NO: 4158653 - RNA, 16 nt, Yersinia pestis
uugugcguaaagaaaa

SEQ ID NO: 4158654 - RNA, 18 nt, Yersinia pestis
uugugcguaaagaaaaaa

SEQ ID NO: 4158655 - RNA, 17 nt, Yersinia pestis
uugugcugccgcuauug

SEQ ID NO: 4158656 - RNA, 14 nt, Yersinia pestis
uuguggcgaaagac

SEQ ID NO: 4158657 - RNA, 16 nt, Yersinia pestis
uugugucaauaccuua

SEQ ID NO: 4158658 - RNA, 22 nt, Yersinia pestis
uugugucaauaccuuacuguau

SEQ ID NO: 4158659 - RNA, 12 nt, Yersinia pestis
uugugugaguug

SEQ ID NO: 4158660 - RNA, 16 nt, Yersinia pestis
uuguuaucaucaccac

SEQ ID NO: 4158661 - RNA, 13 nt, Yersinia pestis
uuguuauuacuaa

SEQ ID NO: 4158662 - RNA, 12 nt, Yersinia pestis
uuguuauuacug

SEQ ID NO: 4158663 - RNA, 12 nt, Yersinia pestis
uuguuauuauca

SEQ ID NO: 4158664 - RNA, 17 nt, Yersinia pestis
uuguucacggcuuugcu

SEQ ID NO: 4158665 - RNA, 21 nt, Yersinia pestis
uuguucauccuguaccgcgcu

SEQ ID NO: 4158666 - RNA, 16 nt, Yersinia pestis
uuguugaccucaaaau

SEQ ID NO: 4158667 - RNA, 16 nt, Yersinia pestis
uuguuucaauaaaucc

SEQ ID NO: 4158668 - RNA, 21 nt, Yersinia pestis
uuguuucaauaaaucccgcuu

SEQ ID NO: 4158669 - RNA, 20 nt, Yersinia pestis
uuguuugaauuuuagucaaa

SEQ ID NO: 4158670 - RNA, 19 nt, Yersinia pestis
uuguuuucaugaugacuuu

SEQ ID NO: 4158671 - RNA, 22 nt, Yersinia pestis
uuguuuucguuuaaaaaauauc

SEQ ID NO: 4158672 - RNA, 18 nt, Yersinia pestis
uuguuuugacuaaaauuc

SEQ ID NO: 4158673 - RNA, 15 nt, Yersinia pestis
uuguuuuuacgugau

SEQ ID NO: 4158674 - RNA, 13 nt, Yersinia pestis
uuuaaaaccaaau

SEQ ID NO: 4158675 - RNA, 13 nt, Yersinia pestis
uuuaaaaucccuc

SEQ ID NO: 4158676 - RNA, 17 nt, Yersinia pestis
uuuaaagaagaauccac

SEQ ID NO: 4158677 - RNA, 12 nt, Yersinia pestis
uuuaaaguuuuu

SEQ ID NO: 4158678 - RNA, 14 nt, Yersinia pestis
uuuaaauaugaucu

SEQ ID NO: 4158679 - RNA, 20 nt, Yersinia pestis
uuuaaaucuuucuccaguaa

SEQ ID NO: 4158680 - RNA, 21 nt, Yersinia pestis
uuuaaauuacgguuuaccacc

SEQ ID NO: 4158681 - RNA, 23 nt, Yersinia pestis
uuuaaauuauugaguaacauuaa

SEQ ID NO: 4158682 - RNA, 21 nt, Yersinia pestis
uuuaaauucaauccauugauc

SEQ ID NO: 4158683 - RNA, 22 nt, Yersinia pestis
uuuaaauucaauccauugaucu

SEQ ID NO: 4158684 - RNA, 15 nt, Yersinia pestis
uuuaacaaaaaauua

SEQ ID NO: 4158685 - RNA, 17 nt, Yersinia pestis
uuuaacaacccauuucc

SEQ ID NO: 4158686 - RNA, 18 nt, Yersinia pestis
uuuaacgccaccaaugca

SEQ ID NO: 4158687 - RNA, 21 nt, Yersinia pestis
uuuaacgccgcugaccuugcu

SEQ ID NO: 4158688 - RNA, 15 nt, Yersinia pestis
uuuaacucaaauaaa

SEQ ID NO: 4158689 - RNA, 22 nt, Yersinia pestis
uuuaacuuccaauuucucaaau

SEQ ID NO: 4158690 - RNA, 14 nt, Yersinia pestis
uuuaacuuuaucag

SEQ ID NO: 4158691 - RNA, 17 nt, Yersinia pestis
uuuaacuuucaucccuu

SEQ ID NO: 4158692 - RNA, 14 nt, Yersinia pestis
uuuaagauccaguu

SEQ ID NO: 4158693 - RNA, 22 nt, Yersinia pestis
uuuaagcgggcuuuaauagcca

SEQ ID NO: 4158694 - RNA, 14 nt, Yersinia pestis
uuuaagcugaaauu

SEQ ID NO: 4158695 - RNA, 22 nt, Yersinia pestis
uuuaagcugcagaggugaacga

SEQ ID NO: 4158696 - RNA, 20 nt, Yersinia pestis
uuuaaguucacuugagagaa

SEQ ID NO: 4158697 - RNA, 17 nt, Yersinia pestis
uuuaauaacuuaucuga

SEQ ID NO: 4158698 - RNA, 19 nt, Yersinia pestis
uuuaauagccaaaauaauu

SEQ ID NO: 4158699 - RNA, 20 nt, Yersinia pestis
uuuaauagcccgcgaauuaa

SEQ ID NO: 4158700 - RNA, 18 nt, Yersinia pestis
uuuaauaugacuagauau

SEQ ID NO: 4158701 - RNA, 16 nt, Yersinia pestis
uuuaauaugcaaaaaa

SEQ ID NO: 4158702 - RNA, 16 nt, Yersinia pestis
uuuaauauuucaaaug

SEQ ID NO: 4158703 - RNA, 18 nt, Yersinia pestis
uuuaauccacuuuucaga

SEQ ID NO: 4158704 - RNA, 18 nt, Yersinia pestis
uuuaaucucuccaugaua

SEQ ID NO: 4158705 - RNA, 11 nt, Yersinia pestis
uuuaaugcccc

SEQ ID NO: 4158706 - RNA, 16 nt, Yersinia pestis
uuuaauggcauuaauu

SEQ ID NO: 4158707 - RNA, 15 nt, Yersinia pestis
uuuaauuaaaaauag

SEQ ID NO: 4158708 - RNA, 20 nt, Yersinia pestis
uuuaauuaaauguauaaaaa

SEQ ID NO: 4158709 - RNA, 21 nt, Yersinia pestis
uuuaauuaaauguauaaaaaa

SEQ ID NO: 4158710 - RNA, 17 nt, Yersinia pestis
uuuaauuaguuuaucag

SEQ ID NO: 4158711 - RNA, 12 nt, Yersinia pestis
uuuaauuauaau

SEQ ID NO: 4158712 - RNA, 22 nt, Yersinia pestis
uuuaauuauaauccacugaaau

SEQ ID NO: 4158713 - RNA, 15 nt, Yersinia pestis
uuuaauuuaaauaaa

SEQ ID NO: 4158714 - RNA, 16 nt, Yersinia pestis
uuuaauuuaugaacac

SEQ ID NO: 4158715 - RNA, 16 nt, Yersinia pestis
uuuaauuuaugauuaa

SEQ ID NO: 4158716 - RNA, 14 nt, Yersinia pestis
uuuacaaaccauau

SEQ ID NO: 4158717 - RNA, 21 nt, Yersinia pestis
uuuacauaauaaccauuuaua

SEQ ID NO: 4158718 - RNA, 19 nt, Yersinia pestis
uuuacaugauugaaaaaca

SEQ ID NO: 4158719 - RNA, 18 nt, Yersinia pestis
uuuaccaaaagcauccaa

SEQ ID NO: 4158720 - RNA, 23 nt, Yersinia pestis
uuuaccacgucuaauugcugccc

SEQ ID NO: 4158721 - RNA, 14 nt, Yersinia pestis
uuuaccauccagug

SEQ ID NO: 4158722 - RNA, 17 nt, Yersinia pestis
uuuacccagccaagacu

SEQ ID NO: 4158723 - RNA, 19 nt, Yersinia pestis
uuuaccgcagggcguucag

SEQ ID NO: 4158724 - RNA, 19 nt, Yersinia pestis
uuuaccgucgauaaccaga

SEQ ID NO: 4158725 - RNA, 16 nt, Yersinia pestis
uuuaccguugggcuuu

SEQ ID NO: 4158726 - RNA, 18 nt, Yersinia pestis
uuuaccugcucaacugcu

SEQ ID NO: 4158727 - RNA, 19 nt, Yersinia pestis
uuuacgcaaguaaaaguca

SEQ ID NO: 4158728 - RNA, 21 nt, Yersinia pestis
uuuacgccuauccucaugauu

SEQ ID NO: 4158729 - RNA, 18 nt, Yersinia pestis
uuuacggcuuaucaaucu

SEQ ID NO: 4158730 - RNA, 21 nt, Yersinia pestis
uuuacgggcugaacccugacg

SEQ ID NO: 4158731 - RNA, 21 nt, Yersinia pestis
uuuacgggugcugggauaauu

SEQ ID NO: 4158732 - RNA, 22 nt, Yersinia pestis
uuuacguacgccgaacuucauc

SEQ ID NO: 4158733 - RNA, 16 nt, Yersinia pestis
uuuacgugaucaucuu

SEQ ID NO: 4158734 - RNA, 19 nt, Yersinia pestis
uuuacuccccaaagccuac

SEQ ID NO: 4158735 - RNA, 14 nt, Yersinia pestis
uuuacuccucugcc

SEQ ID NO: 4158736 - RNA, 21 nt, Yersinia pestis
uuuacugcggcuuucugccug

SEQ ID NO: 4158737 - RNA, 21 nt, Yersinia pestis
uuuacuguuaauccaguugag

SEQ ID NO: 4158738 - RNA, 21 nt, Yersinia pestis
uuuacuuuaucguccaugcuu

SEQ ID NO: 4158739 - RNA, 12 nt, Yersinia pestis
uuuagaaaacau

SEQ ID NO: 4158740 - RNA, 23 nt, Yersinia pestis
uuuagacaagcgcaguagcggcu

SEQ ID NO: 4158741 - RNA, 14 nt, Yersinia pestis
uuuagaucucagaa

SEQ ID NO: 4158742 - RNA, 11 nt, Yersinia pestis
uuuagcaaagc

SEQ ID NO: 4158743 - RNA, 18 nt, Yersinia pestis
uuuagcauuacucugaca

SEQ ID NO: 4158744 - RNA, 12 nt, Yersinia pestis
uuuagcauugca

SEQ ID NO: 4158745 - RNA, 14 nt, Yersinia pestis
uuuagcgcuaaauc

SEQ ID NO: 4158746 - RNA, 19 nt, Yersinia pestis
uuuaggccaauuuggccaa

SEQ ID NO: 4158747 - RNA, 19 nt, Yersinia pestis
uuuaggcgggcaguauaau

SEQ ID NO: 4158748 - RNA, 23 nt, Yersinia pestis
uuuaggguauagcaugaaugaaa

SEQ ID NO: 4158749 - RNA, 18 nt, Yersinia pestis
uuuagucaaaacaauauc

SEQ ID NO: 4158750 - RNA, 18 nt, Yersinia pestis
uuuagucaucaugacgau

SEQ ID NO: 4158751 - RNA, 21 nt, Yersinia pestis
uuuagugcugccagacaauga

SEQ ID NO: 4158752 - RNA, 19 nt, Yersinia pestis
uuuauaaaaaauggaguuu

SEQ ID NO: 4158753 - RNA, 14 nt, Yersinia pestis
uuuauaaaaccacu

SEQ ID NO: 4158754 - RNA, 23 nt, Yersinia pestis
uuuauaaauuacucguauaaaaa

SEQ ID NO: 4158755 - RNA, 18 nt, Yersinia pestis
uuuauaaccgucaccaaa

SEQ ID NO: 4158756 - RNA, 18 nt, Yersinia pestis
uuuauaaugagaauguaa

SEQ ID NO: 4158757 - RNA, 19 nt, Yersinia pestis
uuuauaaugagaauguaaa

SEQ ID NO: 4158758 - RNA, 15 nt, Yersinia pestis
uuuauacauaucaga

SEQ ID NO: 4158759 - RNA, 20 nt, Yersinia pestis
uuuauaccggggccaucauc

SEQ ID NO: 4158760 - RNA, 20 nt, Yersinia pestis
uuuauagaauacaggguaaa

SEQ ID NO: 4158761 - RNA, 19 nt, Yersinia pestis
uuuauagggucgaauguuc

SEQ ID NO: 4158762 - RNA, 12 nt, Yersinia pestis
uuuauaucagau

SEQ ID NO: 4158763 - RNA, 13 nt, Yersinia pestis
uuuauauccccua

SEQ ID NO: 4158764 - RNA, 13 nt, Yersinia pestis
uuuauauccccug

SEQ ID NO: 4158765 - RNA, 19 nt, Yersinia pestis
uuuauauuccacauacaaa

SEQ ID NO: 4158766 - RNA, 16 nt, Yersinia pestis
uuuauauugauaaaaa

SEQ ID NO: 4158767 - RNA, 17 nt, Yersinia pestis
uuuauauugauacggcu

SEQ ID NO: 4158768 - RNA, 23 nt, Yersinia pestis
uuuauauugaugacugaauuguc

SEQ ID NO: 4158769 - RNA, 22 nt, Yersinia pestis
uuuauauugaugugaaacauaa

SEQ ID NO: 4158770 - RNA, 13 nt, Yersinia pestis
uuuauauuuuugg

SEQ ID NO: 4158771 - RNA, 17 nt, Yersinia pestis
uuuaucaauaggucagu

SEQ ID NO: 4158772 - RNA, 19 nt, Yersinia pestis
uuuaucaaucagcugauau

SEQ ID NO: 4158773 - RNA, 15 nt, Yersinia pestis
uuuaucaucauaaau

SEQ ID NO: 4158774 - RNA, 14 nt, Yersinia pestis
uuuauccaaucuug

SEQ ID NO: 4158775 - RNA, 19 nt, Yersinia pestis
uuugacacgggaucaacau

SEQ ID NO: 4158776 - RNA, 13 nt, Yersinia pestis
uuugacuuuaauu

SEQ ID NO: 4158777 - RNA, 23 nt, Yersinia pestis
uuugacuuugucagcagucugag

SEQ ID NO: 4158778 - RNA, 10 nt, Yersinia pestis
uuugagaaag

SEQ ID NO: 4158779 - RNA, 23 nt, Yersinia pestis
uuugagauauaggcaucuuucag

SEQ ID NO: 4158780 - RNA, 21 nt, Yersinia pestis
uuugagccaccgcauuccagc

SEQ ID NO: 4158781 - RNA, 15 nt, Yersinia pestis
uuugagcucaccguu

SEQ ID NO: 4158782 - RNA, 21 nt, Yersinia pestis
uuugauaaggccaugucacua

SEQ ID NO: 4158783 - RNA, 19 nt, Yersinia pestis
uuugauaauuucaguucag

SEQ ID NO: 4158784 - RNA, 13 nt, Yersinia pestis
uuugauacuguuc

SEQ ID NO: 4158785 - RNA, 16 nt, Yersinia pestis
uuugaucauggcuugu

SEQ ID NO: 4158786 - RNA, 14 nt, Yersinia pestis
uuugauuuaaauau

SEQ ID NO: 4158787 - RNA, 16 nt, Yersinia pestis
uuugauuuaaauauua

SEQ ID NO: 4158788 - RNA, 14 nt, Yersinia pestis
uuugauuugaagau

SEQ ID NO: 4158789 - RNA, 12 nt, Yersinia pestis
uuugcaauuaau

SEQ ID NO: 4158790 - RNA, 20 nt, Yersinia pestis
uuugcacgaucagugaagag

SEQ ID NO: 4158791 - RNA, 19 nt, Yersinia pestis
uuugcagcggaugauaaau

SEQ ID NO: 4158792 - RNA, 13 nt, Yersinia pestis
uuugcauccgcaa

SEQ ID NO: 4158793 - RNA, 15 nt, Yersinia pestis
uuugcaucuggugac

SEQ ID NO: 4158794 - RNA, 18 nt, Yersinia pestis
uuugcauugaccgccaaa

SEQ ID NO: 4158795 - RNA, 22 nt, Yersinia pestis
uuugcauugaccgccaaaucca

SEQ ID NO: 4158796 - RNA, 20 nt, Yersinia pestis
uuugcccgcgcuuccaggcu

SEQ ID NO: 4158797 - RNA, 19 nt, Yersinia pestis
uuugccguuguuaguguau

SEQ ID NO: 4158798 - RNA, 22 nt, Yersinia pestis
uuugccuucauccaacucacca

SEQ ID NO: 4158799 - RNA, 24 nt, Yersinia pestis
uuugcgauacaccauuuccaggcu

SEQ ID NO: 4158800 - RNA, 19 nt, Yersinia pestis
uuugcgcagcaaauaaaca

SEQ ID NO: 4158801 - RNA, 19 nt, Yersinia pestis
uuugcgcccgcgccagaug

SEQ ID NO: 4158802 - RNA, 22 nt, Yersinia pestis
uuugcgggacauuuuaaagaau

SEQ ID NO: 4158803 - RNA, 14 nt, Yersinia pestis
uuugcuauugaaca

SEQ ID NO: 4158804 - RNA, 17 nt, Yersinia pestis
uuugcuccuggcaugca

SEQ ID NO: 4158805 - RNA, 20 nt, Yersinia pestis
uuugcucgggcucucuucag

SEQ ID NO: 4158806 - RNA, 13 nt, Yersinia pestis
uuugcugcacugc

SEQ ID NO: 4158807 - RNA, 14 nt, Yersinia pestis
uuugcugccaucag

SEQ ID NO: 4158808 - RNA, 17 nt, Yersinia pestis
uuugcugccauuuccaa

SEQ ID NO: 4158809 - RNA, 19 nt, Yersinia pestis
uuugcugccugcaccagug

SEQ ID NO: 4158810 - RNA, 19 nt, Yersinia pestis
uuugcuguggcgauuuaau

SEQ ID NO: 4158811 - RNA, 19 nt, Yersinia pestis
uuugcuucgauuuuauauu

SEQ ID NO: 4158812 - RNA, 22 nt, Yersinia pestis
uuugcuucgccauuuccaucau

SEQ ID NO: 4158813 - RNA, 15 nt, Yersinia pestis
uuugcuugcugccug

SEQ ID NO: 4158814 - RNA, 23 nt, Yersinia pestis
uuugcuugguuacgggcuugcug

SEQ ID NO: 4158815 - RNA, 17 nt, Yersinia pestis
uuuggauuggucagguu

SEQ ID NO: 4158816 - RNA, 14 nt, Yersinia pestis
uuuggcauuuucag

SEQ ID NO: 4158817 - RNA, 20 nt, Yersinia pestis
uuuggccgcucaacuuugcu

SEQ ID NO: 4158818 - RNA, 20 nt, Yersinia pestis
uuuggcucgugaucagcaga

SEQ ID NO: 4158819 - RNA, 13 nt, Yersinia pestis
uuugggaacaaca

SEQ ID NO: 4158820 - RNA, 17 nt, Yersinia pestis
uuugggaacaacagcau

SEQ ID NO: 4158821 - RNA, 13 nt, Yersinia pestis
uuugggcuaaaac

SEQ ID NO: 4158822 - RNA, 15 nt, Yersinia pestis
uuugggcuugagcag

SEQ ID NO: 4158823 - RNA, 15 nt, Yersinia pestis
uuugggguauauauu

SEQ ID NO: 4158824 - RNA, 22 nt, Yersinia pestis
uuuggucaaauccggauuucua

SEQ ID NO: 4158825 - RNA, 23 nt, Yersinia pestis
uuuggucaguugaauauuccauu

SEQ ID NO: 4158826 - RNA, 21 nt, Yersinia pestis
uuuggugaucaugauuucucg

SEQ ID NO: 4158827 - RNA, 16 nt, Yersinia pestis
uuugguuauuaugauu

SEQ ID NO: 4158828 - RNA, 23 nt, Yersinia pestis
uuugguugaacauuuccacucuu

SEQ ID NO: 4158829 - RNA, 14 nt, Yersinia pestis
uuugguuuucuauu

SEQ ID NO: 4158830 - RNA, 17 nt, Yersinia pestis
uuuguacaacuucuuca

SEQ ID NO: 4158831 - RNA, 18 nt, Yersinia pestis
uuuguagugacguaaaaa

SEQ ID NO: 4158832 - RNA, 22 nt, Yersinia pestis
uuuguauuuacucguuuuacau

SEQ ID NO: 4158833 - RNA, 13 nt, Yersinia pestis
uuuguauuuuguu

SEQ ID NO: 4158834 - RNA, 20 nt, Yersinia pestis
uuugucaauaaccucagccu

SEQ ID NO: 4158835 - RNA, 23 nt, Yersinia pestis
uuugucagcagucugagggccac

SEQ ID NO: 4158836 - RNA, 24 nt, Yersinia pestis
uuugucauacacggucuggcaacg

SEQ ID NO: 4158837 - RNA, 15 nt, Yersinia pestis
uuugucaucaaccuc

SEQ ID NO: 4158838 - RNA, 13 nt, Yersinia pestis
uuugucauguuga

SEQ ID NO: 4158839 - RNA, 20 nt, Yersinia pestis
uuugucauguugaccaaaca

SEQ ID NO: 4158840 - RNA, 22 nt, Yersinia pestis
uuugucauguugaccaaacaga

SEQ ID NO: 4158841 - RNA, 14 nt, Yersinia pestis
uuugucauuuaauu

SEQ ID NO: 4158842 - RNA, 22 nt, Yersinia pestis
uuuguccggagagagacuuugu

SEQ ID NO: 4158843 - RNA, 22 nt, Yersinia pestis
uuuguguugaacuuuauuuaau

SEQ ID NO: 4158844 - RNA, 21 nt, Yersinia pestis
uuuguuaaaauaguggcacaa

SEQ ID NO: 4158845 - RNA, 12 nt, Yersinia pestis
uuuguuauuucu

SEQ ID NO: 4158846 - RNA, 13 nt, Yersinia pestis
uuuguugauguaa

SEQ ID NO: 4158847 - RNA, 22 nt, Yersinia pestis
uuuguugucagauaucugcuca

SEQ ID NO: 4158848 - RNA, 13 nt, Yersinia pestis
uuuguuuuuauau

SEQ ID NO: 4158849 - RNA, 14 nt, Yersinia pestis
uuuuaaaaaaaaag

SEQ ID NO: 4158850 - RNA, 19 nt, Yersinia pestis
uuuuaaacgucagauuagu

SEQ ID NO: 4158851 - RNA, 16 nt, Yersinia pestis
uuuuaaagaaaaaacg

SEQ ID NO: 4158852 - RNA, 21 nt, Yersinia pestis
uuuuaaagcacggccauuucu

SEQ ID NO: 4158853 - RNA, 15 nt, Yersinia pestis
uuuuaacaaaaugga

SEQ ID NO: 4158854 - RNA, 13 nt, Yersinia pestis
uuuuaacaucauu

SEQ ID NO: 4158855 - RNA, 21 nt, Yersinia pestis
uuuuaacgucgcugaaaugcu

SEQ ID NO: 4158856 - RNA, 22 nt, Yersinia pestis
uuuuaacgucgcugaaaugcua

SEQ ID NO: 4158857 - RNA, 23 nt, Yersinia pestis
uuuuaaggacucuuaguuucuac

SEQ ID NO: 4158858 - RNA, 17 nt, Yersinia pestis
uuuuaaguuuauuuaac

SEQ ID NO: 4158859 - RNA, 13 nt, Yersinia pestis
uuuuaauaaaaaa

SEQ ID NO: 4158860 - RNA, 23 nt, Yersinia pestis
uuuuaauaaaaaacugacucacg

SEQ ID NO: 4158861 - RNA, 16 nt, Yersinia pestis
uuuuaaucucuccaug

SEQ ID NO: 4158862 - RNA, 18 nt, Yersinia pestis
uuuuaaucucuccaugau

SEQ ID NO: 4158863 - RNA, 23 nt, Yersinia pestis
uuuuaauuauaauccacugaaau

SEQ ID NO: 4158864 - RNA, 17 nt, Yersinia pestis
uuuuaauuuaaccaucu

SEQ ID NO: 4158865 - RNA, 23 nt, Yersinia pestis
uuuuacaaauuugacauuuccuu

SEQ ID NO: 4158866 - RNA, 13 nt, Yersinia pestis
uuuuacaauuacg

SEQ ID NO: 4158867 - RNA, 13 nt, Yersinia pestis
uuuuaccuaguag

SEQ ID NO: 4158868 - RNA, 23 nt, Yersinia pestis
uuuuaccuuuaacuguuuuauau

SEQ ID NO: 4158869 - RNA, 19 nt, Yersinia pestis
uuuuacgccuauccucaug

SEQ ID NO: 4158870 - RNA, 16 nt, Yersinia pestis
uuuuacgcgugauauu

SEQ ID NO: 4158871 - RNA, 20 nt, Yersinia pestis
uuuuacugguucauuuucca

SEQ ID NO: 4158872 - RNA, 13 nt, Yersinia pestis
uuuuagacgucag

SEQ ID NO: 4158873 - RNA, 16 nt, Yersinia pestis
uuuuagauaucagaaa

SEQ ID NO: 4158874 - RNA, 15 nt, Yersinia pestis
uuuuagcgcuuuuac

SEQ ID NO: 4158875 - RNA, 17 nt, Yersinia pestis
uuuuagcgcuuuuacau

SEQ ID NO: 4158876 - RNA, 17 nt, Yersinia pestis
uuuuagugauuaauuaa

SEQ ID NO: 4158877 - RNA, 15 nt, Yersinia pestis
uuuuauaaucaucua

SEQ ID NO: 4158878 - RNA, 17 nt, Yersinia pestis
uuuuauaccgcagcaua

SEQ ID NO: 4158879 - RNA, 22 nt, Yersinia pestis
uuuuauaccgcagcauaaggcg

SEQ ID NO: 4158880 - RNA, 17 nt, Yersinia pestis
uuuuauaggucauccca

SEQ ID NO: 4158881 - RNA, 16 nt, Yersinia pestis
uuuuauauaauugaag

SEQ ID NO: 4158882 - RNA, 14 nt, Yersinia pestis
uuuuauaucagauu

SEQ ID NO: 4158883 - RNA, 20 nt, Yersinia pestis
uuuuauauugauaaaaauca

SEQ ID NO: 4158884 - RNA, 23 nt, Yersinia pestis
uuuuaucaggcgaaugcccugcu

SEQ ID NO: 4158885 - RNA, 15 nt, Yersinia pestis
uuuuaucaucauaaa

SEQ ID NO: 4158886 - RNA, 15 nt, Yersinia pestis
uuuuaucauuuaaau

SEQ ID NO: 4158887 - RNA, 21 nt, Yersinia pestis
uuuuaucgugaauaaaaauaa

SEQ ID NO: 4158888 - RNA, 13 nt, Yersinia pestis
uuuuaugcccccu

SEQ ID NO: 4158889 - RNA, 12 nt, Yersinia pestis
uuuuaugccuuu

SEQ ID NO: 4158890 - RNA, 22 nt, Yersinia pestis
uuuuauggcauaaacugaaguu

SEQ ID NO: 4158891 - RNA, 13 nt, Yersinia pestis
uuuuauguuaaau

SEQ ID NO: 4158892 - RNA, 15 nt, Yersinia pestis
uuuuauguuaaauca

SEQ ID NO: 4158893 - RNA, 14 nt, Yersinia pestis
uuuuauuaaaucac

SEQ ID NO: 4158894 - RNA, 17 nt, Yersinia pestis
uuuuauuaccugcuauu

SEQ ID NO: 4158895 - RNA, 21 nt, Yersinia pestis
uuuuauuaccugcuauuuuau

SEQ ID NO: 4158896 - RNA, 21 nt, Yersinia pestis
aucgcucugcguuuuucccug

SEQ ID NO: 4158897 - RNA, 22 nt, Yersinia pestis
aucgcucuugagggugaccauc

SEQ ID NO: 4158898 - RNA, 21 nt, Yersinia pestis
aucgcugccaccgucgcagaa

SEQ ID NO: 4158899 - RNA, 16 nt, Yersinia pestis
aucgcuucugaacgua

SEQ ID NO: 4158900 - RNA, 18 nt, Yersinia pestis
aucgcuuuuagauaaagg

SEQ ID NO: 4158901 - RNA, 13 nt, Yersinia pestis
aucgcuuuuuaca

SEQ ID NO: 4158902 - RNA, 19 nt, Yersinia pestis
aucggcaaaccgaauacca

SEQ ID NO: 4158903 - RNA, 15 nt, Yersinia pestis
aucggcauaaauggc

SEQ ID NO: 4158904 - RNA, 20 nt, Yersinia pestis
aucggccagugcgccggccu

SEQ ID NO: 4158905 - RNA, 20 nt, Yersinia pestis
aucggcuguuaccaaacauu

SEQ ID NO: 4158906 - RNA, 21 nt, Yersinia pestis
aucgggacgcguuugcuugcu

SEQ ID NO: 4158907 - RNA, 17 nt, Yersinia pestis
aucgggagaugcaguaa

SEQ ID NO: 4158908 - RNA, 19 nt, Yersinia pestis
aucgggcguuggaggcuuu

SEQ ID NO: 4158909 - RNA, 15 nt, Yersinia pestis
aucgggcuaucauca

SEQ ID NO: 4158910 - RNA, 22 nt, Yersinia pestis
aucgggcuuuacagucgcugcu

SEQ ID NO: 4158911 - RNA, 14 nt, Yersinia pestis
aucggguagcaucc

SEQ ID NO: 4158912 - RNA, 15 nt, Yersinia pestis
aucgguaaaaaauca

SEQ ID NO: 4158913 - RNA, 13 nt, Yersinia pestis
aucgguaaaucgc

SEQ ID NO: 4158914 - RNA, 13 nt, Yersinia pestis
aucgguaucgaua

SEQ ID NO: 4158915 - RNA, 13 nt, Yersinia pestis
aucgguaucggcc

SEQ ID NO: 4158916 - RNA, 21 nt, Yersinia pestis
aucgguggugaccugccaauu

SEQ ID NO: 4158917 - RNA, 15 nt, Yersinia pestis
aucgguuagcuacug

SEQ ID NO: 4158918 - RNA, 16 nt, Yersinia pestis
aucgguuucagcuugc

SEQ ID NO: 4158919 - RNA, 21 nt, Yersinia pestis
aucguaacccccagccagaau

SEQ ID NO: 4158920 - RNA, 12 nt, Yersinia pestis
aucguagucuau

SEQ ID NO: 4158921 - RNA, 15 nt, Yersinia pestis
aucgucaagcaaugg

SEQ ID NO: 4158922 - RNA, 14 nt, Yersinia pestis
aucgucacgaucaa

SEQ ID NO: 4158923 - RNA, 22 nt, Yersinia pestis
aucgucagccccugccagaauc

SEQ ID NO: 4158924 - RNA, 12 nt, Yersinia pestis
aucguccagcag

SEQ ID NO: 4158925 - RNA, 15 nt, Yersinia pestis
aucguccagcagcag

SEQ ID NO: 4158926 - RNA, 15 nt, Yersinia pestis
aucguccggucugaa

SEQ ID NO: 4158927 - RNA, 18 nt, Yersinia pestis
aucguccggucugaagag

SEQ ID NO: 4158928 - RNA, 17 nt, Yersinia pestis
aucgugaauaaaaauaa

SEQ ID NO: 4158929 - RNA, 21 nt, Yersinia pestis
aucgugaguguuucucagcgu

SEQ ID NO: 4158930 - RNA, 19 nt, Yersinia pestis
aucgugcaguaauggaaau

SEQ ID NO: 4158931 - RNA, 17 nt, Yersinia pestis
aucgugcuccgcuucca

SEQ ID NO: 4158932 - RNA, 21 nt, Yersinia pestis
aucguggagacgccuucacgg

SEQ ID NO: 4158933 - RNA, 14 nt, Yersinia pestis
aucguuacucgauu

SEQ ID NO: 4158934 - RNA, 15 nt, Yersinia pestis
aucguugcaggauaa

SEQ ID NO: 4158935 - RNA, 20 nt, Yersinia pestis
aucguuggugcgacaaagau

SEQ ID NO: 4158936 - RNA, 16 nt, Yersinia pestis
aucguuuuauggcgau

SEQ ID NO: 4158937 - RNA, 17 nt, Yersinia pestis
aucuaaaauaucuuuca

SEQ ID NO: 4158938 - RNA, 19 nt, Yersinia pestis
aucuaaacaauugccuuug

SEQ ID NO: 4158939 - RNA, 15 nt, Yersinia pestis
aucuaacuaauaaua

SEQ ID NO: 4158940 - RNA, 18 nt, Yersinia pestis
aucuaacucauucauaau

SEQ ID NO: 4158941 - RNA, 12 nt, Yersinia pestis
aucuaacugcac

SEQ ID NO: 4158942 - RNA, 14 nt, Yersinia pestis
aucuaaguccaaga

SEQ ID NO: 4158943 - RNA, 21 nt, Yersinia pestis
aucuaauagaauagaucccau

SEQ ID NO: 4158944 - RNA, 21 nt, Yersinia pestis
aucuaaucggcuggcaagaua

SEQ ID NO: 4158945 - RNA, 20 nt, Yersinia pestis
aucuagcagugauuucagug

SEQ ID NO: 4158946 - RNA, 15 nt, Yersinia pestis
aucuaggugcaguaa

SEQ ID NO: 4158947 - RNA, 14 nt, Yersinia pestis
aucuaucuguucac

SEQ ID NO: 4158948 - RNA, 13 nt, Yersinia pestis
aucuauuaauauc

SEQ ID NO: 4158949 - RNA, 16 nt, Yersinia pestis
aucuauucucuguaau

SEQ ID NO: 4158950 - RNA, 17 nt, Yersinia pestis
aucuauugugucaauac

SEQ ID NO: 4158951 - RNA, 17 nt, Yersinia pestis
aucuauuugaguuuuag

SEQ ID NO: 4158952 - RNA, 21 nt, Yersinia pestis
aucuauuuuuauuucuccuua

SEQ ID NO: 4158953 - RNA, 15 nt, Yersinia pestis
aucuauuuuuuugaa

SEQ ID NO: 4158954 - RNA, 17 nt, Yersinia pestis
aucucaagacacuauuc

SEQ ID NO: 4158955 - RNA, 16 nt, Yersinia pestis
aucucaccacgcccac

SEQ ID NO: 4158956 - RNA, 15 nt, Yersinia pestis
aucucacgcugaaua

SEQ ID NO: 4158957 - RNA, 18 nt, Yersinia pestis
aucucacgcugaauaaca

SEQ ID NO: 4158958 - RNA, 15 nt, Yersinia pestis
aucucacgguaguga

SEQ ID NO: 4158959 - RNA, 15 nt, Yersinia pestis
aucucagaauuuuuu

SEQ ID NO: 4158960 - RNA, 20 nt, Yersinia pestis
aucucagcagugaguuuauu

SEQ ID NO: 4158961 - RNA, 23 nt, Yersinia pestis
aucucagugagguuuuugauggu

SEQ ID NO: 4158962 - RNA, 20 nt, Yersinia pestis
aucucauccagcaacucaag

SEQ ID NO: 4158963 - RNA, 22 nt, Yersinia pestis
aucucauccauguuagagauaa

SEQ ID NO: 4158964 - RNA, 16 nt, Yersinia pestis
aucucaucggcauacu

SEQ ID NO: 4158965 - RNA, 19 nt, Yersinia pestis
aucucaucggcauacuccu

SEQ ID NO: 4158966 - RNA, 20 nt, Yersinia pestis
aucucaucuuaaucacgaua

SEQ ID NO: 4158967 - RNA, 16 nt, Yersinia pestis
aucucaugacaaagaa

SEQ ID NO: 4158968 - RNA, 13 nt, Yersinia pestis
aucuccagaagca

SEQ ID NO: 4158969 - RNA, 16 nt, Yersinia pestis
aucuccaguugcacac

SEQ ID NO: 4158970 - RNA, 19 nt, Yersinia pestis
aucuccaguugcacaccau

SEQ ID NO: 4158971 - RNA, 15 nt, Yersinia pestis
aucuccauugauuca

SEQ ID NO: 4158972 - RNA, 15 nt, Yersinia pestis
aucuccgcggguucu

SEQ ID NO: 4158973 - RNA, 18 nt, Yersinia pestis
aucuccuccagaauaucu

SEQ ID NO: 4158974 - RNA, 21 nt, Yersinia pestis
aucuccuccagaauaucuuca

SEQ ID NO: 4158975 - RNA, 19 nt, Yersinia pestis
aucuccuccggagaggaga

SEQ ID NO: 4158976 - RNA, 14 nt, Yersinia pestis
aucucgacaaaucc

SEQ ID NO: 4158977 - RNA, 18 nt, Yersinia pestis
aucucgacaaauccuuuu

SEQ ID NO: 4158978 - RNA, 19 nt, Yersinia pestis
aucucgacaaauccuuuua

SEQ ID NO: 4158979 - RNA, 22 nt, Yersinia pestis
aucucgacaaauccuuuuaaaa

SEQ ID NO: 4158980 - RNA, 23 nt, Yersinia pestis
aucucggggccacgguuggccgu

SEQ ID NO: 4158981 - RNA, 14 nt, Yersinia pestis
aucucguugcccug

SEQ ID NO: 4158982 - RNA, 16 nt, Yersinia pestis
aucucuaucaauauau

SEQ ID NO: 4158983 - RNA, 19 nt, Yersinia pestis
aucucuaucaauauauacc

SEQ ID NO: 4158984 - RNA, 20 nt, Yersinia pestis
aucucuaucguuuggcaauu

SEQ ID NO: 4158985 - RNA, 13 nt, Yersinia pestis
aucucuccagccu

SEQ ID NO: 4158986 - RNA, 20 nt, Yersinia pestis
aucucuccagugcaaauuua

SEQ ID NO: 4158987 - RNA, 16 nt, Yersinia pestis
aucucugcaguacaga

SEQ ID NO: 4158988 - RNA, 16 nt, Yersinia pestis
aucucugcgacaucag

SEQ ID NO: 4158989 - RNA, 19 nt, Yersinia pestis
aucucuggcaacggcacau

SEQ ID NO: 4158990 - RNA, 14 nt, Yersinia pestis
aucucuucagcaau

SEQ ID NO: 4158991 - RNA, 19 nt, Yersinia pestis
aucucuucagcaauuuuua

SEQ ID NO: 4158992 - RNA, 20 nt, Yersinia pestis
aucucuucagcaauuuuuag

SEQ ID NO: 4158993 - RNA, 18 nt, Yersinia pestis
aucucuucgccuuugaug

SEQ ID NO: 4158994 - RNA, 21 nt, Yersinia pestis
aucucuugauagguuuuuccc

SEQ ID NO: 4158995 - RNA, 21 nt, Yersinia pestis
aucucuugauuaccaauaauu

SEQ ID NO: 4158996 - RNA, 20 nt, Yersinia pestis
aucucuuuauauucaauauc

SEQ ID NO: 4158997 - RNA, 21 nt, Yersinia pestis
aucucuuuauauucaauauca

SEQ ID NO: 4158998 - RNA, 16 nt, Yersinia pestis
aucugaaacggugagg

SEQ ID NO: 4158999 - RNA, 18 nt, Yersinia pestis
aucugaaacggugaggau

SEQ ID NO: 4159000 - RNA, 21 nt, Yersinia pestis
aucugaaacggugaggauagg

SEQ ID NO: 4159001 - RNA, 15 nt, Yersinia pestis
aucugaauggcccgc

SEQ ID NO: 4159002 - RNA, 15 nt, Yersinia pestis
aucugaccaaacauu

SEQ ID NO: 4159003 - RNA, 19 nt, Yersinia pestis
aucugacucuguaaaaauc

SEQ ID NO: 4159004 - RNA, 22 nt, Yersinia pestis
aucugacugcuugccaaauaua

SEQ ID NO: 4159005 - RNA, 12 nt, Yersinia pestis
aucugagccuuc

SEQ ID NO: 4159006 - RNA, 14 nt, Yersinia pestis
aucugagccuucaa

SEQ ID NO: 4159007 - RNA, 15 nt, Yersinia pestis
aucugagccuucaac

SEQ ID NO: 4159008 - RNA, 17 nt, Yersinia pestis
aucugagcgaacugaau

SEQ ID NO: 4159009 - RNA, 15 nt, Yersinia pestis
aucugauacugaacg

SEQ ID NO: 4159010 - RNA, 18 nt, Yersinia pestis
cgcaggccaugucgauca

SEQ ID NO: 4159011 - RNA, 12 nt, Yersinia pestis
cgcaggcggcca

SEQ ID NO: 4159012 - RNA, 13 nt, Yersinia pestis
cgcaggcggccaa

SEQ ID NO: 4159013 - RNA, 20 nt, Yersinia pestis
cgcagggugagucucagggg

SEQ ID NO: 4159014 - RNA, 21 nt, Yersinia pestis
cgcagguaucucacucaggcg

SEQ ID NO: 4159015 - RNA, 14 nt, Yersinia pestis
cgcagguuaucuga

SEQ ID NO: 4159016 - RNA, 19 nt, Yersinia pestis
cgcagguuaugcagcucaa

SEQ ID NO: 4159017 - RNA, 15 nt, Yersinia pestis
cgcagguucaucaga

SEQ ID NO: 4159018 - RNA, 15 nt, Yersinia pestis
cgcagguuggcggca

SEQ ID NO: 4159019 - RNA, 13 nt, Yersinia pestis
cgcaguaaauuca

SEQ ID NO: 4159020 - RNA, 16 nt, Yersinia pestis
cgcagugacgcaguga

SEQ ID NO: 4159021 - RNA, 16 nt, Yersinia pestis
cgcaguugccaaacaa

SEQ ID NO: 4159022 - RNA, 22 nt, Yersinia pestis
cgcauaugaaaaaccuccggcu

SEQ ID NO: 4159023 - RNA, 23 nt, Yersinia pestis
cgcaucaaacggcaacuucuaca

SEQ ID NO: 4159024 - RNA, 14 nt, Yersinia pestis
cgcaucagccagcc

SEQ ID NO: 4159025 - RNA, 16 nt, Yersinia pestis
cgcauccccacuugua

SEQ ID NO: 4159026 - RNA, 17 nt, Yersinia pestis
cgcauccccaucgccaa

SEQ ID NO: 4159027 - RNA, 22 nt, Yersinia pestis
cgcauccccaucgccaauacaa

SEQ ID NO: 4159028 - RNA, 15 nt, Yersinia pestis
cgcaucgucgcuguu

SEQ ID NO: 4159029 - RNA, 14 nt, Yersinia pestis
cgcaucuuccaaag

SEQ ID NO: 4159030 - RNA, 15 nt, Yersinia pestis
cgcaucuuccaaagg

SEQ ID NO: 4159031 - RNA, 18 nt, Yersinia pestis
cgcaugcaacagauaauu

SEQ ID NO: 4159032 - RNA, 15 nt, Yersinia pestis
cgcauguucagccgc

SEQ ID NO: 4159033 - RNA, 16 nt, Yersinia pestis
cgcauguucagccgcu

SEQ ID NO: 4159034 - RNA, 19 nt, Yersinia pestis
cgcauuaauccgccugaga

SEQ ID NO: 4159035 - RNA, 16 nt, Yersinia pestis
cgcauucaccaccaua

SEQ ID NO: 4159036 - RNA, 20 nt, Yersinia pestis
cgcauucauaucguccaaag

SEQ ID NO: 4159037 - RNA, 16 nt, Yersinia pestis
cgcauucaucagggca

SEQ ID NO: 4159038 - RNA, 13 nt, Yersinia pestis
cgcauuccaucag

SEQ ID NO: 4159039 - RNA, 21 nt, Yersinia pestis
cgcauugaccgcuguuugauu

SEQ ID NO: 4159040 - RNA, 17 nt, Yersinia pestis
cgcauugaggucagcgu

SEQ ID NO: 4159041 - RNA, 14 nt, Yersinia pestis
cgcauugauaaucu

SEQ ID NO: 4159042 - RNA, 17 nt, Yersinia pestis
cgcauugauaaucucca

SEQ ID NO: 4159043 - RNA, 15 nt, Yersinia pestis
cgcauugucacccac

SEQ ID NO: 4159044 - RNA, 21 nt, Yersinia pestis
cgcauugugcuuuuuggcaaa

SEQ ID NO: 4159045 - RNA, 18 nt, Yersinia pestis
cgcauuuuuuucacacca

SEQ ID NO: 4159046 - RNA, 16 nt, Yersinia pestis
cgccaacacuauugug

SEQ ID NO: 4159047 - RNA, 23 nt, Yersinia pestis
cgccaacaggccuaaugccgcgc

SEQ ID NO: 4159048 - RNA, 14 nt, Yersinia pestis
cgccaacugcggca

SEQ ID NO: 4159049 - RNA, 12 nt, Yersinia pestis
cgccaagccagu

SEQ ID NO: 4159050 - RNA, 20 nt, Yersinia pestis
cgccaaggaaggcuauuuuu

SEQ ID NO: 4159051 - RNA, 15 nt, Yersinia pestis
cgccaaguccuccuu

SEQ ID NO: 4159052 - RNA, 20 nt, Yersinia pestis
cgccaauacccguucaacag

SEQ ID NO: 4159053 - RNA, 16 nt, Yersinia pestis
cgccaauucaugcauc

SEQ ID NO: 4159054 - RNA, 14 nt, Yersinia pestis
cgccaauuuuguag

SEQ ID NO: 4159055 - RNA, 13 nt, Yersinia pestis
cgccaccaaugca

SEQ ID NO: 4159056 - RNA, 20 nt, Yersinia pestis
cgccaccaaugcauccaagc

SEQ ID NO: 4159057 - RNA, 14 nt, Yersinia pestis
cgccaccuggaacc

SEQ ID NO: 4159058 - RNA, 20 nt, Yersinia pestis
cgccacgcagugccgaugag

SEQ ID NO: 4159059 - RNA, 20 nt, Yersinia pestis
cgccacgcugauacauuucc

SEQ ID NO: 4159060 - RNA, 15 nt, Yersinia pestis
cgccacggauaaggu

SEQ ID NO: 4159061 - RNA, 18 nt, Yersinia pestis
cgccagauggucacccuc

SEQ ID NO: 4159062 - RNA, 19 nt, Yersinia pestis
cgccagauuauccagcccu

SEQ ID NO: 4159063 - RNA, 23 nt, Yersinia pestis
cgccagauucgcaaagcgggcca

SEQ ID NO: 4159064 - RNA, 22 nt, Yersinia pestis
cgccagcaacuaucuccggccu

SEQ ID NO: 4159065 - RNA, 19 nt, Yersinia pestis
cgccagccccgcuaccaag

SEQ ID NO: 4159066 - RNA, 22 nt, Yersinia pestis
cgccagggguaagauccaccac

SEQ ID NO: 4159067 - RNA, 19 nt, Yersinia pestis
cgccaguaaaccuggcggg

SEQ ID NO: 4159068 - RNA, 22 nt, Yersinia pestis
cgccagucagcuagccugcccc

SEQ ID NO: 4159069 - RNA, 18 nt, Yersinia pestis
cgccagugccgcggcggc

SEQ ID NO: 4159070 - RNA, 13 nt, Yersinia pestis
cgccaguguugcc

SEQ ID NO: 4159071 - RNA, 19 nt, Yersinia pestis
cgccaguguugccauggcc

SEQ ID NO: 4159072 - RNA, 20 nt, Yersinia pestis
cgccauaaugcggcucucuu

SEQ ID NO: 4159073 - RNA, 21 nt, Yersinia pestis
cgccauauacccaaagccagu

SEQ ID NO: 4159074 - RNA, 15 nt, Yersinia pestis
cgccauauauugauc

SEQ ID NO: 4159075 - RNA, 23 nt, Yersinia pestis
cgccauauauugauccaaauggc

SEQ ID NO: 4159076 - RNA, 14 nt, Yersinia pestis
cgccauaucauauc

SEQ ID NO: 4159077 - RNA, 14 nt, Yersinia pestis
cgccauauccaacu

SEQ ID NO: 4159078 - RNA, 22 nt, Yersinia pestis
cgccauauccaacuucuuccau

SEQ ID NO: 4159079 - RNA, 22 nt, Yersinia pestis
cgccauccuuuacuccccugcc

SEQ ID NO: 4159080 - RNA, 13 nt, Yersinia pestis
cgccaucgcacca

SEQ ID NO: 4159081 - RNA, 18 nt, Yersinia pestis
cgccaucguauauccacc

SEQ ID NO: 4159082 - RNA, 23 nt, Yersinia pestis
cgccaugauaaccacaacgacag

SEQ ID NO: 4159083 - RNA, 20 nt, Yersinia pestis
cgccaugcucagaaaccugu

SEQ ID NO: 4159084 - RNA, 17 nt, Yersinia pestis
cgccaugcuggaugaau

SEQ ID NO: 4159085 - RNA, 17 nt, Yersinia pestis
cgccauggcaugccaug

SEQ ID NO: 4159086 - RNA, 14 nt, Yersinia pestis
cgccauucauuuuu

SEQ ID NO: 4159087 - RNA, 17 nt, Yersinia pestis
cgccauugcauauugcu

SEQ ID NO: 4159088 - RNA, 18 nt, Yersinia pestis
cgcccaagcuuggccccu

SEQ ID NO: 4159089 - RNA, 16 nt, Yersinia pestis
cgcccagacgccggcc

SEQ ID NO: 4159090 - RNA, 21 nt, Yersinia pestis
cgcccccaauaagggccaccc

SEQ ID NO: 4159091 - RNA, 14 nt, Yersinia pestis
cgccccgauaaaug

SEQ ID NO: 4159092 - RNA, 13 nt, Yersinia pestis
cgccccgccccug

SEQ ID NO: 4159093 - RNA, 12 nt, Yersinia pestis
cgccccggccgc

SEQ ID NO: 4159094 - RNA, 20 nt, Yersinia pestis
cgccccguuaauccuucacu

SEQ ID NO: 4159095 - RNA, 13 nt, Yersinia pestis
cgcccgcgccaga

SEQ ID NO: 4159096 - RNA, 13 nt, Yersinia pestis
cgcccgcggccaa

SEQ ID NO: 4159097 - RNA, 17 nt, Yersinia pestis
cgcccgcggccaauagc

SEQ ID NO: 4159098 - RNA, 22 nt, Yersinia pestis
cgcccggagcguacacgcaaua

SEQ ID NO: 4159099 - RNA, 13 nt, Yersinia pestis
cgcccggcugacc

SEQ ID NO: 4159100 - RNA, 13 nt, Yersinia pestis
cgcccguugccca

SEQ ID NO: 4159101 - RNA, 16 nt, Yersinia pestis
cgcccguuggccggcc

SEQ ID NO: 4159102 - RNA, 12 nt, Yersinia pestis
cgcccuccugcg

SEQ ID NO: 4159103 - RNA, 15 nt, Yersinia pestis
cgcccuccugcggcg

SEQ ID NO: 4159104 - RNA, 16 nt, Yersinia pestis
cgcccuccugcggcgg

SEQ ID NO: 4159105 - RNA, 18 nt, Yersinia pestis
cgcccucuugcugaguga

SEQ ID NO: 4159106 - RNA, 17 nt, Yersinia pestis
cgcccuugucugggcug

SEQ ID NO: 4159107 - RNA, 23 nt, Yersinia pestis
cgccgaacgacaaauuuuuccuu

SEQ ID NO: 4159108 - RNA, 18 nt, Yersinia pestis
cgccgacaauacugccaa

SEQ ID NO: 4159109 - RNA, 16 nt, Yersinia pestis
cgccgaguaagucaau

SEQ ID NO: 4159110 - RNA, 21 nt, Yersinia pestis
cgccgccucuucugucggagc

SEQ ID NO: 4159111 - RNA, 22 nt, Yersinia pestis
cgccgcgugacuauucugccua

SEQ ID NO: 4159112 - RNA, 22 nt, Yersinia pestis
cgccgcucaauuaaccugagcg

SEQ ID NO: 4159113 - RNA, 23 nt, Yersinia pestis
cgccggaauaaagcucucgcggc

SEQ ID NO: 4159114 - RNA, 13 nt, Yersinia pestis
cgccggguuuugc

SEQ ID NO: 4159115 - RNA, 19 nt, Yersinia pestis
cgccguaaacauggcucuc

SEQ ID NO: 4159116 - RNA, 13 nt, Yersinia pestis
cgccguaaacugc

SEQ ID NO: 4159117 - RNA, 16 nt, Yersinia pestis
cgccguaaacugccgu

SEQ ID NO: 4159118 - RNA, 15 nt, Yersinia pestis
cgccguagauuuaac

SEQ ID NO: 4159119 - RNA, 20 nt, Yersinia pestis
cgccguauaaacgccuccga

SEQ ID NO: 4159120 - RNA, 21 nt, Yersinia pestis
cgccgucaaacucuucagcca

SEQ ID NO: 4159121 - RNA, 14 nt, Yersinia pestis
cgccgucagcucuu

SEQ ID NO: 4159122 - RNA, 13 nt, Yersinia pestis
cgccgucaucauc

SEQ ID NO: 4159123 - RNA, 17 nt, Yersinia pestis
cgccgugagcaaucugg

SEQ ID NO: 4159124 - RNA, 13 nt, Yersinia pestis
cgccgugccagaa

SEQ ID NO: 4159125 - RNA, 23 nt, Yersinia pestis
cgccguggcgacagcuauuuauu

SEQ ID NO: 4159126 - RNA, 23 nt, Yersinia pestis
cgccgugucggaugccgcuccag

SEQ ID NO: 4159127 - RNA, 23 nt, Yersinia pestis
cgccuaaagcgccuuccuuuuau

SEQ ID NO: 4159128 - RNA, 12 nt, Yersinia pestis
cgccuagcauca

SEQ ID NO: 4159129 - RNA, 15 nt, Yersinia pestis
cgccuaguuaaacuc

SEQ ID NO: 4159130 - RNA, 18 nt, Yersinia pestis
cgccuaucugaaugaauu

SEQ ID NO: 4159131 - RNA, 19 nt, Yersinia pestis
cgccucaucguaaccccca

SEQ ID NO: 4159132 - RNA, 16 nt, Yersinia pestis
cgccuccgauucauag

SEQ ID NO: 4159133 - RNA, 19 nt, Yersinia pestis
cgccucgcuuacugguacc

SEQ ID NO: 4159134 - RNA, 12 nt, Yersinia pestis
cgccucucuggc

SEQ ID NO: 4159135 - RNA, 22 nt, Yersinia pestis
ccuguggggcuacuuuuuucac

SEQ ID NO: 4159136 - RNA, 20 nt, Yersinia pestis
ccuguguuuugagcaucacu

SEQ ID NO: 4159137 - RNA, 15 nt, Yersinia pestis
ccuguuaauaauuca

SEQ ID NO: 4159138 - RNA, 17 nt, Yersinia pestis
ccuguuacaucagagcu

SEQ ID NO: 4159139 - RNA, 20 nt, Yersinia pestis
ccuguuagggcgcggcuggu

SEQ ID NO: 4159140 - RNA, 20 nt, Yersinia pestis
ccuguuccaacgagugcaga

SEQ ID NO: 4159141 - RNA, 16 nt, Yersinia pestis
ccuguugaucuucuug

SEQ ID NO: 4159142 - RNA, 13 nt, Yersinia pestis
ccuguugcaauug

SEQ ID NO: 4159143 - RNA, 16 nt, Yersinia pestis
ccuguuuacguaaaua

SEQ ID NO: 4159144 - RNA, 15 nt, Yersinia pestis
ccuguuucgauccag

SEQ ID NO: 4159145 - RNA, 21 nt, Yersinia pestis
ccuuaaccaacaugagccaca

SEQ ID NO: 4159146 - RNA, 19 nt, Yersinia pestis
ccuuaacggucagauccac

SEQ ID NO: 4159147 - RNA, 22 nt, Yersinia pestis
ccuuaacggucagauccacauu

SEQ ID NO: 4159148 - RNA, 14 nt, Yersinia pestis
ccuuaacugcauag

SEQ ID NO: 4159149 - RNA, 16 nt, Yersinia pestis
ccuuaacugcauagcu

SEQ ID NO: 4159150 - RNA, 19 nt, Yersinia pestis
ccuuaauguuuuacgauca

SEQ ID NO: 4159151 - RNA, 21 nt, Yersinia pestis
ccuuaauuaacucuucuguug

SEQ ID NO: 4159152 - RNA, 12 nt, Yersinia pestis
ccuuacagugau

SEQ ID NO: 4159153 - RNA, 15 nt, Yersinia pestis
ccuuacgcugauuaa

SEQ ID NO: 4159154 - RNA, 16 nt, Yersinia pestis
ccuuacuaucuuuauu

SEQ ID NO: 4159155 - RNA, 14 nt, Yersinia pestis
ccuuacuauuuuca

SEQ ID NO: 4159156 - RNA, 14 nt, Yersinia pestis
ccuuacuauuuuuc

SEQ ID NO: 4159157 - RNA, 18 nt, Yersinia pestis
ccuuacuguaucaauacc

SEQ ID NO: 4159158 - RNA, 21 nt, Yersinia pestis
ccuuagcgccaucgcuaauca

SEQ ID NO: 4159159 - RNA, 21 nt, Yersinia pestis
ccuuauaaauccgcuaguuaa

SEQ ID NO: 4159160 - RNA, 14 nt, Yersinia pestis
ccuuaucagcgaaa

SEQ ID NO: 4159161 - RNA, 19 nt, Yersinia pestis
ccuuauccguuaacccaaa

SEQ ID NO: 4159162 - RNA, 17 nt, Yersinia pestis
ccuuaucuaucucaggc

SEQ ID NO: 4159163 - RNA, 12 nt, Yersinia pestis
ccuucaaccacg

SEQ ID NO: 4159164 - RNA, 13 nt, Yersinia pestis
ccuucaacucuac

SEQ ID NO: 4159165 - RNA, 18 nt, Yersinia pestis
ccuucaacuguggauuau

SEQ ID NO: 4159166 - RNA, 23 nt, Yersinia pestis
ccuucacgcaucacaucuugcaa

SEQ ID NO: 4159167 - RNA, 20 nt, Yersinia pestis
ccuucacggaaaauaaagcu

SEQ ID NO: 4159168 - RNA, 20 nt, Yersinia pestis
ccuucacgguaguaauaauu

SEQ ID NO: 4159169 - RNA, 15 nt, Yersinia pestis
ccuucacuuacucuc

SEQ ID NO: 4159170 - RNA, 19 nt, Yersinia pestis
ccuucagacugcugacaaa

SEQ ID NO: 4159171 - RNA, 16 nt, Yersinia pestis
ccuucagcgauacaac

SEQ ID NO: 4159172 - RNA, 19 nt, Yersinia pestis
ccuucaggccuuuacuguu

SEQ ID NO: 4159173 - RNA, 14 nt, Yersinia pestis
ccuucaguucuuua

SEQ ID NO: 4159174 - RNA, 21 nt, Yersinia pestis
ccuucaguuuauuuaagcuga

SEQ ID NO: 4159175 - RNA, 18 nt, Yersinia pestis
ccuucaucgacaauggcu

SEQ ID NO: 4159176 - RNA, 16 nt, Yersinia pestis
ccuucaucuuucaagu

SEQ ID NO: 4159177 - RNA, 18 nt, Yersinia pestis
ccuucauuugacuuuguc

SEQ ID NO: 4159178 - RNA, 13 nt, Yersinia pestis
ccuucccauccua

SEQ ID NO: 4159179 - RNA, 14 nt, Yersinia pestis
ccuuccggcaucuu

SEQ ID NO: 4159180 - RNA, 15 nt, Yersinia pestis
ccuucgaaacugauc

SEQ ID NO: 4159181 - RNA, 22 nt, Yersinia pestis
ccuucgggcuugguguugcaaa

SEQ ID NO: 4159182 - RNA, 20 nt, Yersinia pestis
ccuucgguauauuucccguu

SEQ ID NO: 4159183 - RNA, 18 nt, Yersinia pestis
ccuucucgaugccuucuu

SEQ ID NO: 4159184 - RNA, 17 nt, Yersinia pestis
ccuucucucuaccgauc

SEQ ID NO: 4159185 - RNA, 19 nt, Yersinia pestis
ccuucucuuuaucaauuua

SEQ ID NO: 4159186 - RNA, 15 nt, Yersinia pestis
ccuucuggugguguc

SEQ ID NO: 4159187 - RNA, 17 nt, Yersinia pestis
ccuucuuauuuaucaca

SEQ ID NO: 4159188 - RNA, 15 nt, Yersinia pestis
ccuucuuccauugau

SEQ ID NO: 4159189 - RNA, 22 nt, Yersinia pestis
ccuucuucuccuauccacugug

SEQ ID NO: 4159190 - RNA, 14 nt, Yersinia pestis
ccuucuuuaucugu

SEQ ID NO: 4159191 - RNA, 17 nt, Yersinia pestis
ccuugaaacagcagggg

SEQ ID NO: 4159192 - RNA, 13 nt, Yersinia pestis
ccuugaauagcca

SEQ ID NO: 4159193 - RNA, 22 nt, Yersinia pestis
ccuugaauagccagaagccagg

SEQ ID NO: 4159194 - RNA, 23 nt, Yersinia pestis
ccuugacgccgaugaauauaaac

SEQ ID NO: 4159195 - RNA, 17 nt, Yersinia pestis
ccuugagggucgcccgg

SEQ ID NO: 4159196 - RNA, 14 nt, Yersinia pestis
ccuugaguauccaa

SEQ ID NO: 4159197 - RNA, 14 nt, Yersinia pestis
ccuugauccgccaa

SEQ ID NO: 4159198 - RNA, 14 nt, Yersinia pestis
ccuugaucgccaaa

SEQ ID NO: 4159199 - RNA, 20 nt, Yersinia pestis
ccuugauggaaauacgcuua

SEQ ID NO: 4159200 - RNA, 17 nt, Yersinia pestis
ccuugaugugcucugcu

SEQ ID NO: 4159201 - RNA, 18 nt, Yersinia pestis
ccuugaugugcucugcuc

SEQ ID NO: 4159202 - RNA, 22 nt, Yersinia pestis
ccuugaugugcucugcuccgcc

SEQ ID NO: 4159203 - RNA, 19 nt, Yersinia pestis
ccuugauuaauaacaguaa

SEQ ID NO: 4159204 - RNA, 14 nt, Yersinia pestis
ccuugccagugcaa

SEQ ID NO: 4159205 - RNA, 15 nt, Yersinia pestis
ccuugcgccaagucc

SEQ ID NO: 4159206 - RNA, 19 nt, Yersinia pestis
ccuuggcauugucugcugg

SEQ ID NO: 4159207 - RNA, 24 nt, Yersinia pestis
ccuuggcgcggacgcuuuacuccu

SEQ ID NO: 4159208 - RNA, 20 nt, Yersinia pestis
ccuuggcugccagugccgcc

SEQ ID NO: 4159209 - RNA, 14 nt, Yersinia pestis
ccuuggcuuugcgc

SEQ ID NO: 4159210 - RNA, 23 nt, Yersinia pestis
ccuuguaagaccaauugguaaga

SEQ ID NO: 4159211 - RNA, 22 nt, Yersinia pestis
ccuuguggauauuuaaugcagc

SEQ ID NO: 4159212 - RNA, 13 nt, Yersinia pestis
ccuuguggaucca

SEQ ID NO: 4159213 - RNA, 17 nt, Yersinia pestis
ccuuguucaaucagcau

SEQ ID NO: 4159214 - RNA, 11 nt, Yersinia pestis
ccuuguuucug

SEQ ID NO: 4159215 - RNA, 17 nt, Yersinia pestis
ccuuuaaaucuagcccu

SEQ ID NO: 4159216 - RNA, 16 nt, Yersinia pestis
ccuuuaggaaagccca

SEQ ID NO: 4159217 - RNA, 16 nt, Yersinia pestis
ccuuuauccaaccacc

SEQ ID NO: 4159218 - RNA, 21 nt, Yersinia pestis
ccuuuaucgcggacaccaacu

SEQ ID NO: 4159219 - RNA, 17 nt, Yersinia pestis
ccuuuauguaguucagu

SEQ ID NO: 4159220 - RNA, 12 nt, Yersinia pestis
ccuuucaaaauu

SEQ ID NO: 4159221 - RNA, 22 nt, Yersinia pestis
ccuuucaacaaauucaccagca

SEQ ID NO: 4159222 - RNA, 18 nt, Yersinia pestis
ccuuucaauacggcuuca

SEQ ID NO: 4159223 - RNA, 19 nt, Yersinia pestis
ccuuuccccuggcguuccu

SEQ ID NO: 4159224 - RNA, 15 nt, Yersinia pestis
ccuuucgaguugaac

SEQ ID NO: 4159225 - RNA, 20 nt, Yersinia pestis
ccuuucgaguuuauauugcc

SEQ ID NO: 4159226 - RNA, 23 nt, Yersinia pestis
ccuuucuggugguaccugcauca

SEQ ID NO: 4159227 - RNA, 13 nt, Yersinia pestis
ccuuugacagcau

SEQ ID NO: 4159228 - RNA, 18 nt, Yersinia pestis
ccuuugcuuuucugccua

SEQ ID NO: 4159229 - RNA, 15 nt, Yersinia pestis
ccuuuguauccacgg

SEQ ID NO: 4159230 - RNA, 21 nt, Yersinia pestis
ccuuuguuguuaccaaaaccg

SEQ ID NO: 4159231 - RNA, 13 nt, Yersinia pestis
ccuuuuauuuaga

SEQ ID NO: 4159232 - RNA, 15 nt, Yersinia pestis
ccuuuugaauucacc

SEQ ID NO: 4159233 - RNA, 17 nt, Yersinia pestis
ccuuuugaauucaccaa

SEQ ID NO: 4159234 - RNA, 18 nt, Yersinia pestis
ccuuuugaauucaccaaa

SEQ ID NO: 4159235 - RNA, 13 nt, Yersinia pestis
ccuuuugacuggu

SEQ ID NO: 4159236 - RNA, 17 nt, Yersinia pestis
ccuuuugcugcacugcu

SEQ ID NO: 4159237 - RNA, 20 nt, Yersinia pestis
ccuuuuucaaucacuucugc

SEQ ID NO: 4159238 - RNA, 15 nt, Yersinia pestis
ccuuuuugccucccc

SEQ ID NO: 4159239 - RNA, 15 nt, Yersinia pestis
ccuuuuuucugcaaa

SEQ ID NO: 4159240 - RNA, 12 nt, Yersinia pestis
cgaaaaaccaug

SEQ ID NO: 4159241 - RNA, 13 nt, Yersinia pestis
cgaaaagcagcag

SEQ ID NO: 4159242 - RNA, 12 nt, Yersinia pestis
cgaaaauuuuac

SEQ ID NO: 4159243 - RNA, 17 nt, Yersinia pestis
cgaaacacacuucgccg

SEQ ID NO: 4159244 - RNA, 22 nt, Yersinia pestis
cgaaacaccacgcccaauucca

SEQ ID NO: 4159245 - RNA, 16 nt, Yersinia pestis
cgaaacugaucacugg

SEQ ID NO: 4159246 - RNA, 22 nt, Yersinia pestis
cgaaagacggccaacugcuggc

SEQ ID NO: 4159247 - RNA, 22 nt, Yersinia pestis
cgaaagauaauuuagcaaagcg

SEQ ID NO: 4159248 - RNA, 15 nt, Yersinia pestis
cgaaagcgccugugg

SEQ ID NO: 4159249 - RNA, 15 nt, Yersinia pestis
cgaaaggaacaaaag

SEQ ID NO: 4159250 - RNA, 23 nt, Yersinia pestis
cgaaaguuaaacaauguuaaacu

SEQ ID NO: 4159251 - RNA, 15 nt, Yersinia pestis
cgaaauaaaaccauc

SEQ ID NO: 4159252 - RNA, 18 nt, Yersinia pestis
cgaaauacuuaucuguuu

SEQ ID NO: 4159253 - RNA, 14 nt, Yersinia pestis
cgaaauagcgccug

SEQ ID NO: 4159254 - RNA, 19 nt, Yersinia pestis
cgaaauauucgucucauca

SEQ ID NO: 4159255 - RNA, 16 nt, Yersinia pestis
cgaaaucacccggcca

SEQ ID NO: 4159256 - RNA, 17 nt, Yersinia pestis
cgaaaucacccggccau

SEQ ID NO: 4159257 - RNA, 19 nt, Yersinia pestis
cgaaaucgauggauguucc

SEQ ID NO: 4159258 - RNA, 14 nt, Yersinia pestis
cgaaaugaucuuca

SEQ ID NO: 4159259 - RNA, 18 nt, Yersinia pestis
cgaaauuuaagaaaucua

SEQ ID NO: 4159260 - RNA, 16 nt, Yersinia pestis
cgaacauaaaaaugca

SEQ ID NO: 4159261 - RNA, 14 nt, Yersinia pestis
cgaaccaaggcccu

SEQ ID NO: 4159262 - RNA, 14 nt, Yersinia pestis
cgaacccuucagca

SEQ ID NO: 4159263 - RNA, 22 nt, Yersinia pestis
cgaacgaacacaguccuguuua

SEQ ID NO: 4159264 - RNA, 15 nt, Yersinia pestis
cgaacgcgucacugg

SEQ ID NO: 4159265 - RNA, 21 nt, Yersinia pestis
cgaacgcgucacuggccaccc

SEQ ID NO: 4159266 - RNA, 18 nt, Yersinia pestis
cgaacuacgccucgcaga

SEQ ID NO: 4159267 - RNA, 14 nt, Yersinia pestis
cgaacuaucuuuuc

SEQ ID NO: 4159268 - RNA, 14 nt, Yersinia pestis
cgaagagugcauug

SEQ ID NO: 4159269 - RNA, 21 nt, Yersinia pestis
cgaagauaaccggcuggaaau

SEQ ID NO: 4159270 - RNA, 15 nt, Yersinia pestis
cgaagcccuguuuca

SEQ ID NO: 4159271 - RNA, 13 nt, Yersinia pestis
cgaagcgccccug

SEQ ID NO: 4159272 - RNA, 18 nt, Yersinia pestis
cgaaggcgcguuacaccg

SEQ ID NO: 4159273 - RNA, 13 nt, Yersinia pestis
cgaaggggauaaa

SEQ ID NO: 4159274 - RNA, 15 nt, Yersinia pestis
cgaaguuagacccaa

SEQ ID NO: 4159275 - RNA, 12 nt, Yersinia pestis
cgaauaaaaccu

SEQ ID NO: 4159276 - RNA, 20 nt, Yersinia pestis
cgaauaaaaccuugcgccaa

SEQ ID NO: 4159277 - RNA, 15 nt, Yersinia pestis
cgaauaaauaauugg

SEQ ID NO: 4159278 - RNA, 18 nt, Yersinia pestis
cgaauagaaccggcugac

SEQ ID NO: 4159279 - RNA, 16 nt, Yersinia pestis
cgaauagagacggaaa

SEQ ID NO: 4159280 - RNA, 15 nt, Yersinia pestis
cgaauauaguugauc

SEQ ID NO: 4159281 - RNA, 17 nt, Yersinia pestis
cgaauauaguugaucua

SEQ ID NO: 4159282 - RNA, 20 nt, Yersinia pestis
cgaauauugcguuaccuaaa

SEQ ID NO: 4159283 - RNA, 17 nt, Yersinia pestis
cgaaucaagcuacgcaa

SEQ ID NO: 4159284 - RNA, 13 nt, Yersinia pestis
cgaaucacugacu

SEQ ID NO: 4159285 - RNA, 23 nt, Yersinia pestis
cgaauccccccauucacaccauu

SEQ ID NO: 4159286 - RNA, 19 nt, Yersinia pestis
cgaaugacucgaugacagg

SEQ ID NO: 4159287 - RNA, 22 nt, Yersinia pestis
cgaaugagcaguaauagcaaaa

SEQ ID NO: 4159288 - RNA, 17 nt, Yersinia pestis
cgaaugaguuuuguccu

SEQ ID NO: 4159289 - RNA, 12 nt, Yersinia pestis
cgaaugggucag

SEQ ID NO: 4159290 - RNA, 21 nt, Yersinia pestis
cgaaugugcaguaaccaguua

SEQ ID NO: 4159291 - RNA, 22 nt, Yersinia pestis
cgaauguuauggguaccguuua

SEQ ID NO: 4159292 - RNA, 16 nt, Yersinia pestis
cgaauuaauaaaaccu

SEQ ID NO: 4159293 - RNA, 14 nt, Yersinia pestis
cgaauuauuuagag

SEQ ID NO: 4159294 - RNA, 20 nt, Yersinia pestis
cgaauuauuuagagucuaua

SEQ ID NO: 4159295 - RNA, 19 nt, Yersinia pestis
cgaauuauuuuggaguaua

SEQ ID NO: 4159296 - RNA, 14 nt, Yersinia pestis
cgaauugaucugau

SEQ ID NO: 4159297 - RNA, 16 nt, Yersinia pestis
cgacaaaaaagcggcu

SEQ ID NO: 4159298 - RNA, 15 nt, Yersinia pestis
cgacaacuucaauac

SEQ ID NO: 4159299 - RNA, 20 nt, Yersinia pestis
cgacaauaccgccacacaau

SEQ ID NO: 4159300 - RNA, 23 nt, Yersinia pestis
cgacaauaccgccacacaauaca

SEQ ID NO: 4159301 - RNA, 16 nt, Yersinia pestis
cgacaauauaauaaug

SEQ ID NO: 4159302 - RNA, 17 nt, Yersinia pestis
cgacaauauaauaaugc

SEQ ID NO: 4159303 - RNA, 22 nt, Yersinia pestis
cgacaaugcccccagcggugau

SEQ ID NO: 4159304 - RNA, 13 nt, Yersinia pestis
cgacacaaaugcu

SEQ ID NO: 4159305 - RNA, 13 nt, Yersinia pestis
cgacaccaaucuu

SEQ ID NO: 4159306 - RNA, 17 nt, Yersinia pestis
cgacaccacgaucaggu

SEQ ID NO: 4159307 - RNA, 13 nt, Yersinia pestis
cgacacccagcca

SEQ ID NO: 4159308 - RNA, 17 nt, Yersinia pestis
cgacaccguugauugau

SEQ ID NO: 4159309 - RNA, 15 nt, Yersinia pestis
cgacaccugcuauca

SEQ ID NO: 4159310 - RNA, 17 nt, Yersinia pestis
cgacaccuucaaucauu

SEQ ID NO: 4159311 - RNA, 22 nt, Yersinia pestis
cgacaccuucaaucauugagau

SEQ ID NO: 4159312 - RNA, 20 nt, Yersinia pestis
cgacauaaagcaaacgccgc

SEQ ID NO: 4159313 - RNA, 20 nt, Yersinia pestis
cgacaucagcgccacagucg

SEQ ID NO: 4159314 - RNA, 12 nt, Yersinia pestis
cgacauggaugg

SEQ ID NO: 4159315 - RNA, 18 nt, Yersinia pestis
cgacauuaagcauaucca

SEQ ID NO: 4159316 - RNA, 22 nt, Yersinia pestis
cgacauuaagcauauccaacgc

SEQ ID NO: 4159317 - RNA, 22 nt, Yersinia pestis
cgaccaaauggacgaacagccc

SEQ ID NO: 4159318 - RNA, 15 nt, Yersinia pestis
cgaccaacuggcaau

SEQ ID NO: 4159319 - RNA, 16 nt, Yersinia pestis
cgaccaucacggucau

SEQ ID NO: 4159320 - RNA, 23 nt, Yersinia pestis
cgaccaucacggucaugcggccu

SEQ ID NO: 4159321 - RNA, 12 nt, Yersinia pestis
cgacccaaagcu

SEQ ID NO: 4159322 - RNA, 18 nt, Yersinia pestis
cgacccaaagcucuacac

SEQ ID NO: 4159323 - RNA, 14 nt, Yersinia pestis
cgacccacgccccu

SEQ ID NO: 4159324 - RNA, 19 nt, Yersinia pestis
cgacccggcugcacgccau

SEQ ID NO: 4159325 - RNA, 20 nt, Yersinia pestis
cgacccguuuaugccccugc

SEQ ID NO: 4159326 - RNA, 14 nt, Yersinia pestis
cgaccgcucuucac

SEQ ID NO: 4159327 - RNA, 18 nt, Yersinia pestis
cgaccggggaucaauaaa

SEQ ID NO: 4159328 - RNA, 14 nt, Yersinia pestis
cgaccgucaccaaa

SEQ ID NO: 4159329 - RNA, 14 nt, Yersinia pestis
cgacgauugcacug

SEQ ID NO: 4159330 - RNA, 13 nt, Yersinia pestis
cgacgccccacua

SEQ ID NO: 4159331 - RNA, 16 nt, Yersinia pestis
cgacgcgucacuucuc

SEQ ID NO: 4159332 - RNA, 14 nt, Yersinia pestis
cgacguccaaccca

SEQ ID NO: 4159333 - RNA, 20 nt, Yersinia pestis
cgacgucccuaaagccaucg

SEQ ID NO: 4159334 - RNA, 20 nt, Yersinia pestis
cgacgugaugccaguaauuc

SEQ ID NO: 4159335 - RNA, 15 nt, Yersinia pestis
cgacgugccaacugg

SEQ ID NO: 4159336 - RNA, 14 nt, Yersinia pestis
cgacuaauggccag

SEQ ID NO: 4159337 - RNA, 15 nt, Yersinia pestis
cgacucaagccucua

SEQ ID NO: 4159338 - RNA, 12 nt, Yersinia pestis
cgacucaauaaa

SEQ ID NO: 4159339 - RNA, 18 nt, Yersinia pestis
cgacucaauaauauggga

SEQ ID NO: 4159340 - RNA, 20 nt, Yersinia pestis
cgacucuuuuugugcuucau

SEQ ID NO: 4159341 - RNA, 24 nt, Yersinia pestis
cgacuguucguaaugacugucugc

SEQ ID NO: 4159342 - RNA, 22 nt, Yersinia pestis
cgacuuaauggucuucuuuauu

SEQ ID NO: 4159343 - RNA, 17 nt, Yersinia pestis
cgacuugaugaaguuau

SEQ ID NO: 4159344 - RNA, 21 nt, Yersinia pestis
cgacuuguucacggcuuugcu

SEQ ID NO: 4159345 - RNA, 17 nt, Yersinia pestis
cgagaaagucuuaaucu

SEQ ID NO: 4159346 - RNA, 22 nt, Yersinia pestis
cgagaaagucuuaaucuuuaau

SEQ ID NO: 4159347 - RNA, 16 nt, Yersinia pestis
cgagaaauaguuacug

SEQ ID NO: 4159348 - RNA, 19 nt, Yersinia pestis
cgagaagcuucaacuuaau

SEQ ID NO: 4159349 - RNA, 15 nt, Yersinia pestis
cgagaauaccuggcg

SEQ ID NO: 4159350 - RNA, 22 nt, Yersinia pestis
cgagacuaccggaaccgccgcc

SEQ ID NO: 4159351 - RNA, 17 nt, Yersinia pestis
cgagaggcuauuuaucg

SEQ ID NO: 4159352 - RNA, 23 nt, Yersinia pestis
cgagcacugccccgaagcucaag

SEQ ID NO: 4159353 - RNA, 17 nt, Yersinia pestis
cgagccuacuacaugga

SEQ ID NO: 4159354 - RNA, 22 nt, Yersinia pestis
cgagcggggcaaaaauuacagu

SEQ ID NO: 4159355 - RNA, 13 nt, Yersinia pestis
cgagcguaauucc

SEQ ID NO: 4159356 - RNA, 19 nt, Yersinia pestis
cgagcgucaagccaacccc

SEQ ID NO: 4159357 - RNA, 22 nt, Yersinia pestis
cgagcgugcgguagaccaccaa

SEQ ID NO: 4159358 - RNA, 16 nt, Yersinia pestis
cgagcguuuaaauacc

SEQ ID NO: 4159359 - RNA, 18 nt, Yersinia pestis
cgagcuaacgcuuuuucg

SEQ ID NO: 4159360 - RNA, 13 nt, Yersinia pestis
cgagcuaaugcua

SEQ ID NO: 4159361 - RNA, 21 nt, Yersinia pestis
cgagcuaaugcuauccacaaa

SEQ ID NO: 4159362 - RNA, 23 nt, Yersinia pestis
cgagcuucaccuuuguguugaac

SEQ ID NO: 4159363 - RNA, 13 nt, Yersinia pestis
cgaggaucaccac

SEQ ID NO: 4159364 - RNA, 12 nt, Yersinia pestis
cgaggaugacga

SEQ ID NO: 4159365 - RNA, 18 nt, Yersinia pestis
cgagggcucaaucucugc

SEQ ID NO: 4159366 - RNA, 19 nt, Yersinia pestis
cgaggguucgaaucccucc

SEQ ID NO: 4159367 - RNA, 16 nt, Yersinia pestis
cgaguaaauacaaaua

SEQ ID NO: 4159368 - RNA, 19 nt, Yersinia pestis
cgaguaacuccaucaggcu

SEQ ID NO: 4159369 - RNA, 14 nt, Yersinia pestis
cgaguaaugaaauc

SEQ ID NO: 4159370 - RNA, 15 nt, Yersinia pestis
cgaguaucgugacca

SEQ ID NO: 4159371 - RNA, 19 nt, Yersinia pestis
cgaguaucgugaccaauaa

SEQ ID NO: 4159372 - RNA, 16 nt, Yersinia pestis
cgagucacauuuuuaa

SEQ ID NO: 4159373 - RNA, 17 nt, Yersinia pestis
cgaguccguuaaaaaau

SEQ ID NO: 4159374 - RNA, 18 nt, Yersinia pestis
cgaguccguuaaaaaauu

SEQ ID NO: 4159375 - RNA, 23 nt, Yersinia pestis
cgagucuauugaaaaaauaaugu

SEQ ID NO: 4159376 - RNA, 18 nt, Yersinia pestis
cgagugaacguagccuca

SEQ ID NO: 4159377 - RNA, 22 nt, Yersinia pestis
cgagugaacguagccucaauuu

SEQ ID NO: 4159378 - RNA, 14 nt, Yersinia pestis
cgaguguaaaaagc

SEQ ID NO: 4159379 - RNA, 17 nt, Yersinia pestis
cgaguuaaacugggucg

SEQ ID NO: 4159380 - RNA, 13 nt, Yersinia pestis
cgaguucagugau

SEQ ID NO: 4159381 - RNA, 19 nt, Yersinia pestis
cgaguugacuuuuuuuaac

SEQ ID NO: 4159382 - RNA, 13 nt, Yersinia pestis
cgaguuucccuuu

SEQ ID NO: 4159383 - RNA, 19 nt, Yersinia pestis
cgauaaaagauuuccuuuc

SEQ ID NO: 4159384 - RNA, 20 nt, Yersinia pestis
cgauaaaaggcuauuuaaau

SEQ ID NO: 4159385 - RNA, 16 nt, Yersinia pestis
cgauaaaauucagcca

SEQ ID NO: 4159386 - RNA, 17 nt, Yersinia pestis
cgauaaaauucagccac

SEQ ID NO: 4159387 - RNA, 19 nt, Yersinia pestis
cgauaaacaucaugacaaa

SEQ ID NO: 4159388 - RNA, 21 nt, Yersinia pestis
cgauaaaccaacugaaacugg

SEQ ID NO: 4159389 - RNA, 23 nt, Yersinia pestis
cgauaaagagugaaauauaccgu

SEQ ID NO: 4159390 - RNA, 13 nt, Yersinia pestis
cgauaacauuuuu

SEQ ID NO: 4159391 - RNA, 15 nt, Yersinia pestis
cgauaacauuuuuuc

SEQ ID NO: 4159392 - RNA, 14 nt, Yersinia pestis
cgauaaccaaauca

SEQ ID NO: 4159393 - RNA, 17 nt, Yersinia pestis
cgauaaccaaaucaccu

SEQ ID NO: 4159394 - RNA, 16 nt, Yersinia pestis
cgauaacguuguuucu

SEQ ID NO: 4159395 - RNA, 17 nt, Yersinia pestis
cgauaacguuguuucug

SEQ ID NO: 4159396 - RNA, 22 nt, Yersinia pestis
cgauaacuuuuggcagcaccag

SEQ ID NO: 4159397 - RNA, 17 nt, Yersinia pestis
cgauaagcgggguuaau

SEQ ID NO: 4159398 - RNA, 22 nt, Yersinia pestis
cgauaauuauaaauuccuggcg

SEQ ID NO: 4159399 - RNA, 14 nt, Yersinia pestis
cgauacaggcucug

SEQ ID NO: 4159400 - RNA, 12 nt, Yersinia pestis
cgauaccaauaa

SEQ ID NO: 4159401 - RNA, 19 nt, Yersinia pestis
cgauacccauuuuaaucuc

SEQ ID NO: 4159402 - RNA, 18 nt, Yersinia pestis
cgauacccuucaucuuuc

SEQ ID NO: 4159403 - RNA, 16 nt, Yersinia pestis
cgauacgacuucuuau

SEQ ID NO: 4159404 - RNA, 16 nt, Yersinia pestis
cgauacgaucaucugg

SEQ ID NO: 4159405 - RNA, 18 nt, Yersinia pestis
cgauacggucaucgccgc

SEQ ID NO: 4159406 - RNA, 17 nt, Yersinia pestis
cgauacguugcagguca

SEQ ID NO: 4159407 - RNA, 15 nt, Yersinia pestis
cgauacucauugcac

SEQ ID NO: 4159408 - RNA, 18 nt, Yersinia pestis
cgauacucgauaccagcg

SEQ ID NO: 4159409 - RNA, 17 nt, Yersinia pestis
cgauagauuuucagcgc

SEQ ID NO: 4159410 - RNA, 20 nt, Yersinia pestis
cgauagcccaaagcaauaaa

SEQ ID NO: 4159411 - RNA, 17 nt, Yersinia pestis
cgauagcugcuuuugcu

SEQ ID NO: 4159412 - RNA, 15 nt, Yersinia pestis
cgauagucagcuuca

SEQ ID NO: 4159413 - RNA, 13 nt, Yersinia pestis
cgauauaaauaaa

SEQ ID NO: 4159414 - RNA, 19 nt, Yersinia pestis
cgauauagucuugaugaaa

SEQ ID NO: 4159415 - RNA, 15 nt, Yersinia pestis
cgauaugcuccagau

SEQ ID NO: 4159416 - RNA, 16 nt, Yersinia pestis
cgauauuuaucagccg

SEQ ID NO: 4159417 - RNA, 22 nt, Yersinia pestis
cgaucaacaggccaccuaacac

SEQ ID NO: 4159418 - RNA, 16 nt, Yersinia pestis
cgaucaacccccugug

SEQ ID NO: 4159419 - RNA, 16 nt, Yersinia pestis
cgaucaacccgcagac

SEQ ID NO: 4159420 - RNA, 18 nt, Yersinia pestis
cgaucaacccgcagacug

SEQ ID NO: 4159421 - RNA, 21 nt, Yersinia pestis
cgaucaacccgcagacugaaa

SEQ ID NO: 4159422 - RNA, 17 nt, Yersinia pestis
cgaucaccacgucaccu

SEQ ID NO: 4159423 - RNA, 16 nt, Yersinia pestis
cgaucacggaaaucug

SEQ ID NO: 4159424 - RNA, 18 nt, Yersinia pestis
cgaucacuuucccgcguc

SEQ ID NO: 4159425 - RNA, 16 nt, Yersinia pestis
cgaucagcaauaugcu

SEQ ID NO: 4159426 - RNA, 18 nt, Yersinia pestis
cgaucagcguauaaaacu

SEQ ID NO: 4159427 - RNA, 21 nt, Yersinia pestis
cgaucagugaagagauaaccg

SEQ ID NO: 4159428 - RNA, 21 nt, Yersinia pestis
cgaucauucuagccuugagcg

SEQ ID NO: 4159429 - RNA, 14 nt, Yersinia pestis
cgauccagugaaau

SEQ ID NO: 4159430 - RNA, 19 nt, Yersinia pestis
cgauccgauaauaauucca

SEQ ID NO: 4159431 - RNA, 17 nt, Yersinia pestis
cgauccgggaaaaaaua

SEQ ID NO: 4159432 - RNA, 21 nt, Yersinia pestis
cgauccgggaaaaaauacgcu

SEQ ID NO: 4159433 - RNA, 14 nt, Yersinia pestis
cgauccgucacaac

SEQ ID NO: 4159434 - RNA, 21 nt, Yersinia pestis
cgauccuaggcggugagggag

SEQ ID NO: 4159435 - RNA, 16 nt, Yersinia pestis
cgaucuauucucugua

SEQ ID NO: 4159436 - RNA, 15 nt, Yersinia pestis
cgaucuccuccagaa

SEQ ID NO: 4159437 - RNA, 17 nt, Yersinia pestis
cgaucugccuguucucu

SEQ ID NO: 4159438 - RNA, 22 nt, Yersinia pestis
cgaucuggcaaaaucccagcag

SEQ ID NO: 4159439 - RNA, 22 nt, Yersinia pestis
cgaucugggcugcgcuuaccaa

SEQ ID NO: 4159440 - RNA, 15 nt, Yersinia pestis
cgaucuguugauaaa

SEQ ID NO: 4159441 - RNA, 17 nt, Yersinia pestis
cgaucuugaacggugag

SEQ ID NO: 4159442 - RNA, 20 nt, Yersinia pestis
cgaugaccgugacauuuuca

SEQ ID NO: 4159443 - RNA, 16 nt, Yersinia pestis
cgaugacgcgaucuug

SEQ ID NO: 4159444 - RNA, 18 nt, Yersinia pestis
cgaugacgcgaucuugaa

SEQ ID NO: 4159445 - RNA, 19 nt, Yersinia pestis
cgaugaggcucuucugggc

SEQ ID NO: 4159446 - RNA, 14 nt, Yersinia pestis
cgaugauuugucaa

SEQ ID NO: 4159447 - RNA, 21 nt, Yersinia pestis
cgaugcaaggaaguccaguaa

SEQ ID NO: 4159448 - RNA, 14 nt, Yersinia pestis
cgaugcggauaucu

SEQ ID NO: 4159449 - RNA, 23 nt, Yersinia pestis
cgauggaacaggauuuucaaacu

SEQ ID NO: 4159450 - RNA, 18 nt, Yersinia pestis
cgauggaccaugccauca

SEQ ID NO: 4159451 - RNA, 15 nt, Yersinia pestis
cgauggcacuuguga

SEQ ID NO: 4159452 - RNA, 16 nt, Yersinia pestis
cgauggcuuuacgcaa

SEQ ID NO: 4159453 - RNA, 13 nt, Yersinia pestis
cgaugucaauaaa

SEQ ID NO: 4159454 - RNA, 16 nt, Yersinia pestis
cgauguuuacggcauu

SEQ ID NO: 4159455 - RNA, 16 nt, Yersinia pestis
cgauuacccaccaccu

SEQ ID NO: 4159456 - RNA, 14 nt, Yersinia pestis
cgauucauugagca

SEQ ID NO: 4159457 - RNA, 19 nt, Yersinia pestis
cgauugaaucaaggcuuua

SEQ ID NO: 4159458 - RNA, 17 nt, Yersinia pestis
cgauuguuacgccuuca

SEQ ID NO: 4159459 - RNA, 17 nt, Yersinia pestis
cgauuguuugggauaaa

SEQ ID NO: 4159460 - RNA, 18 nt, Yersinia pestis
cgauuucagcaccauaaa

SEQ ID NO: 4159461 - RNA, 14 nt, Yersinia pestis
cgauuucagcugcu

SEQ ID NO: 4159462 - RNA, 12 nt, Yersinia pestis
cgauuucuacgg

SEQ ID NO: 4159463 - RNA, 16 nt, Yersinia pestis
cgauuugcucuuuuuu

SEQ ID NO: 4159464 - RNA, 11 nt, Yersinia pestis
cgauuuuagcu

SEQ ID NO: 4159465 - RNA, 20 nt, Yersinia pestis
cgauuuuuacgugucagacu

SEQ ID NO: 4159466 - RNA, 14 nt, Yersinia pestis
cgauuuuugaguuu

SEQ ID NO: 4159467 - RNA, 13 nt, Yersinia pestis
cgcaaaaagggca

SEQ ID NO: 4159468 - RNA, 10 nt, Yersinia pestis
cgcaaaacuu

SEQ ID NO: 4159469 - RNA, 19 nt, Yersinia pestis
cgcaaacggguggccgccg

SEQ ID NO: 4159470 - RNA, 23 nt, Yersinia pestis
cgcaaagagaacgggcaaccugu

SEQ ID NO: 4159471 - RNA, 20 nt, Yersinia pestis
cgcaaagcgggccagcaacc

SEQ ID NO: 4159472 - RNA, 18 nt, Yersinia pestis
cgcaaauaggggcaccgu

SEQ ID NO: 4159473 - RNA, 14 nt, Yersinia pestis
cgcaaaucaccuug

SEQ ID NO: 4159474 - RNA, 17 nt, Yersinia pestis
cgcaaccaaucauucaa

SEQ ID NO: 4159475 - RNA, 19 nt, Yersinia pestis
cgcaauaguuaacagcguc

SEQ ID NO: 4159476 - RNA, 17 nt, Yersinia pestis
cgcaauaucaaaacucc

SEQ ID NO: 4159477 - RNA, 14 nt, Yersinia pestis
cgcaaucagauggu

SEQ ID NO: 4159478 - RNA, 21 nt, Yersinia pestis
cgcaaucagccgcaucacuga

SEQ ID NO: 4159479 - RNA, 19 nt, Yersinia pestis
cgcaaucucuugacgccga

SEQ ID NO: 4159480 - RNA, 16 nt, Yersinia pestis
cgcaauggcgcgucau

SEQ ID NO: 4159481 - RNA, 18 nt, Yersinia pestis
cgcaauuugcccaucuuu

SEQ ID NO: 4159482 - RNA, 21 nt, Yersinia pestis
cgcacaacaaauggguuauaa

SEQ ID NO: 4159483 - RNA, 15 nt, Yersinia pestis
cgcacaacugcgaua

SEQ ID NO: 4159484 - RNA, 18 nt, Yersinia pestis
cgcacaguuuucuuaaaa

SEQ ID NO: 4159485 - RNA, 22 nt, Yersinia pestis
cgcacaugccgucaccucauca

SEQ ID NO: 4159486 - RNA, 16 nt, Yersinia pestis
cgcacauuacaagugc

SEQ ID NO: 4159487 - RNA, 21 nt, Yersinia pestis
cgcaccaaugccgguccagac

SEQ ID NO: 4159488 - RNA, 18 nt, Yersinia pestis
cgcaccacugucagggcu

SEQ ID NO: 4159489 - RNA, 12 nt, Yersinia pestis
cgcaccagauuu

SEQ ID NO: 4159490 - RNA, 17 nt, Yersinia pestis
cgcacccgcuacgguag

SEQ ID NO: 4159491 - RNA, 16 nt, Yersinia pestis
cgcacccuccaauaau

SEQ ID NO: 4159492 - RNA, 17 nt, Yersinia pestis
cgcaccgagccacuuua

SEQ ID NO: 4159493 - RNA, 23 nt, Yersinia pestis
cgcacggccgggugcagcgccac

SEQ ID NO: 4159494 - RNA, 13 nt, Yersinia pestis
cgcacggcuacug

SEQ ID NO: 4159495 - RNA, 17 nt, Yersinia pestis
cgcacgggcuuuaauga

SEQ ID NO: 4159496 - RNA, 22 nt, Yersinia pestis
cgcacgggucauuaacgcacau

SEQ ID NO: 4159497 - RNA, 16 nt, Yersinia pestis
cgcacguaccacggcg

SEQ ID NO: 4159498 - RNA, 17 nt, Yersinia pestis
cgcacguucccaggcca

SEQ ID NO: 4159499 - RNA, 22 nt, Yersinia pestis
cgcacuacccgaaucacugacu

SEQ ID NO: 4159500 - RNA, 21 nt, Yersinia pestis
cgcacugagagcauaacccca

SEQ ID NO: 4159501 - RNA, 17 nt, Yersinia pestis
cgcacuggucaguauaa

SEQ ID NO: 4159502 - RNA, 20 nt, Yersinia pestis
cgcacugguugcuucaucaa

SEQ ID NO: 4159503 - RNA, 17 nt, Yersinia pestis
cgcacugguuggcggcu

SEQ ID NO: 4159504 - RNA, 21 nt, Yersinia pestis
cgcacuuaaugccgcugauca

SEQ ID NO: 4159505 - RNA, 15 nt, Yersinia pestis
cgcacuuacccgaau

SEQ ID NO: 4159506 - RNA, 19 nt, Yersinia pestis
cgcagcaaauaaacaaaau

SEQ ID NO: 4159507 - RNA, 15 nt, Yersinia pestis
cgcagcggcuagcag

SEQ ID NO: 4159508 - RNA, 16 nt, Yersinia pestis
cgcaggauaaagcuga

SEQ ID NO: 4159509 - RNA, 15 nt, Yersinia pestis
cgcaggcacugcaga

SEQ ID NO: 4159510 - RNA, 15 nt, Yersinia pestis
ccgguuguucaaucg

SEQ ID NO: 4159511 - RNA, 20 nt, Yersinia pestis
ccguaaacguucugccaauu

SEQ ID NO: 4159512 - RNA, 16 nt, Yersinia pestis
ccguaaauacauccau

SEQ ID NO: 4159513 - RNA, 17 nt, Yersinia pestis
ccguaacgcccuccugc

SEQ ID NO: 4159514 - RNA, 22 nt, Yersinia pestis
ccguaacgguuacugcgcaaau

SEQ ID NO: 4159515 - RNA, 13 nt, Yersinia pestis
ccguaacuucuuc

SEQ ID NO: 4159516 - RNA, 14 nt, Yersinia pestis
ccguaacuucuucg

SEQ ID NO: 4159517 - RNA, 20 nt, Yersinia pestis
ccguaauauuucaagcugua

SEQ ID NO: 4159518 - RNA, 17 nt, Yersinia pestis
ccguaaucaugguugga

SEQ ID NO: 4159519 - RNA, 14 nt, Yersinia pestis
ccguacaaauauaa

SEQ ID NO: 4159520 - RNA, 12 nt, Yersinia pestis
ccguacaacaau

SEQ ID NO: 4159521 - RNA, 12 nt, Yersinia pestis
ccguacauuaaa

SEQ ID NO: 4159522 - RNA, 12 nt, Yersinia pestis
ccguauaaucag

SEQ ID NO: 4159523 - RNA, 13 nt, Yersinia pestis
ccguaucaugggu

SEQ ID NO: 4159524 - RNA, 16 nt, Yersinia pestis
ccgucaagacaacaaa

SEQ ID NO: 4159525 - RNA, 15 nt, Yersinia pestis
ccgucaaugccuguu

SEQ ID NO: 4159526 - RNA, 23 nt, Yersinia pestis
ccgucacucagaaaacagccacc

SEQ ID NO: 4159527 - RNA, 20 nt, Yersinia pestis
ccgucacuuaaaaaucaaua

SEQ ID NO: 4159528 - RNA, 16 nt, Yersinia pestis
ccgucagacugcugac

SEQ ID NO: 4159529 - RNA, 20 nt, Yersinia pestis
ccgucagacugcugacaaac

SEQ ID NO: 4159530 - RNA, 14 nt, Yersinia pestis
ccgucagcaucaua

SEQ ID NO: 4159531 - RNA, 21 nt, Yersinia pestis
ccgucgcgggcacuuugucaa

SEQ ID NO: 4159532 - RNA, 20 nt, Yersinia pestis
ccgucguacuuuaagcugca

SEQ ID NO: 4159533 - RNA, 16 nt, Yersinia pestis
ccgucgucacuuugac

SEQ ID NO: 4159534 - RNA, 16 nt, Yersinia pestis
ccgucuuugagcucac

SEQ ID NO: 4159535 - RNA, 13 nt, Yersinia pestis
ccgugacauuuuc

SEQ ID NO: 4159536 - RNA, 23 nt, Yersinia pestis
ccgugacauuuucaccgaggcgg

SEQ ID NO: 4159537 - RNA, 20 nt, Yersinia pestis
ccgugauguucaauucacug

SEQ ID NO: 4159538 - RNA, 14 nt, Yersinia pestis
ccgugcacccggcc

SEQ ID NO: 4159539 - RNA, 17 nt, Yersinia pestis
ccgugcauagcgugauu

SEQ ID NO: 4159540 - RNA, 18 nt, Yersinia pestis
ccgugcggcuucuuauuu

SEQ ID NO: 4159541 - RNA, 17 nt, Yersinia pestis
ccguggauauccacauc

SEQ ID NO: 4159542 - RNA, 18 nt, Yersinia pestis
ccguggauauccacauca

SEQ ID NO: 4159543 - RNA, 22 nt, Yersinia pestis
ccguggcgcggaugcuuuauuc

SEQ ID NO: 4159544 - RNA, 14 nt, Yersinia pestis
ccguguacccguuc

SEQ ID NO: 4159545 - RNA, 17 nt, Yersinia pestis
ccguuaacccaaagccc

SEQ ID NO: 4159546 - RNA, 21 nt, Yersinia pestis
ccguuacaagacaagcccgau

SEQ ID NO: 4159547 - RNA, 19 nt, Yersinia pestis
ccguuacggcggccaucau

SEQ ID NO: 4159548 - RNA, 14 nt, Yersinia pestis
ccguuacugcaucu

SEQ ID NO: 4159549 - RNA, 21 nt, Yersinia pestis
ccguuauagaucuccugcaac

SEQ ID NO: 4159550 - RNA, 19 nt, Yersinia pestis
ccguucacccuuuggugag

SEQ ID NO: 4159551 - RNA, 13 nt, Yersinia pestis
ccguuccaaccgg

SEQ ID NO: 4159552 - RNA, 15 nt, Yersinia pestis
ccguugcauuuuucu

SEQ ID NO: 4159553 - RNA, 14 nt, Yersinia pestis
ccguugccugugcg

SEQ ID NO: 4159554 - RNA, 19 nt, Yersinia pestis
ccguuggccggccaacauc

SEQ ID NO: 4159555 - RNA, 20 nt, Yersinia pestis
ccguugugaguaauucgcag

SEQ ID NO: 4159556 - RNA, 17 nt, Yersinia pestis
ccguuguguaucagcaa

SEQ ID NO: 4159557 - RNA, 10 nt, Yersinia pestis
ccguuucucu

SEQ ID NO: 4159558 - RNA, 14 nt, Yersinia pestis
ccguuugcagcuca

SEQ ID NO: 4159559 - RNA, 23 nt, Yersinia pestis
ccguuuugggcuugagcagugcg

SEQ ID NO: 4159560 - RNA, 14 nt, Yersinia pestis
ccuaaaaaaaacaa

SEQ ID NO: 4159561 - RNA, 18 nt, Yersinia pestis
ccuaaaaacgucacuucg

SEQ ID NO: 4159562 - RNA, 23 nt, Yersinia pestis
ccuaaaaucauugacguuacaga

SEQ ID NO: 4159563 - RNA, 23 nt, Yersinia pestis
ccuaaaauuaucgcaauuucaga

SEQ ID NO: 4159564 - RNA, 22 nt, Yersinia pestis
ccuaaacagcaacacaaaagcg

SEQ ID NO: 4159565 - RNA, 17 nt, Yersinia pestis
ccuaaaccuuucagaca

SEQ ID NO: 4159566 - RNA, 18 nt, Yersinia pestis
ccuaaagcgccuuccuuu

SEQ ID NO: 4159567 - RNA, 15 nt, Yersinia pestis
ccuaacaaacugaau

SEQ ID NO: 4159568 - RNA, 18 nt, Yersinia pestis
ccuaacaacugccgccau

SEQ ID NO: 4159569 - RNA, 20 nt, Yersinia pestis
ccuaacacguuaaauuucuu

SEQ ID NO: 4159570 - RNA, 13 nt, Yersinia pestis
ccuaacagaccaa

SEQ ID NO: 4159571 - RNA, 12 nt, Yersinia pestis
ccuaaccgcugu

SEQ ID NO: 4159572 - RNA, 18 nt, Yersinia pestis
ccuaacgccaaaauguag

SEQ ID NO: 4159573 - RNA, 18 nt, Yersinia pestis
ccuaacuggcgguuauug

SEQ ID NO: 4159574 - RNA, 21 nt, Yersinia pestis
ccuaagccggucuuuuuacaa

SEQ ID NO: 4159575 - RNA, 14 nt, Yersinia pestis
ccuaauaaauaauu

SEQ ID NO: 4159576 - RNA, 20 nt, Yersinia pestis
ccuaauaaccgacagugcau

SEQ ID NO: 4159577 - RNA, 20 nt, Yersinia pestis
ccuaauauccucaaaauucg

SEQ ID NO: 4159578 - RNA, 18 nt, Yersinia pestis
ccuaaugaacacuuaauu

SEQ ID NO: 4159579 - RNA, 14 nt, Yersinia pestis
ccuaaugccgcgcc

SEQ ID NO: 4159580 - RNA, 15 nt, Yersinia pestis
ccuaauuuaucccga

SEQ ID NO: 4159581 - RNA, 22 nt, Yersinia pestis
ccuaauuuaucccgagcuaacg

SEQ ID NO: 4159582 - RNA, 16 nt, Yersinia pestis
ccuaccaccuacaacc

SEQ ID NO: 4159583 - RNA, 13 nt, Yersinia pestis
ccuaccaccuacc

SEQ ID NO: 4159584 - RNA, 19 nt, Yersinia pestis
ccuacccuuugagaaagga

SEQ ID NO: 4159585 - RNA, 15 nt, Yersinia pestis
ccuaccggccauuga

SEQ ID NO: 4159586 - RNA, 16 nt, Yersinia pestis
ccuaccguucucugcu

SEQ ID NO: 4159587 - RNA, 20 nt, Yersinia pestis
ccuaccugccugcugcugug

SEQ ID NO: 4159588 - RNA, 18 nt, Yersinia pestis
ccuacgccuaaaaaugau

SEQ ID NO: 4159589 - RNA, 21 nt, Yersinia pestis
ccuacgcuggcgcauccccac

SEQ ID NO: 4159590 - RNA, 20 nt, Yersinia pestis
ccuacgguaccgcaggucag

SEQ ID NO: 4159591 - RNA, 16 nt, Yersinia pestis
ccuacguucaggcccc

SEQ ID NO: 4159592 - RNA, 21 nt, Yersinia pestis
ccuacugauuggauaaaauau

SEQ ID NO: 4159593 - RNA, 15 nt, Yersinia pestis
ccuagcaaugagaca

SEQ ID NO: 4159594 - RNA, 18 nt, Yersinia pestis
ccuaggcuauugacaaag

SEQ ID NO: 4159595 - RNA, 22 nt, Yersinia pestis
ccuauaauuaacagcaucacug

SEQ ID NO: 4159596 - RNA, 23 nt, Yersinia pestis
ccuauaauuaacagcaucacugu

SEQ ID NO: 4159597 - RNA, 21 nt, Yersinia pestis
ccuauagcaauauaauaaucu

SEQ ID NO: 4159598 - RNA, 18 nt, Yersinia pestis
ccuaucauucaacacucu

SEQ ID NO: 4159599 - RNA, 15 nt, Yersinia pestis
ccuauccucaccguu

SEQ ID NO: 4159600 - RNA, 13 nt, Yersinia pestis
ccuaucgccgccg

SEQ ID NO: 4159601 - RNA, 22 nt, Yersinia pestis
ccuaucgguaucucccgcaaag

SEQ ID NO: 4159602 - RNA, 15 nt, Yersinia pestis
ccuaucgucacagca

SEQ ID NO: 4159603 - RNA, 22 nt, Yersinia pestis
ccuaucgucagugcgguaacca

SEQ ID NO: 4159604 - RNA, 22 nt, Yersinia pestis
ccuaucugcucuugcucaguaa

SEQ ID NO: 4159605 - RNA, 23 nt, Yersinia pestis
ccuauuagauguguuuaaaucuu

SEQ ID NO: 4159606 - RNA, 20 nt, Yersinia pestis
ccuauuaucccaguuuuuaa

SEQ ID NO: 4159607 - RNA, 15 nt, Yersinia pestis
ccuauugauaaaacc

SEQ ID NO: 4159608 - RNA, 23 nt, Yersinia pestis
ccuauuucagggcguauaaacag

SEQ ID NO: 4159609 - RNA, 13 nt, Yersinia pestis
ccucaaaaaccug

SEQ ID NO: 4159610 - RNA, 19 nt, Yersinia pestis
ccucaaaaggauggcccaa

SEQ ID NO: 4159611 - RNA, 23 nt, Yersinia pestis
ccucaaaaggauggcccaagcca

SEQ ID NO: 4159612 - RNA, 18 nt, Yersinia pestis
ccucaacgcaccccacaa

SEQ ID NO: 4159613 - RNA, 21 nt, Yersinia pestis
ccucaaugcagaugccaauga

SEQ ID NO: 4159614 - RNA, 13 nt, Yersinia pestis
ccucacaagccac

SEQ ID NO: 4159615 - RNA, 16 nt, Yersinia pestis
ccucacguuuagccau

SEQ ID NO: 4159616 - RNA, 13 nt, Yersinia pestis
ccucacucuguga

SEQ ID NO: 4159617 - RNA, 21 nt, Yersinia pestis
ccucagagacaucuuuaccag

SEQ ID NO: 4159618 - RNA, 20 nt, Yersinia pestis
ccucagccucauucaugagg

SEQ ID NO: 4159619 - RNA, 21 nt, Yersinia pestis
ccucaggcccgcuaucacuag

SEQ ID NO: 4159620 - RNA, 16 nt, Yersinia pestis
ccucaggggccaacag

SEQ ID NO: 4159621 - RNA, 19 nt, Yersinia pestis
ccucaguaaaacgcuccag

SEQ ID NO: 4159622 - RNA, 14 nt, Yersinia pestis
ccucagugcgguua

SEQ ID NO: 4159623 - RNA, 13 nt, Yersinia pestis
ccucaguuaucag

SEQ ID NO: 4159624 - RNA, 16 nt, Yersinia pestis
ccucauccguaaaaaa

SEQ ID NO: 4159625 - RNA, 21 nt, Yersinia pestis
ccucaugaaugaggcugaggu

SEQ ID NO: 4159626 - RNA, 23 nt, Yersinia pestis
ccucaugaaugaggcugagguua

SEQ ID NO: 4159627 - RNA, 18 nt, Yersinia pestis
ccucaugauuuguugaug

SEQ ID NO: 4159628 - RNA, 13 nt, Yersinia pestis
ccucauucaugag

SEQ ID NO: 4159629 - RNA, 17 nt, Yersinia pestis
ccucauucaugaggcuu

SEQ ID NO: 4159630 - RNA, 18 nt, Yersinia pestis
ccucauucaugaggcuuc

SEQ ID NO: 4159631 - RNA, 22 nt, Yersinia pestis
ccucauucgggcauuccgguuc

SEQ ID NO: 4159632 - RNA, 20 nt, Yersinia pestis
ccucauuggucgcugggccu

SEQ ID NO: 4159633 - RNA, 15 nt, Yersinia pestis
ccuccaacugaguga

SEQ ID NO: 4159634 - RNA, 20 nt, Yersinia pestis
ccuccaacugagugagcgca

SEQ ID NO: 4159635 - RNA, 17 nt, Yersinia pestis
ccuccaagaugauaaau

SEQ ID NO: 4159636 - RNA, 23 nt, Yersinia pestis
ccuccacugcguacucaccccac

SEQ ID NO: 4159637 - RNA, 16 nt, Yersinia pestis
ccuccauucugcagau

SEQ ID NO: 4159638 - RNA, 15 nt, Yersinia pestis
ccucccgcuaacgca

SEQ ID NO: 4159639 - RNA, 18 nt, Yersinia pestis
ccucccugggggcuagcc

SEQ ID NO: 4159640 - RNA, 19 nt, Yersinia pestis
ccuccgauucauaguccaa

SEQ ID NO: 4159641 - RNA, 21 nt, Yersinia pestis
ccuccgcuuuagcuguacuaa

SEQ ID NO: 4159642 - RNA, 19 nt, Yersinia pestis
ccuccggcgcccuucccau

SEQ ID NO: 4159643 - RNA, 14 nt, Yersinia pestis
ccuccggcuaugcc

SEQ ID NO: 4159644 - RNA, 20 nt, Yersinia pestis
ccuccuuggggccucacucu

SEQ ID NO: 4159645 - RNA, 14 nt, Yersinia pestis
ccucgaaaauaacc

SEQ ID NO: 4159646 - RNA, 23 nt, Yersinia pestis
ccucgacaccaaaacucccuguu

SEQ ID NO: 4159647 - RNA, 19 nt, Yersinia pestis
ccucgcaauggugauaaac

SEQ ID NO: 4159648 - RNA, 14 nt, Yersinia pestis
ccucgcagauccag

SEQ ID NO: 4159649 - RNA, 22 nt, Yersinia pestis
ccucgcccuucgggucaacgcu

SEQ ID NO: 4159650 - RNA, 19 nt, Yersinia pestis
ccucggucggcaagaccuu

SEQ ID NO: 4159651 - RNA, 15 nt, Yersinia pestis
ccucgugagugaagg

SEQ ID NO: 4159652 - RNA, 20 nt, Yersinia pestis
ccucguuguuguaugacaag

SEQ ID NO: 4159653 - RNA, 16 nt, Yersinia pestis
ccucuaacacucuuuc

SEQ ID NO: 4159654 - RNA, 15 nt, Yersinia pestis
ccucuaaucuccucu

SEQ ID NO: 4159655 - RNA, 16 nt, Yersinia pestis
ccucucucauuucguc

SEQ ID NO: 4159656 - RNA, 16 nt, Yersinia pestis
ccucucuuuccagcaa

SEQ ID NO: 4159657 - RNA, 16 nt, Yersinia pestis
ccucugccuauccuca

SEQ ID NO: 4159658 - RNA, 20 nt, Yersinia pestis
ccucugcgcuggcguuuuug

SEQ ID NO: 4159659 - RNA, 15 nt, Yersinia pestis
ccucugcugcugccc

SEQ ID NO: 4159660 - RNA, 23 nt, Yersinia pestis
ccucuggcggugacguuccuugg

SEQ ID NO: 4159661 - RNA, 13 nt, Yersinia pestis
ccucuuaaugucu

SEQ ID NO: 4159662 - RNA, 11 nt, Yersinia pestis
ccucuucaggu

SEQ ID NO: 4159663 - RNA, 18 nt, Yersinia pestis
ccucuucaucuacagacu

SEQ ID NO: 4159664 - RNA, 18 nt, Yersinia pestis
ccucuuccgguuguucua

SEQ ID NO: 4159665 - RNA, 23 nt, Yersinia pestis
ccucuucuucuugguguugcagu

SEQ ID NO: 4159666 - RNA, 20 nt, Yersinia pestis
ccucuugcgcuccacgcccc

SEQ ID NO: 4159667 - RNA, 14 nt, Yersinia pestis
ccucuuguaaacca

SEQ ID NO: 4159668 - RNA, 17 nt, Yersinia pestis
ccucuuuagguacuuug

SEQ ID NO: 4159669 - RNA, 13 nt, Yersinia pestis
ccucuuuccaaca

SEQ ID NO: 4159670 - RNA, 13 nt, Yersinia pestis
ccugaaagucagg

SEQ ID NO: 4159671 - RNA, 20 nt, Yersinia pestis
ccugaaaugauuaaacgccu

SEQ ID NO: 4159672 - RNA, 15 nt, Yersinia pestis
ccugaacucaucagc

SEQ ID NO: 4159673 - RNA, 17 nt, Yersinia pestis
ccugaaggcugauuaau

SEQ ID NO: 4159674 - RNA, 16 nt, Yersinia pestis
ccugaaucaacucauu

SEQ ID NO: 4159675 - RNA, 14 nt, Yersinia pestis
ccugacaaacggcg

SEQ ID NO: 4159676 - RNA, 14 nt, Yersinia pestis
ccugacaggcuuua

SEQ ID NO: 4159677 - RNA, 21 nt, Yersinia pestis
ccugacgaugauaaaucagca

SEQ ID NO: 4159678 - RNA, 22 nt, Yersinia pestis
ccugacggccagcaaccuggcg

SEQ ID NO: 4159679 - RNA, 19 nt, Yersinia pestis
ccugacucacagggcuguu

SEQ ID NO: 4159680 - RNA, 16 nt, Yersinia pestis
ccugacuguuuugcua

SEQ ID NO: 4159681 - RNA, 19 nt, Yersinia pestis
ccugagaaucaaaaaacag

SEQ ID NO: 4159682 - RNA, 15 nt, Yersinia pestis
ccugaggauaaaaac

SEQ ID NO: 4159683 - RNA, 18 nt, Yersinia pestis
ccugagggugaugacaau

SEQ ID NO: 4159684 - RNA, 22 nt, Yersinia pestis
ccugagguuccacucucugcuu

SEQ ID NO: 4159685 - RNA, 18 nt, Yersinia pestis
ccugagguucccaacggc

SEQ ID NO: 4159686 - RNA, 17 nt, Yersinia pestis
ccugaguaauauuauuc

SEQ ID NO: 4159687 - RNA, 13 nt, Yersinia pestis
ccugagugggggc

SEQ ID NO: 4159688 - RNA, 18 nt, Yersinia pestis
ccugauaaggagagaggc

SEQ ID NO: 4159689 - RNA, 14 nt, Yersinia pestis
ccugauacaccauu

SEQ ID NO: 4159690 - RNA, 14 nt, Yersinia pestis
ccugauccaacauc

SEQ ID NO: 4159691 - RNA, 19 nt, Yersinia pestis
ccugauccacuacuuauuu

SEQ ID NO: 4159692 - RNA, 19 nt, Yersinia pestis
ccugaucgauaacccccaa

SEQ ID NO: 4159693 - RNA, 21 nt, Yersinia pestis
ccugaugagagggaguuauuc

SEQ ID NO: 4159694 - RNA, 21 nt, Yersinia pestis
ccugaugugguuguuuuuucc

SEQ ID NO: 4159695 - RNA, 19 nt, Yersinia pestis
ccugauucgcgaccagcag

SEQ ID NO: 4159696 - RNA, 20 nt, Yersinia pestis
ccugauucgcgaccagcaga

SEQ ID NO: 4159697 - RNA, 14 nt, Yersinia pestis
ccugauuguuuuua

SEQ ID NO: 4159698 - RNA, 14 nt, Yersinia pestis
ccugcaaacggcuc

SEQ ID NO: 4159699 - RNA, 16 nt, Yersinia pestis
ccugcaauaacaccag

SEQ ID NO: 4159700 - RNA, 14 nt, Yersinia pestis
ccugcaauuuuuag

SEQ ID NO: 4159701 - RNA, 16 nt, Yersinia pestis
ccugcaauuuuuagcc

SEQ ID NO: 4159702 - RNA, 23 nt, Yersinia pestis
ccugcaccagugccaauccccac

SEQ ID NO: 4159703 - RNA, 12 nt, Yersinia pestis
ccugcaccauau

SEQ ID NO: 4159704 - RNA, 18 nt, Yersinia pestis
ccugcagcaacaauaacu

SEQ ID NO: 4159705 - RNA, 22 nt, Yersinia pestis
ccugcagguaagaaggcaauau

SEQ ID NO: 4159706 - RNA, 15 nt, Yersinia pestis
ccugcauaucauucg

SEQ ID NO: 4159707 - RNA, 19 nt, Yersinia pestis
ccugcaucaucacauucaa

SEQ ID NO: 4159708 - RNA, 22 nt, Yersinia pestis
ccugcccguuaucuuauggcua

SEQ ID NO: 4159709 - RNA, 19 nt, Yersinia pestis
ccugcccuaauaccaauac

SEQ ID NO: 4159710 - RNA, 15 nt, Yersinia pestis
ccugccgccucugcu

SEQ ID NO: 4159711 - RNA, 17 nt, Yersinia pestis
ccugccgccucugcucc

SEQ ID NO: 4159712 - RNA, 21 nt, Yersinia pestis
ccugccgggucagguuuauca

SEQ ID NO: 4159713 - RNA, 14 nt, Yersinia pestis
ccugccuauccuca

SEQ ID NO: 4159714 - RNA, 13 nt, Yersinia pestis
ccugccugcugcu

SEQ ID NO: 4159715 - RNA, 19 nt, Yersinia pestis
ccugccugggccgcugggc

SEQ ID NO: 4159716 - RNA, 18 nt, Yersinia pestis
ccugcgaauuaucaucca

SEQ ID NO: 4159717 - RNA, 19 nt, Yersinia pestis
ccugcgaggcacuucauug

SEQ ID NO: 4159718 - RNA, 18 nt, Yersinia pestis
ccugcgauagccccauau

SEQ ID NO: 4159719 - RNA, 19 nt, Yersinia pestis
ccugcgaucugccuuaucu

SEQ ID NO: 4159720 - RNA, 20 nt, Yersinia pestis
ccugcggccaucaccaugcc

SEQ ID NO: 4159721 - RNA, 15 nt, Yersinia pestis
ccugcguauugcugu

SEQ ID NO: 4159722 - RNA, 16 nt, Yersinia pestis
ccugcuauuuaacaaa

SEQ ID NO: 4159723 - RNA, 15 nt, Yersinia pestis
ccugcucaacugcuc

SEQ ID NO: 4159724 - RNA, 12 nt, Yersinia pestis
ccugcucagcua

SEQ ID NO: 4159725 - RNA, 13 nt, Yersinia pestis
ccugcugcaccuc

SEQ ID NO: 4159726 - RNA, 17 nt, Yersinia pestis
ccugcugcaccucugcu

SEQ ID NO: 4159727 - RNA, 16 nt, Yersinia pestis
ccugcugcuccaauga

SEQ ID NO: 4159728 - RNA, 17 nt, Yersinia pestis
ccugcugcuccaccaau

SEQ ID NO: 4159729 - RNA, 17 nt, Yersinia pestis
ccugcugcuguggcacu

SEQ ID NO: 4159730 - RNA, 12 nt, Yersinia pestis
ccugcuggcgca

SEQ ID NO: 4159731 - RNA, 21 nt, Yersinia pestis
ccugcugggggcgguugcgcu

SEQ ID NO: 4159732 - RNA, 22 nt, Yersinia pestis
ccugcuguuaguaacuguaagg

SEQ ID NO: 4159733 - RNA, 23 nt, Yersinia pestis
ccugcuuaaccgauuucagcacc

SEQ ID NO: 4159734 - RNA, 16 nt, Yersinia pestis
ccugcuugaaagcacc

SEQ ID NO: 4159735 - RNA, 13 nt, Yersinia pestis
ccuggauauucau

SEQ ID NO: 4159736 - RNA, 18 nt, Yersinia pestis
ccuggccccguugucccg

SEQ ID NO: 4159737 - RNA, 20 nt, Yersinia pestis
ccuggccguguuuuucccua

SEQ ID NO: 4159738 - RNA, 22 nt, Yersinia pestis
ccuggcggaugucagauggugc

SEQ ID NO: 4159739 - RNA, 20 nt, Yersinia pestis
ccuggcguaauauugccccc

SEQ ID NO: 4159740 - RNA, 20 nt, Yersinia pestis
ccuggcugcgcaccacuguc

SEQ ID NO: 4159741 - RNA, 16 nt, Yersinia pestis
ccugguggcaaguauc

SEQ ID NO: 4159742 - RNA, 13 nt, Yersinia pestis
ccuguaaaacaag

SEQ ID NO: 4159743 - RNA, 22 nt, Yersinia pestis
ccuguaaaagcagccgugcuug

SEQ ID NO: 4159744 - RNA, 15 nt, Yersinia pestis
ccuguaaauaaauac

SEQ ID NO: 4159745 - RNA, 13 nt, Yersinia pestis
ccuguaaaucuug

SEQ ID NO: 4159746 - RNA, 16 nt, Yersinia pestis
ccuguaacuuuauuga

SEQ ID NO: 4159747 - RNA, 15 nt, Yersinia pestis
ccuguacauaaauuu

SEQ ID NO: 4159748 - RNA, 20 nt, Yersinia pestis
ccuguaccaccaccaacagc

SEQ ID NO: 4159749 - RNA, 15 nt, Yersinia pestis
ccuguacuggcucuc

SEQ ID NO: 4159750 - RNA, 19 nt, Yersinia pestis
ccuguacuuugauucaaaa

SEQ ID NO: 4159751 - RNA, 21 nt, Yersinia pestis
ccuguagcuuuuuaaauacca

SEQ ID NO: 4159752 - RNA, 16 nt, Yersinia pestis
ccugucaccuaccacc

SEQ ID NO: 4159753 - RNA, 13 nt, Yersinia pestis
ccugucaccuguc

SEQ ID NO: 4159754 - RNA, 16 nt, Yersinia pestis
ccugucaccugucacc

SEQ ID NO: 4159755 - RNA, 17 nt, Yersinia pestis
ccugucaccugucaccu

SEQ ID NO: 4159756 - RNA, 22 nt, Yersinia pestis
ccugucuuaggugacaggcaaa

SEQ ID NO: 4159757 - RNA, 17 nt, Yersinia pestis
ccugugauuucagccag

SEQ ID NO: 4159758 - RNA, 19 nt, Yersinia pestis
ccuguggggcuacuuuuuu

SEQ ID NO: 4159759 - RNA, 15 nt, Yersinia pestis
ccaucagcgauagcu

SEQ ID NO: 4159760 - RNA, 11 nt, Yersinia pestis
ccaucaggaag

SEQ ID NO: 4159761 - RNA, 16 nt, Yersinia pestis
ccaucaggauuugcug

SEQ ID NO: 4159762 - RNA, 23 nt, Yersinia pestis
ccaucaggcuacggcugaucugc

SEQ ID NO: 4159763 - RNA, 17 nt, Yersinia pestis
ccaucaggucaguaaug

SEQ ID NO: 4159764 - RNA, 16 nt, Yersinia pestis
ccaucaguacgguuca

SEQ ID NO: 4159765 - RNA, 15 nt, Yersinia pestis
ccaucaguucacuga

SEQ ID NO: 4159766 - RNA, 16 nt, Yersinia pestis
ccaucauaaaggcuaa

SEQ ID NO: 4159767 - RNA, 23 nt, Yersinia pestis
ccaucaucauucaauuguuccau

SEQ ID NO: 4159768 - RNA, 23 nt, Yersinia pestis
ccaucaugaauaggauagacagu

SEQ ID NO: 4159769 - RNA, 14 nt, Yersinia pestis
ccaucauucccgau

SEQ ID NO: 4159770 - RNA, 19 nt, Yersinia pestis
ccauccauauuuggcaugu

SEQ ID NO: 4159771 - RNA, 21 nt, Yersinia pestis
ccauccccaacucuuucaacu

SEQ ID NO: 4159772 - RNA, 18 nt, Yersinia pestis
ccaucccccauggggcca

SEQ ID NO: 4159773 - RNA, 16 nt, Yersinia pestis
ccauccccuguugauc

SEQ ID NO: 4159774 - RNA, 11 nt, Yersinia pestis
ccaucccucac

SEQ ID NO: 4159775 - RNA, 18 nt, Yersinia pestis
ccauccgguuuuaaauua

SEQ ID NO: 4159776 - RNA, 17 nt, Yersinia pestis
ccauccuagcguuucua

SEQ ID NO: 4159777 - RNA, 19 nt, Yersinia pestis
ccauccuagcguuucuaca

SEQ ID NO: 4159778 - RNA, 19 nt, Yersinia pestis
ccauccuuuugacugguca

SEQ ID NO: 4159779 - RNA, 13 nt, Yersinia pestis
ccaucgcaccaaa

SEQ ID NO: 4159780 - RNA, 13 nt, Yersinia pestis
ccaucgccaauac

SEQ ID NO: 4159781 - RNA, 13 nt, Yersinia pestis
ccaucgccccaaa

SEQ ID NO: 4159782 - RNA, 16 nt, Yersinia pestis
ccaucgccgacaaaau

SEQ ID NO: 4159783 - RNA, 22 nt, Yersinia pestis
ccaucgccgacaaaauccccca

SEQ ID NO: 4159784 - RNA, 15 nt, Yersinia pestis
ccaucgcgccuaccu

SEQ ID NO: 4159785 - RNA, 17 nt, Yersinia pestis
ccaucgcuaaucauauc

SEQ ID NO: 4159786 - RNA, 15 nt, Yersinia pestis
ccaucgucagccccu

SEQ ID NO: 4159787 - RNA, 16 nt, Yersinia pestis
ccaucgucagccccug

SEQ ID NO: 4159788 - RNA, 21 nt, Yersinia pestis
ccaucugaugcagguuuugga

SEQ ID NO: 4159789 - RNA, 21 nt, Yersinia pestis
ccaucuuacccaacagugcuc

SEQ ID NO: 4159790 - RNA, 15 nt, Yersinia pestis
ccaucuuccagcauc

SEQ ID NO: 4159791 - RNA, 19 nt, Yersinia pestis
ccaucuugucgucacccau

SEQ ID NO: 4159792 - RNA, 20 nt, Yersinia pestis
ccaucuuguucuaauaauaa

SEQ ID NO: 4159793 - RNA, 22 nt, Yersinia pestis
ccaucuuugauuuaaauauuau

SEQ ID NO: 4159794 - RNA, 22 nt, Yersinia pestis
ccaugacaaaauacgguucacu

SEQ ID NO: 4159795 - RNA, 13 nt, Yersinia pestis
ccaugaccgccag

SEQ ID NO: 4159796 - RNA, 12 nt, Yersinia pestis
ccaugagaacca

SEQ ID NO: 4159797 - RNA, 16 nt, Yersinia pestis
ccaugagaaccaguuc

SEQ ID NO: 4159798 - RNA, 18 nt, Yersinia pestis
ccaugagaaccaguucug

SEQ ID NO: 4159799 - RNA, 21 nt, Yersinia pestis
ccaugagaauacuucaggcca

SEQ ID NO: 4159800 - RNA, 16 nt, Yersinia pestis
ccaugagugaaaauau

SEQ ID NO: 4159801 - RNA, 15 nt, Yersinia pestis
ccaugcacuccacua

SEQ ID NO: 4159802 - RNA, 17 nt, Yersinia pestis
ccaugccagcccaucac

SEQ ID NO: 4159803 - RNA, 14 nt, Yersinia pestis
ccaugccgguugau

SEQ ID NO: 4159804 - RNA, 16 nt, Yersinia pestis
ccaugcgcucuugcau

SEQ ID NO: 4159805 - RNA, 21 nt, Yersinia pestis
ccaugcugcuugauuugcugg

SEQ ID NO: 4159806 - RNA, 20 nt, Yersinia pestis
ccaugcuuucuaacaaaccu

SEQ ID NO: 4159807 - RNA, 13 nt, Yersinia pestis
ccauggccgccag

SEQ ID NO: 4159808 - RNA, 14 nt, Yersinia pestis
ccauggcguaaccg

SEQ ID NO: 4159809 - RNA, 17 nt, Yersinia pestis
ccauggcguaaccgccg

SEQ ID NO: 4159810 - RNA, 14 nt, Yersinia pestis
ccauggcuaacaua

SEQ ID NO: 4159811 - RNA, 17 nt, Yersinia pestis
ccauggcucaccauaaa

SEQ ID NO: 4159812 - RNA, 15 nt, Yersinia pestis
ccaugggaaaucaaa

SEQ ID NO: 4159813 - RNA, 21 nt, Yersinia pestis
ccaugguuacgccagcagcau

SEQ ID NO: 4159814 - RNA, 21 nt, Yersinia pestis
ccaugucaggccaccaaucac

SEQ ID NO: 4159815 - RNA, 21 nt, Yersinia pestis
ccauguuaauggggcauugca

SEQ ID NO: 4159816 - RNA, 20 nt, Yersinia pestis
ccauguuagagauaacaacu

SEQ ID NO: 4159817 - RNA, 13 nt, Yersinia pestis
ccauuaacaauau

SEQ ID NO: 4159818 - RNA, 22 nt, Yersinia pestis
ccauuaacaauguuauauuucu

SEQ ID NO: 4159819 - RNA, 23 nt, Yersinia pestis
ccauuaacaauguuauauuucuu

SEQ ID NO: 4159820 - RNA, 23 nt, Yersinia pestis
ccauuaacgaugaccgugacauu

SEQ ID NO: 4159821 - RNA, 13 nt, Yersinia pestis
ccauuaauuggcc

SEQ ID NO: 4159822 - RNA, 14 nt, Yersinia pestis
ccauuaauuggccg

SEQ ID NO: 4159823 - RNA, 19 nt, Yersinia pestis
ccauuacagcaccuggaac

SEQ ID NO: 4159824 - RNA, 17 nt, Yersinia pestis
ccauuacuguccuuuaa

SEQ ID NO: 4159825 - RNA, 16 nt, Yersinia pestis
ccauuaucguuagcau

SEQ ID NO: 4159826 - RNA, 23 nt, Yersinia pestis
ccauucaaaaauuaaauuaauau

SEQ ID NO: 4159827 - RNA, 20 nt, Yersinia pestis
ccauucaccguguuucagca

SEQ ID NO: 4159828 - RNA, 21 nt, Yersinia pestis
ccauucaucaaacucugcauc

SEQ ID NO: 4159829 - RNA, 16 nt, Yersinia pestis
ccauucauuuuuuaua

SEQ ID NO: 4159830 - RNA, 17 nt, Yersinia pestis
ccauuccguuauuaaac

SEQ ID NO: 4159831 - RNA, 22 nt, Yersinia pestis
ccauucgcaggccagacccauu

SEQ ID NO: 4159832 - RNA, 21 nt, Yersinia pestis
ccauucggcacugcaucugac

SEQ ID NO: 4159833 - RNA, 23 nt, Yersinia pestis
ccauucgucacugucagacaguu

SEQ ID NO: 4159834 - RNA, 22 nt, Yersinia pestis
ccauugauggccuugaaucaaa

SEQ ID NO: 4159835 - RNA, 16 nt, Yersinia pestis
ccauugcauauugcuc

SEQ ID NO: 4159836 - RNA, 22 nt, Yersinia pestis
ccauugcgguuacguucaccua

SEQ ID NO: 4159837 - RNA, 22 nt, Yersinia pestis
ccauugcucaaacucagcauca

SEQ ID NO: 4159838 - RNA, 17 nt, Yersinia pestis
ccauuguauugcucagg

SEQ ID NO: 4159839 - RNA, 21 nt, Yersinia pestis
ccauuguauugcucagggcca

SEQ ID NO: 4159840 - RNA, 13 nt, Yersinia pestis
ccauuuagcuggc

SEQ ID NO: 4159841 - RNA, 21 nt, Yersinia pestis
ccauuuaucgccaagccagua

SEQ ID NO: 4159842 - RNA, 14 nt, Yersinia pestis
ccauuuccaauacc

SEQ ID NO: 4159843 - RNA, 18 nt, Yersinia pestis
ccauuuccaggcuaccaa

SEQ ID NO: 4159844 - RNA, 22 nt, Yersinia pestis
ccauuucuuagaccaccgccau

SEQ ID NO: 4159845 - RNA, 20 nt, Yersinia pestis
ccauuuuaaucucuccauga

SEQ ID NO: 4159846 - RNA, 12 nt, Yersinia pestis
ccauuuuauccu

SEQ ID NO: 4159847 - RNA, 17 nt, Yersinia pestis
ccauuuuauccucuucc

SEQ ID NO: 4159848 - RNA, 19 nt, Yersinia pestis
ccauuuuauuuaacguguu

SEQ ID NO: 4159849 - RNA, 11 nt, Yersinia pestis
ccauuuugcug

SEQ ID NO: 4159850 - RNA, 20 nt, Yersinia pestis
ccauuuuuauaucagauuca

SEQ ID NO: 4159851 - RNA, 20 nt, Yersinia pestis
cccaaaacuuggacaucugc

SEQ ID NO: 4159852 - RNA, 15 nt, Yersinia pestis
cccaaaccaacaaua

SEQ ID NO: 4159853 - RNA, 21 nt, Yersinia pestis
cccaaagcgcagugcucauua

SEQ ID NO: 4159854 - RNA, 17 nt, Yersinia pestis
cccaaagcucuacacug

SEQ ID NO: 4159855 - RNA, 21 nt, Yersinia pestis
cccaaauagcuggcauccuca

SEQ ID NO: 4159856 - RNA, 17 nt, Yersinia pestis
cccaaaugagcagcaau

SEQ ID NO: 4159857 - RNA, 21 nt, Yersinia pestis
cccaacaacgcuccagguuca

SEQ ID NO: 4159858 - RNA, 19 nt, Yersinia pestis
cccaaccccaucagcauau

SEQ ID NO: 4159859 - RNA, 20 nt, Yersinia pestis
cccaaccgaccaaaggccaa

SEQ ID NO: 4159860 - RNA, 13 nt, Yersinia pestis
cccaacugacuga

SEQ ID NO: 4159861 - RNA, 17 nt, Yersinia pestis
cccaacuggcgcgggaa

SEQ ID NO: 4159862 - RNA, 12 nt, Yersinia pestis
cccaagcaggaa

SEQ ID NO: 4159863 - RNA, 23 nt, Yersinia pestis
cccaaggguauaacucaucagua

SEQ ID NO: 4159864 - RNA, 20 nt, Yersinia pestis
cccaauaagugaaacaaaua

SEQ ID NO: 4159865 - RNA, 21 nt, Yersinia pestis
cccaauaagugaaacaaauac

SEQ ID NO: 4159866 - RNA, 15 nt, Yersinia pestis
cccaauggagaucug

SEQ ID NO: 4159867 - RNA, 14 nt, Yersinia pestis
cccaaugucaggaa

SEQ ID NO: 4159868 - RNA, 14 nt, Yersinia pestis
cccacaucaggccg

SEQ ID NO: 4159869 - RNA, 17 nt, Yersinia pestis
cccacauuaaaggccgc

SEQ ID NO: 4159870 - RNA, 12 nt, Yersinia pestis
cccacauucagg

SEQ ID NO: 4159871 - RNA, 14 nt, Yersinia pestis
cccacauucaguac

SEQ ID NO: 4159872 - RNA, 14 nt, Yersinia pestis
cccaccaaaccauu

SEQ ID NO: 4159873 - RNA, 18 nt, Yersinia pestis
cccaccaagggucaucaa

SEQ ID NO: 4159874 - RNA, 21 nt, Yersinia pestis
cccaccauaaugugccucgaa

SEQ ID NO: 4159875 - RNA, 20 nt, Yersinia pestis
cccacggauggaugcuaucc

SEQ ID NO: 4159876 - RNA, 15 nt, Yersinia pestis
cccacggcacauaau

SEQ ID NO: 4159877 - RNA, 18 nt, Yersinia pestis
cccacggcgacguucagc

SEQ ID NO: 4159878 - RNA, 19 nt, Yersinia pestis
cccacguaauuauuguuca

SEQ ID NO: 4159879 - RNA, 21 nt, Yersinia pestis
cccacguuuugacgcguagag

SEQ ID NO: 4159880 - RNA, 16 nt, Yersinia pestis
cccacucgccccacaa

SEQ ID NO: 4159881 - RNA, 16 nt, Yersinia pestis
cccacugacacugaua

SEQ ID NO: 4159882 - RNA, 19 nt, Yersinia pestis
cccacuggccccgaucauc

SEQ ID NO: 4159883 - RNA, 18 nt, Yersinia pestis
cccacuuguaccugugcc

SEQ ID NO: 4159884 - RNA, 19 nt, Yersinia pestis
cccacuuguaccugugcca

SEQ ID NO: 4159885 - RNA, 21 nt, Yersinia pestis
cccacuuguaccugugccagu

SEQ ID NO: 4159886 - RNA, 21 nt, Yersinia pestis
cccagagcgcaaaagaccaag

SEQ ID NO: 4159887 - RNA, 22 nt, Yersinia pestis
cccagagcgcggcuucagcacc

SEQ ID NO: 4159888 - RNA, 23 nt, Yersinia pestis
cccagagcgcggcuucagcaccu

SEQ ID NO: 4159889 - RNA, 17 nt, Yersinia pestis
cccagcacaaugcauuc

SEQ ID NO: 4159890 - RNA, 19 nt, Yersinia pestis
cccagcauucagguguuca

SEQ ID NO: 4159891 - RNA, 13 nt, Yersinia pestis
cccagccagaaug

SEQ ID NO: 4159892 - RNA, 21 nt, Yersinia pestis
cccagccauuugaacaaaccc

SEQ ID NO: 4159893 - RNA, 12 nt, Yersinia pestis
cccagccucugg

SEQ ID NO: 4159894 - RNA, 20 nt, Yersinia pestis
cccaggcaaucucuccccaa

SEQ ID NO: 4159895 - RNA, 13 nt, Yersinia pestis
cccaggccuccgc

SEQ ID NO: 4159896 - RNA, 14 nt, Yersinia pestis
cccaggcguucugu

SEQ ID NO: 4159897 - RNA, 18 nt, Yersinia pestis
cccaguacagaauuucau

SEQ ID NO: 4159898 - RNA, 14 nt, Yersinia pestis
cccaguaccgcugg

SEQ ID NO: 4159899 - RNA, 17 nt, Yersinia pestis
cccaguagagcacuuca

SEQ ID NO: 4159900 - RNA, 15 nt, Yersinia pestis
cccaguagcacaaug

SEQ ID NO: 4159901 - RNA, 20 nt, Yersinia pestis
cccagucgucuucagcuucc

SEQ ID NO: 4159902 - RNA, 18 nt, Yersinia pestis
cccagugcguacgccaac

SEQ ID NO: 4159903 - RNA, 16 nt, Yersinia pestis
cccaguuacuaccuuu

SEQ ID NO: 4159904 - RNA, 21 nt, Yersinia pestis
cccaguuuuuaauuuaaacuc

SEQ ID NO: 4159905 - RNA, 22 nt, Yersinia pestis
cccaguuuuuaauuuaaacucu

SEQ ID NO: 4159906 - RNA, 22 nt, Yersinia pestis
cccauacaaauaguaauaauua

SEQ ID NO: 4159907 - RNA, 21 nt, Yersinia pestis
cccauaccaaccauaucgcca

SEQ ID NO: 4159908 - RNA, 20 nt, Yersinia pestis
cccauauaaaaaacuaaugu

SEQ ID NO: 4159909 - RNA, 17 nt, Yersinia pestis
cccaucaauuuccccaa

SEQ ID NO: 4159910 - RNA, 12 nt, Yersinia pestis
cccaucaccauu

SEQ ID NO: 4159911 - RNA, 11 nt, Yersinia pestis
cccaucacuag

SEQ ID NO: 4159912 - RNA, 17 nt, Yersinia pestis
cccaucaugccagcaau

SEQ ID NO: 4159913 - RNA, 16 nt, Yersinia pestis
cccauccgcaggaagc

SEQ ID NO: 4159914 - RNA, 14 nt, Yersinia pestis
cccauccuguucaa

SEQ ID NO: 4159915 - RNA, 23 nt, Yersinia pestis
cccauggcugaaauaacuuauua

SEQ ID NO: 4159916 - RNA, 23 nt, Yersinia pestis
cccauggugauaaagguguagug

SEQ ID NO: 4159917 - RNA, 15 nt, Yersinia pestis
cccauguuaaugggg

SEQ ID NO: 4159918 - RNA, 21 nt, Yersinia pestis
cccauuagcaguaacguccaa

SEQ ID NO: 4159919 - RNA, 14 nt, Yersinia pestis
cccauucacaccau

SEQ ID NO: 4159920 - RNA, 12 nt, Yersinia pestis
cccauucaucaa

SEQ ID NO: 4159921 - RNA, 22 nt, Yersinia pestis
cccauucaucaaacucugcauc

SEQ ID NO: 4159922 - RNA, 15 nt, Yersinia pestis
cccauucgcgcccca

SEQ ID NO: 4159923 - RNA, 15 nt, Yersinia pestis
cccauuuaucgccaa

SEQ ID NO: 4159924 - RNA, 13 nt, Yersinia pestis
cccauuuauuaca

SEQ ID NO: 4159925 - RNA, 21 nt, Yersinia pestis
cccauuugcccgaaucacugg

SEQ ID NO: 4159926 - RNA, 22 nt, Yersinia pestis
ccccaaauaaucagcucauuaa

SEQ ID NO: 4159927 - RNA, 20 nt, Yersinia pestis
ccccaacucuuucaacuucc

SEQ ID NO: 4159928 - RNA, 15 nt, Yersinia pestis
ccccaagcauagaag

SEQ ID NO: 4159929 - RNA, 13 nt, Yersinia pestis
ccccaagcuuuug

SEQ ID NO: 4159930 - RNA, 21 nt, Yersinia pestis
ccccaauucacgcaaggccag

SEQ ID NO: 4159931 - RNA, 21 nt, Yersinia pestis
ccccacaaccugcgccaccca

SEQ ID NO: 4159932 - RNA, 15 nt, Yersinia pestis
ccccacaucaggccg

SEQ ID NO: 4159933 - RNA, 14 nt, Yersinia pestis
ccccacggccagag

SEQ ID NO: 4159934 - RNA, 13 nt, Yersinia pestis
ccccagagcgcaa

SEQ ID NO: 4159935 - RNA, 14 nt, Yersinia pestis
ccccagcaaagcca

SEQ ID NO: 4159936 - RNA, 12 nt, Yersinia pestis
ccccagccagaa

SEQ ID NO: 4159937 - RNA, 17 nt, Yersinia pestis
ccccagccggugucacu

SEQ ID NO: 4159938 - RNA, 21 nt, Yersinia pestis
ccccaggugcuuauuuauuuu

SEQ ID NO: 4159939 - RNA, 19 nt, Yersinia pestis
ccccauauaaaaaacuaau

SEQ ID NO: 4159940 - RNA, 18 nt, Yersinia pestis
ccccaucaauuuccccaa

SEQ ID NO: 4159941 - RNA, 14 nt, Yersinia pestis
ccccaucauaaagg

SEQ ID NO: 4159942 - RNA, 14 nt, Yersinia pestis
ccccauccguccaa

SEQ ID NO: 4159943 - RNA, 23 nt, Yersinia pestis
ccccaucgccaauacaaucguca

SEQ ID NO: 4159944 - RNA, 12 nt, Yersinia pestis
ccccaucucuuc

SEQ ID NO: 4159945 - RNA, 13 nt, Yersinia pestis
ccccaugaccgcc

SEQ ID NO: 4159946 - RNA, 20 nt, Yersinia pestis
ccccaugauggcguuuucuu

SEQ ID NO: 4159947 - RNA, 22 nt, Yersinia pestis
ccccauuuaucgccaagccagu

SEQ ID NO: 4159948 - RNA, 19 nt, Yersinia pestis
cccccacucgccccacaau

SEQ ID NO: 4159949 - RNA, 24 nt, Yersinia pestis
cccccagcguuguucuaauacuga

SEQ ID NO: 4159950 - RNA, 19 nt, Yersinia pestis
cccccaguagcacaaugcc

SEQ ID NO: 4159951 - RNA, 11 nt, Yersinia pestis
cccccagugcu

SEQ ID NO: 4159952 - RNA, 20 nt, Yersinia pestis
cccccaucaacgacaacauc

SEQ ID NO: 4159953 - RNA, 14 nt, Yersinia pestis
ccccccaagagaaa

SEQ ID NO: 4159954 - RNA, 15 nt, Yersinia pestis
cccccuguaaaacaa

SEQ ID NO: 4159955 - RNA, 17 nt, Yersinia pestis
cccccuuuuucaaucac

SEQ ID NO: 4159956 - RNA, 22 nt, Yersinia pestis
ccccgacgauauuaccgagcgu

SEQ ID NO: 4159957 - RNA, 14 nt, Yersinia pestis
ccccgccucaaugc

SEQ ID NO: 4159958 - RNA, 18 nt, Yersinia pestis
ccccgcgauguaaauauc

SEQ ID NO: 4159959 - RNA, 15 nt, Yersinia pestis
ccccgcguugucagc

SEQ ID NO: 4159960 - RNA, 18 nt, Yersinia pestis
ccccgcuaccaagcccag

SEQ ID NO: 4159961 - RNA, 17 nt, Yersinia pestis
ccccgcucgacucucaa

SEQ ID NO: 4159962 - RNA, 19 nt, Yersinia pestis
ccccgcucgacucucaagc

SEQ ID NO: 4159963 - RNA, 16 nt, Yersinia pestis
ccccggaucacuggcu

SEQ ID NO: 4159964 - RNA, 18 nt, Yersinia pestis
ccccggucacuuaaauaa

SEQ ID NO: 4159965 - RNA, 14 nt, Yersinia pestis
ccccguauaacgca

SEQ ID NO: 4159966 - RNA, 18 nt, Yersinia pestis
ccccguccagcccaccau

SEQ ID NO: 4159967 - RNA, 11 nt, Yersinia pestis
ccccguggcgg

SEQ ID NO: 4159968 - RNA, 15 nt, Yersinia pestis
ccccgugguuguauc

SEQ ID NO: 4159969 - RNA, 15 nt, Yersinia pestis
ccccuaauucuccuu

SEQ ID NO: 4159970 - RNA, 13 nt, Yersinia pestis
ccccuagccagcc

SEQ ID NO: 4159971 - RNA, 17 nt, Yersinia pestis
ccccuagccagccaccg

SEQ ID NO: 4159972 - RNA, 17 nt, Yersinia pestis
ccccucacauuacugau

SEQ ID NO: 4159973 - RNA, 15 nt, Yersinia pestis
ccccuccggaaucag

SEQ ID NO: 4159974 - RNA, 24 nt, Yersinia pestis
ccccucgaaaauaaccaccucgga

SEQ ID NO: 4159975 - RNA, 19 nt, Yersinia pestis
ccccugccguuggcauaug

SEQ ID NO: 4159976 - RNA, 17 nt, Yersinia pestis
ccccugcguauugcugu

SEQ ID NO: 4159977 - RNA, 15 nt, Yersinia pestis
ccccuguaaaacaag

SEQ ID NO: 4159978 - RNA, 18 nt, Yersinia pestis
ccccuuaugcgacaacgc

SEQ ID NO: 4159979 - RNA, 22 nt, Yersinia pestis
ccccuucaaugaaugccgguga

SEQ ID NO: 4159980 - RNA, 15 nt, Yersinia pestis
ccccuuucaccaacc

SEQ ID NO: 4159981 - RNA, 18 nt, Yersinia pestis
cccgaagcucaagcuggc

SEQ ID NO: 4159982 - RNA, 18 nt, Yersinia pestis
cccgaagcucaagcuggu

SEQ ID NO: 4159983 - RNA, 11 nt, Yersinia pestis
cccgaaucaag

SEQ ID NO: 4159984 - RNA, 13 nt, Yersinia pestis
cccgaaucaagcu

SEQ ID NO: 4159985 - RNA, 19 nt, Yersinia pestis
cccgaaucacugacugaug

SEQ ID NO: 4159986 - RNA, 15 nt, Yersinia pestis
cccgaaucacuggug

SEQ ID NO: 4159987 - RNA, 15 nt, Yersinia pestis
cccgacagaacugau

SEQ ID NO: 4159988 - RNA, 15 nt, Yersinia pestis
cccgaguaagcgcug

SEQ ID NO: 4159989 - RNA, 19 nt, Yersinia pestis
cccgaucaggugaugucag

SEQ ID NO: 4159990 - RNA, 17 nt, Yersinia pestis
cccgaucuaucgggaga

SEQ ID NO: 4159991 - RNA, 22 nt, Yersinia pestis
cccgaucugagccauuaucguu

SEQ ID NO: 4159992 - RNA, 22 nt, Yersinia pestis
cccgaugaacugacacacacca

SEQ ID NO: 4159993 - RNA, 12 nt, Yersinia pestis
cccgaugacgcg

SEQ ID NO: 4159994 - RNA, 17 nt, Yersinia pestis
cccgaugauugcaucau

SEQ ID NO: 4159995 - RNA, 19 nt, Yersinia pestis
cccgaugguggcagccugc

SEQ ID NO: 4159996 - RNA, 21 nt, Yersinia pestis
cccgauguggauaauuucagc

SEQ ID NO: 4159997 - RNA, 20 nt, Yersinia pestis
cccgauuauugugccgccuu

SEQ ID NO: 4159998 - RNA, 16 nt, Yersinia pestis
cccgauuucaacgcac

SEQ ID NO: 4159999 - RNA, 20 nt, Yersinia pestis
cccgauuucaacgcaccauc

SEQ ID NO: 4160000 - RNA, 13 nt, Yersinia pestis
cccgcaaagccug

SEQ ID NO: 4160001 - RNA, 18 nt, Yersinia pestis
cccgcaaccugacugcug

SEQ ID NO: 4160002 - RNA, 12 nt, Yersinia pestis
cccgcaauuuua

SEQ ID NO: 4160003 - RNA, 16 nt, Yersinia pestis
cccgccaguaaaccug

SEQ ID NO: 4160004 - RNA, 18 nt, Yersinia pestis
cccgccauggcaugccau

SEQ ID NO: 4160005 - RNA, 14 nt, Yersinia pestis
cccgccccccauca

SEQ ID NO: 4160006 - RNA, 16 nt, Yersinia pestis
cccgcccgguaccgcc

SEQ ID NO: 4160007 - RNA, 11 nt, Yersinia pestis
cccgccucuga

SEQ ID NO: 4160008 - RNA, 15 nt, Yersinia pestis
cccgcgacggagaga

SEQ ID NO: 4160009 - RNA, 11 nt, Yersinia pestis
cccgcgccgac

SEQ ID NO: 4160010 - RNA, 13 nt, Yersinia pestis
cccgcuaacaugc

SEQ ID NO: 4160011 - RNA, 14 nt, Yersinia pestis
cccgcuaucacuag

SEQ ID NO: 4160012 - RNA, 17 nt, Yersinia pestis
cccgcucuaaguuaaca

SEQ ID NO: 4160013 - RNA, 12 nt, Yersinia pestis
cccgcucuguca

SEQ ID NO: 4160014 - RNA, 22 nt, Yersinia pestis
cccgcuggaagucugcuuuauu

SEQ ID NO: 4160015 - RNA, 21 nt, Yersinia pestis
cccgcuggucgauaagcacuc

SEQ ID NO: 4160016 - RNA, 21 nt, Yersinia pestis
cccgcuuaaucauauuuuccu

SEQ ID NO: 4160017 - RNA, 15 nt, Yersinia pestis
cccggaucacuggcu

SEQ ID NO: 4160018 - RNA, 20 nt, Yersinia pestis
cccggccaaccguagugagu

SEQ ID NO: 4160019 - RNA, 22 nt, Yersinia pestis
cccggccuugcccaucaaccac

SEQ ID NO: 4160020 - RNA, 19 nt, Yersinia pestis
cccggcuaggaggccagga

SEQ ID NO: 4160021 - RNA, 16 nt, Yersinia pestis
cccggcucauccgcca

SEQ ID NO: 4160022 - RNA, 17 nt, Yersinia pestis
cccggcugaccuguugu

SEQ ID NO: 4160023 - RNA, 23 nt, Yersinia pestis
cccggcugaccuguuguaacacu

SEQ ID NO: 4160024 - RNA, 16 nt, Yersinia pestis
cccgggaggagcugcg

SEQ ID NO: 4160025 - RNA, 23 nt, Yersinia pestis
cccgguaagcgguauccaccuuc

SEQ ID NO: 4160026 - RNA, 16 nt, Yersinia pestis
cccggucauauucccu

SEQ ID NO: 4160027 - RNA, 15 nt, Yersinia pestis
cccggugacccgugc

SEQ ID NO: 4160028 - RNA, 13 nt, Yersinia pestis
cccggugcggcua

SEQ ID NO: 4160029 - RNA, 17 nt, Yersinia pestis
cccguaacuuaucgaca

SEQ ID NO: 4160030 - RNA, 15 nt, Yersinia pestis
cccguaggccuuaac

SEQ ID NO: 4160031 - RNA, 21 nt, Yersinia pestis
cccgucgggauaucuucaauc

SEQ ID NO: 4160032 - RNA, 13 nt, Yersinia pestis
cccgugucacuua

SEQ ID NO: 4160033 - RNA, 18 nt, Yersinia pestis
cccguguuagcaucugau

SEQ ID NO: 4160034 - RNA, 20 nt, Yersinia pestis
cccguuauaccucaagcugc

SEQ ID NO: 4160035 - RNA, 17 nt, Yersinia pestis
cccguucaacaguauca

SEQ ID NO: 4160036 - RNA, 22 nt, Yersinia pestis
cccguucacuuacugccaaaga

SEQ ID NO: 4160037 - RNA, 12 nt, Yersinia pestis
cccguuccuuca

SEQ ID NO: 4160038 - RNA, 16 nt, Yersinia pestis
cccguucuaguagugg

SEQ ID NO: 4160039 - RNA, 16 nt, Yersinia pestis
cccguugcauuuuucu

SEQ ID NO: 4160040 - RNA, 20 nt, Yersinia pestis
cccguuugcagcucaaagac

SEQ ID NO: 4160041 - RNA, 16 nt, Yersinia pestis
cccuaaaaucauugac

SEQ ID NO: 4160042 - RNA, 18 nt, Yersinia pestis
cccuaaauaauaucuguc

SEQ ID NO: 4160043 - RNA, 16 nt, Yersinia pestis
cccuaauaucauguuc

SEQ ID NO: 4160044 - RNA, 19 nt, Yersinia pestis
cccuaaugcgcucaccaag

SEQ ID NO: 4160045 - RNA, 12 nt, Yersinia pestis
cccuacagaaaa

SEQ ID NO: 4160046 - RNA, 23 nt, Yersinia pestis
cccuacauaaaaauagcuucccu

SEQ ID NO: 4160047 - RNA, 13 nt, Yersinia pestis
cccuacuggcuga

SEQ ID NO: 4160048 - RNA, 15 nt, Yersinia pestis
cccuagccagccacc

SEQ ID NO: 4160049 - RNA, 22 nt, Yersinia pestis
cccuagccagccaccgcacacu

SEQ ID NO: 4160050 - RNA, 18 nt, Yersinia pestis
cccuaucauucaacacuc

SEQ ID NO: 4160051 - RNA, 19 nt, Yersinia pestis
cccucaauagcuaauaauu

SEQ ID NO: 4160052 - RNA, 14 nt, Yersinia pestis
cccucaaugacgcg

SEQ ID NO: 4160053 - RNA, 15 nt, Yersinia pestis
cccucacaagccacg

SEQ ID NO: 4160054 - RNA, 22 nt, Yersinia pestis
cccucacaagccacgccauuca

SEQ ID NO: 4160055 - RNA, 23 nt, Yersinia pestis
cccucacaagccacgccauucau

SEQ ID NO: 4160056 - RNA, 12 nt, Yersinia pestis
cccucagccaaa

SEQ ID NO: 4160057 - RNA, 14 nt, Yersinia pestis
cccucagccaaagc

SEQ ID NO: 4160058 - RNA, 16 nt, Yersinia pestis
cccucauuuuacccga

SEQ ID NO: 4160059 - RNA, 22 nt, Yersinia pestis
cccucauuuucgaacuuaacua

SEQ ID NO: 4160060 - RNA, 17 nt, Yersinia pestis
cccuccaauaacuaaca

SEQ ID NO: 4160061 - RNA, 14 nt, Yersinia pestis
cccuccgccagcaa

SEQ ID NO: 4160062 - RNA, 17 nt, Yersinia pestis
cccuccggcgcccuucc

SEQ ID NO: 4160063 - RNA, 20 nt, Yersinia pestis
cccucuguauugauccccaa

SEQ ID NO: 4160064 - RNA, 22 nt, Yersinia pestis
cccucuugcuuaucaccccuuc

SEQ ID NO: 4160065 - RNA, 16 nt, Yersinia pestis
cccugaacucaucagc

SEQ ID NO: 4160066 - RNA, 22 nt, Yersinia pestis
cccugaauuucaauaacaccgu

SEQ ID NO: 4160067 - RNA, 14 nt, Yersinia pestis
cccugacucccuca

SEQ ID NO: 4160068 - RNA, 20 nt, Yersinia pestis
cccugacucccugacucccu

SEQ ID NO: 4160069 - RNA, 21 nt, Yersinia pestis
cccugagguuccacucucugc

SEQ ID NO: 4160070 - RNA, 22 nt, Yersinia pestis
cccugaguuaaguaauaacuca

SEQ ID NO: 4160071 - RNA, 20 nt, Yersinia pestis
cccugaguuaucuguuucaa

SEQ ID NO: 4160072 - RNA, 20 nt, Yersinia pestis
cccugauccacuacuuauuu

SEQ ID NO: 4160073 - RNA, 19 nt, Yersinia pestis
cccugccagaaucagcccc

SEQ ID NO: 4160074 - RNA, 22 nt, Yersinia pestis
cccugccagaaucagccccaag

SEQ ID NO: 4160075 - RNA, 22 nt, Yersinia pestis
cccugcgcauugauaaucucca

SEQ ID NO: 4160076 - RNA, 22 nt, Yersinia pestis
cccugcuccaaagcuuccaaua

SEQ ID NO: 4160077 - RNA, 13 nt, Yersinia pestis
cccugcucuucug

SEQ ID NO: 4160078 - RNA, 15 nt, Yersinia pestis
cccugcuuauacgcu

SEQ ID NO: 4160079 - RNA, 11 nt, Yersinia pestis
cccuguaaccg

SEQ ID NO: 4160080 - RNA, 15 nt, Yersinia pestis
cccuguagaacaccu

SEQ ID NO: 4160081 - RNA, 15 nt, Yersinia pestis
cccuguauaaaaaua

SEQ ID NO: 4160082 - RNA, 12 nt, Yersinia pestis
cccuguccagcc

SEQ ID NO: 4160083 - RNA, 20 nt, Yersinia pestis
cccugucuccuaucugaggu

SEQ ID NO: 4160084 - RNA, 13 nt, Yersinia pestis
cccugugcgccca

SEQ ID NO: 4160085 - RNA, 23 nt, Yersinia pestis
cccuguugcccagcaaggcgggc

SEQ ID NO: 4160086 - RNA, 19 nt, Yersinia pestis
cccuuauccguuaacccaa

SEQ ID NO: 4160087 - RNA, 14 nt, Yersinia pestis
cccuuaucuacugg

SEQ ID NO: 4160088 - RNA, 20 nt, Yersinia pestis
cccuuaugaguacuauuuuu

SEQ ID NO: 4160089 - RNA, 17 nt, Yersinia pestis
cccuucagucaguaggc

SEQ ID NO: 4160090 - RNA, 14 nt, Yersinia pestis
cccuucgagcaccg

SEQ ID NO: 4160091 - RNA, 22 nt, Yersinia pestis
cccuucgggcuugguguugcaa

SEQ ID NO: 4160092 - RNA, 14 nt, Yersinia pestis
cccuugacugacca

SEQ ID NO: 4160093 - RNA, 17 nt, Yersinia pestis
cccuugaguauccaaua

SEQ ID NO: 4160094 - RNA, 20 nt, Yersinia pestis
cccuuggcucucgacaaccu

SEQ ID NO: 4160095 - RNA, 22 nt, Yersinia pestis
cccuuguuuaucggucacuuua

SEQ ID NO: 4160096 - RNA, 17 nt, Yersinia pestis
cccuuguuuaucuucua

SEQ ID NO: 4160097 - RNA, 16 nt, Yersinia pestis
cccuuucgcagcccaa

SEQ ID NO: 4160098 - RNA, 15 nt, Yersinia pestis
cccuuuggguggugg

SEQ ID NO: 4160099 - RNA, 19 nt, Yersinia pestis
cccuuuuccgucagcccaa

SEQ ID NO: 4160100 - RNA, 22 nt, Yersinia pestis
cccuuuuugaaucaagcauuca

SEQ ID NO: 4160101 - RNA, 19 nt, Yersinia pestis
cccuuuuugguuuucuauu

SEQ ID NO: 4160102 - RNA, 22 nt, Yersinia pestis
ccgaaagcgccugugggcggcu

SEQ ID NO: 4160103 - RNA, 19 nt, Yersinia pestis
ccgaaauaaauauccuccg

SEQ ID NO: 4160104 - RNA, 18 nt, Yersinia pestis
ccgaaaucucaccacgcc

SEQ ID NO: 4160105 - RNA, 18 nt, Yersinia pestis
ccgaaauggaaaggcggg

SEQ ID NO: 4160106 - RNA, 17 nt, Yersinia pestis
ccgaagcucaagcuggc

SEQ ID NO: 4160107 - RNA, 17 nt, Yersinia pestis
ccgaagcucaagcuggu

SEQ ID NO: 4160108 - RNA, 21 nt, Yersinia pestis
ccgaauaaaaccuugcgccaa

SEQ ID NO: 4160109 - RNA, 21 nt, Yersinia pestis
ccgaauaauaaauauccuccg

SEQ ID NO: 4160110 - RNA, 21 nt, Yersinia pestis
ccgaaucacuuaccugaguaa

SEQ ID NO: 4160111 - RNA, 17 nt, Yersinia pestis
ccgaauuaauaaaaccu

SEQ ID NO: 4160112 - RNA, 23 nt, Yersinia pestis
ccgacaagauugccaccuucacc

SEQ ID NO: 4160113 - RNA, 13 nt, Yersinia pestis
ccgacacccagcc

SEQ ID NO: 4160114 - RNA, 14 nt, Yersinia pestis
ccgacacccagcca

SEQ ID NO: 4160115 - RNA, 14 nt, Yersinia pestis
ccgacccacgcccc

SEQ ID NO: 4160116 - RNA, 19 nt, Yersinia pestis
ccgacuugcccaauggcaa

SEQ ID NO: 4160117 - RNA, 13 nt, Yersinia pestis
ccgagaagcuuca

SEQ ID NO: 4160118 - RNA, 14 nt, Yersinia pestis
ccgagauauuauug

SEQ ID NO: 4160119 - RNA, 11 nt, Yersinia pestis
ccgagaucacc

SEQ ID NO: 4160120 - RNA, 14 nt, Yersinia pestis
ccgagcaaucaaaa

SEQ ID NO: 4160121 - RNA, 16 nt, Yersinia pestis
ccgagcaaucaaaagg

SEQ ID NO: 4160122 - RNA, 16 nt, Yersinia pestis
ccgagcgucaagccaa

SEQ ID NO: 4160123 - RNA, 15 nt, Yersinia pestis
ccgagggcgugcucu

SEQ ID NO: 4160124 - RNA, 18 nt, Yersinia pestis
ccgagguuaucagccucu

SEQ ID NO: 4160125 - RNA, 13 nt, Yersinia pestis
ccgaguguaaaaa

SEQ ID NO: 4160126 - RNA, 19 nt, Yersinia pestis
ccgaguugacuuuuuuuaa

SEQ ID NO: 4160127 - RNA, 22 nt, Yersinia pestis
ccgaguugacuuuuuuuaacca

SEQ ID NO: 4160128 - RNA, 13 nt, Yersinia pestis
ccgauaaaaguac

SEQ ID NO: 4160129 - RNA, 12 nt, Yersinia pestis
ccgauaagcccu

SEQ ID NO: 4160130 - RNA, 16 nt, Yersinia pestis
ccgauaauaauuccau

SEQ ID NO: 4160131 - RNA, 14 nt, Yersinia pestis
ccgauaaucaauuu

SEQ ID NO: 4160132 - RNA, 22 nt, Yersinia pestis
ccgauaauuauaaauuccuggc

SEQ ID NO: 4160133 - RNA, 11 nt, Yersinia pestis
ccgauauaaau

SEQ ID NO: 4160134 - RNA, 14 nt, Yersinia pestis
ccgaucagcuuaau

SEQ ID NO: 4160135 - RNA, 20 nt, Yersinia pestis
ccgaugacgcgaucuugaac

SEQ ID NO: 4160136 - RNA, 20 nt, Yersinia pestis
ccgaugacucgaucuugaac

SEQ ID NO: 4160137 - RNA, 17 nt, Yersinia pestis
ccgaugcgacaauuucc

SEQ ID NO: 4160138 - RNA, 18 nt, Yersinia pestis
ccgauggugccgucaaca

SEQ ID NO: 4160139 - RNA, 21 nt, Yersinia pestis
ccgaugguggcagccugcggc

SEQ ID NO: 4160140 - RNA, 16 nt, Yersinia pestis
ccgauucggauaaccg

SEQ ID NO: 4160141 - RNA, 16 nt, Yersinia pestis
ccgauuuaaacccucu

SEQ ID NO: 4160142 - RNA, 18 nt, Yersinia pestis
ccgauuucagcaccauaa

SEQ ID NO: 4160143 - RNA, 11 nt, Yersinia pestis
ccgcaaaacug

SEQ ID NO: 4160144 - RNA, 16 nt, Yersinia pestis
ccgcaaccugacugcu

SEQ ID NO: 4160145 - RNA, 23 nt, Yersinia pestis
ccgcaaccuguuguggaauuacc

SEQ ID NO: 4160146 - RNA, 17 nt, Yersinia pestis
ccgcaagaauaacuggg

SEQ ID NO: 4160147 - RNA, 21 nt, Yersinia pestis
ccgcaauaaauggcauuuuuu

SEQ ID NO: 4160148 - RNA, 16 nt, Yersinia pestis
ccgcaauaucaaugaa

SEQ ID NO: 4160149 - RNA, 15 nt, Yersinia pestis
ccgcacacugacagc

SEQ ID NO: 4160150 - RNA, 19 nt, Yersinia pestis
ccgcaccaacucuucuuua

SEQ ID NO: 4160151 - RNA, 18 nt, Yersinia pestis
ccgcacgaaccguggcgc

SEQ ID NO: 4160152 - RNA, 19 nt, Yersinia pestis
ccgcagcagacaacugaca

SEQ ID NO: 4160153 - RNA, 18 nt, Yersinia pestis
ccgcagcaggcagagcaa

SEQ ID NO: 4160154 - RNA, 22 nt, Yersinia pestis
ccgcagcggcuagcagcagguu

SEQ ID NO: 4160155 - RNA, 17 nt, Yersinia pestis
ccgcaggaagcaaugaa

SEQ ID NO: 4160156 - RNA, 24 nt, Yersinia pestis
ccgcaggccaugucgaucauggca

SEQ ID NO: 4160157 - RNA, 11 nt, Yersinia pestis
ccgcaguccaa

SEQ ID NO: 4160158 - RNA, 21 nt, Yersinia pestis
ccgcaucauuguuuacuauuu

SEQ ID NO: 4160159 - RNA, 14 nt, Yersinia pestis
ccgcaucuaaaccg

SEQ ID NO: 4160160 - RNA, 16 nt, Yersinia pestis
ccgcaugcaacagaua

SEQ ID NO: 4160161 - RNA, 13 nt, Yersinia pestis
ccgcauuccagcg

SEQ ID NO: 4160162 - RNA, 17 nt, Yersinia pestis
ccgccaaauccaagcca

SEQ ID NO: 4160163 - RNA, 19 nt, Yersinia pestis
ccgccacuuuaacugcacc

SEQ ID NO: 4160164 - RNA, 15 nt, Yersinia pestis
ccgccagcagaacca

SEQ ID NO: 4160165 - RNA, 20 nt, Yersinia pestis
ccgccagccuugugcuucau

SEQ ID NO: 4160166 - RNA, 19 nt, Yersinia pestis
ccgccagguuuacuggcgg

SEQ ID NO: 4160167 - RNA, 23 nt, Yersinia pestis
ccgccagguuuacuggcgggcau

SEQ ID NO: 4160168 - RNA, 17 nt, Yersinia pestis
ccgccaguaaaccuggc

SEQ ID NO: 4160169 - RNA, 16 nt, Yersinia pestis
ccgccaguaacuggcc

SEQ ID NO: 4160170 - RNA, 22 nt, Yersinia pestis
ccgccagugccaccguaaaaaa

SEQ ID NO: 4160171 - RNA, 13 nt, Yersinia pestis
ccgccauugccag

SEQ ID NO: 4160172 - RNA, 21 nt, Yersinia pestis
ccgcccccaauaagggccacc

SEQ ID NO: 4160173 - RNA, 19 nt, Yersinia pestis
ccgccccccaucaacgaca

SEQ ID NO: 4160174 - RNA, 14 nt, Yersinia pestis
ccgccccccauccc

SEQ ID NO: 4160175 - RNA, 12 nt, Yersinia pestis
ccgccccgggca

SEQ ID NO: 4160176 - RNA, 13 nt, Yersinia pestis
ccgcccguagaaa

SEQ ID NO: 4160177 - RNA, 15 nt, Yersinia pestis
ccgccgccagccccg

SEQ ID NO: 4160178 - RNA, 19 nt, Yersinia pestis
ccgccggauuucaauccga

SEQ ID NO: 4160179 - RNA, 15 nt, Yersinia pestis
ccgccgucaaaccaa

SEQ ID NO: 4160180 - RNA, 18 nt, Yersinia pestis
ccgccuguauccagcagc

SEQ ID NO: 4160181 - RNA, 21 nt, Yersinia pestis
ccgccuguauccagcagcgcu

SEQ ID NO: 4160182 - RNA, 13 nt, Yersinia pestis
ccgcgaaaaacca

SEQ ID NO: 4160183 - RNA, 14 nt, Yersinia pestis
ccgcgagcaauacc

SEQ ID NO: 4160184 - RNA, 13 nt, Yersinia pestis
ccgcgauaaaaaa

SEQ ID NO: 4160185 - RNA, 23 nt, Yersinia pestis
ccgcgauaaaaaauaaaguccag

SEQ ID NO: 4160186 - RNA, 17 nt, Yersinia pestis
ccgcgaucaacaagaau

SEQ ID NO: 4160187 - RNA, 23 nt, Yersinia pestis
ccgcgaugccaucgcuuuggcuu

SEQ ID NO: 4160188 - RNA, 21 nt, Yersinia pestis
ccgcgccaaggauggcgcggc

SEQ ID NO: 4160189 - RNA, 18 nt, Yersinia pestis
ccgcgccauccuugccuu

SEQ ID NO: 4160190 - RNA, 16 nt, Yersinia pestis
ccgcgccgacuguucg

SEQ ID NO: 4160191 - RNA, 17 nt, Yersinia pestis
ccgcgguuaagcuagcc

SEQ ID NO: 4160192 - RNA, 23 nt, Yersinia pestis
ccgcguugucagccaugccugcg

SEQ ID NO: 4160193 - RNA, 16 nt, Yersinia pestis
ccgcuaaaucaucaaa

SEQ ID NO: 4160194 - RNA, 20 nt, Yersinia pestis
ccgcuaacaaccgugcacca

SEQ ID NO: 4160195 - RNA, 13 nt, Yersinia pestis
ccgcuaaccuuaa

SEQ ID NO: 4160196 - RNA, 17 nt, Yersinia pestis
ccgcuaaggccaaugga

SEQ ID NO: 4160197 - RNA, 11 nt, Yersinia pestis
ccgcuaccaua

SEQ ID NO: 4160198 - RNA, 15 nt, Yersinia pestis
ccgcuagugagugaa

SEQ ID NO: 4160199 - RNA, 20 nt, Yersinia pestis
ccgcuaucacuagcgggccu

SEQ ID NO: 4160200 - RNA, 14 nt, Yersinia pestis
ccgcuaucugcuga

SEQ ID NO: 4160201 - RNA, 12 nt, Yersinia pestis
ccgcuauuuucu

SEQ ID NO: 4160202 - RNA, 14 nt, Yersinia pestis
ccgcucaacuuugc

SEQ ID NO: 4160203 - RNA, 11 nt, Yersinia pestis
ccgcuccagca

SEQ ID NO: 4160204 - RNA, 14 nt, Yersinia pestis
ccgcucggcccgcc

SEQ ID NO: 4160205 - RNA, 21 nt, Yersinia pestis
ccgcugacggcgguauacaga

SEQ ID NO: 4160206 - RNA, 14 nt, Yersinia pestis
ccgcugcaacuccu

SEQ ID NO: 4160207 - RNA, 14 nt, Yersinia pestis
ccgcugcgauacca

SEQ ID NO: 4160208 - RNA, 18 nt, Yersinia pestis
ccgcuggugcggaacagc

SEQ ID NO: 4160209 - RNA, 20 nt, Yersinia pestis
ccgcuguagcgccaaugaca

SEQ ID NO: 4160210 - RNA, 17 nt, Yersinia pestis
ccgcuguaggugucacc

SEQ ID NO: 4160211 - RNA, 18 nt, Yersinia pestis
ccgcuguaggugucacca

SEQ ID NO: 4160212 - RNA, 14 nt, Yersinia pestis
ccgcugucauucca

SEQ ID NO: 4160213 - RNA, 23 nt, Yersinia pestis
ccgcugucauuccaaccuuguaa

SEQ ID NO: 4160214 - RNA, 13 nt, Yersinia pestis
ccgcugugauuaa

SEQ ID NO: 4160215 - RNA, 17 nt, Yersinia pestis
ccgcuuccaucacaaau

SEQ ID NO: 4160216 - RNA, 19 nt, Yersinia pestis
ccgcuucgcgcccgcccca

SEQ ID NO: 4160217 - RNA, 20 nt, Yersinia pestis
ccgcuucguccagaugccaa

SEQ ID NO: 4160218 - RNA, 17 nt, Yersinia pestis
ccgcuugcauacgcuua

SEQ ID NO: 4160219 - RNA, 14 nt, Yersinia pestis
ccgcuugggcgaua

SEQ ID NO: 4160220 - RNA, 12 nt, Yersinia pestis
ccgcuuggguaa

SEQ ID NO: 4160221 - RNA, 14 nt, Yersinia pestis
ccgcuuuagcugua

SEQ ID NO: 4160222 - RNA, 15 nt, Yersinia pestis
ccgcuuugcguaaua

SEQ ID NO: 4160223 - RNA, 15 nt, Yersinia pestis
ccgcuuuuuagcgau

SEQ ID NO: 4160224 - RNA, 19 nt, Yersinia pestis
ccggaauaaagcucucgcg

SEQ ID NO: 4160225 - RNA, 17 nt, Yersinia pestis
ccggaaugaguugcccu

SEQ ID NO: 4160226 - RNA, 21 nt, Yersinia pestis
ccggacauaaugcauccacuu

SEQ ID NO: 4160227 - RNA, 17 nt, Yersinia pestis
ccggagaacuugaacua

SEQ ID NO: 4160228 - RNA, 16 nt, Yersinia pestis
ccggagcaagggcgca

SEQ ID NO: 4160229 - RNA, 23 nt, Yersinia pestis
ccggagcaagggcgcauccccau

SEQ ID NO: 4160230 - RNA, 20 nt, Yersinia pestis
ccggaggauauuuauuauuc

SEQ ID NO: 4160231 - RNA, 21 nt, Yersinia pestis
ccggaggauauuuauuuaauu

SEQ ID NO: 4160232 - RNA, 21 nt, Yersinia pestis
ccggaggauauuuauuuacuc

SEQ ID NO: 4160233 - RNA, 15 nt, Yersinia pestis
ccggagguuuuucau

SEQ ID NO: 4160234 - RNA, 19 nt, Yersinia pestis
ccggagugaugaaaccaaa

SEQ ID NO: 4160235 - RNA, 17 nt, Yersinia pestis
ccggauggucacccuuu

SEQ ID NO: 4160236 - RNA, 18 nt, Yersinia pestis
ccggcaacacgaugccag

SEQ ID NO: 4160237 - RNA, 20 nt, Yersinia pestis
ccggcaaucgcuuccaggac

SEQ ID NO: 4160238 - RNA, 20 nt, Yersinia pestis
ccggcacaggcgcuggcaac

SEQ ID NO: 4160239 - RNA, 18 nt, Yersinia pestis
ccggcaucaaccaagaca

SEQ ID NO: 4160240 - RNA, 20 nt, Yersinia pestis
ccggcgaagggcgcagcccc

SEQ ID NO: 4160241 - RNA, 16 nt, Yersinia pestis
ccggcgguuaucacau

SEQ ID NO: 4160242 - RNA, 17 nt, Yersinia pestis
ccggcuaacgaggcaua

SEQ ID NO: 4160243 - RNA, 19 nt, Yersinia pestis
ccggcuaugccggaggaua

SEQ ID NO: 4160244 - RNA, 12 nt, Yersinia pestis
ccggcucgccca

SEQ ID NO: 4160245 - RNA, 19 nt, Yersinia pestis
ccggcugcaauaagccaga

SEQ ID NO: 4160246 - RNA, 19 nt, Yersinia pestis
ccgggcaaacgccagugca

SEQ ID NO: 4160247 - RNA, 15 nt, Yersinia pestis
ccgggcgaacagaaa

SEQ ID NO: 4160248 - RNA, 22 nt, Yersinia pestis
ccggggagcggauaaagcgcug

SEQ ID NO: 4160249 - RNA, 21 nt, Yersinia pestis
ccgggggcguauuaucggauc

SEQ ID NO: 4160250 - RNA, 14 nt, Yersinia pestis
ccgggugcagcgcc

SEQ ID NO: 4160251 - RNA, 22 nt, Yersinia pestis
ccggucauacauuggcuccccu

SEQ ID NO: 4160252 - RNA, 12 nt, Yersinia pestis
ccggucaugguu

SEQ ID NO: 4160253 - RNA, 12 nt, Yersinia pestis
ccggucugcugg

SEQ ID NO: 4160254 - RNA, 14 nt, Yersinia pestis
ccgguguaccgacc

SEQ ID NO: 4160255 - RNA, 20 nt, Yersinia pestis
ccgguucauuuagcagcgca

SEQ ID NO: 4160256 - RNA, 17 nt, Yersinia pestis
ccgguucggauucuguu

SEQ ID NO: 4160257 - RNA, 17 nt, Yersinia pestis
ccgguugauaucggcaa

SEQ ID NO: 4160258 - RNA, 18 nt, Yersinia pestis
caccacugauaggucaua

SEQ ID NO: 4160259 - RNA, 15 nt, Yersinia pestis
caccacugucagggc

SEQ ID NO: 4160260 - RNA, 15 nt, Yersinia pestis
caccacuuugcugug

SEQ ID NO: 4160261 - RNA, 22 nt, Yersinia pestis
caccagacucugcuaccaggaa

SEQ ID NO: 4160262 - RNA, 23 nt, Yersinia pestis
caccagagaugauagcaauguca

SEQ ID NO: 4160263 - RNA, 20 nt, Yersinia pestis
caccagauuuaauugugcuu

SEQ ID NO: 4160264 - RNA, 15 nt, Yersinia pestis
caccagcagcgccca

SEQ ID NO: 4160265 - RNA, 20 nt, Yersinia pestis
caccagcaggugauacauca

SEQ ID NO: 4160266 - RNA, 15 nt, Yersinia pestis
caccagcgcacugaa

SEQ ID NO: 4160267 - RNA, 15 nt, Yersinia pestis
caccagcgccaugau

SEQ ID NO: 4160268 - RNA, 18 nt, Yersinia pestis
caccagcguggcauugag

SEQ ID NO: 4160269 - RNA, 17 nt, Yersinia pestis
caccaguaaacgccaau

SEQ ID NO: 4160270 - RNA, 15 nt, Yersinia pestis
caccaguagcccagc

SEQ ID NO: 4160271 - RNA, 16 nt, Yersinia pestis
caccaguagcccagcc

SEQ ID NO: 4160272 - RNA, 23 nt, Yersinia pestis
caccagugccaauccccaccaaa

SEQ ID NO: 4160273 - RNA, 14 nt, Yersinia pestis
caccagugggaucc

SEQ ID NO: 4160274 - RNA, 21 nt, Yersinia pestis
caccauaaaaacuucagagcc

SEQ ID NO: 4160275 - RNA, 14 nt, Yersinia pestis
caccaucaacaugg

SEQ ID NO: 4160276 - RNA, 15 nt, Yersinia pestis
caccaucacuuccag

SEQ ID NO: 4160277 - RNA, 18 nt, Yersinia pestis
caccauccagcaaaucau

SEQ ID NO: 4160278 - RNA, 21 nt, Yersinia pestis
caccauccggguuuaucccau

SEQ ID NO: 4160279 - RNA, 16 nt, Yersinia pestis
caccaugaugaaucug

SEQ ID NO: 4160280 - RNA, 17 nt, Yersinia pestis
caccaugaugaaucugu

SEQ ID NO: 4160281 - RNA, 20 nt, Yersinia pestis
caccaugccuucugaaaccc

SEQ ID NO: 4160282 - RNA, 14 nt, Yersinia pestis
caccauguccaugu

SEQ ID NO: 4160283 - RNA, 15 nt, Yersinia pestis
caccauuaacaagcg

SEQ ID NO: 4160284 - RNA, 21 nt, Yersinia pestis
caccauuggcgaucgcgccaa

SEQ ID NO: 4160285 - RNA, 14 nt, Yersinia pestis
caccauuuccaggc

SEQ ID NO: 4160286 - RNA, 15 nt, Yersinia pestis
caccauuuccaggcu

SEQ ID NO: 4160287 - RNA, 14 nt, Yersinia pestis
caccauuugcccug

SEQ ID NO: 4160288 - RNA, 15 nt, Yersinia pestis
cacccaaacugucug

SEQ ID NO: 4160289 - RNA, 13 nt, Yersinia pestis
cacccaacaauga

SEQ ID NO: 4160290 - RNA, 15 nt, Yersinia pestis
cacccaauaauaaaa

SEQ ID NO: 4160291 - RNA, 21 nt, Yersinia pestis
cacccaauaauaaaaaaaaau

SEQ ID NO: 4160292 - RNA, 21 nt, Yersinia pestis
cacccaccaagggucaucaac

SEQ ID NO: 4160293 - RNA, 17 nt, Yersinia pestis
cacccacgguaucugcu

SEQ ID NO: 4160294 - RNA, 12 nt, Yersinia pestis
cacccagcaaaa

SEQ ID NO: 4160295 - RNA, 16 nt, Yersinia pestis
cacccauagcucagcu

SEQ ID NO: 4160296 - RNA, 17 nt, Yersinia pestis
cacccauagcucagcug

SEQ ID NO: 4160297 - RNA, 20 nt, Yersinia pestis
cacccauggagauugccuca

SEQ ID NO: 4160298 - RNA, 12 nt, Yersinia pestis
cacccauguauc

SEQ ID NO: 4160299 - RNA, 22 nt, Yersinia pestis
cacccauugcucaaacucagca

SEQ ID NO: 4160300 - RNA, 20 nt, Yersinia pestis
cacccauuuuauccucuucc

SEQ ID NO: 4160301 - RNA, 21 nt, Yersinia pestis
cacccauuuuauccucuucca

SEQ ID NO: 4160302 - RNA, 23 nt, Yersinia pestis
caccccagucacuuacugaucaa

SEQ ID NO: 4160303 - RNA, 15 nt, Yersinia pestis
caccccuauuaggga

SEQ ID NO: 4160304 - RNA, 14 nt, Yersinia pestis
cacccgcacgccca

SEQ ID NO: 4160305 - RNA, 11 nt, Yersinia pestis
cacccgccauc

SEQ ID NO: 4160306 - RNA, 19 nt, Yersinia pestis
cacccgcuaauucaccaau

SEQ ID NO: 4160307 - RNA, 22 nt, Yersinia pestis
cacccgcuucauucgcauaggg

SEQ ID NO: 4160308 - RNA, 18 nt, Yersinia pestis
cacccggcauaaagguuu

SEQ ID NO: 4160309 - RNA, 13 nt, Yersinia pestis
cacccggccaucu

SEQ ID NO: 4160310 - RNA, 20 nt, Yersinia pestis
cacccuaaugaacgaguaaa

SEQ ID NO: 4160311 - RNA, 17 nt, Yersinia pestis
cacccucaagagcgaua

SEQ ID NO: 4160312 - RNA, 22 nt, Yersinia pestis
cacccucaagagcgauaaccgc

SEQ ID NO: 4160313 - RNA, 19 nt, Yersinia pestis
cacccucugcagcuugcaa

SEQ ID NO: 4160314 - RNA, 13 nt, Yersinia pestis
cacccuuacccug

SEQ ID NO: 4160315 - RNA, 22 nt, Yersinia pestis
cacccuuuaaaucuagcccuuc

SEQ ID NO: 4160316 - RNA, 21 nt, Yersinia pestis
cacccuuuacgcauugguaua

SEQ ID NO: 4160317 - RNA, 20 nt, Yersinia pestis
cacccuuuugaauucaccaa

SEQ ID NO: 4160318 - RNA, 16 nt, Yersinia pestis
caccgacaccacgauc

SEQ ID NO: 4160319 - RNA, 20 nt, Yersinia pestis
caccgagcaugcuaacuugu

SEQ ID NO: 4160320 - RNA, 12 nt, Yersinia pestis
caccgagccacu

SEQ ID NO: 4160321 - RNA, 17 nt, Yersinia pestis
caccgagccacuuuaau

SEQ ID NO: 4160322 - RNA, 20 nt, Yersinia pestis
caccgaggcgggucagaaac

SEQ ID NO: 4160323 - RNA, 17 nt, Yersinia pestis
caccgagguuaucagcc

SEQ ID NO: 4160324 - RNA, 21 nt, Yersinia pestis
caccgaguaaacguggcccuu

SEQ ID NO: 4160325 - RNA, 12 nt, Yersinia pestis
caccgcauucca

SEQ ID NO: 4160326 - RNA, 15 nt, Yersinia pestis
caccgcgucgccgcu

SEQ ID NO: 4160327 - RNA, 21 nt, Yersinia pestis
caccgcuaaccuuaaccaaca

SEQ ID NO: 4160328 - RNA, 20 nt, Yersinia pestis
caccgcuguggaaucggccu

SEQ ID NO: 4160329 - RNA, 23 nt, Yersinia pestis
caccgcuuagcaauaccagccga

SEQ ID NO: 4160330 - RNA, 17 nt, Yersinia pestis
caccggcccaacuggcg

SEQ ID NO: 4160331 - RNA, 23 nt, Yersinia pestis
caccggcgagaaggauugaccaa

SEQ ID NO: 4160332 - RNA, 16 nt, Yersinia pestis
caccggggauccauag

SEQ ID NO: 4160333 - RNA, 18 nt, Yersinia pestis
caccgguuuacccugcgc

SEQ ID NO: 4160334 - RNA, 16 nt, Yersinia pestis
caccguaucaucacca

SEQ ID NO: 4160335 - RNA, 18 nt, Yersinia pestis
caccguggcgcgccacuu

SEQ ID NO: 4160336 - RNA, 13 nt, Yersinia pestis
caccguuacucag

SEQ ID NO: 4160337 - RNA, 23 nt, Yersinia pestis
caccguuuccagaaucaauggga

SEQ ID NO: 4160338 - RNA, 16 nt, Yersinia pestis
caccuaaaaugacgau

SEQ ID NO: 4160339 - RNA, 15 nt, Yersinia pestis
caccuaacaugcuga

SEQ ID NO: 4160340 - RNA, 15 nt, Yersinia pestis
caccuaaccaaacau

SEQ ID NO: 4160341 - RNA, 16 nt, Yersinia pestis
caccuaaccaaacauu

SEQ ID NO: 4160342 - RNA, 19 nt, Yersinia pestis
caccuaaccaaacauuguu

SEQ ID NO: 4160343 - RNA, 17 nt, Yersinia pestis
caccuaauacagcacca

SEQ ID NO: 4160344 - RNA, 11 nt, Yersinia pestis
caccuaccacc

SEQ ID NO: 4160345 - RNA, 20 nt, Yersinia pestis
caccuaccgguguugagguc

SEQ ID NO: 4160346 - RNA, 14 nt, Yersinia pestis
caccuauaauuaac

SEQ ID NO: 4160347 - RNA, 13 nt, Yersinia pestis
caccuaucgccgc

SEQ ID NO: 4160348 - RNA, 21 nt, Yersinia pestis
caccuaucgccgccgccagcc

SEQ ID NO: 4160349 - RNA, 14 nt, Yersinia pestis
caccucaaccugcc

SEQ ID NO: 4160350 - RNA, 16 nt, Yersinia pestis
caccucuugcauacuc

SEQ ID NO: 4160351 - RNA, 13 nt, Yersinia pestis
caccugaaccuga

SEQ ID NO: 4160352 - RNA, 16 nt, Yersinia pestis
caccugagugcggcca

SEQ ID NO: 4160353 - RNA, 21 nt, Yersinia pestis
caccugauaagccgucagcuu

SEQ ID NO: 4160354 - RNA, 20 nt, Yersinia pestis
caccugaucgugccauuaca

SEQ ID NO: 4160355 - RNA, 15 nt, Yersinia pestis
caccugaugagaggg

SEQ ID NO: 4160356 - RNA, 21 nt, Yersinia pestis
caccugcgagggucgcgcccu

SEQ ID NO: 4160357 - RNA, 20 nt, Yersinia pestis
caccugcuaucaugauaaau

SEQ ID NO: 4160358 - RNA, 20 nt, Yersinia pestis
caccugcuuaguuacaauaa

SEQ ID NO: 4160359 - RNA, 16 nt, Yersinia pestis
caccugucaccuguca

SEQ ID NO: 4160360 - RNA, 13 nt, Yersinia pestis
caccuucaaccac

SEQ ID NO: 4160361 - RNA, 13 nt, Yersinia pestis
caccuuccaaacu

SEQ ID NO: 4160362 - RNA, 23 nt, Yersinia pestis
caccuugauuaauaacaguaaua

SEQ ID NO: 4160363 - RNA, 19 nt, Yersinia pestis
caccuuggaaaacagcaac

SEQ ID NO: 4160364 - RNA, 22 nt, Yersinia pestis
caccuuuaccuuuacggccgcu

SEQ ID NO: 4160365 - RNA, 22 nt, Yersinia pestis
cacgaaccugagcgaucaauac

SEQ ID NO: 4160366 - RNA, 18 nt, Yersinia pestis
cacgaauacgauccgcua

SEQ ID NO: 4160367 - RNA, 17 nt, Yersinia pestis
cacgaauuuugaggaua

SEQ ID NO: 4160368 - RNA, 21 nt, Yersinia pestis
cacgacaacaaagccgcugcu

SEQ ID NO: 4160369 - RNA, 16 nt, Yersinia pestis
cacgacaugagcaugc

SEQ ID NO: 4160370 - RNA, 20 nt, Yersinia pestis
cacgacaugagcaugccuga

SEQ ID NO: 4160371 - RNA, 22 nt, Yersinia pestis
cacgacaugagcaugccugagc

SEQ ID NO: 4160372 - RNA, 18 nt, Yersinia pestis
cacgacgcagcuccagcg

SEQ ID NO: 4160373 - RNA, 14 nt, Yersinia pestis
cacgacgcgcuuga

SEQ ID NO: 4160374 - RNA, 16 nt, Yersinia pestis
cacgacuuuuggcccc

SEQ ID NO: 4160375 - RNA, 14 nt, Yersinia pestis
cacgaguaaugaua

SEQ ID NO: 4160376 - RNA, 18 nt, Yersinia pestis
cacgaguugguaaaauau

SEQ ID NO: 4160377 - RNA, 22 nt, Yersinia pestis
cacgauaaauucgauaaaaggc

SEQ ID NO: 4160378 - RNA, 14 nt, Yersinia pestis
cacgauaccaccac

SEQ ID NO: 4160379 - RNA, 16 nt, Yersinia pestis
cacgauaccaccacca

SEQ ID NO: 4160380 - RNA, 17 nt, Yersinia pestis
cacgauaccaccaccaa

SEQ ID NO: 4160381 - RNA, 17 nt, Yersinia pestis
cacgauacgacuucuua

SEQ ID NO: 4160382 - RNA, 14 nt, Yersinia pestis
cacgauagccagug

SEQ ID NO: 4160383 - RNA, 21 nt, Yersinia pestis
cacgaucagugaagagauaac

SEQ ID NO: 4160384 - RNA, 13 nt, Yersinia pestis
cacgauccgcuuu

SEQ ID NO: 4160385 - RNA, 16 nt, Yersinia pestis
cacgaucgaugugaua

SEQ ID NO: 4160386 - RNA, 15 nt, Yersinia pestis
cacgaucuggcaaaa

SEQ ID NO: 4160387 - RNA, 23 nt, Yersinia pestis
cacgaucuggcaaaaucccagca

SEQ ID NO: 4160388 - RNA, 12 nt, Yersinia pestis
cacgaugccagu

SEQ ID NO: 4160389 - RNA, 16 nt, Yersinia pestis
cacgauuuaaugguuu

SEQ ID NO: 4160390 - RNA, 15 nt, Yersinia pestis
cacgauuugaucacg

SEQ ID NO: 4160391 - RNA, 12 nt, Yersinia pestis
cacgcaaauaaa

SEQ ID NO: 4160392 - RNA, 21 nt, Yersinia pestis
cacgcaaauaaagggccugca

SEQ ID NO: 4160393 - RNA, 13 nt, Yersinia pestis
cacgcaaggccag

SEQ ID NO: 4160394 - RNA, 17 nt, Yersinia pestis
cacgcaaucagaugguc

SEQ ID NO: 4160395 - RNA, 15 nt, Yersinia pestis
cacgcagagaugaau

SEQ ID NO: 4160396 - RNA, 15 nt, Yersinia pestis
cacgcagcuuuuucu

SEQ ID NO: 4160397 - RNA, 18 nt, Yersinia pestis
cacgccaguaaacagcca

SEQ ID NO: 4160398 - RNA, 14 nt, Yersinia pestis
cacgccaguguuca

SEQ ID NO: 4160399 - RNA, 12 nt, Yersinia pestis
cacgcccaacuc

SEQ ID NO: 4160400 - RNA, 23 nt, Yersinia pestis
cacgccccaacgguaacccgaua

SEQ ID NO: 4160401 - RNA, 21 nt, Yersinia pestis
cacgcccggcuaaacgcucaa

SEQ ID NO: 4160402 - RNA, 15 nt, Yersinia pestis
cacgccgaacucguc

SEQ ID NO: 4160403 - RNA, 22 nt, Yersinia pestis
cacgccggcuuuuuucucuaca

SEQ ID NO: 4160404 - RNA, 21 nt, Yersinia pestis
cacgccgucuggcuaauacug

SEQ ID NO: 4160405 - RNA, 13 nt, Yersinia pestis
cacgcuaauuauu

SEQ ID NO: 4160406 - RNA, 16 nt, Yersinia pestis
cacgcuccacacaaaa

SEQ ID NO: 4160407 - RNA, 22 nt, Yersinia pestis
cacgcuccacacccgccaaacc

SEQ ID NO: 4160408 - RNA, 21 nt, Yersinia pestis
cacgcucgcccaugaccacuu

SEQ ID NO: 4160409 - RNA, 19 nt, Yersinia pestis
cacgcugggcgaucauuuu

SEQ ID NO: 4160410 - RNA, 23 nt, Yersinia pestis
cacgcugggcgaucauuuucugu

SEQ ID NO: 4160411 - RNA, 19 nt, Yersinia pestis
cacgcuuuaagcuaauucu

SEQ ID NO: 4160412 - RNA, 17 nt, Yersinia pestis
cacggaaaguagccauu

SEQ ID NO: 4160413 - RNA, 13 nt, Yersinia pestis
cacggauaucaac

SEQ ID NO: 4160414 - RNA, 19 nt, Yersinia pestis
cacggauauccaacgguag

SEQ ID NO: 4160415 - RNA, 18 nt, Yersinia pestis
cacggaucucauucagac

SEQ ID NO: 4160416 - RNA, 15 nt, Yersinia pestis
cacggaugaucggca

SEQ ID NO: 4160417 - RNA, 20 nt, Yersinia pestis
cacggauuaacuuuucuuca

SEQ ID NO: 4160418 - RNA, 17 nt, Yersinia pestis
cacggccauuucuuaga

SEQ ID NO: 4160419 - RNA, 18 nt, Yersinia pestis
cacggccgggugcagcgc

SEQ ID NO: 4160420 - RNA, 21 nt, Yersinia pestis
cacggcgaguaggucucgccg

SEQ ID NO: 4160421 - RNA, 15 nt, Yersinia pestis
cacgggaucaacaug

SEQ ID NO: 4160422 - RNA, 20 nt, Yersinia pestis
cacgggcgguaaucugcggc

SEQ ID NO: 4160423 - RNA, 13 nt, Yersinia pestis
cacggggaaacag

SEQ ID NO: 4160424 - RNA, 22 nt, Yersinia pestis
cacggguuuuaucaacgaagaa

SEQ ID NO: 4160425 - RNA, 17 nt, Yersinia pestis
cacgguaguaauaauuu

SEQ ID NO: 4160426 - RNA, 13 nt, Yersinia pestis
cacgguaucugcu

SEQ ID NO: 4160427 - RNA, 14 nt, Yersinia pestis
cacgguaucugcuu

SEQ ID NO: 4160428 - RNA, 17 nt, Yersinia pestis
cacgguauugcucucga

SEQ ID NO: 4160429 - RNA, 13 nt, Yersinia pestis
cacgguucacccc

SEQ ID NO: 4160430 - RNA, 16 nt, Yersinia pestis
cacgguucauuuuuag

SEQ ID NO: 4160431 - RNA, 17 nt, Yersinia pestis
cacgguuucuaaaaaau

SEQ ID NO: 4160432 - RNA, 20 nt, Yersinia pestis
cacgguuugaucaacauggg

SEQ ID NO: 4160433 - RNA, 20 nt, Yersinia pestis
cacguaaacaaugaccaucu

SEQ ID NO: 4160434 - RNA, 16 nt, Yersinia pestis
cacguaauaccuuaaa

SEQ ID NO: 4160435 - RNA, 16 nt, Yersinia pestis
cacgucaucgaagagu

SEQ ID NO: 4160436 - RNA, 16 nt, Yersinia pestis
cacgucgauaguccuu

SEQ ID NO: 4160437 - RNA, 21 nt, Yersinia pestis
cacgucuacgcucuccucucc

SEQ ID NO: 4160438 - RNA, 15 nt, Yersinia pestis
cacgucuacuggcug

SEQ ID NO: 4160439 - RNA, 17 nt, Yersinia pestis
cacgugcuuacuggccu

SEQ ID NO: 4160440 - RNA, 18 nt, Yersinia pestis
cacgugcuuacuggccug

SEQ ID NO: 4160441 - RNA, 17 nt, Yersinia pestis
cacguggguauccagug

SEQ ID NO: 4160442 - RNA, 18 nt, Yersinia pestis
cacguucaccaaagcaau

SEQ ID NO: 4160443 - RNA, 14 nt, Yersinia pestis
cacguucccccgcc

SEQ ID NO: 4160444 - RNA, 22 nt, Yersinia pestis
cacguucggcgucgccacccca

SEQ ID NO: 4160445 - RNA, 21 nt, Yersinia pestis
cacguugagugaucaccugag

SEQ ID NO: 4160446 - RNA, 18 nt, Yersinia pestis
cacguugucaaaaaccca

SEQ ID NO: 4160447 - RNA, 12 nt, Yersinia pestis
cacguuuaaaca

SEQ ID NO: 4160448 - RNA, 13 nt, Yersinia pestis
cacguuuccaaaa

SEQ ID NO: 4160449 - RNA, 12 nt, Yersinia pestis
cacguuuuauau

SEQ ID NO: 4160450 - RNA, 19 nt, Yersinia pestis
cacuaaccccugcauugag

SEQ ID NO: 4160451 - RNA, 17 nt, Yersinia pestis
cacuaacgcugaggcga

SEQ ID NO: 4160452 - RNA, 20 nt, Yersinia pestis
cacuaagauucaaacaguaa

SEQ ID NO: 4160453 - RNA, 12 nt, Yersinia pestis
cacuaauaauaa

SEQ ID NO: 4160454 - RNA, 15 nt, Yersinia pestis
cacuaauaauaauua

SEQ ID NO: 4160455 - RNA, 20 nt, Yersinia pestis
cacuaauacucuguuaccaa

SEQ ID NO: 4160456 - RNA, 14 nt, Yersinia pestis
cacuaauagcauuu

SEQ ID NO: 4160457 - RNA, 17 nt, Yersinia pestis
cacuaauuagugacagu

SEQ ID NO: 4160458 - RNA, 15 nt, Yersinia pestis
cacuacauucugaua

SEQ ID NO: 4160459 - RNA, 18 nt, Yersinia pestis
cacuacgaccccaacggc

SEQ ID NO: 4160460 - RNA, 21 nt, Yersinia pestis
cacuacgggucguuaguccgc

SEQ ID NO: 4160461 - RNA, 14 nt, Yersinia pestis
cacuacucaguugc

SEQ ID NO: 4160462 - RNA, 23 nt, Yersinia pestis
cacuagagcguuacacaucaggc

SEQ ID NO: 4160463 - RNA, 13 nt, Yersinia pestis
cacuagcgggccu

SEQ ID NO: 4160464 - RNA, 13 nt, Yersinia pestis
cacuauaggcuau

SEQ ID NO: 4160465 - RNA, 20 nt, Yersinia pestis
cacuauaggcuauuuuacuu

SEQ ID NO: 4160466 - RNA, 19 nt, Yersinia pestis
cacuauccccaauucacgc

SEQ ID NO: 4160467 - RNA, 14 nt, Yersinia pestis
cacuaugggggauu

SEQ ID NO: 4160468 - RNA, 18 nt, Yersinia pestis
cacuauucuccaacaacu

SEQ ID NO: 4160469 - RNA, 12 nt, Yersinia pestis
cacuauuucaga

SEQ ID NO: 4160470 - RNA, 14 nt, Yersinia pestis
cacuauuucagaca

SEQ ID NO: 4160471 - RNA, 14 nt, Yersinia pestis
cacuauuucaggca

SEQ ID NO: 4160472 - RNA, 17 nt, Yersinia pestis
cacuauuucguguauau

SEQ ID NO: 4160473 - RNA, 12 nt, Yersinia pestis
cacucaagccag

SEQ ID NO: 4160474 - RNA, 22 nt, Yersinia pestis
cacucaagccaguaacuacuau

SEQ ID NO: 4160475 - RNA, 13 nt, Yersinia pestis
cacucaaugucau

SEQ ID NO: 4160476 - RNA, 15 nt, Yersinia pestis
cacucaauuggacua

SEQ ID NO: 4160477 - RNA, 16 nt, Yersinia pestis
cacucacaacccgcug

SEQ ID NO: 4160478 - RNA, 14 nt, Yersinia pestis
cacucaccuaaauc

SEQ ID NO: 4160479 - RNA, 14 nt, Yersinia pestis
cacucagcgcuggc

SEQ ID NO: 4160480 - RNA, 16 nt, Yersinia pestis
cacucauaauuuugau

SEQ ID NO: 4160481 - RNA, 22 nt, Yersinia pestis
cacucauaauuuugaugcuaau

SEQ ID NO: 4160482 - RNA, 15 nt, Yersinia pestis
cacucauccucuggc

SEQ ID NO: 4160483 - RNA, 15 nt, Yersinia pestis
cacucaugacaaaau

SEQ ID NO: 4160484 - RNA, 16 nt, Yersinia pestis
cacuccauuaauuuau

SEQ ID NO: 4160485 - RNA, 19 nt, Yersinia pestis
cacuccauucgucacuguc

SEQ ID NO: 4160486 - RNA, 13 nt, Yersinia pestis
cacuccggcauca

SEQ ID NO: 4160487 - RNA, 12 nt, Yersinia pestis
cacucgaaucac

SEQ ID NO: 4160488 - RNA, 14 nt, Yersinia pestis
cacucguuguauuu

SEQ ID NO: 4160489 - RNA, 21 nt, Yersinia pestis
cacucuacuuucuacuccauu

SEQ ID NO: 4160490 - RNA, 20 nt, Yersinia pestis
cacucucuucaucagucacu

SEQ ID NO: 4160491 - RNA, 22 nt, Yersinia pestis
cacucuggggcaaucaauguau

SEQ ID NO: 4160492 - RNA, 14 nt, Yersinia pestis
cacucuguuuuaaa

SEQ ID NO: 4160493 - RNA, 15 nt, Yersinia pestis
cacucuguuuuaaaa

SEQ ID NO: 4160494 - RNA, 17 nt, Yersinia pestis
cacucuugaacggugag

SEQ ID NO: 4160495 - RNA, 21 nt, Yersinia pestis
cacugaaauaaacaagccauu

SEQ ID NO: 4160496 - RNA, 14 nt, Yersinia pestis
cacugaauaacuga

SEQ ID NO: 4160497 - RNA, 15 nt, Yersinia pestis
cacugacaaaaacag

SEQ ID NO: 4160498 - RNA, 14 nt, Yersinia pestis
cacugacagcaacg

SEQ ID NO: 4160499 - RNA, 20 nt, Yersinia pestis
cacugacagcaacgacgccc

SEQ ID NO: 4160500 - RNA, 19 nt, Yersinia pestis
cacugaccuauugauaaaa

SEQ ID NO: 4160501 - RNA, 15 nt, Yersinia pestis
cacugagaaccgaua

SEQ ID NO: 4160502 - RNA, 14 nt, Yersinia pestis
cacugagggugaua

SEQ ID NO: 4160503 - RNA, 15 nt, Yersinia pestis
cacugaguugcugga

SEQ ID NO: 4160504 - RNA, 17 nt, Yersinia pestis
cacugauagauucauca

SEQ ID NO: 4160505 - RNA, 23 nt, Yersinia pestis
cacugaugagcuggcaaaacuca

SEQ ID NO: 4160506 - RNA, 13 nt, Yersinia pestis
cacugccaucuca

SEQ ID NO: 4160507 - RNA, 16 nt, Yersinia pestis
cacugccugcucucug

SEQ ID NO: 4160508 - RNA, 20 nt, Yersinia pestis
cacugccugcucucugcugc

SEQ ID NO: 4160509 - RNA, 23 nt, Yersinia pestis
cacugcgggcagguaaauagcca

SEQ ID NO: 4160510 - RNA, 13 nt, Yersinia pestis
cacugcucuaucu

SEQ ID NO: 4160511 - RNA, 23 nt, Yersinia pestis
cacugcucuaucucccgcuacac

SEQ ID NO: 4160512 - RNA, 13 nt, Yersinia pestis
cacugcuuuuuac

SEQ ID NO: 4160513 - RNA, 14 nt, Yersinia pestis
cacuggaaaaagug

SEQ ID NO: 4160514 - RNA, 13 nt, Yersinia pestis
cacuggcaccgcu

SEQ ID NO: 4160515 - RNA, 15 nt, Yersinia pestis
cacuggcaccgcuuc

SEQ ID NO: 4160516 - RNA, 18 nt, Yersinia pestis
cacuggccuguugcaauu

SEQ ID NO: 4160517 - RNA, 16 nt, Yersinia pestis
cacugggaucugauca

SEQ ID NO: 4160518 - RNA, 24 nt, Yersinia pestis
cacuggugcugcccaaaaucaaau

SEQ ID NO: 4160519 - RNA, 15 nt, Yersinia pestis
cacugucaucacugc

SEQ ID NO: 4160520 - RNA, 22 nt, Yersinia pestis
cacugucgggguagaucagcgu

SEQ ID NO: 4160521 - RNA, 20 nt, Yersinia pestis
cacugugagcggcauccagu

SEQ ID NO: 4160522 - RNA, 20 nt, Yersinia pestis
cacuguugcgggcaucagcc

SEQ ID NO: 4160523 - RNA, 14 nt, Yersinia pestis
cacuuaaacauaaa

SEQ ID NO: 4160524 - RNA, 12 nt, Yersinia pestis
cacuuaauaaug

SEQ ID NO: 4160525 - RNA, 19 nt, Yersinia pestis
cacuuacccgaaucacuga

SEQ ID NO: 4160526 - RNA, 15 nt, Yersinia pestis
cacuuacugaucaau

SEQ ID NO: 4160527 - RNA, 13 nt, Yersinia pestis
cacuuagugcugg

SEQ ID NO: 4160528 - RNA, 15 nt, Yersinia pestis
cacuuagugcuggcc

SEQ ID NO: 4160529 - RNA, 15 nt, Yersinia pestis
cacuuaguggcauug

SEQ ID NO: 4160530 - RNA, 13 nt, Yersinia pestis
cacuuauccagcu

SEQ ID NO: 4160531 - RNA, 15 nt, Yersinia pestis
cacuuauuauaaagc

SEQ ID NO: 4160532 - RNA, 21 nt, Yersinia pestis
cacuuauuggaaguacuuauu

SEQ ID NO: 4160533 - RNA, 22 nt, Yersinia pestis
cacuuauuggaaguacuuauuu

SEQ ID NO: 4160534 - RNA, 23 nt, Yersinia pestis
cacuuauuggaaguacuuauuug

SEQ ID NO: 4160535 - RNA, 23 nt, Yersinia pestis
cacuuauuugaaauacuuauuug

SEQ ID NO: 4160536 - RNA, 15 nt, Yersinia pestis
cacuucaagcagcau

SEQ ID NO: 4160537 - RNA, 18 nt, Yersinia pestis
cacuucacuugcaugccu

SEQ ID NO: 4160538 - RNA, 21 nt, Yersinia pestis
cacuucaucauucauuuuaaa

SEQ ID NO: 4160539 - RNA, 23 nt, Yersinia pestis
cacuucauuuucucgcggggaua

SEQ ID NO: 4160540 - RNA, 14 nt, Yersinia pestis
cacuuccagcgccc

SEQ ID NO: 4160541 - RNA, 16 nt, Yersinia pestis
cacuuccgccgccaac

SEQ ID NO: 4160542 - RNA, 18 nt, Yersinia pestis
cacuucgauacuacaauc

SEQ ID NO: 4160543 - RNA, 19 nt, Yersinia pestis
cacuucgccuuaucagcga

SEQ ID NO: 4160544 - RNA, 16 nt, Yersinia pestis
cacuucgguggcccuu

SEQ ID NO: 4160545 - RNA, 11 nt, Yersinia pestis
cacuucucuga

SEQ ID NO: 4160546 - RNA, 23 nt, Yersinia pestis
cacuucucugacacacaaauccu

SEQ ID NO: 4160547 - RNA, 18 nt, Yersinia pestis
cacuucuggccgcucuuu

SEQ ID NO: 4160548 - RNA, 11 nt, Yersinia pestis
cacuugaccuu

SEQ ID NO: 4160549 - RNA, 20 nt, Yersinia pestis
cacuugcuggcggcuuuuau

SEQ ID NO: 4160550 - RNA, 16 nt, Yersinia pestis
cacuuguaccugugcc

SEQ ID NO: 4160551 - RNA, 19 nt, Yersinia pestis
cacuuguaccugugccagu

SEQ ID NO: 4160552 - RNA, 20 nt, Yersinia pestis
cacuuguagguuaaauucac

SEQ ID NO: 4160553 - RNA, 22 nt, Yersinia pestis
cacuuuaaauacccagcuucuu

SEQ ID NO: 4160554 - RNA, 17 nt, Yersinia pestis
cacuuuaccgauuucag

SEQ ID NO: 4160555 - RNA, 18 nt, Yersinia pestis
cacuuucaacuauugcau

SEQ ID NO: 4160556 - RNA, 21 nt, Yersinia pestis
cacuuugucaauaaccucaaa

SEQ ID NO: 4160557 - RNA, 23 nt, Yersinia pestis
cacuuugucaauaaccucagccu

SEQ ID NO: 4160558 - RNA, 21 nt, Yersinia pestis
cacuuuuauauccgccauccu

SEQ ID NO: 4160559 - RNA, 17 nt, Yersinia pestis
cacuuuuauccagccau

SEQ ID NO: 4160560 - RNA, 18 nt, Yersinia pestis
cagaaaaacaaugcuuuu

SEQ ID NO: 4160561 - RNA, 14 nt, Yersinia pestis
cagaaaaccuucag

SEQ ID NO: 4160562 - RNA, 16 nt, Yersinia pestis
cagaaaagcaaaggcc

SEQ ID NO: 4160563 - RNA, 14 nt, Yersinia pestis
cagaaaagcgaagg

SEQ ID NO: 4160564 - RNA, 14 nt, Yersinia pestis
cagaaaaucacgua

SEQ ID NO: 4160565 - RNA, 16 nt, Yersinia pestis
cagaaacggcaucugc

SEQ ID NO: 4160566 - RNA, 17 nt, Yersinia pestis
cagaaacggcaucugcc

SEQ ID NO: 4160567 - RNA, 19 nt, Yersinia pestis
cagaaagaagucuaacaaa

SEQ ID NO: 4160568 - RNA, 12 nt, Yersinia pestis
cagaaagcagca

SEQ ID NO: 4160569 - RNA, 22 nt, Yersinia pestis
cagaaagguaugugccaaaaaa

SEQ ID NO: 4160570 - RNA, 16 nt, Yersinia pestis
cagaaaguaaucuuug

SEQ ID NO: 4160571 - RNA, 17 nt, Yersinia pestis
cagaaaguaaucuuuga

SEQ ID NO: 4160572 - RNA, 21 nt, Yersinia pestis
cagaaaguuguucaacgccau

SEQ ID NO: 4160573 - RNA, 19 nt, Yersinia pestis
cagaaauaaauauccuccg

SEQ ID NO: 4160574 - RNA, 17 nt, Yersinia pestis
cagaaauaauaucaagu

SEQ ID NO: 4160575 - RNA, 16 nt, Yersinia pestis
cagaaauagcaccauu

SEQ ID NO: 4160576 - RNA, 21 nt, Yersinia pestis
cagaaauagcaccauuaggcu

SEQ ID NO: 4160577 - RNA, 23 nt, Yersinia pestis
cagaacaccaacaccacacugag

SEQ ID NO: 4160578 - RNA, 21 nt, Yersinia pestis
cagaacagagugugaaaucac

SEQ ID NO: 4160579 - RNA, 16 nt, Yersinia pestis
cagaacagguuuuuuc

SEQ ID NO: 4160580 - RNA, 23 nt, Yersinia pestis
cagaacagguuuuuuccccaugg

SEQ ID NO: 4160581 - RNA, 19 nt, Yersinia pestis
cagaacccccgcgaacagc

SEQ ID NO: 4160582 - RNA, 22 nt, Yersinia pestis
cagaacccccgcgaacagcaga

SEQ ID NO: 4160583 - RNA, 19 nt, Yersinia pestis
cagaaccuguuacaucaga

SEQ ID NO: 4160584 - RNA, 16 nt, Yersinia pestis
cagaacgcaaucaggg

SEQ ID NO: 4160585 - RNA, 16 nt, Yersinia pestis
cagaacugauuucagg

SEQ ID NO: 4160586 - RNA, 14 nt, Yersinia pestis
cagaagcauaugga

SEQ ID NO: 4160587 - RNA, 17 nt, Yersinia pestis
cagaagcauauggaugu

SEQ ID NO: 4160588 - RNA, 16 nt, Yersinia pestis
cagaagcguaaagcac

SEQ ID NO: 4160589 - RNA, 18 nt, Yersinia pestis
cagaagggcggccagcaa

SEQ ID NO: 4160590 - RNA, 19 nt, Yersinia pestis
cagaagggcggccagcaag

SEQ ID NO: 4160591 - RNA, 14 nt, Yersinia pestis
cagaagguaagcca

SEQ ID NO: 4160592 - RNA, 16 nt, Yersinia pestis
cagaagguaagccagu

SEQ ID NO: 4160593 - RNA, 16 nt, Yersinia pestis
cagaaguugaauuuga

SEQ ID NO: 4160594 - RNA, 21 nt, Yersinia pestis
cagaauaaaagcgguaugacc

SEQ ID NO: 4160595 - RNA, 20 nt, Yersinia pestis
cagaauaauaagccgugccu

SEQ ID NO: 4160596 - RNA, 21 nt, Yersinia pestis
cagaauacguagcccuuugcu

SEQ ID NO: 4160597 - RNA, 14 nt, Yersinia pestis
cagaaucaccaaca

SEQ ID NO: 4160598 - RNA, 21 nt, Yersinia pestis
cagaaucacuggcagaaguug

SEQ ID NO: 4160599 - RNA, 18 nt, Yersinia pestis
cagaaucgccugcacacg

SEQ ID NO: 4160600 - RNA, 12 nt, Yersinia pestis
cagaaugaaagg

SEQ ID NO: 4160601 - RNA, 21 nt, Yersinia pestis
cagaaugaaaggcggugaaca

SEQ ID NO: 4160602 - RNA, 17 nt, Yersinia pestis
cagaaugaaguucacca

SEQ ID NO: 4160603 - RNA, 23 nt, Yersinia pestis
cagaaugaaguucaccagcuugg

SEQ ID NO: 4160604 - RNA, 15 nt, Yersinia pestis
cagaauuucauuuuc

SEQ ID NO: 4160605 - RNA, 23 nt, Yersinia pestis
cagaauuuuuuuagauaucagaa

SEQ ID NO: 4160606 - RNA, 11 nt, Yersinia pestis
cagacaaacaa

SEQ ID NO: 4160607 - RNA, 21 nt, Yersinia pestis
cagacaacagucacaccaaca

SEQ ID NO: 4160608 - RNA, 17 nt, Yersinia pestis
cagacaaccaauacaca

SEQ ID NO: 4160609 - RNA, 21 nt, Yersinia pestis
cagacaaccaauacacagcac

SEQ ID NO: 4160610 - RNA, 12 nt, Yersinia pestis
cagacaaccauu

SEQ ID NO: 4160611 - RNA, 16 nt, Yersinia pestis
cagacaacgcuuggca

SEQ ID NO: 4160612 - RNA, 15 nt, Yersinia pestis
cagacaacugacaac

SEQ ID NO: 4160613 - RNA, 18 nt, Yersinia pestis
cagacaagaaugccugcc

SEQ ID NO: 4160614 - RNA, 18 nt, Yersinia pestis
cagacacaagauaaauac

SEQ ID NO: 4160615 - RNA, 21 nt, Yersinia pestis
cagacacagcaacaaccccau

SEQ ID NO: 4160616 - RNA, 15 nt, Yersinia pestis
cagacacguaaaaca

SEQ ID NO: 4160617 - RNA, 16 nt, Yersinia pestis
cagacacugacaucau

SEQ ID NO: 4160618 - RNA, 11 nt, Yersinia pestis
cagacagccau

SEQ ID NO: 4160619 - RNA, 20 nt, Yersinia pestis
cagacaguaaauccugauga

SEQ ID NO: 4160620 - RNA, 21 nt, Yersinia pestis
cagacauauuggucauuuuuc

SEQ ID NO: 4160621 - RNA, 23 nt, Yersinia pestis
cagacauauuggucauuuuuccc

SEQ ID NO: 4160622 - RNA, 20 nt, Yersinia pestis
cagacauuuuucuauuucug

SEQ ID NO: 4160623 - RNA, 18 nt, Yersinia pestis
cagaccaaauagcaagcc

SEQ ID NO: 4160624 - RNA, 12 nt, Yersinia pestis
cagaccaaucaa

SEQ ID NO: 4160625 - RNA, 19 nt, Yersinia pestis
cagacccauuucugcuucu

SEQ ID NO: 4160626 - RNA, 18 nt, Yersinia pestis
cagaccuuuaggaaagcc

SEQ ID NO: 4160627 - RNA, 16 nt, Yersinia pestis
cagacgaaagauaauu

SEQ ID NO: 4160628 - RNA, 17 nt, Yersinia pestis
cagacgaaccgcuuuga

SEQ ID NO: 4160629 - RNA, 18 nt, Yersinia pestis
cagacgaguauuccccac

SEQ ID NO: 4160630 - RNA, 18 nt, Yersinia pestis
cagacgccccgaaccauu

SEQ ID NO: 4160631 - RNA, 14 nt, Yersinia pestis
cagacggaauacca

SEQ ID NO: 4160632 - RNA, 17 nt, Yersinia pestis
cagacggcagcaacgaa

SEQ ID NO: 4160633 - RNA, 19 nt, Yersinia pestis
cagacguacauauaucacu

SEQ ID NO: 4160634 - RNA, 19 nt, Yersinia pestis
cagacguuggcucaucaaa

SEQ ID NO: 4160635 - RNA, 18 nt, Yersinia pestis
cagacucuuauauaaauc

SEQ ID NO: 4160636 - RNA, 19 nt, Yersinia pestis
cagacucuuauauaaaucc

SEQ ID NO: 4160637 - RNA, 19 nt, Yersinia pestis
cagacugaaauaaugguuu

SEQ ID NO: 4160638 - RNA, 20 nt, Yersinia pestis
cagacugaaaugacauugcg

SEQ ID NO: 4160639 - RNA, 16 nt, Yersinia pestis
cagacugacaaccacu

SEQ ID NO: 4160640 - RNA, 16 nt, Yersinia pestis
cagacugcucuuuccc

SEQ ID NO: 4160641 - RNA, 12 nt, Yersinia pestis
cagacugcugac

SEQ ID NO: 4160642 - RNA, 15 nt, Yersinia pestis
cagacugcugacaaa

SEQ ID NO: 4160643 - RNA, 17 nt, Yersinia pestis
cagacugcugacaaccc

SEQ ID NO: 4160644 - RNA, 16 nt, Yersinia pestis
cagacuucuuccaucu

SEQ ID NO: 4160645 - RNA, 17 nt, Yersinia pestis
cagacuuggguaaccaa

SEQ ID NO: 4160646 - RNA, 21 nt, Yersinia pestis
cagagaccacagauaaauaaa

SEQ ID NO: 4160647 - RNA, 22 nt, Yersinia pestis
cagagauaacggcguucuaaau

SEQ ID NO: 4160648 - RNA, 20 nt, Yersinia pestis
cagagauaauagauaacaaa

SEQ ID NO: 4160649 - RNA, 21 nt, Yersinia pestis
cagagaugcagagaugcagug

SEQ ID NO: 4160650 - RNA, 21 nt, Yersinia pestis
cagagauuguuuuccacaugg

SEQ ID NO: 4160651 - RNA, 22 nt, Yersinia pestis
cagagauuguuuuccacauggc

SEQ ID NO: 4160652 - RNA, 21 nt, Yersinia pestis
cagagcacaacggaaggccca

SEQ ID NO: 4160653 - RNA, 18 nt, Yersinia pestis
cagagcacgcagagauga

SEQ ID NO: 4160654 - RNA, 14 nt, Yersinia pestis
cagagcagaaagca

SEQ ID NO: 4160655 - RNA, 15 nt, Yersinia pestis
cagagcagaaagcag

SEQ ID NO: 4160656 - RNA, 16 nt, Yersinia pestis
cagagcagaaagcagc

SEQ ID NO: 4160657 - RNA, 21 nt, Yersinia pestis
cagagccaauccccagaagcg

SEQ ID NO: 4160658 - RNA, 22 nt, Yersinia pestis
cagagccagaauaucguggaga

SEQ ID NO: 4160659 - RNA, 24 nt, Yersinia pestis
cagagccuuauaggcgcauaugaa

SEQ ID NO: 4160660 - RNA, 14 nt, Yersinia pestis
cagagcgggaacgc

SEQ ID NO: 4160661 - RNA, 14 nt, Yersinia pestis
cagagcggguuuuu

SEQ ID NO: 4160662 - RNA, 13 nt, Yersinia pestis
cagagcucaauuu

SEQ ID NO: 4160663 - RNA, 15 nt, Yersinia pestis
cagaggaguaaagcg

SEQ ID NO: 4160664 - RNA, 23 nt, Yersinia pestis
cagagucaguacggaaucauaaa

SEQ ID NO: 4160665 - RNA, 15 nt, Yersinia pestis
cagaguccucucacc

SEQ ID NO: 4160666 - RNA, 17 nt, Yersinia pestis
cagagucgcaaaaaaua

SEQ ID NO: 4160667 - RNA, 18 nt, Yersinia pestis
cagauaaagaaaaacccg

SEQ ID NO: 4160668 - RNA, 19 nt, Yersinia pestis
cagauaaagaaaaacccgu

SEQ ID NO: 4160669 - RNA, 17 nt, Yersinia pestis
cagauaaauaaaauaau

SEQ ID NO: 4160670 - RNA, 16 nt, Yersinia pestis
cagauaccacaucaaa

SEQ ID NO: 4160671 - RNA, 15 nt, Yersinia pestis
cagauacggcuccag

SEQ ID NO: 4160672 - RNA, 17 nt, Yersinia pestis
cagauacggcuccagaa

SEQ ID NO: 4160673 - RNA, 19 nt, Yersinia pestis
cagauaggcgaaauugacu

SEQ ID NO: 4160674 - RNA, 19 nt, Yersinia pestis
cagauaggcuugugcgcca

SEQ ID NO: 4160675 - RNA, 16 nt, Yersinia pestis
cagauaucagccagug

SEQ ID NO: 4160676 - RNA, 15 nt, Yersinia pestis
cagauaucugcucau

SEQ ID NO: 4160677 - RNA, 22 nt, Yersinia pestis
cagauaucugcucauuaccaau

SEQ ID NO: 4160678 - RNA, 14 nt, Yersinia pestis
cagauaugcauuau

SEQ ID NO: 4160679 - RNA, 23 nt, Yersinia pestis
cagauaugccaggcaucaucugc

SEQ ID NO: 4160680 - RNA, 19 nt, Yersinia pestis
cagauauuacgcagccaua

SEQ ID NO: 4160681 - RNA, 23 nt, Yersinia pestis
cagauauuacgcagccauaccca

SEQ ID NO: 4160682 - RNA, 19 nt, Yersinia pestis
cagauauuuucggguaucu

SEQ ID NO: 4160683 - RNA, 15 nt, Yersinia pestis
cagaucaacagauuu

SEQ ID NO: 4160684 - RNA, 18 nt, Yersinia pestis
cagaucacccgcaaaacu

SEQ ID NO: 4160685 - RNA, 17 nt, Yersinia pestis
cagaucaccgaugauaa

SEQ ID NO: 4160686 - RNA, 12 nt, Yersinia pestis
cagaucauuuuu

SEQ ID NO: 4160687 - RNA, 22 nt, Yersinia pestis
cagauccgcacugggaucugau

SEQ ID NO: 4160688 - RNA, 23 nt, Yersinia pestis
cagauccguaccaccacgaaaau

SEQ ID NO: 4160689 - RNA, 23 nt, Yersinia pestis
cagauccugccgccucugcuccg

SEQ ID NO: 4160690 - RNA, 19 nt, Yersinia pestis
cagaucgcgaugcgccugu

SEQ ID NO: 4160691 - RNA, 19 nt, Yersinia pestis
cagaucguaaagacgccgu

SEQ ID NO: 4160692 - RNA, 23 nt, Yersinia pestis
cagaucguuaaaguuaucaccaa

SEQ ID NO: 4160693 - RNA, 20 nt, Yersinia pestis
cagaucugcccccccuuuca

SEQ ID NO: 4160694 - RNA, 16 nt, Yersinia pestis
cagaugaaaaacugug

SEQ ID NO: 4160695 - RNA, 21 nt, Yersinia pestis
cagaugaaaaacugugcaaau

SEQ ID NO: 4160696 - RNA, 21 nt, Yersinia pestis
cagaugaauauguuccaucag

SEQ ID NO: 4160697 - RNA, 14 nt, Yersinia pestis
cagaugacgggcga

SEQ ID NO: 4160698 - RNA, 19 nt, Yersinia pestis
cagaugccgcuuuaguuuc

SEQ ID NO: 4160699 - RNA, 18 nt, Yersinia pestis
cagauggcaaucugcaag

SEQ ID NO: 4160700 - RNA, 22 nt, Yersinia pestis
cagauggccagauucaccagua

SEQ ID NO: 4160701 - RNA, 17 nt, Yersinia pestis
cagauggugcgccauua

SEQ ID NO: 4160702 - RNA, 15 nt, Yersinia pestis
cagauguaaccaccc

SEQ ID NO: 4160703 - RNA, 16 nt, Yersinia pestis
cagauguaaccaccca

SEQ ID NO: 4160704 - RNA, 17 nt, Yersinia pestis
cagauguaaccacccac

SEQ ID NO: 4160705 - RNA, 21 nt, Yersinia pestis
cagauguaaccacccacgggu

SEQ ID NO: 4160706 - RNA, 19 nt, Yersinia pestis
cagauguauuagcgcugcu

SEQ ID NO: 4160707 - RNA, 18 nt, Yersinia pestis
cagaugucccagaaauau

SEQ ID NO: 4160708 - RNA, 13 nt, Yersinia pestis
cagauguuuaaau

SEQ ID NO: 4160709 - RNA, 22 nt, Yersinia pestis
cagauguuuaaauugcgcccgg

SEQ ID NO: 4160710 - RNA, 15 nt, Yersinia pestis
cagauuauuggcaug

SEQ ID NO: 4160711 - RNA, 20 nt, Yersinia pestis
cagauucgcaaagcgggcca

SEQ ID NO: 4160712 - RNA, 21 nt, Yersinia pestis
cagauucgcaaagcgggccag

SEQ ID NO: 4160713 - RNA, 18 nt, Yersinia pestis
cagauuguuuauaaauua

SEQ ID NO: 4160714 - RNA, 14 nt, Yersinia pestis
cagauuuaaaucau

SEQ ID NO: 4160715 - RNA, 12 nt, Yersinia pestis
cagauuuaccau

SEQ ID NO: 4160716 - RNA, 18 nt, Yersinia pestis
cagauuugcccaaucuaa

SEQ ID NO: 4160717 - RNA, 12 nt, Yersinia pestis
cagauuugguau

SEQ ID NO: 4160718 - RNA, 17 nt, Yersinia pestis
cagauuuuccauccccu

SEQ ID NO: 4160719 - RNA, 18 nt, Yersinia pestis
cagauuuuugcuuuccac

SEQ ID NO: 4160720 - RNA, 22 nt, Yersinia pestis
cagcaaaagccucuugcgcucc

SEQ ID NO: 4160721 - RNA, 19 nt, Yersinia pestis
cagcaaacagugauucgcu

SEQ ID NO: 4160722 - RNA, 17 nt, Yersinia pestis
cagcaaacaucgguaaa

SEQ ID NO: 4160723 - RNA, 21 nt, Yersinia pestis
cagcaaacaucgguaaaucgc

SEQ ID NO: 4160724 - RNA, 22 nt, Yersinia pestis
cagcaaauaccgggacuaccaa

SEQ ID NO: 4160725 - RNA, 14 nt, Yersinia pestis
cagcaaaucacauu

SEQ ID NO: 4160726 - RNA, 14 nt, Yersinia pestis
cagcaaaucauaaa

SEQ ID NO: 4160727 - RNA, 12 nt, Yersinia pestis
cagcaaaucauu

SEQ ID NO: 4160728 - RNA, 14 nt, Yersinia pestis
cagcaaauugcuga

SEQ ID NO: 4160729 - RNA, 20 nt, Yersinia pestis
cagcaaauugcugaaaaaaa

SEQ ID NO: 4160730 - RNA, 19 nt, Yersinia pestis
cagcaacgcgaugcauuaa

SEQ ID NO: 4160731 - RNA, 15 nt, Yersinia pestis
cagcaacgguuucaa

SEQ ID NO: 4160732 - RNA, 17 nt, Yersinia pestis
cagcaacucaagccacu

SEQ ID NO: 4160733 - RNA, 23 nt, Yersinia pestis
cagcaagaaacucccuucaauca

SEQ ID NO: 4160734 - RNA, 12 nt, Yersinia pestis
cagcaagagcag

SEQ ID NO: 4160735 - RNA, 23 nt, Yersinia pestis
cagcaagauugggaucaacgccc

SEQ ID NO: 4160736 - RNA, 12 nt, Yersinia pestis
cagcaagccaau

SEQ ID NO: 4160737 - RNA, 21 nt, Yersinia pestis
cagcaaggcggcaagcaagca

SEQ ID NO: 4160738 - RNA, 20 nt, Yersinia pestis
cagcaaggcgggcaaauuca

SEQ ID NO: 4160739 - RNA, 21 nt, Yersinia pestis
cagcaaguuagcgauaucugc

SEQ ID NO: 4160740 - RNA, 22 nt, Yersinia pestis
cagcaaguuagcgauaucugcg

SEQ ID NO: 4160741 - RNA, 17 nt, Yersinia pestis
cagcaauaaaccacugg

SEQ ID NO: 4160742 - RNA, 12 nt, Yersinia pestis
cagcaauacgcc

SEQ ID NO: 4160743 - RNA, 13 nt, Yersinia pestis
cagcaauauuguc

SEQ ID NO: 4160744 - RNA, 18 nt, Yersinia pestis
cagcacaaacagcuuuuu

SEQ ID NO: 4160745 - RNA, 14 nt, Yersinia pestis
cagcacaagcgccu

SEQ ID NO: 4160746 - RNA, 14 nt, Yersinia pestis
cagcacacgacagc

SEQ ID NO: 4160747 - RNA, 16 nt, Yersinia pestis
cagcacagagcacaac

SEQ ID NO: 4160748 - RNA, 17 nt, Yersinia pestis
cagcacagagcacaacg

SEQ ID NO: 4160749 - RNA, 16 nt, Yersinia pestis
cagcacauaaagcgca

SEQ ID NO: 4160750 - RNA, 21 nt, Yersinia pestis
cagcacauaaagcgcauuauu

SEQ ID NO: 4160751 - RNA, 23 nt, Yersinia pestis
cagcaccagggaugggcgccgcu

SEQ ID NO: 4160752 - RNA, 14 nt, Yersinia pestis
cagcaccauacagc

SEQ ID NO: 4160753 - RNA, 12 nt, Yersinia pestis
cagcacgccagu

SEQ ID NO: 4160754 - RNA, 15 nt, Yersinia pestis
cagcacgccaguguu

SEQ ID NO: 4160755 - RNA, 17 nt, Yersinia pestis
cagcacgccaguguuca

SEQ ID NO: 4160756 - RNA, 19 nt, Yersinia pestis
cagcacgggcuaucgggua

SEQ ID NO: 4160757 - RNA, 16 nt, Yersinia pestis
cagcacgguaaccuuu

SEQ ID NO: 4160758 - RNA, 15 nt, Yersinia pestis
cagcacguaccgcug

SEQ ID NO: 4160759 - RNA, 15 nt, Yersinia pestis
cagcacuauccccaa

SEQ ID NO: 4160760 - RNA, 17 nt, Yersinia pestis
cagcacuccccgcccgu

SEQ ID NO: 4160761 - RNA, 20 nt, Yersinia pestis
cagcacugguagcaucaucg

SEQ ID NO: 4160762 - RNA, 13 nt, Yersinia pestis
cagcagaaacccg

SEQ ID NO: 4160763 - RNA, 15 nt, Yersinia pestis
cagcagaacaaaaca

SEQ ID NO: 4160764 - RNA, 19 nt, Yersinia pestis
cagcagaacaaaacaagcc

SEQ ID NO: 4160765 - RNA, 17 nt, Yersinia pestis
cagcagaguaaagcagg

SEQ ID NO: 4160766 - RNA, 19 nt, Yersinia pestis
cagcagagucgcaaaaaau

SEQ ID NO: 4160767 - RNA, 14 nt, Yersinia pestis
cagcagcacguuca

SEQ ID NO: 4160768 - RNA, 14 nt, Yersinia pestis
cagcagcaguauua

SEQ ID NO: 4160769 - RNA, 18 nt, Yersinia pestis
cagcagcauccugaacuu

SEQ ID NO: 4160770 - RNA, 12 nt, Yersinia pestis
cagcagcgcgcu

SEQ ID NO: 4160771 - RNA, 23 nt, Yersinia pestis
cagcagcuuuugugcaggaguaa

SEQ ID NO: 4160772 - RNA, 16 nt, Yersinia pestis
cagcaggcgugcugcu

SEQ ID NO: 4160773 - RNA, 23 nt, Yersinia pestis
cagcagggauucugucagagcua

SEQ ID NO: 4160774 - RNA, 17 nt, Yersinia pestis
cagcaggggcguuagcu

SEQ ID NO: 4160775 - RNA, 12 nt, Yersinia pestis
cagcagucugaa

SEQ ID NO: 4160776 - RNA, 15 nt, Yersinia pestis
cagcagucugaagcc

SEQ ID NO: 4160777 - RNA, 23 nt, Yersinia pestis
cagcagucugacaccggggaucc

SEQ ID NO: 4160778 - RNA, 15 nt, Yersinia pestis
cagcagucugacaga

SEQ ID NO: 4160779 - RNA, 12 nt, Yersinia pestis
cagcagucugau

SEQ ID NO: 4160780 - RNA, 20 nt, Yersinia pestis
cagcaguuacaguagugaag

SEQ ID NO: 4160781 - RNA, 20 nt, Yersinia pestis
cagcauaaauauucauuaaa

SEQ ID NO: 4160782 - RNA, 14 nt, Yersinia pestis
cagcauaaccagug

SEQ ID NO: 4160783 - RNA, 22 nt, Yersinia pestis
cagcauacgugccaaaaugccu

SEQ ID NO: 4160784 - RNA, 14 nt, Yersinia pestis
cagcauauuguaaa

SEQ ID NO: 4160785 - RNA, 14 nt, Yersinia pestis
cagcaucaccgccg

SEQ ID NO: 4160786 - RNA, 14 nt, Yersinia pestis
cagcaucacugucu

SEQ ID NO: 4160787 - RNA, 14 nt, Yersinia pestis
cagcaucccagcca

SEQ ID NO: 4160788 - RNA, 16 nt, Yersinia pestis
cagcaucccagccacc

SEQ ID NO: 4160789 - RNA, 17 nt, Yersinia pestis
cagcaucccagccacca

SEQ ID NO: 4160790 - RNA, 17 nt, Yersinia pestis
cagcauccugaacuucc

SEQ ID NO: 4160791 - RNA, 16 nt, Yersinia pestis
cagcauccugcaaauu

SEQ ID NO: 4160792 - RNA, 23 nt, Yersinia pestis
cagcaucgcugaggucagugcug

SEQ ID NO: 4160793 - RNA, 15 nt, Yersinia pestis
cagcaucuagcagug

SEQ ID NO: 4160794 - RNA, 17 nt, Yersinia pestis
cagcaucugcaauggcu

SEQ ID NO: 4160795 - RNA, 19 nt, Yersinia pestis
cagcaucuucaaucaacug

SEQ ID NO: 4160796 - RNA, 16 nt, Yersinia pestis
cagcauuaacccauau

SEQ ID NO: 4160797 - RNA, 20 nt, Yersinia pestis
cagcauuaccaaggaaacca

SEQ ID NO: 4160798 - RNA, 15 nt, Yersinia pestis
cagcauucaggcuuu

SEQ ID NO: 4160799 - RNA, 21 nt, Yersinia pestis
cagcauucaggcuuuuuucua

SEQ ID NO: 4160800 - RNA, 16 nt, Yersinia pestis
cagcauucugcuucca

SEQ ID NO: 4160801 - RNA, 14 nt, Yersinia pestis
cagcauuucaggau

SEQ ID NO: 4160802 - RNA, 22 nt, Yersinia pestis
cagcauuuuuagggauaccuga

SEQ ID NO: 4160803 - RNA, 21 nt, Yersinia pestis
cagccaaaauaaucaccagac

SEQ ID NO: 4160804 - RNA, 12 nt, Yersinia pestis
cagccaaccauc

SEQ ID NO: 4160805 - RNA, 15 nt, Yersinia pestis
cagccaagucaggga

SEQ ID NO: 4160806 - RNA, 12 nt, Yersinia pestis
cagccaauggcc

SEQ ID NO: 4160807 - RNA, 13 nt, Yersinia pestis
cagccaauggcca

SEQ ID NO: 4160808 - RNA, 20 nt, Yersinia pestis
cagccaauggccaccauuaa

SEQ ID NO: 4160809 - RNA, 15 nt, Yersinia pestis
cagccaauguuucaa

SEQ ID NO: 4160810 - RNA, 13 nt, Yersinia pestis
cagccacaugauu

SEQ ID NO: 4160811 - RNA, 14 nt, Yersinia pestis
cagccaccauuggc

SEQ ID NO: 4160812 - RNA, 17 nt, Yersinia pestis
cagccaccgcacacuga

SEQ ID NO: 4160813 - RNA, 17 nt, Yersinia pestis
cagccacguaauaccac

SEQ ID NO: 4160814 - RNA, 15 nt, Yersinia pestis
cagccacucaauggc

SEQ ID NO: 4160815 - RNA, 18 nt, Yersinia pestis
cagccacucacauaagaa

SEQ ID NO: 4160816 - RNA, 19 nt, Yersinia pestis
cagccacuuguagguuaaa

SEQ ID NO: 4160817 - RNA, 13 nt, Yersinia pestis
cagccagcgucau

SEQ ID NO: 4160818 - RNA, 16 nt, Yersinia pestis
cagccagugcuggcaa

SEQ ID NO: 4160819 - RNA, 19 nt, Yersinia pestis
cagccaucggucauuuuac

SEQ ID NO: 4160820 - RNA, 15 nt, Yersinia pestis
cagccaugccugcga

SEQ ID NO: 4160821 - RNA, 17 nt, Yersinia pestis
cagccaugggcugaagu

SEQ ID NO: 4160822 - RNA, 17 nt, Yersinia pestis
cagccauugagcgaaga

SEQ ID NO: 4160823 - RNA, 23 nt, Yersinia pestis
cagccauuugaacaaaccccacu

SEQ ID NO: 4160824 - RNA, 19 nt, Yersinia pestis
cagcccaccagcagcgccc

SEQ ID NO: 4160825 - RNA, 14 nt, Yersinia pestis
cagcccagauggca

SEQ ID NO: 4160826 - RNA, 14 nt, Yersinia pestis
cagcccaucuuuga

SEQ ID NO: 4160827 - RNA, 20 nt, Yersinia pestis
cagccccaaacacuuagcac

SEQ ID NO: 4160828 - RNA, 18 nt, Yersinia pestis
cagccccuaacagcagug

SEQ ID NO: 4160829 - RNA, 16 nt, Yersinia pestis
cagccccuagcaccgc

SEQ ID NO: 4160830 - RNA, 14 nt, Yersinia pestis
cagcccgguaucac

SEQ ID NO: 4160831 - RNA, 23 nt, Yersinia pestis
cagcccuacuggcccgcccauaa

SEQ ID NO: 4160832 - RNA, 20 nt, Yersinia pestis
cagcccugaucgcugugcaa

SEQ ID NO: 4160833 - RNA, 22 nt, Yersinia pestis
cagcccugccuggcaggaagcc

SEQ ID NO: 4160834 - RNA, 19 nt, Yersinia pestis
cagcccuuauucaaagaau

SEQ ID NO: 4160835 - RNA, 14 nt, Yersinia pestis
cagccgagaaauag

SEQ ID NO: 4160836 - RNA, 21 nt, Yersinia pestis
cagccgauguguuucgacggu

SEQ ID NO: 4160837 - RNA, 23 nt, Yersinia pestis
cagccggauaggcuuaauaugcc

SEQ ID NO: 4160838 - RNA, 22 nt, Yersinia pestis
cagccgggaugaucaacaguga

SEQ ID NO: 4160839 - RNA, 17 nt, Yersinia pestis
cagccguaucuucugcc

SEQ ID NO: 4160840 - RNA, 17 nt, Yersinia pestis
cagccguuucuuucaau

SEQ ID NO: 4160841 - RNA, 14 nt, Yersinia pestis
cagccuaaaaugaa

SEQ ID NO: 4160842 - RNA, 14 nt, Yersinia pestis
cagccuaaccgcug

SEQ ID NO: 4160843 - RNA, 14 nt, Yersinia pestis
cagccuaaggccau

SEQ ID NO: 4160844 - RNA, 14 nt, Yersinia pestis
cagccuauccucac

SEQ ID NO: 4160845 - RNA, 17 nt, Yersinia pestis
cagccuauccucaccgu

SEQ ID NO: 4160846 - RNA, 21 nt, Yersinia pestis
cagccuauggcgguuccaaag

SEQ ID NO: 4160847 - RNA, 14 nt, Yersinia pestis
cagccucauucaug

SEQ ID NO: 4160848 - RNA, 18 nt, Yersinia pestis
cagccucuaacacucuuu

SEQ ID NO: 4160849 - RNA, 17 nt, Yersinia pestis
cagccucuaacauacuc

SEQ ID NO: 4160850 - RNA, 16 nt, Yersinia pestis
cagccugaauuuccug

SEQ ID NO: 4160851 - RNA, 19 nt, Yersinia pestis
cagccuguacuuuaacuuu

SEQ ID NO: 4160852 - RNA, 12 nt, Yersinia pestis
cagccuguuaau

SEQ ID NO: 4160853 - RNA, 23 nt, Yersinia pestis
cagcgaaauguaagcuacuaaug

SEQ ID NO: 4160854 - RNA, 14 nt, Yersinia pestis
cagcgaauaaauaa

SEQ ID NO: 4160855 - RNA, 17 nt, Yersinia pestis
cagcgaauaguaucuac

SEQ ID NO: 4160856 - RNA, 15 nt, Yersinia pestis
cagcgacgauaauuu

SEQ ID NO: 4160857 - RNA, 16 nt, Yersinia pestis
cagcgacgcuaaacac

SEQ ID NO: 4160858 - RNA, 14 nt, Yersinia pestis
cagcgagcacugcc

SEQ ID NO: 4160859 - RNA, 15 nt, Yersinia pestis
cagcgaggcuucuca

SEQ ID NO: 4160860 - RNA, 15 nt, Yersinia pestis
cagcgauuaaaauaa

SEQ ID NO: 4160861 - RNA, 17 nt, Yersinia pestis
cagcgauuaaaauaaag

SEQ ID NO: 4160862 - RNA, 18 nt, Yersinia pestis
cagcgauucauugagcaa

SEQ ID NO: 4160863 - RNA, 20 nt, Yersinia pestis
cagcgcagguggauccguca

SEQ ID NO: 4160864 - RNA, 22 nt, Yersinia pestis
cagcgccaugauaaccacaacg

SEQ ID NO: 4160865 - RNA, 14 nt, Yersinia pestis
cagcgcccaagugc

SEQ ID NO: 4160866 - RNA, 13 nt, Yersinia pestis
cagcgcccccuuu

SEQ ID NO: 4160867 - RNA, 22 nt, Yersinia pestis
cagcgcccuugccagugcaauc

SEQ ID NO: 4160868 - RNA, 20 nt, Yersinia pestis
cagcgccuccagucccccuc

SEQ ID NO: 4160869 - RNA, 13 nt, Yersinia pestis
cagcgcgcagcca

SEQ ID NO: 4160870 - RNA, 18 nt, Yersinia pestis
cagcgcuauuuguaucaa

SEQ ID NO: 4160871 - RNA, 18 nt, Yersinia pestis
cagcgcuggcuauccuga

SEQ ID NO: 4160872 - RNA, 22 nt, Yersinia pestis
cagcgcuggcuuuuucacacgc

SEQ ID NO: 4160873 - RNA, 15 nt, Yersinia pestis
cagcgcuuccacugc

SEQ ID NO: 4160874 - RNA, 21 nt, Yersinia pestis
cagcgcuuggugaugcugcug

SEQ ID NO: 4160875 - RNA, 14 nt, Yersinia pestis
cagcggccaugacg

SEQ ID NO: 4160876 - RNA, 19 nt, Yersinia pestis
cagcggcgaaagcauggca

SEQ ID NO: 4160877 - RNA, 17 nt, Yersinia pestis
cagcggcguaucaaacg

SEQ ID NO: 4160878 - RNA, 15 nt, Yersinia pestis
cagcggggcauucau

SEQ ID NO: 4160879 - RNA, 18 nt, Yersinia pestis
cagcgguagagaucucug

SEQ ID NO: 4160880 - RNA, 22 nt, Yersinia pestis
cagcgguaugaggaucccuucu

SEQ ID NO: 4160881 - RNA, 23 nt, Yersinia pestis
cagcgguaugaggaucccuucug

SEQ ID NO: 4160882 - RNA, 19 nt, Yersinia pestis
cagcggugaucgcugccac

SEQ ID NO: 4160883 - RNA, 23 nt, Yersinia pestis
cagcguaauaccacuacccgcug

SEQ ID NO: 4160884 - RNA, 18 nt, Yersinia pestis
cagcguauagcgccgcca

SEQ ID NO: 4160885 - RNA, 14 nt, Yersinia pestis
cagcguauggggaa

SEQ ID NO: 4160886 - RNA, 20 nt, Yersinia pestis
cagcguauucaguaaaaacu

SEQ ID NO: 4160887 - RNA, 20 nt, Yersinia pestis
cagcguauugugauucauac

SEQ ID NO: 4160888 - RNA, 16 nt, Yersinia pestis
cagcgucaaaccauuu

SEQ ID NO: 4160889 - RNA, 18 nt, Yersinia pestis
cagcgucacccaacgcaa

SEQ ID NO: 4160890 - RNA, 19 nt, Yersinia pestis
cagcgucagucaaugagcc

SEQ ID NO: 4160891 - RNA, 17 nt, Yersinia pestis
cagcgucucguguaaca

SEQ ID NO: 4160892 - RNA, 15 nt, Yersinia pestis
cagcgucuucagugg

SEQ ID NO: 4160893 - RNA, 16 nt, Yersinia pestis
cagcgucuucaguggc

SEQ ID NO: 4160894 - RNA, 15 nt, Yersinia pestis
cagcguggcauugag

SEQ ID NO: 4160895 - RNA, 16 nt, Yersinia pestis
cagcguugacaccaga

SEQ ID NO: 4160896 - RNA, 16 nt, Yersinia pestis
cagcguuggucagcaa

SEQ ID NO: 4160897 - RNA, 17 nt, Yersinia pestis
cagcguuuuauucguuc

SEQ ID NO: 4160898 - RNA, 17 nt, Yersinia pestis
cagcuaaucauugcaau

SEQ ID NO: 4160899 - RNA, 15 nt, Yersinia pestis
cagcuagccugcccc

SEQ ID NO: 4160900 - RNA, 18 nt, Yersinia pestis
cagcucaaagaccacauc

SEQ ID NO: 4160901 - RNA, 12 nt, Yersinia pestis
cagcucaccguc

SEQ ID NO: 4160902 - RNA, 16 nt, Yersinia pestis
cagcucaucaccaaaa

SEQ ID NO: 4160903 - RNA, 14 nt, Yersinia pestis
cagcucuacaguga

SEQ ID NO: 4160904 - RNA, 15 nt, Yersinia pestis
cagcucuagaccuga

SEQ ID NO: 4160905 - RNA, 13 nt, Yersinia pestis
cagcucucugagc

SEQ ID NO: 4160906 - RNA, 20 nt, Yersinia pestis
cagcucucugagccauccag

SEQ ID NO: 4160907 - RNA, 16 nt, Yersinia pestis
cagcucuucaauuucc

SEQ ID NO: 4160908 - RNA, 17 nt, Yersinia pestis
cagcucuucaauuucca

SEQ ID NO: 4160909 - RNA, 22 nt, Yersinia pestis
cagcugacuaaaucgcuuaucu

SEQ ID NO: 4160910 - RNA, 17 nt, Yersinia pestis
cagcugggauaugccgu

SEQ ID NO: 4160911 - RNA, 23 nt, Yersinia pestis
cagcugggauaugccguauacgu

SEQ ID NO: 4160912 - RNA, 13 nt, Yersinia pestis
cagcuucgccacc

SEQ ID NO: 4160913 - RNA, 15 nt, Yersinia pestis
cagcuucgccaccag

SEQ ID NO: 4160914 - RNA, 22 nt, Yersinia pestis
cagcuugauagggcugaagacc

SEQ ID NO: 4160915 - RNA, 14 nt, Yersinia pestis
cagcuugcaacaaa

SEQ ID NO: 4160916 - RNA, 20 nt, Yersinia pestis
cagcuugcaacucggccgcu

SEQ ID NO: 4160917 - RNA, 16 nt, Yersinia pestis
cagcuuguugauauca

SEQ ID NO: 4160918 - RNA, 21 nt, Yersinia pestis
cagcuuuagcauugcagauuu

SEQ ID NO: 4160919 - RNA, 14 nt, Yersinia pestis
caggaacguucaau

SEQ ID NO: 4160920 - RNA, 16 nt, Yersinia pestis
caggaagcaagaaacu

SEQ ID NO: 4160921 - RNA, 13 nt, Yersinia pestis
caggaagcggcca

SEQ ID NO: 4160922 - RNA, 19 nt, Yersinia pestis
caggaagcggccagguuca

SEQ ID NO: 4160923 - RNA, 17 nt, Yersinia pestis
caggaagcguauaagca

SEQ ID NO: 4160924 - RNA, 22 nt, Yersinia pestis
caggagauagccucaccgccag

SEQ ID NO: 4160925 - RNA, 18 nt, Yersinia pestis
caggagcaaccauuuuau

SEQ ID NO: 4160926 - RNA, 17 nt, Yersinia pestis
caggaguugguggcaca

SEQ ID NO: 4160927 - RNA, 19 nt, Yersinia pestis
caggauaaaccuacagcca

SEQ ID NO: 4160928 - RNA, 21 nt, Yersinia pestis
caggauaaagcugaauaucca

SEQ ID NO: 4160929 - RNA, 16 nt, Yersinia pestis
caggauagagagaaug

SEQ ID NO: 4160930 - RNA, 14 nt, Yersinia pestis
caggauagccaacc

SEQ ID NO: 4160931 - RNA, 22 nt, Yersinia pestis
caggaucaccagcaaaggccac

SEQ ID NO: 4160932 - RNA, 23 nt, Yersinia pestis
caggaucaccagcaaaggccacc

SEQ ID NO: 4160933 - RNA, 21 nt, Yersinia pestis
caggaucgaucuggauauauu

SEQ ID NO: 4160934 - RNA, 15 nt, Yersinia pestis
caggaucugcuccuc

SEQ ID NO: 4160935 - RNA, 12 nt, Yersinia pestis
caggaucuggau

SEQ ID NO: 4160936 - RNA, 13 nt, Yersinia pestis
caggaucuuauuu

SEQ ID NO: 4160937 - RNA, 22 nt, Yersinia pestis
caggaugaugaauaccaccauc

SEQ ID NO: 4160938 - RNA, 23 nt, Yersinia pestis
caggaugaugaauaccaccauca

SEQ ID NO: 4160939 - RNA, 15 nt, Yersinia pestis
caggauuagcuucug

SEQ ID NO: 4160940 - RNA, 21 nt, Yersinia pestis
caggauugcgccggaauaaag

SEQ ID NO: 4160941 - RNA, 20 nt, Yersinia pestis
caggcaaagacuacacacag

SEQ ID NO: 4160942 - RNA, 14 nt, Yersinia pestis
caggcaacgacagc

SEQ ID NO: 4160943 - RNA, 20 nt, Yersinia pestis
caggcaacgacagcaacaac

SEQ ID NO: 4160944 - RNA, 15 nt, Yersinia pestis
caggcacaccagaac

SEQ ID NO: 4160945 - RNA, 15 nt, Yersinia pestis
caggcacuuugucaa

SEQ ID NO: 4160946 - RNA, 21 nt, Yersinia pestis
caggcagaucguaaagacgcc

SEQ ID NO: 4160947 - RNA, 14 nt, Yersinia pestis
caggcagcacggcu

SEQ ID NO: 4160948 - RNA, 16 nt, Yersinia pestis
caggcaggagcacaau

SEQ ID NO: 4160949 - RNA, 20 nt, Yersinia pestis
caggcaggagcacaauagga

SEQ ID NO: 4160950 - RNA, 20 nt, Yersinia pestis
caggcauaucacuauuucgu

SEQ ID NO: 4160951 - RNA, 13 nt, Yersinia pestis
caggcaucaucug

SEQ ID NO: 4160952 - RNA, 21 nt, Yersinia pestis
caggcaucaucugcgguaacc

SEQ ID NO: 4160953 - RNA, 16 nt, Yersinia pestis
caggccaagccugugc

SEQ ID NO: 4160954 - RNA, 11 nt, Yersinia pestis
caggccaauag

SEQ ID NO: 4160955 - RNA, 14 nt, Yersinia pestis
caggccaauagccc

SEQ ID NO: 4160956 - RNA, 16 nt, Yersinia pestis
caggccaccuaacacu

SEQ ID NO: 4160957 - RNA, 20 nt, Yersinia pestis
caggccacgcaauucaucac

SEQ ID NO: 4160958 - RNA, 18 nt, Yersinia pestis
caggccagcgacauggcg

SEQ ID NO: 4160959 - RNA, 23 nt, Yersinia pestis
caggccauacuggguuuaaaggu

SEQ ID NO: 4160960 - RNA, 15 nt, Yersinia pestis
caggccauuggcaaa

SEQ ID NO: 4160961 - RNA, 21 nt, Yersinia pestis
caggccauuggcaaaggccag

SEQ ID NO: 4160962 - RNA, 22 nt, Yersinia pestis
caggccauuggcaaaggccagc

SEQ ID NO: 4160963 - RNA, 18 nt, Yersinia pestis
caggccccaauccaccac

SEQ ID NO: 4160964 - RNA, 16 nt, Yersinia pestis
caggccccaucauaaa

SEQ ID NO: 4160965 - RNA, 17 nt, Yersinia pestis
caggcccgcuaucacua

SEQ ID NO: 4160966 - RNA, 20 nt, Yersinia pestis
caggccgguauucagccaaa

SEQ ID NO: 4160967 - RNA, 16 nt, Yersinia pestis
caggccuagcccagua

SEQ ID NO: 4160968 - RNA, 22 nt, Yersinia pestis
caggccuagcccaguaccgcug

SEQ ID NO: 4160969 - RNA, 23 nt, Yersinia pestis
caggccuaucucgcgucgcguac

SEQ ID NO: 4160970 - RNA, 13 nt, Yersinia pestis
caggccuucuuuu

SEQ ID NO: 4160971 - RNA, 14 nt, Yersinia pestis
caggccuuuacugu

SEQ ID NO: 4160972 - RNA, 19 nt, Yersinia pestis
caggccuuuuucucaaucu

SEQ ID NO: 4160973 - RNA, 21 nt, Yersinia pestis
caggcgacccagcgccauaac

SEQ ID NO: 4160974 - RNA, 15 nt, Yersinia pestis
caggcggguaacugu

SEQ ID NO: 4160975 - RNA, 17 nt, Yersinia pestis
caggcguucuguagcug

SEQ ID NO: 4160976 - RNA, 15 nt, Yersinia pestis
caggcucagcacaaa

SEQ ID NO: 4160977 - RNA, 14 nt, Yersinia pestis
caggcucaucaccu

SEQ ID NO: 4160978 - RNA, 17 nt, Yersinia pestis
caggcucaucaccuucc

SEQ ID NO: 4160979 - RNA, 18 nt, Yersinia pestis
caggcucauucaguggcg

SEQ ID NO: 4160980 - RNA, 16 nt, Yersinia pestis
caggcugccugccuga

SEQ ID NO: 4160981 - RNA, 17 nt, Yersinia pestis
caggcugccugccugag

SEQ ID NO: 4160982 - RNA, 17 nt, Yersinia pestis
caggcuucgacaggcaa

SEQ ID NO: 4160983 - RNA, 18 nt, Yersinia pestis
cagggaauucaccggcaa

SEQ ID NO: 4160984 - RNA, 15 nt, Yersinia pestis
cagggagccgcccug

SEQ ID NO: 4160985 - RNA, 15 nt, Yersinia pestis
cagggaucaccucuu

SEQ ID NO: 4160986 - RNA, 13 nt, Yersinia pestis
cagggcagccaau

SEQ ID NO: 4160987 - RNA, 13 nt, Yersinia pestis
cagggccacuucg

SEQ ID NO: 4160988 - RNA, 20 nt, Yersinia pestis
cagggcgauagcccuacugg

SEQ ID NO: 4160989 - RNA, 17 nt, Yersinia pestis
cagggcgcaauggcgcu

SEQ ID NO: 4160990 - RNA, 19 nt, Yersinia pestis
cagggcguauaaacagagc

SEQ ID NO: 4160991 - RNA, 12 nt, Yersinia pestis
cagggcuguuau

SEQ ID NO: 4160992 - RNA, 17 nt, Yersinia pestis
caggggagccgaagcgc

SEQ ID NO: 4160993 - RNA, 23 nt, Yersinia pestis
caggggauagcaacugccaauau

SEQ ID NO: 4160994 - RNA, 20 nt, Yersinia pestis
caggggcaauuugccgccuu

SEQ ID NO: 4160995 - RNA, 19 nt, Yersinia pestis
caggggcgaugucaccauc

SEQ ID NO: 4160996 - RNA, 23 nt, Yersinia pestis
caggggcguuauucucaauugac

SEQ ID NO: 4160997 - RNA, 20 nt, Yersinia pestis
cagggggaugccuuguuucu

SEQ ID NO: 4160998 - RNA, 20 nt, Yersinia pestis
cagggguaagauccaccaca

SEQ ID NO: 4160999 - RNA, 14 nt, Yersinia pestis
caggguaauaaccg

SEQ ID NO: 4161000 - RNA, 18 nt, Yersinia pestis
caggguauuccacccgca

SEQ ID NO: 4161001 - RNA, 14 nt, Yersinia pestis
cagggugaaagccc

SEQ ID NO: 4161002 - RNA, 19 nt, Yersinia pestis
cagggugaaagcccaacug

SEQ ID NO: 4161003 - RNA, 14 nt, Yersinia pestis
cagguaaaacauuu

SEQ ID NO: 4161004 - RNA, 14 nt, Yersinia pestis
cagguaaauagcca

SEQ ID NO: 4161005 - RNA, 13 nt, Yersinia pestis
cagguaaauccuu

SEQ ID NO: 4161006 - RNA, 21 nt, Yersinia pestis
cagguaacgccgcuguagcgc

SEQ ID NO: 4161007 - RNA, 16 nt, Yersinia pestis
cagguaaugcauucug

SEQ ID NO: 4161008 - RNA, 20 nt, Yersinia pestis
cagguaaugucacugccauc

SEQ ID NO: 4161009 - RNA, 19 nt, Yersinia pestis
cagguaauuuauagaccuu

SEQ ID NO: 4161010 - RNA, 14 nt, Yersinia pestis
cagguaccccauaa

SEQ ID NO: 4161011 - RNA, 19 nt, Yersinia pestis
cagguaccccauaaauccc

SEQ ID NO: 4161012 - RNA, 13 nt, Yersinia pestis
cagguaguucauu

SEQ ID NO: 4161013 - RNA, 18 nt, Yersinia pestis
cagguaucucacucaggc

SEQ ID NO: 4161014 - RNA, 14 nt, Yersinia pestis
cagguauucuccag

SEQ ID NO: 4161015 - RNA, 19 nt, Yersinia pestis
cagguauuucuccauugcg

SEQ ID NO: 4161016 - RNA, 20 nt, Yersinia pestis
caggucaaucaauucuucaa

SEQ ID NO: 4161017 - RNA, 22 nt, Yersinia pestis
caggucaggaagagaaaagcag

SEQ ID NO: 4161018 - RNA, 20 nt, Yersinia pestis
caggucucgcacucaucuuu

SEQ ID NO: 4161019 - RNA, 15 nt, Yersinia pestis
caggucugcauggua

SEQ ID NO: 4161020 - RNA, 22 nt, Yersinia pestis
caggugaacguuggcuucaccu

SEQ ID NO: 4161021 - RNA, 13 nt, Yersinia pestis
caggugacugaag

SEQ ID NO: 4161022 - RNA, 18 nt, Yersinia pestis
caggugcgauuaaccuua

SEQ ID NO: 4161023 - RNA, 17 nt, Yersinia pestis
cagguggauccgucauc

SEQ ID NO: 4161024 - RNA, 16 nt, Yersinia pestis
cagguggguacugaua

SEQ ID NO: 4161025 - RNA, 17 nt, Yersinia pestis
cagguuaaaguugauaa

SEQ ID NO: 4161026 - RNA, 20 nt, Yersinia pestis
cagguuaugcagcucaauca

SEQ ID NO: 4161027 - RNA, 18 nt, Yersinia pestis
cagguucauuacacagca

SEQ ID NO: 4161028 - RNA, 16 nt, Yersinia pestis
cagguucggcgcaauc

SEQ ID NO: 4161029 - RNA, 13 nt, Yersinia pestis
cagguuggcggca

SEQ ID NO: 4161030 - RNA, 23 nt, Yersinia pestis
cagguuggcguuucguaaugacc

SEQ ID NO: 4161031 - RNA, 17 nt, Yersinia pestis
cagguuguccgaagaga

SEQ ID NO: 4161032 - RNA, 20 nt, Yersinia pestis
cagguuguccgaagagaaag

SEQ ID NO: 4161033 - RNA, 11 nt, Yersinia pestis
caguaaaaacu

SEQ ID NO: 4161034 - RNA, 16 nt, Yersinia pestis
caguaaaaucaucagc

SEQ ID NO: 4161035 - RNA, 19 nt, Yersinia pestis
caguaaacagccagcauca

SEQ ID NO: 4161036 - RNA, 18 nt, Yersinia pestis
caguaaacauuuugacuu

SEQ ID NO: 4161037 - RNA, 15 nt, Yersinia pestis
caguaaaccaauuuu

SEQ ID NO: 4161038 - RNA, 18 nt, Yersinia pestis
caguaaacgguugcugua

SEQ ID NO: 4161039 - RNA, 19 nt, Yersinia pestis
caguaaacugcgcuuccag

SEQ ID NO: 4161040 - RNA, 23 nt, Yersinia pestis
caguaaagcaaauucccaccaua

SEQ ID NO: 4161041 - RNA, 17 nt, Yersinia pestis
caguaaauuauuuucca

SEQ ID NO: 4161042 - RNA, 14 nt, Yersinia pestis
caguaaauucauca

SEQ ID NO: 4161043 - RNA, 13 nt, Yersinia pestis
caguaacaacauc

SEQ ID NO: 4161044 - RNA, 21 nt, Yersinia pestis
caguaaccccuucgagcaccg

SEQ ID NO: 4161045 - RNA, 16 nt, Yersinia pestis
caguaacggccuucac

SEQ ID NO: 4161046 - RNA, 18 nt, Yersinia pestis
caguaacggcuuauuugc

SEQ ID NO: 4161047 - RNA, 17 nt, Yersinia pestis
caguaacgggucucaau

SEQ ID NO: 4161048 - RNA, 17 nt, Yersinia pestis
caguaacguccaacuga

SEQ ID NO: 4161049 - RNA, 16 nt, Yersinia pestis
caguaacuacuauaua

SEQ ID NO: 4161050 - RNA, 15 nt, Yersinia pestis
caguaacugaucaau

SEQ ID NO: 4161051 - RNA, 13 nt, Yersinia pestis
caguaagaucuuc

SEQ ID NO: 4161052 - RNA, 11 nt, Yersinia pestis
caguaagcucu

SEQ ID NO: 4161053 - RNA, 19 nt, Yersinia pestis
caguaagguauugacacaa

SEQ ID NO: 4161054 - RNA, 18 nt, Yersinia pestis
caguaaucaaacauaaaa

SEQ ID NO: 4161055 - RNA, 16 nt, Yersinia pestis
caguaaugaauucauu

SEQ ID NO: 4161056 - RNA, 17 nt, Yersinia pestis
caguaauucacugcuua

SEQ ID NO: 4161057 - RNA, 13 nt, Yersinia pestis
caguacaaaaaac

SEQ ID NO: 4161058 - RNA, 17 nt, Yersinia pestis
caguacaucacgcagug

SEQ ID NO: 4161059 - RNA, 21 nt, Yersinia pestis
caguaccgacaccaauaccga

SEQ ID NO: 4161060 - RNA, 20 nt, Yersinia pestis
caguacuauucacgagcuaa

SEQ ID NO: 4161061 - RNA, 21 nt, Yersinia pestis
caguagacgacacaaaugcug

SEQ ID NO: 4161062 - RNA, 17 nt, Yersinia pestis
caguagcagggccgccc

SEQ ID NO: 4161063 - RNA, 20 nt, Yersinia pestis
caguagcagggccgcccaga

SEQ ID NO: 4161064 - RNA, 20 nt, Yersinia pestis
caguagcauucgauguaacg

SEQ ID NO: 4161065 - RNA, 23 nt, Yersinia pestis
caguagccacuuugggucugaau

SEQ ID NO: 4161066 - RNA, 19 nt, Yersinia pestis
caguagcccagccggaaca

SEQ ID NO: 4161067 - RNA, 14 nt, Yersinia pestis
caguaggcugaagg

SEQ ID NO: 4161068 - RNA, 20 nt, Yersinia pestis
caguaggcugaaggccugcu

SEQ ID NO: 4161069 - RNA, 22 nt, Yersinia pestis
caguagucaauacaauuauuuu

SEQ ID NO: 4161070 - RNA, 14 nt, Yersinia pestis
caguagugaagaua

SEQ ID NO: 4161071 - RNA, 16 nt, Yersinia pestis
caguaucaauaccgaa

SEQ ID NO: 4161072 - RNA, 17 nt, Yersinia pestis
caguaugcgaaacaccu

SEQ ID NO: 4161073 - RNA, 21 nt, Yersinia pestis
caguauugcagagcaaaacug

SEQ ID NO: 4161074 - RNA, 22 nt, Yersinia pestis
caguauuuagcgugacacuguc

SEQ ID NO: 4161075 - RNA, 23 nt, Yersinia pestis
caguauuugcagcggaugauaaa

SEQ ID NO: 4161076 - RNA, 14 nt, Yersinia pestis
cagucaauauaccu

SEQ ID NO: 4161077 - RNA, 13 nt, Yersinia pestis
cagucaaugacga

SEQ ID NO: 4161078 - RNA, 18 nt, Yersinia pestis
cagucaccgcuguaaaug

SEQ ID NO: 4161079 - RNA, 17 nt, Yersinia pestis
cagucacgcuaccagaa

SEQ ID NO: 4161080 - RNA, 17 nt, Yersinia pestis
cagucacuaauaccuga

SEQ ID NO: 4161081 - RNA, 22 nt, Yersinia pestis
cagucacuaccgcucagauaaa

SEQ ID NO: 4161082 - RNA, 12 nt, Yersinia pestis
cagucacuggcc

SEQ ID NO: 4161083 - RNA, 14 nt, Yersinia pestis
cagucauuaacaca

SEQ ID NO: 4161084 - RNA, 19 nt, Yersinia pestis
cagucauucaccugcccgu

SEQ ID NO: 4161085 - RNA, 15 nt, Yersinia pestis
cagucauuuuauuag

SEQ ID NO: 4161086 - RNA, 19 nt, Yersinia pestis
cagucccccucacaagcca

SEQ ID NO: 4161087 - RNA, 13 nt, Yersinia pestis
caguccguaaauc

SEQ ID NO: 4161088 - RNA, 15 nt, Yersinia pestis
cagucgacaguguaa

SEQ ID NO: 4161089 - RNA, 17 nt, Yersinia pestis
cagucgcacugauagca

SEQ ID NO: 4161090 - RNA, 18 nt, Yersinia pestis
cagucgcacugauagcaa

SEQ ID NO: 4161091 - RNA, 13 nt, Yersinia pestis
cagucgcgaugcg

SEQ ID NO: 4161092 - RNA, 14 nt, Yersinia pestis
cagucgcugcuguu

SEQ ID NO: 4161093 - RNA, 14 nt, Yersinia pestis
cagucgcuucaucc

SEQ ID NO: 4161094 - RNA, 21 nt, Yersinia pestis
cagucgcuucauccgcgcuga

SEQ ID NO: 4161095 - RNA, 15 nt, Yersinia pestis
cagucuaaacgccgc

SEQ ID NO: 4161096 - RNA, 22 nt, Yersinia pestis
cagucuaaacgccgcgucaaua

SEQ ID NO: 4161097 - RNA, 17 nt, Yersinia pestis
cagucuagugcgcugug

SEQ ID NO: 4161098 - RNA, 17 nt, Yersinia pestis
cagucugaaacgccagc

SEQ ID NO: 4161099 - RNA, 22 nt, Yersinia pestis
cagucugaaacgccagccucug

SEQ ID NO: 4161100 - RNA, 15 nt, Yersinia pestis
cagucugaagccuac

SEQ ID NO: 4161101 - RNA, 19 nt, Yersinia pestis
cagucugaaggguauugaa

SEQ ID NO: 4161102 - RNA, 23 nt, Yersinia pestis
cagucugaaggguauugaagaua

SEQ ID NO: 4161103 - RNA, 17 nt, Yersinia pestis
cagucugaauugauguc

SEQ ID NO: 4161104 - RNA, 24 nt, Yersinia pestis
cagucugaauugaugucaauuaaa

SEQ ID NO: 4161105 - RNA, 22 nt, Yersinia pestis
cagucugagccucaugaaugag

SEQ ID NO: 4161106 - RNA, 23 nt, Yersinia pestis
cagucugagccucaugaaugagg

SEQ ID NO: 4161107 - RNA, 17 nt, Yersinia pestis
cagucugagggccacuu

SEQ ID NO: 4161108 - RNA, 21 nt, Yersinia pestis
cagucugagguggccauuacg

SEQ ID NO: 4161109 - RNA, 19 nt, Yersinia pestis
cagucugucguacuuuccu

SEQ ID NO: 4161110 - RNA, 15 nt, Yersinia pestis
cagugaaaucaucac

SEQ ID NO: 4161111 - RNA, 14 nt, Yersinia pestis
cagugaagagauaa

SEQ ID NO: 4161112 - RNA, 12 nt, Yersinia pestis
cagugaaggggg

SEQ ID NO: 4161113 - RNA, 15 nt, Yersinia pestis
cagugacgcagugac

SEQ ID NO: 4161114 - RNA, 15 nt, Yersinia pestis
cagugacgcagugau

SEQ ID NO: 4161115 - RNA, 16 nt, Yersinia pestis
cagugaguccuuuacu

SEQ ID NO: 4161116 - RNA, 21 nt, Yersinia pestis
cagugauaaggccuuuuucug

SEQ ID NO: 4161117 - RNA, 18 nt, Yersinia pestis
cagugauaaucacguuca

SEQ ID NO: 4161118 - RNA, 16 nt, Yersinia pestis
cagugauauuauuuau

SEQ ID NO: 4161119 - RNA, 22 nt, Yersinia pestis
cagugaugaccauucacgccgc

SEQ ID NO: 4161120 - RNA, 18 nt, Yersinia pestis
cagugaugcugcacauca

SEQ ID NO: 4161121 - RNA, 21 nt, Yersinia pestis
cagugauucgggugagugagc

SEQ ID NO: 4161122 - RNA, 16 nt, Yersinia pestis
cagugauuuuaaccac

SEQ ID NO: 4161123 - RNA, 15 nt, Yersinia pestis
cagugcaaaaugcuc

SEQ ID NO: 4161124 - RNA, 23 nt, Yersinia pestis
cagugcaaaaugcucuucaccaa

SEQ ID NO: 4161125 - RNA, 20 nt, Yersinia pestis
cagugcaacauuaaaaauac

SEQ ID NO: 4161126 - RNA, 14 nt, Yersinia pestis
cagugcacagucac

SEQ ID NO: 4161127 - RNA, 15 nt, Yersinia pestis
cagugcacgggaaau

SEQ ID NO: 4161128 - RNA, 21 nt, Yersinia pestis
cagugcauccccacugacauc

SEQ ID NO: 4161129 - RNA, 23 nt, Yersinia pestis
cagugcauucaucaugcugucau

SEQ ID NO: 4161130 - RNA, 16 nt, Yersinia pestis
cagugccaacagcgag

SEQ ID NO: 4161131 - RNA, 17 nt, Yersinia pestis
cagugccaagguucgaa

SEQ ID NO: 4161132 - RNA, 18 nt, Yersinia pestis
cagugccaauccccacca

SEQ ID NO: 4161133 - RNA, 19 nt, Yersinia pestis
cagugccaauugaguaacu

SEQ ID NO: 4161134 - RNA, 13 nt, Yersinia pestis
cagugccaguaau

SEQ ID NO: 4161135 - RNA, 16 nt, Yersinia pestis
cagugccguaugcgca

SEQ ID NO: 4161136 - RNA, 18 nt, Yersinia pestis
cagugccugguuuuacgc

SEQ ID NO: 4161137 - RNA, 20 nt, Yersinia pestis
cagugcgccguaaaucguca

SEQ ID NO: 4161138 - RNA, 20 nt, Yersinia pestis
cagugcgcgauaaacgguag

SEQ ID NO: 4161139 - RNA, 13 nt, Yersinia pestis
cagugcgcggcgc

SEQ ID NO: 4161140 - RNA, 16 nt, Yersinia pestis
cagugcgcggcgccgu

SEQ ID NO: 4161141 - RNA, 22 nt, Yersinia pestis
cagugcgcggcgccgucacgua

SEQ ID NO: 4161142 - RNA, 23 nt, Yersinia pestis
cagugcgguuaucgcucuugagg

SEQ ID NO: 4161143 - RNA, 20 nt, Yersinia pestis
cagugcguaaucagccgcgg

SEQ ID NO: 4161144 - RNA, 23 nt, Yersinia pestis
caguggaacauuuucguggaaau

SEQ ID NO: 4161145 - RNA, 18 nt, Yersinia pestis
caguggccauugaacaua

SEQ ID NO: 4161146 - RNA, 22 nt, Yersinia pestis
caguggcggcaaaagaacgugc

SEQ ID NO: 4161147 - RNA, 14 nt, Yersinia pestis
caguggcuggaaag

SEQ ID NO: 4161148 - RNA, 18 nt, Yersinia pestis
cagugggauagagaucag

SEQ ID NO: 4161149 - RNA, 22 nt, Yersinia pestis
cagugggcagggcgcaauggcg

SEQ ID NO: 4161150 - RNA, 17 nt, Yersinia pestis
caguggucaucaccguu

SEQ ID NO: 4161151 - RNA, 18 nt, Yersinia pestis
caguggucaucaccguuu

SEQ ID NO: 4161152 - RNA, 22 nt, Yersinia pestis
cagugguuuuauaaauaaauag

SEQ ID NO: 4161153 - RNA, 16 nt, Yersinia pestis
caguguaucaauagga

SEQ ID NO: 4161154 - RNA, 18 nt, Yersinia pestis
caguguauuaccugcgac

SEQ ID NO: 4161155 - RNA, 21 nt, Yersinia pestis
cagugucagguaaaaagguaa

SEQ ID NO: 4161156 - RNA, 22 nt, Yersinia pestis
cagugucaguucgacaccuuca

SEQ ID NO: 4161157 - RNA, 20 nt, Yersinia pestis
cagugucaucccguaggcuu

SEQ ID NO: 4161158 - RNA, 20 nt, Yersinia pestis
cagugucuggcaauccagcg

SEQ ID NO: 4161159 - RNA, 18 nt, Yersinia pestis
cagugugcgcaucagcca

SEQ ID NO: 4161160 - RNA, 18 nt, Yersinia pestis
caguuaaaaauagacagc

SEQ ID NO: 4161161 - RNA, 19 nt, Yersinia pestis
caguuaaaaauagacagca

SEQ ID NO: 4161162 - RNA, 22 nt, Yersinia pestis
caguuaaacgguaaccauccau

SEQ ID NO: 4161163 - RNA, 22 nt, Yersinia pestis
caguuaaggcuggcugugugag

SEQ ID NO: 4161164 - RNA, 20 nt, Yersinia pestis
caguuacacagaauuaugga

SEQ ID NO: 4161165 - RNA, 12 nt, Yersinia pestis
caguuaggcaag

SEQ ID NO: 4161166 - RNA, 16 nt, Yersinia pestis
caguuaggcggacaac

SEQ ID NO: 4161167 - RNA, 14 nt, Yersinia pestis
caguuauuauuuuu

SEQ ID NO: 4161168 - RNA, 23 nt, Yersinia pestis
caguuauuauuuuuaaugauuga

SEQ ID NO: 4161169 - RNA, 12 nt, Yersinia pestis
caguucaacagu

SEQ ID NO: 4161170 - RNA, 21 nt, Yersinia pestis
caguucacucuguuuuaaaaa

SEQ ID NO: 4161171 - RNA, 14 nt, Yersinia pestis
caguucagcccccu

SEQ ID NO: 4161172 - RNA, 20 nt, Yersinia pestis
caguucagcccccucaauac

SEQ ID NO: 4161173 - RNA, 21 nt, Yersinia pestis
caguucagcccccucaauacc

SEQ ID NO: 4161174 - RNA, 23 nt, Yersinia pestis
caguucagcccccucaauaccgg

SEQ ID NO: 4161175 - RNA, 14 nt, Yersinia pestis
caguucaucaauaa

SEQ ID NO: 4161176 - RNA, 15 nt, Yersinia pestis
caguucauggccaug

SEQ ID NO: 4161177 - RNA, 12 nt, Yersinia pestis
caguucauuaau

SEQ ID NO: 4161178 - RNA, 19 nt, Yersinia pestis
caguucauuccccaucgcc

SEQ ID NO: 4161179 - RNA, 20 nt, Yersinia pestis
caguucauuccccaucgcca

SEQ ID NO: 4161180 - RNA, 22 nt, Yersinia pestis
caguuccugauucgguuucguu

SEQ ID NO: 4161181 - RNA, 21 nt, Yersinia pestis
caguucgauauuauucucuac

SEQ ID NO: 4161182 - RNA, 18 nt, Yersinia pestis
caguucgcguuccggcgu

SEQ ID NO: 4161183 - RNA, 14 nt, Yersinia pestis
caguucggcuuucg

SEQ ID NO: 4161184 - RNA, 18 nt, Yersinia pestis
caguucugguagcugcuc

SEQ ID NO: 4161185 - RNA, 18 nt, Yersinia pestis
caguugaugaaucaauga

SEQ ID NO: 4161186 - RNA, 14 nt, Yersinia pestis
caguugauggcuuu

SEQ ID NO: 4161187 - RNA, 15 nt, Yersinia pestis
caguugcucauuuuc

SEQ ID NO: 4161188 - RNA, 24 nt, Yersinia pestis
caguuggcgcacguucccaggcca

SEQ ID NO: 4161189 - RNA, 20 nt, Yersinia pestis
caguuggguaucuuugcuuc

SEQ ID NO: 4161190 - RNA, 14 nt, Yersinia pestis
caguugucuauuuu

SEQ ID NO: 4161191 - RNA, 23 nt, Yersinia pestis
caguugucuauuuucauuauuuu

SEQ ID NO: 4161192 - RNA, 14 nt, Yersinia pestis
caguugucugaggc

SEQ ID NO: 4161193 - RNA, 14 nt, Yersinia pestis
caguuuauuuuccc

SEQ ID NO: 4161194 - RNA, 22 nt, Yersinia pestis
caguuuauuuucccuuucucag

SEQ ID NO: 4161195 - RNA, 17 nt, Yersinia pestis
caguuucacccucugcg

SEQ ID NO: 4161196 - RNA, 17 nt, Yersinia pestis
caguuucuaccgcuuca

SEQ ID NO: 4161197 - RNA, 22 nt, Yersinia pestis
caguuuuauuguauaaaacacc

SEQ ID NO: 4161198 - RNA, 17 nt, Yersinia pestis
caguuuuuuauggcaua

SEQ ID NO: 4161199 - RNA, 16 nt, Yersinia pestis
cauaaaaaaagaaggg

SEQ ID NO: 4161200 - RNA, 23 nt, Yersinia pestis
cauaaaaaaagaaggguuagcau

SEQ ID NO: 4161201 - RNA, 14 nt, Yersinia pestis
cauaaaaaccgccc

SEQ ID NO: 4161202 - RNA, 15 nt, Yersinia pestis
cauaaaaacuucaga

SEQ ID NO: 4161203 - RNA, 13 nt, Yersinia pestis
cauaaaaagaaaa

SEQ ID NO: 4161204 - RNA, 17 nt, Yersinia pestis
cauaaaaagaaaaaaac

SEQ ID NO: 4161205 - RNA, 13 nt, Yersinia pestis
cauaaaaauacau

SEQ ID NO: 4161206 - RNA, 14 nt, Yersinia pestis
cauaaaaauacaua

SEQ ID NO: 4161207 - RNA, 15 nt, Yersinia pestis
cauaaaaauacauau

SEQ ID NO: 4161208 - RNA, 19 nt, Yersinia pestis
cauaaaaauacauaucaac

SEQ ID NO: 4161209 - RNA, 20 nt, Yersinia pestis
cauaaaaaugcacugaacaa

SEQ ID NO: 4161210 - RNA, 14 nt, Yersinia pestis
cauaaaacgauuuu

SEQ ID NO: 4161211 - RNA, 20 nt, Yersinia pestis
cauaaaaggauggcccaagc

SEQ ID NO: 4161212 - RNA, 16 nt, Yersinia pestis
cauaaaauaaauaauu

SEQ ID NO: 4161213 - RNA, 16 nt, Yersinia pestis
cauaaaaugagccuga

SEQ ID NO: 4161214 - RNA, 18 nt, Yersinia pestis
cauaaacaaguugaacca

SEQ ID NO: 4161215 - RNA, 17 nt, Yersinia pestis
cauaaacggaacucauc

SEQ ID NO: 4161216 - RNA, 15 nt, Yersinia pestis
cauaaacugaaguua

SEQ ID NO: 4161217 - RNA, 23 nt, Yersinia pestis
cauaaacugaaguuaaaaagccu

SEQ ID NO: 4161218 - RNA, 13 nt, Yersinia pestis
cauaaagcuauuc

SEQ ID NO: 4161219 - RNA, 13 nt, Yersinia pestis
cauaaauaaagag

SEQ ID NO: 4161220 - RNA, 15 nt, Yersinia pestis
cauaaauaaagauac

SEQ ID NO: 4161221 - RNA, 15 nt, Yersinia pestis
cauaaauaauaaaua

SEQ ID NO: 4161222 - RNA, 20 nt, Yersinia pestis
cauaaauaggugcgccagug

SEQ ID NO: 4161223 - RNA, 23 nt, Yersinia pestis
cauaaaucaguacuauucacgag

SEQ ID NO: 4161224 - RNA, 21 nt, Yersinia pestis
cauaaaucccgagacacucau

SEQ ID NO: 4161225 - RNA, 22 nt, Yersinia pestis
cauaaaucccgagacacucauc

SEQ ID NO: 4161226 - RNA, 15 nt, Yersinia pestis
cauaaauuaaaacug

SEQ ID NO: 4161227 - RNA, 14 nt, Yersinia pestis
cauaaauuuaucuc

SEQ ID NO: 4161228 - RNA, 14 nt, Yersinia pestis
cauaacaauggccg

SEQ ID NO: 4161229 - RNA, 14 nt, Yersinia pestis
cauaacaauuaauu

SEQ ID NO: 4161230 - RNA, 16 nt, Yersinia pestis
cauaacaccaauugca

SEQ ID NO: 4161231 - RNA, 19 nt, Yersinia pestis
cauaacaccaauugcaggc

SEQ ID NO: 4161232 - RNA, 21 nt, Yersinia pestis
cauaacaccaauugcaggcuu

SEQ ID NO: 4161233 - RNA, 18 nt, Yersinia pestis
cauaacaggugcaguuuc

SEQ ID NO: 4161234 - RNA, 17 nt, Yersinia pestis
cauaacauccuaaaaag

SEQ ID NO: 4161235 - RNA, 16 nt, Yersinia pestis
cauaaccgcuaaggcc

SEQ ID NO: 4161236 - RNA, 20 nt, Yersinia pestis
cauaaccgguaccggcuggg

SEQ ID NO: 4161237 - RNA, 16 nt, Yersinia pestis
cauaacgcuuuuucau

SEQ ID NO: 4161238 - RNA, 16 nt, Yersinia pestis
cauaacugcugugcau

SEQ ID NO: 4161239 - RNA, 16 nt, Yersinia pestis
cauaagacaacgccgc

SEQ ID NO: 4161240 - RNA, 16 nt, Yersinia pestis
cauaagauaacgggca

SEQ ID NO: 4161241 - RNA, 19 nt, Yersinia pestis
cauaagcgacgacauuaau

SEQ ID NO: 4161242 - RNA, 21 nt, Yersinia pestis
cauaagcggacauggcaacag

SEQ ID NO: 4161243 - RNA, 19 nt, Yersinia pestis
cauaagcgggguauuuuac

SEQ ID NO: 4161244 - RNA, 18 nt, Yersinia pestis
cauaaguccuuaaaaauc

SEQ ID NO: 4161245 - RNA, 23 nt, Yersinia pestis
cauaagugcauuuuugaaacuuu

SEQ ID NO: 4161246 - RNA, 18 nt, Yersinia pestis
cauaauaaccauuuauau

SEQ ID NO: 4161247 - RNA, 16 nt, Yersinia pestis
cauaauauagcugaau

SEQ ID NO: 4161248 - RNA, 20 nt, Yersinia pestis
cauaaucaacgcucaaucac

SEQ ID NO: 4161249 - RNA, 14 nt, Yersinia pestis
cauaaucagccugc

SEQ ID NO: 4161250 - RNA, 16 nt, Yersinia pestis
cauaaucuuuacugca

SEQ ID NO: 4161251 - RNA, 18 nt, Yersinia pestis
cauaaugagguuauccaa

SEQ ID NO: 4161252 - RNA, 20 nt, Yersinia pestis
cauaaugcauccacuuuuuc

SEQ ID NO: 4161253 - RNA, 16 nt, Yersinia pestis
cauaaugccggcggcc

SEQ ID NO: 4161254 - RNA, 23 nt, Yersinia pestis
cauaaugcggcucucuuucucca

SEQ ID NO: 4161255 - RNA, 15 nt, Yersinia pestis
cauaauuaaauauua

SEQ ID NO: 4161256 - RNA, 22 nt, Yersinia pestis
cauaauuaaauauuaacauuaa

SEQ ID NO: 4161257 - RNA, 13 nt, Yersinia pestis
cauaauucagcaa

SEQ ID NO: 4161258 - RNA, 16 nt, Yersinia pestis
cauaauuccacauaaa

SEQ ID NO: 4161259 - RNA, 18 nt, Yersinia pestis
cauaauuccacauaaaau

SEQ ID NO: 4161260 - RNA, 20 nt, Yersinia pestis
cauaauuuugaugcuaauuu

SEQ ID NO: 4161261 - RNA, 19 nt, Yersinia pestis
cauacaaauaguaauaauu

SEQ ID NO: 4161262 - RNA, 15 nt, Yersinia pestis
cauacaaccauuuca

SEQ ID NO: 4161263 - RNA, 19 nt, Yersinia pestis
cauacaagccgugaccaaa

SEQ ID NO: 4161264 - RNA, 21 nt, Yersinia pestis
cauacacuaagugcaucaauc

SEQ ID NO: 4161265 - RNA, 18 nt, Yersinia pestis
cauacagcucaucaccaa

SEQ ID NO: 4161266 - RNA, 19 nt, Yersinia pestis
cauacagguguaccgcuuc

SEQ ID NO: 4161267 - RNA, 11 nt, Yersinia pestis
cauacauuggc

SEQ ID NO: 4161268 - RNA, 17 nt, Yersinia pestis
cauacccgcuguacugc

SEQ ID NO: 4161269 - RNA, 13 nt, Yersinia pestis
cauaccuggauca

SEQ ID NO: 4161270 - RNA, 17 nt, Yersinia pestis
cauaccuguacuuugau

SEQ ID NO: 4161271 - RNA, 12 nt, Yersinia pestis
cauaccuuaauu

SEQ ID NO: 4161272 - RNA, 15 nt, Yersinia pestis
cauaccuuacuucca

SEQ ID NO: 4161273 - RNA, 15 nt, Yersinia pestis
cauacgcagccugaa

SEQ ID NO: 4161274 - RNA, 23 nt, Yersinia pestis
cauacgcagccugaauuuccugc

SEQ ID NO: 4161275 - RNA, 20 nt, Yersinia pestis
cauacgcuuaaccagcacuu

SEQ ID NO: 4161276 - RNA, 14 nt, Yersinia pestis
cauacgucuccauu

SEQ ID NO: 4161277 - RNA, 20 nt, Yersinia pestis
cauacgucuccauuucaacg

SEQ ID NO: 4161278 - RNA, 13 nt, Yersinia pestis
cauacucccccau

SEQ ID NO: 4161279 - RNA, 22 nt, Yersinia pestis
cauacucccccauuuccugugu

SEQ ID NO: 4161280 - RNA, 21 nt, Yersinia pestis
cauacuccuuaaucguccggu

SEQ ID NO: 4161281 - RNA, 13 nt, Yersinia pestis
cauacugcagaau

SEQ ID NO: 4161282 - RNA, 22 nt, Yersinia pestis
cauacuguugugggaucuuggc

SEQ ID NO: 4161283 - RNA, 22 nt, Yersinia pestis
cauagaagaagaauugcagaua

SEQ ID NO: 4161284 - RNA, 12 nt, Yersinia pestis
cauagaauuuaa

SEQ ID NO: 4161285 - RNA, 12 nt, Yersinia pestis
cauagagagaaa

SEQ ID NO: 4161286 - RNA, 19 nt, Yersinia pestis
cauagagagaacagcgaau

SEQ ID NO: 4161287 - RNA, 19 nt, Yersinia pestis
cauagaugcaaaugucaga

SEQ ID NO: 4161288 - RNA, 20 nt, Yersinia pestis
cauagcacccaauguauaug

SEQ ID NO: 4161289 - RNA, 16 nt, Yersinia pestis
cauagccauggcuucu

SEQ ID NO: 4161290 - RNA, 15 nt, Yersinia pestis
cauagcgugauuuuu

SEQ ID NO: 4161291 - RNA, 17 nt, Yersinia pestis
cauagcgugauuuuuau

SEQ ID NO: 4161292 - RNA, 14 nt, Yersinia pestis
cauagcuaaccuua

SEQ ID NO: 4161293 - RNA, 22 nt, Yersinia pestis
cauagggcugaauaucauuaug

SEQ ID NO: 4161294 - RNA, 17 nt, Yersinia pestis
cauaggucuuuacgcag

SEQ ID NO: 4161295 - RNA, 20 nt, Yersinia pestis
cauagguuggggaugccauu

SEQ ID NO: 4161296 - RNA, 13 nt, Yersinia pestis
cauaguccaacgc

SEQ ID NO: 4161297 - RNA, 22 nt, Yersinia pestis
cauaguccaacgcacugguugc

SEQ ID NO: 4161298 - RNA, 23 nt, Yersinia pestis
cauagugcaaaauuccaccauuc

SEQ ID NO: 4161299 - RNA, 21 nt, Yersinia pestis
cauaguuucaauaugcucugc

SEQ ID NO: 4161300 - RNA, 17 nt, Yersinia pestis
cauauaaaacacgcaua

SEQ ID NO: 4161301 - RNA, 12 nt, Yersinia pestis
cauauaaaccag

SEQ ID NO: 4161302 - RNA, 14 nt, Yersinia pestis
cauauaaaccagcc

SEQ ID NO: 4161303 - RNA, 19 nt, Yersinia pestis
cauauaaaccagccaguga

SEQ ID NO: 4161304 - RNA, 16 nt, Yersinia pestis
cauauaagcaauaccg

SEQ ID NO: 4161305 - RNA, 14 nt, Yersinia pestis
cauauaaucauacu

SEQ ID NO: 4161306 - RNA, 17 nt, Yersinia pestis
cauauacccaaagccag

SEQ ID NO: 4161307 - RNA, 15 nt, Yersinia pestis
cauauacuggagcua

SEQ ID NO: 4161308 - RNA, 22 nt, Yersinia pestis
cauauagcggcguucagcaaua

SEQ ID NO: 4161309 - RNA, 24 nt, Yersinia pestis
cauauagcggcguucagcaauaug

SEQ ID NO: 4161310 - RNA, 17 nt, Yersinia pestis
cauauaucacuauuuca

SEQ ID NO: 4161311 - RNA, 22 nt, Yersinia pestis
cauauaucacuauuucaggcau

SEQ ID NO: 4161312 - RNA, 21 nt, Yersinia pestis
cauauauugauccaaauggcu

SEQ ID NO: 4161313 - RNA, 20 nt, Yersinia pestis
cauauauuuuucuuucucga

SEQ ID NO: 4161314 - RNA, 19 nt, Yersinia pestis
cauaucaaaaggauaaccu

SEQ ID NO: 4161315 - RNA, 16 nt, Yersinia pestis
cauaucaaaauaaaaa

SEQ ID NO: 4161316 - RNA, 16 nt, Yersinia pestis
cauaucaacacugccu

SEQ ID NO: 4161317 - RNA, 22 nt, Yersinia pestis
cauaucacaguuaaaaauagac

SEQ ID NO: 4161318 - RNA, 21 nt, Yersinia pestis
cauaucagaaccaagcaauag

SEQ ID NO: 4161319 - RNA, 18 nt, Yersinia pestis
cauaucagcaaugacggu

SEQ ID NO: 4161320 - RNA, 22 nt, Yersinia pestis
cauauccaaagauaucuuugag

SEQ ID NO: 4161321 - RNA, 16 nt, Yersinia pestis
cauauccgaugauaua

SEQ ID NO: 4161322 - RNA, 16 nt, Yersinia pestis
cauauccgguuguuca

SEQ ID NO: 4161323 - RNA, 17 nt, Yersinia pestis
cauauccucgagaugua

SEQ ID NO: 4161324 - RNA, 23 nt, Yersinia pestis
cauaucgaucaaccauucauacu

SEQ ID NO: 4161325 - RNA, 13 nt, Yersinia pestis
cauaucggccaag

SEQ ID NO: 4161326 - RNA, 13 nt, Yersinia pestis
cauaucguccaaa

SEQ ID NO: 4161327 - RNA, 15 nt, Yersinia pestis
cauaucguccaaagg

SEQ ID NO: 4161328 - RNA, 18 nt, Yersinia pestis
cauaucuccguugaaacc

SEQ ID NO: 4161329 - RNA, 22 nt, Yersinia pestis
cauaucuugaaccaauuuuucu

SEQ ID NO: 4161330 - RNA, 13 nt, Yersinia pestis
cauaugaaaaacc

SEQ ID NO: 4161331 - RNA, 15 nt, Yersinia pestis
cauaugaaaaaccuc

SEQ ID NO: 4161332 - RNA, 18 nt, Yersinia pestis
cauaugaaaaaccuccgg

SEQ ID NO: 4161333 - RNA, 15 nt, Yersinia pestis
cauaugaaugagcag

SEQ ID NO: 4161334 - RNA, 15 nt, Yersinia pestis
cauaugacaaauaag

SEQ ID NO: 4161335 - RNA, 16 nt, Yersinia pestis
cauaugaguuucaaau

SEQ ID NO: 4161336 - RNA, 19 nt, Yersinia pestis
cauaugcgccuauaaggcu

SEQ ID NO: 4161337 - RNA, 21 nt, Yersinia pestis
cauaugcgcgucaauccacuc

SEQ ID NO: 4161338 - RNA, 14 nt, Yersinia pestis
cauauggaugaugc

SEQ ID NO: 4161339 - RNA, 18 nt, Yersinia pestis
cauauggaugaugcacag

SEQ ID NO: 4161340 - RNA, 15 nt, Yersinia pestis
cauauuaaaugcauu

SEQ ID NO: 4161341 - RNA, 23 nt, Yersinia pestis
cauauuaaaugcauuauaaggaa

SEQ ID NO: 4161342 - RNA, 21 nt, Yersinia pestis
cauauuaacauaucaauaagu

SEQ ID NO: 4161343 - RNA, 17 nt, Yersinia pestis
cauauuaccgcugaaaa

SEQ ID NO: 4161344 - RNA, 14 nt, Yersinia pestis
cauauuacucacac

SEQ ID NO: 4161345 - RNA, 17 nt, Yersinia pestis
cauauuauuaaugaaau

SEQ ID NO: 4161346 - RNA, 13 nt, Yersinia pestis
cauauuauuuaca

SEQ ID NO: 4161347 - RNA, 11 nt, Yersinia pestis
cauauuauuug

SEQ ID NO: 4161348 - RNA, 14 nt, Yersinia pestis
cauauucaaccgcc

SEQ ID NO: 4161349 - RNA, 13 nt, Yersinia pestis
cauauucaccaca

SEQ ID NO: 4161350 - RNA, 20 nt, Yersinia pestis
cauauucaccacacauacca

SEQ ID NO: 4161351 - RNA, 12 nt, Yersinia pestis
cauauuggccag

SEQ ID NO: 4161352 - RNA, 17 nt, Yersinia pestis
cauauuggccaguugcc

SEQ ID NO: 4161353 - RNA, 16 nt, Yersinia pestis
cauauuggugcgguua

SEQ ID NO: 4161354 - RNA, 18 nt, Yersinia pestis
cauauuguccaaaggaag

SEQ ID NO: 4161355 - RNA, 20 nt, Yersinia pestis
cauauuguccaaaggaaggg

SEQ ID NO: 4161356 - RNA, 14 nt, Yersinia pestis
cauauuuaacugac

SEQ ID NO: 4161357 - RNA, 16 nt, Yersinia pestis
cauauuucucuuuccg

SEQ ID NO: 4161358 - RNA, 19 nt, Yersinia pestis
cauauuucucuuuccgcuc

SEQ ID NO: 4161359 - RNA, 13 nt, Yersinia pestis
cauauuuuaaaua

SEQ ID NO: 4161360 - RNA, 17 nt, Yersinia pestis
cauauuuuuuagaucuc

SEQ ID NO: 4161361 - RNA, 11 nt, Yersinia pestis
caucaaaggag

SEQ ID NO: 4161362 - RNA, 20 nt, Yersinia pestis
caucaaaggagugcccggca

SEQ ID NO: 4161363 - RNA, 17 nt, Yersinia pestis
caucaaaggcaauaccg

SEQ ID NO: 4161364 - RNA, 18 nt, Yersinia pestis
caucaaaggcaauaccgg

SEQ ID NO: 4161365 - RNA, 14 nt, Yersinia pestis
caucaaauacacga

SEQ ID NO: 4161366 - RNA, 14 nt, Yersinia pestis
caucaacauacuga

SEQ ID NO: 4161367 - RNA, 22 nt, Yersinia pestis
caucaaccgggauaucaaauuc

SEQ ID NO: 4161368 - RNA, 22 nt, Yersinia pestis
caucaaccucagccucauucau

SEQ ID NO: 4161369 - RNA, 12 nt, Yersinia pestis
caucaaccugau

SEQ ID NO: 4161370 - RNA, 16 nt, Yersinia pestis
caucaacucgccaccc

SEQ ID NO: 4161371 - RNA, 16 nt, Yersinia pestis
caucaacuucugcaaa

SEQ ID NO: 4161372 - RNA, 16 nt, Yersinia pestis
caucaagccaccgcug

SEQ ID NO: 4161373 - RNA, 17 nt, Yersinia pestis
caucaaguacuucaauu

SEQ ID NO: 4161374 - RNA, 16 nt, Yersinia pestis
caucaagugaaccauc

SEQ ID NO: 4161375 - RNA, 14 nt, Yersinia pestis
caucaauaaaauua

SEQ ID NO: 4161376 - RNA, 13 nt, Yersinia pestis
caucaauaacggu

SEQ ID NO: 4161377 - RNA, 12 nt, Yersinia pestis
caucaauaccaa

SEQ ID NO: 4161378 - RNA, 22 nt, Yersinia pestis
caucaaucgucaauccaaucau

SEQ ID NO: 4161379 - RNA, 16 nt, Yersinia pestis
caucaaugauucgcug

SEQ ID NO: 4161380 - RNA, 20 nt, Yersinia pestis
caucaaugauucgcugaaca

SEQ ID NO: 4161381 - RNA, 21 nt, Yersinia pestis
caucaauggauucuugcugca

SEQ ID NO: 4161382 - RNA, 22 nt, Yersinia pestis
caucaauggcaccucaucccaa

SEQ ID NO: 4161383 - RNA, 23 nt, Yersinia pestis
caucacaaauauuggcccacugg

SEQ ID NO: 4161384 - RNA, 18 nt, Yersinia pestis
caucacacuuguuugccc

SEQ ID NO: 4161385 - RNA, 22 nt, Yersinia pestis
caucacagaacaucugccaggc

SEQ ID NO: 4161386 - RNA, 20 nt, Yersinia pestis
caucacauccgaucagccag

SEQ ID NO: 4161387 - RNA, 13 nt, Yersinia pestis
caucaccacccug

SEQ ID NO: 4161388 - RNA, 20 nt, Yersinia pestis
caucacccagcaaaauagca

SEQ ID NO: 4161389 - RNA, 21 nt, Yersinia pestis
caucacccguuuucccaguaa

SEQ ID NO: 4161390 - RNA, 16 nt, Yersinia pestis
caucaccgcuaucacu

SEQ ID NO: 4161391 - RNA, 18 nt, Yersinia pestis
caucacgauagccaguga

SEQ ID NO: 4161392 - RNA, 23 nt, Yersinia pestis
caucacgcagugcaucuuccaau

SEQ ID NO: 4161393 - RNA, 18 nt, Yersinia pestis
caucacugcuauuuaccc

SEQ ID NO: 4161394 - RNA, 20 nt, Yersinia pestis
caucacuggcgggccguuua

SEQ ID NO: 4161395 - RNA, 19 nt, Yersinia pestis
caucacugucuauuuuuau

SEQ ID NO: 4161396 - RNA, 14 nt, Yersinia pestis
caucagacagccau

SEQ ID NO: 4161397 - RNA, 13 nt, Yersinia pestis
caucagacauauu

SEQ ID NO: 4161398 - RNA, 14 nt, Yersinia pestis
caucagacugcucu

SEQ ID NO: 4161399 - RNA, 18 nt, Yersinia pestis
caucagacugcucuuucc

SEQ ID NO: 4161400 - RNA, 21 nt, Yersinia pestis
caucagacugcucuuucccuu

SEQ ID NO: 4161401 - RNA, 22 nt, Yersinia pestis
caucagaucguuaaacccggca

SEQ ID NO: 4161402 - RNA, 18 nt, Yersinia pestis
caucagcaaaguauuuau

SEQ ID NO: 4161403 - RNA, 18 nt, Yersinia pestis
caucagcaagugauagau

SEQ ID NO: 4161404 - RNA, 21 nt, Yersinia pestis
caucagcagagagcgacucac

SEQ ID NO: 4161405 - RNA, 23 nt, Yersinia pestis
caucagcauauuacccaguacug

SEQ ID NO: 4161406 - RNA, 17 nt, Yersinia pestis
caucagcaucaauaaaa

SEQ ID NO: 4161407 - RNA, 16 nt, Yersinia pestis
caucagccagccacug

SEQ ID NO: 4161408 - RNA, 17 nt, Yersinia pestis
caucagcccauugcugu

SEQ ID NO: 4161409 - RNA, 15 nt, Yersinia pestis
caucagccucuaaca

SEQ ID NO: 4161410 - RNA, 21 nt, Yersinia pestis
caucagcgauucauugagcaa

SEQ ID NO: 4161411 - RNA, 18 nt, Yersinia pestis
caucagcgccgccucuuc

SEQ ID NO: 4161412 - RNA, 19 nt, Yersinia pestis
caucagcgccuuugccccg

SEQ ID NO: 4161413 - RNA, 14 nt, Yersinia pestis
caucagcgcuggcu

SEQ ID NO: 4161414 - RNA, 19 nt, Yersinia pestis
caucagggaauucaccggc

SEQ ID NO: 4161415 - RNA, 22 nt, Yersinia pestis
caucagggaauugacuaaauuu

SEQ ID NO: 4161416 - RNA, 18 nt, Yersinia pestis
caucagguuguauuuugc

SEQ ID NO: 4161417 - RNA, 19 nt, Yersinia pestis
caucagguuguauuuugca

SEQ ID NO: 4161418 - RNA, 14 nt, Yersinia pestis
caucagugggauag

SEQ ID NO: 4161419 - RNA, 12 nt, Yersinia pestis
caucaguucacu

SEQ ID NO: 4161420 - RNA, 19 nt, Yersinia pestis
caucauaaaaauacauauc

SEQ ID NO: 4161421 - RNA, 20 nt, Yersinia pestis
caucauaagacuaacagaau

SEQ ID NO: 4161422 - RNA, 12 nt, Yersinia pestis
caucauacugac

SEQ ID NO: 4161423 - RNA, 13 nt, Yersinia pestis
caucauaucgaug

SEQ ID NO: 4161424 - RNA, 18 nt, Yersinia pestis
caucauaucgaugacagc

SEQ ID NO: 4161425 - RNA, 17 nt, Yersinia pestis
caucaucaaaaccgaug

SEQ ID NO: 4161426 - RNA, 22 nt, Yersinia pestis
caucaucaaaaccgaugaguga

SEQ ID NO: 4161427 - RNA, 13 nt, Yersinia pestis
caucaucaaugga

SEQ ID NO: 4161428 - RNA, 19 nt, Yersinia pestis
caucaucaauuaauacccu

SEQ ID NO: 4161429 - RNA, 21 nt, Yersinia pestis
caucaucacauucaaacacuu

SEQ ID NO: 4161430 - RNA, 15 nt, Yersinia pestis
caucauccacuagca

SEQ ID NO: 4161431 - RNA, 20 nt, Yersinia pestis
caucauccagcucaacgacc

SEQ ID NO: 4161432 - RNA, 13 nt, Yersinia pestis
caucauccauaaa

SEQ ID NO: 4161433 - RNA, 12 nt, Yersinia pestis
caucaucccagu

SEQ ID NO: 4161434 - RNA, 20 nt, Yersinia pestis
caucaucccagucgucuuca

SEQ ID NO: 4161435 - RNA, 22 nt, Yersinia pestis
caucaucuucaaccuggaacca

SEQ ID NO: 4161436 - RNA, 12 nt, Yersinia pestis
caucaucuucuu

SEQ ID NO: 4161437 - RNA, 15 nt, Yersinia pestis
caucaucuucuucau

SEQ ID NO: 4161438 - RNA, 13 nt, Yersinia pestis
caucaugacaaaa

SEQ ID NO: 4161439 - RNA, 16 nt, Yersinia pestis
caucaugaucugauac

SEQ ID NO: 4161440 - RNA, 15 nt, Yersinia pestis
caucauuauuaugua

SEQ ID NO: 4161441 - RNA, 14 nt, Yersinia pestis
caucauuugagcug

SEQ ID NO: 4161442 - RNA, 22 nt, Yersinia pestis
caucauuuuuuaucuuguaaau

SEQ ID NO: 4161443 - RNA, 15 nt, Yersinia pestis
cauccaaauagccuu

SEQ ID NO: 4161444 - RNA, 17 nt, Yersinia pestis
cauccaagccaucauua

SEQ ID NO: 4161445 - RNA, 20 nt, Yersinia pestis
cauccaauaccaccaaugcg

SEQ ID NO: 4161446 - RNA, 20 nt, Yersinia pestis
cauccaauuuuuucaucaua

SEQ ID NO: 4161447 - RNA, 12 nt, Yersinia pestis
cauccacaucuu

SEQ ID NO: 4161448 - RNA, 19 nt, Yersinia pestis
cauccacaucuugcgccga

SEQ ID NO: 4161449 - RNA, 15 nt, Yersinia pestis
cauccacugcggcca

SEQ ID NO: 4161450 - RNA, 23 nt, Yersinia pestis
cauccagcguaaacaguagcagg

SEQ ID NO: 4161451 - RNA, 17 nt, Yersinia pestis
cauccagcucauauaau

SEQ ID NO: 4161452 - RNA, 15 nt, Yersinia pestis
cauccaguaagcugu

SEQ ID NO: 4161453 - RNA, 17 nt, Yersinia pestis
cauccauaaguauuuau

SEQ ID NO: 4161454 - RNA, 20 nt, Yersinia pestis
cauccauaaguauuuauucc

SEQ ID NO: 4161455 - RNA, 15 nt, Yersinia pestis
cauccaugccauggc

SEQ ID NO: 4161456 - RNA, 18 nt, Yersinia pestis
cauccaugggccucgcuu

SEQ ID NO: 4161457 - RNA, 20 nt, Yersinia pestis
cauccauguaggcucgagcc

SEQ ID NO: 4161458 - RNA, 13 nt, Yersinia pestis
cauccauuguauu

SEQ ID NO: 4161459 - RNA, 14 nt, Yersinia pestis
cauccauuguauug

SEQ ID NO: 4161460 - RNA, 20 nt, Yersinia pestis
cauccauuguauugcucagg

SEQ ID NO: 4161461 - RNA, 22 nt, Yersinia pestis
cauccauuguauugcucagggc

SEQ ID NO: 4161462 - RNA, 22 nt, Yersinia pestis
caucccaaaauagccagcccca

SEQ ID NO: 4161463 - RNA, 16 nt, Yersinia pestis
caucccaacgcaggca

SEQ ID NO: 4161464 - RNA, 23 nt, Yersinia pestis
caucccaagagaacggagagaac

SEQ ID NO: 4161465 - RNA, 14 nt, Yersinia pestis
caucccaauaauua

SEQ ID NO: 4161466 - RNA, 11 nt, Yersinia pestis
caucccagcac

SEQ ID NO: 4161467 - RNA, 13 nt, Yersinia pestis
caucccagccacc

SEQ ID NO: 4161468 - RNA, 19 nt, Yersinia pestis
caucccagccaccaugggu

SEQ ID NO: 4161469 - RNA, 16 nt, Yersinia pestis
caucccaggcauccuu

SEQ ID NO: 4161470 - RNA, 14 nt, Yersinia pestis
caucccauaugcua

SEQ ID NO: 4161471 - RNA, 18 nt, Yersinia pestis
caucccauugcaggauaa

SEQ ID NO: 4161472 - RNA, 22 nt, Yersinia pestis
cauccccaaacgcugaccaugg

SEQ ID NO: 4161473 - RNA, 19 nt, Yersinia pestis
cauccccacugacaucauu

SEQ ID NO: 4161474 - RNA, 19 nt, Yersinia pestis
cauccccacuuguaccugu

SEQ ID NO: 4161475 - RNA, 11 nt, Yersinia pestis
cauccccagaa

SEQ ID NO: 4161476 - RNA, 16 nt, Yersinia pestis
cauccccaucgccaau

SEQ ID NO: 4161477 - RNA, 14 nt, Yersinia pestis
caucccuuaaccac

SEQ ID NO: 4161478 - RNA, 18 nt, Yersinia pestis
caucccuugacugaccau

SEQ ID NO: 4161479 - RNA, 17 nt, Yersinia pestis
cauccgaauuuuuacug

SEQ ID NO: 4161480 - RNA, 15 nt, Yersinia pestis
cauccgcauaaguua

SEQ ID NO: 4161481 - RNA, 13 nt, Yersinia pestis
cauccgcuugcag

SEQ ID NO: 4161482 - RNA, 16 nt, Yersinia pestis
cauccgcuugcagcaa

SEQ ID NO: 4161483 - RNA, 13 nt, Yersinia pestis
cauccggguuuau

SEQ ID NO: 4161484 - RNA, 15 nt, Yersinia pestis
cauccguauuauuug

SEQ ID NO: 4161485 - RNA, 15 nt, Yersinia pestis
cauccguccaaugaa

SEQ ID NO: 4161486 - RNA, 17 nt, Yersinia pestis
cauccguccaaugaaua

SEQ ID NO: 4161487 - RNA, 22 nt, Yersinia pestis
cauccuaaagauaauuaauuca

SEQ ID NO: 4161488 - RNA, 15 nt, Yersinia pestis
cauccucaggaugga

SEQ ID NO: 4161489 - RNA, 23 nt, Yersinia pestis
cauccuccugaucuucauugccu

SEQ ID NO: 4161490 - RNA, 16 nt, Yersinia pestis
cauccugaacuuccug

SEQ ID NO: 4161491 - RNA, 19 nt, Yersinia pestis
cauccugaauccccgcuuc

SEQ ID NO: 4161492 - RNA, 14 nt, Yersinia pestis
cauccugcaaauuu

SEQ ID NO: 4161493 - RNA, 16 nt, Yersinia pestis
cauccuguucaaaagg

SEQ ID NO: 4161494 - RNA, 18 nt, Yersinia pestis
cauccuuuacuccccugc

SEQ ID NO: 4161495 - RNA, 15 nt, Yersinia pestis
caucgaaaaaaauac

SEQ ID NO: 4161496 - RNA, 19 nt, Yersinia pestis
caucgaacgcgucacuggc

SEQ ID NO: 4161497 - RNA, 20 nt, Yersinia pestis
caucgaacgcgucacuggcc

SEQ ID NO: 4161498 - RNA, 14 nt, Yersinia pestis
caucgacaauggcu

SEQ ID NO: 4161499 - RNA, 21 nt, Yersinia pestis
caucgacaccaagacugaagu

SEQ ID NO: 4161500 - RNA, 18 nt, Yersinia pestis
caucgacgcgccauaagc

SEQ ID NO: 4161501 - RNA, 19 nt, Yersinia pestis
caucgagcgggcuucacca

SEQ ID NO: 4161502 - RNA, 20 nt, Yersinia pestis
caucgaguccguuaaaaaau

SEQ ID NO: 4161503 - RNA, 21 nt, Yersinia pestis
caucgaguccguuaaaaaauu

SEQ ID NO: 4161504 - RNA, 20 nt, Yersinia pestis
caucgccaauacaaucguca

SEQ ID NO: 4161505 - RNA, 18 nt, Yersinia pestis
caucgccguuuugccauu

SEQ ID NO: 4161506 - RNA, 17 nt, Yersinia pestis
caucgccuucuggcaaa

SEQ ID NO: 4161507 - RNA, 23 nt, Yersinia pestis
caucgcgccuaccugccugcugc

SEQ ID NO: 4161508 - RNA, 15 nt, Yersinia pestis
caucgcgcuuuuuag

SEQ ID NO: 4161509 - RNA, 17 nt, Yersinia pestis
caucgcggcgcacauca

SEQ ID NO: 4161510 - RNA, 18 nt, Yersinia pestis
caucgcgggcgcgcugcu

SEQ ID NO: 4161511 - RNA, 17 nt, Yersinia pestis
caucgcucuccugcccu

SEQ ID NO: 4161512 - RNA, 20 nt, Yersinia pestis
caucgcugaggucagugcug

SEQ ID NO: 4161513 - RNA, 22 nt, Yersinia pestis
caucggauugcaacaacgccag

SEQ ID NO: 4161514 - RNA, 15 nt, Yersinia pestis
caucggcaaaaacag

SEQ ID NO: 4161515 - RNA, 18 nt, Yersinia pestis
caucggcauucgcagcgc

SEQ ID NO: 4161516 - RNA, 15 nt, Yersinia pestis
caucggcguucggua

SEQ ID NO: 4161517 - RNA, 22 nt, Yersinia pestis
caucgggaacaggaucugcucc

SEQ ID NO: 4161518 - RNA, 23 nt, Yersinia pestis
caucgggaacaggaucugcuccu

SEQ ID NO: 4161519 - RNA, 14 nt, Yersinia pestis
caucgggaugcgcu

SEQ ID NO: 4161520 - RNA, 18 nt, Yersinia pestis
caucgggaugcgcucgcu

SEQ ID NO: 4161521 - RNA, 17 nt, Yersinia pestis
caucgggcuugucuugu

SEQ ID NO: 4161522 - RNA, 19 nt, Yersinia pestis
caucgggguuugucagcag

SEQ ID NO: 4161523 - RNA, 23 nt, Yersinia pestis
caucgguaaaucgcccaauguca

SEQ ID NO: 4161524 - RNA, 22 nt, Yersinia pestis
caucggucauuuuacgccuggc

SEQ ID NO: 4161525 - RNA, 19 nt, Yersinia pestis
caucgucacgaucaaccau

SEQ ID NO: 4161526 - RNA, 17 nt, Yersinia pestis
caucgucagaaccugca

SEQ ID NO: 4161527 - RNA, 15 nt, Yersinia pestis
caucgucagccccug

SEQ ID NO: 4161528 - RNA, 15 nt, Yersinia pestis
caucgucaugauuga

SEQ ID NO: 4161529 - RNA, 21 nt, Yersinia pestis
caucgucgcuguuacccaugg

SEQ ID NO: 4161530 - RNA, 12 nt, Yersinia pestis
caucguggcuuu

SEQ ID NO: 4161531 - RNA, 18 nt, Yersinia pestis
caucuaacugcacaauuu

SEQ ID NO: 4161532 - RNA, 21 nt, Yersinia pestis
caucuaccuguguugcgccau

SEQ ID NO: 4161533 - RNA, 14 nt, Yersinia pestis
caucuagcagugau

SEQ ID NO: 4161534 - RNA, 21 nt, Yersinia pestis
caucuagcucaagggcacagu

SEQ ID NO: 4161535 - RNA, 18 nt, Yersinia pestis
caucuaugggcuucgcca

SEQ ID NO: 4161536 - RNA, 15 nt, Yersinia pestis
caucuauugugucaa

SEQ ID NO: 4161537 - RNA, 23 nt, Yersinia pestis
caucucaugacaaagaauguuau

SEQ ID NO: 4161538 - RNA, 16 nt, Yersinia pestis
caucuccagaauauaa

SEQ ID NO: 4161539 - RNA, 18 nt, Yersinia pestis
caucuccagaauauaaaa

SEQ ID NO: 4161540 - RNA, 18 nt, Yersinia pestis
caucucggcguaaacaau

SEQ ID NO: 4161541 - RNA, 12 nt, Yersinia pestis
caucucggcuuu

SEQ ID NO: 4161542 - RNA, 15 nt, Yersinia pestis
caucugaaagcuuca

SEQ ID NO: 4161543 - RNA, 20 nt, Yersinia pestis
caucugggggcgcucggcag

SEQ ID NO: 4161544 - RNA, 15 nt, Yersinia pestis
caucuuccaaaggaa

SEQ ID NO: 4161545 - RNA, 16 nt, Yersinia pestis
caucuuccaaaggaag

SEQ ID NO: 4161546 - RNA, 18 nt, Yersinia pestis
caucuuccaaaggaaggg

SEQ ID NO: 4161547 - RNA, 15 nt, Yersinia pestis
caucuuccgucaguu

SEQ ID NO: 4161548 - RNA, 15 nt, Yersinia pestis
caucuucuucuuuaa

SEQ ID NO: 4161549 - RNA, 21 nt, Yersinia pestis
caucuucuucuuuaaccggua

SEQ ID NO: 4161550 - RNA, 13 nt, Yersinia pestis
caucuugaaaaua

SEQ ID NO: 4161551 - RNA, 15 nt, Yersinia pestis
caucuugcaacaacg

SEQ ID NO: 4161552 - RNA, 20 nt, Yersinia pestis
caucuugcgccgaaauaaaa

SEQ ID NO: 4161553 - RNA, 19 nt, Yersinia pestis
caucuuguucuaauaauaa

SEQ ID NO: 4161554 - RNA, 15 nt, Yersinia pestis
caucuuuaacaacaa

SEQ ID NO: 4161555 - RNA, 22 nt, Yersinia pestis
caucuuuaccccauugcaccaa

SEQ ID NO: 4161556 - RNA, 22 nt, Yersinia pestis
caucuuucaguuuuauuguaua

SEQ ID NO: 4161557 - RNA, 21 nt, Yersinia pestis
caucuuucucauuagcgucuu

SEQ ID NO: 4161558 - RNA, 17 nt, Yersinia pestis
caucuuuucauggguuu

SEQ ID NO: 4161559 - RNA, 12 nt, Yersinia pestis
caucuuuugcua

SEQ ID NO: 4161560 - RNA, 19 nt, Yersinia pestis
caucuuuuucugccugagu

SEQ ID NO: 4161561 - RNA, 22 nt, Yersinia pestis
caucuuuuuuuuuauuaucauc

SEQ ID NO: 4161562 - RNA, 15 nt, Yersinia pestis
caugaauauucacca

SEQ ID NO: 4161563 - RNA, 14 nt, Yersinia pestis
caugaaugaggcug

SEQ ID NO: 4161564 - RNA, 13 nt, Yersinia pestis
caugacaaaauac

SEQ ID NO: 4161565 - RNA, 17 nt, Yersinia pestis
caugacaaagaauguua

SEQ ID NO: 4161566 - RNA, 14 nt, Yersinia pestis
caugacaucccagc

SEQ ID NO: 4161567 - RNA, 20 nt, Yersinia pestis
caugacuagugccacaacaa

SEQ ID NO: 4161568 - RNA, 20 nt, Yersinia pestis
caugagaaccaguucuggua

SEQ ID NO: 4161569 - RNA, 20 nt, Yersinia pestis
caugagaaguuuuuggcgaa

SEQ ID NO: 4161570 - RNA, 20 nt, Yersinia pestis
caugagaauacuucaggcca

SEQ ID NO: 4161571 - RNA, 14 nt, Yersinia pestis
caugaguaaaagau

SEQ ID NO: 4161572 - RNA, 15 nt, Yersinia pestis
caugagugaaaauau

SEQ ID NO: 4161573 - RNA, 19 nt, Yersinia pestis
caugauaaaacuauucugc

SEQ ID NO: 4161574 - RNA, 20 nt, Yersinia pestis
caugauaaccacaacgacag

SEQ ID NO: 4161575 - RNA, 21 nt, Yersinia pestis
caugauagcuugggcgauagu

SEQ ID NO: 4161576 - RNA, 20 nt, Yersinia pestis
caugaugaauacgauaaaga

SEQ ID NO: 4161577 - RNA, 21 nt, Yersinia pestis
caugaugucgcgacucaagcc

SEQ ID NO: 4161578 - RNA, 18 nt, Yersinia pestis
caugauucguagaaacau

SEQ ID NO: 4161579 - RNA, 15 nt, Yersinia pestis
caugauucucuauuc

SEQ ID NO: 4161580 - RNA, 16 nt, Yersinia pestis
caugauuucucgcuuu

SEQ ID NO: 4161581 - RNA, 20 nt, Yersinia pestis
caugauuuguugaugaauga

SEQ ID NO: 4161582 - RNA, 12 nt, Yersinia pestis
caugcacaguug

SEQ ID NO: 4161583 - RNA, 21 nt, Yersinia pestis
caugcagcauuucaggaucga

SEQ ID NO: 4161584 - RNA, 21 nt, Yersinia pestis
caugcagcauuuucagcaacu

SEQ ID NO: 4161585 - RNA, 14 nt, Yersinia pestis
caugccaauuauuc

SEQ ID NO: 4161586 - RNA, 16 nt, Yersinia pestis
caugccaauuauucuc

SEQ ID NO: 4161587 - RNA, 15 nt, Yersinia pestis
caugccacuucgcua

SEQ ID NO: 4161588 - RNA, 15 nt, Yersinia pestis
caugcccagcguugg

SEQ ID NO: 4161589 - RNA, 17 nt, Yersinia pestis
caugcccauacacaguc

SEQ ID NO: 4161590 - RNA, 17 nt, Yersinia pestis
caugccuaauuugguac

SEQ ID NO: 4161591 - RNA, 17 nt, Yersinia pestis
caugccuugaaacucaa

SEQ ID NO: 4161592 - RNA, 14 nt, Yersinia pestis
caugcgauacgccc

SEQ ID NO: 4161593 - RNA, 19 nt, Yersinia pestis
caugcgauacgcccgcccc

SEQ ID NO: 4161594 - RNA, 20 nt, Yersinia pestis
caugcgaugcgagcaaggca

SEQ ID NO: 4161595 - RNA, 16 nt, Yersinia pestis
caugcggauugaacug

SEQ ID NO: 4161596 - RNA, 24 nt, Yersinia pestis
caugcggcgugggcaaucuccagu

SEQ ID NO: 4161597 - RNA, 14 nt, Yersinia pestis
caugcuaauaccac

SEQ ID NO: 4161598 - RNA, 19 nt, Yersinia pestis
caugcuaauaccacaacau

SEQ ID NO: 4161599 - RNA, 23 nt, Yersinia pestis
caugcucagaaaccugugugacc

SEQ ID NO: 4161600 - RNA, 19 nt, Yersinia pestis
caugcucugcuaauacgcu

SEQ ID NO: 4161601 - RNA, 15 nt, Yersinia pestis
caugcucuucauaag

SEQ ID NO: 4161602 - RNA, 18 nt, Yersinia pestis
caugcucuucauaagcca

SEQ ID NO: 4161603 - RNA, 13 nt, Yersinia pestis
caugcugauagca

SEQ ID NO: 4161604 - RNA, 14 nt, Yersinia pestis
caugcuggcggaua

SEQ ID NO: 4161605 - RNA, 14 nt, Yersinia pestis
caugcuuaaagccu

SEQ ID NO: 4161606 - RNA, 20 nt, Yersinia pestis
caugcuugucguauuuccag

SEQ ID NO: 4161607 - RNA, 16 nt, Yersinia pestis
cauggaagaccagaua

SEQ ID NO: 4161608 - RNA, 20 nt, Yersinia pestis
cauggauggucauaaaaucg

SEQ ID NO: 4161609 - RNA, 15 nt, Yersinia pestis
cauggauguauuuac

SEQ ID NO: 4161610 - RNA, 18 nt, Yersinia pestis
cauggauguauuuacggc

SEQ ID NO: 4161611 - RNA, 18 nt, Yersinia pestis
cauggccaugaaucaaau

SEQ ID NO: 4161612 - RNA, 19 nt, Yersinia pestis
cauggcgaucaccaguacg

SEQ ID NO: 4161613 - RNA, 18 nt, Yersinia pestis
cauggcggcagcacagag

SEQ ID NO: 4161614 - RNA, 15 nt, Yersinia pestis
cauggcucaccauaa

SEQ ID NO: 4161615 - RNA, 23 nt, Yersinia pestis
cauggcucaccauaaauucacag

SEQ ID NO: 4161616 - RNA, 14 nt, Yersinia pestis
cauggcugggaagg

SEQ ID NO: 4161617 - RNA, 16 nt, Yersinia pestis
cauggcuugugcagca

SEQ ID NO: 4161618 - RNA, 20 nt, Yersinia pestis
cauggcuuuuugcccgcgcu

SEQ ID NO: 4161619 - RNA, 13 nt, Yersinia pestis
caugggaaaucaa

SEQ ID NO: 4161620 - RNA, 22 nt, Yersinia pestis
caugggguuuauugguuauuuu

SEQ ID NO: 4161621 - RNA, 14 nt, Yersinia pestis
caugguaagaauaa

SEQ ID NO: 4161622 - RNA, 15 nt, Yersinia pestis
caugguaagaauaaa

SEQ ID NO: 4161623 - RNA, 19 nt, Yersinia pestis
caugguagccugcacggcu

SEQ ID NO: 4161624 - RNA, 19 nt, Yersinia pestis
cauggucaucgcuucacac

SEQ ID NO: 4161625 - RNA, 17 nt, Yersinia pestis
caugguugcuagcccaa

SEQ ID NO: 4161626 - RNA, 17 nt, Yersinia pestis
caugguuggcccaaucg

SEQ ID NO: 4161627 - RNA, 17 nt, Yersinia pestis
cauguaacacacagcag

SEQ ID NO: 4161628 - RNA, 11 nt, Yersinia pestis
cauguacaccg

SEQ ID NO: 4161629 - RNA, 15 nt, Yersinia pestis
cauguacuagaucac

SEQ ID NO: 4161630 - RNA, 20 nt, Yersinia pestis
cauguacuagaucacagacg

SEQ ID NO: 4161631 - RNA, 19 nt, Yersinia pestis
cauguaucccgcuugggua

SEQ ID NO: 4161632 - RNA, 20 nt, Yersinia pestis
caugucagacagcacgggcu

SEQ ID NO: 4161633 - RNA, 23 nt, Yersinia pestis
caugucagacagcacgggcuauc

SEQ ID NO: 4161634 - RNA, 16 nt, Yersinia pestis
caugucgccuuauugu

SEQ ID NO: 4161635 - RNA, 20 nt, Yersinia pestis
caugucggcagguaaugcau

SEQ ID NO: 4161636 - RNA, 12 nt, Yersinia pestis
caugugcaauua

SEQ ID NO: 4161637 - RNA, 18 nt, Yersinia pestis
caugugcaauuaaugcug

SEQ ID NO: 4161638 - RNA, 14 nt, Yersinia pestis
cauguguguucuug

SEQ ID NO: 4161639 - RNA, 21 nt, Yersinia pestis
cauguguuuguuuggauaaaa

SEQ ID NO: 4161640 - RNA, 21 nt, Yersinia pestis
cauguuauuagcguuacagcu

SEQ ID NO: 4161641 - RNA, 19 nt, Yersinia pestis
cauguucacccaguaacug

SEQ ID NO: 4161642 - RNA, 23 nt, Yersinia pestis
cauguugaaaucuauuguauaua

SEQ ID NO: 4161643 - RNA, 16 nt, Yersinia pestis
cauguugaguuuacgc

SEQ ID NO: 4161644 - RNA, 13 nt, Yersinia pestis
cauguugcaacau

SEQ ID NO: 4161645 - RNA, 22 nt, Yersinia pestis
cauguugugugugaagugugca

SEQ ID NO: 4161646 - RNA, 20 nt, Yersinia pestis
cauguuguugguggaacggu

SEQ ID NO: 4161647 - RNA, 14 nt, Yersinia pestis
cauuaaaagcaugc

SEQ ID NO: 4161648 - RNA, 12 nt, Yersinia pestis
cauuaaaauaac

SEQ ID NO: 4161649 - RNA, 12 nt, Yersinia pestis
cauuaaaggccg

SEQ ID NO: 4161650 - RNA, 17 nt, Yersinia pestis
cauuaaaugcuuuuugc

SEQ ID NO: 4161651 - RNA, 14 nt, Yersinia pestis
cauuaacaauauua

SEQ ID NO: 4161652 - RNA, 13 nt, Yersinia pestis
cauuaacaauguu

SEQ ID NO: 4161653 - RNA, 20 nt, Yersinia pestis
cauuaacaauguuauauuuc

SEQ ID NO: 4161654 - RNA, 16 nt, Yersinia pestis
cauuaacaauuacuuu

SEQ ID NO: 4161655 - RNA, 16 nt, Yersinia pestis
cauuaaccuaaaaacg

SEQ ID NO: 4161656 - RNA, 16 nt, Yersinia pestis
cauuaacucauuacag

SEQ ID NO: 4161657 - RNA, 22 nt, Yersinia pestis
cauuaagauaauagcuaaacau

SEQ ID NO: 4161658 - RNA, 12 nt, Yersinia pestis
cauuaagaugca

SEQ ID NO: 4161659 - RNA, 14 nt, Yersinia pestis
cauuaaggagugcc

SEQ ID NO: 4161660 - RNA, 17 nt, Yersinia pestis
cauuaauaccguuuucu

SEQ ID NO: 4161661 - RNA, 17 nt, Yersinia pestis
cauuaauagaaucugcu

SEQ ID NO: 4161662 - RNA, 20 nt, Yersinia pestis
cauuaauccucucuugaaau

SEQ ID NO: 4161663 - RNA, 17 nt, Yersinia pestis
cauuaauuaaucagaca

SEQ ID NO: 4161664 - RNA, 20 nt, Yersinia pestis
cauuacaagugccaaaugga

SEQ ID NO: 4161665 - RNA, 23 nt, Yersinia pestis
cauuacaggccccaauccaccac

SEQ ID NO: 4161666 - RNA, 14 nt, Yersinia pestis
cauuacauccuuag

SEQ ID NO: 4161667 - RNA, 18 nt, Yersinia pestis
cauuaccaaggaaaccac

SEQ ID NO: 4161668 - RNA, 15 nt, Yersinia pestis
cauuaccaauaccau

SEQ ID NO: 4161669 - RNA, 19 nt, Yersinia pestis
cauuaccccggcggcgggu

SEQ ID NO: 4161670 - RNA, 13 nt, Yersinia pestis
cauuacgccaccu

SEQ ID NO: 4161671 - RNA, 22 nt, Yersinia pestis
cauuacguaauaguaaaacagg

SEQ ID NO: 4161672 - RNA, 21 nt, Yersinia pestis
cauuacugcguucuucuugug

SEQ ID NO: 4161673 - RNA, 22 nt, Yersinia pestis
cauuacugcguucuucuugugg

SEQ ID NO: 4161674 - RNA, 21 nt, Yersinia pestis
cauuacuguccuuuaacucaa

SEQ ID NO: 4161675 - RNA, 17 nt, Yersinia pestis
cauuacuuugaauagca

SEQ ID NO: 4161676 - RNA, 16 nt, Yersinia pestis
cauuagcccaacggcu

SEQ ID NO: 4161677 - RNA, 15 nt, Yersinia pestis
cauuagcucaaauau

SEQ ID NO: 4161678 - RNA, 16 nt, Yersinia pestis
cauuagggccaccaga

SEQ ID NO: 4161679 - RNA, 20 nt, Yersinia pestis
cauuaguaaugggaucaaau

SEQ ID NO: 4161680 - RNA, 22 nt, Yersinia pestis
cauuauaaggaauauacuuuac

SEQ ID NO: 4161681 - RNA, 14 nt, Yersinia pestis
cauuauauagauuu

SEQ ID NO: 4161682 - RNA, 23 nt, Yersinia pestis
cauuaucuaaacaauugccuuug

SEQ ID NO: 4161683 - RNA, 23 nt, Yersinia pestis
cauuaucuuccauagauacacuc

SEQ ID NO: 4161684 - RNA, 14 nt, Yersinia pestis
cauuaucuuuaauu

SEQ ID NO: 4161685 - RNA, 12 nt, Yersinia pestis
cauuauguguca

SEQ ID NO: 4161686 - RNA, 15 nt, Yersinia pestis
cauuauuaccuaauu

SEQ ID NO: 4161687 - RNA, 12 nt, Yersinia pestis
cauuauuauuua

SEQ ID NO: 4161688 - RNA, 20 nt, Yersinia pestis
cauuauucaugaugccgagu

SEQ ID NO: 4161689 - RNA, 17 nt, Yersinia pestis
cauuauuugauauagac

SEQ ID NO: 4161690 - RNA, 13 nt, Yersinia pestis
cauucaaacacuu

SEQ ID NO: 4161691 - RNA, 14 nt, Yersinia pestis
cauucaauguaaaa

SEQ ID NO: 4161692 - RNA, 21 nt, Yersinia pestis
cauucacaccgcuacccgccc

SEQ ID NO: 4161693 - RNA, 16 nt, Yersinia pestis
cauucaccaccaccag

SEQ ID NO: 4161694 - RNA, 23 nt, Yersinia pestis
cauucaccugcccgucacucaga

SEQ ID NO: 4161695 - RNA, 14 nt, Yersinia pestis
cauucagaugcuga

SEQ ID NO: 4161696 - RNA, 10 nt, Yersinia pestis
cauucagcag

SEQ ID NO: 4161697 - RNA, 12 nt, Yersinia pestis
cauucagcagca

SEQ ID NO: 4161698 - RNA, 15 nt, Yersinia pestis
cauucaguacauaaa

SEQ ID NO: 4161699 - RNA, 18 nt, Yersinia pestis
cauucauaauugaagagu

SEQ ID NO: 4161700 - RNA, 15 nt, Yersinia pestis
cauucauaucuuuac

SEQ ID NO: 4161701 - RNA, 15 nt, Yersinia pestis
cauucaugaggcuca

SEQ ID NO: 4161702 - RNA, 19 nt, Yersinia pestis
cauucaugaggcucagacu

SEQ ID NO: 4161703 - RNA, 16 nt, Yersinia pestis
cauucaugaggcuucu

SEQ ID NO: 4161704 - RNA, 16 nt, Yersinia pestis
cauucauuuuaaaaaa

SEQ ID NO: 4161705 - RNA, 17 nt, Yersinia pestis
cauucauuuuaaaaaaa

SEQ ID NO: 4161706 - RNA, 18 nt, Yersinia pestis
cauucauuuuaaaaaaau

SEQ ID NO: 4161707 - RNA, 20 nt, Yersinia pestis
cauuccaauuagauuugagc

SEQ ID NO: 4161708 - RNA, 16 nt, Yersinia pestis
cauuccaguaaaaaaa

SEQ ID NO: 4161709 - RNA, 15 nt, Yersinia pestis
cauuccguuuaaacu

SEQ ID NO: 4161710 - RNA, 17 nt, Yersinia pestis
cauucgaaugauugacu

SEQ ID NO: 4161711 - RNA, 17 nt, Yersinia pestis
cauucgacggguuuuac

SEQ ID NO: 4161712 - RNA, 23 nt, Yersinia pestis
cauucgagcuaccggcauuggcu

SEQ ID NO: 4161713 - RNA, 23 nt, Yersinia pestis
cauucgcacaguuuucuuaaaau

SEQ ID NO: 4161714 - RNA, 19 nt, Yersinia pestis
cauucgcacgggcuuuaau

SEQ ID NO: 4161715 - RNA, 17 nt, Yersinia pestis
cauucgccugauaaaau

SEQ ID NO: 4161716 - RNA, 20 nt, Yersinia pestis
cauucuaguuugugcugcua

SEQ ID NO: 4161717 - RNA, 23 nt, Yersinia pestis
cauucuaguuugugcugcuaaua

SEQ ID NO: 4161718 - RNA, 16 nt, Yersinia pestis
cauucuaucauccuug

SEQ ID NO: 4161719 - RNA, 22 nt, Yersinia pestis
cauucucuacucgcucaccacu

SEQ ID NO: 4161720 - RNA, 16 nt, Yersinia pestis
cauucugagcaccaca

SEQ ID NO: 4161721 - RNA, 19 nt, Yersinia pestis
cauucugauagugauuuuu

SEQ ID NO: 4161722 - RNA, 20 nt, Yersinia pestis
cauucugauagugauuuuuu

SEQ ID NO: 4161723 - RNA, 18 nt, Yersinia pestis
cauucugcagauguauua

SEQ ID NO: 4161724 - RNA, 21 nt, Yersinia pestis
cauucuggggcgguuuuccuc

SEQ ID NO: 4161725 - RNA, 15 nt, Yersinia pestis
cauucugucaucaag

SEQ ID NO: 4161726 - RNA, 15 nt, Yersinia pestis
cauucuuuaucacac

SEQ ID NO: 4161727 - RNA, 17 nt, Yersinia pestis
cauucuuugguccucuu

SEQ ID NO: 4161728 - RNA, 12 nt, Yersinia pestis
cauugaccagcg

SEQ ID NO: 4161729 - RNA, 22 nt, Yersinia pestis
cauugacgauaucaauaaagaa

SEQ ID NO: 4161730 - RNA, 17 nt, Yersinia pestis
cauugagacccguuacu

SEQ ID NO: 4161731 - RNA, 22 nt, Yersinia pestis
cauugagcauaucaaucagcau

SEQ ID NO: 4161732 - RNA, 19 nt, Yersinia pestis
cauugaggguugucagcag

SEQ ID NO: 4161733 - RNA, 20 nt, Yersinia pestis
cauugaggguugucagcagu

SEQ ID NO: 4161734 - RNA, 23 nt, Yersinia pestis
cauugaggguugucagcagucug

SEQ ID NO: 4161735 - RNA, 15 nt, Yersinia pestis
cauugaggugguaaa

SEQ ID NO: 4161736 - RNA, 23 nt, Yersinia pestis
cauugagucacggauggaucccc

SEQ ID NO: 4161737 - RNA, 16 nt, Yersinia pestis
cauugauaaucuccau

SEQ ID NO: 4161738 - RNA, 22 nt, Yersinia pestis
cauugauaaucuccauugauuc

SEQ ID NO: 4161739 - RNA, 14 nt, Yersinia pestis
cauugauccucguu

SEQ ID NO: 4161740 - RNA, 20 nt, Yersinia pestis
cauugcacagguccaucagc

SEQ ID NO: 4161741 - RNA, 21 nt, Yersinia pestis
cauugccacgacgcagcucca

SEQ ID NO: 4161742 - RNA, 16 nt, Yersinia pestis
cauugccgaugucaau

SEQ ID NO: 4161743 - RNA, 17 nt, Yersinia pestis
cauugcgcuaacagcgu

SEQ ID NO: 4161744 - RNA, 20 nt, Yersinia pestis
cauugcguucaauacauggu

SEQ ID NO: 4161745 - RNA, 20 nt, Yersinia pestis
cauugcugcuguuauuacug

SEQ ID NO: 4161746 - RNA, 20 nt, Yersinia pestis
cauuggcgguuauuauuuac

SEQ ID NO: 4161747 - RNA, 18 nt, Yersinia pestis
cauuggcuugguuguuuc

SEQ ID NO: 4161748 - RNA, 21 nt, Yersinia pestis
cauuggcuuuuugcuggaacu

SEQ ID NO: 4161749 - RNA, 19 nt, Yersinia pestis
cauuggugucccaaacucu

SEQ ID NO: 4161750 - RNA, 22 nt, Yersinia pestis
cauuggugucccaaacucugga

SEQ ID NO: 4161751 - RNA, 13 nt, Yersinia pestis
cauuguaaaauaa

SEQ ID NO: 4161752 - RNA, 13 nt, Yersinia pestis
cauugucaccuga

SEQ ID NO: 4161753 - RNA, 21 nt, Yersinia pestis
cauugucauggccugaugcac

SEQ ID NO: 4161754 - RNA, 15 nt, Yersinia pestis
cauugucugcuggcc

SEQ ID NO: 4161755 - RNA, 21 nt, Yersinia pestis
cauugugcuuuuuggcaaacu

SEQ ID NO: 4161756 - RNA, 17 nt, Yersinia pestis
cauuguggcuaaaccca

SEQ ID NO: 4161757 - RNA, 13 nt, Yersinia pestis
cauuguucuuacu

SEQ ID NO: 4161758 - RNA, 17 nt, Yersinia pestis
cauuguuggcggugaca

SEQ ID NO: 4161759 - RNA, 23 nt, Yersinia pestis
cauuguuuggucgguaagcuggc

SEQ ID NO: 4161760 - RNA, 13 nt, Yersinia pestis
cauuuaaacacuc

SEQ ID NO: 4161761 - RNA, 23 nt, Yersinia pestis
cauuuauauaacgacuauuuauc

SEQ ID NO: 4161762 - RNA, 22 nt, Yersinia pestis
cauuuauauaguaacuauuuac

SEQ ID NO: 4161763 - RNA, 19 nt, Yersinia pestis
cauuuaucauauuaacaua

SEQ ID NO: 4161764 - RNA, 19 nt, Yersinia pestis
cauuuaucgccaagccagu

SEQ ID NO: 4161765 - RNA, 18 nt, Yersinia pestis
cauuuaucuaaaacugcc

SEQ ID NO: 4161766 - RNA, 18 nt, Yersinia pestis
cauuuauuacauuuacau

SEQ ID NO: 4161767 - RNA, 22 nt, Yersinia pestis
cauuuauugcggcuuagccacu

SEQ ID NO: 4161768 - RNA, 12 nt, Yersinia pestis
cauuuauuucca

SEQ ID NO: 4161769 - RNA, 21 nt, Yersinia pestis
cauuuauuuccacgacaugag

SEQ ID NO: 4161770 - RNA, 22 nt, Yersinia pestis
cauuucaggacugucuucaacu

SEQ ID NO: 4161771 - RNA, 14 nt, Yersinia pestis
cauuucauuaaaug

SEQ ID NO: 4161772 - RNA, 15 nt, Yersinia pestis
cauuucccccaccug

SEQ ID NO: 4161773 - RNA, 16 nt, Yersinia pestis
cauuucccgugcacug

SEQ ID NO: 4161774 - RNA, 17 nt, Yersinia pestis
cauuuccguuaacccaa

SEQ ID NO: 4161775 - RNA, 22 nt, Yersinia pestis
cauuuccguuaacccaaagccc

SEQ ID NO: 4161776 - RNA, 15 nt, Yersinia pestis
cauuuccuguauuuc

SEQ ID NO: 4161777 - RNA, 19 nt, Yersinia pestis
cauuucucaucgcuuuuuu

SEQ ID NO: 4161778 - RNA, 15 nt, Yersinia pestis
cauuucuuagaccac

SEQ ID NO: 4161779 - RNA, 15 nt, Yersinia pestis
cauuucuuauaucug

SEQ ID NO: 4161780 - RNA, 23 nt, Yersinia pestis
cauuucuuuuucaacucagcggc

SEQ ID NO: 4161781 - RNA, 14 nt, Yersinia pestis
cauuugaaaugcau

SEQ ID NO: 4161782 - RNA, 23 nt, Yersinia pestis
cauuugaccuccguaggccaacc

SEQ ID NO: 4161783 - RNA, 22 nt, Yersinia pestis
cauuugaguaaacauccggcug

SEQ ID NO: 4161784 - RNA, 17 nt, Yersinia pestis
cauuugcacagcauuua

SEQ ID NO: 4161785 - RNA, 13 nt, Yersinia pestis
cauuugcaucuau

SEQ ID NO: 4161786 - RNA, 18 nt, Yersinia pestis
cauuugcaucuauggauu

SEQ ID NO: 4161787 - RNA, 19 nt, Yersinia pestis
cauuugggugagggcaauu

SEQ ID NO: 4161788 - RNA, 18 nt, Yersinia pestis
cauuuguagccugucccu

SEQ ID NO: 4161789 - RNA, 17 nt, Yersinia pestis
cauuuguuaaucgcuga

SEQ ID NO: 4161790 - RNA, 14 nt, Yersinia pestis
cauuuuaaaaaaau

SEQ ID NO: 4161791 - RNA, 20 nt, Yersinia pestis
cauuuuaacaacccauuucc

SEQ ID NO: 4161792 - RNA, 18 nt, Yersinia pestis
cauuuuaaucucuccaug

SEQ ID NO: 4161793 - RNA, 23 nt, Yersinia pestis
cauuuuaaucucuccaugauaua

SEQ ID NO: 4161794 - RNA, 12 nt, Yersinia pestis
cauuuuacgccu

SEQ ID NO: 4161795 - RNA, 14 nt, Yersinia pestis
cauuuuagcuggca

SEQ ID NO: 4161796 - RNA, 17 nt, Yersinia pestis
cauuuuauccucuucca

SEQ ID NO: 4161797 - RNA, 18 nt, Yersinia pestis
cauuuuaucgugaauaaa

SEQ ID NO: 4161798 - RNA, 19 nt, Yersinia pestis
cauuuuaucgugaauaaaa

SEQ ID NO: 4161799 - RNA, 20 nt, Yersinia pestis
cauuuuaucgugaauaaaaa

SEQ ID NO: 4161800 - RNA, 18 nt, Yersinia pestis
cauuuuauuagacauaga

SEQ ID NO: 4161801 - RNA, 21 nt, Yersinia pestis
cauuuuauuagacauagagau

SEQ ID NO: 4161802 - RNA, 18 nt, Yersinia pestis
cauuuuauugccagaggg

SEQ ID NO: 4161803 - RNA, 21 nt, Yersinia pestis
cauuuucgaacuuaacuacug

SEQ ID NO: 4161804 - RNA, 12 nt, Yersinia pestis
cauuuugaccag

SEQ ID NO: 4161805 - RNA, 14 nt, Yersinia pestis
cauuuugaccagca

SEQ ID NO: 4161806 - RNA, 24 nt, Yersinia pestis
cauuuugaccagcauacgugccaa

SEQ ID NO: 4161807 - RNA, 17 nt, Yersinia pestis
cauuuuggccgcuuugg

SEQ ID NO: 4161808 - RNA, 19 nt, Yersinia pestis
cauuuugggcuugagcagu

SEQ ID NO: 4161809 - RNA, 23 nt, Yersinia pestis
cauuuuggguuugagcagugcgc

SEQ ID NO: 4161810 - RNA, 19 nt, Yersinia pestis
cauuuuuaaguggcaucag

SEQ ID NO: 4161811 - RNA, 14 nt, Yersinia pestis
cauuuuuauuuuau

SEQ ID NO: 4161812 - RNA, 14 nt, Yersinia pestis
cauuuuucuauuuc

SEQ ID NO: 4161813 - RNA, 19 nt, Yersinia pestis
cauuuuucucggggcaagg

SEQ ID NO: 4161814 - RNA, 13 nt, Yersinia pestis
cauuuuuugggau

SEQ ID NO: 4161815 - RNA, 15 nt, Yersinia pestis
cauuuuuuguaguga

SEQ ID NO: 4161816 - RNA, 17 nt, Yersinia pestis
cauuuuuuuauuaaguu

SEQ ID NO: 4161817 - RNA, 18 nt, Yersinia pestis
cauuuuuuuauuaaguuu

SEQ ID NO: 4161818 - RNA, 20 nt, Yersinia pestis
cauuuuuuuauuaaguuuuu

SEQ ID NO: 4161819 - RNA, 12 nt, Yersinia pestis
ccaaaacagccu

SEQ ID NO: 4161820 - RNA, 19 nt, Yersinia pestis
ccaaaacagccuaaggcca

SEQ ID NO: 4161821 - RNA, 15 nt, Yersinia pestis
ccaaaacaucggcca

SEQ ID NO: 4161822 - RNA, 15 nt, Yersinia pestis
ccaaaaccauuggaa

SEQ ID NO: 4161823 - RNA, 12 nt, Yersinia pestis
ccaaaaccggca

SEQ ID NO: 4161824 - RNA, 16 nt, Yersinia pestis
ccaaaacgccaccagc

SEQ ID NO: 4161825 - RNA, 15 nt, Yersinia pestis
ccaaaacucaugucc

SEQ ID NO: 4161826 - RNA, 18 nt, Yersinia pestis
ccaaaacucccuguuacg

SEQ ID NO: 4161827 - RNA, 24 nt, Yersinia pestis
ccaaaauaauucgaguagauucau

SEQ ID NO: 4161828 - RNA, 14 nt, Yersinia pestis
ccaaaauagccagc

SEQ ID NO: 4161829 - RNA, 19 nt, Yersinia pestis
ccaaaauuuagaagcccug

SEQ ID NO: 4161830 - RNA, 18 nt, Yersinia pestis
ccaaacauuuucaucuga

SEQ ID NO: 4161831 - RNA, 14 nt, Yersinia pestis
ccaaaccaaaaacu

SEQ ID NO: 4161832 - RNA, 22 nt, Yersinia pestis
ccaaaccauugguuaaguuuca

SEQ ID NO: 4161833 - RNA, 14 nt, Yersinia pestis
ccaaacgugcuacu

SEQ ID NO: 4161834 - RNA, 17 nt, Yersinia pestis
ccaaacugcucauaaag

SEQ ID NO: 4161835 - RNA, 18 nt, Yersinia pestis
ccaaacugcucauaaagc

SEQ ID NO: 4161836 - RNA, 16 nt, Yersinia pestis
ccaaagauaucuuuga

SEQ ID NO: 4161837 - RNA, 18 nt, Yersinia pestis
ccaaagauauguucuucc

SEQ ID NO: 4161838 - RNA, 21 nt, Yersinia pestis
ccaaagccgguaucaacucug

SEQ ID NO: 4161839 - RNA, 18 nt, Yersinia pestis
ccaaagccgucaguuccu

SEQ ID NO: 4161840 - RNA, 13 nt, Yersinia pestis
ccaaagcugcgcc

SEQ ID NO: 4161841 - RNA, 15 nt, Yersinia pestis
ccaaagcugcgccaa

SEQ ID NO: 4161842 - RNA, 19 nt, Yersinia pestis
ccaaagggagccauugcaa

SEQ ID NO: 4161843 - RNA, 14 nt, Yersinia pestis
ccaaaguagaacug

SEQ ID NO: 4161844 - RNA, 18 nt, Yersinia pestis
ccaaauaaauauccuccg

SEQ ID NO: 4161845 - RNA, 22 nt, Yersinia pestis
ccaaauacauauaaccaucaaa

SEQ ID NO: 4161846 - RNA, 14 nt, Yersinia pestis
ccaaaucagcaagc

SEQ ID NO: 4161847 - RNA, 17 nt, Yersinia pestis
ccaaaucagcaagcugc

SEQ ID NO: 4161848 - RNA, 20 nt, Yersinia pestis
ccaaaucagcaagcugcuca

SEQ ID NO: 4161849 - RNA, 22 nt, Yersinia pestis
ccaaaucaguaccaccaccaca

SEQ ID NO: 4161850 - RNA, 17 nt, Yersinia pestis
ccaaaucugccugauac

SEQ ID NO: 4161851 - RNA, 13 nt, Yersinia pestis
ccaaaugaaaaau

SEQ ID NO: 4161852 - RNA, 16 nt, Yersinia pestis
ccaaaugagaugggcc

SEQ ID NO: 4161853 - RNA, 16 nt, Yersinia pestis
ccaaaugcaaaccagg

SEQ ID NO: 4161854 - RNA, 20 nt, Yersinia pestis
ccaaaugcccauuaguaaug

SEQ ID NO: 4161855 - RNA, 19 nt, Yersinia pestis
ccaaaugcucagccaucuc

SEQ ID NO: 4161856 - RNA, 13 nt, Yersinia pestis
ccaaaugcugacu

SEQ ID NO: 4161857 - RNA, 13 nt, Yersinia pestis
ccaaaugguuagu

SEQ ID NO: 4161858 - RNA, 21 nt, Yersinia pestis
ccaaauguuggauaacccccu

SEQ ID NO: 4161859 - RNA, 23 nt, Yersinia pestis
ccaaauguuggauaacccccuga

SEQ ID NO: 4161860 - RNA, 20 nt, Yersinia pestis
ccaaauuacuuuaaagccaa

SEQ ID NO: 4161861 - RNA, 20 nt, Yersinia pestis
ccaacaacuggguggccagu

SEQ ID NO: 4161862 - RNA, 13 nt, Yersinia pestis
ccaacaauuugcg

SEQ ID NO: 4161863 - RNA, 16 nt, Yersinia pestis
ccaacaauuugcgccc

SEQ ID NO: 4161864 - RNA, 18 nt, Yersinia pestis
ccaacaauuugcgcccgc

SEQ ID NO: 4161865 - RNA, 13 nt, Yersinia pestis
ccaacaccaccau

SEQ ID NO: 4161866 - RNA, 21 nt, Yersinia pestis
ccaacacuccucuuucuuaau

SEQ ID NO: 4161867 - RNA, 16 nt, Yersinia pestis
ccaacagacucacucu

SEQ ID NO: 4161868 - RNA, 18 nt, Yersinia pestis
ccaacagagugaaucgcc

SEQ ID NO: 4161869 - RNA, 16 nt, Yersinia pestis
ccaacagcauuaccaa

SEQ ID NO: 4161870 - RNA, 22 nt, Yersinia pestis
ccaacaucgcuugugcuacauc

SEQ ID NO: 4161871 - RNA, 18 nt, Yersinia pestis
ccaacaugagccacacau

SEQ ID NO: 4161872 - RNA, 18 nt, Yersinia pestis
ccaaccaucaccaucggc

SEQ ID NO: 4161873 - RNA, 16 nt, Yersinia pestis
ccaaccccaucagcau

SEQ ID NO: 4161874 - RNA, 14 nt, Yersinia pestis
ccaacccuuuuuga

SEQ ID NO: 4161875 - RNA, 20 nt, Yersinia pestis
ccaaccggauaaaacaauag

SEQ ID NO: 4161876 - RNA, 11 nt, Yersinia pestis
ccaaccuauau

SEQ ID NO: 4161877 - RNA, 17 nt, Yersinia pestis
ccaaccuuguaacuuua

SEQ ID NO: 4161878 - RNA, 19 nt, Yersinia pestis
ccaacgagaaaggaaugcc

SEQ ID NO: 4161879 - RNA, 17 nt, Yersinia pestis
ccaacgcaagcgggcca

SEQ ID NO: 4161880 - RNA, 15 nt, Yersinia pestis
ccaacggacacauaa

SEQ ID NO: 4161881 - RNA, 17 nt, Yersinia pestis
ccaacggccccucaggc

SEQ ID NO: 4161882 - RNA, 21 nt, Yersinia pestis
ccaacggcuaacgguaaauaa

SEQ ID NO: 4161883 - RNA, 21 nt, Yersinia pestis
ccaacgguagguucaacccaa

SEQ ID NO: 4161884 - RNA, 21 nt, Yersinia pestis
ccaacucaccuuuaucgcgga

SEQ ID NO: 4161885 - RNA, 18 nt, Yersinia pestis
ccaacuccugccuacgcu

SEQ ID NO: 4161886 - RNA, 24 nt, Yersinia pestis
ccaacucuuucaacuuccgcguua

SEQ ID NO: 4161887 - RNA, 15 nt, Yersinia pestis
ccaacugacugaagu

SEQ ID NO: 4161888 - RNA, 15 nt, Yersinia pestis
ccaacugagugagcg

SEQ ID NO: 4161889 - RNA, 15 nt, Yersinia pestis
ccaacugauuuuuau

SEQ ID NO: 4161890 - RNA, 14 nt, Yersinia pestis
ccaacuuaccuuga

SEQ ID NO: 4161891 - RNA, 21 nt, Yersinia pestis
ccaacuuaccuugauccgcca

SEQ ID NO: 4161892 - RNA, 14 nt, Yersinia pestis
ccaacuugcuggca

SEQ ID NO: 4161893 - RNA, 22 nt, Yersinia pestis
ccaacuuuuuuaccacauuucc

SEQ ID NO: 4161894 - RNA, 14 nt, Yersinia pestis
ccaagaaaagcacc

SEQ ID NO: 4161895 - RNA, 16 nt, Yersinia pestis
ccaagaaaagcaccgc

SEQ ID NO: 4161896 - RNA, 17 nt, Yersinia pestis
ccaagaaaagcaccgca

SEQ ID NO: 4161897 - RNA, 13 nt, Yersinia pestis
ccaagaaacgccc

SEQ ID NO: 4161898 - RNA, 17 nt, Yersinia pestis
ccaagaacccuuuaucu

SEQ ID NO: 4161899 - RNA, 17 nt, Yersinia pestis
ccaagaacgccaaauga

SEQ ID NO: 4161900 - RNA, 19 nt, Yersinia pestis
ccaagaauaauaacgccua

SEQ ID NO: 4161901 - RNA, 15 nt, Yersinia pestis
ccaagagaaacccau

SEQ ID NO: 4161902 - RNA, 22 nt, Yersinia pestis
ccaagagagaauccauuuaauc

SEQ ID NO: 4161903 - RNA, 13 nt, Yersinia pestis
ccaagaggcugcg

SEQ ID NO: 4161904 - RNA, 19 nt, Yersinia pestis
ccaagaugauaaauacaaa

SEQ ID NO: 4161905 - RNA, 17 nt, Yersinia pestis
ccaagcccgcugcaacu

SEQ ID NO: 4161906 - RNA, 21 nt, Yersinia pestis
ccaagcuuuugccacauuucc

SEQ ID NO: 4161907 - RNA, 14 nt, Yersinia pestis
ccaaggagauagcg

SEQ ID NO: 4161908 - RNA, 17 nt, Yersinia pestis
ccaaggagaucgcucuc

SEQ ID NO: 4161909 - RNA, 23 nt, Yersinia pestis
ccaaggauggcgcggcucgagcc

SEQ ID NO: 4161910 - RNA, 12 nt, Yersinia pestis
ccaaggcauccg

SEQ ID NO: 4161911 - RNA, 20 nt, Yersinia pestis
ccaaggcgacuuugaugcca

SEQ ID NO: 4161912 - RNA, 19 nt, Yersinia pestis
ccaaguaugauaaugccuu

SEQ ID NO: 4161913 - RNA, 20 nt, Yersinia pestis
ccaaguccacgggcucaugc

SEQ ID NO: 4161914 - RNA, 23 nt, Yersinia pestis
ccaaguuuacuuuguauuuugca

SEQ ID NO: 4161915 - RNA, 20 nt, Yersinia pestis
ccaauaagugaaacaaauac

SEQ ID NO: 4161916 - RNA, 16 nt, Yersinia pestis
ccaauaaugccgaaug

SEQ ID NO: 4161917 - RNA, 17 nt, Yersinia pestis
ccaauaccauuuuagcu

SEQ ID NO: 4161918 - RNA, 16 nt, Yersinia pestis
ccaauagacaaaagug

SEQ ID NO: 4161919 - RNA, 18 nt, Yersinia pestis
ccaauagauuucacuuuc

SEQ ID NO: 4161920 - RNA, 19 nt, Yersinia pestis
ccaauagcccaaauaaccu

SEQ ID NO: 4161921 - RNA, 17 nt, Yersinia pestis
ccaauagcgaucagcaa

SEQ ID NO: 4161922 - RNA, 16 nt, Yersinia pestis
ccaauaucugccaauu

SEQ ID NO: 4161923 - RNA, 14 nt, Yersinia pestis
ccaauauugaguaa

SEQ ID NO: 4161924 - RNA, 13 nt, Yersinia pestis
ccaaucaucaucc

SEQ ID NO: 4161925 - RNA, 18 nt, Yersinia pestis
ccaaucauucugucauca

SEQ ID NO: 4161926 - RNA, 16 nt, Yersinia pestis
ccaauccaugccagcc

SEQ ID NO: 4161927 - RNA, 16 nt, Yersinia pestis
ccaaucgaaccgauac

SEQ ID NO: 4161928 - RNA, 22 nt, Yersinia pestis
ccaaucgcucugcguuuuuccc

SEQ ID NO: 4161929 - RNA, 15 nt, Yersinia pestis
ccaaucuccaaugac

SEQ ID NO: 4161930 - RNA, 21 nt, Yersinia pestis
ccaaugaugacuugauuaaca

SEQ ID NO: 4161931 - RNA, 13 nt, Yersinia pestis
ccaaugauuaacg

SEQ ID NO: 4161932 - RNA, 18 nt, Yersinia pestis
ccaaugccaagaauaauu

SEQ ID NO: 4161933 - RNA, 11 nt, Yersinia pestis
ccaaugcuuuu

SEQ ID NO: 4161934 - RNA, 17 nt, Yersinia pestis
ccaauggaaaauacacu

SEQ ID NO: 4161935 - RNA, 17 nt, Yersinia pestis
ccaauggccaccauuaa

SEQ ID NO: 4161936 - RNA, 17 nt, Yersinia pestis
ccaauggcucaccuuuc

SEQ ID NO: 4161937 - RNA, 20 nt, Yersinia pestis
ccaauguuuaauuuccggua

SEQ ID NO: 4161938 - RNA, 15 nt, Yersinia pestis
ccaauguuucaaauc

SEQ ID NO: 4161939 - RNA, 22 nt, Yersinia pestis
ccaauuaggggaagguaaaaaa

SEQ ID NO: 4161940 - RNA, 22 nt, Yersinia pestis
ccaauucacgcagguaguuagu

SEQ ID NO: 4161941 - RNA, 21 nt, Yersinia pestis
ccaauucacgccuaucucgac

SEQ ID NO: 4161942 - RNA, 12 nt, Yersinia pestis
ccaauucaguac

SEQ ID NO: 4161943 - RNA, 13 nt, Yersinia pestis
ccaauucaucagc

SEQ ID NO: 4161944 - RNA, 18 nt, Yersinia pestis
ccaauucguauuccucaa

SEQ ID NO: 4161945 - RNA, 22 nt, Yersinia pestis
ccaauucuuaggucaucgucac

SEQ ID NO: 4161946 - RNA, 16 nt, Yersinia pestis
ccaauugacuagcagg

SEQ ID NO: 4161947 - RNA, 19 nt, Yersinia pestis
ccaauugaguaacugauua

SEQ ID NO: 4161948 - RNA, 23 nt, Yersinia pestis
ccaauugcaggcuuucacgcucc

SEQ ID NO: 4161949 - RNA, 15 nt, Yersinia pestis
ccaauuggcuuaacu

SEQ ID NO: 4161950 - RNA, 16 nt, Yersinia pestis
ccaauuguuucuuccc

SEQ ID NO: 4161951 - RNA, 13 nt, Yersinia pestis
ccaauuuggccaa

SEQ ID NO: 4161952 - RNA, 18 nt, Yersinia pestis
ccaauuugggcauuaagu

SEQ ID NO: 4161953 - RNA, 16 nt, Yersinia pestis
ccaauuuuucuguauc

SEQ ID NO: 4161954 - RNA, 13 nt, Yersinia pestis
ccacaaauuuuua

SEQ ID NO: 4161955 - RNA, 14 nt, Yersinia pestis
ccacaacagauggc

SEQ ID NO: 4161956 - RNA, 12 nt, Yersinia pestis
ccacaacugaau

SEQ ID NO: 4161957 - RNA, 11 nt, Yersinia pestis
ccacaauccgg

SEQ ID NO: 4161958 - RNA, 22 nt, Yersinia pestis
ccacaauccgguguuccacaau

SEQ ID NO: 4161959 - RNA, 20 nt, Yersinia pestis
ccacaauggcagagcuuuuc

SEQ ID NO: 4161960 - RNA, 21 nt, Yersinia pestis
ccacacagcauucugcuucca

SEQ ID NO: 4161961 - RNA, 15 nt, Yersinia pestis
ccacaccggcugcaa

SEQ ID NO: 4161962 - RNA, 21 nt, Yersinia pestis
ccacaccuccgcccucuugcu

SEQ ID NO: 4161963 - RNA, 15 nt, Yersinia pestis
ccacagcgagcggcg

SEQ ID NO: 4161964 - RNA, 22 nt, Yersinia pestis
ccacagcgagcggcgauaucac

SEQ ID NO: 4161965 - RNA, 19 nt, Yersinia pestis
ccacauaaaauagcccagu

SEQ ID NO: 4161966 - RNA, 22 nt, Yersinia pestis
ccacauaaaauagcccagugcg

SEQ ID NO: 4161967 - RNA, 21 nt, Yersinia pestis
ccacauauauagagaaaucua

SEQ ID NO: 4161968 - RNA, 12 nt, Yersinia pestis
ccacaucaaccu

SEQ ID NO: 4161969 - RNA, 14 nt, Yersinia pestis
ccacaucaaccuga

SEQ ID NO: 4161970 - RNA, 17 nt, Yersinia pestis
ccacaucacgcagcgcu

SEQ ID NO: 4161971 - RNA, 11 nt, Yersinia pestis
ccacaucauua

SEQ ID NO: 4161972 - RNA, 21 nt, Yersinia pestis
ccacaucggccccuuaccuac

SEQ ID NO: 4161973 - RNA, 20 nt, Yersinia pestis
ccacaugagauucaggagau

SEQ ID NO: 4161974 - RNA, 14 nt, Yersinia pestis
ccaccaaauaaaac

SEQ ID NO: 4161975 - RNA, 20 nt, Yersinia pestis
ccaccaauagcgaucagcaa

SEQ ID NO: 4161976 - RNA, 14 nt, Yersinia pestis
ccaccacaucaucc

SEQ ID NO: 4161977 - RNA, 16 nt, Yersinia pestis
ccaccacaucauccag

SEQ ID NO: 4161978 - RNA, 17 nt, Yersinia pestis
ccaccacaucauccagu

SEQ ID NO: 4161979 - RNA, 22 nt, Yersinia pestis
ccaccacgaaaaaauggcagcc

SEQ ID NO: 4161980 - RNA, 16 nt, Yersinia pestis
ccaccagacugacaac

SEQ ID NO: 4161981 - RNA, 20 nt, Yersinia pestis
ccaccagacugacaaccacu

SEQ ID NO: 4161982 - RNA, 17 nt, Yersinia pestis
ccaccagcguggcauug

SEQ ID NO: 4161983 - RNA, 21 nt, Yersinia pestis
ccaccaggcggcccuuggcuu

SEQ ID NO: 4161984 - RNA, 23 nt, Yersinia pestis
ccaccaggcggcccuuggcuuug

SEQ ID NO: 4161985 - RNA, 24 nt, Yersinia pestis
ccaccagguuaccuauaaacuuga

SEQ ID NO: 4161986 - RNA, 16 nt, Yersinia pestis
ccaccaguaaacgcca

SEQ ID NO: 4161987 - RNA, 21 nt, Yersinia pestis
ccaccaguaaacgccaaucac

SEQ ID NO: 4161988 - RNA, 16 nt, Yersinia pestis
ccaccaucacuuccag

SEQ ID NO: 4161989 - RNA, 18 nt, Yersinia pestis
ccaccaugaugaaucugu

SEQ ID NO: 4161990 - RNA, 14 nt, Yersinia pestis
ccaccauuggcgau

SEQ ID NO: 4161991 - RNA, 15 nt, Yersinia pestis
ccaccccagcauuca

SEQ ID NO: 4161992 - RNA, 15 nt, Yersinia pestis
ccacccccagugcug

SEQ ID NO: 4161993 - RNA, 14 nt, Yersinia pestis
ccaccccccccuua

SEQ ID NO: 4161994 - RNA, 20 nt, Yersinia pestis
ccacccguugcauuuuucug

SEQ ID NO: 4161995 - RNA, 20 nt, Yersinia pestis
ccacccugccaaaaaauaag

SEQ ID NO: 4161996 - RNA, 12 nt, Yersinia pestis
ccaccgcacacu

SEQ ID NO: 4161997 - RNA, 21 nt, Yersinia pestis
ccaccgucaagacaacaaaca

SEQ ID NO: 4161998 - RNA, 14 nt, Yersinia pestis
ccaccgucaccaaa

SEQ ID NO: 4161999 - RNA, 16 nt, Yersinia pestis
ccaccgucaccaaaua

SEQ ID NO: 4162000 - RNA, 22 nt, Yersinia pestis
ccaccguggcgcgccacuucuu

SEQ ID NO: 4162001 - RNA, 22 nt, Yersinia pestis
ccaccuaauacagcaccaccga

SEQ ID NO: 4162002 - RNA, 21 nt, Yersinia pestis
ccaccuacaaccuaccaccua

SEQ ID NO: 4162003 - RNA, 14 nt, Yersinia pestis
ccaccuaccaccua

SEQ ID NO: 4162004 - RNA, 19 nt, Yersinia pestis
ccaccuaccaccuacaacc

SEQ ID NO: 4162005 - RNA, 18 nt, Yersinia pestis
ccaccuaccaccuaccac

SEQ ID NO: 4162006 - RNA, 21 nt, Yersinia pestis
ccaccugacuguggcugcucu

SEQ ID NO: 4162007 - RNA, 21 nt, Yersinia pestis
ccaccuuaaguaaguuuaaac

SEQ ID NO: 4162008 - RNA, 13 nt, Yersinia pestis
ccacgaaaaaaug

SEQ ID NO: 4162009 - RNA, 21 nt, Yersinia pestis
ccacgaagagcgccucacuga

SEQ ID NO: 4162010 - RNA, 20 nt, Yersinia pestis
ccacgaguuuucccugcgcc

SEQ ID NO: 4162011 - RNA, 16 nt, Yersinia pestis
ccacgaugugaagcaa

SEQ ID NO: 4162012 - RNA, 17 nt, Yersinia pestis
ccacgauuagcccguuc

SEQ ID NO: 4162013 - RNA, 23 nt, Yersinia pestis
ccacgauuagcccguucggucac

SEQ ID NO: 4162014 - RNA, 21 nt, Yersinia pestis
ccacgauuguuugggauaaag

SEQ ID NO: 4162015 - RNA, 16 nt, Yersinia pestis
ccacgcaauggagaac

SEQ ID NO: 4162016 - RNA, 20 nt, Yersinia pestis
ccacgcacgauauucagugc

SEQ ID NO: 4162017 - RNA, 14 nt, Yersinia pestis
ccacgcaucaauaa

SEQ ID NO: 4162018 - RNA, 13 nt, Yersinia pestis
ccacgcauuccau

SEQ ID NO: 4162019 - RNA, 16 nt, Yersinia pestis
ccacgcauuccaucag

SEQ ID NO: 4162020 - RNA, 22 nt, Yersinia pestis
ccacgccaacccucuuccgguu

SEQ ID NO: 4162021 - RNA, 17 nt, Yersinia pestis
ccacgccaauuaccguc

SEQ ID NO: 4162022 - RNA, 23 nt, Yersinia pestis
ccacgccagccuguuaauaauuc

SEQ ID NO: 4162023 - RNA, 22 nt, Yersinia pestis
ccacgccaguaaacagccagca

SEQ ID NO: 4162024 - RNA, 14 nt, Yersinia pestis
ccacgccccaacgg

SEQ ID NO: 4162025 - RNA, 16 nt, Yersinia pestis
ccacgcgguacuuugc

SEQ ID NO: 4162026 - RNA, 19 nt, Yersinia pestis
ccacgcguaaucauagcca

SEQ ID NO: 4162027 - RNA, 16 nt, Yersinia pestis
ccacgcuccacacaaa

SEQ ID NO: 4162028 - RNA, 15 nt, Yersinia pestis
ccacgcuccuggcga

SEQ ID NO: 4162029 - RNA, 18 nt, Yersinia pestis
ccacgcugaaacuuuuca

SEQ ID NO: 4162030 - RNA, 17 nt, Yersinia pestis
ccacgcugauacauuuc

SEQ ID NO: 4162031 - RNA, 13 nt, Yersinia pestis
ccacggauuaacu

SEQ ID NO: 4162032 - RNA, 22 nt, Yersinia pestis
ccacggcaccuucugauuuuuu

SEQ ID NO: 4162033 - RNA, 13 nt, Yersinia pestis
ccacggcgcugca

SEQ ID NO: 4162034 - RNA, 17 nt, Yersinia pestis
ccacggcgcugcagcga

SEQ ID NO: 4162035 - RNA, 18 nt, Yersinia pestis
ccacggcgcugcagcgau

SEQ ID NO: 4162036 - RNA, 15 nt, Yersinia pestis
ccacggcucacacac

SEQ ID NO: 4162037 - RNA, 21 nt, Yersinia pestis
ccacggugccuagccuauuug

SEQ ID NO: 4162038 - RNA, 15 nt, Yersinia pestis
ccacguagaucaaca

SEQ ID NO: 4162039 - RNA, 17 nt, Yersinia pestis
ccacgucaucgaagagu

SEQ ID NO: 4162040 - RNA, 17 nt, Yersinia pestis
ccacgucuaauugcugc

SEQ ID NO: 4162041 - RNA, 20 nt, Yersinia pestis
ccacgucuaauugcugccca

SEQ ID NO: 4162042 - RNA, 16 nt, Yersinia pestis
ccacuaaggucaucaa

SEQ ID NO: 4162043 - RNA, 20 nt, Yersinia pestis
ccacuacugaacgucauaau

SEQ ID NO: 4162044 - RNA, 16 nt, Yersinia pestis
ccacuaguuaaaacca

SEQ ID NO: 4162045 - RNA, 16 nt, Yersinia pestis
ccacucgccccacaau

SEQ ID NO: 4162046 - RNA, 23 nt, Yersinia pestis
ccacucggguucuaaauccugca

SEQ ID NO: 4162047 - RNA, 16 nt, Yersinia pestis
ccacucguucucaacc

SEQ ID NO: 4162048 - RNA, 14 nt, Yersinia pestis
ccacucucccucag

SEQ ID NO: 4162049 - RNA, 17 nt, Yersinia pestis
ccacucucccucaguga

SEQ ID NO: 4162050 - RNA, 23 nt, Yersinia pestis
ccacugaccgggaacaacgaaac

SEQ ID NO: 4162051 - RNA, 15 nt, Yersinia pestis
ccacugaccuauuga

SEQ ID NO: 4162052 - RNA, 23 nt, Yersinia pestis
ccacugaccuauugauaaaacca

SEQ ID NO: 4162053 - RNA, 24 nt, Yersinia pestis
ccacugauaggucauauacaccgc

SEQ ID NO: 4162054 - RNA, 13 nt, Yersinia pestis
ccacugcggucaa

SEQ ID NO: 4162055 - RNA, 17 nt, Yersinia pestis
ccacugcggucaaagaa

SEQ ID NO: 4162056 - RNA, 16 nt, Yersinia pestis
ccacuggccugagaac

SEQ ID NO: 4162057 - RNA, 23 nt, Yersinia pestis
ccacuguaucuuugcuaucucuu

SEQ ID NO: 4162058 - RNA, 14 nt, Yersinia pestis
ccacuguuuuucau

SEQ ID NO: 4162059 - RNA, 21 nt, Yersinia pestis
ccacuuaacacgaaccuucuc

SEQ ID NO: 4162060 - RNA, 16 nt, Yersinia pestis
ccacuuaguggcauug

SEQ ID NO: 4162061 - RNA, 16 nt, Yersinia pestis
ccacuuccugauggcc

SEQ ID NO: 4162062 - RNA, 19 nt, Yersinia pestis
ccacuugcuuggauuccgu

SEQ ID NO: 4162063 - RNA, 20 nt, Yersinia pestis
ccacuuguaccugugccagu

SEQ ID NO: 4162064 - RNA, 16 nt, Yersinia pestis
ccacuuuaacugcacc

SEQ ID NO: 4162065 - RNA, 17 nt, Yersinia pestis
ccacuuuaccgauuuca

SEQ ID NO: 4162066 - RNA, 15 nt, Yersinia pestis
ccacuuugcugugag

SEQ ID NO: 4162067 - RNA, 19 nt, Yersinia pestis
ccagaaaaccuucagcaaa

SEQ ID NO: 4162068 - RNA, 15 nt, Yersinia pestis
ccagaaaggcaaaaa

SEQ ID NO: 4162069 - RNA, 12 nt, Yersinia pestis
ccagaaauauug

SEQ ID NO: 4162070 - RNA, 21 nt, Yersinia pestis
ccagaacaauaccgccaauau

SEQ ID NO: 4162071 - RNA, 12 nt, Yersinia pestis
ccagaagccagg

SEQ ID NO: 4162072 - RNA, 17 nt, Yersinia pestis
ccagaagccagggucau

SEQ ID NO: 4162073 - RNA, 14 nt, Yersinia pestis
ccagaagcgcacau

SEQ ID NO: 4162074 - RNA, 15 nt, Yersinia pestis
ccagaauaauaagcc

SEQ ID NO: 4162075 - RNA, 19 nt, Yersinia pestis
ccagaaucacugucaaaaa

SEQ ID NO: 4162076 - RNA, 21 nt, Yersinia pestis
ccagaauuucauuguggagga

SEQ ID NO: 4162077 - RNA, 14 nt, Yersinia pestis
ccagacaacaguca

SEQ ID NO: 4162078 - RNA, 14 nt, Yersinia pestis
ccagacaaccaaua

SEQ ID NO: 4162079 - RNA, 20 nt, Yersinia pestis
ccagacaaccaauacacagc

SEQ ID NO: 4162080 - RNA, 23 nt, Yersinia pestis
ccagacacugacaucaucaccua

SEQ ID NO: 4162081 - RNA, 16 nt, Yersinia pestis
ccagacauguuguucu

SEQ ID NO: 4162082 - RNA, 14 nt, Yersinia pestis
ccagacccugcacc

SEQ ID NO: 4162083 - RNA, 23 nt, Yersinia pestis
ccagaccgcguaagccgugccug

SEQ ID NO: 4162084 - RNA, 18 nt, Yersinia pestis
ccagacgaguauucccca

SEQ ID NO: 4162085 - RNA, 23 nt, Yersinia pestis
ccagacucugcuaccaggaagcg

SEQ ID NO: 4162086 - RNA, 14 nt, Yersinia pestis
ccagacugacaacc

SEQ ID NO: 4162087 - RNA, 17 nt, Yersinia pestis
ccagacugacaaccacu

SEQ ID NO: 4162088 - RNA, 20 nt, Yersinia pestis
ccagacugacaaccacuaaa

SEQ ID NO: 4162089 - RNA, 22 nt, Yersinia pestis
ccagagcgcggcuucagcaccu

SEQ ID NO: 4162090 - RNA, 23 nt, Yersinia pestis
ccagaggguuaacggauccugcc

SEQ ID NO: 4162091 - RNA, 19 nt, Yersinia pestis
ccagauaacauacaccauc

SEQ ID NO: 4162092 - RNA, 21 nt, Yersinia pestis
ccagauaaucgccaauaaccg

SEQ ID NO: 4162093 - RNA, 18 nt, Yersinia pestis
ccagauagcgaaucacau

SEQ ID NO: 4162094 - RNA, 18 nt, Yersinia pestis
ccagaucagcacggaacc

SEQ ID NO: 4162095 - RNA, 23 nt, Yersinia pestis
ccagaucagcacggaaccccugc

SEQ ID NO: 4162096 - RNA, 17 nt, Yersinia pestis
ccagaucauuuuuuucc

SEQ ID NO: 4162097 - RNA, 19 nt, Yersinia pestis
ccagaucuuuuucauucug

SEQ ID NO: 4162098 - RNA, 20 nt, Yersinia pestis
ccagaugccaaauaucuuuc

SEQ ID NO: 4162099 - RNA, 12 nt, Yersinia pestis
ccagauggccag

SEQ ID NO: 4162100 - RNA, 15 nt, Yersinia pestis
ccagauggucacccu

SEQ ID NO: 4162101 - RNA, 16 nt, Yersinia pestis
ccagauuauuggcaug

SEQ ID NO: 4162102 - RNA, 14 nt, Yersinia pestis
ccagauuggcgugu

SEQ ID NO: 4162103 - RNA, 16 nt, Yersinia pestis
ccagauugucaaucac

SEQ ID NO: 4162104 - RNA, 18 nt, Yersinia pestis
ccagauugugcggcuggc

SEQ ID NO: 4162105 - RNA, 15 nt, Yersinia pestis
ccagcaaacgcauuu

SEQ ID NO: 4162106 - RNA, 22 nt, Yersinia pestis
ccagcaaacgcauuugaguaaa

SEQ ID NO: 4162107 - RNA, 12 nt, Yersinia pestis
ccagcaaaucau

SEQ ID NO: 4162108 - RNA, 20 nt, Yersinia pestis
ccagcaacgaauaaaaaagc

SEQ ID NO: 4162109 - RNA, 18 nt, Yersinia pestis
ccagcaacguaacaugca

SEQ ID NO: 4162110 - RNA, 20 nt, Yersinia pestis
ccagcaacguaacaugcagc

SEQ ID NO: 4162111 - RNA, 19 nt, Yersinia pestis
ccagcaacucaagccacuc

SEQ ID NO: 4162112 - RNA, 17 nt, Yersinia pestis
ccagcaacugaaaccga

SEQ ID NO: 4162113 - RNA, 13 nt, Yersinia pestis
ccagcaagagcag

SEQ ID NO: 4162114 - RNA, 14 nt, Yersinia pestis
ccagcaagccgugg

SEQ ID NO: 4162115 - RNA, 18 nt, Yersinia pestis
ccagcaauaaaccacugg

SEQ ID NO: 4162116 - RNA, 19 nt, Yersinia pestis
ccagcaauuggccuuccau

SEQ ID NO: 4162117 - RNA, 14 nt, Yersinia pestis
ccagcacaaugacu

SEQ ID NO: 4162118 - RNA, 22 nt, Yersinia pestis
ccagcacguuuuaaugccaauu

SEQ ID NO: 4162119 - RNA, 17 nt, Yersinia pestis
ccagcagaaguuguugc

SEQ ID NO: 4162120 - RNA, 23 nt, Yersinia pestis
ccagcagcauaauacgaucagcg

SEQ ID NO: 4162121 - RNA, 14 nt, Yersinia pestis
ccagcagcauccug

SEQ ID NO: 4162122 - RNA, 23 nt, Yersinia pestis
ccagcauguuccuguugcuggcc

SEQ ID NO: 4162123 - RNA, 23 nt, Yersinia pestis
ccagccaagacuuuccacaacag

SEQ ID NO: 4162124 - RNA, 13 nt, Yersinia pestis
ccagccaccgcac

SEQ ID NO: 4162125 - RNA, 19 nt, Yersinia pestis
ccagccccaaucaccggcu

SEQ ID NO: 4162126 - RNA, 17 nt, Yersinia pestis
ccagccccuaacagcag

SEQ ID NO: 4162127 - RNA, 20 nt, Yersinia pestis
ccagccgauaauccaccuga

SEQ ID NO: 4162128 - RNA, 21 nt, Yersinia pestis
ccagccuguuaauaauucagg

SEQ ID NO: 4162129 - RNA, 19 nt, Yersinia pestis
ccagccuuaacugcauagc

SEQ ID NO: 4162130 - RNA, 13 nt, Yersinia pestis
ccagcgccccauc

SEQ ID NO: 4162131 - RNA, 11 nt, Yersinia pestis
ccagcgcccgg

SEQ ID NO: 4162132 - RNA, 15 nt, Yersinia pestis
ccagcgggaaucaaa

SEQ ID NO: 4162133 - RNA, 14 nt, Yersinia pestis
ccagcgguguuacc

SEQ ID NO: 4162134 - RNA, 18 nt, Yersinia pestis
ccagcgguguuaccagac

SEQ ID NO: 4162135 - RNA, 20 nt, Yersinia pestis
ccagcgguguuaccagaccc

SEQ ID NO: 4162136 - RNA, 19 nt, Yersinia pestis
ccagcguaaacaguagcag

SEQ ID NO: 4162137 - RNA, 23 nt, Yersinia pestis
ccagcguccugugcaaagugcug

SEQ ID NO: 4162138 - RNA, 20 nt, Yersinia pestis
ccagcgucgccguaaauugc

SEQ ID NO: 4162139 - RNA, 18 nt, Yersinia pestis
ccagcguggcccaggcaa

SEQ ID NO: 4162140 - RNA, 23 nt, Yersinia pestis
ccagcguucuaucaaugccuugg

SEQ ID NO: 4162141 - RNA, 12 nt, Yersinia pestis
ccagcucaccgu

SEQ ID NO: 4162142 - RNA, 14 nt, Yersinia pestis
ccagcucauauaau

SEQ ID NO: 4162143 - RNA, 14 nt, Yersinia pestis
ccagcuuacgguua

SEQ ID NO: 4162144 - RNA, 11 nt, Yersinia pestis
ccagcuucccu

SEQ ID NO: 4162145 - RNA, 14 nt, Yersinia pestis
ccagcuucccugca

SEQ ID NO: 4162146 - RNA, 19 nt, Yersinia pestis
ccagcuuuuuacgcaacaa

SEQ ID NO: 4162147 - RNA, 16 nt, Yersinia pestis
ccaggacauccagcgg

SEQ ID NO: 4162148 - RNA, 15 nt, Yersinia pestis
ccaggcaacgacagc

SEQ ID NO: 4162149 - RNA, 19 nt, Yersinia pestis
ccaggcaacgacagcaaca

SEQ ID NO: 4162150 - RNA, 13 nt, Yersinia pestis
ccaggcaucaucu

SEQ ID NO: 4162151 - RNA, 18 nt, Yersinia pestis
ccaggcauuaaaaucacc

SEQ ID NO: 4162152 - RNA, 16 nt, Yersinia pestis
ccaggccacggccgcc

SEQ ID NO: 4162153 - RNA, 18 nt, Yersinia pestis
ccaggccuagcccaguac

SEQ ID NO: 4162154 - RNA, 20 nt, Yersinia pestis
ccaggcgaucucuucggccc

SEQ ID NO: 4162155 - RNA, 20 nt, Yersinia pestis
ccaggcugaacgcacaaugg

SEQ ID NO: 4162156 - RNA, 18 nt, Yersinia pestis
ccaggcuggccacuucca

SEQ ID NO: 4162157 - RNA, 21 nt, Yersinia pestis
ccaggcugugguggcggucaa

SEQ ID NO: 4162158 - RNA, 18 nt, Yersinia pestis
ccagggcaccaagaccga

SEQ ID NO: 4162159 - RNA, 18 nt, Yersinia pestis
ccagggcguuuaccaucc

SEQ ID NO: 4162160 - RNA, 22 nt, Yersinia pestis
ccagggcguuuaccauccagug

SEQ ID NO: 4162161 - RNA, 20 nt, Yersinia pestis
ccaggggucgacguucauau

SEQ ID NO: 4162162 - RNA, 14 nt, Yersinia pestis
ccagguaagaaaga

SEQ ID NO: 4162163 - RNA, 21 nt, Yersinia pestis
ccagguaagaaagagaugacc

SEQ ID NO: 4162164 - RNA, 20 nt, Yersinia pestis
ccaggucgaucgacuucuua

SEQ ID NO: 4162165 - RNA, 21 nt, Yersinia pestis
ccaggugcuuauuuauuuuua

SEQ ID NO: 4162166 - RNA, 15 nt, Yersinia pestis
ccagguucaauuuca

SEQ ID NO: 4162167 - RNA, 13 nt, Yersinia pestis
ccaguaaaaaaau

SEQ ID NO: 4162168 - RNA, 14 nt, Yersinia pestis
ccaguaaaaaaaua

SEQ ID NO: 4162169 - RNA, 16 nt, Yersinia pestis
ccaguaaaaaaauagc

SEQ ID NO: 4162170 - RNA, 14 nt, Yersinia pestis
ccaguaacugauca

SEQ ID NO: 4162171 - RNA, 17 nt, Yersinia pestis
ccaguaagcuguugacc

SEQ ID NO: 4162172 - RNA, 23 nt, Yersinia pestis
ccaguaagcuguugaccugaaga

SEQ ID NO: 4162173 - RNA, 22 nt, Yersinia pestis
ccaguaauaccuuaauggcuuu

SEQ ID NO: 4162174 - RNA, 13 nt, Yersinia pestis
ccaguacagugaa

SEQ ID NO: 4162175 - RNA, 14 nt, Yersinia pestis
ccaguacugaccac

SEQ ID NO: 4162176 - RNA, 15 nt, Yersinia pestis
ccaguagcccagccg

SEQ ID NO: 4162177 - RNA, 15 nt, Yersinia pestis
ccaguaggggccacc

SEQ ID NO: 4162178 - RNA, 13 nt, Yersinia pestis
ccaguaugguuuc

SEQ ID NO: 4162179 - RNA, 20 nt, Yersinia pestis
ccagucacuuacugaucaau

SEQ ID NO: 4162180 - RNA, 12 nt, Yersinia pestis
ccagucagggcg

SEQ ID NO: 4162181 - RNA, 15 nt, Yersinia pestis
ccagucauaaauauc

SEQ ID NO: 4162182 - RNA, 18 nt, Yersinia pestis
ccagucgucuucagcuuc

SEQ ID NO: 4162183 - RNA, 14 nt, Yersinia pestis
ccagucuaaacgcc

SEQ ID NO: 4162184 - RNA, 18 nt, Yersinia pestis
ccagugagccauguguuu

SEQ ID NO: 4162185 - RNA, 19 nt, Yersinia pestis
ccagugcaaaaugcucuuc

SEQ ID NO: 4162186 - RNA, 20 nt, Yersinia pestis
ccagugcaaaaugcucuuca

SEQ ID NO: 4162187 - RNA, 14 nt, Yersinia pestis
ccagugcaaauuua

SEQ ID NO: 4162188 - RNA, 12 nt, Yersinia pestis
ccagugccaauc

SEQ ID NO: 4162189 - RNA, 19 nt, Yersinia pestis
ccagugccaauccccacca

SEQ ID NO: 4162190 - RNA, 15 nt, Yersinia pestis
ccagugccaauugag

SEQ ID NO: 4162191 - RNA, 18 nt, Yersinia pestis
ccagugcgggagccgcac

SEQ ID NO: 4162192 - RNA, 19 nt, Yersinia pestis
ccagugcuuuauccaaugg

SEQ ID NO: 4162193 - RNA, 20 nt, Yersinia pestis
ccagugcuuuauccaauggc

SEQ ID NO: 4162194 - RNA, 16 nt, Yersinia pestis
ccaguggcaucaauau

SEQ ID NO: 4162195 - RNA, 20 nt, Yersinia pestis
ccagugguuucccuucgcgc

SEQ ID NO: 4162196 - RNA, 20 nt, Yersinia pestis
ccaguguuagcuguuuuagu

SEQ ID NO: 4162197 - RNA, 15 nt, Yersinia pestis
ccaguguucauauuc

SEQ ID NO: 4162198 - RNA, 21 nt, Yersinia pestis
ccaguguuuucuccacaccaa

SEQ ID NO: 4162199 - RNA, 13 nt, Yersinia pestis
ccaguuauuauuu

SEQ ID NO: 4162200 - RNA, 16 nt, Yersinia pestis
ccaguucaacaccaag

SEQ ID NO: 4162201 - RNA, 23 nt, Yersinia pestis
ccaguucaagauaaaguucuucg

SEQ ID NO: 4162202 - RNA, 16 nt, Yersinia pestis
ccaguucaguccagcc

SEQ ID NO: 4162203 - RNA, 17 nt, Yersinia pestis
ccaguucaguccagcca

SEQ ID NO: 4162204 - RNA, 23 nt, Yersinia pestis
ccaguugccacucauauucaaaa

SEQ ID NO: 4162205 - RNA, 14 nt, Yersinia pestis
ccaguugucuauuu

SEQ ID NO: 4162206 - RNA, 12 nt, Yersinia pestis
ccauaaaaggau

SEQ ID NO: 4162207 - RNA, 21 nt, Yersinia pestis
ccauaaaauaaauaauuugua

SEQ ID NO: 4162208 - RNA, 16 nt, Yersinia pestis
ccauaaaguuuuuccu

SEQ ID NO: 4162209 - RNA, 13 nt, Yersinia pestis
ccauaaaucccga

SEQ ID NO: 4162210 - RNA, 12 nt, Yersinia pestis
ccauaaccgaug

SEQ ID NO: 4162211 - RNA, 16 nt, Yersinia pestis
ccauaacgcugcucaa

SEQ ID NO: 4162212 - RNA, 23 nt, Yersinia pestis
ccauaagcccccguaucauggaa

SEQ ID NO: 4162213 - RNA, 20 nt, Yersinia pestis
ccauaagcgacgacauuaau

SEQ ID NO: 4162214 - RNA, 21 nt, Yersinia pestis
ccauaagcgggguauuuuacu

SEQ ID NO: 4162215 - RNA, 22 nt, Yersinia pestis
ccauaagugaacaugaugaaug

SEQ ID NO: 4162216 - RNA, 22 nt, Yersinia pestis
ccauaagugcacugaaccccaa

SEQ ID NO: 4162217 - RNA, 15 nt, Yersinia pestis
ccauaauaaugcgau

SEQ ID NO: 4162218 - RNA, 16 nt, Yersinia pestis
ccauaauccagaagcc

SEQ ID NO: 4162219 - RNA, 21 nt, Yersinia pestis
ccauaaugccguuauagaucu

SEQ ID NO: 4162220 - RNA, 18 nt, Yersinia pestis
ccauaauuaauuauucaa

SEQ ID NO: 4162221 - RNA, 12 nt, Yersinia pestis
ccauacaaauag

SEQ ID NO: 4162222 - RNA, 20 nt, Yersinia pestis
ccauacaaauaguaauaauu

SEQ ID NO: 4162223 - RNA, 14 nt, Yersinia pestis
ccauacccaaacca

SEQ ID NO: 4162224 - RNA, 21 nt, Yersinia pestis
ccauacccuuuggucaauaaa

SEQ ID NO: 4162225 - RNA, 19 nt, Yersinia pestis
ccauacgaauuuuucccug

SEQ ID NO: 4162226 - RNA, 20 nt, Yersinia pestis
ccauacucccguaauuuauu

SEQ ID NO: 4162227 - RNA, 21 nt, Yersinia pestis
ccauagguacggguauagcgg

SEQ ID NO: 4162228 - RNA, 16 nt, Yersinia pestis
ccauauacgcauaaug

SEQ ID NO: 4162229 - RNA, 23 nt, Yersinia pestis
ccauauagcggcguucagcaaua

SEQ ID NO: 4162230 - RNA, 12 nt, Yersinia pestis
ccauauccaaag

SEQ ID NO: 4162231 - RNA, 17 nt, Yersinia pestis
ccauauccaaagauauc

SEQ ID NO: 4162232 - RNA, 17 nt, Yersinia pestis
ccauauccucaagaccg

SEQ ID NO: 4162233 - RNA, 13 nt, Yersinia pestis
ccauauccucgag

SEQ ID NO: 4162234 - RNA, 22 nt, Yersinia pestis
ccauauccuggcgguaauaaau

SEQ ID NO: 4162235 - RNA, 18 nt, Yersinia pestis
ccauauguugccaccagc

SEQ ID NO: 4162236 - RNA, 16 nt, Yersinia pestis
ccauauuacucacaca

SEQ ID NO: 4162237 - RNA, 16 nt, Yersinia pestis
ccauauuauuguuauu

SEQ ID NO: 4162238 - RNA, 16 nt, Yersinia pestis
ccaucaaacauagaca

SEQ ID NO: 4162239 - RNA, 21 nt, Yersinia pestis
ccaucaaauacacauaaccau

SEQ ID NO: 4162240 - RNA, 13 nt, Yersinia pestis
ccaucaaccaccg

SEQ ID NO: 4162241 - RNA, 23 nt, Yersinia pestis
ccaucaacucagggcuggcaccg

SEQ ID NO: 4162242 - RNA, 13 nt, Yersinia pestis
ccaucaauaaacu

SEQ ID NO: 4162243 - RNA, 15 nt, Yersinia pestis
ccaucaauaaagcug

SEQ ID NO: 4162244 - RNA, 21 nt, Yersinia pestis
ccaucaauaccaauaaaaccu

SEQ ID NO: 4162245 - RNA, 20 nt, Yersinia pestis
ccaucaccaucggcaauaau

SEQ ID NO: 4162246 - RNA, 20 nt, Yersinia pestis
ccaucaccauugaccagcgu

SEQ ID NO: 4162247 - RNA, 22 nt, Yersinia pestis
ccaucaccccaacgcuggcugg

SEQ ID NO: 4162248 - RNA, 13 nt, Yersinia pestis
ccaucacucugcu

SEQ ID NO: 4162249 - RNA, 18 nt, Yersinia pestis
aucugauacugaacgcaa

SEQ ID NO: 4162250 - RNA, 15 nt, Yersinia pestis
aucugauaucucuuu

SEQ ID NO: 4162251 - RNA, 16 nt, Yersinia pestis
aucugauaucucuuua

SEQ ID NO: 4162252 - RNA, 19 nt, Yersinia pestis
aucugauaucucuuuauca

SEQ ID NO: 4162253 - RNA, 14 nt, Yersinia pestis
aucugauauuauug

SEQ ID NO: 4162254 - RNA, 20 nt, Yersinia pestis
aucugaucaaucucaucaau

SEQ ID NO: 4162255 - RNA, 21 nt, Yersinia pestis
aucugcaauggcuggcaaggc

SEQ ID NO: 4162256 - RNA, 22 nt, Yersinia pestis
aucugcacuguaauugcgucag

SEQ ID NO: 4162257 - RNA, 15 nt, Yersinia pestis
aucugcauaccugga

SEQ ID NO: 4162258 - RNA, 14 nt, Yersinia pestis
aucugcauuaaaau

SEQ ID NO: 4162259 - RNA, 15 nt, Yersinia pestis
aucugcauuaaaaua

SEQ ID NO: 4162260 - RNA, 15 nt, Yersinia pestis
aucugcauugauuaa

SEQ ID NO: 4162261 - RNA, 18 nt, Yersinia pestis
aucugccaccgcacaguu

SEQ ID NO: 4162262 - RNA, 22 nt, Yersinia pestis
aucugcccagccugguuuuuua

SEQ ID NO: 4162263 - RNA, 21 nt, Yersinia pestis
aucugccgggaggauaaguuc

SEQ ID NO: 4162264 - RNA, 20 nt, Yersinia pestis
aucugcgguaaccaauaaca

SEQ ID NO: 4162265 - RNA, 15 nt, Yersinia pestis
aucugcugaccauua

SEQ ID NO: 4162266 - RNA, 19 nt, Yersinia pestis
aucugcuuuacugcuuuuc

SEQ ID NO: 4162267 - RNA, 21 nt, Yersinia pestis
aucugcuuuacugcuuuucua

SEQ ID NO: 4162268 - RNA, 13 nt, Yersinia pestis
aucuggaauuuau

SEQ ID NO: 4162269 - RNA, 15 nt, Yersinia pestis
aucuggaugugcuuc

SEQ ID NO: 4162270 - RNA, 20 nt, Yersinia pestis
aucuggcgauuuugcggcug

SEQ ID NO: 4162271 - RNA, 20 nt, Yersinia pestis
aucuggcguagguaguggcu

SEQ ID NO: 4162272 - RNA, 19 nt, Yersinia pestis
aucuggcuuucucaacagc

SEQ ID NO: 4162273 - RNA, 16 nt, Yersinia pestis
aucugggguauaacgc

SEQ ID NO: 4162274 - RNA, 20 nt, Yersinia pestis
aucugggugagagguugcaa

SEQ ID NO: 4162275 - RNA, 23 nt, Yersinia pestis
aucugguuuuuuuauaaauuacu

SEQ ID NO: 4162276 - RNA, 15 nt, Yersinia pestis
aucuguaaucaccag

SEQ ID NO: 4162277 - RNA, 23 nt, Yersinia pestis
aucugucuaagugccaguuaaua

SEQ ID NO: 4162278 - RNA, 14 nt, Yersinia pestis
aucuguggugacau

SEQ ID NO: 4162279 - RNA, 14 nt, Yersinia pestis
aucuguuucaaaua

SEQ ID NO: 4162280 - RNA, 16 nt, Yersinia pestis
aucuguuuuugccacc

SEQ ID NO: 4162281 - RNA, 17 nt, Yersinia pestis
aucuguuuuugccaccu

SEQ ID NO: 4162282 - RNA, 13 nt, Yersinia pestis
aucuuaaaaauaa

SEQ ID NO: 4162283 - RNA, 16 nt, Yersinia pestis
aucuuauccacagcau

SEQ ID NO: 4162284 - RNA, 23 nt, Yersinia pestis
aucuuaugacgcugcaccgcuga

SEQ ID NO: 4162285 - RNA, 15 nt, Yersinia pestis
aucuucacucagcgc

SEQ ID NO: 4162286 - RNA, 20 nt, Yersinia pestis
aucuucauccgcuccagccu

SEQ ID NO: 4162287 - RNA, 17 nt, Yersinia pestis
aucuucauugccuucua

SEQ ID NO: 4162288 - RNA, 18 nt, Yersinia pestis
aucuuccacucuuucaau

SEQ ID NO: 4162289 - RNA, 20 nt, Yersinia pestis
aucuuccgucaguugcccgu

SEQ ID NO: 4162290 - RNA, 15 nt, Yersinia pestis
aucuuccuuuccauu

SEQ ID NO: 4162291 - RNA, 19 nt, Yersinia pestis
aucuuccuuuccauuuuca

SEQ ID NO: 4162292 - RNA, 12 nt, Yersinia pestis
aucuucuacuua

SEQ ID NO: 4162293 - RNA, 14 nt, Yersinia pestis
aucuucugccagcc

SEQ ID NO: 4162294 - RNA, 17 nt, Yersinia pestis
aucuugaaccaauuuuu

SEQ ID NO: 4162295 - RNA, 20 nt, Yersinia pestis
aucuugcagcgaucacagau

SEQ ID NO: 4162296 - RNA, 19 nt, Yersinia pestis
aucuugcgccgaaauaaaa

SEQ ID NO: 4162297 - RNA, 23 nt, Yersinia pestis
aucuuguaaauagucauauauuu

SEQ ID NO: 4162298 - RNA, 23 nt, Yersinia pestis
aucuugucauuaccaaugguuuc

SEQ ID NO: 4162299 - RNA, 16 nt, Yersinia pestis
aucuugucguuauuuu

SEQ ID NO: 4162300 - RNA, 23 nt, Yersinia pestis
aucuuguucaccaauuugcaaag

SEQ ID NO: 4162301 - RNA, 16 nt, Yersinia pestis
aucuuguucuaauaau

SEQ ID NO: 4162302 - RNA, 15 nt, Yersinia pestis
aucuuuaacaacaac

SEQ ID NO: 4162303 - RNA, 15 nt, Yersinia pestis
aucuuuaauuuuucc

SEQ ID NO: 4162304 - RNA, 16 nt, Yersinia pestis
aucuuuaauuuuuccc

SEQ ID NO: 4162305 - RNA, 14 nt, Yersinia pestis
aucuuuaccagccc

SEQ ID NO: 4162306 - RNA, 13 nt, Yersinia pestis
aucuuuacugcau

SEQ ID NO: 4162307 - RNA, 17 nt, Yersinia pestis
aucuuuauuauuauuua

SEQ ID NO: 4162308 - RNA, 17 nt, Yersinia pestis
aucuuuauugcuccuua

SEQ ID NO: 4162309 - RNA, 22 nt, Yersinia pestis
aucuuucuccaguaaaagaaua

SEQ ID NO: 4162310 - RNA, 21 nt, Yersinia pestis
aucuuucugacuaacucuucu

SEQ ID NO: 4162311 - RNA, 13 nt, Yersinia pestis
aucuuuuuguaau

SEQ ID NO: 4162312 - RNA, 20 nt, Yersinia pestis
augaaaaacagauauacggc

SEQ ID NO: 4162313 - RNA, 19 nt, Yersinia pestis
augaaaaaguccgcaacau

SEQ ID NO: 4162314 - RNA, 15 nt, Yersinia pestis
augaaaaccggcauu

SEQ ID NO: 4162315 - RNA, 15 nt, Yersinia pestis
augaaaauagccaac

SEQ ID NO: 4162316 - RNA, 15 nt, Yersinia pestis
augaaaucaguguau

SEQ ID NO: 4162317 - RNA, 22 nt, Yersinia pestis
augaaaucuaacgugaucgccg

SEQ ID NO: 4162318 - RNA, 18 nt, Yersinia pestis
augaacacagcuaaauua

SEQ ID NO: 4162319 - RNA, 23 nt, Yersinia pestis
augaaccgccaaucgaacccaac

SEQ ID NO: 4162320 - RNA, 18 nt, Yersinia pestis
augaacggauacccagca

SEQ ID NO: 4162321 - RNA, 12 nt, Yersinia pestis
augaacgugccg

SEQ ID NO: 4162322 - RNA, 13 nt, Yersinia pestis
augaacucaacuu

SEQ ID NO: 4162323 - RNA, 13 nt, Yersinia pestis
augaacugucuug

SEQ ID NO: 4162324 - RNA, 11 nt, Yersinia pestis
augaagaccug

SEQ ID NO: 4162325 - RNA, 19 nt, Yersinia pestis
augaagcacaaaaagaguc

SEQ ID NO: 4162326 - RNA, 18 nt, Yersinia pestis
augaagcauuaaacagau

SEQ ID NO: 4162327 - RNA, 15 nt, Yersinia pestis
augaagcucauuaau

SEQ ID NO: 4162328 - RNA, 22 nt, Yersinia pestis
augaaguuauccuccauucugc

SEQ ID NO: 4162329 - RNA, 18 nt, Yersinia pestis
augaaguugucagugauu

SEQ ID NO: 4162330 - RNA, 22 nt, Yersinia pestis
augaauaacgccggcgccauug

SEQ ID NO: 4162331 - RNA, 15 nt, Yersinia pestis
augaauauaugauac

SEQ ID NO: 4162332 - RNA, 18 nt, Yersinia pestis
augaauaucuugcauaca

SEQ ID NO: 4162333 - RNA, 14 nt, Yersinia pestis
augaauauuauuca

SEQ ID NO: 4162334 - RNA, 16 nt, Yersinia pestis
augaauauucaccacc

SEQ ID NO: 4162335 - RNA, 13 nt, Yersinia pestis
augaaugaggcug

SEQ ID NO: 4162336 - RNA, 16 nt, Yersinia pestis
augaaugaggcugagg

SEQ ID NO: 4162337 - RNA, 18 nt, Yersinia pestis
augaaugaggcugagguu

SEQ ID NO: 4162338 - RNA, 22 nt, Yersinia pestis
augaaugagguuuacauuuaaa

SEQ ID NO: 4162339 - RNA, 16 nt, Yersinia pestis
augaaugcgaacuacg

SEQ ID NO: 4162340 - RNA, 12 nt, Yersinia pestis
augaauuaucaa

SEQ ID NO: 4162341 - RNA, 12 nt, Yersinia pestis
augacaaauaag

SEQ ID NO: 4162342 - RNA, 19 nt, Yersinia pestis
augacaaguugucuguaau

SEQ ID NO: 4162343 - RNA, 23 nt, Yersinia pestis
augacaaguugucuguaauaaua

SEQ ID NO: 4162344 - RNA, 14 nt, Yersinia pestis
augacacaauuccc

SEQ ID NO: 4162345 - RNA, 22 nt, Yersinia pestis
augacagacgcgguuaacgacg

SEQ ID NO: 4162346 - RNA, 13 nt, Yersinia pestis
augacaguauuug

SEQ ID NO: 4162347 - RNA, 23 nt, Yersinia pestis
augacaguauuugcagcggauga

SEQ ID NO: 4162348 - RNA, 19 nt, Yersinia pestis
augacauugcgaauauugc

SEQ ID NO: 4162349 - RNA, 20 nt, Yersinia pestis
augaccaacuguaaaaucuu

SEQ ID NO: 4162350 - RNA, 15 nt, Yersinia pestis
augaccaauagucac

SEQ ID NO: 4162351 - RNA, 20 nt, Yersinia pestis
augaccacuggugaaagaaa

SEQ ID NO: 4162352 - RNA, 13 nt, Yersinia pestis
augaccaucaacu

SEQ ID NO: 4162353 - RNA, 18 nt, Yersinia pestis
augaccaucuuccagcau

SEQ ID NO: 4162354 - RNA, 14 nt, Yersinia pestis
augacccaacguca

SEQ ID NO: 4162355 - RNA, 13 nt, Yersinia pestis
augacccaaugga

SEQ ID NO: 4162356 - RNA, 23 nt, Yersinia pestis
augaccccgcgugcgcaucaaug

SEQ ID NO: 4162357 - RNA, 13 nt, Yersinia pestis
augaccgccagug

SEQ ID NO: 4162358 - RNA, 18 nt, Yersinia pestis
augaccgugacauuuuca

SEQ ID NO: 4162359 - RNA, 18 nt, Yersinia pestis
augacgaaaaacaccuau

SEQ ID NO: 4162360 - RNA, 19 nt, Yersinia pestis
augacgccaacuucaagcc

SEQ ID NO: 4162361 - RNA, 19 nt, Yersinia pestis
augacgcccgcagcggcua

SEQ ID NO: 4162362 - RNA, 17 nt, Yersinia pestis
augacgcgaucuugaac

SEQ ID NO: 4162363 - RNA, 17 nt, Yersinia pestis
augacgcgccauacugc

SEQ ID NO: 4162364 - RNA, 18 nt, Yersinia pestis
augacuaauugugcagca

SEQ ID NO: 4162365 - RNA, 21 nt, Yersinia pestis
augacuaauugugcagcauca

SEQ ID NO: 4162366 - RNA, 18 nt, Yersinia pestis
augacuaucccuucaauc

SEQ ID NO: 4162367 - RNA, 17 nt, Yersinia pestis
augacuccugaaauaaa

SEQ ID NO: 4162368 - RNA, 12 nt, Yersinia pestis
augacugaacau

SEQ ID NO: 4162369 - RNA, 14 nt, Yersinia pestis
augacuggcuauua

SEQ ID NO: 4162370 - RNA, 18 nt, Yersinia pestis
augacuuaacugaaagcc

SEQ ID NO: 4162371 - RNA, 13 nt, Yersinia pestis
augagaaguaaaa

SEQ ID NO: 4162372 - RNA, 13 nt, Yersinia pestis
augagaagugaga

SEQ ID NO: 4162373 - RNA, 21 nt, Yersinia pestis
augagaagugagaagugaaaa

SEQ ID NO: 4162374 - RNA, 20 nt, Yersinia pestis
augagaaugccgaacugaua

SEQ ID NO: 4162375 - RNA, 16 nt, Yersinia pestis
augagaauguaaauuu

SEQ ID NO: 4162376 - RNA, 14 nt, Yersinia pestis
augagaaugugacu

SEQ ID NO: 4162377 - RNA, 15 nt, Yersinia pestis
augagacaagagcaa

SEQ ID NO: 4162378 - RNA, 22 nt, Yersinia pestis
augagagcgaauggcaauggcc

SEQ ID NO: 4162379 - RNA, 20 nt, Yersinia pestis
augagauucaggagauagcc

SEQ ID NO: 4162380 - RNA, 18 nt, Yersinia pestis
augagcacggacagcagc

SEQ ID NO: 4162381 - RNA, 14 nt, Yersinia pestis
augagccuuacccc

SEQ ID NO: 4162382 - RNA, 23 nt, Yersinia pestis
augagcgcauugcacagguccau

SEQ ID NO: 4162383 - RNA, 19 nt, Yersinia pestis
augagcgccaaauguagag

SEQ ID NO: 4162384 - RNA, 19 nt, Yersinia pestis
augagcuggcaaaacucag

SEQ ID NO: 4162385 - RNA, 14 nt, Yersinia pestis
augagcuguagaac

SEQ ID NO: 4162386 - RNA, 21 nt, Yersinia pestis
augaggcuaccugcaccaauc

SEQ ID NO: 4162387 - RNA, 21 nt, Yersinia pestis
augaggcucuucugggcugaa

SEQ ID NO: 4162388 - RNA, 22 nt, Yersinia pestis
augagguaauacucauccagau

SEQ ID NO: 4162389 - RNA, 14 nt, Yersinia pestis
augaguaaaccgua

SEQ ID NO: 4162390 - RNA, 22 nt, Yersinia pestis
augaguaaaccguacauuaaau

SEQ ID NO: 4162391 - RNA, 13 nt, Yersinia pestis
augaguacuauuu

SEQ ID NO: 4162392 - RNA, 14 nt, Yersinia pestis
augaguaucaauau

SEQ ID NO: 4162393 - RNA, 14 nt, Yersinia pestis
augagucagucugu

SEQ ID NO: 4162394 - RNA, 15 nt, Yersinia pestis
augagucagucuguu

SEQ ID NO: 4162395 - RNA, 21 nt, Yersinia pestis
augagugaaaauauguaguug

SEQ ID NO: 4162396 - RNA, 13 nt, Yersinia pestis
augauaaaauccu

SEQ ID NO: 4162397 - RNA, 14 nt, Yersinia pestis
augauaaauaaccg

SEQ ID NO: 4162398 - RNA, 20 nt, Yersinia pestis
augauaaauacaaaauuaac

SEQ ID NO: 4162399 - RNA, 22 nt, Yersinia pestis
augauaaauucuugcgcuucau

SEQ ID NO: 4162400 - RNA, 16 nt, Yersinia pestis
augauaacaauaaaau

SEQ ID NO: 4162401 - RNA, 17 nt, Yersinia pestis
augauaacaauaaaauc

SEQ ID NO: 4162402 - RNA, 23 nt, Yersinia pestis
augauaagugaauaaaucaaagc

SEQ ID NO: 4162403 - RNA, 14 nt, Yersinia pestis
augauacgugcuau

SEQ ID NO: 4162404 - RNA, 18 nt, Yersinia pestis
augauagcgacacccuca

SEQ ID NO: 4162405 - RNA, 21 nt, Yersinia pestis
augauaggcacggcacuaaua

SEQ ID NO: 4162406 - RNA, 13 nt, Yersinia pestis
augauauagcugu

SEQ ID NO: 4162407 - RNA, 18 nt, Yersinia pestis
augaucaaacggauaauc

SEQ ID NO: 4162408 - RNA, 12 nt, Yersinia pestis
augaucaacagu

SEQ ID NO: 4162409 - RNA, 16 nt, Yersinia pestis
augaucaucaagccaa

SEQ ID NO: 4162410 - RNA, 11 nt, Yersinia pestis
augaucggcau

SEQ ID NO: 4162411 - RNA, 17 nt, Yersinia pestis
augaucuugauaaacau

SEQ ID NO: 4162412 - RNA, 15 nt, Yersinia pestis
augaucuuuauuauu

SEQ ID NO: 4162413 - RNA, 21 nt, Yersinia pestis
augaugaagcauuaaacagau

SEQ ID NO: 4162414 - RNA, 14 nt, Yersinia pestis
augaugacggugau

SEQ ID NO: 4162415 - RNA, 17 nt, Yersinia pestis
augaugacuuuuauuau

SEQ ID NO: 4162416 - RNA, 17 nt, Yersinia pestis
augaugauaucaccuuu

SEQ ID NO: 4162417 - RNA, 14 nt, Yersinia pestis
augaugauuauuuu

SEQ ID NO: 4162418 - RNA, 13 nt, Yersinia pestis
augaugauuuuua

SEQ ID NO: 4162419 - RNA, 15 nt, Yersinia pestis
augaugccgaucauc

SEQ ID NO: 4162420 - RNA, 18 nt, Yersinia pestis
augaugcggaagaaggcu

SEQ ID NO: 4162421 - RNA, 20 nt, Yersinia pestis
augauggcgugauggcgcag

SEQ ID NO: 4162422 - RNA, 19 nt, Yersinia pestis
augauggcguuuucuucga

SEQ ID NO: 4162423 - RNA, 21 nt, Yersinia pestis
augaugucgcgacucaagccu

SEQ ID NO: 4162424 - RNA, 20 nt, Yersinia pestis
augauguugauuaacccuuu

SEQ ID NO: 4162425 - RNA, 13 nt, Yersinia pestis
augauuaaauggu

SEQ ID NO: 4162426 - RNA, 22 nt, Yersinia pestis
augauuauuuauuuacagccac

SEQ ID NO: 4162427 - RNA, 15 nt, Yersinia pestis
augauuauuuuaugg

SEQ ID NO: 4162428 - RNA, 14 nt, Yersinia pestis
augauuauuuugug

SEQ ID NO: 4162429 - RNA, 15 nt, Yersinia pestis
augauucauugaguu

SEQ ID NO: 4162430 - RNA, 14 nt, Yersinia pestis
augauucgccauuc

SEQ ID NO: 4162431 - RNA, 22 nt, Yersinia pestis
augauucguagaaacaucgcca

SEQ ID NO: 4162432 - RNA, 14 nt, Yersinia pestis
augauugaaaaaca

SEQ ID NO: 4162433 - RNA, 16 nt, Yersinia pestis
augauugaaaaacaga

SEQ ID NO: 4162434 - RNA, 15 nt, Yersinia pestis
augauugauuaucaa

SEQ ID NO: 4162435 - RNA, 16 nt, Yersinia pestis
augauuggagcaaaug

SEQ ID NO: 4162436 - RNA, 19 nt, Yersinia pestis
augauuguuuuauggcgau

SEQ ID NO: 4162437 - RNA, 13 nt, Yersinia pestis
augauuuuuuuca

SEQ ID NO: 4162438 - RNA, 20 nt, Yersinia pestis
augcaaaaaaagacacuaac

SEQ ID NO: 4162439 - RNA, 15 nt, Yersinia pestis
augcaaaugucagau

SEQ ID NO: 4162440 - RNA, 21 nt, Yersinia pestis
augcaaaugucagaucgcgau

SEQ ID NO: 4162441 - RNA, 17 nt, Yersinia pestis
augcaacuuggcaccua

SEQ ID NO: 4162442 - RNA, 15 nt, Yersinia pestis
augcaaucuaacuaa

SEQ ID NO: 4162443 - RNA, 19 nt, Yersinia pestis
augcaauuuuugcagugca

SEQ ID NO: 4162444 - RNA, 16 nt, Yersinia pestis
augcacaguaggcuga

SEQ ID NO: 4162445 - RNA, 15 nt, Yersinia pestis
augcacaguugucug

SEQ ID NO: 4162446 - RNA, 19 nt, Yersinia pestis
augcacaguugucugaggc

SEQ ID NO: 4162447 - RNA, 17 nt, Yersinia pestis
augcaccaaauucagaa

SEQ ID NO: 4162448 - RNA, 16 nt, Yersinia pestis
augcaccaaucaacau

SEQ ID NO: 4162449 - RNA, 16 nt, Yersinia pestis
augcaccuacaaauuu

SEQ ID NO: 4162450 - RNA, 14 nt, Yersinia pestis
augcacuccacuau

SEQ ID NO: 4162451 - RNA, 16 nt, Yersinia pestis
augcagacucuuauau

SEQ ID NO: 4162452 - RNA, 14 nt, Yersinia pestis
augcagagaugcag

SEQ ID NO: 4162453 - RNA, 14 nt, Yersinia pestis
augcagauaucagc

SEQ ID NO: 4162454 - RNA, 16 nt, Yersinia pestis
augcagaugccaauga

SEQ ID NO: 4162455 - RNA, 15 nt, Yersinia pestis
augcagcauuucagg

SEQ ID NO: 4162456 - RNA, 16 nt, Yersinia pestis
augcagcauuucagga

SEQ ID NO: 4162457 - RNA, 22 nt, Yersinia pestis
augcagcguauucaguaaaaac

SEQ ID NO: 4162458 - RNA, 17 nt, Yersinia pestis
augcagcucaaucacau

SEQ ID NO: 4162459 - RNA, 18 nt, Yersinia pestis
augcagggagguuauauu

SEQ ID NO: 4162460 - RNA, 20 nt, Yersinia pestis
augcaggggaaauggugucu

SEQ ID NO: 4162461 - RNA, 21 nt, Yersinia pestis
augcaggggggcguuaucacg

SEQ ID NO: 4162462 - RNA, 18 nt, Yersinia pestis
augcagguuuugccagau

SEQ ID NO: 4162463 - RNA, 12 nt, Yersinia pestis
augcaguaaaua

SEQ ID NO: 4162464 - RNA, 23 nt, Yersinia pestis
augcaguaacgggucucaaugca

SEQ ID NO: 4162465 - RNA, 15 nt, Yersinia pestis
augcaguuuauccaa

SEQ ID NO: 4162466 - RNA, 12 nt, Yersinia pestis
augcauauguag

SEQ ID NO: 4162467 - RNA, 21 nt, Yersinia pestis
augcauauuugcagaaaguaa

SEQ ID NO: 4162468 - RNA, 19 nt, Yersinia pestis
augcauccaagccaucauu

SEQ ID NO: 4162469 - RNA, 19 nt, Yersinia pestis
augcauguuauuggcuaaa

SEQ ID NO: 4162470 - RNA, 13 nt, Yersinia pestis
augcauuauaagg

SEQ ID NO: 4162471 - RNA, 14 nt, Yersinia pestis
augccaagaauaau

SEQ ID NO: 4162472 - RNA, 17 nt, Yersinia pestis
augccaagucuuauugc

SEQ ID NO: 4162473 - RNA, 18 nt, Yersinia pestis
augccaauuccauauuua

SEQ ID NO: 4162474 - RNA, 16 nt, Yersinia pestis
augccacuucgcuacg

SEQ ID NO: 4162475 - RNA, 17 nt, Yersinia pestis
augccaguaauucacug

SEQ ID NO: 4162476 - RNA, 21 nt, Yersinia pestis
augccaguacagugaaaaugg

SEQ ID NO: 4162477 - RNA, 15 nt, Yersinia pestis
augccagucaaugac

SEQ ID NO: 4162478 - RNA, 15 nt, Yersinia pestis
augccauagcugcug

SEQ ID NO: 4162479 - RNA, 19 nt, Yersinia pestis
augccaucccccuuuggcc

SEQ ID NO: 4162480 - RNA, 20 nt, Yersinia pestis
augccauggcgaaaauccuu

SEQ ID NO: 4162481 - RNA, 14 nt, Yersinia pestis
augccauucaagcc

SEQ ID NO: 4162482 - RNA, 16 nt, Yersinia pestis
augccccgcuauugcc

SEQ ID NO: 4162483 - RNA, 16 nt, Yersinia pestis
augcccugagauuauu

SEQ ID NO: 4162484 - RNA, 22 nt, Yersinia pestis
augccgccugacugcccgccug

SEQ ID NO: 4162485 - RNA, 17 nt, Yersinia pestis
augccgcuaacaaccgu

SEQ ID NO: 4162486 - RNA, 16 nt, Yersinia pestis
augccgcuccagcacu

SEQ ID NO: 4162487 - RNA, 22 nt, Yersinia pestis
augccggaggauauuuauuauu

SEQ ID NO: 4162488 - RNA, 14 nt, Yersinia pestis
augccggugagcac

SEQ ID NO: 4162489 - RNA, 15 nt, Yersinia pestis
augccggugagcacg

SEQ ID NO: 4162490 - RNA, 20 nt, Yersinia pestis
augccguuaauugugaucag

SEQ ID NO: 4162491 - RNA, 21 nt, Yersinia pestis
augccuauuugcagaaaguaa

SEQ ID NO: 4162492 - RNA, 23 nt, Yersinia pestis
augccucacggcuaccagcagca

SEQ ID NO: 4162493 - RNA, 20 nt, Yersinia pestis
augccucugcuaacaacagu

SEQ ID NO: 4162494 - RNA, 14 nt, Yersinia pestis
augccuuacgggag

SEQ ID NO: 4162495 - RNA, 17 nt, Yersinia pestis
augccuuggcaaagaga

SEQ ID NO: 4162496 - RNA, 21 nt, Yersinia pestis
augccuuggcauguucagggu

SEQ ID NO: 4162497 - RNA, 15 nt, Yersinia pestis
augccuuguuucugg

SEQ ID NO: 4162498 - RNA, 16 nt, Yersinia pestis
augccuuguuucuggc

SEQ ID NO: 4162499 - RNA, 21 nt, Yersinia pestis
augccuuuuaaaugaagcagu

SEQ ID NO: 4162500 - RNA, 12 nt, Yersinia pestis
augccuuuucuu

SEQ ID NO: 4162501 - RNA, 13 nt, Yersinia pestis
augccuuuucuuc

SEQ ID NO: 4162502 - RNA, 14 nt, Yersinia pestis
augcgaaaaaauau

SEQ ID NO: 4162503 - RNA, 14 nt, Yersinia pestis
augcgaauacuuug

SEQ ID NO: 4162504 - RNA, 22 nt, Yersinia pestis
augcgacaccugcuaucaugau

SEQ ID NO: 4162505 - RNA, 14 nt, Yersinia pestis
augcgagcaaggca

SEQ ID NO: 4162506 - RNA, 22 nt, Yersinia pestis
augcgauacgcccgccccagca

SEQ ID NO: 4162507 - RNA, 13 nt, Yersinia pestis
augcgauuuuuga

SEQ ID NO: 4162508 - RNA, 17 nt, Yersinia pestis
augcgcccgcgcaggca

SEQ ID NO: 4162509 - RNA, 15 nt, Yersinia pestis
augcgcgacauuuug

SEQ ID NO: 4162510 - RNA, 17 nt, Yersinia pestis
augcgcgcgucacuaaa

SEQ ID NO: 4162511 - RNA, 19 nt, Yersinia pestis
augcgcucgcuugcugccu

SEQ ID NO: 4162512 - RNA, 16 nt, Yersinia pestis
augcggauaucuugau

SEQ ID NO: 4162513 - RNA, 17 nt, Yersinia pestis
augcgguucuguaucau

SEQ ID NO: 4162514 - RNA, 18 nt, Yersinia pestis
augcguaucauuauugau

SEQ ID NO: 4162515 - RNA, 19 nt, Yersinia pestis
augcgucuuuagauuucac

SEQ ID NO: 4162516 - RNA, 15 nt, Yersinia pestis
augcguuguaauaac

SEQ ID NO: 4162517 - RNA, 12 nt, Yersinia pestis
augcuaaaaaac

SEQ ID NO: 4162518 - RNA, 18 nt, Yersinia pestis
augcuaacaacuuccaca

SEQ ID NO: 4162519 - RNA, 17 nt, Yersinia pestis
augcuaacucgcgauaa

SEQ ID NO: 4162520 - RNA, 11 nt, Yersinia pestis
augcuaauuuc

SEQ ID NO: 4162521 - RNA, 13 nt, Yersinia pestis
augcuaauuucau

SEQ ID NO: 4162522 - RNA, 18 nt, Yersinia pestis
augcuacggauugcaaau

SEQ ID NO: 4162523 - RNA, 21 nt, Yersinia pestis
augcuauauuuggcuuucagc

SEQ ID NO: 4162524 - RNA, 18 nt, Yersinia pestis
augcuauuuacugcauuc

SEQ ID NO: 4162525 - RNA, 21 nt, Yersinia pestis
augcucaaguguaaaagauag

SEQ ID NO: 4162526 - RNA, 13 nt, Yersinia pestis
augcucacaauca

SEQ ID NO: 4162527 - RNA, 23 nt, Yersinia pestis
augcucacugccgcguaauaaac

SEQ ID NO: 4162528 - RNA, 17 nt, Yersinia pestis
augcucaucaaguauuu

SEQ ID NO: 4162529 - RNA, 14 nt, Yersinia pestis
augcucauuuaaaa

SEQ ID NO: 4162530 - RNA, 16 nt, Yersinia pestis
augcucauuuaaaaua

SEQ ID NO: 4162531 - RNA, 11 nt, Yersinia pestis
augcuccagau

SEQ ID NO: 4162532 - RNA, 21 nt, Yersinia pestis
augcucggugcgguaucaaca

SEQ ID NO: 4162533 - RNA, 19 nt, Yersinia pestis
augcucucgagaaauaaau

SEQ ID NO: 4162534 - RNA, 16 nt, Yersinia pestis
augcucugcugggaua

SEQ ID NO: 4162535 - RNA, 21 nt, Yersinia pestis
augcucuucaccaaaggaagc

SEQ ID NO: 4162536 - RNA, 18 nt, Yersinia pestis
augcucuucauaagccag

SEQ ID NO: 4162537 - RNA, 18 nt, Yersinia pestis
augcucuuuuuaugcagg

SEQ ID NO: 4162538 - RNA, 15 nt, Yersinia pestis
augcugaccacugcu

SEQ ID NO: 4162539 - RNA, 14 nt, Yersinia pestis
augcugauaaaauu

SEQ ID NO: 4162540 - RNA, 21 nt, Yersinia pestis
augcuggcccaguagagcacu

SEQ ID NO: 4162541 - RNA, 22 nt, Yersinia pestis
augcuggcccaguagagcacuu

SEQ ID NO: 4162542 - RNA, 16 nt, Yersinia pestis
augcuggugcucggca

SEQ ID NO: 4162543 - RNA, 17 nt, Yersinia pestis
augcuggugcucggcau

SEQ ID NO: 4162544 - RNA, 20 nt, Yersinia pestis
augcugucacugucaaaacc

SEQ ID NO: 4162545 - RNA, 14 nt, Yersinia pestis
augcuuaaagccuu

SEQ ID NO: 4162546 - RNA, 19 nt, Yersinia pestis
augcuuucaucgaaaaaaa

SEQ ID NO: 4162547 - RNA, 20 nt, Yersinia pestis
auggaaaaauuagccaagca

SEQ ID NO: 4162548 - RNA, 21 nt, Yersinia pestis
auggaaaauauucuaaguaaa

SEQ ID NO: 4162549 - RNA, 19 nt, Yersinia pestis
auggaaauacgcuuaccug

SEQ ID NO: 4162550 - RNA, 15 nt, Yersinia pestis
auggaaauagcucaa

SEQ ID NO: 4162551 - RNA, 17 nt, Yersinia pestis
auggaaauccguuuuuu

SEQ ID NO: 4162552 - RNA, 18 nt, Yersinia pestis
auggaaauuauuuagaaa

SEQ ID NO: 4162553 - RNA, 13 nt, Yersinia pestis
auggaagaccaga

SEQ ID NO: 4162554 - RNA, 13 nt, Yersinia pestis
auggaagauagau

SEQ ID NO: 4162555 - RNA, 22 nt, Yersinia pestis
auggaccgcgacacaagccauu

SEQ ID NO: 4162556 - RNA, 13 nt, Yersinia pestis
auggacgaacagc

SEQ ID NO: 4162557 - RNA, 17 nt, Yersinia pestis
auggacgaacagcccca

SEQ ID NO: 4162558 - RNA, 22 nt, Yersinia pestis
auggacgaacagugccaacagc

SEQ ID NO: 4162559 - RNA, 16 nt, Yersinia pestis
auggacgauuaccguu

SEQ ID NO: 4162560 - RNA, 14 nt, Yersinia pestis
auggacggcauaua

SEQ ID NO: 4162561 - RNA, 14 nt, Yersinia pestis
auggagagauguug

SEQ ID NO: 4162562 - RNA, 22 nt, Yersinia pestis
auggagaucugggcgacccaaa

SEQ ID NO: 4162563 - RNA, 19 nt, Yersinia pestis
auggauaaauucagccgcu

SEQ ID NO: 4162564 - RNA, 14 nt, Yersinia pestis
auggaugaccaaug

SEQ ID NO: 4162565 - RNA, 18 nt, Yersinia pestis
auggauguauuuacggcg

SEQ ID NO: 4162566 - RNA, 15 nt, Yersinia pestis
auggaugugauccac

SEQ ID NO: 4162567 - RNA, 14 nt, Yersinia pestis
auggauucucuaua

SEQ ID NO: 4162568 - RNA, 23 nt, Yersinia pestis
auggauucuugcugcaaccguga

SEQ ID NO: 4162569 - RNA, 17 nt, Yersinia pestis
auggauugaaaccgcug

SEQ ID NO: 4162570 - RNA, 18 nt, Yersinia pestis
auggcaaaggauaaugau

SEQ ID NO: 4162571 - RNA, 15 nt, Yersinia pestis
auggcaacagcaugg

SEQ ID NO: 4162572 - RNA, 15 nt, Yersinia pestis
auggcaaccccugcc

SEQ ID NO: 4162573 - RNA, 20 nt, Yersinia pestis
auggcaccgugggcaaagaa

SEQ ID NO: 4162574 - RNA, 22 nt, Yersinia pestis
auggcagcccuuauucaaagaa

SEQ ID NO: 4162575 - RNA, 17 nt, Yersinia pestis
auggcagguaucaauac

SEQ ID NO: 4162576 - RNA, 13 nt, Yersinia pestis
auggcauuuucag

SEQ ID NO: 4162577 - RNA, 14 nt, Yersinia pestis
auggccagacacug

SEQ ID NO: 4162578 - RNA, 15 nt, Yersinia pestis
auggccaugaaucaa

SEQ ID NO: 4162579 - RNA, 19 nt, Yersinia pestis
auggccaugaaucaaauua

SEQ ID NO: 4162580 - RNA, 15 nt, Yersinia pestis
auggccauuaccccg

SEQ ID NO: 4162581 - RNA, 18 nt, Yersinia pestis
auggcccaagccauccuu

SEQ ID NO: 4162582 - RNA, 15 nt, Yersinia pestis
auggccgccagcacg

SEQ ID NO: 4162583 - RNA, 17 nt, Yersinia pestis
auggccguaucaugggu

SEQ ID NO: 4162584 - RNA, 18 nt, Yersinia pestis
auggcgaaaauccuucau

SEQ ID NO: 4162585 - RNA, 18 nt, Yersinia pestis
auggcgaugaugauuauu

SEQ ID NO: 4162586 - RNA, 16 nt, Yersinia pestis
auggcgcacauuacaa

SEQ ID NO: 4162587 - RNA, 21 nt, Yersinia pestis
auggcgcagacccgugaacau

SEQ ID NO: 4162588 - RNA, 20 nt, Yersinia pestis
auggcgcaguguaaaaccug

SEQ ID NO: 4162589 - RNA, 14 nt, Yersinia pestis
auggcgcggcucga

SEQ ID NO: 4162590 - RNA, 16 nt, Yersinia pestis
auggcggcuugguugc

SEQ ID NO: 4162591 - RNA, 22 nt, Yersinia pestis
auggcggucgcacugugagcgg

SEQ ID NO: 4162592 - RNA, 22 nt, Yersinia pestis
auggcuaaacucuggcacuggc

SEQ ID NO: 4162593 - RNA, 20 nt, Yersinia pestis
auggcuaagcacaauuguua

SEQ ID NO: 4162594 - RNA, 16 nt, Yersinia pestis
auggcuaauuaauuua

SEQ ID NO: 4162595 - RNA, 18 nt, Yersinia pestis
auggcuccaccguucagg

SEQ ID NO: 4162596 - RNA, 17 nt, Yersinia pestis
auggcugaaauaacuua

SEQ ID NO: 4162597 - RNA, 17 nt, Yersinia pestis
auggcugccaucaggau

SEQ ID NO: 4162598 - RNA, 15 nt, Yersinia pestis
auggcugucugauga

SEQ ID NO: 4162599 - RNA, 15 nt, Yersinia pestis
auggcuuauuucacu

SEQ ID NO: 4162600 - RNA, 16 nt, Yersinia pestis
auggcuugugcagcaa

SEQ ID NO: 4162601 - RNA, 14 nt, Yersinia pestis
auggcuuuacgcaa

SEQ ID NO: 4162602 - RNA, 22 nt, Yersinia pestis
auggcuuuagguugagaauuaa

SEQ ID NO: 4162603 - RNA, 17 nt, Yersinia pestis
auggcuuuggugaucau

SEQ ID NO: 4162604 - RNA, 14 nt, Yersinia pestis
auggcuuuuuuaau

SEQ ID NO: 4162605 - RNA, 20 nt, Yersinia pestis
auggcuuuuuuacgcgccug

SEQ ID NO: 4162606 - RNA, 22 nt, Yersinia pestis
auggcuuuuuuacgcgccugcu

SEQ ID NO: 4162607 - RNA, 13 nt, Yersinia pestis
augggaugcccac

SEQ ID NO: 4162608 - RNA, 13 nt, Yersinia pestis
augggcagaagag

SEQ ID NO: 4162609 - RNA, 21 nt, Yersinia pestis
augggcgccgcuuuaccuguu

SEQ ID NO: 4162610 - RNA, 22 nt, Yersinia pestis
augggcugcacuuuuacgggcc

SEQ ID NO: 4162611 - RNA, 24 nt, Yersinia pestis
auggggaaaagcaguaagcaugaa

SEQ ID NO: 4162612 - RNA, 15 nt, Yersinia pestis
auggggagcuugccu

SEQ ID NO: 4162613 - RNA, 20 nt, Yersinia pestis
auggggccaccuaauccaag

SEQ ID NO: 4162614 - RNA, 20 nt, Yersinia pestis
augggguaaucccgaaucaa

SEQ ID NO: 4162615 - RNA, 21 nt, Yersinia pestis
augggguuuauugguuauuuu

SEQ ID NO: 4162616 - RNA, 22 nt, Yersinia pestis
auggucaacuaaacagaucacc

SEQ ID NO: 4162617 - RNA, 13 nt, Yersinia pestis
auggucacccuca

SEQ ID NO: 4162618 - RNA, 16 nt, Yersinia pestis
auggucacccuuuuga

SEQ ID NO: 4162619 - RNA, 19 nt, Yersinia pestis
auggucaggaacccauuug

SEQ ID NO: 4162620 - RNA, 18 nt, Yersinia pestis
auggucauaaaaucgaua

SEQ ID NO: 4162621 - RNA, 15 nt, Yersinia pestis
auggucauccacaac

SEQ ID NO: 4162622 - RNA, 17 nt, Yersinia pestis
auggucgucauguuuaa

SEQ ID NO: 4162623 - RNA, 15 nt, Yersinia pestis
auggugaaccagaua

SEQ ID NO: 4162624 - RNA, 18 nt, Yersinia pestis
auggugggccgugcggga

SEQ ID NO: 4162625 - RNA, 18 nt, Yersinia pestis
auggugggucgugcggga

SEQ ID NO: 4162626 - RNA, 17 nt, Yersinia pestis
augguguaaaugcccgu

SEQ ID NO: 4162627 - RNA, 20 nt, Yersinia pestis
augguguguagucuucauca

SEQ ID NO: 4162628 - RNA, 15 nt, Yersinia pestis
augguuaaaacucaa

SEQ ID NO: 4162629 - RNA, 19 nt, Yersinia pestis
augguuaaucuacccgaau

SEQ ID NO: 4162630 - RNA, 18 nt, Yersinia pestis
augguuaccaaaaagcaa

SEQ ID NO: 4162631 - RNA, 18 nt, Yersinia pestis
augguuagguugaaauac

SEQ ID NO: 4162632 - RNA, 18 nt, Yersinia pestis
augguucaucauuuuuua

SEQ ID NO: 4162633 - RNA, 22 nt, Yersinia pestis
augguugcucaaguuauacugu

SEQ ID NO: 4162634 - RNA, 16 nt, Yersinia pestis
augguuuccaguacug

SEQ ID NO: 4162635 - RNA, 12 nt, Yersinia pestis
augguuuugugu

SEQ ID NO: 4162636 - RNA, 20 nt, Yersinia pestis
auguaaaacacgcaacacuu

SEQ ID NO: 4162637 - RNA, 15 nt, Yersinia pestis
auguaacacacagca

SEQ ID NO: 4162638 - RNA, 16 nt, Yersinia pestis
auguacacauuauuua

SEQ ID NO: 4162639 - RNA, 18 nt, Yersinia pestis
auguacaccuaaaacaua

SEQ ID NO: 4162640 - RNA, 21 nt, Yersinia pestis
auguacgcaaguaucuuaccg

SEQ ID NO: 4162641 - RNA, 21 nt, Yersinia pestis
auguacguucagguaucgcuu

SEQ ID NO: 4162642 - RNA, 15 nt, Yersinia pestis
auguacuacuucaua

SEQ ID NO: 4162643 - RNA, 15 nt, Yersinia pestis
auguacuuaauacug

SEQ ID NO: 4162644 - RNA, 15 nt, Yersinia pestis
auguagaaguugccg

SEQ ID NO: 4162645 - RNA, 14 nt, Yersinia pestis
auguagagauuagg

SEQ ID NO: 4162646 - RNA, 19 nt, Yersinia pestis
auguaguacuuaccuuccc

SEQ ID NO: 4162647 - RNA, 14 nt, Yersinia pestis
auguaguucagucg

SEQ ID NO: 4162648 - RNA, 12 nt, Yersinia pestis
auguauaaaaaa

SEQ ID NO: 4162649 - RNA, 19 nt, Yersinia pestis
auguauaaaaaagauaaua

SEQ ID NO: 4162650 - RNA, 13 nt, Yersinia pestis
auguauaaagaau

SEQ ID NO: 4162651 - RNA, 23 nt, Yersinia pestis
auguauauguugggaaauaacca

SEQ ID NO: 4162652 - RNA, 20 nt, Yersinia pestis
auguauccaaggcagauauu

SEQ ID NO: 4162653 - RNA, 15 nt, Yersinia pestis
auguauucaagcgau

SEQ ID NO: 4162654 - RNA, 15 nt, Yersinia pestis
augucaauuaaaaac

SEQ ID NO: 4162655 - RNA, 13 nt, Yersinia pestis
augucaccuccac

SEQ ID NO: 4162656 - RNA, 15 nt, Yersinia pestis
augucacguuaaguu

SEQ ID NO: 4162657 - RNA, 20 nt, Yersinia pestis
augucaucuuccgucaguug

SEQ ID NO: 4162658 - RNA, 13 nt, Yersinia pestis
augucaugauaaa

SEQ ID NO: 4162659 - RNA, 19 nt, Yersinia pestis
augucaugcaauuacugca

SEQ ID NO: 4162660 - RNA, 16 nt, Yersinia pestis
augucaugguuaaacu

SEQ ID NO: 4162661 - RNA, 22 nt, Yersinia pestis
auguccucaccauuuauugcca

SEQ ID NO: 4162662 - RNA, 22 nt, Yersinia pestis
augucgaaagauagcaaaagaa

SEQ ID NO: 4162663 - RNA, 20 nt, Yersinia pestis
augucgcccccucuggcaua

SEQ ID NO: 4162664 - RNA, 21 nt, Yersinia pestis
augucgcgacucaagccucua

SEQ ID NO: 4162665 - RNA, 23 nt, Yersinia pestis
augucgcuguagcgccagguaag

SEQ ID NO: 4162666 - RNA, 19 nt, Yersinia pestis
augucucuauucacuauuu

SEQ ID NO: 4162667 - RNA, 21 nt, Yersinia pestis
augucuuuacuaaauuagaaa

SEQ ID NO: 4162668 - RNA, 19 nt, Yersinia pestis
augugaaacauaauuaaau

SEQ ID NO: 4162669 - RNA, 14 nt, Yersinia pestis
augugauaccuaaa

SEQ ID NO: 4162670 - RNA, 15 nt, Yersinia pestis
augugauauuuuacu

SEQ ID NO: 4162671 - RNA, 23 nt, Yersinia pestis
augugauguggcuugcaaucaga

SEQ ID NO: 4162672 - RNA, 12 nt, Yersinia pestis
augugcccuugu

SEQ ID NO: 4162673 - RNA, 18 nt, Yersinia pestis
augugcggaaauaaacau

SEQ ID NO: 4162674 - RNA, 22 nt, Yersinia pestis
augugcggaaauaaacaucaaa

SEQ ID NO: 4162675 - RNA, 18 nt, Yersinia pestis
augugcuucuuuaaucac

SEQ ID NO: 4162676 - RNA, 14 nt, Yersinia pestis
auguggauaauuuc

SEQ ID NO: 4162677 - RNA, 22 nt, Yersinia pestis
auguggauaauuucagcagcac

SEQ ID NO: 4162678 - RNA, 22 nt, Yersinia pestis
auguguaguaugcgauuuuuga

SEQ ID NO: 4162679 - RNA, 20 nt, Yersinia pestis
auguguaguugaaguucaca

SEQ ID NO: 4162680 - RNA, 14 nt, Yersinia pestis
auguguugaauauc

SEQ ID NO: 4162681 - RNA, 13 nt, Yersinia pestis
auguuaaaucagu

SEQ ID NO: 4162682 - RNA, 15 nt, Yersinia pestis
auguuagagauaaca

SEQ ID NO: 4162683 - RNA, 16 nt, Yersinia pestis
auguuaucgccaacac

SEQ ID NO: 4162684 - RNA, 16 nt, Yersinia pestis
auguuauggauuuuua

SEQ ID NO: 4162685 - RNA, 14 nt, Yersinia pestis
auguucagccgcuc

SEQ ID NO: 4162686 - RNA, 23 nt, Yersinia pestis
auguuccggacuucauaaauauu

SEQ ID NO: 4162687 - RNA, 21 nt, Yersinia pestis
auguuccugaauggcaucacc

SEQ ID NO: 4162688 - RNA, 20 nt, Yersinia pestis
auguuccuguugcuggccag

SEQ ID NO: 4162689 - RNA, 19 nt, Yersinia pestis
auguugauauaagcagcac

SEQ ID NO: 4162690 - RNA, 17 nt, Yersinia pestis
auguugcacugacggca

SEQ ID NO: 4162691 - RNA, 20 nt, Yersinia pestis
auguugcccuuaguuggcaa

SEQ ID NO: 4162692 - RNA, 14 nt, Yersinia pestis
auguuguucaaugc

SEQ ID NO: 4162693 - RNA, 15 nt, Yersinia pestis
auguuguucaaugcg

SEQ ID NO: 4162694 - RNA, 17 nt, Yersinia pestis
auguuuauauugauaaa

SEQ ID NO: 4162695 - RNA, 23 nt, Yersinia pestis
auguuucgcgguauuuggcauuc

SEQ ID NO: 4162696 - RNA, 22 nt, Yersinia pestis
auguuucuauccgaaaaauauu

SEQ ID NO: 4162697 - RNA, 18 nt, Yersinia pestis
auguuugaugguuaugug

SEQ ID NO: 4162698 - RNA, 13 nt, Yersinia pestis
auguuugauuaag

SEQ ID NO: 4162699 - RNA, 17 nt, Yersinia pestis
auguuuguugauguaag

SEQ ID NO: 4162700 - RNA, 13 nt, Yersinia pestis
auguuuugcugcc

SEQ ID NO: 4162701 - RNA, 17 nt, Yersinia pestis
auguuuugcugccauuu

SEQ ID NO: 4162702 - RNA, 16 nt, Yersinia pestis
auguuuuuaacaaaau

SEQ ID NO: 4162703 - RNA, 16 nt, Yersinia pestis
auuaaaaaagguggcc

SEQ ID NO: 4162704 - RNA, 20 nt, Yersinia pestis
auuaaaaaauaauuuuaugg

SEQ ID NO: 4162705 - RNA, 12 nt, Yersinia pestis
auuaaaaacaaa

SEQ ID NO: 4162706 - RNA, 12 nt, Yersinia pestis
auuaaaaacccu

SEQ ID NO: 4162707 - RNA, 13 nt, Yersinia pestis
auuaaaaacccuc

SEQ ID NO: 4162708 - RNA, 13 nt, Yersinia pestis
auuaaaaauacaa

SEQ ID NO: 4162709 - RNA, 14 nt, Yersinia pestis
auuaaaaauacaac

SEQ ID NO: 4162710 - RNA, 13 nt, Yersinia pestis
auuaaaaauuaau

SEQ ID NO: 4162711 - RNA, 16 nt, Yersinia pestis
auuaaaaccacgcauu

SEQ ID NO: 4162712 - RNA, 12 nt, Yersinia pestis
auuaaaauaaca

SEQ ID NO: 4162713 - RNA, 13 nt, Yersinia pestis
auuaaaauaacaa

SEQ ID NO: 4162714 - RNA, 21 nt, Yersinia pestis
auuaaaaucacccgcaagaau

SEQ ID NO: 4162715 - RNA, 23 nt, Yersinia pestis
auuaaacagucuuauuacucauu

SEQ ID NO: 4162716 - RNA, 22 nt, Yersinia pestis
auuaaacgccugggauccauag

SEQ ID NO: 4162717 - RNA, 13 nt, Yersinia pestis
auuaaacgcucau

SEQ ID NO: 4162718 - RNA, 19 nt, Yersinia pestis
auuaaacgucucuuuuuca

SEQ ID NO: 4162719 - RNA, 20 nt, Yersinia pestis
auuaaacgucucuuuuucau

SEQ ID NO: 4162720 - RNA, 15 nt, Yersinia pestis
auuaaacuauuaacu

SEQ ID NO: 4162721 - RNA, 11 nt, Yersinia pestis
auuaaacugaa

SEQ ID NO: 4162722 - RNA, 14 nt, Yersinia pestis
auuaaacuugcucu

SEQ ID NO: 4162723 - RNA, 14 nt, Yersinia pestis
auuaaagauuucau

SEQ ID NO: 4162724 - RNA, 20 nt, Yersinia pestis
auuaaagccauucagcagca

SEQ ID NO: 4162725 - RNA, 12 nt, Yersinia pestis
auuaaauaagaa

SEQ ID NO: 4162726 - RNA, 12 nt, Yersinia pestis
auuaaauagggc

SEQ ID NO: 4162727 - RNA, 16 nt, Yersinia pestis
auuaaauguauaaaaa

SEQ ID NO: 4162728 - RNA, 14 nt, Yersinia pestis
auuaaauuuuauga

SEQ ID NO: 4162729 - RNA, 20 nt, Yersinia pestis
auuaaauuuuaugacacaua

SEQ ID NO: 4162730 - RNA, 14 nt, Yersinia pestis
auuaacaaagcuau

SEQ ID NO: 4162731 - RNA, 12 nt, Yersinia pestis
auuaacaagcga

SEQ ID NO: 4162732 - RNA, 22 nt, Yersinia pestis
auuaacaauguuauauuucuua

SEQ ID NO: 4162733 - RNA, 12 nt, Yersinia pestis
auuaacauccau

SEQ ID NO: 4162734 - RNA, 13 nt, Yersinia pestis
auuaacauccauu

SEQ ID NO: 4162735 - RNA, 22 nt, Yersinia pestis
auuaaccaagcucgccaucgca

SEQ ID NO: 4162736 - RNA, 23 nt, Yersinia pestis
auuaaccgcuccaggcuggccac

SEQ ID NO: 4162737 - RNA, 16 nt, Yersinia pestis
auuaaccuuaucacca

SEQ ID NO: 4162738 - RNA, 15 nt, Yersinia pestis
auuaacgauuauuaa

SEQ ID NO: 4162739 - RNA, 23 nt, Yersinia pestis
auuaacggugcgacaaugccccc

SEQ ID NO: 4162740 - RNA, 15 nt, Yersinia pestis
auuaacuucaauuug

SEQ ID NO: 4162741 - RNA, 23 nt, Yersinia pestis
auuaacuuuucuucauugcugcu

SEQ ID NO: 4162742 - RNA, 14 nt, Yersinia pestis
auuaagaaaccagc

SEQ ID NO: 4162743 - RNA, 21 nt, Yersinia pestis
auuaagacaaggaaaaggcag

SEQ ID NO: 4162744 - RNA, 21 nt, Yersinia pestis
auuaagauaauagcuaaacau

SEQ ID NO: 4162745 - RNA, 21 nt, Yersinia pestis
auuaagccgacucgaacuugu

SEQ ID NO: 4162746 - RNA, 16 nt, Yersinia pestis
auuaaggaaacucaug

SEQ ID NO: 4162747 - RNA, 12 nt, Yersinia pestis
auuaaggagugc

SEQ ID NO: 4162748 - RNA, 23 nt, Yersinia pestis
auuaaguccaagaagauaacuuu

SEQ ID NO: 4162749 - RNA, 15 nt, Yersinia pestis
auuaauaaaaccuuu

SEQ ID NO: 4162750 - RNA, 16 nt, Yersinia pestis
auuaauaaauauccuc

SEQ ID NO: 4162751 - RNA, 19 nt, Yersinia pestis
auuaauaaccauaaaauaa

SEQ ID NO: 4162752 - RNA, 14 nt, Yersinia pestis
auuaauaacgccga

SEQ ID NO: 4162753 - RNA, 21 nt, Yersinia pestis
auuaauaauaacgucgccagu

SEQ ID NO: 4162754 - RNA, 21 nt, Yersinia pestis
auuaauacaacguuuaguaau

SEQ ID NO: 4162755 - RNA, 13 nt, Yersinia pestis
auuaauacaucau

SEQ ID NO: 4162756 - RNA, 15 nt, Yersinia pestis
auuaauacaucauca

SEQ ID NO: 4162757 - RNA, 21 nt, Yersinia pestis
auuaauaguguuguaagauuu

SEQ ID NO: 4162758 - RNA, 18 nt, Yersinia pestis
auuaauauauaaaauaaa

SEQ ID NO: 4162759 - RNA, 14 nt, Yersinia pestis
auuaauauccaauu

SEQ ID NO: 4162760 - RNA, 20 nt, Yersinia pestis
auuaauaugccgacaaccaa

SEQ ID NO: 4162761 - RNA, 23 nt, Yersinia pestis
auuaaucaagauauuacuucuuu

SEQ ID NO: 4162762 - RNA, 15 nt, Yersinia pestis
auuaaucagcauuaa

SEQ ID NO: 4162763 - RNA, 18 nt, Yersinia pestis
auuaauccccaggugcuu

SEQ ID NO: 4162764 - RNA, 18 nt, Yersinia pestis
auuaaucguuauaauauu

SEQ ID NO: 4162765 - RNA, 19 nt, Yersinia pestis
auuaaucguuauaauauua

SEQ ID NO: 4162766 - RNA, 21 nt, Yersinia pestis
auuaaucguuauaauauuaaa

SEQ ID NO: 4162767 - RNA, 21 nt, Yersinia pestis
auuaaucuaauuucaaaugaa

SEQ ID NO: 4162768 - RNA, 22 nt, Yersinia pestis
auuaaucuauuaauaucgaggu

SEQ ID NO: 4162769 - RNA, 23 nt, Yersinia pestis
auuaaucuuguaaagacgcuaau

SEQ ID NO: 4162770 - RNA, 19 nt, Yersinia pestis
auuaaugagccuuaccccu

SEQ ID NO: 4162771 - RNA, 12 nt, Yersinia pestis
auuaaugauaac

SEQ ID NO: 4162772 - RNA, 14 nt, Yersinia pestis
auuaaugcaccuac

SEQ ID NO: 4162773 - RNA, 23 nt, Yersinia pestis
auuaauggcagcauacauaucau

SEQ ID NO: 4162774 - RNA, 15 nt, Yersinia pestis
auuaauggucaaggu

SEQ ID NO: 4162775 - RNA, 22 nt, Yersinia pestis
auuaauguacaccuaaaacaua

SEQ ID NO: 4162776 - RNA, 21 nt, Yersinia pestis
auuaaugucgccauaacgcac

SEQ ID NO: 4162777 - RNA, 13 nt, Yersinia pestis
auuaauuaacacc

SEQ ID NO: 4162778 - RNA, 13 nt, Yersinia pestis
auuaauuaaugaa

SEQ ID NO: 4162779 - RNA, 11 nt, Yersinia pestis
auuaauuacuu

SEQ ID NO: 4162780 - RNA, 11 nt, Yersinia pestis
auuaauuauuc

SEQ ID NO: 4162781 - RNA, 20 nt, Yersinia pestis
auuaauuccacgcugaaacu

SEQ ID NO: 4162782 - RNA, 22 nt, Yersinia pestis
auuaauucuuuuugccaauaau

SEQ ID NO: 4162783 - RNA, 13 nt, Yersinia pestis
auuaauuuaaaca

SEQ ID NO: 4162784 - RNA, 12 nt, Yersinia pestis
auuaauuuuuca

SEQ ID NO: 4162785 - RNA, 18 nt, Yersinia pestis
auuacaccuuaaaacagc

SEQ ID NO: 4162786 - RNA, 14 nt, Yersinia pestis
auuacacugaauug

SEQ ID NO: 4162787 - RNA, 22 nt, Yersinia pestis
auuacacuuucuuugaugcaua

SEQ ID NO: 4162788 - RNA, 17 nt, Yersinia pestis
auuacagacaaaucaca

SEQ ID NO: 4162789 - RNA, 17 nt, Yersinia pestis
auuacaggccccaaucc

SEQ ID NO: 4162790 - RNA, 18 nt, Yersinia pestis
auuacaguucuuuaucca

SEQ ID NO: 4162791 - RNA, 20 nt, Yersinia pestis
auuacaucccgccauggcau

SEQ ID NO: 4162792 - RNA, 22 nt, Yersinia pestis
auuaccaccaccuccacaggag

SEQ ID NO: 4162793 - RNA, 20 nt, Yersinia pestis
auuaccacgccgucuggcua

SEQ ID NO: 4162794 - RNA, 21 nt, Yersinia pestis
auuacccacgccgaaaacaau

SEQ ID NO: 4162795 - RNA, 13 nt, Yersinia pestis
auuacccauaacu

SEQ ID NO: 4162796 - RNA, 15 nt, Yersinia pestis
auuacccauaacuug

SEQ ID NO: 4162797 - RNA, 20 nt, Yersinia pestis
auuacccauaacuugagcac

SEQ ID NO: 4162798 - RNA, 17 nt, Yersinia pestis
auuacccucauuuuacc

SEQ ID NO: 4162799 - RNA, 20 nt, Yersinia pestis
auuacccucauuuuacccga

SEQ ID NO: 4162800 - RNA, 15 nt, Yersinia pestis
auuaccgagcgucaa

SEQ ID NO: 4162801 - RNA, 13 nt, Yersinia pestis
auuaccgcacacu

SEQ ID NO: 4162802 - RNA, 20 nt, Yersinia pestis
auuaccggcguuuuuacagu

SEQ ID NO: 4162803 - RNA, 16 nt, Yersinia pestis
auuaccuaauuuaucc

SEQ ID NO: 4162804 - RNA, 17 nt, Yersinia pestis
auuaccugcauauccuc

SEQ ID NO: 4162805 - RNA, 20 nt, Yersinia pestis
auuaccuuacuucaaaacua

SEQ ID NO: 4162806 - RNA, 13 nt, Yersinia pestis
auuacgccaccug

SEQ ID NO: 4162807 - RNA, 18 nt, Yersinia pestis
auuacgccaccugagguu

SEQ ID NO: 4162808 - RNA, 13 nt, Yersinia pestis
auuacgccaccuu

SEQ ID NO: 4162809 - RNA, 17 nt, Yersinia pestis
auuacgccauccacuca

SEQ ID NO: 4162810 - RNA, 20 nt, Yersinia pestis
auuacggccccagcccagca

SEQ ID NO: 4162811 - RNA, 23 nt, Yersinia pestis
auuacgguuuaccaccuuaaaau

SEQ ID NO: 4162812 - RNA, 15 nt, Yersinia pestis
auuacucaggaacaa

SEQ ID NO: 4162813 - RNA, 14 nt, Yersinia pestis
auuacuggucucaa

SEQ ID NO: 4162814 - RNA, 15 nt, Yersinia pestis
auuacugucauuucc

SEQ ID NO: 4162815 - RNA, 23 nt, Yersinia pestis
auuacugucauuuccuccgcuuu

SEQ ID NO: 4162816 - RNA, 18 nt, Yersinia pestis
auuacuguucaucauauc

SEQ ID NO: 4162817 - RNA, 20 nt, Yersinia pestis
auuacuugauaaggcaaggc

SEQ ID NO: 4162818 - RNA, 15 nt, Yersinia pestis
auuacuuuauuuaaa

SEQ ID NO: 4162819 - RNA, 14 nt, Yersinia pestis
auuagaaaacaagu

SEQ ID NO: 4162820 - RNA, 19 nt, Yersinia pestis
auuagaauguguaguugaa

SEQ ID NO: 4162821 - RNA, 20 nt, Yersinia pestis
auuagagguuauugacaaag

SEQ ID NO: 4162822 - RNA, 19 nt, Yersinia pestis
auuagaugagugguuuaua

SEQ ID NO: 4162823 - RNA, 19 nt, Yersinia pestis
auuagaugguuaacucauu

SEQ ID NO: 4162824 - RNA, 17 nt, Yersinia pestis
auuagcaguauuagcuu

SEQ ID NO: 4162825 - RNA, 18 nt, Yersinia pestis
auuagcaguauuagcuuu

SEQ ID NO: 4162826 - RNA, 17 nt, Yersinia pestis
auuagccagaaauagca

SEQ ID NO: 4162827 - RNA, 14 nt, Yersinia pestis
auuagccagcagaa

SEQ ID NO: 4162828 - RNA, 18 nt, Yersinia pestis
auuagccagccaauggcc

SEQ ID NO: 4162829 - RNA, 12 nt, Yersinia pestis
auuagccauaag

SEQ ID NO: 4162830 - RNA, 18 nt, Yersinia pestis
auuagccccaaaugccag

SEQ ID NO: 4162831 - RNA, 22 nt, Yersinia pestis
auuagccugaccgguaauaucg

SEQ ID NO: 4162832 - RNA, 21 nt, Yersinia pestis
auuagcggauuaauaaguaaa

SEQ ID NO: 4162833 - RNA, 18 nt, Yersinia pestis
auuagcguuacagcuaaa

SEQ ID NO: 4162834 - RNA, 21 nt, Yersinia pestis
auuagcuugugugcuuacauu

SEQ ID NO: 4162835 - RNA, 14 nt, Yersinia pestis
auuaggcaggugaa

SEQ ID NO: 4162836 - RNA, 14 nt, Yersinia pestis
auuaggcuuuaacc

SEQ ID NO: 4162837 - RNA, 18 nt, Yersinia pestis
auuaggguugguuggugg

SEQ ID NO: 4162838 - RNA, 20 nt, Yersinia pestis
auuagugagcgguugaaaag

SEQ ID NO: 4162839 - RNA, 14 nt, Yersinia pestis
auuagugcacagau

SEQ ID NO: 4162840 - RNA, 23 nt, Yersinia pestis
auuaguugaccuugguaaauacc

SEQ ID NO: 4162841 - RNA, 18 nt, Yersinia pestis
auuaguuuuagaugucag

SEQ ID NO: 4162842 - RNA, 18 nt, Yersinia pestis
auuauaauccacugaaau

SEQ ID NO: 4162843 - RNA, 13 nt, Yersinia pestis
auuauauagauuu

SEQ ID NO: 4162844 - RNA, 18 nt, Yersinia pestis
auuauauagauuuauuca

SEQ ID NO: 4162845 - RNA, 13 nt, Yersinia pestis
auuauauuuaauu

SEQ ID NO: 4162846 - RNA, 19 nt, Yersinia pestis
auuauauuuaauuuaaaua

SEQ ID NO: 4162847 - RNA, 15 nt, Yersinia pestis
auuaucaaguuaaau

SEQ ID NO: 4162848 - RNA, 22 nt, Yersinia pestis
auuaucagcccaucuuugauuu

SEQ ID NO: 4162849 - RNA, 15 nt, Yersinia pestis
auuaucaucaauagc

SEQ ID NO: 4162850 - RNA, 19 nt, Yersinia pestis
auuaucaucauuacacuga

SEQ ID NO: 4162851 - RNA, 12 nt, Yersinia pestis
auuaucaucuuu

SEQ ID NO: 4162852 - RNA, 12 nt, Yersinia pestis
auuaucauguaa

SEQ ID NO: 4162853 - RNA, 14 nt, Yersinia pestis
auuauccauccccg

SEQ ID NO: 4162854 - RNA, 16 nt, Yersinia pestis
auuaucgcuuuuaugg

SEQ ID NO: 4162855 - RNA, 22 nt, Yersinia pestis
auuaucgguagcgguaauuaau

SEQ ID NO: 4162856 - RNA, 19 nt, Yersinia pestis
auuaucuuauccacagcau

SEQ ID NO: 4162857 - RNA, 14 nt, Yersinia pestis
auuaugaaaguaag

SEQ ID NO: 4162858 - RNA, 22 nt, Yersinia pestis
auuaugacaacugaaaauacua

SEQ ID NO: 4162859 - RNA, 20 nt, Yersinia pestis
auuaugauuggcugaugcgc

SEQ ID NO: 4162860 - RNA, 23 nt, Yersinia pestis
auuauggacaggcucauuuugua

SEQ ID NO: 4162861 - RNA, 22 nt, Yersinia pestis
auuaugggugguuagcagauaa

SEQ ID NO: 4162862 - RNA, 16 nt, Yersinia pestis
auuauuaaacuauuaa

SEQ ID NO: 4162863 - RNA, 20 nt, Yersinia pestis
auuauuaaacuauuaacucu

SEQ ID NO: 4162864 - RNA, 22 nt, Yersinia pestis
auuauuaacgauuauuaaacua

SEQ ID NO: 4162865 - RNA, 13 nt, Yersinia pestis
auuauuaaugaaa

SEQ ID NO: 4162866 - RNA, 16 nt, Yersinia pestis
auuauuaaugaaauua

SEQ ID NO: 4162867 - RNA, 17 nt, Yersinia pestis
auuauuaauguacaccu

SEQ ID NO: 4162868 - RNA, 14 nt, Yersinia pestis
auuauuacuagaca

SEQ ID NO: 4162869 - RNA, 13 nt, Yersinia pestis
auuauuauuacua

SEQ ID NO: 4162870 - RNA, 15 nt, Yersinia pestis
auuauuauuuacaaa

SEQ ID NO: 4162871 - RNA, 13 nt, Yersinia pestis
auuauuauuuaua

SEQ ID NO: 4162872 - RNA, 21 nt, Yersinia pestis
auuauucaucguaucgugcag

SEQ ID NO: 4162873 - RNA, 12 nt, Yersinia pestis
auuauucugcuc

SEQ ID NO: 4162874 - RNA, 19 nt, Yersinia pestis
auuauucuucaccacgauu

SEQ ID NO: 4162875 - RNA, 13 nt, Yersinia pestis
auuauucuuuuac

SEQ ID NO: 4162876 - RNA, 15 nt, Yersinia pestis
auuauugaccagaua

SEQ ID NO: 4162877 - RNA, 18 nt, Yersinia pestis
auuauugaguaacauuaa

SEQ ID NO: 4162878 - RNA, 18 nt, Yersinia pestis
auuauugauguuauuaau

SEQ ID NO: 4162879 - RNA, 18 nt, Yersinia pestis
auuauugccggguaugaa

SEQ ID NO: 4162880 - RNA, 21 nt, Yersinia pestis
auuauugguguguaauuuuua

SEQ ID NO: 4162881 - RNA, 14 nt, Yersinia pestis
auuauuuaauuaaa

SEQ ID NO: 4162882 - RNA, 14 nt, Yersinia pestis
auuauuuaucaauc

SEQ ID NO: 4162883 - RNA, 15 nt, Yersinia pestis
auuauuuauuuuaua

SEQ ID NO: 4162884 - RNA, 17 nt, Yersinia pestis
auuauuuauuuuauaau

SEQ ID NO: 4162885 - RNA, 17 nt, Yersinia pestis
auuauuugauauagaca

SEQ ID NO: 4162886 - RNA, 23 nt, Yersinia pestis
auuauuugggguauaacgaucag

SEQ ID NO: 4162887 - RNA, 21 nt, Yersinia pestis
auuauuugggguauauauuuu

SEQ ID NO: 4162888 - RNA, 12 nt, Yersinia pestis
auuauuuuaugg

SEQ ID NO: 4162889 - RNA, 18 nt, Yersinia pestis
auuauuuucaaccaguua

SEQ ID NO: 4162890 - RNA, 19 nt, Yersinia pestis
auuauuuuccagaugaaua

SEQ ID NO: 4162891 - RNA, 22 nt, Yersinia pestis
auuauuuuggaguauacauuau

SEQ ID NO: 4162892 - RNA, 21 nt, Yersinia pestis
auuauuuuguacgaauaacuc

SEQ ID NO: 4162893 - RNA, 21 nt, Yersinia pestis
auuauuuugugcguaaagaaa

SEQ ID NO: 4162894 - RNA, 16 nt, Yersinia pestis
auuauuuuuauacaga

SEQ ID NO: 4162895 - RNA, 15 nt, Yersinia pestis
auucaaaaauuaaau

SEQ ID NO: 4162896 - RNA, 18 nt, Yersinia pestis
auucaaaaauuaaauuaa

SEQ ID NO: 4162897 - RNA, 15 nt, Yersinia pestis
auucaaaauagaaaa

SEQ ID NO: 4162898 - RNA, 13 nt, Yersinia pestis
auucaaaaugcca

SEQ ID NO: 4162899 - RNA, 23 nt, Yersinia pestis
auucaaaauguauuauuuuguac

SEQ ID NO: 4162900 - RNA, 18 nt, Yersinia pestis
auucaaacacuuaugauc

SEQ ID NO: 4162901 - RNA, 14 nt, Yersinia pestis
auucaaaguugccg

SEQ ID NO: 4162902 - RNA, 17 nt, Yersinia pestis
auucaacacucuacuuu

SEQ ID NO: 4162903 - RNA, 21 nt, Yersinia pestis
auucaacagccuuucccugaa

SEQ ID NO: 4162904 - RNA, 19 nt, Yersinia pestis
auucaaccaauuauccauc

SEQ ID NO: 4162905 - RNA, 21 nt, Yersinia pestis
auucaacccacuguuggaggc

SEQ ID NO: 4162906 - RNA, 24 nt, Yersinia pestis
auucaacgugacucacuacauucu

SEQ ID NO: 4162907 - RNA, 17 nt, Yersinia pestis
auucaacguguuguuuu

SEQ ID NO: 4162908 - RNA, 20 nt, Yersinia pestis
auucaacguguuguuuucau

SEQ ID NO: 4162909 - RNA, 21 nt, Yersinia pestis
auucaacguguuguuuucaug

SEQ ID NO: 4162910 - RNA, 22 nt, Yersinia pestis
auucaacguguuguuuucauga

SEQ ID NO: 4162911 - RNA, 20 nt, Yersinia pestis
auucaaggccagcacguuuu

SEQ ID NO: 4162912 - RNA, 20 nt, Yersinia pestis
auucaaggcuacccaauaac

SEQ ID NO: 4162913 - RNA, 16 nt, Yersinia pestis
auucaagguauuuggg

SEQ ID NO: 4162914 - RNA, 13 nt, Yersinia pestis
auucaauaucacu

SEQ ID NO: 4162915 - RNA, 23 nt, Yersinia pestis
auucaauccauugaucucauucc

SEQ ID NO: 4162916 - RNA, 13 nt, Yersinia pestis
auucaauugaucu

SEQ ID NO: 4162917 - RNA, 15 nt, Yersinia pestis
auucaauugugcaaa

SEQ ID NO: 4162918 - RNA, 21 nt, Yersinia pestis
auucaauugugcaaaaucagc

SEQ ID NO: 4162919 - RNA, 23 nt, Yersinia pestis
auucaauugugcaaaaucagcau

SEQ ID NO: 4162920 - RNA, 12 nt, Yersinia pestis
auucacaacagu

SEQ ID NO: 4162921 - RNA, 14 nt, Yersinia pestis
auucaccacacaua

SEQ ID NO: 4162922 - RNA, 23 nt, Yersinia pestis
auucaccacacauaccacacaca

SEQ ID NO: 4162923 - RNA, 15 nt, Yersinia pestis
auucaccaccauauu

SEQ ID NO: 4162924 - RNA, 17 nt, Yersinia pestis
auucaccaccauuaaca

SEQ ID NO: 4162925 - RNA, 23 nt, Yersinia pestis
auucaccagauggcgaucaaggu

SEQ ID NO: 4162926 - RNA, 15 nt, Yersinia pestis
auucacccuuuaaau

SEQ ID NO: 4162927 - RNA, 15 nt, Yersinia pestis
auucacgagcuaacg

SEQ ID NO: 4162928 - RNA, 19 nt, Yersinia pestis
auucacguccucuuauuaa

SEQ ID NO: 4162929 - RNA, 22 nt, Yersinia pestis
auucacuauuuauuaaucuauu

SEQ ID NO: 4162930 - RNA, 16 nt, Yersinia pestis
auucacugaguugaga

SEQ ID NO: 4162931 - RNA, 12 nt, Yersinia pestis
auucacuuuccc

SEQ ID NO: 4162932 - RNA, 16 nt, Yersinia pestis
auucacuuuccccugg

SEQ ID NO: 4162933 - RNA, 16 nt, Yersinia pestis
auucagacgacgugca

SEQ ID NO: 4162934 - RNA, 16 nt, Yersinia pestis
auucagaggaaagaga

SEQ ID NO: 4162935 - RNA, 21 nt, Yersinia pestis
auucagaugagaaucucucca

SEQ ID NO: 4162936 - RNA, 12 nt, Yersinia pestis
auucagcaauau

SEQ ID NO: 4162937 - RNA, 16 nt, Yersinia pestis
auucagcagcaagaaa

SEQ ID NO: 4162938 - RNA, 22 nt, Yersinia pestis
auucagcaucaaauuauuuuuc

SEQ ID NO: 4162939 - RNA, 19 nt, Yersinia pestis
auucaggccuugauggcua

SEQ ID NO: 4162940 - RNA, 16 nt, Yersinia pestis
auucagguugagcauc

SEQ ID NO: 4162941 - RNA, 14 nt, Yersinia pestis
auucaguaaaaacu

SEQ ID NO: 4162942 - RNA, 16 nt, Yersinia pestis
auucauaccgcagaua

SEQ ID NO: 4162943 - RNA, 19 nt, Yersinia pestis
auucauaccgcagauaaaa

SEQ ID NO: 4162944 - RNA, 17 nt, Yersinia pestis
auucauaccuguacuuu

SEQ ID NO: 4162945 - RNA, 20 nt, Yersinia pestis
auucauaccuguacuuugau

SEQ ID NO: 4162946 - RNA, 16 nt, Yersinia pestis
auucauaguuaagaca

SEQ ID NO: 4162947 - RNA, 17 nt, Yersinia pestis
auucauaucgcuaaaac

SEQ ID NO: 4162948 - RNA, 12 nt, Yersinia pestis
auucauaucuuu

SEQ ID NO: 4162949 - RNA, 18 nt, Yersinia pestis
auucauaugacaaauaag

SEQ ID NO: 4162950 - RNA, 13 nt, Yersinia pestis
auucaucagcaau

SEQ ID NO: 4162951 - RNA, 20 nt, Yersinia pestis
auucaucagcaauuugcuug

SEQ ID NO: 4162952 - RNA, 14 nt, Yersinia pestis
auucaucagggcag

SEQ ID NO: 4162953 - RNA, 23 nt, Yersinia pestis
auucaucaugcugucauuggugc

SEQ ID NO: 4162954 - RNA, 15 nt, Yersinia pestis
auucaucccuaaaau

SEQ ID NO: 4162955 - RNA, 18 nt, Yersinia pestis
auucaucccuaaaaucau

SEQ ID NO: 4162956 - RNA, 14 nt, Yersinia pestis
auucaucuagcuua

SEQ ID NO: 4162957 - RNA, 15 nt, Yersinia pestis
auucaucuuuaacaa

SEQ ID NO: 4162958 - RNA, 19 nt, Yersinia pestis
auucaucuuuaacaacaac

SEQ ID NO: 4162959 - RNA, 13 nt, Yersinia pestis
auucaugaggcuu

SEQ ID NO: 4162960 - RNA, 20 nt, Yersinia pestis
auucaugcaucuccacucuu

SEQ ID NO: 4162961 - RNA, 18 nt, Yersinia pestis
auucaugcuaauaccaca

SEQ ID NO: 4162962 - RNA, 19 nt, Yersinia pestis
auucaugcuaauaccacaa

SEQ ID NO: 4162963 - RNA, 17 nt, Yersinia pestis
auucaugguuucaaaau

SEQ ID NO: 4162964 - RNA, 17 nt, Yersinia pestis
auucauuauuacucagc

SEQ ID NO: 4162965 - RNA, 13 nt, Yersinia pestis
auucauugagcaa

SEQ ID NO: 4162966 - RNA, 21 nt, Yersinia pestis
auucauugccgaugucaauaa

SEQ ID NO: 4162967 - RNA, 18 nt, Yersinia pestis
auucauuggcgguugagu

SEQ ID NO: 4162968 - RNA, 15 nt, Yersinia pestis
auucauuucuuuggc

SEQ ID NO: 4162969 - RNA, 13 nt, Yersinia pestis
auucauuuuaaaa

SEQ ID NO: 4162970 - RNA, 14 nt, Yersinia pestis
auucauuuuaaaaa

SEQ ID NO: 4162971 - RNA, 15 nt, Yersinia pestis
auucauuuuaaaaaa

SEQ ID NO: 4162972 - RNA, 18 nt, Yersinia pestis
auuccacaaauuuuuacc

SEQ ID NO: 4162973 - RNA, 19 nt, Yersinia pestis
auuccacauaaaauagccc

SEQ ID NO: 4162974 - RNA, 17 nt, Yersinia pestis
auuccagagugccggga

SEQ ID NO: 4162975 - RNA, 23 nt, Yersinia pestis
auuccagcggcgcugacuggcag

SEQ ID NO: 4162976 - RNA, 22 nt, Yersinia pestis
auuccauguucucuccuaaaau

SEQ ID NO: 4162977 - RNA, 20 nt, Yersinia pestis
auucccaaagcgcagugcuc

SEQ ID NO: 4162978 - RNA, 20 nt, Yersinia pestis
auucccaccacuugcuacca

SEQ ID NO: 4162979 - RNA, 21 nt, Yersinia pestis
auucccaccauaaugugccuc

SEQ ID NO: 4162980 - RNA, 22 nt, Yersinia pestis
auucccaucgaacgcgucacug

SEQ ID NO: 4162981 - RNA, 16 nt, Yersinia pestis
auuccccaccauugca

SEQ ID NO: 4162982 - RNA, 16 nt, Yersinia pestis
auucccccaguagcac

SEQ ID NO: 4162983 - RNA, 18 nt, Yersinia pestis
auuccccccagucacuac

SEQ ID NO: 4162984 - RNA, 21 nt, Yersinia pestis
auucccccgguuaaugccagc

SEQ ID NO: 4162985 - RNA, 14 nt, Yersinia pestis
auucccucaauagc

SEQ ID NO: 4162986 - RNA, 23 nt, Yersinia pestis
auucccugcgguuauuugcuauc

SEQ ID NO: 4162987 - RNA, 16 nt, Yersinia pestis
auuccgccaacaggau

SEQ ID NO: 4162988 - RNA, 17 nt, Yersinia pestis
auuccgccuguuuucag

SEQ ID NO: 4162989 - RNA, 19 nt, Yersinia pestis
auuccgccuguuuucaggc

SEQ ID NO: 4162990 - RNA, 22 nt, Yersinia pestis
auuccgcuucacauuugaaaug

SEQ ID NO: 4162991 - RNA, 16 nt, Yersinia pestis
auuccgucgauaucua

SEQ ID NO: 4162992 - RNA, 14 nt, Yersinia pestis
auuccguggcuuag

SEQ ID NO: 4162993 - RNA, 16 nt, Yersinia pestis
auuccuauaaauuuua

SEQ ID NO: 4162994 - RNA, 18 nt, Yersinia pestis
auuccucucugaaucacu

SEQ ID NO: 4162995 - RNA, 22 nt, Yersinia pestis
auuccuuguggugaugaaggua

SEQ ID NO: 4162996 - RNA, 14 nt, Yersinia pestis
auucgacuguuuuu

SEQ ID NO: 4162997 - RNA, 15 nt, Yersinia pestis
auucgagugugauga

SEQ ID NO: 4162998 - RNA, 18 nt, Yersinia pestis
auucgccugauaaaauua

SEQ ID NO: 4162999 - RNA, 13 nt, Yersinia pestis
auucgcgccccaa

SEQ ID NO: 4163000 - RNA, 19 nt, Yersinia pestis
auucgcggaacaacgccuc

SEQ ID NO: 4163001 - RNA, 16 nt, Yersinia pestis
auucgcgguuacacca

SEQ ID NO: 4163002 - RNA, 18 nt, Yersinia pestis
auucgggaucaugaugau

SEQ ID NO: 4163003 - RNA, 18 nt, Yersinia pestis
auucgugcucaucaaccu

SEQ ID NO: 4163004 - RNA, 20 nt, Yersinia pestis
auucgugcucaucaaccuca

SEQ ID NO: 4163005 - RNA, 21 nt, Yersinia pestis
auucgugcucaucaaccucag

SEQ ID NO: 4163006 - RNA, 20 nt, Yersinia pestis
auucuaccuggcucaaauuu

SEQ ID NO: 4163007 - RNA, 21 nt, Yersinia pestis
auucuaccuggcucaaauuug

SEQ ID NO: 4163008 - RNA, 13 nt, Yersinia pestis
auucuagcaacau

SEQ ID NO: 4163009 - RNA, 17 nt, Yersinia pestis
auucuauccggauuaaa

SEQ ID NO: 4163010 - RNA, 13 nt, Yersinia pestis
auucucaaaauaa

SEQ ID NO: 4163011 - RNA, 14 nt, Yersinia pestis
auucucaauauuaa

SEQ ID NO: 4163012 - RNA, 19 nt, Yersinia pestis
auucucaauauuaauaaug

SEQ ID NO: 4163013 - RNA, 14 nt, Yersinia pestis
auucucccauuuau

SEQ ID NO: 4163014 - RNA, 15 nt, Yersinia pestis
auucucccauuuauu

SEQ ID NO: 4163015 - RNA, 19 nt, Yersinia pestis
auucucccgauacccauuu

SEQ ID NO: 4163016 - RNA, 21 nt, Yersinia pestis
auucucuacucgcucaccacu

SEQ ID NO: 4163017 - RNA, 17 nt, Yersinia pestis
auucucuggugauacca

SEQ ID NO: 4163018 - RNA, 12 nt, Yersinia pestis
auucucugucuu

SEQ ID NO: 4163019 - RNA, 20 nt, Yersinia pestis
auucugaagacacacuuauu

SEQ ID NO: 4163020 - RNA, 22 nt, Yersinia pestis
auucugacgggacaaucuguuc

SEQ ID NO: 4163021 - RNA, 23 nt, Yersinia pestis
auucugagcaccacaauaccauu

SEQ ID NO: 4163022 - RNA, 19 nt, Yersinia pestis
auucugauagugauuuuuu

SEQ ID NO: 4163023 - RNA, 22 nt, Yersinia pestis
auucugauagugauuuuuuuca

SEQ ID NO: 4163024 - RNA, 19 nt, Yersinia pestis
auucuggucgccagauuga

SEQ ID NO: 4163025 - RNA, 13 nt, Yersinia pestis
auucugucagagc

SEQ ID NO: 4163026 - RNA, 20 nt, Yersinia pestis
auucuuaucaaucaaaaaau

SEQ ID NO: 4163027 - RNA, 13 nt, Yersinia pestis
auucuuuaggauu

SEQ ID NO: 4163028 - RNA, 18 nt, Yersinia pestis
auucuuuuuguuaaaaua

SEQ ID NO: 4163029 - RNA, 21 nt, Yersinia pestis
auucuuuuuguuaaaauagug

SEQ ID NO: 4163030 - RNA, 15 nt, Yersinia pestis
auugaaaaaauaaug

SEQ ID NO: 4163031 - RNA, 15 nt, Yersinia pestis
auugaagacaaugcc

SEQ ID NO: 4163032 - RNA, 11 nt, Yersinia pestis
auugaagaguu

SEQ ID NO: 4163033 - RNA, 14 nt, Yersinia pestis
auugaagauacccu

SEQ ID NO: 4163034 - RNA, 19 nt, Yersinia pestis
auugaagggcaaaacguga

SEQ ID NO: 4163035 - RNA, 21 nt, Yersinia pestis
auugaauaacuucgcgaacac

SEQ ID NO: 4163036 - RNA, 19 nt, Yersinia pestis
auugacaaagugccugcaa

SEQ ID NO: 4163037 - RNA, 16 nt, Yersinia pestis
auugacaggugguucu

SEQ ID NO: 4163038 - RNA, 16 nt, Yersinia pestis
auugaccagauagcug

SEQ ID NO: 4163039 - RNA, 20 nt, Yersinia pestis
auugaccauagagagaaaaa

SEQ ID NO: 4163040 - RNA, 16 nt, Yersinia pestis
auugacgaauuaaaac

SEQ ID NO: 4163041 - RNA, 22 nt, Yersinia pestis
auugacgguuacagcgcaauaa

SEQ ID NO: 4163042 - RNA, 16 nt, Yersinia pestis
auugacugaaugugaa

SEQ ID NO: 4163043 - RNA, 16 nt, Yersinia pestis
auugagaaucacuacg

SEQ ID NO: 4163044 - RNA, 23 nt, Yersinia pestis
auugagacccguuacugcaucua

SEQ ID NO: 4163045 - RNA, 18 nt, Yersinia pestis
auugagagaaaugcucau

SEQ ID NO: 4163046 - RNA, 21 nt, Yersinia pestis
auugagcaggcucuucucuga

SEQ ID NO: 4163047 - RNA, 24 nt, Yersinia pestis
auugagcauaucaaucagcaucuu

SEQ ID NO: 4163048 - RNA, 13 nt, Yersinia pestis
auugagguaaacc

SEQ ID NO: 4163049 - RNA, 13 nt, Yersinia pestis
auugagguugccg

SEQ ID NO: 4163050 - RNA, 17 nt, Yersinia pestis
auugagucguuauaaca

SEQ ID NO: 4163051 - RNA, 18 nt, Yersinia pestis
auugagugcggccacacg

SEQ ID NO: 4163052 - RNA, 13 nt, Yersinia pestis
auugauaaaacca

SEQ ID NO: 4163053 - RNA, 22 nt, Yersinia pestis
auugauaaaaccacugaccuau

SEQ ID NO: 4163054 - RNA, 13 nt, Yersinia pestis
auugauaaaaccg

SEQ ID NO: 4163055 - RNA, 17 nt, Yersinia pestis
auugauaaaaguaauuu

SEQ ID NO: 4163056 - RNA, 19 nt, Yersinia pestis
auugauaauggcauuuuca

SEQ ID NO: 4163057 - RNA, 13 nt, Yersinia pestis
auugauacaguaa

SEQ ID NO: 4163058 - RNA, 18 nt, Yersinia pestis
auugauagccacaucauu

SEQ ID NO: 4163059 - RNA, 16 nt, Yersinia pestis
auugauauauagaaau

SEQ ID NO: 4163060 - RNA, 17 nt, Yersinia pestis
auugauccaaauggcug

SEQ ID NO: 4163061 - RNA, 12 nt, Yersinia pestis
auugauccaggg

SEQ ID NO: 4163062 - RNA, 16 nt, Yersinia pestis
auugaugauuugaccg

SEQ ID NO: 4163063 - RNA, 15 nt, Yersinia pestis
auugaugcacaguag

SEQ ID NO: 4163064 - RNA, 14 nt, Yersinia pestis
auugauugcuuacc

SEQ ID NO: 4163065 - RNA, 15 nt, Yersinia pestis
auugauugcuuacca

SEQ ID NO: 4163066 - RNA, 21 nt, Yersinia pestis
auugcaacaacgccagauaac

SEQ ID NO: 4163067 - RNA, 13 nt, Yersinia pestis
auugcaacugggc

SEQ ID NO: 4163068 - RNA, 21 nt, Yersinia pestis
auugcacaugcagcauuucag

SEQ ID NO: 4163069 - RNA, 23 nt, Yersinia pestis
auugcacaugcagcauuucagga

SEQ ID NO: 4163070 - RNA, 20 nt, Yersinia pestis
auugcacgguauagcuauca

SEQ ID NO: 4163071 - RNA, 20 nt, Yersinia pestis
auugcacuggcuaauaccau

SEQ ID NO: 4163072 - RNA, 17 nt, Yersinia pestis
auugcagagcaaaacug

SEQ ID NO: 4163073 - RNA, 17 nt, Yersinia pestis
auugcagauaccacauc

SEQ ID NO: 4163074 - RNA, 14 nt, Yersinia pestis
auugcaggauagcc

SEQ ID NO: 4163075 - RNA, 13 nt, Yersinia pestis
auugcauauugcu

SEQ ID NO: 4163076 - RNA, 13 nt, Yersinia pestis
auugcaucuuuaa

SEQ ID NO: 4163077 - RNA, 13 nt, Yersinia pestis
auugccaaaugca

SEQ ID NO: 4163078 - RNA, 22 nt, Yersinia pestis
auugccaucuuguucuaauaau

SEQ ID NO: 4163079 - RNA, 23 nt, Yersinia pestis
auugccccccaauauuggauaau

SEQ ID NO: 4163080 - RNA, 18 nt, Yersinia pestis
auugcccgcguaaucucu

SEQ ID NO: 4163081 - RNA, 21 nt, Yersinia pestis
auugcccuacggguaaagcgu

SEQ ID NO: 4163082 - RNA, 16 nt, Yersinia pestis
auugccggaaauuuau

SEQ ID NO: 4163083 - RNA, 18 nt, Yersinia pestis
auugccggauuccaccug

SEQ ID NO: 4163084 - RNA, 20 nt, Yersinia pestis
auugccggauuccaccugac

SEQ ID NO: 4163085 - RNA, 14 nt, Yersinia pestis
auugccucggcaag

SEQ ID NO: 4163086 - RNA, 16 nt, Yersinia pestis
auugccugauuuuuau

SEQ ID NO: 4163087 - RNA, 21 nt, Yersinia pestis
auugccugauuuuuaucauca

SEQ ID NO: 4163088 - RNA, 12 nt, Yersinia pestis
auugcgaauauu

SEQ ID NO: 4163089 - RNA, 13 nt, Yersinia pestis
auugcgggcuggg

SEQ ID NO: 4163090 - RNA, 15 nt, Yersinia pestis
auugcguuaccuaaa

SEQ ID NO: 4163091 - RNA, 11 nt, Yersinia pestis
auugcguucaa

SEQ ID NO: 4163092 - RNA, 17 nt, Yersinia pestis
auugcuaaauuuuguac

SEQ ID NO: 4163093 - RNA, 20 nt, Yersinia pestis
auugcuaaguacuaucuauu

SEQ ID NO: 4163094 - RNA, 22 nt, Yersinia pestis
auugcucaaacucagcaucacc

SEQ ID NO: 4163095 - RNA, 16 nt, Yersinia pestis
auugcugaaaaaaaac

SEQ ID NO: 4163096 - RNA, 23 nt, Yersinia pestis
auugcugaguaaauuaaauuuua

SEQ ID NO: 4163097 - RNA, 22 nt, Yersinia pestis
auugcugcuguuauuacuguca

SEQ ID NO: 4163098 - RNA, 13 nt, Yersinia pestis
auugcuggcuauc

SEQ ID NO: 4163099 - RNA, 18 nt, Yersinia pestis
auugcuggcuaucauccc

SEQ ID NO: 4163100 - RNA, 14 nt, Yersinia pestis
auugcugugguuga

SEQ ID NO: 4163101 - RNA, 19 nt, Yersinia pestis
auugcuuugcgauacacca

SEQ ID NO: 4163102 - RNA, 16 nt, Yersinia pestis
auuggacccgucacca

SEQ ID NO: 4163103 - RNA, 20 nt, Yersinia pestis
auuggagucgcauguaggca

SEQ ID NO: 4163104 - RNA, 22 nt, Yersinia pestis
auuggcaacaacagauaaagcu

SEQ ID NO: 4163105 - RNA, 19 nt, Yersinia pestis
auuggccgacugacacaaa

SEQ ID NO: 4163106 - RNA, 22 nt, Yersinia pestis
auuggccuuccaucgucagaac

SEQ ID NO: 4163107 - RNA, 17 nt, Yersinia pestis
auuggcgagcaugacac

SEQ ID NO: 4163108 - RNA, 19 nt, Yersinia pestis
auuggcgaugcgcuccgcc

SEQ ID NO: 4163109 - RNA, 24 nt, Yersinia pestis
auuggcggaagacuuccagcacca

SEQ ID NO: 4163110 - RNA, 20 nt, Yersinia pestis
auuggcucauaacacuuaau

SEQ ID NO: 4163111 - RNA, 16 nt, Yersinia pestis
auuggcugauucaaca

SEQ ID NO: 4163112 - RNA, 13 nt, Yersinia pestis
auuggcugcuugc

SEQ ID NO: 4163113 - RNA, 13 nt, Yersinia pestis
auuggcuuaacaa

SEQ ID NO: 4163114 - RNA, 18 nt, Yersinia pestis
auuggguaauaucaccau

SEQ ID NO: 4163115 - RNA, 16 nt, Yersinia pestis
auuggguaaucucuuu

SEQ ID NO: 4163116 - RNA, 15 nt, Yersinia pestis
auuggucaauaaaau

SEQ ID NO: 4163117 - RNA, 21 nt, Yersinia pestis
auuggucagguuaacaaacac

SEQ ID NO: 4163118 - RNA, 20 nt, Yersinia pestis
auugguguuacagcaaggca

SEQ ID NO: 4163119 - RNA, 22 nt, Yersinia pestis
auugguguuacagcaaggcagc

SEQ ID NO: 4163120 - RNA, 12 nt, Yersinia pestis
auugguuaaguu

SEQ ID NO: 4163121 - RNA, 16 nt, Yersinia pestis
auugguuauccuauuc

SEQ ID NO: 4163122 - RNA, 15 nt, Yersinia pestis
auuguauugcucagg

SEQ ID NO: 4163123 - RNA, 17 nt, Yersinia pestis
auugucuuuaauaaaau

SEQ ID NO: 4163124 - RNA, 15 nt, Yersinia pestis
auugugagcuauucc

SEQ ID NO: 4163125 - RNA, 21 nt, Yersinia pestis
auugugaguuaaaaauaaauu

SEQ ID NO: 4163126 - RNA, 14 nt, Yersinia pestis
auugugcagcauca

SEQ ID NO: 4163127 - RNA, 14 nt, Yersinia pestis
auuguggcuaaacc

SEQ ID NO: 4163128 - RNA, 17 nt, Yersinia pestis
auugugucaauaccuua

SEQ ID NO: 4163129 - RNA, 21 nt, Yersinia pestis
auugugucaauaccuuacugu

SEQ ID NO: 4163130 - RNA, 15 nt, Yersinia pestis
auuguuaucaaauca

SEQ ID NO: 4163131 - RNA, 20 nt, Yersinia pestis
auuguuauuaucaugaagaa

SEQ ID NO: 4163132 - RNA, 13 nt, Yersinia pestis
auuguuauuuuua

SEQ ID NO: 4163133 - RNA, 14 nt, Yersinia pestis
auuguuauuuuuau

SEQ ID NO: 4163134 - RNA, 23 nt, Yersinia pestis
auuguucaauaggccagcaaugc

SEQ ID NO: 4163135 - RNA, 22 nt, Yersinia pestis
auuguugaauaccaagccaaau

SEQ ID NO: 4163136 - RNA, 12 nt, Yersinia pestis
auuguugccaau

SEQ ID NO: 4163137 - RNA, 22 nt, Yersinia pestis
auuguuucugauaucuaaaaaa

SEQ ID NO: 4163138 - RNA, 18 nt, Yersinia pestis
auuguuugcuaucaauug

SEQ ID NO: 4163139 - RNA, 19 nt, Yersinia pestis
auuguuugcuuucagauaa

SEQ ID NO: 4163140 - RNA, 22 nt, Yersinia pestis
auuguuuuaccgucgucucuau

SEQ ID NO: 4163141 - RNA, 22 nt, Yersinia pestis
auuguuuuacguucagcacugc

SEQ ID NO: 4163142 - RNA, 13 nt, Yersinia pestis
auuuaaacacuca

SEQ ID NO: 4163143 - RNA, 20 nt, Yersinia pestis
auuuaaacagccguauaucu

SEQ ID NO: 4163144 - RNA, 11 nt, Yersinia pestis
auuuaaacucu

SEQ ID NO: 4163145 - RNA, 13 nt, Yersinia pestis
auuuaaaguuuuu

SEQ ID NO: 4163146 - RNA, 18 nt, Yersinia pestis
auuuaaauaagauccaga

SEQ ID NO: 4163147 - RNA, 21 nt, Yersinia pestis
auuuaacgccaccaaugcauc

SEQ ID NO: 4163148 - RNA, 19 nt, Yersinia pestis
auuuaacuuuaaauccauc

SEQ ID NO: 4163149 - RNA, 12 nt, Yersinia pestis
auuuaagaaauc

SEQ ID NO: 4163150 - RNA, 19 nt, Yersinia pestis
auuuaagcugaaauuuuuu

SEQ ID NO: 4163151 - RNA, 20 nt, Yersinia pestis
auuuaagcugaaauuuuuua

SEQ ID NO: 4163152 - RNA, 22 nt, Yersinia pestis
auuuaagcugaaauuuuuuaau

SEQ ID NO: 4163153 - RNA, 19 nt, Yersinia pestis
auuuaaucgcucauccaua

SEQ ID NO: 4163154 - RNA, 16 nt, Yersinia pestis
auuuaauuaaaugacu

SEQ ID NO: 4163155 - RNA, 15 nt, Yersinia pestis
auuuaauuaaaugua

SEQ ID NO: 4163156 - RNA, 22 nt, Yersinia pestis
auuuaauuaaauguauaaaaaa

SEQ ID NO: 4163157 - RNA, 18 nt, Yersinia pestis
auuuaauuuauccaacug

SEQ ID NO: 4163158 - RNA, 21 nt, Yersinia pestis
auuuacaaaccacauuuuuua

SEQ ID NO: 4163159 - RNA, 23 nt, Yersinia pestis
auuuacaaauaaccgccaaaaua

SEQ ID NO: 4163160 - RNA, 22 nt, Yersinia pestis
auuuaccgacagcaucuagcag

SEQ ID NO: 4163161 - RNA, 17 nt, Yersinia pestis
auuuaccgucuuuuugg

SEQ ID NO: 4163162 - RNA, 18 nt, Yersinia pestis
auuuacggcuuuucgcuc

SEQ ID NO: 4163163 - RNA, 18 nt, Yersinia pestis
auuuacguuuuuugcggu

SEQ ID NO: 4163164 - RNA, 21 nt, Yersinia pestis
auuuacuccccaaagccuacg

SEQ ID NO: 4163165 - RNA, 18 nt, Yersinia pestis
auuuacucguuuuacauu

SEQ ID NO: 4163166 - RNA, 20 nt, Yersinia pestis
auuuacugcauucugagcac

SEQ ID NO: 4163167 - RNA, 22 nt, Yersinia pestis
auuuacugguaccaaacaacaa

SEQ ID NO: 4163168 - RNA, 22 nt, Yersinia pestis
auuuagcaaagcgauaucguua

SEQ ID NO: 4163169 - RNA, 16 nt, Yersinia pestis
auuuagccauucaaaa

SEQ ID NO: 4163170 - RNA, 17 nt, Yersinia pestis
auuuagccauucaaaaa

SEQ ID NO: 4163171 - RNA, 13 nt, Yersinia pestis
auuuagccgguaa

SEQ ID NO: 4163172 - RNA, 20 nt, Yersinia pestis
auuuagcgugacacugucac

SEQ ID NO: 4163173 - RNA, 22 nt, Yersinia pestis
auuuaggauuagccgcuuucau

SEQ ID NO: 4163174 - RNA, 13 nt, Yersinia pestis
auuuauaaaacca

SEQ ID NO: 4163175 - RNA, 12 nt, Yersinia pestis
auuuauagaaua

SEQ ID NO: 4163176 - RNA, 14 nt, Yersinia pestis
auuuauagaauaca

SEQ ID NO: 4163177 - RNA, 20 nt, Yersinia pestis
auuuauagaccuucucucua

SEQ ID NO: 4163178 - RNA, 13 nt, Yersinia pestis
auuuauauaacga

SEQ ID NO: 4163179 - RNA, 19 nt, Yersinia pestis
auuuauaucaguugugggu

SEQ ID NO: 4163180 - RNA, 17 nt, Yersinia pestis
auuuaucaaucagcuga

SEQ ID NO: 4163181 - RNA, 16 nt, Yersinia pestis
auuuaucauauuaaca

SEQ ID NO: 4163182 - RNA, 21 nt, Yersinia pestis
auuuaucauauuaacauauca

SEQ ID NO: 4163183 - RNA, 19 nt, Yersinia pestis
auuuaucgccaagccagua

SEQ ID NO: 4163184 - RNA, 19 nt, Yersinia pestis
auuuaucugcauuaaaaua

SEQ ID NO: 4163185 - RNA, 20 nt, Yersinia pestis
auuuaucugcauuaaaauaa

SEQ ID NO: 4163186 - RNA, 22 nt, Yersinia pestis
auuuaucugcauuaaaauaaca

SEQ ID NO: 4163187 - RNA, 13 nt, Yersinia pestis
auuuaugaacacu

SEQ ID NO: 4163188 - RNA, 14 nt, Yersinia pestis
auuuaugaacacuc

SEQ ID NO: 4163189 - RNA, 23 nt, Yersinia pestis
auuuauuccucucugaaucacua

SEQ ID NO: 4163190 - RNA, 23 nt, Yersinia pestis
auuuauugccaacguuaaacccc

SEQ ID NO: 4163191 - RNA, 19 nt, Yersinia pestis
auuuauuggucaauaaaau

SEQ ID NO: 4163192 - RNA, 18 nt, Yersinia pestis
auuuauuguuaucaaauc

SEQ ID NO: 4163193 - RNA, 20 nt, Yersinia pestis
auuuauuuacucuuuuuuau

SEQ ID NO: 4163194 - RNA, 17 nt, Yersinia pestis
auuuauuuauaaaacca

SEQ ID NO: 4163195 - RNA, 14 nt, Yersinia pestis
auuuauuuauccug

SEQ ID NO: 4163196 - RNA, 19 nt, Yersinia pestis
auuuauuuccgcugacuua

SEQ ID NO: 4163197 - RNA, 13 nt, Yersinia pestis
auuuauuucugca

SEQ ID NO: 4163198 - RNA, 20 nt, Yersinia pestis
auuuauuuguagugacguaa

SEQ ID NO: 4163199 - RNA, 17 nt, Yersinia pestis
auuuauuuuacccuucg

SEQ ID NO: 4163200 - RNA, 15 nt, Yersinia pestis
auuuauuuuccccua

SEQ ID NO: 4163201 - RNA, 14 nt, Yersinia pestis
auuuauuuuuaagg

SEQ ID NO: 4163202 - RNA, 22 nt, Yersinia pestis
auuuauuuuugcuuguuauuuu

SEQ ID NO: 4163203 - RNA, 15 nt, Yersinia pestis
auuuauuuuuucuuu

SEQ ID NO: 4163204 - RNA, 13 nt, Yersinia pestis
auuucaaaguaaa

SEQ ID NO: 4163205 - RNA, 16 nt, Yersinia pestis
auuucaaaguaaaaua

SEQ ID NO: 4163206 - RNA, 23 nt, Yersinia pestis
auuucaacaaaacgaacacugca

SEQ ID NO: 4163207 - RNA, 20 nt, Yersinia pestis
auuucaacgucaaucaucca

SEQ ID NO: 4163208 - RNA, 17 nt, Yersinia pestis
auuucaagcaauucaga

SEQ ID NO: 4163209 - RNA, 18 nt, Yersinia pestis
auuucaaggcuaaccggg

SEQ ID NO: 4163210 - RNA, 12 nt, Yersinia pestis
auuucaaucacu

SEQ ID NO: 4163211 - RNA, 22 nt, Yersinia pestis
auuucaaugggaugcccacacu

SEQ ID NO: 4163212 - RNA, 20 nt, Yersinia pestis
auuucacacuguuuaguuca

SEQ ID NO: 4163213 - RNA, 19 nt, Yersinia pestis
auuucaccgagaucaccua

SEQ ID NO: 4163214 - RNA, 17 nt, Yersinia pestis
auuucaccuauaauuaa

SEQ ID NO: 4163215 - RNA, 19 nt, Yersinia pestis
auuucacggauaucaacau

SEQ ID NO: 4163216 - RNA, 13 nt, Yersinia pestis
auuucacguucau

SEQ ID NO: 4163217 - RNA, 19 nt, Yersinia pestis
auuucacguucaucaauac

SEQ ID NO: 4163218 - RNA, 17 nt, Yersinia pestis
auuucacuggcaccgcu

SEQ ID NO: 4163219 - RNA, 14 nt, Yersinia pestis
auuucagacauaca

SEQ ID NO: 4163220 - RNA, 18 nt, Yersinia pestis
auuucagacugcugacaa

SEQ ID NO: 4163221 - RNA, 22 nt, Yersinia pestis
auuucagauaaaaauaaucaau

SEQ ID NO: 4163222 - RNA, 18 nt, Yersinia pestis
auuucagcaccauaaauu

SEQ ID NO: 4163223 - RNA, 17 nt, Yersinia pestis
auuucagcagcacguuc

SEQ ID NO: 4163224 - RNA, 14 nt, Yersinia pestis
auuucagccaggcg

SEQ ID NO: 4163225 - RNA, 12 nt, Yersinia pestis
auuucagcugcu

SEQ ID NO: 4163226 - RNA, 22 nt, Yersinia pestis
auuucagggcguauaaacagag

SEQ ID NO: 4163227 - RNA, 14 nt, Yersinia pestis
auuucagucaauaa

SEQ ID NO: 4163228 - RNA, 19 nt, Yersinia pestis
auuucagucaauaaacauu

SEQ ID NO: 4163229 - RNA, 14 nt, Yersinia pestis
auuucauaccgcug

SEQ ID NO: 4163230 - RNA, 23 nt, Yersinia pestis
auuucauagggcugaauaucauu

SEQ ID NO: 4163231 - RNA, 18 nt, Yersinia pestis
auuucaucggcaaaaaca

SEQ ID NO: 4163232 - RNA, 20 nt, Yersinia pestis
auuucaucggcaaaaacagu

SEQ ID NO: 4163233 - RNA, 17 nt, Yersinia pestis
auuucaucucaauaacu

SEQ ID NO: 4163234 - RNA, 17 nt, Yersinia pestis
auuucaugcgaauacuu

SEQ ID NO: 4163235 - RNA, 20 nt, Yersinia pestis
auuucauuuuaaaaucguau

SEQ ID NO: 4163236 - RNA, 15 nt, Yersinia pestis
auuuccauaucaacc

SEQ ID NO: 4163237 - RNA, 15 nt, Yersinia pestis
auuuccauauuaugg

SEQ ID NO: 4163238 - RNA, 17 nt, Yersinia pestis
auuuccauauuauggug

SEQ ID NO: 4163239 - RNA, 18 nt, Yersinia pestis
auuuccaucuagcucaag

SEQ ID NO: 4163240 - RNA, 22 nt, Yersinia pestis
auuucccccaccugauaagccg

SEQ ID NO: 4163241 - RNA, 16 nt, Yersinia pestis
auuucccguugauauc

SEQ ID NO: 4163242 - RNA, 14 nt, Yersinia pestis
auuuccuguauuuc

SEQ ID NO: 4163243 - RNA, 16 nt, Yersinia pestis
auuuccuguauuuccu

SEQ ID NO: 4163244 - RNA, 17 nt, Yersinia pestis
auuuccuguauuuccug

SEQ ID NO: 4163245 - RNA, 15 nt, Yersinia pestis
auuucgaaaacucaa

SEQ ID NO: 4163246 - RNA, 19 nt, Yersinia pestis
auuucgcccugcauaucau

SEQ ID NO: 4163247 - RNA, 15 nt, Yersinia pestis
auuucgguaggaaua

SEQ ID NO: 4163248 - RNA, 18 nt, Yersinia pestis
auuucgguuugucauauc

SEQ ID NO: 4163249 - RNA, 21 nt, Yersinia pestis
auuucuaccaguuuuuuccug

SEQ ID NO: 4163250 - RNA, 19 nt, Yersinia pestis
auuucuacgccgucaucau

SEQ ID NO: 4163251 - RNA, 20 nt, Yersinia pestis
auuucuacgccgucaucauc

SEQ ID NO: 4163252 - RNA, 19 nt, Yersinia pestis
auuucuaguggcaacggaa

SEQ ID NO: 4163253 - RNA, 21 nt, Yersinia pestis
auuucucugaugaacggagau

SEQ ID NO: 4163254 - RNA, 16 nt, Yersinia pestis
auuucucuguauuuuc

SEQ ID NO: 4163255 - RNA, 13 nt, Yersinia pestis
auuucucuuuuau

SEQ ID NO: 4163256 - RNA, 16 nt, Yersinia pestis
auuucuguuccaggca

SEQ ID NO: 4163257 - RNA, 14 nt, Yersinia pestis
auuucuucuagcuc

SEQ ID NO: 4163258 - RNA, 23 nt, Yersinia pestis
auuucuucuagcucuuccagcaa

SEQ ID NO: 4163259 - RNA, 18 nt, Yersinia pestis
auuucuugaugcggauaa

SEQ ID NO: 4163260 - RNA, 13 nt, Yersinia pestis
auuucuugauguc

SEQ ID NO: 4163261 - RNA, 18 nt, Yersinia pestis
auuucuuuuaaaucagaa

SEQ ID NO: 4163262 - RNA, 22 nt, Yersinia pestis
auuucuuuugcuguauuuuucg

SEQ ID NO: 4163263 - RNA, 17 nt, Yersinia pestis
auuucuuuuuauguuaa

SEQ ID NO: 4163264 - RNA, 17 nt, Yersinia pestis
auuugaaaugcauuggu

SEQ ID NO: 4163265 - RNA, 23 nt, Yersinia pestis
auuugagauauaggcaucuuuca

SEQ ID NO: 4163266 - RNA, 14 nt, Yersinia pestis
auuugcagaaagua

SEQ ID NO: 4163267 - RNA, 21 nt, Yersinia pestis
auuugcauaaucgcguucaga

SEQ ID NO: 4163268 - RNA, 19 nt, Yersinia pestis
auuugccucugcuagcaaa

SEQ ID NO: 4163269 - RNA, 13 nt, Yersinia pestis
auuugcuaucugg

SEQ ID NO: 4163270 - RNA, 15 nt, Yersinia pestis
auuugcuucguuucc

SEQ ID NO: 4163271 - RNA, 18 nt, Yersinia pestis
auuuggaaugaguuuaag

SEQ ID NO: 4163272 - RNA, 16 nt, Yersinia pestis
auuugggguauauauu

SEQ ID NO: 4163273 - RNA, 21 nt, Yersinia pestis
auuugggucgguaaccugaaa

SEQ ID NO: 4163274 - RNA, 19 nt, Yersinia pestis
auuugguuauaucccaaua

SEQ ID NO: 4163275 - RNA, 15 nt, Yersinia pestis
auuuguaaauuuuuu

SEQ ID NO: 4163276 - RNA, 18 nt, Yersinia pestis
auuuguagugaaugacag

SEQ ID NO: 4163277 - RNA, 15 nt, Yersinia pestis
auuuguaguuuuuca

SEQ ID NO: 4163278 - RNA, 10 nt, Yersinia pestis
auuuguauuc

SEQ ID NO: 4163279 - RNA, 18 nt, Yersinia pestis
auuuguauucucaucauc

SEQ ID NO: 4163280 - RNA, 19 nt, Yersinia pestis
auuugucauguugaccaaa

SEQ ID NO: 4163281 - RNA, 14 nt, Yersinia pestis
auuugugucgggau

SEQ ID NO: 4163282 - RNA, 17 nt, Yersinia pestis
auuuuaacaacccauuu

SEQ ID NO: 4163283 - RNA, 18 nt, Yersinia pestis
auuuuaagccgcaaggau

SEQ ID NO: 4163284 - RNA, 14 nt, Yersinia pestis
auuuuaaguuaaug

SEQ ID NO: 4163285 - RNA, 22 nt, Yersinia pestis
auuuuaaguuaauguuuauauu

SEQ ID NO: 4163286 - RNA, 15 nt, Yersinia pestis
auuuuaaucucucca

SEQ ID NO: 4163287 - RNA, 12 nt, Yersinia pestis
auuuuaccaaca

SEQ ID NO: 4163288 - RNA, 20 nt, Yersinia pestis
auuuuacugcggcuuucugc

SEQ ID NO: 4163289 - RNA, 19 nt, Yersinia pestis
auuuuagcggccucuagcu

SEQ ID NO: 4163290 - RNA, 16 nt, Yersinia pestis
auuuuaguuuuauacc

SEQ ID NO: 4163291 - RNA, 19 nt, Yersinia pestis
auuuuauaaugagaaugua

SEQ ID NO: 4163292 - RNA, 18 nt, Yersinia pestis
auuuuauauugauaaaaa

SEQ ID NO: 4163293 - RNA, 19 nt, Yersinia pestis
auuuuauauugauaaaaau

SEQ ID NO: 4163294 - RNA, 17 nt, Yersinia pestis
auuuuauauugaugacu

SEQ ID NO: 4163295 - RNA, 20 nt, Yersinia pestis
auuuuauauugaugacugaa

SEQ ID NO: 4163296 - RNA, 18 nt, Yersinia pestis
auuuuaucccaaaagaag

SEQ ID NO: 4163297 - RNA, 21 nt, Yersinia pestis
auuuuauccucuuccaauugg

SEQ ID NO: 4163298 - RNA, 14 nt, Yersinia pestis
auuuuaucuacuuc

SEQ ID NO: 4163299 - RNA, 19 nt, Yersinia pestis
auuuuaugaauuaauuuau

SEQ ID NO: 4163300 - RNA, 19 nt, Yersinia pestis
auuuuauugauuggcucau

SEQ ID NO: 4163301 - RNA, 23 nt, Yersinia pestis
auuuuauugcguuaguccaccca

SEQ ID NO: 4163302 - RNA, 14 nt, Yersinia pestis
auuuuauuggaugc

SEQ ID NO: 4163303 - RNA, 22 nt, Yersinia pestis
auuuuauuguuuucguuuaaaa

SEQ ID NO: 4163304 - RNA, 22 nt, Yersinia pestis
auuuucagacugaaaugacauu

SEQ ID NO: 4163305 - RNA, 16 nt, Yersinia pestis
auuuucaucugaccaa

SEQ ID NO: 4163306 - RNA, 14 nt, Yersinia pestis
auuuucauuauuuu

SEQ ID NO: 4163307 - RNA, 19 nt, Yersinia pestis
auuuucauugauacaaaua

SEQ ID NO: 4163308 - RNA, 15 nt, Yersinia pestis
auuuucauuuuaaca

SEQ ID NO: 4163309 - RNA, 16 nt, Yersinia pestis
auuuucauuuuaacaa

SEQ ID NO: 4163310 - RNA, 21 nt, Yersinia pestis
auuuuccagaugaauauguuc

SEQ ID NO: 4163311 - RNA, 16 nt, Yersinia pestis
auuuuccaguuucauc

SEQ ID NO: 4163312 - RNA, 14 nt, Yersinia pestis
auuuucccucugcc

SEQ ID NO: 4163313 - RNA, 17 nt, Yersinia pestis
auuuucccugugcaauc

SEQ ID NO: 4163314 - RNA, 21 nt, Yersinia pestis
auuuucccugugcaaucaagg

SEQ ID NO: 4163315 - RNA, 14 nt, Yersinia pestis
auuuucccuuucuc

SEQ ID NO: 4163316 - RNA, 20 nt, Yersinia pestis
auuuuccgcagcucaccuag

SEQ ID NO: 4163317 - RNA, 16 nt, Yersinia pestis
auuuuccugcacauca

SEQ ID NO: 4163318 - RNA, 13 nt, Yersinia pestis
auuuuccugcaua

SEQ ID NO: 4163319 - RNA, 23 nt, Yersinia pestis
auuuuccugcauauuauuuugca

SEQ ID NO: 4163320 - RNA, 15 nt, Yersinia pestis
auuuucgaacuuaac

SEQ ID NO: 4163321 - RNA, 20 nt, Yersinia pestis
auuuucgcccuaacauugag

SEQ ID NO: 4163322 - RNA, 13 nt, Yersinia pestis
auuuucuauacca

SEQ ID NO: 4163323 - RNA, 19 nt, Yersinia pestis
auuuucuauaccaauugau

SEQ ID NO: 4163324 - RNA, 16 nt, Yersinia pestis
auuuucucgcggggau

SEQ ID NO: 4163325 - RNA, 18 nt, Yersinia pestis
auuuucugccaacgagaa

SEQ ID NO: 4163326 - RNA, 22 nt, Yersinia pestis
auuuugagaugcgagauauaaa

SEQ ID NO: 4163327 - RNA, 19 nt, Yersinia pestis
auuuugaggauauuagggc

SEQ ID NO: 4163328 - RNA, 22 nt, Yersinia pestis
auuuugcacacgauuaccugca

SEQ ID NO: 4163329 - RNA, 15 nt, Yersinia pestis
auuuugccggggagu

SEQ ID NO: 4163330 - RNA, 15 nt, Yersinia pestis
auuuugcggcugagu

SEQ ID NO: 4163331 - RNA, 19 nt, Yersinia pestis
auuuugcgucaccaggcca

SEQ ID NO: 4163332 - RNA, 13 nt, Yersinia pestis
auuuugcugccag

SEQ ID NO: 4163333 - RNA, 20 nt, Yersinia pestis
auuuuggccgcuuugguugc

SEQ ID NO: 4163334 - RNA, 14 nt, Yersinia pestis
auuuuggccuucau

SEQ ID NO: 4163335 - RNA, 16 nt, Yersinia pestis
auuuugggcuaaaacu

SEQ ID NO: 4163336 - RNA, 17 nt, Yersinia pestis
auuuugggcuugagcag

SEQ ID NO: 4163337 - RNA, 17 nt, Yersinia pestis
auuuuggguuugagcag

SEQ ID NO: 4163338 - RNA, 18 nt, Yersinia pestis
auuuugucaugaaaaucu

SEQ ID NO: 4163339 - RNA, 19 nt, Yersinia pestis
auuuugucaugaaaaucuu

SEQ ID NO: 4163340 - RNA, 20 nt, Yersinia pestis
auuuugucgaccgcucuuca

SEQ ID NO: 4163341 - RNA, 20 nt, Yersinia pestis
auuuugugggaaugcccuuu

SEQ ID NO: 4163342 - RNA, 15 nt, Yersinia pestis
auuuuguuuucucuu

SEQ ID NO: 4163343 - RNA, 18 nt, Yersinia pestis
auuuuuaacgucagauaa

SEQ ID NO: 4163344 - RNA, 14 nt, Yersinia pestis
auuuuuaauaaugu

SEQ ID NO: 4163345 - RNA, 21 nt, Yersinia pestis
auuuuuacgauaucaccaggu

SEQ ID NO: 4163346 - RNA, 16 nt, Yersinia pestis
auuuuuagaaaacauu

SEQ ID NO: 4163347 - RNA, 18 nt, Yersinia pestis
auuuuuaucugauuuuau

SEQ ID NO: 4163348 - RNA, 19 nt, Yersinia pestis
auuuuuauguuuaucaccc

SEQ ID NO: 4163349 - RNA, 15 nt, Yersinia pestis
auuuuucauucuauu

SEQ ID NO: 4163350 - RNA, 15 nt, Yersinia pestis
auuuuucccugcuga

SEQ ID NO: 4163351 - RNA, 22 nt, Yersinia pestis
auuuuucccugcugaucgccaa

SEQ ID NO: 4163352 - RNA, 21 nt, Yersinia pestis
auuuuucggugaaccaucaac

SEQ ID NO: 4163353 - RNA, 15 nt, Yersinia pestis
auuuuucguccacua

SEQ ID NO: 4163354 - RNA, 20 nt, Yersinia pestis
auuuuucuguucagauuuac

SEQ ID NO: 4163355 - RNA, 13 nt, Yersinia pestis
auuuuucuuucuc

SEQ ID NO: 4163356 - RNA, 18 nt, Yersinia pestis
auuuuugcauauaaaaca

SEQ ID NO: 4163357 - RNA, 22 nt, Yersinia pestis
auuuuuggggucugaauauaaa

SEQ ID NO: 4163358 - RNA, 12 nt, Yersinia pestis
auuuuuguugaa

SEQ ID NO: 4163359 - RNA, 12 nt, Yersinia pestis
auuuuuuaaaac

SEQ ID NO: 4163360 - RNA, 15 nt, Yersinia pestis
auuuuuuauauucca

SEQ ID NO: 4163361 - RNA, 17 nt, Yersinia pestis
auuuuuuaucuuguaaa

SEQ ID NO: 4163362 - RNA, 23 nt, Yersinia pestis
auuuuuuguucuuaauuuuauca

SEQ ID NO: 4163363 - RNA, 17 nt, Yersinia pestis
auuuuuuucacccaugu

SEQ ID NO: 4163364 - RNA, 15 nt, Yersinia pestis
auuuuuuugaugcau

SEQ ID NO: 4163365 - RNA, 18 nt, Yersinia pestis
auuuuuuugaugcauccu

SEQ ID NO: 4163366 - RNA, 13 nt, Yersinia pestis
auuuuuuugcuuu

SEQ ID NO: 4163367 - RNA, 21 nt, Yersinia pestis
auuuuuuuuccuauaaaccaa

SEQ ID NO: 4163368 - RNA, 22 nt, Yersinia pestis
auuuuuuuuccuauaaaccaac

SEQ ID NO: 4163369 - RNA, 14 nt, Yersinia pestis
caaaaaaaauacau

SEQ ID NO: 4163370 - RNA, 12 nt, Yersinia pestis
caaaaaacaaac

SEQ ID NO: 4163371 - RNA, 15 nt, Yersinia pestis
caaaaaaccggcucc

SEQ ID NO: 4163372 - RNA, 17 nt, Yersinia pestis
caaaaaacugcggcaau

SEQ ID NO: 4163373 - RNA, 24 nt, Yersinia pestis
caaaaaauuaaugagucucacaaa

SEQ ID NO: 4163374 - RNA, 19 nt, Yersinia pestis
caaaaacacagguucucca

SEQ ID NO: 4163375 - RNA, 20 nt, Yersinia pestis
caaaaacacagguucuccag

SEQ ID NO: 4163376 - RNA, 18 nt, Yersinia pestis
caaaaacccauuaaaaac

SEQ ID NO: 4163377 - RNA, 19 nt, Yersinia pestis
caaaaacccauuaaaaaca

SEQ ID NO: 4163378 - RNA, 20 nt, Yersinia pestis
caaaaacccauuaaaaacaa

SEQ ID NO: 4163379 - RNA, 19 nt, Yersinia pestis
caaaaaccugugugguacc

SEQ ID NO: 4163380 - RNA, 20 nt, Yersinia pestis
caaaaagaauuaauaaauau

SEQ ID NO: 4163381 - RNA, 21 nt, Yersinia pestis
caaaaauaaacgggcuuccau

SEQ ID NO: 4163382 - RNA, 19 nt, Yersinia pestis
caaaaaugauauugugaua

SEQ ID NO: 4163383 - RNA, 22 nt, Yersinia pestis
caaaaccgaugagugaaaucuc

SEQ ID NO: 4163384 - RNA, 17 nt, Yersinia pestis
caaaaccggcauuaagc

SEQ ID NO: 4163385 - RNA, 14 nt, Yersinia pestis
caaaaccgugacua

SEQ ID NO: 4163386 - RNA, 20 nt, Yersinia pestis
caaaaccgugacuaaaacaa

SEQ ID NO: 4163387 - RNA, 16 nt, Yersinia pestis
caaaacgaacacugca

SEQ ID NO: 4163388 - RNA, 13 nt, Yersinia pestis
caaaacgaguaaa

SEQ ID NO: 4163389 - RNA, 19 nt, Yersinia pestis
caaaacgaguaaauagcaa

SEQ ID NO: 4163390 - RNA, 16 nt, Yersinia pestis
caaaacgccaccagcg

SEQ ID NO: 4163391 - RNA, 21 nt, Yersinia pestis
caaaacgccaccagcgccaug

SEQ ID NO: 4163392 - RNA, 15 nt, Yersinia pestis
caaaacgugaaagca

SEQ ID NO: 4163393 - RNA, 14 nt, Yersinia pestis
caaaacucagguga

SEQ ID NO: 4163394 - RNA, 11 nt, Yersinia pestis
caaaacucaug

SEQ ID NO: 4163395 - RNA, 16 nt, Yersinia pestis
caaaacuccaucaaaa

SEQ ID NO: 4163396 - RNA, 13 nt, Yersinia pestis
caaaacugaagca

SEQ ID NO: 4163397 - RNA, 13 nt, Yersinia pestis
caaaagaagacaa

SEQ ID NO: 4163398 - RNA, 20 nt, Yersinia pestis
caaaagcaucaccaaagaua

SEQ ID NO: 4163399 - RNA, 15 nt, Yersinia pestis
caaaagcccaucgcc

SEQ ID NO: 4163400 - RNA, 22 nt, Yersinia pestis
caaaagcgaucagcaauaugcu

SEQ ID NO: 4163401 - RNA, 18 nt, Yersinia pestis
caaaaggauggcccaagc

SEQ ID NO: 4163402 - RNA, 22 nt, Yersinia pestis
caaaaggauggcccaagccauc

SEQ ID NO: 4163403 - RNA, 22 nt, Yersinia pestis
caaaaggccccguaaucauggu

SEQ ID NO: 4163404 - RNA, 21 nt, Yersinia pestis
caaaagugacgaaugagcagu

SEQ ID NO: 4163405 - RNA, 19 nt, Yersinia pestis
caaaaguucacaugaugaa

SEQ ID NO: 4163406 - RNA, 13 nt, Yersinia pestis
caaaauaaaaauu

SEQ ID NO: 4163407 - RNA, 20 nt, Yersinia pestis
caaaauaaaaauucacaaca

SEQ ID NO: 4163408 - RNA, 20 nt, Yersinia pestis
caaaauaacugggauauucu

SEQ ID NO: 4163409 - RNA, 12 nt, Yersinia pestis
caaaauacccau

SEQ ID NO: 4163410 - RNA, 16 nt, Yersinia pestis
caaaauacuuaacaau

SEQ ID NO: 4163411 - RNA, 21 nt, Yersinia pestis
caaaauacuuaacaaucagug

SEQ ID NO: 4163412 - RNA, 23 nt, Yersinia pestis
caaaauagaggaaauaaaugacu

SEQ ID NO: 4163413 - RNA, 18 nt, Yersinia pestis
caaaauagccagccccag

SEQ ID NO: 4163414 - RNA, 20 nt, Yersinia pestis
caaaaucaaauacugugcca

SEQ ID NO: 4163415 - RNA, 13 nt, Yersinia pestis
caaaaucaccggu

SEQ ID NO: 4163416 - RNA, 21 nt, Yersinia pestis
caaaauccaccagcgggcggc

SEQ ID NO: 4163417 - RNA, 16 nt, Yersinia pestis
caaaauccgugcuggu

SEQ ID NO: 4163418 - RNA, 12 nt, Yersinia pestis
caaaaugacaau

SEQ ID NO: 4163419 - RNA, 14 nt, Yersinia pestis
caaaaugagccugu

SEQ ID NO: 4163420 - RNA, 16 nt, Yersinia pestis
caaaaugccaacaacu

SEQ ID NO: 4163421 - RNA, 16 nt, Yersinia pestis
caaaaugccuaccguu

SEQ ID NO: 4163422 - RNA, 21 nt, Yersinia pestis
caaaaugcgguggcacugacg

SEQ ID NO: 4163423 - RNA, 23 nt, Yersinia pestis
caaaaugcucuucaccaaaggaa

SEQ ID NO: 4163424 - RNA, 15 nt, Yersinia pestis
caaaaugugaaaagc

SEQ ID NO: 4163425 - RNA, 16 nt, Yersinia pestis
caaaaugugaaaagca

SEQ ID NO: 4163426 - RNA, 19 nt, Yersinia pestis
caaacaaacgcuugagcuu

SEQ ID NO: 4163427 - RNA, 14 nt, Yersinia pestis
caaacaacaacaca

SEQ ID NO: 4163428 - RNA, 15 nt, Yersinia pestis
caaacaaccuaaaaa

SEQ ID NO: 4163429 - RNA, 16 nt, Yersinia pestis
caaacaaccuaaaaaa

SEQ ID NO: 4163430 - RNA, 13 nt, Yersinia pestis
caaacaauccuau

SEQ ID NO: 4163431 - RNA, 23 nt, Yersinia pestis
caaacacuuaugaucuugaauaa

SEQ ID NO: 4163432 - RNA, 23 nt, Yersinia pestis
caaacagccgaucaacccgcaga

SEQ ID NO: 4163433 - RNA, 16 nt, Yersinia pestis
caaacaguaacccagc

SEQ ID NO: 4163434 - RNA, 14 nt, Yersinia pestis
caaacaucgguaaa

SEQ ID NO: 4163435 - RNA, 22 nt, Yersinia pestis
caaacaugagcgcaugcccggu

SEQ ID NO: 4163436 - RNA, 19 nt, Yersinia pestis
caaaccaauuucucggcca

SEQ ID NO: 4163437 - RNA, 13 nt, Yersinia pestis
caaaccagcccug

SEQ ID NO: 4163438 - RNA, 17 nt, Yersinia pestis
caaaccccacuaacgcu

SEQ ID NO: 4163439 - RNA, 18 nt, Yersinia pestis
caaaccccgccucuucua

SEQ ID NO: 4163440 - RNA, 20 nt, Yersinia pestis
caaaccccgccucuucuaau

SEQ ID NO: 4163441 - RNA, 21 nt, Yersinia pestis
caaacccuaauaccaacagca

SEQ ID NO: 4163442 - RNA, 14 nt, Yersinia pestis
caaaccgaauacca

SEQ ID NO: 4163443 - RNA, 17 nt, Yersinia pestis
caaaccgggguucgcaa

SEQ ID NO: 4163444 - RNA, 16 nt, Yersinia pestis
caaacgcucaguuaaa

SEQ ID NO: 4163445 - RNA, 13 nt, Yersinia pestis
caaacgcugcaca

SEQ ID NO: 4163446 - RNA, 14 nt, Yersinia pestis
caaacgcuugagcu

SEQ ID NO: 4163447 - RNA, 22 nt, Yersinia pestis
caaacggacuccccgcucggcc

SEQ ID NO: 4163448 - RNA, 17 nt, Yersinia pestis
caaacgggugcgccaau

SEQ ID NO: 4163449 - RNA, 21 nt, Yersinia pestis
caaacggucuguuaauccuaa

SEQ ID NO: 4163450 - RNA, 24 nt, Yersinia pestis
caaacgugaugugcccuuguuuau

SEQ ID NO: 4163451 - RNA, 14 nt, Yersinia pestis
caaacguuuuauuc

SEQ ID NO: 4163452 - RNA, 13 nt, Yersinia pestis
caaacucagccaa

SEQ ID NO: 4163453 - RNA, 21 nt, Yersinia pestis
caaacucagccaauccagcaa

SEQ ID NO: 4163454 - RNA, 20 nt, Yersinia pestis
caaacucagccaucaguuca

SEQ ID NO: 4163455 - RNA, 19 nt, Yersinia pestis
caaacucagcgaauaaaua

SEQ ID NO: 4163456 - RNA, 21 nt, Yersinia pestis
caaacucggccgggcugacau

SEQ ID NO: 4163457 - RNA, 18 nt, Yersinia pestis
caaacugaauggauugaa

SEQ ID NO: 4163458 - RNA, 12 nt, Yersinia pestis
caaacugauaaa

SEQ ID NO: 4163459 - RNA, 18 nt, Yersinia pestis
caaacuggccauguugug

SEQ ID NO: 4163460 - RNA, 20 nt, Yersinia pestis
caaacuguuuuuuaaagaaa

SEQ ID NO: 4163461 - RNA, 18 nt, Yersinia pestis
caaacuuaaaaaucaaaa

SEQ ID NO: 4163462 - RNA, 22 nt, Yersinia pestis
caaagaagacaucuggcuggca

SEQ ID NO: 4163463 - RNA, 16 nt, Yersinia pestis
caaagaauguuauugc

SEQ ID NO: 4163464 - RNA, 21 nt, Yersinia pestis
caaagaauugagguaaaccaa

SEQ ID NO: 4163465 - RNA, 20 nt, Yersinia pestis
caaagaccacaucaaccuga

SEQ ID NO: 4163466 - RNA, 19 nt, Yersinia pestis
caaagagucgcaaaacuuc

SEQ ID NO: 4163467 - RNA, 15 nt, Yersinia pestis
caaagauacagugga

SEQ ID NO: 4163468 - RNA, 22 nt, Yersinia pestis
caaagauuucaucggcaaaaac

SEQ ID NO: 4163469 - RNA, 14 nt, Yersinia pestis
caaagcaauaaacu

SEQ ID NO: 4163470 - RNA, 21 nt, Yersinia pestis
caaagcaaugaauacccaaaa

SEQ ID NO: 4163471 - RNA, 21 nt, Yersinia pestis
caaagcaccaacuaagcagau

SEQ ID NO: 4163472 - RNA, 16 nt, Yersinia pestis
caaagccuacgagaga

SEQ ID NO: 4163473 - RNA, 22 nt, Yersinia pestis
caaagccuacgagagaucguag

SEQ ID NO: 4163474 - RNA, 21 nt, Yersinia pestis
caaagccugccauacccgcug

SEQ ID NO: 4163475 - RNA, 12 nt, Yersinia pestis
caaagcuauuuu

SEQ ID NO: 4163476 - RNA, 17 nt, Yersinia pestis
caaagcuauuuuuagcc

SEQ ID NO: 4163477 - RNA, 17 nt, Yersinia pestis
caaagcuuacuguucac

SEQ ID NO: 4163478 - RNA, 16 nt, Yersinia pestis
caaaggaagggguucu

SEQ ID NO: 4163479 - RNA, 19 nt, Yersinia pestis
caaaggcccgcuaucacua

SEQ ID NO: 4163480 - RNA, 13 nt, Yersinia pestis
caaaguaaaauaa

SEQ ID NO: 4163481 - RNA, 15 nt, Yersinia pestis
caaaguaaaauaaaa

SEQ ID NO: 4163482 - RNA, 23 nt, Yersinia pestis
caaaguaccgcuuugugaugcac

SEQ ID NO: 4163483 - RNA, 22 nt, Yersinia pestis
caaaguaccuauggcgaagaga

SEQ ID NO: 4163484 - RNA, 16 nt, Yersinia pestis
caaaguagaacuggcc

SEQ ID NO: 4163485 - RNA, 13 nt, Yersinia pestis
caaaguaguacga

SEQ ID NO: 4163486 - RNA, 22 nt, Yersinia pestis
caaagugcccgcgacggagaga

SEQ ID NO: 4163487 - RNA, 20 nt, Yersinia pestis
caaagugccugcggcggaga

SEQ ID NO: 4163488 - RNA, 20 nt, Yersinia pestis
caaagugcugcaaggcauua

SEQ ID NO: 4163489 - RNA, 22 nt, Yersinia pestis
caaagugcuuaacccaccaaua

SEQ ID NO: 4163490 - RNA, 13 nt, Yersinia pestis
caaaguugaguau

SEQ ID NO: 4163491 - RNA, 15 nt, Yersinia pestis
caaauaaaacagaac

SEQ ID NO: 4163492 - RNA, 16 nt, Yersinia pestis
caaauaaaaccaagaa

SEQ ID NO: 4163493 - RNA, 14 nt, Yersinia pestis
caaauaaauauccu

SEQ ID NO: 4163494 - RNA, 21 nt, Yersinia pestis
caaauaacccgccuagcauca

SEQ ID NO: 4163495 - RNA, 18 nt, Yersinia pestis
caaauaaguacuuccaau

SEQ ID NO: 4163496 - RNA, 14 nt, Yersinia pestis
caaauaauuacgua

SEQ ID NO: 4163497 - RNA, 15 nt, Yersinia pestis
caaauaauucagacg

SEQ ID NO: 4163498 - RNA, 17 nt, Yersinia pestis
caaauaauucagacggc

SEQ ID NO: 4163499 - RNA, 20 nt, Yersinia pestis
caaauaauucagacggcaga

SEQ ID NO: 4163500 - RNA, 13 nt, Yersinia pestis
caaauacacauaa

SEQ ID NO: 4163501 - RNA, 22 nt, Yersinia pestis
caaauacccuaauucagauguu

SEQ ID NO: 4163502 - RNA, 19 nt, Yersinia pestis
caaauaccgggacuaccaa

SEQ ID NO: 4163503 - RNA, 22 nt, Yersinia pestis
caaauacgaccgucaccaaaua

SEQ ID NO: 4163504 - RNA, 22 nt, Yersinia pestis
caaauacggcgaaauauaaaac

SEQ ID NO: 4163505 - RNA, 17 nt, Yersinia pestis
caaauacuucaaaugac

SEQ ID NO: 4163506 - RNA, 17 nt, Yersinia pestis
caaauagaucggguaaa

SEQ ID NO: 4163507 - RNA, 21 nt, Yersinia pestis
caaauagaucggguaaaccaa

SEQ ID NO: 4163508 - RNA, 22 nt, Yersinia pestis
caaauagaucggguaaaccaau

SEQ ID NO: 4163509 - RNA, 15 nt, Yersinia pestis
caaauagauuuaacu

SEQ ID NO: 4163510 - RNA, 21 nt, Yersinia pestis
caaauagcaagccaaaacagc

SEQ ID NO: 4163511 - RNA, 16 nt, Yersinia pestis
caaauagguuuuacuc

SEQ ID NO: 4163512 - RNA, 16 nt, Yersinia pestis
caaauauaaugcugaa

SEQ ID NO: 4163513 - RNA, 15 nt, Yersinia pestis
caaauaucauuauuu

SEQ ID NO: 4163514 - RNA, 20 nt, Yersinia pestis
caaaucaccugacaccaaga

SEQ ID NO: 4163515 - RNA, 13 nt, Yersinia pestis
caaaucaccuugg

SEQ ID NO: 4163516 - RNA, 21 nt, Yersinia pestis
caaaucaguaccaccaccaca

SEQ ID NO: 4163517 - RNA, 20 nt, Yersinia pestis
caaaucauacgcagccugaa

SEQ ID NO: 4163518 - RNA, 18 nt, Yersinia pestis
caaaucaucagacagcca

SEQ ID NO: 4163519 - RNA, 16 nt, Yersinia pestis
caaaucccgcuggaag

SEQ ID NO: 4163520 - RNA, 22 nt, Yersinia pestis
caaauccuguagcucagccugu

SEQ ID NO: 4163521 - RNA, 19 nt, Yersinia pestis
caaaucgccaaacugcuca

SEQ ID NO: 4163522 - RNA, 22 nt, Yersinia pestis
caaaucugacgguuauuuucug

SEQ ID NO: 4163523 - RNA, 13 nt, Yersinia pestis
caaaucugcuccc

SEQ ID NO: 4163524 - RNA, 16 nt, Yersinia pestis
caaaucuggauaaugu

SEQ ID NO: 4163525 - RNA, 20 nt, Yersinia pestis
caaaucuugugaugcauauu

SEQ ID NO: 4163526 - RNA, 12 nt, Yersinia pestis
caaaugaacuau

SEQ ID NO: 4163527 - RNA, 17 nt, Yersinia pestis
caaaugaacuaucgccu

SEQ ID NO: 4163528 - RNA, 21 nt, Yersinia pestis
caaaugaccguacaucuggcc

SEQ ID NO: 4163529 - RNA, 15 nt, Yersinia pestis
caaaugccaguaagg

SEQ ID NO: 4163530 - RNA, 22 nt, Yersinia pestis
caaaugggccacaggcugcaug

SEQ ID NO: 4163531 - RNA, 13 nt, Yersinia pestis
caaaugucagauc

SEQ ID NO: 4163532 - RNA, 15 nt, Yersinia pestis
caaaugucagaucgc

SEQ ID NO: 4163533 - RNA, 20 nt, Yersinia pestis
caaaugucagaucgcgaugc

SEQ ID NO: 4163534 - RNA, 14 nt, Yersinia pestis
caaauuaacacauc

SEQ ID NO: 4163535 - RNA, 13 nt, Yersinia pestis
caaauuaauaggu

SEQ ID NO: 4163536 - RNA, 22 nt, Yersinia pestis
caaauuacggcucaguugaugc

SEQ ID NO: 4163537 - RNA, 13 nt, Yersinia pestis
caaauuacuuuaa

SEQ ID NO: 4163538 - RNA, 23 nt, Yersinia pestis
caaauuagcgucuuuaacgcugc

SEQ ID NO: 4163539 - RNA, 19 nt, Yersinia pestis
caaauuauauaagagauga

SEQ ID NO: 4163540 - RNA, 14 nt, Yersinia pestis
caaauucaccagca

SEQ ID NO: 4163541 - RNA, 17 nt, Yersinia pestis
caaauucucaaugauaa

SEQ ID NO: 4163542 - RNA, 18 nt, Yersinia pestis
caaauucucaaugauaaa

SEQ ID NO: 4163543 - RNA, 18 nt, Yersinia pestis
caaauucuuucaacgcau

SEQ ID NO: 4163544 - RNA, 17 nt, Yersinia pestis
caaauugcggcaaccaa

SEQ ID NO: 4163545 - RNA, 19 nt, Yersinia pestis
caaauugcugaaaaaaaac

SEQ ID NO: 4163546 - RNA, 18 nt, Yersinia pestis
caaauuguggaaauaacg

SEQ ID NO: 4163547 - RNA, 17 nt, Yersinia pestis
caaauuugacauuuccu

SEQ ID NO: 4163548 - RNA, 21 nt, Yersinia pestis
caaauuuuuaccuucuacaaa

SEQ ID NO: 4163549 - RNA, 15 nt, Yersinia pestis
caaauuuuuccuuua

SEQ ID NO: 4163550 - RNA, 21 nt, Yersinia pestis
caaauuuuuuauauuccacau

SEQ ID NO: 4163551 - RNA, 20 nt, Yersinia pestis
caacaaacaguucauaucga

SEQ ID NO: 4163552 - RNA, 16 nt, Yersinia pestis
caacaaacucugcgua

SEQ ID NO: 4163553 - RNA, 13 nt, Yersinia pestis
caacaaaguaagg

SEQ ID NO: 4163554 - RNA, 17 nt, Yersinia pestis
caacaaauucaccagca

SEQ ID NO: 4163555 - RNA, 20 nt, Yersinia pestis
caacaaauucaccagcaaua

SEQ ID NO: 4163556 - RNA, 18 nt, Yersinia pestis
caacaacgccucaucuuc

SEQ ID NO: 4163557 - RNA, 18 nt, Yersinia pestis
caacaacucgaauuauuu

SEQ ID NO: 4163558 - RNA, 22 nt, Yersinia pestis
caacaagaucccaagcaggaaa

SEQ ID NO: 4163559 - RNA, 18 nt, Yersinia pestis
caacaauaaagcgguaaa

SEQ ID NO: 4163560 - RNA, 22 nt, Yersinia pestis
caacaauauucgcagccaaaau

SEQ ID NO: 4163561 - RNA, 23 nt, Yersinia pestis
caacaauuuacgguccauaaaau

SEQ ID NO: 4163562 - RNA, 13 nt, Yersinia pestis
caacacaccugca

SEQ ID NO: 4163563 - RNA, 15 nt, Yersinia pestis
caacacauaaaauca

SEQ ID NO: 4163564 - RNA, 13 nt, Yersinia pestis
caacaccacacug

SEQ ID NO: 4163565 - RNA, 19 nt, Yersinia pestis
caacaccacacugagcacc

SEQ ID NO: 4163566 - RNA, 15 nt, Yersinia pestis
caacacccaacucaa

SEQ ID NO: 4163567 - RNA, 18 nt, Yersinia pestis
caacacccgaccagacaa

SEQ ID NO: 4163568 - RNA, 13 nt, Yersinia pestis
caacacugccuga

SEQ ID NO: 4163569 - RNA, 14 nt, Yersinia pestis
caacagauaaagcu

SEQ ID NO: 4163570 - RNA, 21 nt, Yersinia pestis
caacagauaauuggcaauaau

SEQ ID NO: 4163571 - RNA, 22 nt, Yersinia pestis
caacagauaauuggcaauaaug

SEQ ID NO: 4163572 - RNA, 22 nt, Yersinia pestis
caacagaugaugauuuuuacag

SEQ ID NO: 4163573 - RNA, 23 nt, Yersinia pestis
caacagaugaugauuuuuacagc

SEQ ID NO: 4163574 - RNA, 11 nt, Yersinia pestis
caacagcaaaa

SEQ ID NO: 4163575 - RNA, 17 nt, Yersinia pestis
caacagcaucaucaaau

SEQ ID NO: 4163576 - RNA, 18 nt, Yersinia pestis
caacagcguaauaccacu

SEQ ID NO: 4163577 - RNA, 13 nt, Yersinia pestis
caacaguaaaggu

SEQ ID NO: 4163578 - RNA, 15 nt, Yersinia pestis
caacaguaccuucua

SEQ ID NO: 4163579 - RNA, 22 nt, Yersinia pestis
caacaguuauuuuaauugcuga

SEQ ID NO: 4163580 - RNA, 18 nt, Yersinia pestis
caacauaaauaggccgcc

SEQ ID NO: 4163581 - RNA, 20 nt, Yersinia pestis
caacauaaauaggccgccaa

SEQ ID NO: 4163582 - RNA, 15 nt, Yersinia pestis
caacauaaguaauaa

SEQ ID NO: 4163583 - RNA, 18 nt, Yersinia pestis
caacauaaguaauaagua

SEQ ID NO: 4163584 - RNA, 15 nt, Yersinia pestis
caacauaaucaaucc

SEQ ID NO: 4163585 - RNA, 19 nt, Yersinia pestis
caacauagguuuuuucacu

SEQ ID NO: 4163586 - RNA, 16 nt, Yersinia pestis
caacauaguugaauaa

SEQ ID NO: 4163587 - RNA, 19 nt, Yersinia pestis
caacaucacauccgaucag

SEQ ID NO: 4163588 - RNA, 11 nt, Yersinia pestis
caacaucaucg

SEQ ID NO: 4163589 - RNA, 20 nt, Yersinia pestis
caacauccaguucgaccaau

SEQ ID NO: 4163590 - RNA, 23 nt, Yersinia pestis
caacaugggcaagcucugggcug

SEQ ID NO: 4163591 - RNA, 14 nt, Yersinia pestis
caacaugguccaca

SEQ ID NO: 4163592 - RNA, 15 nt, Yersinia pestis
caacaugguccacag

SEQ ID NO: 4163593 - RNA, 14 nt, Yersinia pestis
caacauuaaaaaua

SEQ ID NO: 4163594 - RNA, 23 nt, Yersinia pestis
caacauuaaaaauacaaccaaca

SEQ ID NO: 4163595 - RNA, 22 nt, Yersinia pestis
caacauuagggccaccagacug

SEQ ID NO: 4163596 - RNA, 20 nt, Yersinia pestis
caacauugcucggcugacga

SEQ ID NO: 4163597 - RNA, 16 nt, Yersinia pestis
caacauuuuuagcuuc

SEQ ID NO: 4163598 - RNA, 13 nt, Yersinia pestis
caaccaacaaaca

SEQ ID NO: 4163599 - RNA, 21 nt, Yersinia pestis
caaccacgguaauagcuuaau

SEQ ID NO: 4163600 - RNA, 19 nt, Yersinia pestis
caaccacuaaaccacauaa

SEQ ID NO: 4163601 - RNA, 23 nt, Yersinia pestis
caaccacuaaaccacauaacgca

SEQ ID NO: 4163602 - RNA, 17 nt, Yersinia pestis
caaccagacguuaugaa

SEQ ID NO: 4163603 - RNA, 14 nt, Yersinia pestis
caaccaggccgcca

SEQ ID NO: 4163604 - RNA, 15 nt, Yersinia pestis
caaccauaucgccau

SEQ ID NO: 4163605 - RNA, 13 nt, Yersinia pestis
caaccaucaccau

SEQ ID NO: 4163606 - RNA, 22 nt, Yersinia pestis
caaccauuguggcuaaacccaa

SEQ ID NO: 4163607 - RNA, 23 nt, Yersinia pestis
caaccauuuuauugccagagggc

SEQ ID NO: 4163608 - RNA, 18 nt, Yersinia pestis
caacccaauaauaaucca

SEQ ID NO: 4163609 - RNA, 12 nt, Yersinia pestis
caaccccagccg

SEQ ID NO: 4163610 - RNA, 16 nt, Yersinia pestis
caaccccaucagcaua

SEQ ID NO: 4163611 - RNA, 17 nt, Yersinia pestis
caacccgauccagaaua

SEQ ID NO: 4163612 - RNA, 15 nt, Yersinia pestis
caacccgcacguuca

SEQ ID NO: 4163613 - RNA, 18 nt, Yersinia pestis
caacccggcuguuaaauu

SEQ ID NO: 4163614 - RNA, 18 nt, Yersinia pestis
caacccuaacaccgagua

SEQ ID NO: 4163615 - RNA, 17 nt, Yersinia pestis
caaccgaccaaaggcca

SEQ ID NO: 4163616 - RNA, 14 nt, Yersinia pestis
caaccgagaagucg

SEQ ID NO: 4163617 - RNA, 13 nt, Yersinia pestis
caaccggcgcgcu

SEQ ID NO: 4163618 - RNA, 23 nt, Yersinia pestis
caaccguuguguaucagcaacuu

SEQ ID NO: 4163619 - RNA, 13 nt, Yersinia pestis
caaccuaaaaaaa

SEQ ID NO: 4163620 - RNA, 18 nt, Yersinia pestis
caaccuaaaaaaaacaac

SEQ ID NO: 4163621 - RNA, 14 nt, Yersinia pestis
caaccucagccuca

SEQ ID NO: 4163622 - RNA, 20 nt, Yersinia pestis
caaccucggucugaauaaga

SEQ ID NO: 4163623 - RNA, 17 nt, Yersinia pestis
caaccugcgccacccau

SEQ ID NO: 4163624 - RNA, 18 nt, Yersinia pestis
caaccuugaucaaaaacg

SEQ ID NO: 4163625 - RNA, 21 nt, Yersinia pestis
caaccuuggugaagaucaaug

SEQ ID NO: 4163626 - RNA, 20 nt, Yersinia pestis
caaccuuuuccgccaugaga

SEQ ID NO: 4163627 - RNA, 14 nt, Yersinia pestis
caacgaaacacacu

SEQ ID NO: 4163628 - RNA, 17 nt, Yersinia pestis
caacgaaggcaacaaca

SEQ ID NO: 4163629 - RNA, 17 nt, Yersinia pestis
caacgaauaaaaaagcc

SEQ ID NO: 4163630 - RNA, 17 nt, Yersinia pestis
caacgaccucaucaccc

SEQ ID NO: 4163631 - RNA, 16 nt, Yersinia pestis
caacgcaauugcaccg

SEQ ID NO: 4163632 - RNA, 14 nt, Yersinia pestis
caacgcacaccccc

SEQ ID NO: 4163633 - RNA, 23 nt, Yersinia pestis
caacgcacgauccgcccauugcg

SEQ ID NO: 4163634 - RNA, 20 nt, Yersinia pestis
caacgcagacaugauuaaau

SEQ ID NO: 4163635 - RNA, 21 nt, Yersinia pestis
caacgcaggcacugcagaaaa

SEQ ID NO: 4163636 - RNA, 23 nt, Yersinia pestis
caacgcauuaccccguugcucua

SEQ ID NO: 4163637 - RNA, 14 nt, Yersinia pestis
caacgccaauaccg

SEQ ID NO: 4163638 - RNA, 19 nt, Yersinia pestis
caacgccggaucaucaacc

SEQ ID NO: 4163639 - RNA, 18 nt, Yersinia pestis
caacgcgcagugccguca

SEQ ID NO: 4163640 - RNA, 21 nt, Yersinia pestis
caacgcguacgggacggguug

SEQ ID NO: 4163641 - RNA, 19 nt, Yersinia pestis
caacgcuccgguuuucacc

SEQ ID NO: 4163642 - RNA, 23 nt, Yersinia pestis
caacgcuccgguuuucaccccca

SEQ ID NO: 4163643 - RNA, 22 nt, Yersinia pestis
caacgcuguuggguugugguau

SEQ ID NO: 4163644 - RNA, 21 nt, Yersinia pestis
caacgcuuacguuuugagguu

SEQ ID NO: 4163645 - RNA, 13 nt, Yersinia pestis
caacgcuuaucaa

SEQ ID NO: 4163646 - RNA, 14 nt, Yersinia pestis
caacggacacauaa

SEQ ID NO: 4163647 - RNA, 18 nt, Yersinia pestis
caacggacacauaagugu

SEQ ID NO: 4163648 - RNA, 18 nt, Yersinia pestis
caacggagagaacaggca

SEQ ID NO: 4163649 - RNA, 21 nt, Yersinia pestis
caacggagcguacacgcagua

SEQ ID NO: 4163650 - RNA, 15 nt, Yersinia pestis
caacggaguaacaaa

SEQ ID NO: 4163651 - RNA, 21 nt, Yersinia pestis
caacggcccaauauugaucca

SEQ ID NO: 4163652 - RNA, 14 nt, Yersinia pestis
caacggugaacaga

SEQ ID NO: 4163653 - RNA, 14 nt, Yersinia pestis
caacgucacuucca

SEQ ID NO: 4163654 - RNA, 20 nt, Yersinia pestis
caacgucaucgccacacgca

SEQ ID NO: 4163655 - RNA, 15 nt, Yersinia pestis
caacguuaaaccccc

SEQ ID NO: 4163656 - RNA, 15 nt, Yersinia pestis
caacguuaguuugag

SEQ ID NO: 4163657 - RNA, 19 nt, Yersinia pestis
caacguuuaguaaucaaua

SEQ ID NO: 4163658 - RNA, 19 nt, Yersinia pestis
caacuaaacagggcagaaa

SEQ ID NO: 4163659 - RNA, 22 nt, Yersinia pestis
caacuaauucuuaggauaacca

SEQ ID NO: 4163660 - RNA, 17 nt, Yersinia pestis
caacuaucguccgcgcc

SEQ ID NO: 4163661 - RNA, 18 nt, Yersinia pestis
caacuauugcaucuuuaa

SEQ ID NO: 4163662 - RNA, 21 nt, Yersinia pestis
caacuauugcaucuuuaauua

SEQ ID NO: 4163663 - RNA, 14 nt, Yersinia pestis
caacucaaaacaau

SEQ ID NO: 4163664 - RNA, 20 nt, Yersinia pestis
caacuccugccuacgcuggc

SEQ ID NO: 4163665 - RNA, 21 nt, Yersinia pestis
caacuccuuaccacugcucac

SEQ ID NO: 4163666 - RNA, 22 nt, Yersinia pestis
caacuccuuaccacugcucacu

SEQ ID NO: 4163667 - RNA, 16 nt, Yersinia pestis
caacucgaauuauuuu

SEQ ID NO: 4163668 - RNA, 17 nt, Yersinia pestis
caacucggccgcuaagu

SEQ ID NO: 4163669 - RNA, 21 nt, Yersinia pestis
caacucggccgcuaagucacg

SEQ ID NO: 4163670 - RNA, 13 nt, Yersinia pestis
caacucuacauug

SEQ ID NO: 4163671 - RNA, 20 nt, Yersinia pestis
caacucuagcgccagcaauu

SEQ ID NO: 4163672 - RNA, 15 nt, Yersinia pestis
caacucugaugaaau

SEQ ID NO: 4163673 - RNA, 13 nt, Yersinia pestis
caacucuucuuua

SEQ ID NO: 4163674 - RNA, 17 nt, Yersinia pestis
caacucuucuuuacugc

SEQ ID NO: 4163675 - RNA, 19 nt, Yersinia pestis
caacugaaaccgaucacua

SEQ ID NO: 4163676 - RNA, 14 nt, Yersinia pestis
caacugaaacugga

SEQ ID NO: 4163677 - RNA, 22 nt, Yersinia pestis
caacugagucgcuugauucuca

SEQ ID NO: 4163678 - RNA, 19 nt, Yersinia pestis
caacugauaauucaguguc

SEQ ID NO: 4163679 - RNA, 22 nt, Yersinia pestis
caacugauuuuuauggcagaaa

SEQ ID NO: 4163680 - RNA, 17 nt, Yersinia pestis
caacugccaauauguua

SEQ ID NO: 4163681 - RNA, 17 nt, Yersinia pestis
caacugccccucuuuuc

SEQ ID NO: 4163682 - RNA, 20 nt, Yersinia pestis
caacugccgccaugcuggau

SEQ ID NO: 4163683 - RNA, 19 nt, Yersinia pestis
caacugguuaucacugucc

SEQ ID NO: 4163684 - RNA, 14 nt, Yersinia pestis
caacuguaaaaucu

SEQ ID NO: 4163685 - RNA, 15 nt, Yersinia pestis
caacuuagccuacuc

SEQ ID NO: 4163686 - RNA, 19 nt, Yersinia pestis
caacuucaauaccaaauuu

SEQ ID NO: 4163687 - RNA, 16 nt, Yersinia pestis
caacuuccacacaaac

SEQ ID NO: 4163688 - RNA, 20 nt, Yersinia pestis
caacuuccagugccaauuga

SEQ ID NO: 4163689 - RNA, 14 nt, Yersinia pestis
caacuucuacauag

SEQ ID NO: 4163690 - RNA, 11 nt, Yersinia pestis
caacuucuuca

SEQ ID NO: 4163691 - RNA, 12 nt, Yersinia pestis
caacuucuucau

SEQ ID NO: 4163692 - RNA, 22 nt, Yersinia pestis
caacuugugacgccggagaaau

SEQ ID NO: 4163693 - RNA, 23 nt, Yersinia pestis
caacuuuaauaugcaaaaaaaga

SEQ ID NO: 4163694 - RNA, 19 nt, Yersinia pestis
caacuuucucuuuccucuu

SEQ ID NO: 4163695 - RNA, 16 nt, Yersinia pestis
caacuuuggccaccgc

SEQ ID NO: 4163696 - RNA, 13 nt, Yersinia pestis
caacuuuuacugu

SEQ ID NO: 4163697 - RNA, 18 nt, Yersinia pestis
caacuuuuauuggcauua

SEQ ID NO: 4163698 - RNA, 22 nt, Yersinia pestis
caacuuuuuuaccacauuuccu

SEQ ID NO: 4163699 - RNA, 18 nt, Yersinia pestis
caacuuuuuucauccuaa

SEQ ID NO: 4163700 - RNA, 19 nt, Yersinia pestis
caacuuuuuucauccuaaa

SEQ ID NO: 4163701 - RNA, 23 nt, Yersinia pestis
caagaaacuucauuucagguaaa

SEQ ID NO: 4163702 - RNA, 15 nt, Yersinia pestis
caagaaagaaaaaua

SEQ ID NO: 4163703 - RNA, 18 nt, Yersinia pestis
caagaaccgaaauaucau

SEQ ID NO: 4163704 - RNA, 19 nt, Yersinia pestis
caagaagacuaaacgcuac

SEQ ID NO: 4163705 - RNA, 23 nt, Yersinia pestis
caagacaacaaacaguaacccag

SEQ ID NO: 4163706 - RNA, 17 nt, Yersinia pestis
caagaccuugguaucug

SEQ ID NO: 4163707 - RNA, 21 nt, Yersinia pestis
caagacgauaucgacgccugu

SEQ ID NO: 4163708 - RNA, 17 nt, Yersinia pestis
caagacucaguaaauau

SEQ ID NO: 4163709 - RNA, 20 nt, Yersinia pestis
caagacucaguaaauauaau

SEQ ID NO: 4163710 - RNA, 17 nt, Yersinia pestis
caagacuuuccacaaca

SEQ ID NO: 4163711 - RNA, 18 nt, Yersinia pestis
caagacuuuccacaacag

SEQ ID NO: 4163712 - RNA, 20 nt, Yersinia pestis
caagagaaacccauagcaaa

SEQ ID NO: 4163713 - RNA, 16 nt, Yersinia pestis
caagagaaaugcacuu

SEQ ID NO: 4163714 - RNA, 22 nt, Yersinia pestis
caagagcgauaaccgcacugag

SEQ ID NO: 4163715 - RNA, 14 nt, Yersinia pestis
caagagugagucau

SEQ ID NO: 4163716 - RNA, 15 nt, Yersinia pestis
caagagugagucauc

SEQ ID NO: 4163717 - RNA, 23 nt, Yersinia pestis
caagagugagucaucgggguuug

SEQ ID NO: 4163718 - RNA, 20 nt, Yersinia pestis
caagaguuucauuugcugug

SEQ ID NO: 4163719 - RNA, 13 nt, Yersinia pestis
caagauaaaguuc

SEQ ID NO: 4163720 - RNA, 18 nt, Yersinia pestis
caagauaccgaguucuca

SEQ ID NO: 4163721 - RNA, 20 nt, Yersinia pestis
caagauagaaccaugagaau

SEQ ID NO: 4163722 - RNA, 17 nt, Yersinia pestis
caagauauuacuucuuu

SEQ ID NO: 4163723 - RNA, 13 nt, Yersinia pestis
caagaugcauauu

SEQ ID NO: 4163724 - RNA, 20 nt, Yersinia pestis
caagaugccuauuugcagaa

SEQ ID NO: 4163725 - RNA, 19 nt, Yersinia pestis
caagauugggaucaacgcc

SEQ ID NO: 4163726 - RNA, 23 nt, Yersinia pestis
caagauugggaucaacgcccgcg

SEQ ID NO: 4163727 - RNA, 15 nt, Yersinia pestis
caagcaagcggcagc

SEQ ID NO: 4163728 - RNA, 19 nt, Yersinia pestis
caagcaagcggcagcgcug

SEQ ID NO: 4163729 - RNA, 12 nt, Yersinia pestis
caagcaauggca

SEQ ID NO: 4163730 - RNA, 19 nt, Yersinia pestis
caagcagugucagggcaau

SEQ ID NO: 4163731 - RNA, 24 nt, Yersinia pestis
caagcagugucagggcaauaacaa

SEQ ID NO: 4163732 - RNA, 12 nt, Yersinia pestis
caagcauagaag

SEQ ID NO: 4163733 - RNA, 18 nt, Yersinia pestis
caagcaugugauguggcu

SEQ ID NO: 4163734 - RNA, 23 nt, Yersinia pestis
caagcauugagcgccacaucggc

SEQ ID NO: 4163735 - RNA, 16 nt, Yersinia pestis
caagccaacccccauu

SEQ ID NO: 4163736 - RNA, 14 nt, Yersinia pestis
caagccaaugaauc

SEQ ID NO: 4163737 - RNA, 14 nt, Yersinia pestis
caagccaauggcca

SEQ ID NO: 4163738 - RNA, 14 nt, Yersinia pestis
caagccaccaccac

SEQ ID NO: 4163739 - RNA, 19 nt, Yersinia pestis
caagccgauaaucaauuug

SEQ ID NO: 4163740 - RNA, 22 nt, Yersinia pestis
caagccgcuuaucucggggcca

SEQ ID NO: 4163741 - RNA, 21 nt, Yersinia pestis
caagccuaacaaacugaaugg

SEQ ID NO: 4163742 - RNA, 22 nt, Yersinia pestis
caagccuaacaaacugaaugga

SEQ ID NO: 4163743 - RNA, 11 nt, Yersinia pestis
caagccucuag

SEQ ID NO: 4163744 - RNA, 23 nt, Yersinia pestis
caagccucuagcuaacagugacc

SEQ ID NO: 4163745 - RNA, 16 nt, Yersinia pestis
caagccugugcuaaau

SEQ ID NO: 4163746 - RNA, 21 nt, Yersinia pestis
caagccugugcuaaaucccag

SEQ ID NO: 4163747 - RNA, 23 nt, Yersinia pestis
caagccuucauucaauugaucua

SEQ ID NO: 4163748 - RNA, 23 nt, Yersinia pestis
caagcggccagcuugcaagugua

SEQ ID NO: 4163749 - RNA, 14 nt, Yersinia pestis
caagcgggccaagg

SEQ ID NO: 4163750 - RNA, 21 nt, Yersinia pestis
caagcgggccaaggggagcca

SEQ ID NO: 4163751 - RNA, 19 nt, Yersinia pestis
caagcguacaucaggguga

SEQ ID NO: 4163752 - RNA, 20 nt, Yersinia pestis
caagcguuaugacgccaacu

SEQ ID NO: 4163753 - RNA, 13 nt, Yersinia pestis
caagcuacaugug

SEQ ID NO: 4163754 - RNA, 19 nt, Yersinia pestis
caagcuacaugugcauuga

SEQ ID NO: 4163755 - RNA, 15 nt, Yersinia pestis
caagcuacggccugu

SEQ ID NO: 4163756 - RNA, 20 nt, Yersinia pestis
caagcucgccaucgcaccaa

SEQ ID NO: 4163757 - RNA, 14 nt, Yersinia pestis
caagcugcauguac

SEQ ID NO: 4163758 - RNA, 21 nt, Yersinia pestis
caagcuucaauuugacgcugu

SEQ ID NO: 4163759 - RNA, 16 nt, Yersinia pestis
caagcuuggccccuua

SEQ ID NO: 4163760 - RNA, 19 nt, Yersinia pestis
caagcuuuugccacauuuc

SEQ ID NO: 4163761 - RNA, 22 nt, Yersinia pestis
caagcuuuugccacauuucccu

SEQ ID NO: 4163762 - RNA, 18 nt, Yersinia pestis
caaggaaaaggcagagag

SEQ ID NO: 4163763 - RNA, 16 nt, Yersinia pestis
caaggacuucaucacc

SEQ ID NO: 4163764 - RNA, 18 nt, Yersinia pestis
caaggagaucgcucucac

SEQ ID NO: 4163765 - RNA, 21 nt, Yersinia pestis
caaggagaucgcucucacccu

SEQ ID NO: 4163766 - RNA, 21 nt, Yersinia pestis
caaggauaagcaguucuggcu

SEQ ID NO: 4163767 - RNA, 19 nt, Yersinia pestis
caaggcagcaagcaaacga

SEQ ID NO: 4163768 - RNA, 14 nt, Yersinia pestis
caaggccuuguggc

SEQ ID NO: 4163769 - RNA, 20 nt, Yersinia pestis
caaggcgacuuugaugccaa

SEQ ID NO: 4163770 - RNA, 17 nt, Yersinia pestis
caaggcggaauagagga

SEQ ID NO: 4163771 - RNA, 16 nt, Yersinia pestis
caaggcggcagagcca

SEQ ID NO: 4163772 - RNA, 12 nt, Yersinia pestis
caaggcuaaccg

SEQ ID NO: 4163773 - RNA, 19 nt, Yersinia pestis
caaggcucuggcaauggcu

SEQ ID NO: 4163774 - RNA, 13 nt, Yersinia pestis
caaggcuuucugg

SEQ ID NO: 4163775 - RNA, 18 nt, Yersinia pestis
caaggggagccacacacu

SEQ ID NO: 4163776 - RNA, 20 nt, Yersinia pestis
caaggggcgagccacgauca

SEQ ID NO: 4163777 - RNA, 17 nt, Yersinia pestis
caaggguauaacucauc

SEQ ID NO: 4163778 - RNA, 17 nt, Yersinia pestis
caagggucaucaacaaa

SEQ ID NO: 4163779 - RNA, 20 nt, Yersinia pestis
caaggucgccauauuauugu

SEQ ID NO: 4163780 - RNA, 16 nt, Yersinia pestis
caaggucgccucuggg

SEQ ID NO: 4163781 - RNA, 18 nt, Yersinia pestis
caaggucuuucgcccaca

SEQ ID NO: 4163782 - RNA, 20 nt, Yersinia pestis
caaggugccauaaauaccaa

SEQ ID NO: 4163783 - RNA, 17 nt, Yersinia pestis
caaguaaaagucagcaa

SEQ ID NO: 4163784 - RNA, 19 nt, Yersinia pestis
caaguaaaagucagcaaau

SEQ ID NO: 4163785 - RNA, 13 nt, Yersinia pestis
caaguacacugca

SEQ ID NO: 4163786 - RNA, 14 nt, Yersinia pestis
caaguaugcagggu

SEQ ID NO: 4163787 - RNA, 16 nt, Yersinia pestis
caagucagggaucacc

SEQ ID NO: 4163788 - RNA, 15 nt, Yersinia pestis
caagucaugguacaa

SEQ ID NO: 4163789 - RNA, 16 nt, Yersinia pestis
caagucccgccccggg

SEQ ID NO: 4163790 - RNA, 15 nt, Yersinia pestis
caagucuugaagagu

SEQ ID NO: 4163791 - RNA, 14 nt, Yersinia pestis
caagugaacgaggc

SEQ ID NO: 4163792 - RNA, 12 nt, Yersinia pestis
caagugcuucaa

SEQ ID NO: 4163793 - RNA, 15 nt, Yersinia pestis
caaguguaaaagaua

SEQ ID NO: 4163794 - RNA, 22 nt, Yersinia pestis
caaguguuaguuuuaauaacuu

SEQ ID NO: 4163795 - RNA, 23 nt, Yersinia pestis
caaguuaaauacugcacguuuaa

SEQ ID NO: 4163796 - RNA, 18 nt, Yersinia pestis
caaguucugccccugacu

SEQ ID NO: 4163797 - RNA, 19 nt, Yersinia pestis
caaguuugcagucgcuuca

SEQ ID NO: 4163798 - RNA, 15 nt, Yersinia pestis
caauaaaauuaccca

SEQ ID NO: 4163799 - RNA, 21 nt, Yersinia pestis
caauaaaauuacccagcaucu

SEQ ID NO: 4163800 - RNA, 19 nt, Yersinia pestis
caauaaacagacuaaaaac

SEQ ID NO: 4163801 - RNA, 20 nt, Yersinia pestis
caauaaacagacuaaaaacc

SEQ ID NO: 4163802 - RNA, 22 nt, Yersinia pestis
caauaaagccauuucaguaacu

SEQ ID NO: 4163803 - RNA, 19 nt, Yersinia pestis
caauaaagcgauaaauacu

SEQ ID NO: 4163804 - RNA, 18 nt, Yersinia pestis
caauaaaggcaagauuuc

SEQ ID NO: 4163805 - RNA, 14 nt, Yersinia pestis
caauaaaucgccac

SEQ ID NO: 4163806 - RNA, 22 nt, Yersinia pestis
caauaaauucauuagcucaaau

SEQ ID NO: 4163807 - RNA, 16 nt, Yersinia pestis
caauaacaaacacauc

SEQ ID NO: 4163808 - RNA, 23 nt, Yersinia pestis
caauaaccucacacgauuuuuac

SEQ ID NO: 4163809 - RNA, 15 nt, Yersinia pestis
caauaaccucagggc

SEQ ID NO: 4163810 - RNA, 21 nt, Yersinia pestis
caauaaccucaggggccaaca

SEQ ID NO: 4163811 - RNA, 16 nt, Yersinia pestis
caauaacguguuuauc

SEQ ID NO: 4163812 - RNA, 16 nt, Yersinia pestis
caauaacuauuuuuga

SEQ ID NO: 4163813 - RNA, 17 nt, Yersinia pestis
caauaaggugccacaca

SEQ ID NO: 4163814 - RNA, 22 nt, Yersinia pestis
caauaagugcaaacuuaaaaau

SEQ ID NO: 4163815 - RNA, 24 nt, Yersinia pestis
caauaagugcaaacuuaaaaauca

SEQ ID NO: 4163816 - RNA, 17 nt, Yersinia pestis
caauaauaaaaaaaaau

SEQ ID NO: 4163817 - RNA, 20 nt, Yersinia pestis
caauaauaaaaaaaaauaaa

SEQ ID NO: 4163818 - RNA, 13 nt, Yersinia pestis
caauaauaagccg

SEQ ID NO: 4163819 - RNA, 14 nt, Yersinia pestis
caauaauaagccgc

SEQ ID NO: 4163820 - RNA, 15 nt, Yersinia pestis
caauaauaagccgca

SEQ ID NO: 4163821 - RNA, 18 nt, Yersinia pestis
caauaauuaauuucacug

SEQ ID NO: 4163822 - RNA, 13 nt, Yersinia pestis
caauaauucagau

SEQ ID NO: 4163823 - RNA, 14 nt, Yersinia pestis
caauacaauuauuu

SEQ ID NO: 4163824 - RNA, 13 nt, Yersinia pestis
caauacauagaag

SEQ ID NO: 4163825 - RNA, 14 nt, Yersinia pestis
caauaccauuuugc

SEQ ID NO: 4163826 - RNA, 15 nt, Yersinia pestis
caauaccgccaauau

SEQ ID NO: 4163827 - RNA, 21 nt, Yersinia pestis
caauaccgccacacaauacau

SEQ ID NO: 4163828 - RNA, 18 nt, Yersinia pestis
caauaccuuacugcauca

SEQ ID NO: 4163829 - RNA, 18 nt, Yersinia pestis
caauaccuuacuguauca

SEQ ID NO: 4163830 - RNA, 16 nt, Yersinia pestis
caauacggauucagcg

SEQ ID NO: 4163831 - RNA, 22 nt, Yersinia pestis
caauacguugaauuaaaaaccc

SEQ ID NO: 4163832 - RNA, 14 nt, Yersinia pestis
caauacuacuuucu

SEQ ID NO: 4163833 - RNA, 18 nt, Yersinia pestis
caauacuguuaucacuga

SEQ ID NO: 4163834 - RNA, 16 nt, Yersinia pestis
caauagaaaaacacug

SEQ ID NO: 4163835 - RNA, 15 nt, Yersinia pestis
caauagacaaaagug

SEQ ID NO: 4163836 - RNA, 20 nt, Yersinia pestis
caauagccaagaucacauga

SEQ ID NO: 4163837 - RNA, 17 nt, Yersinia pestis
caauagccauggcuuua

SEQ ID NO: 4163838 - RNA, 16 nt, Yersinia pestis
caauaggcuauuuuac

SEQ ID NO: 4163839 - RNA, 15 nt, Yersinia pestis
caauaggucaguggu

SEQ ID NO: 4163840 - RNA, 14 nt, Yersinia pestis
caauaguguugcua

SEQ ID NO: 4163841 - RNA, 21 nt, Yersinia pestis
caauauaaagccauuggucaa

SEQ ID NO: 4163842 - RNA, 18 nt, Yersinia pestis
caauauaaggcuuuauau

SEQ ID NO: 4163843 - RNA, 23 nt, Yersinia pestis
caauauaccggggaagagauaaa

SEQ ID NO: 4163844 - RNA, 22 nt, Yersinia pestis
caauauauacccguaauauuuc

SEQ ID NO: 4163845 - RNA, 16 nt, Yersinia pestis
caauaucaaaacucca

SEQ ID NO: 4163846 - RNA, 19 nt, Yersinia pestis
caauaucaaaacuccauca

SEQ ID NO: 4163847 - RNA, 13 nt, Yersinia pestis
caauauccauauu

SEQ ID NO: 4163848 - RNA, 18 nt, Yersinia pestis
caauauccauauuaaaug

SEQ ID NO: 4163849 - RNA, 17 nt, Yersinia pestis
caauaucugccaauuca

SEQ ID NO: 4163850 - RNA, 15 nt, Yersinia pestis
caauaucuuugucug

SEQ ID NO: 4163851 - RNA, 14 nt, Yersinia pestis
caauaugaaauuuc

SEQ ID NO: 4163852 - RNA, 15 nt, Yersinia pestis
caauaugaaauuuca

SEQ ID NO: 4163853 - RNA, 17 nt, Yersinia pestis
caauaugaaauuucacu

SEQ ID NO: 4163854 - RNA, 18 nt, Yersinia pestis
caauaugaaauuucacug

SEQ ID NO: 4163855 - RNA, 20 nt, Yersinia pestis
caauaugaacuuguucaucu

SEQ ID NO: 4163856 - RNA, 20 nt, Yersinia pestis
caauauguuagcagcacaag

SEQ ID NO: 4163857 - RNA, 13 nt, Yersinia pestis
caauauuaccaau

SEQ ID NO: 4163858 - RNA, 15 nt, Yersinia pestis
caauauucgcagcca

SEQ ID NO: 4163859 - RNA, 22 nt, Yersinia pestis
caauauugcauaaaugacgagc

SEQ ID NO: 4163860 - RNA, 22 nt, Yersinia pestis
caauauugccuucacccaggcu

SEQ ID NO: 4163861 - RNA, 14 nt, Yersinia pestis
caauauuggauaau

SEQ ID NO: 4163862 - RNA, 18 nt, Yersinia pestis
caauauuggauaauaacc

SEQ ID NO: 4163863 - RNA, 16 nt, Yersinia pestis
caaucaaaaaauaaau

SEQ ID NO: 4163864 - RNA, 18 nt, Yersinia pestis
caaucaaaagggaucacc

SEQ ID NO: 4163865 - RNA, 20 nt, Yersinia pestis
caaucaaaagggaucaccag

SEQ ID NO: 4163866 - RNA, 14 nt, Yersinia pestis
caaucaacauaaau

SEQ ID NO: 4163867 - RNA, 17 nt, Yersinia pestis
caaucaagcaauaauug

SEQ ID NO: 4163868 - RNA, 23 nt, Yersinia pestis
caaucaaucaccauaacugcugc

SEQ ID NO: 4163869 - RNA, 13 nt, Yersinia pestis
caaucaaugaacc

SEQ ID NO: 4163870 - RNA, 17 nt, Yersinia pestis
caaucaauugcccccau

SEQ ID NO: 4163871 - RNA, 14 nt, Yersinia pestis
caaucacaucaccg

SEQ ID NO: 4163872 - RNA, 15 nt, Yersinia pestis
caaucacauccccug

SEQ ID NO: 4163873 - RNA, 11 nt, Yersinia pestis
caaucacugcg

SEQ ID NO: 4163874 - RNA, 17 nt, Yersinia pestis
caaucacuuuauacgcu

SEQ ID NO: 4163875 - RNA, 19 nt, Yersinia pestis
caaucacuuuauacgcuuu

SEQ ID NO: 4163876 - RNA, 15 nt, Yersinia pestis
caaucaggaaauuac

SEQ ID NO: 4163877 - RNA, 21 nt, Yersinia pestis
caaucauagccaucccaauaa

SEQ ID NO: 4163878 - RNA, 12 nt, Yersinia pestis
caaucaucaucc

SEQ ID NO: 4163879 - RNA, 23 nt, Yersinia pestis
caaucaucaucccagucgucuuc

SEQ ID NO: 4163880 - RNA, 16 nt, Yersinia pestis
caaucaucguggcuuu

SEQ ID NO: 4163881 - RNA, 19 nt, Yersinia pestis
caaucaugggccaauccaa

SEQ ID NO: 4163882 - RNA, 18 nt, Yersinia pestis
caaucauuacaucaucuu

SEQ ID NO: 4163883 - RNA, 19 nt, Yersinia pestis
caaucauuacaucaucuuc

SEQ ID NO: 4163884 - RNA, 18 nt, Yersinia pestis
caaucauucugucaucaa

SEQ ID NO: 4163885 - RNA, 15 nt, Yersinia pestis
caaucauuuuuuuau

SEQ ID NO: 4163886 - RNA, 13 nt, Yersinia pestis
caauccaaaugac

SEQ ID NO: 4163887 - RNA, 20 nt, Yersinia pestis
caauccaaccuauauagccc

SEQ ID NO: 4163888 - RNA, 16 nt, Yersinia pestis
caauccaauuuaccac

SEQ ID NO: 4163889 - RNA, 19 nt, Yersinia pestis
caauccagcgccuguucca

SEQ ID NO: 4163890 - RNA, 15 nt, Yersinia pestis
caauccauccgguuu

SEQ ID NO: 4163891 - RNA, 16 nt, Yersinia pestis
caaucccaaagcuuau

SEQ ID NO: 4163892 - RNA, 14 nt, Yersinia pestis
caauccgaacaaaa

SEQ ID NO: 4163893 - RNA, 15 nt, Yersinia pestis
caauccgaacaaaau

SEQ ID NO: 4163894 - RNA, 17 nt, Yersinia pestis
caauccggcacaggcuc

SEQ ID NO: 4163895 - RNA, 14 nt, Yersinia pestis
caaucgauuccugu

SEQ ID NO: 4163896 - RNA, 21 nt, Yersinia pestis
caaucgcuuccaggacaucca

SEQ ID NO: 4163897 - RNA, 22 nt, Yersinia pestis
caaucggaaaucggugauauuc

SEQ ID NO: 4163898 - RNA, 15 nt, Yersinia pestis
caaucggauaaccgc

SEQ ID NO: 4163899 - RNA, 17 nt, Yersinia pestis
caaucggcagauuggau

SEQ ID NO: 4163900 - RNA, 17 nt, Yersinia pestis
caaucgggaaaacaggc

SEQ ID NO: 4163901 - RNA, 18 nt, Yersinia pestis
caaucgucuucggucaua

SEQ ID NO: 4163902 - RNA, 15 nt, Yersinia pestis
caaucuagaacuauu

SEQ ID NO: 4163903 - RNA, 12 nt, Yersinia pestis
caaucucaucaa

SEQ ID NO: 4163904 - RNA, 19 nt, Yersinia pestis
caaucuccaaugaccccgc

SEQ ID NO: 4163905 - RNA, 16 nt, Yersinia pestis
caaucuccaguaaauc

SEQ ID NO: 4163906 - RNA, 21 nt, Yersinia pestis
caaucuccccguuuaggauug

SEQ ID NO: 4163907 - RNA, 20 nt, Yersinia pestis
caaucucguuaucagccaca

SEQ ID NO: 4163908 - RNA, 22 nt, Yersinia pestis
caaucucugggugcugcucccg

SEQ ID NO: 4163909 - RNA, 18 nt, Yersinia pestis
caaucucuugauagguuu

SEQ ID NO: 4163910 - RNA, 18 nt, Yersinia pestis
caaucuguuccugauucc

SEQ ID NO: 4163911 - RNA, 21 nt, Yersinia pestis
caaucuguuccugauuccaaa

SEQ ID NO: 4163912 - RNA, 19 nt, Yersinia pestis
caaucuuauugaaaacaag

SEQ ID NO: 4163913 - RNA, 15 nt, Yersinia pestis
caaucuucuucaguc

SEQ ID NO: 4163914 - RNA, 21 nt, Yersinia pestis
caaugaaauauggugauaacu

SEQ ID NO: 4163915 - RNA, 13 nt, Yersinia pestis
caaugaauaccca

SEQ ID NO: 4163916 - RNA, 23 nt, Yersinia pestis
caaugaaucaacagaugaugauu

SEQ ID NO: 4163917 - RNA, 18 nt, Yersinia pestis
caaugaauccggauccag

SEQ ID NO: 4163918 - RNA, 13 nt, Yersinia pestis
caaugaaugccgg

SEQ ID NO: 4163919 - RNA, 16 nt, Yersinia pestis
caaugaccaucuucca

SEQ ID NO: 4163920 - RNA, 20 nt, Yersinia pestis
caaugaccuuacagugauaa

SEQ ID NO: 4163921 - RNA, 19 nt, Yersinia pestis
caaugacuccugaaauaaa

SEQ ID NO: 4163922 - RNA, 20 nt, Yersinia pestis
caaugacuccugaaauaaag

SEQ ID NO: 4163923 - RNA, 21 nt, Yersinia pestis
caaugacuccugaaauaaaga

SEQ ID NO: 4163924 - RNA, 16 nt, Yersinia pestis
caaugacuuaacugaa

SEQ ID NO: 4163925 - RNA, 19 nt, Yersinia pestis
caaugacuuaacugaaagc

SEQ ID NO: 4163926 - RNA, 16 nt, Yersinia pestis
caaugagacaagagca

SEQ ID NO: 4163927 - RNA, 15 nt, Yersinia pestis
caaugauaaaauccu

SEQ ID NO: 4163928 - RNA, 16 nt, Yersinia pestis
caaugauaaaauccug

SEQ ID NO: 4163929 - RNA, 16 nt, Yersinia pestis
caaugauuuuuuucau

SEQ ID NO: 4163930 - RNA, 13 nt, Yersinia pestis
caaugcaaauauc

SEQ ID NO: 4163931 - RNA, 21 nt, Yersinia pestis
caaugccaagaauaauuacug

SEQ ID NO: 4163932 - RNA, 22 nt, Yersinia pestis
caaugccgcgaaggugugcuca

SEQ ID NO: 4163933 - RNA, 19 nt, Yersinia pestis
caaugcuccagcaacugaa

SEQ ID NO: 4163934 - RNA, 13 nt, Yersinia pestis
caaugcuuauuuc

SEQ ID NO: 4163935 - RNA, 15 nt, Yersinia pestis
caauggaaaauacac

SEQ ID NO: 4163936 - RNA, 15 nt, Yersinia pestis
caauggcaaaacaga

SEQ ID NO: 4163937 - RNA, 14 nt, Yersinia pestis
caauggcaccgugc

SEQ ID NO: 4163938 - RNA, 17 nt, Yersinia pestis
caauggccuuagcacgu

SEQ ID NO: 4163939 - RNA, 21 nt, Yersinia pestis
caauggcgaugagaaugccga

SEQ ID NO: 4163940 - RNA, 22 nt, Yersinia pestis
caauggcuaauuagaugagugg

SEQ ID NO: 4163941 - RNA, 19 nt, Yersinia pestis
caauggcugcauuggccga

SEQ ID NO: 4163942 - RNA, 21 nt, Yersinia pestis
caaugggucauugcgugcaau

SEQ ID NO: 4163943 - RNA, 16 nt, Yersinia pestis
caauggucaugcacag

SEQ ID NO: 4163944 - RNA, 18 nt, Yersinia pestis
caauggugauaaaccuca

SEQ ID NO: 4163945 - RNA, 17 nt, Yersinia pestis
caaugguucaucauuuu

SEQ ID NO: 4163946 - RNA, 22 nt, Yersinia pestis
caauguagacuuggcuuuuucu

SEQ ID NO: 4163947 - RNA, 13 nt, Yersinia pestis
caaugucaccuga

SEQ ID NO: 4163948 - RNA, 16 nt, Yersinia pestis
caaugucaugcaauua

SEQ ID NO: 4163949 - RNA, 14 nt, Yersinia pestis
caaugugagaaucu

SEQ ID NO: 4163950 - RNA, 21 nt, Yersinia pestis
caaugugauaccuaaaccuuc

SEQ ID NO: 4163951 - RNA, 21 nt, Yersinia pestis
caaugugcggaaauaaacauc

SEQ ID NO: 4163952 - RNA, 18 nt, Yersinia pestis
caauguguugaauaucca

SEQ ID NO: 4163953 - RNA, 22 nt, Yersinia pestis
caauguguugaauauccaaugg

SEQ ID NO: 4163954 - RNA, 23 nt, Yersinia pestis
caauguguugaauauccaauggu

SEQ ID NO: 4163955 - RNA, 15 nt, Yersinia pestis
caauguucucugggu

SEQ ID NO: 4163956 - RNA, 18 nt, Yersinia pestis
caauguugcugaauaaau

SEQ ID NO: 4163957 - RNA, 19 nt, Yersinia pestis
caauguugcugaauaaaua

SEQ ID NO: 4163958 - RNA, 12 nt, Yersinia pestis
caauuaaaaacg

SEQ ID NO: 4163959 - RNA, 12 nt, Yersinia pestis
caauuaacacuu

SEQ ID NO: 4163960 - RNA, 14 nt, Yersinia pestis
caauuacugcauug

SEQ ID NO: 4163961 - RNA, 22 nt, Yersinia pestis
caauuaggggaagguaaaaaag

SEQ ID NO: 4163962 - RNA, 23 nt, Yersinia pestis
caauuaggggaagguaaaaaaga

SEQ ID NO: 4163963 - RNA, 13 nt, Yersinia pestis
caauuagucacua

SEQ ID NO: 4163964 - RNA, 19 nt, Yersinia pestis
caauuaugacguucaguag

SEQ ID NO: 4163965 - RNA, 12 nt, Yersinia pestis
caauucaaugcu

SEQ ID NO: 4163966 - RNA, 14 nt, Yersinia pestis
caauucacccauac

SEQ ID NO: 4163967 - RNA, 18 nt, Yersinia pestis
caauucacgcaaggccag

SEQ ID NO: 4163968 - RNA, 15 nt, Yersinia pestis
caauucacucauaau

SEQ ID NO: 4163969 - RNA, 17 nt, Yersinia pestis
caauucagaagacaaua

SEQ ID NO: 4163970 - RNA, 16 nt, Yersinia pestis
caauucaucacguuua

SEQ ID NO: 4163971 - RNA, 19 nt, Yersinia pestis
caauucaucagcgcuggcu

SEQ ID NO: 4163972 - RNA, 18 nt, Yersinia pestis
caauucgaccguuuuuac

SEQ ID NO: 4163973 - RNA, 15 nt, Yersinia pestis
caauucgcaagaagc

SEQ ID NO: 4163974 - RNA, 15 nt, Yersinia pestis
caauucucccauuua

SEQ ID NO: 4163975 - RNA, 20 nt, Yersinia pestis
caauugaguaacugauuaau

SEQ ID NO: 4163976 - RNA, 20 nt, Yersinia pestis
caauugaguaguaaaaccua

SEQ ID NO: 4163977 - RNA, 13 nt, Yersinia pestis
caauugaucaggg

SEQ ID NO: 4163978 - RNA, 19 nt, Yersinia pestis
caauugaugucaugauaaa

SEQ ID NO: 4163979 - RNA, 12 nt, Yersinia pestis
caauugcaccgc

SEQ ID NO: 4163980 - RNA, 20 nt, Yersinia pestis
caauugcagacgacggaacc

SEQ ID NO: 4163981 - RNA, 16 nt, Yersinia pestis
caauugcggucagcau

SEQ ID NO: 4163982 - RNA, 12 nt, Yersinia pestis
caauugcuggcu

SEQ ID NO: 4163983 - RNA, 17 nt, Yersinia pestis
caauuggucaugaugaa

SEQ ID NO: 4163984 - RNA, 18 nt, Yersinia pestis
caauuuaccacuauccaa

SEQ ID NO: 4163985 - RNA, 17 nt, Yersinia pestis
caauuuacgguccauaa

SEQ ID NO: 4163986 - RNA, 18 nt, Yersinia pestis
caauuuacgguccauaaa

SEQ ID NO: 4163987 - RNA, 22 nt, Yersinia pestis
caauuuagacaugggcagugca

SEQ ID NO: 4163988 - RNA, 21 nt, Yersinia pestis
caauuuaucagacaaucugug

SEQ ID NO: 4163989 - RNA, 20 nt, Yersinia pestis
caauuucaccccgacauuca

SEQ ID NO: 4163990 - RNA, 21 nt, Yersinia pestis
caauuucaugcgaauacuuug

SEQ ID NO: 4163991 - RNA, 14 nt, Yersinia pestis
caauuucauuuacg

SEQ ID NO: 4163992 - RNA, 20 nt, Yersinia pestis
caauuuccccugcuucguag

SEQ ID NO: 4163993 - RNA, 15 nt, Yersinia pestis
caauuugcccaucuu

SEQ ID NO: 4163994 - RNA, 21 nt, Yersinia pestis
caauuugccgccuuccucaau

SEQ ID NO: 4163995 - RNA, 12 nt, Yersinia pestis
caauuuggccaa

SEQ ID NO: 4163996 - RNA, 20 nt, Yersinia pestis
caauuugucauguugaccaa

SEQ ID NO: 4163997 - RNA, 14 nt, Yersinia pestis
caauuuuauggaua

SEQ ID NO: 4163998 - RNA, 16 nt, Yersinia pestis
caauuuuugcagugca

SEQ ID NO: 4163999 - RNA, 22 nt, Yersinia pestis
caauuuuugccuuucugggcug

SEQ ID NO: 4164000 - RNA, 20 nt, Yersinia pestis
caauuuuuugguguccccac

SEQ ID NO: 4164001 - RNA, 22 nt, Yersinia pestis
cacaaaaaagaaauuuuuagaa

SEQ ID NO: 4164002 - RNA, 23 nt, Yersinia pestis
cacaaacucaugcucuucauaag

SEQ ID NO: 4164003 - RNA, 18 nt, Yersinia pestis
cacaaacuugagucagca

SEQ ID NO: 4164004 - RNA, 20 nt, Yersinia pestis
cacaaaguagguuaagaccc

SEQ ID NO: 4164005 - RNA, 15 nt, Yersinia pestis
cacaacccgauccag

SEQ ID NO: 4164006 - RNA, 16 nt, Yersinia pestis
cacaacccgcugaugc

SEQ ID NO: 4164007 - RNA, 18 nt, Yersinia pestis
cacaacgcaucaguaaug

SEQ ID NO: 4164008 - RNA, 19 nt, Yersinia pestis
cacaacgcaucaguaaugu

SEQ ID NO: 4164009 - RNA, 16 nt, Yersinia pestis
cacaacgcauuacccc

SEQ ID NO: 4164010 - RNA, 20 nt, Yersinia pestis
cacaacggaaggcccagccg

SEQ ID NO: 4164011 - RNA, 12 nt, Yersinia pestis
cacaacugcgau

SEQ ID NO: 4164012 - RNA, 19 nt, Yersinia pestis
cacaacuuuuauuggcauu

SEQ ID NO: 4164013 - RNA, 13 nt, Yersinia pestis
cacaagauaaaua

SEQ ID NO: 4164014 - RNA, 12 nt, Yersinia pestis
cacaauaagccc

SEQ ID NO: 4164015 - RNA, 17 nt, Yersinia pestis
cacaauacauagaagcu

SEQ ID NO: 4164016 - RNA, 23 nt, Yersinia pestis
cacaauagcuaccccuucaguca

SEQ ID NO: 4164017 - RNA, 17 nt, Yersinia pestis
cacaauaggcuauuuua

SEQ ID NO: 4164018 - RNA, 15 nt, Yersinia pestis
cacaaucaguaaaua

SEQ ID NO: 4164019 - RNA, 19 nt, Yersinia pestis
cacaauccaauuuaccacu

SEQ ID NO: 4164020 - RNA, 21 nt, Yersinia pestis
cacaaucucguuaucagccac

SEQ ID NO: 4164021 - RNA, 23 nt, Yersinia pestis
cacaaucuugcagcgaucacaga

SEQ ID NO: 4164022 - RNA, 13 nt, Yersinia pestis
cacaauguugaua

SEQ ID NO: 4164023 - RNA, 23 nt, Yersinia pestis
cacaauuagcugaucgggcuuua

SEQ ID NO: 4164024 - RNA, 16 nt, Yersinia pestis
cacaauuucaccccga

SEQ ID NO: 4164025 - RNA, 23 nt, Yersinia pestis
cacaauuugguagaacugcggca

SEQ ID NO: 4164026 - RNA, 18 nt, Yersinia pestis
cacacacaaagcccaaaa

SEQ ID NO: 4164027 - RNA, 12 nt, Yersinia pestis
cacacacuaaua

SEQ ID NO: 4164028 - RNA, 23 nt, Yersinia pestis
cacacacuaauaauaauuaaucu

SEQ ID NO: 4164029 - RNA, 14 nt, Yersinia pestis
cacacagaaucacc

SEQ ID NO: 4164030 - RNA, 17 nt, Yersinia pestis
cacacagaaucaccaac

SEQ ID NO: 4164031 - RNA, 18 nt, Yersinia pestis
cacacagaaucaccaaca

SEQ ID NO: 4164032 - RNA, 15 nt, Yersinia pestis
cacacaguauucugc

SEQ ID NO: 4164033 - RNA, 12 nt, Yersinia pestis
cacacauaccac

SEQ ID NO: 4164034 - RNA, 15 nt, Yersinia pestis
cacacauaccacaca

SEQ ID NO: 4164035 - RNA, 20 nt, Yersinia pestis
cacacauaccacacacaaag

SEQ ID NO: 4164036 - RNA, 20 nt, Yersinia pestis
cacaccaucaguacgguuca

SEQ ID NO: 4164037 - RNA, 16 nt, Yersinia pestis
cacacccgccaaacca

SEQ ID NO: 4164038 - RNA, 17 nt, Yersinia pestis
cacacccucaacucaaa

SEQ ID NO: 4164039 - RNA, 13 nt, Yersinia pestis
cacaccggcugca

SEQ ID NO: 4164040 - RNA, 22 nt, Yersinia pestis
cacacguguacucauauugucc

SEQ ID NO: 4164041 - RNA, 13 nt, Yersinia pestis
cacacucaguaca

SEQ ID NO: 4164042 - RNA, 17 nt, Yersinia pestis
cacacugagcaccgcag

SEQ ID NO: 4164043 - RNA, 17 nt, Yersinia pestis
cacacuggguaaggcaa

SEQ ID NO: 4164044 - RNA, 14 nt, Yersinia pestis
cacacugguugaaa

SEQ ID NO: 4164045 - RNA, 15 nt, Yersinia pestis
cacacugucaucacu

SEQ ID NO: 4164046 - RNA, 16 nt, Yersinia pestis
cacacugucaucacug

SEQ ID NO: 4164047 - RNA, 19 nt, Yersinia pestis
cacagaaacgauuacccac

SEQ ID NO: 4164048 - RNA, 13 nt, Yersinia pestis
cacagaaucacca

SEQ ID NO: 4164049 - RNA, 23 nt, Yersinia pestis
cacagagcgggaacgccaaguau

SEQ ID NO: 4164050 - RNA, 13 nt, Yersinia pestis
cacagauaaacaa

SEQ ID NO: 4164051 - RNA, 14 nt, Yersinia pestis
cacagauaaauaaa

SEQ ID NO: 4164052 - RNA, 14 nt, Yersinia pestis
cacagaugcuggcu

SEQ ID NO: 4164053 - RNA, 17 nt, Yersinia pestis
cacagcacgguaaccuu

SEQ ID NO: 4164054 - RNA, 17 nt, Yersinia pestis
cacagcagaacaaaaca

SEQ ID NO: 4164055 - RNA, 14 nt, Yersinia pestis
cacagcagacagcg

SEQ ID NO: 4164056 - RNA, 16 nt, Yersinia pestis
cacagccuacgggguc

SEQ ID NO: 4164057 - RNA, 20 nt, Yersinia pestis
cacagccugccgggaugacu

SEQ ID NO: 4164058 - RNA, 17 nt, Yersinia pestis
cacagcggcggauaaau

SEQ ID NO: 4164059 - RNA, 20 nt, Yersinia pestis
cacaggcuucgacaggcaau

SEQ ID NO: 4164060 - RNA, 17 nt, Yersinia pestis
cacaggcuuucaggacu

SEQ ID NO: 4164061 - RNA, 18 nt, Yersinia pestis
cacaggggcgaugucacc

SEQ ID NO: 4164062 - RNA, 14 nt, Yersinia pestis
cacaguacaaaaaa

SEQ ID NO: 4164063 - RNA, 19 nt, Yersinia pestis
cacagucgcacugauagca

SEQ ID NO: 4164064 - RNA, 19 nt, Yersinia pestis
cacaguuuucuuaaaauac

SEQ ID NO: 4164065 - RNA, 19 nt, Yersinia pestis
cacauaaaaagaaaaaaac

SEQ ID NO: 4164066 - RNA, 15 nt, Yersinia pestis
cacauaaccaucaaa

SEQ ID NO: 4164067 - RNA, 17 nt, Yersinia pestis
cacauagcgucagguag

SEQ ID NO: 4164068 - RNA, 14 nt, Yersinia pestis
cacaucaaccugau

SEQ ID NO: 4164069 - RNA, 21 nt, Yersinia pestis
cacaucaaccugaucaucaaa

SEQ ID NO: 4164070 - RNA, 14 nt, Yersinia pestis
cacaucaauauaaa

SEQ ID NO: 4164071 - RNA, 11 nt, Yersinia pestis
cacaucacagu

SEQ ID NO: 4164072 - RNA, 17 nt, Yersinia pestis
cacaucacagugccaaa

SEQ ID NO: 4164073 - RNA, 19 nt, Yersinia pestis
cacaucacgcuuaagacgu

SEQ ID NO: 4164074 - RNA, 13 nt, Yersinia pestis
cacaucauccacu

SEQ ID NO: 4164075 - RNA, 18 nt, Yersinia pestis
cacaucgcccugcucuuc

SEQ ID NO: 4164076 - RNA, 15 nt, Yersinia pestis
cacaugcagcauuuc

SEQ ID NO: 4164077 - RNA, 19 nt, Yersinia pestis
cacaugguuucaaugagca

SEQ ID NO: 4164078 - RNA, 21 nt, Yersinia pestis
cacaugguuucaaugagcaua

SEQ ID NO: 4164079 - RNA, 22 nt, Yersinia pestis
cacauuacaagugccaaaugga

SEQ ID NO: 4164080 - RNA, 18 nt, Yersinia pestis
cacauuacccggccaacc

SEQ ID NO: 4164081 - RNA, 17 nt, Yersinia pestis
cacauucaguacauaaa

SEQ ID NO: 4164082 - RNA, 14 nt, Yersinia pestis
cacauucagucacu

SEQ ID NO: 4164083 - RNA, 19 nt, Yersinia pestis
cacauuccaguaaaaaaau

SEQ ID NO: 4164084 - RNA, 23 nt, Yersinia pestis
cacauuucaaauuaucgaucaca

SEQ ID NO: 4164085 - RNA, 17 nt, Yersinia pestis
cacauuugaaaugcauu

SEQ ID NO: 4164086 - RNA, 15 nt, Yersinia pestis
caccaaaaugacaau

SEQ ID NO: 4164087 - RNA, 16 nt, Yersinia pestis
caccaaagcaaugaau

SEQ ID NO: 4164088 - RNA, 17 nt, Yersinia pestis
caccaaaggaagccgag

SEQ ID NO: 4164089 - RNA, 13 nt, Yersinia pestis
caccaacccgccc

SEQ ID NO: 4164090 - RNA, 16 nt, Yersinia pestis
caccaacggccccuca

SEQ ID NO: 4164091 - RNA, 23 nt, Yersinia pestis
caccaacggcccggcuaaaccaa

SEQ ID NO: 4164092 - RNA, 14 nt, Yersinia pestis
caccaacuccugcc

SEQ ID NO: 4164093 - RNA, 15 nt, Yersinia pestis
caccaacuccugccu

SEQ ID NO: 4164094 - RNA, 21 nt, Yersinia pestis
caccaauacaaacagggcagc

SEQ ID NO: 4164095 - RNA, 21 nt, Yersinia pestis
caccaauagcgaucagcaacg

SEQ ID NO: 4164096 - RNA, 15 nt, Yersinia pestis
caccaauaucaauau

SEQ ID NO: 4164097 - RNA, 19 nt, Yersinia pestis
caccaaucauuacaucauc

SEQ ID NO: 4164098 - RNA, 16 nt, Yersinia pestis
caccaaugaaugcagg

SEQ ID NO: 4164099 - RNA, 17 nt, Yersinia pestis
caccaaugcauccaagc

SEQ ID NO: 4164100 - RNA, 12 nt, Yersinia pestis
caccaaugccgg

SEQ ID NO: 4164101 - RNA, 16 nt, Yersinia pestis
caccaauuucaucgcu

SEQ ID NO: 4164102 - RNA, 22 nt, Yersinia pestis
caccacaccggcugcaauaagc

SEQ ID NO: 4164103 - RNA, 17 nt, Yersinia pestis
caccacacugagcaccg

SEQ ID NO: 4164104 - RNA, 14 nt, Yersinia pestis
caccaccaacagca

SEQ ID NO: 4164105 - RNA, 14 nt, Yersinia pestis
caccaccacaaaca

SEQ ID NO: 4164106 - RNA, 13 nt, Yersinia pestis
caccaccacaccg

SEQ ID NO: 4164107 - RNA, 15 nt, Yersinia pestis
caccaccaccaggcg

SEQ ID NO: 4164108 - RNA, 14 nt, Yersinia pestis
caccaccaggcggc

SEQ ID NO: 4164109 - RNA, 16 nt, Yersinia pestis
caccaccgacaccacg

SEQ ID NO: 4164110 - RNA, 13 nt, Yersinia pestis
caccaccuccaca

SEQ ID NO: 4164111 - RNA, 18 nt, Yersinia pestis
caccacgaaaaaauggca

SEQ ID NO: 4164112 - RNA, 18 nt, Yersinia pestis
caccacgccaauuaccgu

SEQ ID NO: 4164113 - RNA, 12 nt, Yersinia pestis
caccacggucag

SEQ ID NO: 4164114 - RNA, 18 nt, Yersinia pestis
caccacuaguuaaaacca

SEQ ID NO: 4164115 - RNA, 16 nt, Yersinia pestis
ggagugaugaaaccaa

SEQ ID NO: 4164116 - RNA, 14 nt, Yersinia pestis
ggaguugguggcac

SEQ ID NO: 4164117 - RNA, 18 nt, Yersinia pestis
ggaguuuuacugauaugg

SEQ ID NO: 4164118 - RNA, 19 nt, Yersinia pestis
ggaguuuugauauugcgug

SEQ ID NO: 4164119 - RNA, 13 nt, Yersinia pestis
ggaguuuuuauuu

SEQ ID NO: 4164120 - RNA, 13 nt, Yersinia pestis
ggauaaaaaugca

SEQ ID NO: 4164121 - RNA, 17 nt, Yersinia pestis
ggauaaauuaauaacgc

SEQ ID NO: 4164122 - RNA, 22 nt, Yersinia pestis
ggauaaauuaauaacgccgagu

SEQ ID NO: 4164123 - RNA, 19 nt, Yersinia pestis
ggauaaccgcauucccugc

SEQ ID NO: 4164124 - RNA, 19 nt, Yersinia pestis
ggauaacguuucagggugg

SEQ ID NO: 4164125 - RNA, 16 nt, Yersinia pestis
ggauaaggugaugaau

SEQ ID NO: 4164126 - RNA, 18 nt, Yersinia pestis
ggauaaguuccggcagau

SEQ ID NO: 4164127 - RNA, 17 nt, Yersinia pestis
ggauaaucuaggccugg

SEQ ID NO: 4164128 - RNA, 15 nt, Yersinia pestis
ggauaaugauauucc

SEQ ID NO: 4164129 - RNA, 13 nt, Yersinia pestis
ggauaauuucagc

SEQ ID NO: 4164130 - RNA, 15 nt, Yersinia pestis
ggauacuggugucuu

SEQ ID NO: 4164131 - RNA, 21 nt, Yersinia pestis
ggauaggcagaggaguaaagc

SEQ ID NO: 4164132 - RNA, 14 nt, Yersinia pestis
ggauaucucaccgc

SEQ ID NO: 4164133 - RNA, 20 nt, Yersinia pestis
ggauaugacuaaacugauca

SEQ ID NO: 4164134 - RNA, 20 nt, Yersinia pestis
ggauaugauguuacggguaa

SEQ ID NO: 4164135 - RNA, 18 nt, Yersinia pestis
ggauauucacguuuuucc

SEQ ID NO: 4164136 - RNA, 21 nt, Yersinia pestis
ggauauuuauuguuaucaaau

SEQ ID NO: 4164137 - RNA, 17 nt, Yersinia pestis
ggauauuuauuuauccu

SEQ ID NO: 4164138 - RNA, 11 nt, Yersinia pestis
ggauauuucgg

SEQ ID NO: 4164139 - RNA, 13 nt, Yersinia pestis
ggaucaacauggu

SEQ ID NO: 4164140 - RNA, 18 nt, Yersinia pestis
ggaucaacgcccgcggcc

SEQ ID NO: 4164141 - RNA, 17 nt, Yersinia pestis
ggaucaaguuagcaggc

SEQ ID NO: 4164142 - RNA, 17 nt, Yersinia pestis
ggaucaauuugauagau

SEQ ID NO: 4164143 - RNA, 22 nt, Yersinia pestis
ggaucacauagugcaaaauucc

SEQ ID NO: 4164144 - RNA, 20 nt, Yersinia pestis
ggaucaccagcaaaggccac

SEQ ID NO: 4164145 - RNA, 12 nt, Yersinia pestis
ggaucacgcugu

SEQ ID NO: 4164146 - RNA, 13 nt, Yersinia pestis
ggauccauaggau

SEQ ID NO: 4164147 - RNA, 14 nt, Yersinia pestis
ggauccauaggauc

SEQ ID NO: 4164148 - RNA, 16 nt, Yersinia pestis
ggauccuugggucagu

SEQ ID NO: 4164149 - RNA, 16 nt, Yersinia pestis
ggaucgggcugauaaa

SEQ ID NO: 4164150 - RNA, 19 nt, Yersinia pestis
ggaucuauucccugcaauu

SEQ ID NO: 4164151 - RNA, 17 nt, Yersinia pestis
ggaucucaggugugagg

SEQ ID NO: 4164152 - RNA, 14 nt, Yersinia pestis
ggaucucuucagca

SEQ ID NO: 4164153 - RNA, 15 nt, Yersinia pestis
ggaugaauaaaugac

SEQ ID NO: 4164154 - RNA, 17 nt, Yersinia pestis
ggaugaugcacagcugg

SEQ ID NO: 4164155 - RNA, 12 nt, Yersinia pestis
ggaugcccacac

SEQ ID NO: 4164156 - RNA, 19 nt, Yersinia pestis
ggaugccggaaucagccag

SEQ ID NO: 4164157 - RNA, 20 nt, Yersinia pestis
ggaugccggaaucagccaga

SEQ ID NO: 4164158 - RNA, 19 nt, Yersinia pestis
ggaugccuuguuucuggca

SEQ ID NO: 4164159 - RNA, 20 nt, Yersinia pestis
ggaugcgcucgcuugcugcc

SEQ ID NO: 4164160 - RNA, 14 nt, Yersinia pestis
ggauggcccaagcc

SEQ ID NO: 4164161 - RNA, 19 nt, Yersinia pestis
ggauggcccaagccauccu

SEQ ID NO: 4164162 - RNA, 15 nt, Yersinia pestis
ggauuaugugcggca

SEQ ID NO: 4164163 - RNA, 22 nt, Yersinia pestis
ggauucgugucaauauucuguu

SEQ ID NO: 4164164 - RNA, 14 nt, Yersinia pestis
ggauucuugcugca

SEQ ID NO: 4164165 - RNA, 15 nt, Yersinia pestis
ggauugccaaaugca

SEQ ID NO: 4164166 - RNA, 17 nt, Yersinia pestis
ggauugccaaaugcaaa

SEQ ID NO: 4164167 - RNA, 14 nt, Yersinia pestis
ggauuuaaaauccc

SEQ ID NO: 4164168 - RNA, 21 nt, Yersinia pestis
ggauuucaauccgaccacuga

SEQ ID NO: 4164169 - RNA, 11 nt, Yersinia pestis
ggcaaaaaaau

SEQ ID NO: 4164170 - RNA, 15 nt, Yersinia pestis
ggcaaagucaucaaa

SEQ ID NO: 4164171 - RNA, 17 nt, Yersinia pestis
ggcaaagucugguggug

SEQ ID NO: 4164172 - RNA, 19 nt, Yersinia pestis
ggcaaauagaggggcgcug

SEQ ID NO: 4164173 - RNA, 16 nt, Yersinia pestis
ggcaaauaggccgcau

SEQ ID NO: 4164174 - RNA, 23 nt, Yersinia pestis
ggcaaauugcgagcugagcuuau

SEQ ID NO: 4164175 - RNA, 21 nt, Yersinia pestis
ggcaacagcguaauaccacua

SEQ ID NO: 4164176 - RNA, 22 nt, Yersinia pestis
ggcaaccagcguucuaucaaug

SEQ ID NO: 4164177 - RNA, 16 nt, Yersinia pestis
ggcaaccaguuauagc

SEQ ID NO: 4164178 - RNA, 13 nt, Yersinia pestis
ggcaaccgaguaa

SEQ ID NO: 4164179 - RNA, 19 nt, Yersinia pestis
ggcaaccgguaacauauaa

SEQ ID NO: 4164180 - RNA, 15 nt, Yersinia pestis
ggcaacgacauguug

SEQ ID NO: 4164181 - RNA, 18 nt, Yersinia pestis
ggcaacgguaaaagguua

SEQ ID NO: 4164182 - RNA, 20 nt, Yersinia pestis
ggcaacucuagcgccagcaa

SEQ ID NO: 4164183 - RNA, 21 nt, Yersinia pestis
ggcaacucuagcgccagcaau

SEQ ID NO: 4164184 - RNA, 18 nt, Yersinia pestis
ggcaacuuuuuucauccu

SEQ ID NO: 4164185 - RNA, 13 nt, Yersinia pestis
ggcaagaaacuuc

SEQ ID NO: 4164186 - RNA, 22 nt, Yersinia pestis
ggcaagaacaccgucaguaugg

SEQ ID NO: 4164187 - RNA, 16 nt, Yersinia pestis
ggcaagcaagcaaagc

SEQ ID NO: 4164188 - RNA, 16 nt, Yersinia pestis
ggcaaggauggcgcgg

SEQ ID NO: 4164189 - RNA, 22 nt, Yersinia pestis
ggcaagguaaacggguuuuugu

SEQ ID NO: 4164190 - RNA, 15 nt, Yersinia pestis
ggcaauaaaggcaag

SEQ ID NO: 4164191 - RNA, 13 nt, Yersinia pestis
ggcaauaauucag

SEQ ID NO: 4164192 - RNA, 21 nt, Yersinia pestis
ggcaauaauucagaugagaau

SEQ ID NO: 4164193 - RNA, 20 nt, Yersinia pestis
ggcaauacaccgccaguaug

SEQ ID NO: 4164194 - RNA, 19 nt, Yersinia pestis
ggcaauauuggcgcacaac

SEQ ID NO: 4164195 - RNA, 14 nt, Yersinia pestis
ggcaauccagcgcc

SEQ ID NO: 4164196 - RNA, 17 nt, Yersinia pestis
ggcaaucuccaguaaau

SEQ ID NO: 4164197 - RNA, 19 nt, Yersinia pestis
ggcaauggcucaggcucau

SEQ ID NO: 4164198 - RNA, 21 nt, Yersinia pestis
ggcaauuaucuuauccacagc

SEQ ID NO: 4164199 - RNA, 22 nt, Yersinia pestis
ggcacaauccaauuuaccacua

SEQ ID NO: 4164200 - RNA, 17 nt, Yersinia pestis
ggcacaccgcuacaggc

SEQ ID NO: 4164201 - RNA, 21 nt, Yersinia pestis
ggcacaucuccagaauauaaa

SEQ ID NO: 4164202 - RNA, 13 nt, Yersinia pestis
ggcaccaugccca

SEQ ID NO: 4164203 - RNA, 17 nt, Yersinia pestis
ggcaccaugcccauaca

SEQ ID NO: 4164204 - RNA, 12 nt, Yersinia pestis
ggcaccaugcug

SEQ ID NO: 4164205 - RNA, 14 nt, Yersinia pestis
ggcaccguggauaa

SEQ ID NO: 4164206 - RNA, 18 nt, Yersinia pestis
ggcacgcuuucugcaaua

SEQ ID NO: 4164207 - RNA, 18 nt, Yersinia pestis
ggcacggaucucauucag

SEQ ID NO: 4164208 - RNA, 21 nt, Yersinia pestis
ggcacgugcagguuugccaau

SEQ ID NO: 4164209 - RNA, 20 nt, Yersinia pestis
ggcacuccgguggcuuacgc

SEQ ID NO: 4164210 - RNA, 16 nt, Yersinia pestis
ggcacugcagaaaaug

SEQ ID NO: 4164211 - RNA, 22 nt, Yersinia pestis
ggcacuggcaauaaagaggcca

SEQ ID NO: 4164212 - RNA, 16 nt, Yersinia pestis
ggcacuuugucaauaa

SEQ ID NO: 4164213 - RNA, 23 nt, Yersinia pestis
ggcacuuugucaauaaccucaca

SEQ ID NO: 4164214 - RNA, 18 nt, Yersinia pestis
ggcagaaauaauaucaag

SEQ ID NO: 4164215 - RNA, 14 nt, Yersinia pestis
ggcagaaguccuga

SEQ ID NO: 4164216 - RNA, 19 nt, Yersinia pestis
ggcagaggaguaaagcguc

SEQ ID NO: 4164217 - RNA, 19 nt, Yersinia pestis
ggcagauaugccaggcauc

SEQ ID NO: 4164218 - RNA, 20 nt, Yersinia pestis
ggcagauuggauugaaauca

SEQ ID NO: 4164219 - RNA, 16 nt, Yersinia pestis
ggcagcacagagcaca

SEQ ID NO: 4164220 - RNA, 17 nt, Yersinia pestis
ggcagccugcggcggcu

SEQ ID NO: 4164221 - RNA, 15 nt, Yersinia pestis
ggcagcgacaaccug

SEQ ID NO: 4164222 - RNA, 22 nt, Yersinia pestis
ggcaggaagcccguuauggcaa

SEQ ID NO: 4164223 - RNA, 17 nt, Yersinia pestis
ggcaggccccaucauaa

SEQ ID NO: 4164224 - RNA, 18 nt, Yersinia pestis
ggcaggcccgcuucccua

SEQ ID NO: 4164225 - RNA, 21 nt, Yersinia pestis
ggcagggcgcuuucuggguga

SEQ ID NO: 4164226 - RNA, 15 nt, Yersinia pestis
ggcagguaaauccuu

SEQ ID NO: 4164227 - RNA, 17 nt, Yersinia pestis
ggcagguagggcggccc

SEQ ID NO: 4164228 - RNA, 16 nt, Yersinia pestis
ggcaguaacgccauaa

SEQ ID NO: 4164229 - RNA, 14 nt, Yersinia pestis
ggcagugcgggcaa

SEQ ID NO: 4164230 - RNA, 21 nt, Yersinia pestis
ggcaguuuuuuauggcauaaa

SEQ ID NO: 4164231 - RNA, 18 nt, Yersinia pestis
ggcauaaauaauaaauaa

SEQ ID NO: 4164232 - RNA, 14 nt, Yersinia pestis
ggcauaaauggcua

SEQ ID NO: 4164233 - RNA, 19 nt, Yersinia pestis
ggcauaaauucuagcaaca

SEQ ID NO: 4164234 - RNA, 19 nt, Yersinia pestis
ggcauauaaccaugcgaua

SEQ ID NO: 4164235 - RNA, 16 nt, Yersinia pestis
ggcaucaaucagcggg

SEQ ID NO: 4164236 - RNA, 23 nt, Yersinia pestis
ggcaucaccgcuaucacugauau

SEQ ID NO: 4164237 - RNA, 24 nt, Yersinia pestis
ggcaucuuucaguuuuauuguaua

SEQ ID NO: 4164238 - RNA, 17 nt, Yersinia pestis
ggcaugauagcgcgaga

SEQ ID NO: 4164239 - RNA, 16 nt, Yersinia pestis
ggcaugcauuggaaaa

SEQ ID NO: 4164240 - RNA, 23 nt, Yersinia pestis
ggcaugccaauuauucucugaac

SEQ ID NO: 4164241 - RNA, 22 nt, Yersinia pestis
ggcauggaacgggaacagcgcc

SEQ ID NO: 4164242 - RNA, 23 nt, Yersinia pestis
ggcauuccgguucgcacauaucg

SEQ ID NO: 4164243 - RNA, 21 nt, Yersinia pestis
ggcauucuaguuugugcugcu

SEQ ID NO: 4164244 - RNA, 17 nt, Yersinia pestis
ggcauugaccaaagcgg

SEQ ID NO: 4164245 - RNA, 17 nt, Yersinia pestis
ggcauuuuacuggguga

SEQ ID NO: 4164246 - RNA, 14 nt, Yersinia pestis
ggccaacaggcccc

SEQ ID NO: 4164247 - RNA, 15 nt, Yersinia pestis
ggccaacaggccccu

SEQ ID NO: 4164248 - RNA, 20 nt, Yersinia pestis
ggccaacaucgaagggcggg

SEQ ID NO: 4164249 - RNA, 21 nt, Yersinia pestis
ggccaaccguagugagucagg

SEQ ID NO: 4164250 - RNA, 13 nt, Yersinia pestis
ggccaacugcugg

SEQ ID NO: 4164251 - RNA, 16 nt, Yersinia pestis
ggccaacugcuggcca

SEQ ID NO: 4164252 - RNA, 17 nt, Yersinia pestis
ggccaaguuuacuuugu

SEQ ID NO: 4164253 - RNA, 22 nt, Yersinia pestis
ggccaauagaaaaacacuggca

SEQ ID NO: 4164254 - RNA, 15 nt, Yersinia pestis
ggccaauaggccccu

SEQ ID NO: 4164255 - RNA, 22 nt, Yersinia pestis
ggccaauuggcuuaacucgcca

SEQ ID NO: 4164256 - RNA, 16 nt, Yersinia pestis
ggccaauuuggccaau

SEQ ID NO: 4164257 - RNA, 19 nt, Yersinia pestis
ggccaauuuggccaauaau

SEQ ID NO: 4164258 - RNA, 21 nt, Yersinia pestis
ggccaccaaauugcggccagu

SEQ ID NO: 4164259 - RNA, 17 nt, Yersinia pestis
ggccaccacgaaaaaau

SEQ ID NO: 4164260 - RNA, 20 nt, Yersinia pestis
ggccacccgccaucaggcaa

SEQ ID NO: 4164261 - RNA, 18 nt, Yersinia pestis
ggccacccugccaaaaaa

SEQ ID NO: 4164262 - RNA, 19 nt, Yersinia pestis
ggccacccugccaaaaaau

SEQ ID NO: 4164263 - RNA, 18 nt, Yersinia pestis
ggccacuucgguggcccu

SEQ ID NO: 4164264 - RNA, 16 nt, Yersinia pestis
ggccagaguuaugggc

SEQ ID NO: 4164265 - RNA, 21 nt, Yersinia pestis
ggccagcgcuaacgguggcau

SEQ ID NO: 4164266 - RNA, 19 nt, Yersinia pestis
ggccagcuugcaaguguau

SEQ ID NO: 4164267 - RNA, 15 nt, Yersinia pestis
ggccagugcgccggc

SEQ ID NO: 4164268 - RNA, 17 nt, Yersinia pestis
ggccaguugccacucau

SEQ ID NO: 4164269 - RNA, 19 nt, Yersinia pestis
ggccaguuuuagucucgca

SEQ ID NO: 4164270 - RNA, 14 nt, Yersinia pestis
ggccaucaucuuca

SEQ ID NO: 4164271 - RNA, 18 nt, Yersinia pestis
ggccaugaaucaaauuau

SEQ ID NO: 4164272 - RNA, 18 nt, Yersinia pestis
ggccaugucaggccacca

SEQ ID NO: 4164273 - RNA, 18 nt, Yersinia pestis
ggccaugucgaucauggc

SEQ ID NO: 4164274 - RNA, 17 nt, Yersinia pestis
ggccauuguuaugguau

SEQ ID NO: 4164275 - RNA, 19 nt, Yersinia pestis
ggccccaauccaccacuga

SEQ ID NO: 4164276 - RNA, 14 nt, Yersinia pestis
ggccccagcccagc

SEQ ID NO: 4164277 - RNA, 15 nt, Yersinia pestis
ggccccagcccagca

SEQ ID NO: 4164278 - RNA, 23 nt, Yersinia pestis
ggcccccuccaacugagugagcg

SEQ ID NO: 4164279 - RNA, 19 nt, Yersinia pestis
ggccccuaaugcgcucacc

SEQ ID NO: 4164280 - RNA, 20 nt, Yersinia pestis
ggccccuaaugcgcucacca

SEQ ID NO: 4164281 - RNA, 18 nt, Yersinia pestis
ggccccuuaaauaugaug

SEQ ID NO: 4164282 - RNA, 14 nt, Yersinia pestis
ggcccgcuagugau

SEQ ID NO: 4164283 - RNA, 17 nt, Yersinia pestis
ggcccgcuagugauagc

SEQ ID NO: 4164284 - RNA, 20 nt, Yersinia pestis
ggcccgcuagugauagcggg

SEQ ID NO: 4164285 - RNA, 23 nt, Yersinia pestis
ggcccgcuagugauagcgggccu

SEQ ID NO: 4164286 - RNA, 14 nt, Yersinia pestis
ggcccgcuucccua

SEQ ID NO: 4164287 - RNA, 15 nt, Yersinia pestis
ggccgacaauaccgc

SEQ ID NO: 4164288 - RNA, 16 nt, Yersinia pestis
ggccgaggaauaugcc

SEQ ID NO: 4164289 - RNA, 18 nt, Yersinia pestis
ggccgauacacaugguug

SEQ ID NO: 4164290 - RNA, 21 nt, Yersinia pestis
ggccgauacgcgccgcagcag

SEQ ID NO: 4164291 - RNA, 19 nt, Yersinia pestis
ggccgcaauaguuaacagc

SEQ ID NO: 4164292 - RNA, 20 nt, Yersinia pestis
ggccgccgcggugaagaaca

SEQ ID NO: 4164293 - RNA, 20 nt, Yersinia pestis
ggccgccuucuuuuuacugc

SEQ ID NO: 4164294 - RNA, 21 nt, Yersinia pestis
ggccgcgaauaacagacguua

SEQ ID NO: 4164295 - RNA, 20 nt, Yersinia pestis
ggccgcuacugguaauaaug

SEQ ID NO: 4164296 - RNA, 14 nt, Yersinia pestis
ggccgcuugccaau

SEQ ID NO: 4164297 - RNA, 20 nt, Yersinia pestis
ggccgcuugccaaucacggu

SEQ ID NO: 4164298 - RNA, 14 nt, Yersinia pestis
ggccgguuaauuga

SEQ ID NO: 4164299 - RNA, 14 nt, Yersinia pestis
ggccguaucauggg

SEQ ID NO: 4164300 - RNA, 17 nt, Yersinia pestis
ggccguguuuuucccua

SEQ ID NO: 4164301 - RNA, 20 nt, Yersinia pestis
ggccguugaugcucauuuaa

SEQ ID NO: 4164302 - RNA, 22 nt, Yersinia pestis
ggccuaagccggucuuuuuaca

SEQ ID NO: 4164303 - RNA, 15 nt, Yersinia pestis
ggccuacuggugccu

SEQ ID NO: 4164304 - RNA, 14 nt, Yersinia pestis
ggccucuucuuuua

SEQ ID NO: 4164305 - RNA, 12 nt, Yersinia pestis
ggccugagaacc

SEQ ID NO: 4164306 - RNA, 18 nt, Yersinia pestis
ggccugcaaacggcucau

SEQ ID NO: 4164307 - RNA, 12 nt, Yersinia pestis
ggccugcggcca

SEQ ID NO: 4164308 - RNA, 23 nt, Yersinia pestis
ggccugcugugucgcuauuuccg

SEQ ID NO: 4164309 - RNA, 13 nt, Yersinia pestis
ggcgaaaggcgca

SEQ ID NO: 4164310 - RNA, 16 nt, Yersinia pestis
ggcgaacagaaaucaa

SEQ ID NO: 4164311 - RNA, 19 nt, Yersinia pestis
ggcgaagggcgcagccccc

SEQ ID NO: 4164312 - RNA, 15 nt, Yersinia pestis
ggcgaaugcccugcu

SEQ ID NO: 4164313 - RNA, 16 nt, Yersinia pestis
ggcgacccagcgccau

SEQ ID NO: 4164314 - RNA, 23 nt, Yersinia pestis
ggcgacguugcucccaucccuca

SEQ ID NO: 4164315 - RNA, 11 nt, Yersinia pestis
ggcgagcacug

SEQ ID NO: 4164316 - RNA, 21 nt, Yersinia pestis
ggcgaguaucgugaccaauaa

SEQ ID NO: 4164317 - RNA, 24 nt, Yersinia pestis
ggcgaguuucccuuuuccaucaga

SEQ ID NO: 4164318 - RNA, 12 nt, Yersinia pestis
ggcgauaaucuc

SEQ ID NO: 4164319 - RNA, 14 nt, Yersinia pestis
ggcgcacaacugcg

SEQ ID NO: 4164320 - RNA, 21 nt, Yersinia pestis
ggcgcacauuacaagugccaa

SEQ ID NO: 4164321 - RNA, 17 nt, Yersinia pestis
ggcgcacguucccaggc

SEQ ID NO: 4164322 - RNA, 14 nt, Yersinia pestis
ggcgcacugauucu

SEQ ID NO: 4164323 - RNA, 17 nt, Yersinia pestis
ggcgcacugauucucuu

SEQ ID NO: 4164324 - RNA, 19 nt, Yersinia pestis
ggcgcagagaucgauagca

SEQ ID NO: 4164325 - RNA, 17 nt, Yersinia pestis
ggcgcauaaaaugagcc

SEQ ID NO: 4164326 - RNA, 18 nt, Yersinia pestis
ggcgcauaugaaaaaccu

SEQ ID NO: 4164327 - RNA, 19 nt, Yersinia pestis
ggcgcaucgcgaucugaca

SEQ ID NO: 4164328 - RNA, 18 nt, Yersinia pestis
ggcgccgucacguacugg

SEQ ID NO: 4164329 - RNA, 18 nt, Yersinia pestis
ggcgcgcauaguauccau

SEQ ID NO: 4164330 - RNA, 20 nt, Yersinia pestis
ggcgcucaauguuccucagg

SEQ ID NO: 4164331 - RNA, 14 nt, Yersinia pestis
ggcgcucggcagcu

SEQ ID NO: 4164332 - RNA, 20 nt, Yersinia pestis
ggcgcugagguucuccaaca

SEQ ID NO: 4164333 - RNA, 20 nt, Yersinia pestis
ggcgcuuaauucuggccgau

SEQ ID NO: 4164334 - RNA, 15 nt, Yersinia pestis
ggcgcuuacaugaug

SEQ ID NO: 4164335 - RNA, 15 nt, Yersinia pestis
ggcgcuuacuuaccc

SEQ ID NO: 4164336 - RNA, 22 nt, Yersinia pestis
ggcgcuuuguguauaaaccggu

SEQ ID NO: 4164337 - RNA, 18 nt, Yersinia pestis
ggcggaaauuaaaaauua

SEQ ID NO: 4164338 - RNA, 15 nt, Yersinia pestis
ggcggaagacuucca

SEQ ID NO: 4164339 - RNA, 22 nt, Yersinia pestis
ggcggagagaacaggcagagcg

SEQ ID NO: 4164340 - RNA, 16 nt, Yersinia pestis
ggcggaugucagaugg

SEQ ID NO: 4164341 - RNA, 14 nt, Yersinia pestis
ggcggcgagcacug

SEQ ID NO: 4164342 - RNA, 18 nt, Yersinia pestis
ggcggcuaaccugcacgc

SEQ ID NO: 4164343 - RNA, 23 nt, Yersinia pestis
ggcgggaacacgucuacuggcug

SEQ ID NO: 4164344 - RNA, 16 nt, Yersinia pestis
ggcgggaucuccagaa

SEQ ID NO: 4164345 - RNA, 19 nt, Yersinia pestis
ggcgguaaccccggcggcu

SEQ ID NO: 4164346 - RNA, 20 nt, Yersinia pestis
ggcgguaaccccggcggcug

SEQ ID NO: 4164347 - RNA, 21 nt, Yersinia pestis
ggcggucaaacuccccuggca

SEQ ID NO: 4164348 - RNA, 20 nt, Yersinia pestis
ggcgguuaaucggaugguca

SEQ ID NO: 4164349 - RNA, 20 nt, Yersinia pestis
ggcgguucauauuggccagu

SEQ ID NO: 4164350 - RNA, 22 nt, Yersinia pestis
ggcguaccauaguuuuucuccu

SEQ ID NO: 4164351 - RNA, 16 nt, Yersinia pestis
ggcguagcuugauucg

SEQ ID NO: 4164352 - RNA, 14 nt, Yersinia pestis
ggcguauaaacaga

SEQ ID NO: 4164353 - RNA, 13 nt, Yersinia pestis
ggcgucaaagcgg

SEQ ID NO: 4164354 - RNA, 13 nt, Yersinia pestis
ggcgucagccgcg

SEQ ID NO: 4164355 - RNA, 17 nt, Yersinia pestis
ggcgucuuuacgaucug

SEQ ID NO: 4164356 - RNA, 16 nt, Yersinia pestis
ggcguggcacaccgcu

SEQ ID NO: 4164357 - RNA, 23 nt, Yersinia pestis
ggcguuaauauaacaauguuuau

SEQ ID NO: 4164358 - RNA, 17 nt, Yersinia pestis
ggcguucccgcaggcgg

SEQ ID NO: 4164359 - RNA, 14 nt, Yersinia pestis
ggcguugaugacua

SEQ ID NO: 4164360 - RNA, 13 nt, Yersinia pestis
ggcguuggggugg

SEQ ID NO: 4164361 - RNA, 15 nt, Yersinia pestis
ggcguuuaaugcccc

SEQ ID NO: 4164362 - RNA, 17 nt, Yersinia pestis
ggcguuucucagacugu

SEQ ID NO: 4164363 - RNA, 16 nt, Yersinia pestis
ggcuaaaacucaaaua

SEQ ID NO: 4164364 - RNA, 18 nt, Yersinia pestis
ggcuaaaacucaaauaga

SEQ ID NO: 4164365 - RNA, 19 nt, Yersinia pestis
ggcuaaaacucaaauagau

SEQ ID NO: 4164366 - RNA, 21 nt, Yersinia pestis
ggcuaaacucuggcacuggca

SEQ ID NO: 4164367 - RNA, 21 nt, Yersinia pestis
ggcuaaaggugauaucaauac

SEQ ID NO: 4164368 - RNA, 24 nt, Yersinia pestis
ggcuaaauccacacgcgagcauaa

SEQ ID NO: 4164369 - RNA, 21 nt, Yersinia pestis
ggcuaagccgcaauaaauggc

SEQ ID NO: 4164370 - RNA, 17 nt, Yersinia pestis
ggcuaauaccaggcugg

SEQ ID NO: 4164371 - RNA, 20 nt, Yersinia pestis
ggcuaaucguggugaagaau

SEQ ID NO: 4164372 - RNA, 19 nt, Yersinia pestis
ggcuaauuaauuuaaacaa

SEQ ID NO: 4164373 - RNA, 12 nt, Yersinia pestis
ggcuaucaucaa

SEQ ID NO: 4164374 - RNA, 14 nt, Yersinia pestis
ggcuaucuuaugac

SEQ ID NO: 4164375 - RNA, 13 nt, Yersinia pestis
ggcucaaauagca

SEQ ID NO: 4164376 - RNA, 12 nt, Yersinia pestis
ggcucaaauuug

SEQ ID NO: 4164377 - RNA, 19 nt, Yersinia pestis
ggcucaauccaaaugacac

SEQ ID NO: 4164378 - RNA, 21 nt, Yersinia pestis
ggcucaauccaaaugacacuu

SEQ ID NO: 4164379 - RNA, 18 nt, Yersinia pestis
ggcucaaugcgaaaaaau

SEQ ID NO: 4164380 - RNA, 20 nt, Yersinia pestis
ggcucacacacuaauaauaa

SEQ ID NO: 4164381 - RNA, 19 nt, Yersinia pestis
ggcucagcacaaacauggc

SEQ ID NO: 4164382 - RNA, 13 nt, Yersinia pestis
ggcucauuuuuug

SEQ ID NO: 4164383 - RNA, 15 nt, Yersinia pestis
ggcucccccuugauu

SEQ ID NO: 4164384 - RNA, 16 nt, Yersinia pestis
ggcuccuauagcucag

SEQ ID NO: 4164385 - RNA, 14 nt, Yersinia pestis
ggcucgaagcgcgc

SEQ ID NO: 4164386 - RNA, 13 nt, Yersinia pestis
ggcucgagccgcg

SEQ ID NO: 4164387 - RNA, 14 nt, Yersinia pestis
ggcucgagccgcgc

SEQ ID NO: 4164388 - RNA, 16 nt, Yersinia pestis
ggcucgagccgcgcca

SEQ ID NO: 4164389 - RNA, 19 nt, Yersinia pestis
ggcucgcacccuuacccug

SEQ ID NO: 4164390 - RNA, 13 nt, Yersinia pestis
ggcucgugaucag

SEQ ID NO: 4164391 - RNA, 18 nt, Yersinia pestis
ggcucucuuuuuucucuu

SEQ ID NO: 4164392 - RNA, 14 nt, Yersinia pestis
ggcucugaaacgcu

SEQ ID NO: 4164393 - RNA, 23 nt, Yersinia pestis
ggcucugcgaccaaggcucuggc

SEQ ID NO: 4164394 - RNA, 17 nt, Yersinia pestis
ggcucuggcaauggcua

SEQ ID NO: 4164395 - RNA, 22 nt, Yersinia pestis
ggcucuggccagcgucuucagu

SEQ ID NO: 4164396 - RNA, 22 nt, Yersinia pestis
ggcucuggguuaccugccuuca

SEQ ID NO: 4164397 - RNA, 14 nt, Yersinia pestis
ggcugaagacccaa

SEQ ID NO: 4164398 - RNA, 13 nt, Yersinia pestis
ggcugauagaaag

SEQ ID NO: 4164399 - RNA, 14 nt, Yersinia pestis
ggcugauuaauauc

SEQ ID NO: 4164400 - RNA, 17 nt, Yersinia pestis
ggcugauuaccugcauc

SEQ ID NO: 4164401 - RNA, 15 nt, Yersinia pestis
ggcugauucacuggc

SEQ ID NO: 4164402 - RNA, 17 nt, Yersinia pestis
ggcugcaauaagccaga

SEQ ID NO: 4164403 - RNA, 14 nt, Yersinia pestis
ggcugccuuccugc

SEQ ID NO: 4164404 - RNA, 20 nt, Yersinia pestis
ggcugcguucuuugauuuga

SEQ ID NO: 4164405 - RNA, 17 nt, Yersinia pestis
ggcugcugcagccggga

SEQ ID NO: 4164406 - RNA, 20 nt, Yersinia pestis
ggcuggaaaggaauaucugu

SEQ ID NO: 4164407 - RNA, 16 nt, Yersinia pestis
ggcuggaucagcagac

SEQ ID NO: 4164408 - RNA, 22 nt, Yersinia pestis
ggcuggcaccgguggucgcgau

SEQ ID NO: 4164409 - RNA, 16 nt, Yersinia pestis
ggcuguauucacguau

SEQ ID NO: 4164410 - RNA, 17 nt, Yersinia pestis
ggcugucccgaugauug

SEQ ID NO: 4164411 - RNA, 18 nt, Yersinia pestis
ggcugucggcgaugaaaa

SEQ ID NO: 4164412 - RNA, 20 nt, Yersinia pestis
ggcugucggcgaugaaaaac

SEQ ID NO: 4164413 - RNA, 21 nt, Yersinia pestis
ggcugucggcgaugaaaaaca

SEQ ID NO: 4164414 - RNA, 14 nt, Yersinia pestis
ggcuguugacauaa

SEQ ID NO: 4164415 - RNA, 12 nt, Yersinia pestis
ggcuuagccacu

SEQ ID NO: 4164416 - RNA, 17 nt, Yersinia pestis
ggcuuagucauuaagaa

SEQ ID NO: 4164417 - RNA, 21 nt, Yersinia pestis
ggcuuaucuuccagauagcga

SEQ ID NO: 4164418 - RNA, 18 nt, Yersinia pestis
ggcuucuccugcgguggc

SEQ ID NO: 4164419 - RNA, 12 nt, Yersinia pestis
ggcuucuggaug

SEQ ID NO: 4164420 - RNA, 15 nt, Yersinia pestis
ggcuucuuaauuccc

SEQ ID NO: 4164421 - RNA, 17 nt, Yersinia pestis
ggcuugcaaucagaggc

SEQ ID NO: 4164422 - RNA, 19 nt, Yersinia pestis
ggcuugcgcgaaauauugc

SEQ ID NO: 4164423 - RNA, 19 nt, Yersinia pestis
ggcuugcucaauaccauug

SEQ ID NO: 4164424 - RNA, 12 nt, Yersinia pestis
ggcuuuaauauc

SEQ ID NO: 4164425 - RNA, 19 nt, Yersinia pestis
ggcuuuaccuuacguaaac

SEQ ID NO: 4164426 - RNA, 20 nt, Yersinia pestis
ggcuuuacggcucaccuggc

SEQ ID NO: 4164427 - RNA, 15 nt, Yersinia pestis
ggcuuucucuugcca

SEQ ID NO: 4164428 - RNA, 14 nt, Yersinia pestis
ggcuuucugccugu

SEQ ID NO: 4164429 - RNA, 17 nt, Yersinia pestis
ggcuuucugccuguggg

SEQ ID NO: 4164430 - RNA, 20 nt, Yersinia pestis
ggcuuuuaucguugcuacca

SEQ ID NO: 4164431 - RNA, 14 nt, Yersinia pestis
ggcuuuuggggcgc

SEQ ID NO: 4164432 - RNA, 16 nt, Yersinia pestis
ggcuuuuuuaauaaaa

SEQ ID NO: 4164433 - RNA, 23 nt, Yersinia pestis
ggcuuuuuuaauaaaaaacugac

SEQ ID NO: 4164434 - RNA, 20 nt, Yersinia pestis
gggaaaaguggcuaucugaa

SEQ ID NO: 4164435 - RNA, 15 nt, Yersinia pestis
gggaaacaguaaauu

SEQ ID NO: 4164436 - RNA, 21 nt, Yersinia pestis
gggaaaucaaagacuaaccuc

SEQ ID NO: 4164437 - RNA, 22 nt, Yersinia pestis
gggaauaacgacgaaggauaca

SEQ ID NO: 4164438 - RNA, 12 nt, Yersinia pestis
gggaaugcccuu

SEQ ID NO: 4164439 - RNA, 18 nt, Yersinia pestis
gggaauucaccggcaauc

SEQ ID NO: 4164440 - RNA, 20 nt, Yersinia pestis
gggacugccagaucaaagau

SEQ ID NO: 4164441 - RNA, 12 nt, Yersinia pestis
gggagggcgcgc

SEQ ID NO: 4164442 - RNA, 21 nt, Yersinia pestis
gggaguauacggucaaaagcu

SEQ ID NO: 4164443 - RNA, 23 nt, Yersinia pestis
gggauauacccuauaggcucaau

SEQ ID NO: 4164444 - RNA, 12 nt, Yersinia pestis
gggauaucucac

SEQ ID NO: 4164445 - RNA, 19 nt, Yersinia pestis
gggauaugacuaaacugau

SEQ ID NO: 4164446 - RNA, 15 nt, Yersinia pestis
gggauauuaauucca

SEQ ID NO: 4164447 - RNA, 16 nt, Yersinia pestis
gggauauuaauuccac

SEQ ID NO: 4164448 - RNA, 15 nt, Yersinia pestis
gggaucaccucuuca

SEQ ID NO: 4164449 - RNA, 12 nt, Yersinia pestis
gggaucgcgcag

SEQ ID NO: 4164450 - RNA, 18 nt, Yersinia pestis
gggaugaaaaauacaaau

SEQ ID NO: 4164451 - RNA, 23 nt, Yersinia pestis
gggaugauagcuucucgcaccag

SEQ ID NO: 4164452 - RNA, 11 nt, Yersinia pestis
gggaugcccac

SEQ ID NO: 4164453 - RNA, 10 nt, Yersinia pestis
gggauggaaa

SEQ ID NO: 4164454 - RNA, 23 nt, Yersinia pestis
gggcaauacguguagccaaagug

SEQ ID NO: 4164455 - RNA, 21 nt, Yersinia pestis
gggcacaacaagcggccagcu

SEQ ID NO: 4164456 - RNA, 11 nt, Yersinia pestis
gggcagaaaau

SEQ ID NO: 4164457 - RNA, 23 nt, Yersinia pestis
gggcagaccaguugacagguugg

SEQ ID NO: 4164458 - RNA, 22 nt, Yersinia pestis
gggcagguaaauagccaaacac

SEQ ID NO: 4164459 - RNA, 11 nt, Yersinia pestis
gggcaguaacg

SEQ ID NO: 4164460 - RNA, 16 nt, Yersinia pestis
gggcauugcagacugc

SEQ ID NO: 4164461 - RNA, 14 nt, Yersinia pestis
gggccaaggucagg

SEQ ID NO: 4164462 - RNA, 19 nt, Yersinia pestis
gggccaauccaauaggaua

SEQ ID NO: 4164463 - RNA, 17 nt, Yersinia pestis
gggccacaggcugcaug

SEQ ID NO: 4164464 - RNA, 21 nt, Yersinia pestis
gggccaccagacugacaacca

SEQ ID NO: 4164465 - RNA, 20 nt, Yersinia pestis
gggccguuuacucgcaauac

SEQ ID NO: 4164466 - RNA, 22 nt, Yersinia pestis
gggccuuaaaaaacgauuagcu

SEQ ID NO: 4164467 - RNA, 18 nt, Yersinia pestis
gggcgauagcccuacugg

SEQ ID NO: 4164468 - RNA, 19 nt, Yersinia pestis
gggcgcggguaauggcggu

SEQ ID NO: 4164469 - RNA, 20 nt, Yersinia pestis
gggcgcugagguucuccaac

SEQ ID NO: 4164470 - RNA, 23 nt, Yersinia pestis
gggcuauuuauuuagagcguccu

SEQ ID NO: 4164471 - RNA, 17 nt, Yersinia pestis
gggcugacagagcgggu

SEQ ID NO: 4164472 - RNA, 11 nt, Yersinia pestis
gggcugaucau

SEQ ID NO: 4164473 - RNA, 15 nt, Yersinia pestis
gggcugccaguaaaa

SEQ ID NO: 4164474 - RNA, 17 nt, Yersinia pestis
gggcuuccaucaggaag

SEQ ID NO: 4164475 - RNA, 16 nt, Yersinia pestis
gggcuucggucaggug

SEQ ID NO: 4164476 - RNA, 15 nt, Yersinia pestis
gggcuugagcagugc

SEQ ID NO: 4164477 - RNA, 21 nt, Yersinia pestis
gggcuugcauaucagcaauga

SEQ ID NO: 4164478 - RNA, 14 nt, Yersinia pestis
gggcuugcugcaac

SEQ ID NO: 4164479 - RNA, 20 nt, Yersinia pestis
gggcuuguugauaugagcga

SEQ ID NO: 4164480 - RNA, 23 nt, Yersinia pestis
ggggaagagauaaaucggcggcc

SEQ ID NO: 4164481 - RNA, 12 nt, Yersinia pestis
ggggaccagcac

SEQ ID NO: 4164482 - RNA, 19 nt, Yersinia pestis
ggggcacaauucugaaagu

SEQ ID NO: 4164483 - RNA, 23 nt, Yersinia pestis
ggggcacacuuuucacuccggca

SEQ ID NO: 4164484 - RNA, 13 nt, Yersinia pestis
ggggcaucugcug

SEQ ID NO: 4164485 - RNA, 17 nt, Yersinia pestis
ggggccaacaggccccu

SEQ ID NO: 4164486 - RNA, 17 nt, Yersinia pestis
ggggccaauaggccccu

SEQ ID NO: 4164487 - RNA, 17 nt, Yersinia pestis
ggggccaucaucuucaa

SEQ ID NO: 4164488 - RNA, 15 nt, Yersinia pestis
ggggcguuaucacgg

SEQ ID NO: 4164489 - RNA, 19 nt, Yersinia pestis
ggggguugucagcagucug

SEQ ID NO: 4164490 - RNA, 20 nt, Yersinia pestis
ggggguugucagcagucuga

SEQ ID NO: 4164491 - RNA, 13 nt, Yersinia pestis
gggguucacgccu

SEQ ID NO: 4164492 - RNA, 23 nt, Yersinia pestis
gggguuuaggccuauaaccccca

SEQ ID NO: 4164493 - RNA, 13 nt, Yersinia pestis
ggguaaaaucccc

SEQ ID NO: 4164494 - RNA, 18 nt, Yersinia pestis
ggguaaaccaaucaagca

SEQ ID NO: 4164495 - RNA, 14 nt, Yersinia pestis
ggguaacgccauag

SEQ ID NO: 4164496 - RNA, 23 nt, Yersinia pestis
ggguaacgccgcuaaaucaucaa

SEQ ID NO: 4164497 - RNA, 16 nt, Yersinia pestis
ggguaagauccaccac

SEQ ID NO: 4164498 - RNA, 14 nt, Yersinia pestis
ggguaagcugaacg

SEQ ID NO: 4164499 - RNA, 17 nt, Yersinia pestis
ggguaauccccaccaac

SEQ ID NO: 4164500 - RNA, 11 nt, Yersinia pestis
ggguaucugug

SEQ ID NO: 4164501 - RNA, 11 nt, Yersinia pestis
ggguaucuguu

SEQ ID NO: 4164502 - RNA, 18 nt, Yersinia pestis
ggguaucuuugcuucagg

SEQ ID NO: 4164503 - RNA, 20 nt, Yersinia pestis
ggguaucuuugcuucaggca

SEQ ID NO: 4164504 - RNA, 17 nt, Yersinia pestis
ggguauugaagauaccc

SEQ ID NO: 4164505 - RNA, 14 nt, Yersinia pestis
gggucagcucuaca

SEQ ID NO: 4164506 - RNA, 11 nt, Yersinia pestis
gggucaggaag

SEQ ID NO: 4164507 - RNA, 20 nt, Yersinia pestis
gggucagugaaaaaugagaa

SEQ ID NO: 4164508 - RNA, 13 nt, Yersinia pestis
gggucgugcggga

SEQ ID NO: 4164509 - RNA, 22 nt, Yersinia pestis
gggugagucucagggaugaagc

SEQ ID NO: 4164510 - RNA, 16 nt, Yersinia pestis
gggugauauuugugau

SEQ ID NO: 4164511 - RNA, 19 nt, Yersinia pestis
gggugauggcugucugaug

SEQ ID NO: 4164512 - RNA, 24 nt, Yersinia pestis
ggguggccgccgcggugaagaaca

SEQ ID NO: 4164513 - RNA, 21 nt, Yersinia pestis
ggguuagcggcauaagccaaa

SEQ ID NO: 4164514 - RNA, 15 nt, Yersinia pestis
ggguuccaacugaua

SEQ ID NO: 4164515 - RNA, 19 nt, Yersinia pestis
ggguugcccaucagcauca

SEQ ID NO: 4164516 - RNA, 20 nt, Yersinia pestis
gguaaaaggcccgcuaguga

SEQ ID NO: 4164517 - RNA, 21 nt, Yersinia pestis
gguaaaaucacguuuccaaaa

SEQ ID NO: 4164518 - RNA, 14 nt, Yersinia pestis
gguaaaauccccau

SEQ ID NO: 4164519 - RNA, 19 nt, Yersinia pestis
gguaaagaagcauagaaau

SEQ ID NO: 4164520 - RNA, 17 nt, Yersinia pestis
gguaaaugauggcggcu

SEQ ID NO: 4164521 - RNA, 20 nt, Yersinia pestis
gguaaauuccguaccaguug

SEQ ID NO: 4164522 - RNA, 17 nt, Yersinia pestis
gguaacaaggcaaauag

SEQ ID NO: 4164523 - RNA, 17 nt, Yersinia pestis
gguaaccaaucacauca

SEQ ID NO: 4164524 - RNA, 17 nt, Yersinia pestis
gguaaccagcaucagua

SEQ ID NO: 4164525 - RNA, 18 nt, Yersinia pestis
gguaacgcagaaauauuc

SEQ ID NO: 4164526 - RNA, 22 nt, Yersinia pestis
gguaacgccgcuguagcgccaa

SEQ ID NO: 4164527 - RNA, 22 nt, Yersinia pestis
gguaacuuacaggcugccugcc

SEQ ID NO: 4164528 - RNA, 12 nt, Yersinia pestis
gguaagaaagag

SEQ ID NO: 4164529 - RNA, 15 nt, Yersinia pestis
gguaagaauaaauaa

SEQ ID NO: 4164530 - RNA, 16 nt, Yersinia pestis
gguaagccuuucucca

SEQ ID NO: 4164531 - RNA, 11 nt, Yersinia pestis
gguaaggcaaa

SEQ ID NO: 4164532 - RNA, 14 nt, Yersinia pestis
gguaagucagcggg

SEQ ID NO: 4164533 - RNA, 13 nt, Yersinia pestis
gguaauaaaucau

SEQ ID NO: 4164534 - RNA, 16 nt, Yersinia pestis
gguaauaagugaucag

SEQ ID NO: 4164535 - RNA, 16 nt, Yersinia pestis
gguaauaaugcucggc

SEQ ID NO: 4164536 - RNA, 21 nt, Yersinia pestis
gguaauaucgguaaaaaauca

SEQ ID NO: 4164537 - RNA, 20 nt, Yersinia pestis
gguaauaugugcuucuuuaa

SEQ ID NO: 4164538 - RNA, 17 nt, Yersinia pestis
gguaaucagacugcuga

SEQ ID NO: 4164539 - RNA, 13 nt, Yersinia pestis
gguaaucaugggg

SEQ ID NO: 4164540 - RNA, 21 nt, Yersinia pestis
gguaaucccgauauaaauaaa

SEQ ID NO: 4164541 - RNA, 17 nt, Yersinia pestis
gguaaugacauauucaa

SEQ ID NO: 4164542 - RNA, 17 nt, Yersinia pestis
gguaauuaauauauaaa

SEQ ID NO: 4164543 - RNA, 22 nt, Yersinia pestis
gguaauuaauauauaaaauaaa

SEQ ID NO: 4164544 - RNA, 20 nt, Yersinia pestis
gguacaauucgcaagaagcg

SEQ ID NO: 4164545 - RNA, 18 nt, Yersinia pestis
gguacccauuauucuuua

SEQ ID NO: 4164546 - RNA, 16 nt, Yersinia pestis
gguaccgcaggucaga

SEQ ID NO: 4164547 - RNA, 20 nt, Yersinia pestis
gguaccgggccauagcccau

SEQ ID NO: 4164548 - RNA, 19 nt, Yersinia pestis
gguacgaugggccgugucg

SEQ ID NO: 4164549 - RNA, 15 nt, Yersinia pestis
gguacggccagcaau

SEQ ID NO: 4164550 - RNA, 17 nt, Yersinia pestis
gguacugaucauuauua

SEQ ID NO: 4164551 - RNA, 13 nt, Yersinia pestis
gguacuuaacugg

SEQ ID NO: 4164552 - RNA, 18 nt, Yersinia pestis
gguacuuaacuggccaau

SEQ ID NO: 4164553 - RNA, 15 nt, Yersinia pestis
gguacuugacgcugc

SEQ ID NO: 4164554 - RNA, 14 nt, Yersinia pestis
gguagaacugcggc

SEQ ID NO: 4164555 - RNA, 24 nt, Yersinia pestis
gguagaccaccaacuccugccuac

SEQ ID NO: 4164556 - RNA, 21 nt, Yersinia pestis
gguagcaaaauuagcauuacc

SEQ ID NO: 4164557 - RNA, 18 nt, Yersinia pestis
gguagcagccacaugguu

SEQ ID NO: 4164558 - RNA, 17 nt, Yersinia pestis
gguagcuccgcagcuaa

SEQ ID NO: 4164559 - RNA, 16 nt, Yersinia pestis
gguagguauaauuauu

SEQ ID NO: 4164560 - RNA, 19 nt, Yersinia pestis
gguagguuucugggcuggc

SEQ ID NO: 4164561 - RNA, 13 nt, Yersinia pestis
gguaguaauaauu

SEQ ID NO: 4164562 - RNA, 15 nt, Yersinia pestis
gguagucauauucag

SEQ ID NO: 4164563 - RNA, 13 nt, Yersinia pestis
gguagugacucau

SEQ ID NO: 4164564 - RNA, 23 nt, Yersinia pestis
gguauagcgauagaguugauaaa

SEQ ID NO: 4164565 - RNA, 19 nt, Yersinia pestis
gguauauuuaccaaaagca

SEQ ID NO: 4164566 - RNA, 22 nt, Yersinia pestis
gguaucaaucagcggagcugac

SEQ ID NO: 4164567 - RNA, 11 nt, Yersinia pestis
gguaucaguca

SEQ ID NO: 4164568 - RNA, 15 nt, Yersinia pestis
gguaucgauguggug

SEQ ID NO: 4164569 - RNA, 13 nt, Yersinia pestis
gguaucggugaug

SEQ ID NO: 4164570 - RNA, 12 nt, Yersinia pestis
gguaucuuugcu

SEQ ID NO: 4164571 - RNA, 19 nt, Yersinia pestis
gguauggcgcuuaacugca

SEQ ID NO: 4164572 - RNA, 21 nt, Yersinia pestis
gguauuaccaaucagcgcgaa

SEQ ID NO: 4164573 - RNA, 17 nt, Yersinia pestis
gguauuccgagcaauca

SEQ ID NO: 4164574 - RNA, 14 nt, Yersinia pestis
gguauucggcggcu

SEQ ID NO: 4164575 - RNA, 12 nt, Yersinia pestis
gguauuuucuau

SEQ ID NO: 4164576 - RNA, 14 nt, Yersinia pestis
ggucaacugugcca

SEQ ID NO: 4164577 - RNA, 19 nt, Yersinia pestis
ggucaauaaacgccgauca

SEQ ID NO: 4164578 - RNA, 13 nt, Yersinia pestis
ggucaauaccaua

SEQ ID NO: 4164579 - RNA, 18 nt, Yersinia pestis
ggucaauaccauauccac

SEQ ID NO: 4164580 - RNA, 20 nt, Yersinia pestis
ggucaauaucaccagugaua

SEQ ID NO: 4164581 - RNA, 18 nt, Yersinia pestis
ggucacuaaaacugaagc

SEQ ID NO: 4164582 - RNA, 12 nt, Yersinia pestis
ggucacuuaaau

SEQ ID NO: 4164583 - RNA, 17 nt, Yersinia pestis
ggucagaaccuguuaca

SEQ ID NO: 4164584 - RNA, 19 nt, Yersinia pestis
ggucagccaacgacaggua

SEQ ID NO: 4164585 - RNA, 13 nt, Yersinia pestis
ggucagcggagca

SEQ ID NO: 4164586 - RNA, 16 nt, Yersinia pestis
ggucaguugaauauuc

SEQ ID NO: 4164587 - RNA, 23 nt, Yersinia pestis
ggucauacacaugaaaaucaagu

SEQ ID NO: 4164588 - RNA, 16 nt, Yersinia pestis
ggucauaccggcggca

SEQ ID NO: 4164589 - RNA, 15 nt, Yersinia pestis
ggucauauacaccgc

SEQ ID NO: 4164590 - RNA, 22 nt, Yersinia pestis
ggucauauacaccgcaccacga

SEQ ID NO: 4164591 - RNA, 15 nt, Yersinia pestis
ggucauuuuucccuu

SEQ ID NO: 4164592 - RNA, 19 nt, Yersinia pestis
gguccccagagcgcaaaag

SEQ ID NO: 4164593 - RNA, 17 nt, Yersinia pestis
ggucccuaacgcaauac

SEQ ID NO: 4164594 - RNA, 17 nt, Yersinia pestis
gguccucuuaugguagc

SEQ ID NO: 4164595 - RNA, 21 nt, Yersinia pestis
ggucgaacccauucaucaaac

SEQ ID NO: 4164596 - RNA, 22 nt, Yersinia pestis
ggucgacaaaaugugaaaagca

SEQ ID NO: 4164597 - RNA, 16 nt, Yersinia pestis
ggucgauuacauacuu

SEQ ID NO: 4164598 - RNA, 15 nt, Yersinia pestis
ggucgcacccaaacu

SEQ ID NO: 4164599 - RNA, 13 nt, Yersinia pestis
ggucgcugggccu

SEQ ID NO: 4164600 - RNA, 18 nt, Yersinia pestis
ggucgggcgcugagcggg

SEQ ID NO: 4164601 - RNA, 23 nt, Yersinia pestis
ggucgggcugucggcgaugaaaa

SEQ ID NO: 4164602 - RNA, 16 nt, Yersinia pestis
ggucgugaaagcagaa

SEQ ID NO: 4164603 - RNA, 16 nt, Yersinia pestis
ggucuauugguuucua

SEQ ID NO: 4164604 - RNA, 19 nt, Yersinia pestis
ggucucuuugaccagggcu

SEQ ID NO: 4164605 - RNA, 17 nt, Yersinia pestis
ggucugcuggcggaaca

SEQ ID NO: 4164606 - RNA, 22 nt, Yersinia pestis
ggucuuucgcccacaaccaggc

SEQ ID NO: 4164607 - RNA, 14 nt, Yersinia pestis
ggugaaaauaauaa

SEQ ID NO: 4164608 - RNA, 10 nt, Yersinia pestis
ggugaacaga

SEQ ID NO: 4164609 - RNA, 19 nt, Yersinia pestis
ggugaaccaucaacaauuc

SEQ ID NO: 4164610 - RNA, 17 nt, Yersinia pestis
ggugaaguguuuaccac

SEQ ID NO: 4164611 - RNA, 15 nt, Yersinia pestis
ggugaaguucuauaa

SEQ ID NO: 4164612 - RNA, 20 nt, Yersinia pestis
ggugaauacguucaaaugau

SEQ ID NO: 4164613 - RNA, 19 nt, Yersinia pestis
ggugacauccgcuugcagc

SEQ ID NO: 4164614 - RNA, 18 nt, Yersinia pestis
ggugacauguuccagugc

SEQ ID NO: 4164615 - RNA, 15 nt, Yersinia pestis
ggugacccgugcggc

SEQ ID NO: 4164616 - RNA, 21 nt, Yersinia pestis
ggugagaaacgugaauugcua

SEQ ID NO: 4164617 - RNA, 14 nt, Yersinia pestis
ggugagugagcgcg

SEQ ID NO: 4164618 - RNA, 15 nt, Yersinia pestis
ggugagugagcgcgg

SEQ ID NO: 4164619 - RNA, 20 nt, Yersinia pestis
ggugaucgguuagcuacuga

SEQ ID NO: 4164620 - RNA, 21 nt, Yersinia pestis
ggugaucgguuagcuacugau

SEQ ID NO: 4164621 - RNA, 13 nt, Yersinia pestis
ggugaugcugcug

SEQ ID NO: 4164622 - RNA, 12 nt, Yersinia pestis
ggugccacacag

SEQ ID NO: 4164623 - RNA, 21 nt, Yersinia pestis
ggugcgggcaucgacggguaa

SEQ ID NO: 4164624 - RNA, 15 nt, Yersinia pestis
ggugcgggccagaau

SEQ ID NO: 4164625 - RNA, 19 nt, Yersinia pestis
ggugcuaccucguaguaau

SEQ ID NO: 4164626 - RNA, 14 nt, Yersinia pestis
ggugcugacaaaca

SEQ ID NO: 4164627 - RNA, 13 nt, Yersinia pestis
ggugcuguuccaa

SEQ ID NO: 4164628 - RNA, 23 nt, Yersinia pestis
gguggauaaaaaacgggcuuggc

SEQ ID NO: 4164629 - RNA, 21 nt, Yersinia pestis
gguggcaggccccaucauaaa

SEQ ID NO: 4164630 - RNA, 14 nt, Yersinia pestis
gguggcucaaucca

SEQ ID NO: 4164631 - RNA, 17 nt, Yersinia pestis
ggugguuuucuuacaag

SEQ ID NO: 4164632 - RNA, 18 nt, Yersinia pestis
gguguaaaugcccgucgg

SEQ ID NO: 4164633 - RNA, 15 nt, Yersinia pestis
gguguaaauuucaaa

SEQ ID NO: 4164634 - RNA, 19 nt, Yersinia pestis
gguguguggcaauaaaggc

SEQ ID NO: 4164635 - RNA, 18 nt, Yersinia pestis
gguguguuguuggcuaau

SEQ ID NO: 4164636 - RNA, 19 nt, Yersinia pestis
gguguuaaccgccccaaca

SEQ ID NO: 4164637 - RNA, 14 nt, Yersinia pestis
gguuaaauacagca

SEQ ID NO: 4164638 - RNA, 22 nt, Yersinia pestis
gguuaacagccccgucucaaca

SEQ ID NO: 4164639 - RNA, 22 nt, Yersinia pestis
gguuaacggucucuuucgggca

SEQ ID NO: 4164640 - RNA, 17 nt, Yersinia pestis
gguuaacuuuuucuauc

SEQ ID NO: 4164641 - RNA, 17 nt, Yersinia pestis
gguuaccaaaaagcaac

SEQ ID NO: 4164642 - RNA, 23 nt, Yersinia pestis
gguuaucacacccuaaagaucuu

SEQ ID NO: 4164643 - RNA, 14 nt, Yersinia pestis
gguuaucacagcaa

SEQ ID NO: 4164644 - RNA, 17 nt, Yersinia pestis
gguuaucacauaaauaa

SEQ ID NO: 4164645 - RNA, 18 nt, Yersinia pestis
gguuaucacaucauccac

SEQ ID NO: 4164646 - RNA, 16 nt, Yersinia pestis
gguuaucugacugcuu

SEQ ID NO: 4164647 - RNA, 13 nt, Yersinia pestis
gguuauugacaaa

SEQ ID NO: 4164648 - RNA, 13 nt, Yersinia pestis
gguucaaaucagu

SEQ ID NO: 4164649 - RNA, 13 nt, Yersinia pestis
gguucaauucccg

SEQ ID NO: 4164650 - RNA, 21 nt, Yersinia pestis
gguucacccgcacgcccauag

SEQ ID NO: 4164651 - RNA, 20 nt, Yersinia pestis
gguucaccuuucgguugcau

SEQ ID NO: 4164652 - RNA, 11 nt, Yersinia pestis
gguucacggaa

SEQ ID NO: 4164653 - RNA, 15 nt, Yersinia pestis
gguucaguaaaacca

SEQ ID NO: 4164654 - RNA, 15 nt, Yersinia pestis
gguuccaaagcacca

SEQ ID NO: 4164655 - RNA, 15 nt, Yersinia pestis
gguucuccaacaacc

SEQ ID NO: 4164656 - RNA, 11 nt, Yersinia pestis
gguugaaaguu

SEQ ID NO: 4164657 - RNA, 16 nt, Yersinia pestis
gguugaggauuauaau

SEQ ID NO: 4164658 - RNA, 18 nt, Yersinia pestis
gguugcauuugggcagau

SEQ ID NO: 4164659 - RNA, 19 nt, Yersinia pestis
gguugccauuaauuggccg

SEQ ID NO: 4164660 - RNA, 16 nt, Yersinia pestis
gguugccggaagagaa

SEQ ID NO: 4164661 - RNA, 14 nt, Yersinia pestis
gguugcuguaaugc

SEQ ID NO: 4164662 - RNA, 23 nt, Yersinia pestis
gguugcuucguagaguugcaguu

SEQ ID NO: 4164663 - RNA, 13 nt, Yersinia pestis
gguuggcuagccu

SEQ ID NO: 4164664 - RNA, 23 nt, Yersinia pestis
gguugggaaaaguggcuaucuga

SEQ ID NO: 4164665 - RNA, 15 nt, Yersinia pestis
gguuguccgaagaga

SEQ ID NO: 4164666 - RNA, 21 nt, Yersinia pestis
gguugucuauguuugaugguu

SEQ ID NO: 4164667 - RNA, 20 nt, Yersinia pestis
gguuuaggccaauuuggcca

SEQ ID NO: 4164668 - RNA, 22 nt, Yersinia pestis
gguuuaggccaauuuggccaau

SEQ ID NO: 4164669 - RNA, 15 nt, Yersinia pestis
gguuuaggccuauaa

SEQ ID NO: 4164670 - RNA, 17 nt, Yersinia pestis
gguuucaacauccaguu

SEQ ID NO: 4164671 - RNA, 17 nt, Yersinia pestis
gguuucagcuugcaaca

SEQ ID NO: 4164672 - RNA, 22 nt, Yersinia pestis
gguuuccccaaacgcauuucgu

SEQ ID NO: 4164673 - RNA, 14 nt, Yersinia pestis
gguuugaauccagu

SEQ ID NO: 4164674 - RNA, 15 nt, Yersinia pestis
gguuugacggcggcg

SEQ ID NO: 4164675 - RNA, 15 nt, Yersinia pestis
gguuugaucaacaug

SEQ ID NO: 4164676 - RNA, 17 nt, Yersinia pestis
gguuuguaagucagauu

SEQ ID NO: 4164677 - RNA, 14 nt, Yersinia pestis
gguuuuaucaauag

SEQ ID NO: 4164678 - RNA, 18 nt, Yersinia pestis
gguuuucugaauaccaua

SEQ ID NO: 4164679 - RNA, 18 nt, Yersinia pestis
gguuuucugcggcaagcu

SEQ ID NO: 4164680 - RNA, 16 nt, Yersinia pestis
gguuuuuguaacaggc

SEQ ID NO: 4164681 - RNA, 19 nt, Yersinia pestis
gguuuuuugcgggacagaa

SEQ ID NO: 4164682 - RNA, 19 nt, Yersinia pestis
guaaaaaaccuuauuuuug

SEQ ID NO: 4164683 - RNA, 18 nt, Yersinia pestis
guaaaaaccaucugaugc

SEQ ID NO: 4164684 - RNA, 18 nt, Yersinia pestis
guaaaacaaaguaguacg

SEQ ID NO: 4164685 - RNA, 20 nt, Yersinia pestis
guaaaacaagggguuucaga

SEQ ID NO: 4164686 - RNA, 17 nt, Yersinia pestis
guaaaacacgcaacacu

SEQ ID NO: 4164687 - RNA, 19 nt, Yersinia pestis
guaaaacagggagccgccc

SEQ ID NO: 4164688 - RNA, 17 nt, Yersinia pestis
guaaaagaauaaauguc

SEQ ID NO: 4164689 - RNA, 20 nt, Yersinia pestis
guaaaagaauaaaugucacu

SEQ ID NO: 4164690 - RNA, 16 nt, Yersinia pestis
guaaaagauucauaaa

SEQ ID NO: 4164691 - RNA, 18 nt, Yersinia pestis
guaaaagccagucagggc

SEQ ID NO: 4164692 - RNA, 15 nt, Yersinia pestis
guaaaaggcccgcua

SEQ ID NO: 4164693 - RNA, 22 nt, Yersinia pestis
guaaaaucuuucuguucagcau

SEQ ID NO: 4164694 - RNA, 16 nt, Yersinia pestis
guaaaauuuaaaguaa

SEQ ID NO: 4164695 - RNA, 20 nt, Yersinia pestis
guaaacaauaauucgcaugg

SEQ ID NO: 4164696 - RNA, 16 nt, Yersinia pestis
guaaacagacacagca

SEQ ID NO: 4164697 - RNA, 13 nt, Yersinia pestis
guaaacagccagc

SEQ ID NO: 4164698 - RNA, 16 nt, Yersinia pestis
guaaaccguacauuaa

SEQ ID NO: 4164699 - RNA, 21 nt, Yersinia pestis
guaaaccuaacacguuaaauu

SEQ ID NO: 4164700 - RNA, 16 nt, Yersinia pestis
guaaacgcaucccagg

SEQ ID NO: 4164701 - RNA, 23 nt, Yersinia pestis
guaaacguggcccuuucgcagcc

SEQ ID NO: 4164702 - RNA, 15 nt, Yersinia pestis
guaaagaacccccca

SEQ ID NO: 4164703 - RNA, 22 nt, Yersinia pestis
guaaagacgccggcuucccugu

SEQ ID NO: 4164704 - RNA, 20 nt, Yersinia pestis
guaaagacgccguaaauaca

SEQ ID NO: 4164705 - RNA, 16 nt, Yersinia pestis
guaaagcacccacacc

SEQ ID NO: 4164706 - RNA, 16 nt, Yersinia pestis
guaaagcaggccuucu

SEQ ID NO: 4164707 - RNA, 15 nt, Yersinia pestis
guaaauacauggcga

SEQ ID NO: 4164708 - RNA, 21 nt, Yersinia pestis
guaaauauaauuucaaaguaa

SEQ ID NO: 4164709 - RNA, 15 nt, Yersinia pestis
guaaaucaggccggu

SEQ ID NO: 4164710 - RNA, 12 nt, Yersinia pestis
guaaauccuucu

SEQ ID NO: 4164711 - RNA, 19 nt, Yersinia pestis
guaaaugccccauuuuggc

SEQ ID NO: 4164712 - RNA, 15 nt, Yersinia pestis
guaaauggcuaaacu

SEQ ID NO: 4164713 - RNA, 23 nt, Yersinia pestis
guaaauguacagucauuuacuga

SEQ ID NO: 4164714 - RNA, 14 nt, Yersinia pestis
guaaauuagccacu

SEQ ID NO: 4164715 - RNA, 12 nt, Yersinia pestis
guaaauuccuau

SEQ ID NO: 4164716 - RNA, 15 nt, Yersinia pestis
guaacaacugaacca

SEQ ID NO: 4164717 - RNA, 17 nt, Yersinia pestis
guaacacacagcagaca

SEQ ID NO: 4164718 - RNA, 21 nt, Yersinia pestis
guaacacuucagacugaaagu

SEQ ID NO: 4164719 - RNA, 19 nt, Yersinia pestis
guaacacuugaccaaccug

SEQ ID NO: 4164720 - RNA, 11 nt, Yersinia pestis
guaacagagcc

SEQ ID NO: 4164721 - RNA, 12 nt, Yersinia pestis
guaacaggccau

SEQ ID NO: 4164722 - RNA, 23 nt, Yersinia pestis
guaacauauaaaccagccaguga

SEQ ID NO: 4164723 - RNA, 17 nt, Yersinia pestis
guaacauuacuuugaau

SEQ ID NO: 4164724 - RNA, 21 nt, Yersinia pestis
guaacauuuguauuuuuucuu

SEQ ID NO: 4164725 - RNA, 20 nt, Yersinia pestis
guaaccccgcguucacuuuc

SEQ ID NO: 4164726 - RNA, 17 nt, Yersinia pestis
guaacccuuuggcaacc

SEQ ID NO: 4164727 - RNA, 18 nt, Yersinia pestis
guaaccgcaaggauacca

SEQ ID NO: 4164728 - RNA, 22 nt, Yersinia pestis
guaaccggcuaggcucagcaug

SEQ ID NO: 4164729 - RNA, 22 nt, Yersinia pestis
guaacgaaucugcacuguaauu

SEQ ID NO: 4164730 - RNA, 16 nt, Yersinia pestis
guaacgaauucagcag

SEQ ID NO: 4164731 - RNA, 16 nt, Yersinia pestis
guaacgcagauaaauc

SEQ ID NO: 4164732 - RNA, 16 nt, Yersinia pestis
guaacggaauucagaa

SEQ ID NO: 4164733 - RNA, 18 nt, Yersinia pestis
guaacggaauucagaacg

SEQ ID NO: 4164734 - RNA, 20 nt, Yersinia pestis
guaacgggucucaaugcagu

SEQ ID NO: 4164735 - RNA, 20 nt, Yersinia pestis
guaacguccaacugacgcca

SEQ ID NO: 4164736 - RNA, 15 nt, Yersinia pestis
guaacucaaugccaa

SEQ ID NO: 4164737 - RNA, 22 nt, Yersinia pestis
guaacucaggauccucgucgua

SEQ ID NO: 4164738 - RNA, 13 nt, Yersinia pestis
guaacugaucaau

SEQ ID NO: 4164739 - RNA, 16 nt, Yersinia pestis
guaacuguaaggccaa

SEQ ID NO: 4164740 - RNA, 13 nt, Yersinia pestis
guaacuuuucggg

SEQ ID NO: 4164741 - RNA, 22 nt, Yersinia pestis
guaacuuuucgggcuaaagaca

SEQ ID NO: 4164742 - RNA, 22 nt, Yersinia pestis
guaacuuuuuguugcaccaacg

SEQ ID NO: 4164743 - RNA, 21 nt, Yersinia pestis
guaagaauaaauaauaucaau

SEQ ID NO: 4164744 - RNA, 17 nt, Yersinia pestis
guaagaccaauugguaa

SEQ ID NO: 4164745 - RNA, 15 nt, Yersinia pestis
guaagauuucaagca

SEQ ID NO: 4164746 - RNA, 22 nt, Yersinia pestis
guaagcaugaaacacaguggaa

SEQ ID NO: 4164747 - RNA, 11 nt, Yersinia pestis
guaagccaacg

SEQ ID NO: 4164748 - RNA, 21 nt, Yersinia pestis
guaagccgugccugcuggcaa

SEQ ID NO: 4164749 - RNA, 21 nt, Yersinia pestis
guaagcgcuggcuuaauuggc

SEQ ID NO: 4164750 - RNA, 23 nt, Yersinia pestis
guaagcuuugugcaaaauacaaa

SEQ ID NO: 4164751 - RNA, 17 nt, Yersinia pestis
guaaggccaauuggcuu

SEQ ID NO: 4164752 - RNA, 14 nt, Yersinia pestis
guaaguaaaaagga

SEQ ID NO: 4164753 - RNA, 19 nt, Yersinia pestis
guaauagcuuaaucaucau

SEQ ID NO: 4164754 - RNA, 14 nt, Yersinia pestis
guaauaguaaaaca

SEQ ID NO: 4164755 - RNA, 23 nt, Yersinia pestis
guaauaguuaaucgcagcagaga

SEQ ID NO: 4164756 - RNA, 17 nt, Yersinia pestis
guaauauccacauugga

SEQ ID NO: 4164757 - RNA, 20 nt, Yersinia pestis
guaauaucgguaaaaaauca

SEQ ID NO: 4164758 - RNA, 19 nt, Yersinia pestis
guaauaucugccaccgcac

SEQ ID NO: 4164759 - RNA, 13 nt, Yersinia pestis
guaauauugaaga

SEQ ID NO: 4164760 - RNA, 14 nt, Yersinia pestis
guaaucaaacauaa

SEQ ID NO: 4164761 - RNA, 22 nt, Yersinia pestis
guaaucaacacauaaaaucagc

SEQ ID NO: 4164762 - RNA, 11 nt, Yersinia pestis
guaaucaccag

SEQ ID NO: 4164763 - RNA, 15 nt, Yersinia pestis
guaaucagacugcug

SEQ ID NO: 4164764 - RNA, 17 nt, Yersinia pestis
guaaucagacugcugac

SEQ ID NO: 4164765 - RNA, 17 nt, Yersinia pestis
guaaucaugguuggaua

SEQ ID NO: 4164766 - RNA, 19 nt, Yersinia pestis
guaaucccgauauaaauaa

SEQ ID NO: 4164767 - RNA, 22 nt, Yersinia pestis
guaaucgacggaaacagcacgg

SEQ ID NO: 4164768 - RNA, 16 nt, Yersinia pestis
guaaucguauucucaa

SEQ ID NO: 4164769 - RNA, 13 nt, Yersinia pestis
guaaucugacugu

SEQ ID NO: 4164770 - RNA, 11 nt, Yersinia pestis
guaaugaaauc

SEQ ID NO: 4164771 - RNA, 17 nt, Yersinia pestis
guaaugaccuacacacu

SEQ ID NO: 4164772 - RNA, 20 nt, Yersinia pestis
guaaugacgcccgcagcggc

SEQ ID NO: 4164773 - RNA, 21 nt, Yersinia pestis
guaaugagccgcauugauccu

SEQ ID NO: 4164774 - RNA, 14 nt, Yersinia pestis
guaaugaggcuacc

SEQ ID NO: 4164775 - RNA, 17 nt, Yersinia pestis
guaauggcgauaauauu

SEQ ID NO: 4164776 - RNA, 17 nt, Yersinia pestis
guaauggcgcacauuac

SEQ ID NO: 4164777 - RNA, 21 nt, Yersinia pestis
guaaugguuaccaaaaagcaa

SEQ ID NO: 4164778 - RNA, 23 nt, Yersinia pestis
guaaugucacugccaucucaugu

SEQ ID NO: 4164779 - RNA, 16 nt, Yersinia pestis
guaauuauuuuggcua

SEQ ID NO: 4164780 - RNA, 21 nt, Yersinia pestis
guaauucacccuuuaaaucua

SEQ ID NO: 4164781 - RNA, 19 nt, Yersinia pestis
guaauucccaccacuugcu

SEQ ID NO: 4164782 - RNA, 14 nt, Yersinia pestis
guaauucgcagaca

SEQ ID NO: 4164783 - RNA, 16 nt, Yersinia pestis
guaauuuacugacggu

SEQ ID NO: 4164784 - RNA, 13 nt, Yersinia pestis
guaauuuauagac

SEQ ID NO: 4164785 - RNA, 16 nt, Yersinia pestis
guacaaaaaacaaacc

SEQ ID NO: 4164786 - RNA, 23 nt, Yersinia pestis
guacaaaaauaaacgggcuucca

SEQ ID NO: 4164787 - RNA, 14 nt, Yersinia pestis
guacaaauugugga

SEQ ID NO: 4164788 - RNA, 16 nt, Yersinia pestis
guacaacaagauccca

SEQ ID NO: 4164789 - RNA, 12 nt, Yersinia pestis
guacaacacaaa

SEQ ID NO: 4164790 - RNA, 12 nt, Yersinia pestis
guacaacacauc

SEQ ID NO: 4164791 - RNA, 17 nt, Yersinia pestis
guacaacgcuuaucaaa

SEQ ID NO: 4164792 - RNA, 21 nt, Yersinia pestis
guacaaucucugggugcugcu

SEQ ID NO: 4164793 - RNA, 14 nt, Yersinia pestis
guacacacagugau

SEQ ID NO: 4164794 - RNA, 19 nt, Yersinia pestis
guacagcguuggucagcaa

SEQ ID NO: 4164795 - RNA, 23 nt, Yersinia pestis
guacauauauaauacuauuugua

SEQ ID NO: 4164796 - RNA, 15 nt, Yersinia pestis
guacauaucgagcug

SEQ ID NO: 4164797 - RNA, 15 nt, Yersinia pestis
guacaucguagucua

SEQ ID NO: 4164798 - RNA, 14 nt, Yersinia pestis
guacauuaaaugaa

SEQ ID NO: 4164799 - RNA, 15 nt, Yersinia pestis
guacauuaaaugaau

SEQ ID NO: 4164800 - RNA, 16 nt, Yersinia pestis
guacauuaaaugaaua

SEQ ID NO: 4164801 - RNA, 20 nt, Yersinia pestis
guaccaaaucagcaagcugc

SEQ ID NO: 4164802 - RNA, 22 nt, Yersinia pestis
guaccaaaucagcaagcugcuc

SEQ ID NO: 4164803 - RNA, 23 nt, Yersinia pestis
guaccaaaucagcaagcugcuca

SEQ ID NO: 4164804 - RNA, 19 nt, Yersinia pestis
guaccaaucuccaaugacc

SEQ ID NO: 4164805 - RNA, 17 nt, Yersinia pestis
guacccgaucugagcca

SEQ ID NO: 4164806 - RNA, 21 nt, Yersinia pestis
guacccguaggcccacaauca

SEQ ID NO: 4164807 - RNA, 13 nt, Yersinia pestis
guacccucauugg

SEQ ID NO: 4164808 - RNA, 13 nt, Yersinia pestis
guaccgauaaaag

SEQ ID NO: 4164809 - RNA, 13 nt, Yersinia pestis
guaccgcagguca

SEQ ID NO: 4164810 - RNA, 22 nt, Yersinia pestis
guaccggcgguuaucacaucau

SEQ ID NO: 4164811 - RNA, 17 nt, Yersinia pestis
guaccugcacugagcca

SEQ ID NO: 4164812 - RNA, 12 nt, Yersinia pestis
guaccugcauca

SEQ ID NO: 4164813 - RNA, 20 nt, Yersinia pestis
guaccuguaagguugaccug

SEQ ID NO: 4164814 - RNA, 20 nt, Yersinia pestis
guaccuugacgccgaugaau

SEQ ID NO: 4164815 - RNA, 18 nt, Yersinia pestis
guacgacgccagauagca

SEQ ID NO: 4164816 - RNA, 15 nt, Yersinia pestis
guacggugccagcag

SEQ ID NO: 4164817 - RNA, 17 nt, Yersinia pestis
guacggugccagcagca

SEQ ID NO: 4164818 - RNA, 20 nt, Yersinia pestis
guacguagcgauaacagaua

SEQ ID NO: 4164819 - RNA, 17 nt, Yersinia pestis
guacguuggcgacgcuc

SEQ ID NO: 4164820 - RNA, 23 nt, Yersinia pestis
guacucauauuguccaaaggaag

SEQ ID NO: 4164821 - RNA, 17 nt, Yersinia pestis
guacuccucgccgguaa

SEQ ID NO: 4164822 - RNA, 24 nt, Yersinia pestis
guacugaucauuauuauccuccca

SEQ ID NO: 4164823 - RNA, 23 nt, Yersinia pestis
guacugauuauuuggugaguaaa

SEQ ID NO: 4164824 - RNA, 16 nt, Yersinia pestis
guacugcugcaacuca

SEQ ID NO: 4164825 - RNA, 18 nt, Yersinia pestis
guacugggaugaagaaau

SEQ ID NO: 4164826 - RNA, 18 nt, Yersinia pestis
guacuguuaguucagacg

SEQ ID NO: 4164827 - RNA, 12 nt, Yersinia pestis
guacuguugaug

SEQ ID NO: 4164828 - RNA, 13 nt, Yersinia pestis
guacuguugaugc

SEQ ID NO: 4164829 - RNA, 20 nt, Yersinia pestis
guacuguugaugcagaugac

SEQ ID NO: 4164830 - RNA, 11 nt, Yersinia pestis
guacuuaacgu

SEQ ID NO: 4164831 - RNA, 13 nt, Yersinia pestis
guacuuagcaaua

SEQ ID NO: 4164832 - RNA, 22 nt, Yersinia pestis
guacuuccaauaagugauucga

SEQ ID NO: 4164833 - RNA, 13 nt, Yersinia pestis
guacuuggucacu

SEQ ID NO: 4164834 - RNA, 20 nt, Yersinia pestis
guacuuugauucaaaaugcc

SEQ ID NO: 4164835 - RNA, 17 nt, Yersinia pestis
guacuuugcgaaagacg

SEQ ID NO: 4164836 - RNA, 19 nt, Yersinia pestis
guagacgacacaaaugcug

SEQ ID NO: 4164837 - RNA, 18 nt, Yersinia pestis
guagagcguagacuaaau

SEQ ID NO: 4164838 - RNA, 22 nt, Yersinia pestis
guagaggcuuuaaucugcauca

SEQ ID NO: 4164839 - RNA, 17 nt, Yersinia pestis
guagauaauuucuacgc

SEQ ID NO: 4164840 - RNA, 22 nt, Yersinia pestis
guagaucccgugugauuuccau

SEQ ID NO: 4164841 - RNA, 17 nt, Yersinia pestis
guagauuuaaccccaau

SEQ ID NO: 4164842 - RNA, 20 nt, Yersinia pestis
guagauuuucucaggcacau

SEQ ID NO: 4164843 - RNA, 12 nt, Yersinia pestis
guagcaaauaac

SEQ ID NO: 4164844 - RNA, 14 nt, Yersinia pestis
guagcacuccagau

SEQ ID NO: 4164845 - RNA, 20 nt, Yersinia pestis
guagcagcccaacacuuuua

SEQ ID NO: 4164846 - RNA, 14 nt, Yersinia pestis
guagcccacugaca

SEQ ID NO: 4164847 - RNA, 14 nt, Yersinia pestis
guagcccuuugcuu

SEQ ID NO: 4164848 - RNA, 16 nt, Yersinia pestis
guagccugcacggcuc

SEQ ID NO: 4164849 - RNA, 12 nt, Yersinia pestis
guagcuaauaaa

SEQ ID NO: 4164850 - RNA, 14 nt, Yersinia pestis
guagcucagcuggu

SEQ ID NO: 4164851 - RNA, 21 nt, Yersinia pestis
guagcuccgcagcuaauguug

SEQ ID NO: 4164852 - RNA, 13 nt, Yersinia pestis
guagcuuaucccc

SEQ ID NO: 4164853 - RNA, 19 nt, Yersinia pestis
guaggaaaauagcggaaga

SEQ ID NO: 4164854 - RNA, 21 nt, Yersinia pestis
guaggcaauacaccgccagua

SEQ ID NO: 4164855 - RNA, 19 nt, Yersinia pestis
guaggcaucucugaagccu

SEQ ID NO: 4164856 - RNA, 13 nt, Yersinia pestis
guaggcaucugcc

SEQ ID NO: 4164857 - RNA, 23 nt, Yersinia pestis
guaggggccaccaaauaaaacaa

SEQ ID NO: 4164858 - RNA, 14 nt, Yersinia pestis
guagguuucugggc

SEQ ID NO: 4164859 - RNA, 13 nt, Yersinia pestis
guaguaaccacac

SEQ ID NO: 4164860 - RNA, 20 nt, Yersinia pestis
guaguauuaacgaaauacuc

SEQ ID NO: 4164861 - RNA, 23 nt, Yersinia pestis
guagucauacaaaaugagccugu

SEQ ID NO: 4164862 - RNA, 19 nt, Yersinia pestis
guagugaagauaauaacgg

SEQ ID NO: 4164863 - RNA, 17 nt, Yersinia pestis
guaguuacagcaaauac

SEQ ID NO: 4164864 - RNA, 12 nt, Yersinia pestis
guaguuuugcau

SEQ ID NO: 4164865 - RNA, 14 nt, Yersinia pestis
guauaaaaauagcc

SEQ ID NO: 4164866 - RNA, 16 nt, Yersinia pestis
guauaaaaauagccuu

SEQ ID NO: 4164867 - RNA, 16 nt, Yersinia pestis
guauaaauagccugua

SEQ ID NO: 4164868 - RNA, 23 nt, Yersinia pestis
guauaacgaucaguuugccuugu

SEQ ID NO: 4164869 - RNA, 16 nt, Yersinia pestis
guauaacucaucagua

SEQ ID NO: 4164870 - RNA, 17 nt, Yersinia pestis
guauaacucaucaguaa

SEQ ID NO: 4164871 - RNA, 19 nt, Yersinia pestis
guauacaauugccugauuu

SEQ ID NO: 4164872 - RNA, 20 nt, Yersinia pestis
guauacaugccucugcuaac

SEQ ID NO: 4164873 - RNA, 20 nt, Yersinia pestis
guauacauuauuauuuacaa

SEQ ID NO: 4164874 - RNA, 23 nt, Yersinia pestis
guauacauuauuauuuacaaacc

SEQ ID NO: 4164875 - RNA, 14 nt, Yersinia pestis
guauaccccugcuc

SEQ ID NO: 4164876 - RNA, 20 nt, Yersinia pestis
guauaccccugcucacgcaa

SEQ ID NO: 4164877 - RNA, 20 nt, Yersinia pestis
guauacccgccgcaucuaaa

SEQ ID NO: 4164878 - RNA, 23 nt, Yersinia pestis
guauacuaaaacagcucacucgg

SEQ ID NO: 4164879 - RNA, 13 nt, Yersinia pestis
guauagcaugaau

SEQ ID NO: 4164880 - RNA, 13 nt, Yersinia pestis
guauagcggcggg

SEQ ID NO: 4164881 - RNA, 16 nt, Yersinia pestis
guauauaccugucaua

SEQ ID NO: 4164882 - RNA, 18 nt, Yersinia pestis
guauaucacuucugcugu

SEQ ID NO: 4164883 - RNA, 21 nt, Yersinia pestis
guauauguugggaaauaacca

SEQ ID NO: 4164884 - RNA, 17 nt, Yersinia pestis
guauauuggccugcaca

SEQ ID NO: 4164885 - RNA, 23 nt, Yersinia pestis
guaucaaaacgccagauaugauc

SEQ ID NO: 4164886 - RNA, 20 nt, Yersinia pestis
guaucaacucugaugaaauc

SEQ ID NO: 4164887 - RNA, 23 nt, Yersinia pestis
guaucagccccuaaauccugcaa

SEQ ID NO: 4164888 - RNA, 13 nt, Yersinia pestis
guaucagcggcgu

SEQ ID NO: 4164889 - RNA, 14 nt, Yersinia pestis
guaucauggaagac

SEQ ID NO: 4164890 - RNA, 13 nt, Yersinia pestis
guauccagcagcg

SEQ ID NO: 4164891 - RNA, 16 nt, Yersinia pestis
guauccagcagcgcug

SEQ ID NO: 4164892 - RNA, 17 nt, Yersinia pestis
guauccagcagcgcugg

SEQ ID NO: 4164893 - RNA, 14 nt, Yersinia pestis
guauccaucugaug

SEQ ID NO: 4164894 - RNA, 19 nt, Yersinia pestis
guaucccuggcucaucaaa

SEQ ID NO: 4164895 - RNA, 19 nt, Yersinia pestis
guauccguuaucgcgccuu

SEQ ID NO: 4164896 - RNA, 14 nt, Yersinia pestis
guauccuuagccaa

SEQ ID NO: 4164897 - RNA, 22 nt, Yersinia pestis
guaucgaauugaucugauauua

SEQ ID NO: 4164898 - RNA, 22 nt, Yersinia pestis
guaucgcccuggcuaauuuuau

SEQ ID NO: 4164899 - RNA, 16 nt, Yersinia pestis
guaucgcuaucaccgg

SEQ ID NO: 4164900 - RNA, 16 nt, Yersinia pestis
guaucgcuuucagcag

SEQ ID NO: 4164901 - RNA, 19 nt, Yersinia pestis
guaucggccaauucagcaa

SEQ ID NO: 4164902 - RNA, 19 nt, Yersinia pestis
guaucgucaagcaauggca

SEQ ID NO: 4164903 - RNA, 23 nt, Yersinia pestis
guaucuacccacuccccgucagc

SEQ ID NO: 4164904 - RNA, 23 nt, Yersinia pestis
guaucugggguauaacgcucgcc

SEQ ID NO: 4164905 - RNA, 18 nt, Yersinia pestis
guaucuguuuuugccacc

SEQ ID NO: 4164906 - RNA, 24 nt, Yersinia pestis
guaucuucauccgcuccagccugg

SEQ ID NO: 4164907 - RNA, 19 nt, Yersinia pestis
guaugauauugaugacgcu

SEQ ID NO: 4164908 - RNA, 22 nt, Yersinia pestis
guauggcuugcucaauaccauu

SEQ ID NO: 4164909 - RNA, 21 nt, Yersinia pestis
guauuaauauaauacuuaagu

SEQ ID NO: 4164910 - RNA, 17 nt, Yersinia pestis
guauuaccaaucagcgc

SEQ ID NO: 4164911 - RNA, 16 nt, Yersinia pestis
guauuaguuucaaaua

SEQ ID NO: 4164912 - RNA, 21 nt, Yersinia pestis
guauucaaaauagaaaagcgc

SEQ ID NO: 4164913 - RNA, 16 nt, Yersinia pestis
guauucaguaaaaacu

SEQ ID NO: 4164914 - RNA, 17 nt, Yersinia pestis
guauucauaucgcuaaa

SEQ ID NO: 4164915 - RNA, 20 nt, Yersinia pestis
guauucauaucgcuaaaaca

SEQ ID NO: 4164916 - RNA, 20 nt, Yersinia pestis
guauuccgagcaaucaaaag

SEQ ID NO: 4164917 - RNA, 14 nt, Yersinia pestis
guauuccugccugg

SEQ ID NO: 4164918 - RNA, 18 nt, Yersinia pestis
guauucgacauggauggu

SEQ ID NO: 4164919 - RNA, 18 nt, Yersinia pestis
guauucuuaucaaucaaa

SEQ ID NO: 4164920 - RNA, 13 nt, Yersinia pestis
guauucuugauuc

SEQ ID NO: 4164921 - RNA, 14 nt, Yersinia pestis
guauugaagauacc

SEQ ID NO: 4164922 - RNA, 22 nt, Yersinia pestis
guauugacacaauagaugcagu

SEQ ID NO: 4164923 - RNA, 20 nt, Yersinia pestis
guauugagcgcgguaacuaa

SEQ ID NO: 4164924 - RNA, 17 nt, Yersinia pestis
guauugauaaaaauauc

SEQ ID NO: 4164925 - RNA, 15 nt, Yersinia pestis
guauugaugcaguga

SEQ ID NO: 4164926 - RNA, 13 nt, Yersinia pestis
guauugaugcaug

SEQ ID NO: 4164927 - RNA, 12 nt, Yersinia pestis
guauugcucagg

SEQ ID NO: 4164928 - RNA, 21 nt, Yersinia pestis
guauugcugaguaaauuaaau

SEQ ID NO: 4164929 - RNA, 21 nt, Yersinia pestis
guauugcuguucgccagauua

SEQ ID NO: 4164930 - RNA, 17 nt, Yersinia pestis
guauuggaaaaaucagu

SEQ ID NO: 4164931 - RNA, 20 nt, Yersinia pestis
guauuggcuaacuggcgcug

SEQ ID NO: 4164932 - RNA, 19 nt, Yersinia pestis
guauuggcugcuuucguuc

SEQ ID NO: 4164933 - RNA, 22 nt, Yersinia pestis
guauugguaacgcagaaauauu

SEQ ID NO: 4164934 - RNA, 19 nt, Yersinia pestis
guauuguauacaugccucu

SEQ ID NO: 4164935 - RNA, 13 nt, Yersinia pestis
guauuuacggcgu

SEQ ID NO: 4164936 - RNA, 11 nt, Yersinia pestis
guauuuccugu

SEQ ID NO: 4164937 - RNA, 13 nt, Yersinia pestis
guauuuccuguau

SEQ ID NO: 4164938 - RNA, 19 nt, Yersinia pestis
guauuuccuguauuuccug

SEQ ID NO: 4164939 - RNA, 20 nt, Yersinia pestis
guauuuccuguauuuccugu

SEQ ID NO: 4164940 - RNA, 22 nt, Yersinia pestis
guauuugcuucgcugggcugcc

SEQ ID NO: 4164941 - RNA, 15 nt, Yersinia pestis
guauuugggccaccg

SEQ ID NO: 4164942 - RNA, 16 nt, Yersinia pestis
guauuuuucgcaguaa

SEQ ID NO: 4164943 - RNA, 19 nt, Yersinia pestis
gucaaaaacccauuaaaaa

SEQ ID NO: 4164944 - RNA, 14 nt, Yersinia pestis
gucaacgauuguua

SEQ ID NO: 4164945 - RNA, 14 nt, Yersinia pestis
gucaacuaaacaga

SEQ ID NO: 4164946 - RNA, 15 nt, Yersinia pestis
gucaagccaaccccc

SEQ ID NO: 4164947 - RNA, 23 nt, Yersinia pestis
gucaauaaccucacgggcuucca

SEQ ID NO: 4164948 - RNA, 20 nt, Yersinia pestis
gucaauaaccucagccucau

SEQ ID NO: 4164949 - RNA, 21 nt, Yersinia pestis
gucaauaaccucaggcccgcu

SEQ ID NO: 4164950 - RNA, 14 nt, Yersinia pestis
gucaauaccuuacu

SEQ ID NO: 4164951 - RNA, 16 nt, Yersinia pestis
gucaauaccuuacugu

SEQ ID NO: 4164952 - RNA, 16 nt, Yersinia pestis
gucaauaucaucaucu

SEQ ID NO: 4164953 - RNA, 22 nt, Yersinia pestis
gucaaucacuggcaauaauuca

SEQ ID NO: 4164954 - RNA, 20 nt, Yersinia pestis
gucaaucauuuuuuuauuaa

SEQ ID NO: 4164955 - RNA, 18 nt, Yersinia pestis
gucaauccaaucauucug

SEQ ID NO: 4164956 - RNA, 16 nt, Yersinia pestis
gucaaucgcucuucac

SEQ ID NO: 4164957 - RNA, 20 nt, Yersinia pestis
gucaaucuagaacuauuggu

SEQ ID NO: 4164958 - RNA, 18 nt, Yersinia pestis
gucaaucuuauugaaaac

SEQ ID NO: 4164959 - RNA, 12 nt, Yersinia pestis
gucaauuaaaaa

SEQ ID NO: 4164960 - RNA, 23 nt, Yersinia pestis
gucaauuuuugccuuucugggcu

SEQ ID NO: 4164961 - RNA, 14 nt, Yersinia pestis
gucacaauagucuc

SEQ ID NO: 4164962 - RNA, 23 nt, Yersinia pestis
gucacaccagacagaauauccag

SEQ ID NO: 4164963 - RNA, 17 nt, Yersinia pestis
gucacagaggaaucaaa

SEQ ID NO: 4164964 - RNA, 22 nt, Yersinia pestis
gucacagaggaaucaaagagcg

SEQ ID NO: 4164965 - RNA, 18 nt, Yersinia pestis
gucacaguaaaucaggcc

SEQ ID NO: 4164966 - RNA, 23 nt, Yersinia pestis
gucaccaaaaucccaaaauauga

SEQ ID NO: 4164967 - RNA, 19 nt, Yersinia pestis
gucaccaacggccccucag

SEQ ID NO: 4164968 - RNA, 16 nt, Yersinia pestis
gucaccacaaagguca

SEQ ID NO: 4164969 - RNA, 21 nt, Yersinia pestis
gucaccacggcuuucaauaaa

SEQ ID NO: 4164970 - RNA, 22 nt, Yersinia pestis
gucaccaucaauauaagagaaa

SEQ ID NO: 4164971 - RNA, 12 nt, Yersinia pestis
gucaccaucuug

SEQ ID NO: 4164972 - RNA, 21 nt, Yersinia pestis
gucacccaaccgaccaaaggc

SEQ ID NO: 4164973 - RNA, 19 nt, Yersinia pestis
gucaccgaacucgauaaua

SEQ ID NO: 4164974 - RNA, 20 nt, Yersinia pestis
gucaccgauacuuccagugg

SEQ ID NO: 4164975 - RNA, 13 nt, Yersinia pestis
gucaccgcaggcc

SEQ ID NO: 4164976 - RNA, 17 nt, Yersinia pestis
gucaccgccaaaugaaa

SEQ ID NO: 4164977 - RNA, 13 nt, Yersinia pestis
gucaccuaccacc

SEQ ID NO: 4164978 - RNA, 19 nt, Yersinia pestis
gucaccuagauaaucaagu

SEQ ID NO: 4164979 - RNA, 16 nt, Yersinia pestis
gucaccugaaccugac

SEQ ID NO: 4164980 - RNA, 23 nt, Yersinia pestis
gucaccugaaugccauucaagcc

SEQ ID NO: 4164981 - RNA, 20 nt, Yersinia pestis
gucaccugucaccuaccacc

SEQ ID NO: 4164982 - RNA, 21 nt, Yersinia pestis
gucaccugucaccugucaccu

SEQ ID NO: 4164983 - RNA, 14 nt, Yersinia pestis
gucaccuuucuuga

SEQ ID NO: 4164984 - RNA, 22 nt, Yersinia pestis
gucacgcggcggcgucaaauua

SEQ ID NO: 4164985 - RNA, 15 nt, Yersinia pestis
gucacguacugggug

SEQ ID NO: 4164986 - RNA, 17 nt, Yersinia pestis
gucacuaaaacugaagc

SEQ ID NO: 4164987 - RNA, 20 nt, Yersinia pestis
gucacuaaauccaaaugccc

SEQ ID NO: 4164988 - RNA, 17 nt, Yersinia pestis
gucacuauucccauggu

SEQ ID NO: 4164989 - RNA, 21 nt, Yersinia pestis
gucacucaagccaguaacuac

SEQ ID NO: 4164990 - RNA, 14 nt, Yersinia pestis
gucacucaauugga

SEQ ID NO: 4164991 - RNA, 14 nt, Yersinia pestis
gucacucagaaaac

SEQ ID NO: 4164992 - RNA, 17 nt, Yersinia pestis
gucacucagaaaacagc

SEQ ID NO: 4164993 - RNA, 19 nt, Yersinia pestis
gucacugaugcuuggcccg

SEQ ID NO: 4164994 - RNA, 11 nt, Yersinia pestis
gucacuggcca

SEQ ID NO: 4164995 - RNA, 13 nt, Yersinia pestis
gucacugucagac

SEQ ID NO: 4164996 - RNA, 18 nt, Yersinia pestis
gucacugucagacaguuc

SEQ ID NO: 4164997 - RNA, 17 nt, Yersinia pestis
gucacuuaaauaacuca

SEQ ID NO: 4164998 - RNA, 22 nt, Yersinia pestis
gucacuucucugacacacaaau

SEQ ID NO: 4164999 - RNA, 13 nt, Yersinia pestis
gucagaaccugca

SEQ ID NO: 4165000 - RNA, 16 nt, Yersinia pestis
gucagaaccuguuaca

SEQ ID NO: 4165001 - RNA, 21 nt, Yersinia pestis
gucagaugcugacgggcgcgg

SEQ ID NO: 4165002 - RNA, 19 nt, Yersinia pestis
gucagauuaguuuuagaug

SEQ ID NO: 4165003 - RNA, 14 nt, Yersinia pestis
gucagcaaaucaaa

SEQ ID NO: 4165004 - RNA, 22 nt, Yersinia pestis
gucagcacaaacagcuuuuuaa

SEQ ID NO: 4165005 - RNA, 19 nt, Yersinia pestis
gucagcagucugacaccgg

SEQ ID NO: 4165006 - RNA, 17 nt, Yersinia pestis
gucagccaccguguccg

SEQ ID NO: 4165007 - RNA, 17 nt, Yersinia pestis
gucagccauugagcgaa

SEQ ID NO: 4165008 - RNA, 10 nt, Yersinia pestis
gucagcccaa

SEQ ID NO: 4165009 - RNA, 18 nt, Yersinia pestis
gucagccgcgaaaaacca

SEQ ID NO: 4165010 - RNA, 16 nt, Yersinia pestis
gucaggaaacuggcca

SEQ ID NO: 4165011 - RNA, 12 nt, Yersinia pestis
gucaggaagaga

SEQ ID NO: 4165012 - RNA, 16 nt, Yersinia pestis
gucagggcuaagcagg

SEQ ID NO: 4165013 - RNA, 14 nt, Yersinia pestis
gucagggugaaagc

SEQ ID NO: 4165014 - RNA, 16 nt, Yersinia pestis
gucagguaaguagaau

SEQ ID NO: 4165015 - RNA, 19 nt, Yersinia pestis
gucagguuaauaccugcac

SEQ ID NO: 4165016 - RNA, 14 nt, Yersinia pestis
gucaguaaugaauu

SEQ ID NO: 4165017 - RNA, 16 nt, Yersinia pestis
gucaguaauucacccu

SEQ ID NO: 4165018 - RNA, 22 nt, Yersinia pestis
gucaguacggaaucauaaaagc

SEQ ID NO: 4165019 - RNA, 18 nt, Yersinia pestis
gucagucaaugagccugc

SEQ ID NO: 4165020 - RNA, 15 nt, Yersinia pestis
gucagugaaaaauga

SEQ ID NO: 4165021 - RNA, 18 nt, Yersinia pestis
gucagugcggccaccuau

SEQ ID NO: 4165022 - RNA, 16 nt, Yersinia pestis
gucagugcuauucaua

SEQ ID NO: 4165023 - RNA, 15 nt, Yersinia pestis
gucagugcuccaucu

SEQ ID NO: 4165024 - RNA, 12 nt, Yersinia pestis
gucagugguggu

SEQ ID NO: 4165025 - RNA, 19 nt, Yersinia pestis
gucagugguuuuaucaaua

SEQ ID NO: 4165026 - RNA, 23 nt, Yersinia pestis
gucaguguuucggcauugagcac

SEQ ID NO: 4165027 - RNA, 23 nt, Yersinia pestis
gucaguugaauauuccauuuguc

SEQ ID NO: 4165028 - RNA, 14 nt, Yersinia pestis
gucaguuuagcgag

SEQ ID NO: 4165029 - RNA, 20 nt, Yersinia pestis
gucaguuuuggcuugaaagc

SEQ ID NO: 4165030 - RNA, 19 nt, Yersinia pestis
gucauaaauaaagauaccc

SEQ ID NO: 4165031 - RNA, 15 nt, Yersinia pestis
gucauaaauauuuua

SEQ ID NO: 4165032 - RNA, 20 nt, Yersinia pestis
gucauacaaaaugagccugu

SEQ ID NO: 4165033 - RNA, 12 nt, Yersinia pestis
gucauaccauuc

SEQ ID NO: 4165034 - RNA, 20 nt, Yersinia pestis
gucauaccggcggcacacug

SEQ ID NO: 4165035 - RNA, 22 nt, Yersinia pestis
gucauaucgaucaaccauucau

SEQ ID NO: 4165036 - RNA, 13 nt, Yersinia pestis
gucaucaaccucg

SEQ ID NO: 4165037 - RNA, 17 nt, Yersinia pestis
gucaucacccagcaaaa

SEQ ID NO: 4165038 - RNA, 18 nt, Yersinia pestis
gucaucaccguuucuaug

SEQ ID NO: 4165039 - RNA, 21 nt, Yersinia pestis
gucaucacuaacgacagauua

SEQ ID NO: 4165040 - RNA, 14 nt, Yersinia pestis
gucaucagcauccg

SEQ ID NO: 4165041 - RNA, 21 nt, Yersinia pestis
gucaucagcgccuuugccccg

SEQ ID NO: 4165042 - RNA, 17 nt, Yersinia pestis
gucauccuucaaguugu

SEQ ID NO: 4165043 - RNA, 20 nt, Yersinia pestis
gucaucgaagagugcauuga

SEQ ID NO: 4165044 - RNA, 20 nt, Yersinia pestis
gucaucgccuucuggcaaac

SEQ ID NO: 4165045 - RNA, 20 nt, Yersinia pestis
gucaucgcggcgcacaucau

SEQ ID NO: 4165046 - RNA, 18 nt, Yersinia pestis
gucaucgggguuugucag

SEQ ID NO: 4165047 - RNA, 17 nt, Yersinia pestis
gucaucggguuuugucg

SEQ ID NO: 4165048 - RNA, 13 nt, Yersinia pestis
gucaugaaaaucu

SEQ ID NO: 4165049 - RNA, 20 nt, Yersinia pestis
gucaugauagacagcaaacg

SEQ ID NO: 4165050 - RNA, 16 nt, Yersinia pestis
gucaugcaauuacugc

SEQ ID NO: 4165051 - RNA, 18 nt, Yersinia pestis
gucaugcaauuacugcau

SEQ ID NO: 4165052 - RNA, 13 nt, Yersinia pestis
gucaugcggccuu

SEQ ID NO: 4165053 - RNA, 17 nt, Yersinia pestis
gucaugcggccuuccaa

SEQ ID NO: 4165054 - RNA, 15 nt, Yersinia pestis
gucaugcucacaauc

SEQ ID NO: 4165055 - RNA, 16 nt, Yersinia pestis
gucaugguacaacugc

SEQ ID NO: 4165056 - RNA, 12 nt, Yersinia pestis
gucauuaacaca

SEQ ID NO: 4165057 - RNA, 20 nt, Yersinia pestis
gucauuaccgcacacuacag

SEQ ID NO: 4165058 - RNA, 13 nt, Yersinia pestis
gucauuauuaaac

SEQ ID NO: 4165059 - RNA, 15 nt, Yersinia pestis
gucauuccaaccuug

SEQ ID NO: 4165060 - RNA, 17 nt, Yersinia pestis
gucauugguguuacagc

SEQ ID NO: 4165061 - RNA, 20 nt, Yersinia pestis
gucauugguuaacuuauagc

SEQ ID NO: 4165062 - RNA, 14 nt, Yersinia pestis
gucauuuacugaug

SEQ ID NO: 4165063 - RNA, 21 nt, Yersinia pestis
gucauuuccguuaacccaaag

SEQ ID NO: 4165064 - RNA, 12 nt, Yersinia pestis
gucauuuccugu

SEQ ID NO: 4165065 - RNA, 14 nt, Yersinia pestis
gucauuuccuguau

SEQ ID NO: 4165066 - RNA, 21 nt, Yersinia pestis
gucauuuccuguauuuccugu

SEQ ID NO: 4165067 - RNA, 15 nt, Yersinia pestis
gucauuugcgcaaua

SEQ ID NO: 4165068 - RNA, 20 nt, Yersinia pestis
gucauuuuauuuaggcuaca

SEQ ID NO: 4165069 - RNA, 21 nt, Yersinia pestis
guccaacauguugaaaucuau

SEQ ID NO: 4165070 - RNA, 20 nt, Yersinia pestis
guccaagaagauaacuuuuu

SEQ ID NO: 4165071 - RNA, 14 nt, Yersinia pestis
guccaagaagccaa

SEQ ID NO: 4165072 - RNA, 15 nt, Yersinia pestis
guccaaguaauaaaa

SEQ ID NO: 4165073 - RNA, 23 nt, Yersinia pestis
guccacaacaccacuuugcugug

SEQ ID NO: 4165074 - RNA, 19 nt, Yersinia pestis
guccacuuucaccaaacca

SEQ ID NO: 4165075 - RNA, 14 nt, Yersinia pestis
guccagaucggcaa

SEQ ID NO: 4165076 - RNA, 14 nt, Yersinia pestis
guccagcccaccau

SEQ ID NO: 4165077 - RNA, 21 nt, Yersinia pestis
guccaguuuuucccguaacuu

SEQ ID NO: 4165078 - RNA, 15 nt, Yersinia pestis
guccauaaucuggaa

SEQ ID NO: 4165079 - RNA, 17 nt, Yersinia pestis
guccauaaugagguuau

SEQ ID NO: 4165080 - RNA, 12 nt, Yersinia pestis
guccauaauucu

SEQ ID NO: 4165081 - RNA, 16 nt, Yersinia pestis
guccauaauucugugu

SEQ ID NO: 4165082 - RNA, 20 nt, Yersinia pestis
gucccaaacucuggaugggu

SEQ ID NO: 4165083 - RNA, 13 nt, Yersinia pestis
gucccaagaaaag

SEQ ID NO: 4165084 - RNA, 21 nt, Yersinia pestis
guccccgagaggcuauuuauc

SEQ ID NO: 4165085 - RNA, 18 nt, Yersinia pestis
gucccgacuuuggcgcgc

SEQ ID NO: 4165086 - RNA, 18 nt, Yersinia pestis
gucccuaaagccaucgcc

SEQ ID NO: 4165087 - RNA, 23 nt, Yersinia pestis
gucccuacgguaccgcaggucag

SEQ ID NO: 4165088 - RNA, 15 nt, Yersinia pestis
guccuggccaaagcc

SEQ ID NO: 4165089 - RNA, 15 nt, Yersinia pestis
guccuguuguggugg

SEQ ID NO: 4165090 - RNA, 14 nt, Yersinia pestis
guccuuaaagacca

SEQ ID NO: 4165091 - RNA, 19 nt, Yersinia pestis
guccuuuaacucaauuuug

SEQ ID NO: 4165092 - RNA, 22 nt, Yersinia pestis
gucgauaaacaucaugacaaaa

SEQ ID NO: 4165093 - RNA, 19 nt, Yersinia pestis
gucgauaaccagagucagu

SEQ ID NO: 4165094 - RNA, 14 nt, Yersinia pestis
gucgaucauggcaa

SEQ ID NO: 4165095 - RNA, 17 nt, Yersinia pestis
gucgaucgcuuuuuaca

SEQ ID NO: 4165096 - RNA, 21 nt, Yersinia pestis
gucgaugaccugcugcaccuc

SEQ ID NO: 4165097 - RNA, 20 nt, Yersinia pestis
gucgcacccaaacugucugc

SEQ ID NO: 4165098 - RNA, 20 nt, Yersinia pestis
gucgcauaagacaacgccgc

SEQ ID NO: 4165099 - RNA, 20 nt, Yersinia pestis
gucgccaacauuuauuuauc

SEQ ID NO: 4165100 - RNA, 20 nt, Yersinia pestis
gucgcgggcacuuugucaau

SEQ ID NO: 4165101 - RNA, 16 nt, Yersinia pestis
gucgcguuggcuaaaa

SEQ ID NO: 4165102 - RNA, 15 nt, Yersinia pestis
gucgcugaaaugcua

SEQ ID NO: 4165103 - RNA, 16 nt, Yersinia pestis
gucggcauuaaaagca

SEQ ID NO: 4165104 - RNA, 19 nt, Yersinia pestis
gucggcauuaaaagcaugc

SEQ ID NO: 4165105 - RNA, 23 nt, Yersinia pestis
gucggccagcgcuaacgguggca

SEQ ID NO: 4165106 - RNA, 15 nt, Yersinia pestis
gucggccgaaaggua

SEQ ID NO: 4165107 - RNA, 22 nt, Yersinia pestis
gucgggcgcugagcgggcggca

SEQ ID NO: 4165108 - RNA, 22 nt, Yersinia pestis
gucgguaaccugaaagucagga

SEQ ID NO: 4165109 - RNA, 21 nt, Yersinia pestis
gucggugacucgggucaguga

SEQ ID NO: 4165110 - RNA, 13 nt, Yersinia pestis
gucgucagcgaca

SEQ ID NO: 4165111 - RNA, 20 nt, Yersinia pestis
gucguggaguagagcuucca

SEQ ID NO: 4165112 - RNA, 20 nt, Yersinia pestis
gucguuauaaaccaaauggu

SEQ ID NO: 4165113 - RNA, 18 nt, Yersinia pestis
gucuaagugccaguuaau

SEQ ID NO: 4165114 - RNA, 12 nt, Yersinia pestis
gucuacgcucuc

SEQ ID NO: 4165115 - RNA, 22 nt, Yersinia pestis
gucuagcgcaguacucaccgcc

SEQ ID NO: 4165116 - RNA, 14 nt, Yersinia pestis
gucuauaaaaccgu

SEQ ID NO: 4165117 - RNA, 21 nt, Yersinia pestis
gucuauuuucauuauuuucaa

SEQ ID NO: 4165118 - RNA, 22 nt, Yersinia pestis
gucuauuuuuauaaucaucuac

SEQ ID NO: 4165119 - RNA, 12 nt, Yersinia pestis
gucucaaggccu

SEQ ID NO: 4165120 - RNA, 14 nt, Yersinia pestis
gucucuauucacua

SEQ ID NO: 4165121 - RNA, 13 nt, Yersinia pestis
gucucuauuggcu

SEQ ID NO: 4165122 - RNA, 17 nt, Yersinia pestis
gucucuguggauugcca

SEQ ID NO: 4165123 - RNA, 18 nt, Yersinia pestis
gucucuuucgggcaaaaa

SEQ ID NO: 4165124 - RNA, 21 nt, Yersinia pestis
gucucuuucgggcaaaaaaau

SEQ ID NO: 4165125 - RNA, 15 nt, Yersinia pestis
gucugaaacgccagc

SEQ ID NO: 4165126 - RNA, 18 nt, Yersinia pestis
gucugaauaccgcuggcg

SEQ ID NO: 4165127 - RNA, 23 nt, Yersinia pestis
gucugaauauaaauuuaauaaaa

SEQ ID NO: 4165128 - RNA, 20 nt, Yersinia pestis
gucugacggguauaucacuu

SEQ ID NO: 4165129 - RNA, 16 nt, Yersinia pestis
gucugagccucaugaa

SEQ ID NO: 4165130 - RNA, 13 nt, Yersinia pestis
gucugauaaccgu

SEQ ID NO: 4165131 - RNA, 16 nt, Yersinia pestis
gucugcaauagcucau

SEQ ID NO: 4165132 - RNA, 16 nt, Yersinia pestis
gucugccagaauuuug

SEQ ID NO: 4165133 - RNA, 21 nt, Yersinia pestis
gucugcccacucaccuaaauc

SEQ ID NO: 4165134 - RNA, 15 nt, Yersinia pestis
gucugcgacaauaac

SEQ ID NO: 4165135 - RNA, 12 nt, Yersinia pestis
gucugcggccua

SEQ ID NO: 4165136 - RNA, 18 nt, Yersinia pestis
gucugcgucauaccauuc

SEQ ID NO: 4165137 - RNA, 20 nt, Yersinia pestis
gucugcuguugccacagacg

SEQ ID NO: 4165138 - RNA, 15 nt, Yersinia pestis
gucuggcaauccagc

SEQ ID NO: 4165139 - RNA, 19 nt, Yersinia pestis
gucugggacuuuaucugcc

SEQ ID NO: 4165140 - RNA, 15 nt, Yersinia pestis
gucuggugcugguaa

SEQ ID NO: 4165141 - RNA, 15 nt, Yersinia pestis
gucuguuucauucug

SEQ ID NO: 4165142 - RNA, 21 nt, Yersinia pestis
gucuguuugucacggcggccg

SEQ ID NO: 4165143 - RNA, 15 nt, Yersinia pestis
gucuuauuacucauu

SEQ ID NO: 4165144 - RNA, 14 nt, Yersinia pestis
gucuucaacuuuac

SEQ ID NO: 4165145 - RNA, 15 nt, Yersinia pestis
gucuucaguggcugg

SEQ ID NO: 4165146 - RNA, 22 nt, Yersinia pestis
gucuugacgguucgaaaauaau

SEQ ID NO: 4165147 - RNA, 16 nt, Yersinia pestis
gucuugaucaacucac

SEQ ID NO: 4165148 - RNA, 21 nt, Yersinia pestis
gucuuggucauaccggcggca

SEQ ID NO: 4165149 - RNA, 17 nt, Yersinia pestis
gucuuuaaaaucuugug

SEQ ID NO: 4165150 - RNA, 19 nt, Yersinia pestis
gucuuuacgaucugccugu

SEQ ID NO: 4165151 - RNA, 16 nt, Yersinia pestis
gucuuucgggcugaug

SEQ ID NO: 4165152 - RNA, 17 nt, Yersinia pestis
gucuuucgggcugauga

SEQ ID NO: 4165153 - RNA, 16 nt, Yersinia pestis
gucuuugagcucaccg

SEQ ID NO: 4165154 - RNA, 23 nt, Yersinia pestis
gucuuuuugggugacaacgucac

SEQ ID NO: 4165155 - RNA, 21 nt, Yersinia pestis
gugaaaccauuaacaauguua

SEQ ID NO: 4165156 - RNA, 20 nt, Yersinia pestis
gugaaacgauaugcuccaga

SEQ ID NO: 4165157 - RNA, 20 nt, Yersinia pestis
gugaaagcaucccuucgcaa

SEQ ID NO: 4165158 - RNA, 17 nt, Yersinia pestis
gugaaagggaaguuucu

SEQ ID NO: 4165159 - RNA, 16 nt, Yersinia pestis
gugaaaucgguagaca

SEQ ID NO: 4165160 - RNA, 15 nt, Yersinia pestis
gugaacaucuggcga

SEQ ID NO: 4165161 - RNA, 15 nt, Yersinia pestis
gugaaccagauaaca

SEQ ID NO: 4165162 - RNA, 19 nt, Yersinia pestis
gugaacggccaucaauaaa

SEQ ID NO: 4165163 - RNA, 14 nt, Yersinia pestis
gugaagaacagcag

SEQ ID NO: 4165164 - RNA, 18 nt, Yersinia pestis
gugaagaacagcaguggg

SEQ ID NO: 4165165 - RNA, 20 nt, Yersinia pestis
gugaagagcgauugacugaa

SEQ ID NO: 4165166 - RNA, 22 nt, Yersinia pestis
gugaagauuuuugauaauuuca

SEQ ID NO: 4165167 - RNA, 12 nt, Yersinia pestis
gugaaguuuaua

SEQ ID NO: 4165168 - RNA, 14 nt, Yersinia pestis
gugaauaaaaauaa

SEQ ID NO: 4165169 - RNA, 14 nt, Yersinia pestis
gugaauaaaucaaa

SEQ ID NO: 4165170 - RNA, 11 nt, Yersinia pestis
gugaauaacgc

SEQ ID NO: 4165171 - RNA, 19 nt, Yersinia pestis
gugaauaacugguccaacu

SEQ ID NO: 4165172 - RNA, 12 nt, Yersinia pestis
gugacaggcugc

SEQ ID NO: 4165173 - RNA, 20 nt, Yersinia pestis
gugacauccgcuugcagcaa

SEQ ID NO: 4165174 - RNA, 17 nt, Yersinia pestis
gugacauguuccagugc

SEQ ID NO: 4165175 - RNA, 13 nt, Yersinia pestis
gugacauuuucac

SEQ ID NO: 4165176 - RNA, 17 nt, Yersinia pestis
gugaccccguggcggcg

SEQ ID NO: 4165177 - RNA, 23 nt, Yersinia pestis
gugacgcuugaauauagcguuca

SEQ ID NO: 4165178 - RNA, 21 nt, Yersinia pestis
gugacggcuuuauaguccuuc

SEQ ID NO: 4165179 - RNA, 23 nt, Yersinia pestis
gugacuauucugccuauccucac

SEQ ID NO: 4165180 - RNA, 18 nt, Yersinia pestis
gugacucaucaaaacaau

SEQ ID NO: 4165181 - RNA, 13 nt, Yersinia pestis
gugacugccggga

SEQ ID NO: 4165182 - RNA, 13 nt, Yersinia pestis
gugaggaucaccg

SEQ ID NO: 4165183 - RNA, 15 nt, Yersinia pestis
gugagguggccgaga

SEQ ID NO: 4165184 - RNA, 18 nt, Yersinia pestis
gugagguuuuugauggug

SEQ ID NO: 4165185 - RNA, 23 nt, Yersinia pestis
gugaguaaacaccuucagacuga

SEQ ID NO: 4165186 - RNA, 20 nt, Yersinia pestis
gugaguaauucgcagacaga

SEQ ID NO: 4165187 - RNA, 18 nt, Yersinia pestis
gugagucagguggcuauu

SEQ ID NO: 4165188 - RNA, 15 nt, Yersinia pestis
gugagugagcgcagg

SEQ ID NO: 4165189 - RNA, 13 nt, Yersinia pestis
gugagugagcgcg

SEQ ID NO: 4165190 - RNA, 20 nt, Yersinia pestis
gugaguuaacgaguguacag

SEQ ID NO: 4165191 - RNA, 13 nt, Yersinia pestis
gugauagcgggcc

SEQ ID NO: 4165192 - RNA, 14 nt, Yersinia pestis
gugauauaaaucca

SEQ ID NO: 4165193 - RNA, 17 nt, Yersinia pestis
gugauauugggccggag

SEQ ID NO: 4165194 - RNA, 12 nt, Yersinia pestis
gugaucaucgca

SEQ ID NO: 4165195 - RNA, 15 nt, Yersinia pestis
gugaucgccgcuaau

SEQ ID NO: 4165196 - RNA, 15 nt, Yersinia pestis
gugaucgcucaggcg

SEQ ID NO: 4165197 - RNA, 15 nt, Yersinia pestis
gugaucgcugccgca

SEQ ID NO: 4165198 - RNA, 17 nt, Yersinia pestis
gugaucucguugcccug

SEQ ID NO: 4165199 - RNA, 17 nt, Yersinia pestis
gugaugacaaugcguua

SEQ ID NO: 4165200 - RNA, 15 nt, Yersinia pestis
gugaugccccgcuau

SEQ ID NO: 4165201 - RNA, 16 nt, Yersinia pestis
gugauggcggcuggaa

SEQ ID NO: 4165202 - RNA, 22 nt, Yersinia pestis
gugauuaccugagagagguuga

SEQ ID NO: 4165203 - RNA, 16 nt, Yersinia pestis
gugauuauuuaaacaa

SEQ ID NO: 4165204 - RNA, 12 nt, Yersinia pestis
gugauuccagcu

SEQ ID NO: 4165205 - RNA, 14 nt, Yersinia pestis
gugauuguuuuacg

SEQ ID NO: 4165206 - RNA, 23 nt, Yersinia pestis
gugauuuuuuucacccauguauc

SEQ ID NO: 4165207 - RNA, 16 nt, Yersinia pestis
gugcaaacuuaaaaau

SEQ ID NO: 4165208 - RNA, 16 nt, Yersinia pestis
gugcaacauuaaaaau

SEQ ID NO: 4165209 - RNA, 18 nt, Yersinia pestis
gugcaauaaauucaaaau

SEQ ID NO: 4165210 - RNA, 18 nt, Yersinia pestis
gugcaaucaagggcgaua

SEQ ID NO: 4165211 - RNA, 13 nt, Yersinia pestis
gugcaaugcagau

SEQ ID NO: 4165212 - RNA, 18 nt, Yersinia pestis
gugcacagauaggagaag

SEQ ID NO: 4165213 - RNA, 14 nt, Yersinia pestis
gugcacggcaguga

SEQ ID NO: 4165214 - RNA, 20 nt, Yersinia pestis
gugcagaacaaaagugaaac

SEQ ID NO: 4165215 - RNA, 18 nt, Yersinia pestis
gugcaucuuccaauucau

SEQ ID NO: 4165216 - RNA, 15 nt, Yersinia pestis
gugcauguaacugua

SEQ ID NO: 4165217 - RNA, 20 nt, Yersinia pestis
gugcauuaucuuuaauuuuu

SEQ ID NO: 4165218 - RNA, 13 nt, Yersinia pestis
gugccaaaaaaag

SEQ ID NO: 4165219 - RNA, 17 nt, Yersinia pestis
gugccaaaauaucuucc

SEQ ID NO: 4165220 - RNA, 23 nt, Yersinia pestis
gugccaaauggaauaaaaaguca

SEQ ID NO: 4165221 - RNA, 13 nt, Yersinia pestis
gugccaaccgguc

SEQ ID NO: 4165222 - RNA, 19 nt, Yersinia pestis
gugccaacucagcggccug

SEQ ID NO: 4165223 - RNA, 14 nt, Yersinia pestis
gugccacaacaagc

SEQ ID NO: 4165224 - RNA, 21 nt, Yersinia pestis
gugccacaacaagccucgcug

SEQ ID NO: 4165225 - RNA, 15 nt, Yersinia pestis
gugccagauccucuu

SEQ ID NO: 4165226 - RNA, 12 nt, Yersinia pestis
gugccagcagca

SEQ ID NO: 4165227 - RNA, 17 nt, Yersinia pestis
gugccauaaauaccaau

SEQ ID NO: 4165228 - RNA, 15 nt, Yersinia pestis
gugccauaucgccag

SEQ ID NO: 4165229 - RNA, 18 nt, Yersinia pestis
gugcccaacggcaaucac

SEQ ID NO: 4165230 - RNA, 23 nt, Yersinia pestis
gugcccaccguucuuauugaagg

SEQ ID NO: 4165231 - RNA, 21 nt, Yersinia pestis
gugcccuuuuugguuuucuau

SEQ ID NO: 4165232 - RNA, 18 nt, Yersinia pestis
gugccgccgauugcgcuu

SEQ ID NO: 4165233 - RNA, 13 nt, Yersinia pestis
gugccgcuggggu

SEQ ID NO: 4165234 - RNA, 14 nt, Yersinia pestis
gugccuaauaaaua

SEQ ID NO: 4165235 - RNA, 18 nt, Yersinia pestis
gugccugaauggaaaaau

SEQ ID NO: 4165236 - RNA, 18 nt, Yersinia pestis
gugcgaaauaccccucac

SEQ ID NO: 4165237 - RNA, 17 nt, Yersinia pestis
gugcgcaucagccagcc

SEQ ID NO: 4165238 - RNA, 22 nt, Yersinia pestis
gugcgccacgcagugccgauga

SEQ ID NO: 4165239 - RNA, 14 nt, Yersinia pestis
gugcgccggccugc

SEQ ID NO: 4165240 - RNA, 14 nt, Yersinia pestis
gugcgcuccauuuc

SEQ ID NO: 4165241 - RNA, 18 nt, Yersinia pestis
gugcggcauauaaccaug

SEQ ID NO: 4165242 - RNA, 21 nt, Yersinia pestis
gugcguuacucggcgcaucca

SEQ ID NO: 4165243 - RNA, 15 nt, Yersinia pestis
gugcguuuagggaca

SEQ ID NO: 4165244 - RNA, 24 nt, Yersinia pestis
gugcguuuuauucaagugcucacu

SEQ ID NO: 4165245 - RNA, 23 nt, Yersinia pestis
gugcuaaaucccaggcguucugu

SEQ ID NO: 4165246 - RNA, 14 nt, Yersinia pestis
gugcuacagcagca

SEQ ID NO: 4165247 - RNA, 16 nt, Yersinia pestis
gugcucauuaucgcag

SEQ ID NO: 4165248 - RNA, 23 nt, Yersinia pestis
gugcugaauuggaagagccugaa

SEQ ID NO: 4165249 - RNA, 15 nt, Yersinia pestis
gugcugcccaaaauc

SEQ ID NO: 4165250 - RNA, 12 nt, Yersinia pestis
gugcuguauuua

SEQ ID NO: 4165251 - RNA, 18 nt, Yersinia pestis
gugcuguuccaaccaacc

SEQ ID NO: 4165252 - RNA, 20 nt, Yersinia pestis
gugcuguuggugauauaaau

SEQ ID NO: 4165253 - RNA, 18 nt, Yersinia pestis
gugcuuacauuucaucuu

SEQ ID NO: 4165254 - RNA, 15 nt, Yersinia pestis
gugcuucagacagua

SEQ ID NO: 4165255 - RNA, 21 nt, Yersinia pestis
gugcuugcggaauuucuucua

SEQ ID NO: 4165256 - RNA, 19 nt, Yersinia pestis
gugcuuuauccaauggcuc

SEQ ID NO: 4165257 - RNA, 12 nt, Yersinia pestis
gugcuuugccau

SEQ ID NO: 4165258 - RNA, 14 nt, Yersinia pestis
gugcuuugccuucu

SEQ ID NO: 4165259 - RNA, 19 nt, Yersinia pestis
gugcuuuucuuaauaccua

SEQ ID NO: 4165260 - RNA, 22 nt, Yersinia pestis
guggagagaaaggcuuugccug

SEQ ID NO: 4165261 - RNA, 17 nt, Yersinia pestis
guggaguaguucuuggg

SEQ ID NO: 4165262 - RNA, 15 nt, Yersinia pestis
guggauaaacaaaua

SEQ ID NO: 4165263 - RNA, 19 nt, Yersinia pestis
guggauaauuucagcagca

SEQ ID NO: 4165264 - RNA, 16 nt, Yersinia pestis
guggauccagcaccac

SEQ ID NO: 4165265 - RNA, 14 nt, Yersinia pestis
guggauugccaaau

SEQ ID NO: 4165266 - RNA, 12 nt, Yersinia pestis
guggcacaaggc

SEQ ID NO: 4165267 - RNA, 15 nt, Yersinia pestis
guggcacgcugcaug

SEQ ID NO: 4165268 - RNA, 12 nt, Yersinia pestis
guggcacugacg

SEQ ID NO: 4165269 - RNA, 16 nt, Yersinia pestis
guggcagauuggcuug

SEQ ID NO: 4165270 - RNA, 16 nt, Yersinia pestis
guggcauaaucaacgc

SEQ ID NO: 4165271 - RNA, 21 nt, Yersinia pestis
guggccaguaacgcuucauca

SEQ ID NO: 4165272 - RNA, 12 nt, Yersinia pestis
guggccauuacg

SEQ ID NO: 4165273 - RNA, 16 nt, Yersinia pestis
guggccgccgcgguga

SEQ ID NO: 4165274 - RNA, 23 nt, Yersinia pestis
guggccugguugcccugaagcaa

SEQ ID NO: 4165275 - RNA, 14 nt, Yersinia pestis
guggccugugauga

SEQ ID NO: 4165276 - RNA, 17 nt, Yersinia pestis
guggcgaaaaccccacc

SEQ ID NO: 4165277 - RNA, 14 nt, Yersinia pestis
guggcgggaacacg

SEQ ID NO: 4165278 - RNA, 23 nt, Yersinia pestis
guggcuaucugaaacugagauuu

SEQ ID NO: 4165279 - RNA, 18 nt, Yersinia pestis
guggcuauuagccgauca

SEQ ID NO: 4165280 - RNA, 23 nt, Yersinia pestis
guggcucgacggccaauuucagu

SEQ ID NO: 4165281 - RNA, 20 nt, Yersinia pestis
guggcugaaucguacuucuu

SEQ ID NO: 4165282 - RNA, 13 nt, Yersinia pestis
guggcuuggcaug

SEQ ID NO: 4165283 - RNA, 22 nt, Yersinia pestis
gugggaaugcccuuuugugcau

SEQ ID NO: 4165284 - RNA, 12 nt, Yersinia pestis
gugggauagaga

SEQ ID NO: 4165285 - RNA, 13 nt, Yersinia pestis
gugggcuauaggg

SEQ ID NO: 4165286 - RNA, 14 nt, Yersinia pestis
gugguccccagagc

SEQ ID NO: 4165287 - RNA, 14 nt, Yersinia pestis
gugguggcagagaa

SEQ ID NO: 4165288 - RNA, 16 nt, Yersinia pestis
gugguucuauauagac

SEQ ID NO: 4165289 - RNA, 18 nt, Yersinia pestis
gugguuuccuggaacgaa

SEQ ID NO: 4165290 - RNA, 10 nt, Yersinia pestis
gugguuuggu

SEQ ID NO: 4165291 - RNA, 19 nt, Yersinia pestis
guguaaaaacuuaucuaaa

SEQ ID NO: 4165292 - RNA, 14 nt, Yersinia pestis
guguaacccgccuu

SEQ ID NO: 4165293 - RNA, 15 nt, Yersinia pestis
guguaacugccaccg

SEQ ID NO: 4165294 - RNA, 23 nt, Yersinia pestis
guguaagaacuggcuggaucagc

SEQ ID NO: 4165295 - RNA, 15 nt, Yersinia pestis
guguacucauauugu

SEQ ID NO: 4165296 - RNA, 14 nt, Yersinia pestis
guguauaucacuau

SEQ ID NO: 4165297 - RNA, 13 nt, Yersinia pestis
guguaugcaaaau

SEQ ID NO: 4165298 - RNA, 18 nt, Yersinia pestis
guguauucgcaucuucca

SEQ ID NO: 4165299 - RNA, 22 nt, Yersinia pestis
gugucaaaccaauuucucggcc

SEQ ID NO: 4165300 - RNA, 19 nt, Yersinia pestis
gugucaauguagacuuggc

SEQ ID NO: 4165301 - RNA, 18 nt, Yersinia pestis
gugucacaguaaaucagg

SEQ ID NO: 4165302 - RNA, 23 nt, Yersinia pestis
gugucaccgagagauucaugggc

SEQ ID NO: 4165303 - RNA, 19 nt, Yersinia pestis
gugucagggcaauaacaaa

SEQ ID NO: 4165304 - RNA, 21 nt, Yersinia pestis
gugucagggcaauaacaaaca

SEQ ID NO: 4165305 - RNA, 18 nt, Yersinia pestis
gugucaugcgcagaaaac

SEQ ID NO: 4165306 - RNA, 18 nt, Yersinia pestis
gugucauuugcgcaauac

SEQ ID NO: 4165307 - RNA, 12 nt, Yersinia pestis
guguccaguuuu

SEQ ID NO: 4165308 - RNA, 19 nt, Yersinia pestis
gugucccaaacucuggaug

SEQ ID NO: 4165309 - RNA, 21 nt, Yersinia pestis
gugucccaaacucuggauggg

SEQ ID NO: 4165310 - RNA, 15 nt, Yersinia pestis
gugucucgcccacag

SEQ ID NO: 4165311 - RNA, 18 nt, Yersinia pestis
gugucucuggagcuucug

SEQ ID NO: 4165312 - RNA, 15 nt, Yersinia pestis
gugugauuuccaucu

SEQ ID NO: 4165313 - RNA, 21 nt, Yersinia pestis
gugugucuucagaaugaaagg

SEQ ID NO: 4165314 - RNA, 21 nt, Yersinia pestis
guguuauuuuucucuuucagc

SEQ ID NO: 4165315 - RNA, 21 nt, Yersinia pestis
guguucauaaauuaaaacuga

SEQ ID NO: 4165316 - RNA, 15 nt, Yersinia pestis
guguucgguaaauaa

SEQ ID NO: 4165317 - RNA, 15 nt, Yersinia pestis
guguugacgccauuc

SEQ ID NO: 4165318 - RNA, 17 nt, Yersinia pestis
guguugcaacggucauu

SEQ ID NO: 4165319 - RNA, 12 nt, Yersinia pestis
guguugggcagu

SEQ ID NO: 4165320 - RNA, 14 nt, Yersinia pestis
guguuucaaauaag

SEQ ID NO: 4165321 - RNA, 14 nt, Yersinia pestis
guguuuuucaucug

SEQ ID NO: 4165322 - RNA, 17 nt, Yersinia pestis
guuaaaaacugugccug

SEQ ID NO: 4165323 - RNA, 14 nt, Yersinia pestis
guuaaagacauauc

SEQ ID NO: 4165324 - RNA, 17 nt, Yersinia pestis
guuaaaguuaucaccaa

SEQ ID NO: 4165325 - RNA, 16 nt, Yersinia pestis
guuaaauacagcacca

SEQ ID NO: 4165326 - RNA, 19 nt, Yersinia pestis
guuaaauagugggcuaaaa

SEQ ID NO: 4165327 - RNA, 17 nt, Yersinia pestis
guuaaauaugcugacca

SEQ ID NO: 4165328 - RNA, 11 nt, Yersinia pestis
guuaaaugaag

SEQ ID NO: 4165329 - RNA, 18 nt, Yersinia pestis
guuaaauucacuuucccc

SEQ ID NO: 4165330 - RNA, 14 nt, Yersinia pestis
guuaacccaaagcc

SEQ ID NO: 4165331 - RNA, 16 nt, Yersinia pestis
guuaacucauuuaucu

SEQ ID NO: 4165332 - RNA, 18 nt, Yersinia pestis
guuaacugcaguaaaaau

SEQ ID NO: 4165333 - RNA, 21 nt, Yersinia pestis
guuaacuggcuccgcacggcu

SEQ ID NO: 4165334 - RNA, 16 nt, Yersinia pestis
guuaacuuauagcuca

SEQ ID NO: 4165335 - RNA, 13 nt, Yersinia pestis
guuaacuuuuucu

SEQ ID NO: 4165336 - RNA, 14 nt, Yersinia pestis
guuaacuuuuucua

SEQ ID NO: 4165337 - RNA, 23 nt, Yersinia pestis
guuaagauuacguagacauaaau

SEQ ID NO: 4165338 - RNA, 16 nt, Yersinia pestis
guuaaguuucaucauu

SEQ ID NO: 4165339 - RNA, 13 nt, Yersinia pestis
guuaauauuuauc

SEQ ID NO: 4165340 - RNA, 14 nt, Yersinia pestis
guuaauauuuaucu

SEQ ID NO: 4165341 - RNA, 23 nt, Yersinia pestis
guuaauauuuaucugcauuaaaa

SEQ ID NO: 4165342 - RNA, 16 nt, Yersinia pestis
guuaaucaagcgccau

SEQ ID NO: 4165343 - RNA, 13 nt, Yersinia pestis
guuaaucgcagca

SEQ ID NO: 4165344 - RNA, 17 nt, Yersinia pestis
guuaaugggcguauuug

SEQ ID NO: 4165345 - RNA, 20 nt, Yersinia pestis
guuaauguguuuuugucauu

SEQ ID NO: 4165346 - RNA, 15 nt, Yersinia pestis
guuaauugaauugcc

SEQ ID NO: 4165347 - RNA, 21 nt, Yersinia pestis
guuaauuuaauuuaugauuaa

SEQ ID NO: 4165348 - RNA, 15 nt, Yersinia pestis
guuacacaucaggcu

SEQ ID NO: 4165349 - RNA, 17 nt, Yersinia pestis
guuacagcaaggcagca

SEQ ID NO: 4165350 - RNA, 14 nt, Yersinia pestis
guuaccaaaaagca

SEQ ID NO: 4165351 - RNA, 16 nt, Yersinia pestis
guuaccagaaaaccuu

SEQ ID NO: 4165352 - RNA, 17 nt, Yersinia pestis
guuaccagaaaaccuuc

SEQ ID NO: 4165353 - RNA, 18 nt, Yersinia pestis
guuaccuaaccaaacauu

SEQ ID NO: 4165354 - RNA, 17 nt, Yersinia pestis
guuaccuugugucacca

SEQ ID NO: 4165355 - RNA, 22 nt, Yersinia pestis
guuacgauacguugcaggucaa

SEQ ID NO: 4165356 - RNA, 17 nt, Yersinia pestis
guuacgggcuugcugca

SEQ ID NO: 4165357 - RNA, 20 nt, Yersinia pestis
guuacgggcuugcugcaacc

SEQ ID NO: 4165358 - RNA, 16 nt, Yersinia pestis
guuacgugagcaucug

SEQ ID NO: 4165359 - RNA, 20 nt, Yersinia pestis
guuacugcgcaaauccugaa

SEQ ID NO: 4165360 - RNA, 18 nt, Yersinia pestis
guuacuuccauaaacgga

SEQ ID NO: 4165361 - RNA, 13 nt, Yersinia pestis
guuagaaauauaa

SEQ ID NO: 4165362 - RNA, 16 nt, Yersinia pestis
guuagcagauaauaaa

SEQ ID NO: 4165363 - RNA, 13 nt, Yersinia pestis
guuagcaucugau

SEQ ID NO: 4165364 - RNA, 17 nt, Yersinia pestis
guuagcauuaaacggug

SEQ ID NO: 4165365 - RNA, 23 nt, Yersinia pestis
guuagcgauuucuaguggcaacg

SEQ ID NO: 4165366 - RNA, 15 nt, Yersinia pestis
guuagcuaugcaguu

SEQ ID NO: 4165367 - RNA, 14 nt, Yersinia pestis
guuagcucuucacg

SEQ ID NO: 4165368 - RNA, 17 nt, Yersinia pestis
guuagggcgcggcuggu

SEQ ID NO: 4165369 - RNA, 19 nt, Yersinia pestis
guuagggcgcggcugguaa

SEQ ID NO: 4165370 - RNA, 15 nt, Yersinia pestis
guuagguaauaccaa

SEQ ID NO: 4165371 - RNA, 22 nt, Yersinia pestis
guuaguaacuguaaggccaaac

SEQ ID NO: 4165372 - RNA, 12 nt, Yersinia pestis
guuagugaguua

SEQ ID NO: 4165373 - RNA, 18 nt, Yersinia pestis
guuauaaaacagccacga

SEQ ID NO: 4165374 - RNA, 17 nt, Yersinia pestis
guuauaacagcuuaccg

SEQ ID NO: 4165375 - RNA, 16 nt, Yersinia pestis
guuauaaggcuaacac

SEQ ID NO: 4165376 - RNA, 13 nt, Yersinia pestis
guuauaauauuaa

SEQ ID NO: 4165377 - RNA, 22 nt, Yersinia pestis
guuaucaaauacgaccgucacc

SEQ ID NO: 4165378 - RNA, 17 nt, Yersinia pestis
guuaucaauaaguucgu

SEQ ID NO: 4165379 - RNA, 15 nt, Yersinia pestis
guuaucacagcaaau

SEQ ID NO: 4165380 - RNA, 21 nt, Yersinia pestis
guuaucacauaaauaaguuca

SEQ ID NO: 4165381 - RNA, 15 nt, Yersinia pestis
guuaucacaucaucc

SEQ ID NO: 4165382 - RNA, 14 nt, Yersinia pestis
guuaucaucaccac

SEQ ID NO: 4165383 - RNA, 20 nt, Yersinia pestis
guuaucaucccuugacugac

SEQ ID NO: 4165384 - RNA, 14 nt, Yersinia pestis
guuaucgcucuuga

SEQ ID NO: 4165385 - RNA, 20 nt, Yersinia pestis
guuaucggccauauuaccgc

SEQ ID NO: 4165386 - RNA, 21 nt, Yersinia pestis
guuaucgguaucaucgagaug

SEQ ID NO: 4165387 - RNA, 13 nt, Yersinia pestis
guuaucggugcug

SEQ ID NO: 4165388 - RNA, 16 nt, Yersinia pestis
guuaucuauuguaucu

SEQ ID NO: 4165389 - RNA, 15 nt, Yersinia pestis
guuaucuggaauuua

SEQ ID NO: 4165390 - RNA, 18 nt, Yersinia pestis
guuaucuguaaucaccag

SEQ ID NO: 4165391 - RNA, 14 nt, Yersinia pestis
guuaucuuugacuc

SEQ ID NO: 4165392 - RNA, 15 nt, Yersinia pestis
guuaugaauaaacca

SEQ ID NO: 4165393 - RNA, 15 nt, Yersinia pestis
guuaugccaaccgga

SEQ ID NO: 4165394 - RNA, 17 nt, Yersinia pestis
guuauuacuaaugagau

SEQ ID NO: 4165395 - RNA, 14 nt, Yersinia pestis
guuauuauuaaauu

SEQ ID NO: 4165396 - RNA, 17 nt, Yersinia pestis
guuauucuuuauuuauu

SEQ ID NO: 4165397 - RNA, 22 nt, Yersinia pestis
guuauugaccaccuuauuggcc

SEQ ID NO: 4165398 - RNA, 21 nt, Yersinia pestis
guuauugcugcacaaguuggu

SEQ ID NO: 4165399 - RNA, 14 nt, Yersinia pestis
guuauuggcuaaag

SEQ ID NO: 4165400 - RNA, 22 nt, Yersinia pestis
guuauuucugaccguuguaugu

SEQ ID NO: 4165401 - RNA, 15 nt, Yersinia pestis
guuauuucuguucca

SEQ ID NO: 4165402 - RNA, 12 nt, Yersinia pestis
guuauuuuaauu

SEQ ID NO: 4165403 - RNA, 13 nt, Yersinia pestis
guucaaaaggugc

SEQ ID NO: 4165404 - RNA, 14 nt, Yersinia pestis
guucaaaugauuca

SEQ ID NO: 4165405 - RNA, 20 nt, Yersinia pestis
guucaaccuuuuccgccaug

SEQ ID NO: 4165406 - RNA, 13 nt, Yersinia pestis
guucaagaaccga

SEQ ID NO: 4165407 - RNA, 14 nt, Yersinia pestis
guucaagagugagu

SEQ ID NO: 4165408 - RNA, 18 nt, Yersinia pestis
guucaaucggcagugcca

SEQ ID NO: 4165409 - RNA, 19 nt, Yersinia pestis
guucaaucggcagugccau

SEQ ID NO: 4165410 - RNA, 16 nt, Yersinia pestis
guucaccagcuugggu

SEQ ID NO: 4165411 - RNA, 22 nt, Yersinia pestis
guucaccagcuugggugaagac

SEQ ID NO: 4165412 - RNA, 15 nt, Yersinia pestis
guucaccccucaccc

SEQ ID NO: 4165413 - RNA, 17 nt, Yersinia pestis
guucacccgcacgccca

SEQ ID NO: 4165414 - RNA, 20 nt, Yersinia pestis
guucacgauggaaaaaauac

SEQ ID NO: 4165415 - RNA, 20 nt, Yersinia pestis
guucacuugagagaaacuuu

SEQ ID NO: 4165416 - RNA, 22 nt, Yersinia pestis
guucagacguacauauaucacu

SEQ ID NO: 4165417 - RNA, 15 nt, Yersinia pestis
guucagcaauaugaa

SEQ ID NO: 4165418 - RNA, 14 nt, Yersinia pestis
guucagcagcgaca

SEQ ID NO: 4165419 - RNA, 17 nt, Yersinia pestis
guucagcauaaauauuc

SEQ ID NO: 4165420 - RNA, 18 nt, Yersinia pestis
guucagcaucccagccac

SEQ ID NO: 4165421 - RNA, 15 nt, Yersinia pestis
guucaggauccgccu

SEQ ID NO: 4165422 - RNA, 14 nt, Yersinia pestis
guucaguaguggcu

SEQ ID NO: 4165423 - RNA, 16 nt, Yersinia pestis
guucauauuggccagu

SEQ ID NO: 4165424 - RNA, 18 nt, Yersinia pestis
guucaucauuuuuuaucu

SEQ ID NO: 4165425 - RNA, 17 nt, Yersinia pestis
guucauuccccaucgcc

SEQ ID NO: 4165426 - RNA, 22 nt, Yersinia pestis
guucauuuagcagcgcacuggg

SEQ ID NO: 4165427 - RNA, 21 nt, Yersinia pestis
guuccaacgcacacccccauu

SEQ ID NO: 4165428 - RNA, 22 nt, Yersinia pestis
guuccacuguaucuuugcuauc

SEQ ID NO: 4165429 - RNA, 17 nt, Yersinia pestis
guuccaggcaagaaacu

SEQ ID NO: 4165430 - RNA, 18 nt, Yersinia pestis
guuccaguucgacauaaa

SEQ ID NO: 4165431 - RNA, 14 nt, Yersinia pestis
guucccguucaucc

SEQ ID NO: 4165432 - RNA, 16 nt, Yersinia pestis
guuccgguacgcgaug

SEQ ID NO: 4165433 - RNA, 15 nt, Yersinia pestis
guuccuguuuuugaa

SEQ ID NO: 4165434 - RNA, 16 nt, Yersinia pestis
guuccuucagccacca

SEQ ID NO: 4165435 - RNA, 19 nt, Yersinia pestis
guucgaggauaucacucug

SEQ ID NO: 4165436 - RNA, 15 nt, Yersinia pestis
guucgcaaugaaccc

SEQ ID NO: 4165437 - RNA, 13 nt, Yersinia pestis
guucgguaaauaa

SEQ ID NO: 4165438 - RNA, 15 nt, Yersinia pestis
guucuaucucaucuu

SEQ ID NO: 4165439 - RNA, 21 nt, Yersinia pestis
guucuaucucaucuuaaucac

SEQ ID NO: 4165440 - RNA, 18 nt, Yersinia pestis
guucucaaccaaauagcg

SEQ ID NO: 4165441 - RNA, 21 nt, Yersinia pestis
guucucuggaguuauacccau

SEQ ID NO: 4165442 - RNA, 22 nt, Yersinia pestis
guucugauuccauguucucucc

SEQ ID NO: 4165443 - RNA, 23 nt, Yersinia pestis
guucugccaauuuggggcugcuu

SEQ ID NO: 4165444 - RNA, 22 nt, Yersinia pestis
guucuggaucggcauacuccau

SEQ ID NO: 4165445 - RNA, 18 nt, Yersinia pestis
guucuggcccuaaauggg

SEQ ID NO: 4165446 - RNA, 16 nt, Yersinia pestis
guucuguagcugacac

SEQ ID NO: 4165447 - RNA, 14 nt, Yersinia pestis
guucugucacaauc

SEQ ID NO: 4165448 - RNA, 21 nt, Yersinia pestis
guucuucuuguggcaguucac

SEQ ID NO: 4165449 - RNA, 17 nt, Yersinia pestis
guugaaucaauugcugu

SEQ ID NO: 4165450 - RNA, 16 nt, Yersinia pestis
guugaauuaaaaaccc

SEQ ID NO: 4165451 - RNA, 19 nt, Yersinia pestis
guugaccugaagaaagguc

SEQ ID NO: 4165452 - RNA, 19 nt, Yersinia pestis
guugacucgcggcaggcau

SEQ ID NO: 4165453 - RNA, 15 nt, Yersinia pestis
guugacuuuuuuuaa

SEQ ID NO: 4165454 - RNA, 18 nt, Yersinia pestis
guugacuuuuuuuaacca

SEQ ID NO: 4165455 - RNA, 15 nt, Yersinia pestis
guugagauuaucagc

SEQ ID NO: 4165456 - RNA, 19 nt, Yersinia pestis
guugaggagaucgauaaag

SEQ ID NO: 4165457 - RNA, 20 nt, Yersinia pestis
guugauaaaacacucuuuuu

SEQ ID NO: 4165458 - RNA, 15 nt, Yersinia pestis
guugaugaguaaaca

SEQ ID NO: 4165459 - RNA, 19 nt, Yersinia pestis
guugaugcucauuuaaaau

SEQ ID NO: 4165460 - RNA, 18 nt, Yersinia pestis
guugauggcgcaguaacu

SEQ ID NO: 4165461 - RNA, 15 nt, Yersinia pestis
guugcacccugcuug

SEQ ID NO: 4165462 - RNA, 18 nt, Yersinia pestis
guugcaugcgccauauac

SEQ ID NO: 4165463 - RNA, 23 nt, Yersinia pestis
guugcaugcgccauauacccaaa

SEQ ID NO: 4165464 - RNA, 16 nt, Yersinia pestis
guugcauuuuucuguu

SEQ ID NO: 4165465 - RNA, 13 nt, Yersinia pestis
guugccaaccgga

SEQ ID NO: 4165466 - RNA, 22 nt, Yersinia pestis
guugccaccagcguugacacuc

SEQ ID NO: 4165467 - RNA, 18 nt, Yersinia pestis
guugccaccugcuggggg

SEQ ID NO: 4165468 - RNA, 17 nt, Yersinia pestis
guugccauaaccugagc

SEQ ID NO: 4165469 - RNA, 19 nt, Yersinia pestis
guugccauggccgccagca

SEQ ID NO: 4165470 - RNA, 19 nt, Yersinia pestis
guugcucacccauuuuauc

SEQ ID NO: 4165471 - RNA, 19 nt, Yersinia pestis
guugcucccguagcaaaua

SEQ ID NO: 4165472 - RNA, 19 nt, Yersinia pestis
guugcuggagcauugcgcu

SEQ ID NO: 4165473 - RNA, 15 nt, Yersinia pestis
guugcuguucucucc

SEQ ID NO: 4165474 - RNA, 15 nt, Yersinia pestis
guugcuuuuaacucc

SEQ ID NO: 4165475 - RNA, 22 nt, Yersinia pestis
guuggaguaucagaaacagcag

SEQ ID NO: 4165476 - RNA, 19 nt, Yersinia pestis
guuggcguuucguaaugac

SEQ ID NO: 4165477 - RNA, 18 nt, Yersinia pestis
guuggcuaaauaaccaga

SEQ ID NO: 4165478 - RNA, 14 nt, Yersinia pestis
guuggcugccuucc

SEQ ID NO: 4165479 - RNA, 21 nt, Yersinia pestis
guugggaaaaguggcuaucug

SEQ ID NO: 4165480 - RNA, 19 nt, Yersinia pestis
guugggcggucaucagccc

SEQ ID NO: 4165481 - RNA, 12 nt, Yersinia pestis
guuggggaugcc

SEQ ID NO: 4165482 - RNA, 16 nt, Yersinia pestis
guuggguaaaccaauc

SEQ ID NO: 4165483 - RNA, 17 nt, Yersinia pestis
guuggucaccacuugca

SEQ ID NO: 4165484 - RNA, 17 nt, Yersinia pestis
guuggucagcacuucca

SEQ ID NO: 4165485 - RNA, 15 nt, Yersinia pestis
guuggugacgcuggg

SEQ ID NO: 4165486 - RNA, 20 nt, Yersinia pestis
guuguaauaacgcaucaugg

SEQ ID NO: 4165487 - RNA, 13 nt, Yersinia pestis
guuguaccgccau

SEQ ID NO: 4165488 - RNA, 18 nt, Yersinia pestis
guuguaccuguuuuuguu

SEQ ID NO: 4165489 - RNA, 20 nt, Yersinia pestis
guugucagauaucugcucau

SEQ ID NO: 4165490 - RNA, 20 nt, Yersinia pestis
guugucagcagucugaaauc

SEQ ID NO: 4165491 - RNA, 20 nt, Yersinia pestis
guuguuggguaugauuuuua

SEQ ID NO: 4165492 - RNA, 15 nt, Yersinia pestis
guuguuucaauaaau

SEQ ID NO: 4165493 - RNA, 13 nt, Yersinia pestis
guuuaaaaaauau

SEQ ID NO: 4165494 - RNA, 21 nt, Yersinia pestis
guuuaaaaaggcguuauccuu

SEQ ID NO: 4165495 - RNA, 20 nt, Yersinia pestis
guuuaaaucuuucuccagua

SEQ ID NO: 4165496 - RNA, 14 nt, Yersinia pestis
guuuaaugccccug

SEQ ID NO: 4165497 - RNA, 12 nt, Yersinia pestis
guuuaauuucac

SEQ ID NO: 4165498 - RNA, 19 nt, Yersinia pestis
guuuacaugauugaaaaac

SEQ ID NO: 4165499 - RNA, 20 nt, Yersinia pestis
guuuacuggcgggcauuuuc

SEQ ID NO: 4165500 - RNA, 15 nt, Yersinia pestis
guuuagccaugaggu

SEQ ID NO: 4165501 - RNA, 17 nt, Yersinia pestis
guuuagcuuccaacuga

SEQ ID NO: 4165502 - RNA, 16 nt, Yersinia pestis
guuuauacuauuuaug

SEQ ID NO: 4165503 - RNA, 17 nt, Yersinia pestis
guuuaucacccgccauc

SEQ ID NO: 4165504 - RNA, 11 nt, Yersinia pestis
guuuaucccau

SEQ ID NO: 4165505 - RNA, 19 nt, Yersinia pestis
guuuaucccauuaaugagu

SEQ ID NO: 4165506 - RNA, 18 nt, Yersinia pestis
guuuaucucgcugugccc

SEQ ID NO: 4165507 - RNA, 17 nt, Yersinia pestis
guuuauuuaacacauuc

SEQ ID NO: 4165508 - RNA, 17 nt, Yersinia pestis
guuucaaauaaguacuu

SEQ ID NO: 4165509 - RNA, 17 nt, Yersinia pestis
guuucaacaucgcaccg

SEQ ID NO: 4165510 - RNA, 13 nt, Yersinia pestis
guuucacccucug

SEQ ID NO: 4165511 - RNA, 18 nt, Yersinia pestis
guuucaguggcuucucuu

SEQ ID NO: 4165512 - RNA, 17 nt, Yersinia pestis
guuuccagcccaccagc

SEQ ID NO: 4165513 - RNA, 19 nt, Yersinia pestis
guuucccguaccagugcca

SEQ ID NO: 4165514 - RNA, 23 nt, Yersinia pestis
guuucccuucgcgcaguaaacca

SEQ ID NO: 4165515 - RNA, 17 nt, Yersinia pestis
guuuccucuucaucuac

SEQ ID NO: 4165516 - RNA, 18 nt, Yersinia pestis
guuucgccuucccacaaa

SEQ ID NO: 4165517 - RNA, 21 nt, Yersinia pestis
guuucuggaaugagaugaaca

SEQ ID NO: 4165518 - RNA, 15 nt, Yersinia pestis
guuucuuacuaaaau

SEQ ID NO: 4165519 - RNA, 16 nt, Yersinia pestis
guuucuuacuaaaaua

SEQ ID NO: 4165520 - RNA, 12 nt, Yersinia pestis
guuugacgcugu

SEQ ID NO: 4165521 - RNA, 14 nt, Yersinia pestis
guuugacggcggcg

SEQ ID NO: 4165522 - RNA, 13 nt, Yersinia pestis
guuugaugguuau

SEQ ID NO: 4165523 - RNA, 12 nt, Yersinia pestis
guuugcagcacu

SEQ ID NO: 4165524 - RNA, 20 nt, Yersinia pestis
guuugccguuuccagugcgg

SEQ ID NO: 4165525 - RNA, 16 nt, Yersinia pestis
guuugcgccguaaacu

SEQ ID NO: 4165526 - RNA, 18 nt, Yersinia pestis
guuugcgccguaaacugc

SEQ ID NO: 4165527 - RNA, 16 nt, Yersinia pestis
guuugcugggcugacc

SEQ ID NO: 4165528 - RNA, 12 nt, Yersinia pestis
guuuggugguuu

SEQ ID NO: 4165529 - RNA, 22 nt, Yersinia pestis
guuuguaaccgacuugcccaau

SEQ ID NO: 4165530 - RNA, 18 nt, Yersinia pestis
guuuguaucgaugaucaa

SEQ ID NO: 4165531 - RNA, 23 nt, Yersinia pestis
guuugucggacuguugcaaccag

SEQ ID NO: 4165532 - RNA, 15 nt, Yersinia pestis
guuuguuuggauaaa

SEQ ID NO: 4165533 - RNA, 15 nt, Yersinia pestis
guuuuagacgucaga

SEQ ID NO: 4165534 - RNA, 19 nt, Yersinia pestis
guuuuagucucgcagccgc

SEQ ID NO: 4165535 - RNA, 23 nt, Yersinia pestis
guuuuauacccguuauaccucaa

SEQ ID NO: 4165536 - RNA, 18 nt, Yersinia pestis
guuuuaucaauaggucag

SEQ ID NO: 4165537 - RNA, 18 nt, Yersinia pestis
guuuuauucaagugcuca

SEQ ID NO: 4165538 - RNA, 20 nt, Yersinia pestis
guuuuauugaugauuugacc

SEQ ID NO: 4165539 - RNA, 17 nt, Yersinia pestis
guuuucauuauuuucac

SEQ ID NO: 4165540 - RNA, 14 nt, Yersinia pestis
guuuuccacauggc

SEQ ID NO: 4165541 - RNA, 16 nt, Yersinia pestis
guuuucguuuaaaaaa

SEQ ID NO: 4165542 - RNA, 15 nt, Yersinia pestis
guuuucuauuuccac

SEQ ID NO: 4165543 - RNA, 13 nt, Yersinia pestis
guuuugaacgcgc

SEQ ID NO: 4165544 - RNA, 14 nt, Yersinia pestis
guuuugacuaaaau

SEQ ID NO: 4165545 - RNA, 15 nt, Yersinia pestis
guuuugacuaaaauu

SEQ ID NO: 4165546 - RNA, 21 nt, Yersinia pestis
guuuugcaaugcuuauuucac

SEQ ID NO: 4165547 - RNA, 18 nt, Yersinia pestis
guuuugcagaucaaucgc

SEQ ID NO: 4165548 - RNA, 18 nt, Yersinia pestis
guuuugccgggcaauugu

SEQ ID NO: 4165549 - RNA, 18 nt, Yersinia pestis
guuuugcuaacugugcca

SEQ ID NO: 4165550 - RNA, 18 nt, Yersinia pestis
guuuuguuuccccuaauu

SEQ ID NO: 4165551 - RNA, 21 nt, Yersinia pestis
guuuuuauauauccaaaauaa

SEQ ID NO: 4165552 - RNA, 14 nt, Yersinia pestis
guuuuuaucccccu

SEQ ID NO: 4165553 - RNA, 20 nt, Yersinia pestis
guuuuucaucugugccugca

SEQ ID NO: 4165554 - RNA, 18 nt, Yersinia pestis
guuuuucuugccagaugg

SEQ ID NO: 4165555 - RNA, 16 nt, Yersinia pestis
guuuuugaaauaccac

SEQ ID NO: 4165556 - RNA, 21 nt, Yersinia pestis
guuuuugucauuuaauuaaau

SEQ ID NO: 4165557 - RNA, 19 nt, Yersinia pestis
guuuuuuacgguggcacug

SEQ ID NO: 4165558 - RNA, 14 nt, Yersinia pestis
guuuuuuauuuaua

SEQ ID NO: 4165559 - RNA, 13 nt, Yersinia pestis
guuuuuucuuucu

SEQ ID NO: 4165560 - RNA, 21 nt, Yersinia pestis
guuuuuuuacauauaauccaa

SEQ ID NO: 4165561 - RNA, 17 nt, Yersinia pestis
uaaaaaaaaauaaaauu

SEQ ID NO: 4165562 - RNA, 12 nt, Yersinia pestis
uaaaaaaauagc

SEQ ID NO: 4165563 - RNA, 13 nt, Yersinia pestis
uaaaaaaauuaaa

SEQ ID NO: 4165564 - RNA, 18 nt, Yersinia pestis
uaaaaaaauuaaaauaau

SEQ ID NO: 4165565 - RNA, 18 nt, Yersinia pestis
uaaaaaacgcgacgguca

SEQ ID NO: 4165566 - RNA, 20 nt, Yersinia pestis
uaaaaaacgggcuuggcggu

SEQ ID NO: 4165567 - RNA, 13 nt, Yersinia pestis
uaaaaaagucacu

SEQ ID NO: 4165568 - RNA, 20 nt, Yersinia pestis
uaaaaaagugcuauccucuu

SEQ ID NO: 4165569 - RNA, 18 nt, Yersinia pestis
uaaaaaaugauaaauucu

SEQ ID NO: 4165570 - RNA, 14 nt, Yersinia pestis
uaaaaacccucuca

SEQ ID NO: 4165571 - RNA, 19 nt, Yersinia pestis
uaaaaacccucucauccug

SEQ ID NO: 4165572 - RNA, 23 nt, Yersinia pestis
uaaaaacccucuucaaucggaua

SEQ ID NO: 4165573 - RNA, 20 nt, Yersinia pestis
uaaaaacuaccguauaauca

SEQ ID NO: 4165574 - RNA, 12 nt, Yersinia pestis
uaaaaacugugc

SEQ ID NO: 4165575 - RNA, 23 nt, Yersinia pestis
uaaaaacuuaucuaaaaaaccag

SEQ ID NO: 4165576 - RNA, 20 nt, Yersinia pestis
uaaaaagaucugcauugauu

SEQ ID NO: 4165577 - RNA, 19 nt, Yersinia pestis
uaaaaagcagcaaacgaac

SEQ ID NO: 4165578 - RNA, 19 nt, Yersinia pestis
uaaaaagccugaauucugu

SEQ ID NO: 4165579 - RNA, 14 nt, Yersinia pestis
uaaaaauaaucaau

SEQ ID NO: 4165580 - RNA, 16 nt, Yersinia pestis
uaaaaauacauaucaa

SEQ ID NO: 4165581 - RNA, 17 nt, Yersinia pestis
uaaaaauagauuaaaag

SEQ ID NO: 4165582 - RNA, 22 nt, Yersinia pestis
uaaaaaucaauacguugaauua

SEQ ID NO: 4165583 - RNA, 19 nt, Yersinia pestis
uaaaaaugcacugaacaau

SEQ ID NO: 4165584 - RNA, 19 nt, Yersinia pestis
uaaaaauucacaacagugc

SEQ ID NO: 4165585 - RNA, 20 nt, Yersinia pestis
uaaaacacaucacgcuuaag

SEQ ID NO: 4165586 - RNA, 15 nt, Yersinia pestis
uaaaacagaaccccc

SEQ ID NO: 4165587 - RNA, 20 nt, Yersinia pestis
uaaaacagcagccaccaaaa

SEQ ID NO: 4165588 - RNA, 14 nt, Yersinia pestis
uaaaacagccacga

SEQ ID NO: 4165589 - RNA, 16 nt, Yersinia pestis
uaaaacagcuaacacu

SEQ ID NO: 4165590 - RNA, 14 nt, Yersinia pestis
uaaaacagcucacu

SEQ ID NO: 4165591 - RNA, 12 nt, Yersinia pestis
uaaaacauuuca

SEQ ID NO: 4165592 - RNA, 12 nt, Yersinia pestis
uaaaaccacuga

SEQ ID NO: 4165593 - RNA, 14 nt, Yersinia pestis
uaaaaccacugacc

SEQ ID NO: 4165594 - RNA, 23 nt, Yersinia pestis
uaaaaccacugaccuauugauaa

SEQ ID NO: 4165595 - RNA, 15 nt, Yersinia pestis
uaaaaccggagucaa

SEQ ID NO: 4165596 - RNA, 20 nt, Yersinia pestis
uaaaaccggagucaaucauu

SEQ ID NO: 4165597 - RNA, 20 nt, Yersinia pestis
uaaaacgacacuaaccguaa

SEQ ID NO: 4165598 - RNA, 18 nt, Yersinia pestis
uaaaacgaguaaauacaa

SEQ ID NO: 4165599 - RNA, 21 nt, Yersinia pestis
uaaaacgaguaaauacaaaua

SEQ ID NO: 4165600 - RNA, 22 nt, Yersinia pestis
uaaaacgcacacugcagauuag

SEQ ID NO: 4165601 - RNA, 14 nt, Yersinia pestis
uaaaacucaaacug

SEQ ID NO: 4165602 - RNA, 21 nt, Yersinia pestis
uaaaacucacgguuucuaaaa

SEQ ID NO: 4165603 - RNA, 22 nt, Yersinia pestis
uaaaacucucgaaaauguguga

SEQ ID NO: 4165604 - RNA, 15 nt, Yersinia pestis
uaaaacugaagcauc

SEQ ID NO: 4165605 - RNA, 18 nt, Yersinia pestis
uaaaacugaagcaucaau

SEQ ID NO: 4165606 - RNA, 20 nt, Yersinia pestis
uaaaacugauauaaagcauu

SEQ ID NO: 4165607 - RNA, 23 nt, Yersinia pestis
uaaaacuggcacgaacaaucgcc

SEQ ID NO: 4165608 - RNA, 18 nt, Yersinia pestis
uaaaacuuuggcugaggg

SEQ ID NO: 4165609 - RNA, 19 nt, Yersinia pestis
uaaaagauucauaaaaaaa

SEQ ID NO: 4165610 - RNA, 18 nt, Yersinia pestis
uaaaagcacagacaaaca

SEQ ID NO: 4165611 - RNA, 19 nt, Yersinia pestis
uaaaagcacagacaaacaa

SEQ ID NO: 4165612 - RNA, 19 nt, Yersinia pestis
uaaaaggauggcccaagcc

SEQ ID NO: 4165613 - RNA, 12 nt, Yersinia pestis
uaaaaggcccgc

SEQ ID NO: 4165614 - RNA, 19 nt, Yersinia pestis
uaaaaggcuauuuaaauuu

SEQ ID NO: 4165615 - RNA, 14 nt, Yersinia pestis
uaaaagucagcaaa

SEQ ID NO: 4165616 - RNA, 14 nt, Yersinia pestis
uaaaauaaauuuau

SEQ ID NO: 4165617 - RNA, 13 nt, Yersinia pestis
uaaaauaauaaug

SEQ ID NO: 4165618 - RNA, 15 nt, Yersinia pestis
uaaaauaauaauggu

SEQ ID NO: 4165619 - RNA, 11 nt, Yersinia pestis
uaaaauaauga

SEQ ID NO: 4165620 - RNA, 13 nt, Yersinia pestis
uaaaauaaugagu

SEQ ID NO: 4165621 - RNA, 15 nt, Yersinia pestis
uaaaauauggcaggu

SEQ ID NO: 4165622 - RNA, 14 nt, Yersinia pestis
uaaaauauuuugcu

SEQ ID NO: 4165623 - RNA, 15 nt, Yersinia pestis
uaaaaucaaaacagg

SEQ ID NO: 4165624 - RNA, 20 nt, Yersinia pestis
uaaaaucaucagccucuaac

SEQ ID NO: 4165625 - RNA, 16 nt, Yersinia pestis
uaaaauccccauucca

SEQ ID NO: 4165626 - RNA, 17 nt, Yersinia pestis
uaaaauccccauuccaa

SEQ ID NO: 4165627 - RNA, 20 nt, Yersinia pestis
uaaaauccccauuccaauua

SEQ ID NO: 4165628 - RNA, 15 nt, Yersinia pestis
uaaaaucgauaguca

SEQ ID NO: 4165629 - RNA, 16 nt, Yersinia pestis
uaaaaucuugugccgc

SEQ ID NO: 4165630 - RNA, 20 nt, Yersinia pestis
uaaaaugggccugagugggg

SEQ ID NO: 4165631 - RNA, 12 nt, Yersinia pestis
uaaaauuaauua

SEQ ID NO: 4165632 - RNA, 18 nt, Yersinia pestis
uaaaauuacccagcaucu

SEQ ID NO: 4165633 - RNA, 14 nt, Yersinia pestis
uaaaauuaucgcaa

SEQ ID NO: 4165634 - RNA, 15 nt, Yersinia pestis
uaaaauucgcuauga

SEQ ID NO: 4165635 - RNA, 13 nt, Yersinia pestis
uaaaauuuaaagu

SEQ ID NO: 4165636 - RNA, 17 nt, Yersinia pestis
uaaaauuuaaaguaaac

SEQ ID NO: 4165637 - RNA, 13 nt, Yersinia pestis
uaaacaaaauagg

SEQ ID NO: 4165638 - RNA, 18 nt, Yersinia pestis
uaaacaaccaaaaaucuu

SEQ ID NO: 4165639 - RNA, 19 nt, Yersinia pestis
uaaacaaccaaaaaucuug

SEQ ID NO: 4165640 - RNA, 20 nt, Yersinia pestis
uaaacaaccaaaaaucuugu

SEQ ID NO: 4165641 - RNA, 13 nt, Yersinia pestis
uaaacaacgcuga

SEQ ID NO: 4165642 - RNA, 18 nt, Yersinia pestis
uaaacaacgcugaaaaau

SEQ ID NO: 4165643 - RNA, 20 nt, Yersinia pestis
uaaacaacgcugaaaaaucu

SEQ ID NO: 4165644 - RNA, 17 nt, Yersinia pestis
uaaacaauguuaaacuu

SEQ ID NO: 4165645 - RNA, 18 nt, Yersinia pestis
uaaacacucaauaaguag

SEQ ID NO: 4165646 - RNA, 14 nt, Yersinia pestis
uaaacagacacagc

SEQ ID NO: 4165647 - RNA, 16 nt, Yersinia pestis
uaaacagacacagcaa

SEQ ID NO: 4165648 - RNA, 15 nt, Yersinia pestis
uaaacagacuaaaaa

SEQ ID NO: 4165649 - RNA, 18 nt, Yersinia pestis
uaaacagacuaaaaaccg

SEQ ID NO: 4165650 - RNA, 19 nt, Yersinia pestis
uaaacagccguauaucuua

SEQ ID NO: 4165651 - RNA, 15 nt, Yersinia pestis
uaaacagcuuaucag

SEQ ID NO: 4165652 - RNA, 17 nt, Yersinia pestis
uaaacagggcagaaaau

SEQ ID NO: 4165653 - RNA, 17 nt, Yersinia pestis
uaaacauuguuauauua

SEQ ID NO: 4165654 - RNA, 13 nt, Yersinia pestis
uaaacauuuugac

SEQ ID NO: 4165655 - RNA, 11 nt, Yersinia pestis
uaaaccaauau

SEQ ID NO: 4165656 - RNA, 16 nt, Yersinia pestis
uaaaccagccagugau

SEQ ID NO: 4165657 - RNA, 15 nt, Yersinia pestis
uaaacccaaccccau

SEQ ID NO: 4165658 - RNA, 20 nt, Yersinia pestis
uaaacccaaccccaucagca

SEQ ID NO: 4165659 - RNA, 21 nt, Yersinia pestis
uaaacccccuguaaccgcaag

SEQ ID NO: 4165660 - RNA, 18 nt, Yersinia pestis
uaaacccggcaucaacca

SEQ ID NO: 4165661 - RNA, 18 nt, Yersinia pestis
uaaaccgaguucagaucg

SEQ ID NO: 4165662 - RNA, 23 nt, Yersinia pestis
uaaaccgcuauaucaucagcaga

SEQ ID NO: 4165663 - RNA, 21 nt, Yersinia pestis
uaaaccgggccuaauuuaacu

SEQ ID NO: 4165664 - RNA, 17 nt, Yersinia pestis
uaaaccggucauacauu

SEQ ID NO: 4165665 - RNA, 16 nt, Yersinia pestis
uaaaccguacauuaaa

SEQ ID NO: 4165666 - RNA, 15 nt, Yersinia pestis
uaaaccgugcggcua

SEQ ID NO: 4165667 - RNA, 16 nt, Yersinia pestis
uaaaccuacagccauc

SEQ ID NO: 4165668 - RNA, 21 nt, Yersinia pestis
uaaacgaccauuucucugaug

SEQ ID NO: 4165669 - RNA, 15 nt, Yersinia pestis
uaaacgaguuuccag

SEQ ID NO: 4165670 - RNA, 17 nt, Yersinia pestis
uaaacgccaaucaccuu

SEQ ID NO: 4165671 - RNA, 12 nt, Yersinia pestis
uaaacgccaguc

SEQ ID NO: 4165672 - RNA, 21 nt, Yersinia pestis
uaaacgccgcgucaauaacau

SEQ ID NO: 4165673 - RNA, 20 nt, Yersinia pestis
uaaacgccugggauccauag

SEQ ID NO: 4165674 - RNA, 14 nt, Yersinia pestis
uaaacgggcuucca

SEQ ID NO: 4165675 - RNA, 18 nt, Yersinia pestis
uaaacgggcuuccaucag

SEQ ID NO: 4165676 - RNA, 21 nt, Yersinia pestis
uaaacgggcuuccaucaggaa

SEQ ID NO: 4165677 - RNA, 16 nt, Yersinia pestis
uaaacggguaucggcc

SEQ ID NO: 4165678 - RNA, 18 nt, Yersinia pestis
uaaacgucucuuuuucau

SEQ ID NO: 4165679 - RNA, 19 nt, Yersinia pestis
uaaacguggcccuuucgca

SEQ ID NO: 4165680 - RNA, 12 nt, Yersinia pestis
uaaacuaauauc

SEQ ID NO: 4165681 - RNA, 14 nt, Yersinia pestis
uaaacuaauaucuu

SEQ ID NO: 4165682 - RNA, 19 nt, Yersinia pestis
uaaacuaauaucuuucaua

SEQ ID NO: 4165683 - RNA, 23 nt, Yersinia pestis
uaaacuaccgaucaucaggcagg

SEQ ID NO: 4165684 - RNA, 13 nt, Yersinia pestis
uaaacucuuucau

SEQ ID NO: 4165685 - RNA, 18 nt, Yersinia pestis
uaaacugaauaucccccu

SEQ ID NO: 4165686 - RNA, 17 nt, Yersinia pestis
uaaacugccguaaacaa

SEQ ID NO: 4165687 - RNA, 18 nt, Yersinia pestis
uaaacugugcccuugagc

SEQ ID NO: 4165688 - RNA, 14 nt, Yersinia pestis
uaaacuucuuuauc

SEQ ID NO: 4165689 - RNA, 18 nt, Yersinia pestis
uaaacuugauucaccaga

SEQ ID NO: 4165690 - RNA, 17 nt, Yersinia pestis
uaaacuuguaucaaaac

SEQ ID NO: 4165691 - RNA, 12 nt, Yersinia pestis
uaaagaaaaaac

SEQ ID NO: 4165692 - RNA, 14 nt, Yersinia pestis
uaaagaaaaacccg

SEQ ID NO: 4165693 - RNA, 23 nt, Yersinia pestis
uaaagaaaaacccguugaagccu

SEQ ID NO: 4165694 - RNA, 15 nt, Yersinia pestis
uaaagaauaaugggu

SEQ ID NO: 4165695 - RNA, 17 nt, Yersinia pestis
uaaagaaugcaaccagu

SEQ ID NO: 4165696 - RNA, 16 nt, Yersinia pestis
uaaagacgcaugagcu

SEQ ID NO: 4165697 - RNA, 20 nt, Yersinia pestis
uaaagacgccguaaauacau

SEQ ID NO: 4165698 - RNA, 23 nt, Yersinia pestis
uaaagacgccguaaauacaucca

SEQ ID NO: 4165699 - RNA, 18 nt, Yersinia pestis
uaaagacgcuaauuaaag

SEQ ID NO: 4165700 - RNA, 13 nt, Yersinia pestis
uaaagacuucagc

SEQ ID NO: 4165701 - RNA, 17 nt, Yersinia pestis
uaaagcagcaucuggcg

SEQ ID NO: 4165702 - RNA, 14 nt, Yersinia pestis
uaaagcaucagacu

SEQ ID NO: 4165703 - RNA, 16 nt, Yersinia pestis
uaaagcauuuaucaua

SEQ ID NO: 4165704 - RNA, 20 nt, Yersinia pestis
uaaagcauuuaucauauuaa

SEQ ID NO: 4165705 - RNA, 15 nt, Yersinia pestis
uaaagccaucgccau

SEQ ID NO: 4165706 - RNA, 18 nt, Yersinia pestis
uaaagccauucagcagca

SEQ ID NO: 4165707 - RNA, 13 nt, Yersinia pestis
uaaagccauuuca

SEQ ID NO: 4165708 - RNA, 11 nt, Yersinia pestis
uaaagcccagg

SEQ ID NO: 4165709 - RNA, 13 nt, Yersinia pestis
uaaagcccgcuua

SEQ ID NO: 4165710 - RNA, 17 nt, Yersinia pestis
uaaagccucuuguguaa

SEQ ID NO: 4165711 - RNA, 14 nt, Yersinia pestis
uaaagccuuucagc

SEQ ID NO: 4165712 - RNA, 16 nt, Yersinia pestis
uaaagcuauucaucug

SEQ ID NO: 4165713 - RNA, 19 nt, Yersinia pestis
uaaaggcaagauuucucuu

SEQ ID NO: 4165714 - RNA, 15 nt, Yersinia pestis
uaaaggcgaugauuu

SEQ ID NO: 4165715 - RNA, 20 nt, Yersinia pestis
uaaaggcgaugauuugucaa

SEQ ID NO: 4165716 - RNA, 22 nt, Yersinia pestis
uaaaggcuaaaccggcacaggc

SEQ ID NO: 4165717 - RNA, 19 nt, Yersinia pestis
uaaagguaaaaggcccgcu

SEQ ID NO: 4165718 - RNA, 20 nt, Yersinia pestis
uaaaggugaucgcucaggcg

SEQ ID NO: 4165719 - RNA, 23 nt, Yersinia pestis
uaaagguguaguggaagugaucc

SEQ ID NO: 4165720 - RNA, 14 nt, Yersinia pestis
uaaagguuugccag

SEQ ID NO: 4165721 - RNA, 20 nt, Yersinia pestis
uaaaguaaaagccagucagg

SEQ ID NO: 4165722 - RNA, 16 nt, Yersinia pestis
uaaagucggccuauga

SEQ ID NO: 4165723 - RNA, 12 nt, Yersinia pestis
uaaaguuuuucc

SEQ ID NO: 4165724 - RNA, 20 nt, Yersinia pestis
uaaauaaaaagcguuucaga

SEQ ID NO: 4165725 - RNA, 19 nt, Yersinia pestis
uaaauaaaagauaacgcaa

SEQ ID NO: 4165726 - RNA, 14 nt, Yersinia pestis
uaaauaaaauaaau

SEQ ID NO: 4165727 - RNA, 13 nt, Yersinia pestis
uaaauaaaauaau

SEQ ID NO: 4165728 - RNA, 14 nt, Yersinia pestis
uaaauaaaauaaua

SEQ ID NO: 4165729 - RNA, 16 nt, Yersinia pestis
uaaauaaaauaauaau

SEQ ID NO: 4165730 - RNA, 18 nt, Yersinia pestis
uaaauaaaauaauaaugg

SEQ ID NO: 4165731 - RNA, 14 nt, Yersinia pestis
uaaauaaaauagcg

SEQ ID NO: 4165732 - RNA, 15 nt, Yersinia pestis
uaaauaaauagaaaa

SEQ ID NO: 4165733 - RNA, 14 nt, Yersinia pestis
uaaauaaauuuaau

SEQ ID NO: 4165734 - RNA, 18 nt, Yersinia pestis
uaaauaacacccauuugc

SEQ ID NO: 4165735 - RNA, 22 nt, Yersinia pestis
uaaauaaccagagacagcaaca

SEQ ID NO: 4165736 - RNA, 22 nt, Yersinia pestis
uaaauaaccgagcgugaagagc

SEQ ID NO: 4165737 - RNA, 20 nt, Yersinia pestis
uaaauaaguaggcaucugcc

SEQ ID NO: 4165738 - RNA, 19 nt, Yersinia pestis
gcagagucgcaaaaaauau

SEQ ID NO: 4165739 - RNA, 18 nt, Yersinia pestis
gcagauaaaucuguggca

SEQ ID NO: 4165740 - RNA, 21 nt, Yersinia pestis
gcagauacuggaagccgacga

SEQ ID NO: 4165741 - RNA, 19 nt, Yersinia pestis
gcagauaugaugcggaaga

SEQ ID NO: 4165742 - RNA, 15 nt, Yersinia pestis
gcagaucguaaagac

SEQ ID NO: 4165743 - RNA, 18 nt, Yersinia pestis
gcagauguaaccacccac

SEQ ID NO: 4165744 - RNA, 21 nt, Yersinia pestis
gcagauguauuagcgcugcuc

SEQ ID NO: 4165745 - RNA, 21 nt, Yersinia pestis
gcagcaaaaccaagcugauga

SEQ ID NO: 4165746 - RNA, 13 nt, Yersinia pestis
gcagcaagaaacu

SEQ ID NO: 4165747 - RNA, 14 nt, Yersinia pestis
gcagcaagaacaau

SEQ ID NO: 4165748 - RNA, 22 nt, Yersinia pestis
gcagcaaguuagcgauaucugc

SEQ ID NO: 4165749 - RNA, 21 nt, Yersinia pestis
gcagcaccaauaucaauauuc

SEQ ID NO: 4165750 - RNA, 17 nt, Yersinia pestis
gcagcagacaacugaca

SEQ ID NO: 4165751 - RNA, 22 nt, Yersinia pestis
gcagcagugccugguuuuacgc

SEQ ID NO: 4165752 - RNA, 24 nt, Yersinia pestis
gcagcagugcgguucaagccgaua

SEQ ID NO: 4165753 - RNA, 14 nt, Yersinia pestis
gcagccaaaauaau

SEQ ID NO: 4165754 - RNA, 19 nt, Yersinia pestis
gcagcccccuuauggcaca

SEQ ID NO: 4165755 - RNA, 14 nt, Yersinia pestis
gcagccgccgcugg

SEQ ID NO: 4165756 - RNA, 19 nt, Yersinia pestis
gcagccgggaugaucaaca

SEQ ID NO: 4165757 - RNA, 15 nt, Yersinia pestis
gcagccugcggcggc

SEQ ID NO: 4165758 - RNA, 16 nt, Yersinia pestis
gcagcgacaaccugua

SEQ ID NO: 4165759 - RNA, 16 nt, Yersinia pestis
gcagcgagcacugccc

SEQ ID NO: 4165760 - RNA, 17 nt, Yersinia pestis
gcagcgcgcagccaacg

SEQ ID NO: 4165761 - RNA, 11 nt, Yersinia pestis
gcagcggggga

SEQ ID NO: 4165762 - RNA, 15 nt, Yersinia pestis
gcagcgucaaggucg

SEQ ID NO: 4165763 - RNA, 19 nt, Yersinia pestis
gcagcuaauguuggcaacu

SEQ ID NO: 4165764 - RNA, 14 nt, Yersinia pestis
gcagcuuguugaua

SEQ ID NO: 4165765 - RNA, 21 nt, Yersinia pestis
gcagcuuuugugcaggaguaa

SEQ ID NO: 4165766 - RNA, 22 nt, Yersinia pestis
gcaggaaauugccgcaucagcc

SEQ ID NO: 4165767 - RNA, 22 nt, Yersinia pestis
gcaggaacgaaguuagacccaa

SEQ ID NO: 4165768 - RNA, 14 nt, Yersinia pestis
gcaggaagcaauga

SEQ ID NO: 4165769 - RNA, 22 nt, Yersinia pestis
gcaggaaguuauggaugaccaa

SEQ ID NO: 4165770 - RNA, 16 nt, Yersinia pestis
gcaggauaaagcugaa

SEQ ID NO: 4165771 - RNA, 22 nt, Yersinia pestis
gcaggccagacccauuucugcu

SEQ ID NO: 4165772 - RNA, 22 nt, Yersinia pestis
gcaggccaugucgaucauggca

SEQ ID NO: 4165773 - RNA, 17 nt, Yersinia pestis
gcaggccccaucauaaa

SEQ ID NO: 4165774 - RNA, 14 nt, Yersinia pestis
gcaggcccugguug

SEQ ID NO: 4165775 - RNA, 19 nt, Yersinia pestis
gcaggcccuuucaccgcug

SEQ ID NO: 4165776 - RNA, 14 nt, Yersinia pestis
gcaggcggccaaug

SEQ ID NO: 4165777 - RNA, 14 nt, Yersinia pestis
gcaggcuucaacua

SEQ ID NO: 4165778 - RNA, 22 nt, Yersinia pestis
gcaggcuuucacgcuccacacc

SEQ ID NO: 4165779 - RNA, 22 nt, Yersinia pestis
gcagggaaagguagaucgggga

SEQ ID NO: 4165780 - RNA, 15 nt, Yersinia pestis
gcagggcauucgccu

SEQ ID NO: 4165781 - RNA, 18 nt, Yersinia pestis
gcagggccgauaaaaaac

SEQ ID NO: 4165782 - RNA, 21 nt, Yersinia pestis
gcaggggaggcgguccuccug

SEQ ID NO: 4165783 - RNA, 15 nt, Yersinia pestis
gcaggguauuuucuc

SEQ ID NO: 4165784 - RNA, 15 nt, Yersinia pestis
gcagggucaguaaua

SEQ ID NO: 4165785 - RNA, 20 nt, Yersinia pestis
gcaggguggagagaaaggcu

SEQ ID NO: 4165786 - RNA, 19 nt, Yersinia pestis
gcagguaaugucacugcca

SEQ ID NO: 4165787 - RNA, 19 nt, Yersinia pestis
gcagguagggcggcccacu

SEQ ID NO: 4165788 - RNA, 23 nt, Yersinia pestis
gcagguaucaauacagacgccga

SEQ ID NO: 4165789 - RNA, 14 nt, Yersinia pestis
gcaggucagaauga

SEQ ID NO: 4165790 - RNA, 23 nt, Yersinia pestis
gcagguuaaaguugauaaagcug

SEQ ID NO: 4165791 - RNA, 14 nt, Yersinia pestis
gcaguaacgccaua

SEQ ID NO: 4165792 - RNA, 16 nt, Yersinia pestis
gcaguaacguccaacu

SEQ ID NO: 4165793 - RNA, 20 nt, Yersinia pestis
gcaguacaaauuguggaaau

SEQ ID NO: 4165794 - RNA, 19 nt, Yersinia pestis
gcagucagccacaaaaguu

SEQ ID NO: 4165795 - RNA, 15 nt, Yersinia pestis
gcagucgauaaacau

SEQ ID NO: 4165796 - RNA, 22 nt, Yersinia pestis
gcagucgauaaacaucaugaca

SEQ ID NO: 4165797 - RNA, 23 nt, Yersinia pestis
gcagucuccaucacucuucgugc

SEQ ID NO: 4165798 - RNA, 21 nt, Yersinia pestis
gcagucugaaacgccagccuc

SEQ ID NO: 4165799 - RNA, 16 nt, Yersinia pestis
gcagucugagccucau

SEQ ID NO: 4165800 - RNA, 12 nt, Yersinia pestis
gcagucugaggg

SEQ ID NO: 4165801 - RNA, 15 nt, Yersinia pestis
gcagucugagggcca

SEQ ID NO: 4165802 - RNA, 20 nt, Yersinia pestis
gcagucugagggccacuucg

SEQ ID NO: 4165803 - RNA, 23 nt, Yersinia pestis
gcagucugaggggcguuuaaugc

SEQ ID NO: 4165804 - RNA, 16 nt, Yersinia pestis
gcagugacgcagugac

SEQ ID NO: 4165805 - RNA, 17 nt, Yersinia pestis
gcagugacgcagugauu

SEQ ID NO: 4165806 - RNA, 21 nt, Yersinia pestis
gcagugaucaguccuuagcau

SEQ ID NO: 4165807 - RNA, 20 nt, Yersinia pestis
gcagugcacgggaaaugagc

SEQ ID NO: 4165808 - RNA, 14 nt, Yersinia pestis
gcagugcagcaaaa

SEQ ID NO: 4165809 - RNA, 20 nt, Yersinia pestis
gcagugccacggauauccaa

SEQ ID NO: 4165810 - RNA, 19 nt, Yersinia pestis
gcagugccaucgccaacag

SEQ ID NO: 4165811 - RNA, 19 nt, Yersinia pestis
gcaguguaaaaccugacug

SEQ ID NO: 4165812 - RNA, 21 nt, Yersinia pestis
gcagugucagggcaauaacaa

SEQ ID NO: 4165813 - RNA, 22 nt, Yersinia pestis
gcaguuaagguuagcuaugcag

SEQ ID NO: 4165814 - RNA, 17 nt, Yersinia pestis
gcaguuugaaguaugac

SEQ ID NO: 4165815 - RNA, 21 nt, Yersinia pestis
gcauaaaaauagcccucccug

SEQ ID NO: 4165816 - RNA, 15 nt, Yersinia pestis
gcauaaagcuauuca

SEQ ID NO: 4165817 - RNA, 18 nt, Yersinia pestis
gcauaaagcuauucaucu

SEQ ID NO: 4165818 - RNA, 19 nt, Yersinia pestis
gcauaaagcuauucaucug

SEQ ID NO: 4165819 - RNA, 21 nt, Yersinia pestis
gcauaacuggcgguuucaccu

SEQ ID NO: 4165820 - RNA, 15 nt, Yersinia pestis
gcauaagacaacgcc

SEQ ID NO: 4165821 - RNA, 13 nt, Yersinia pestis
gcauaaucagcgg

SEQ ID NO: 4165822 - RNA, 14 nt, Yersinia pestis
gcauaccuggauca

SEQ ID NO: 4165823 - RNA, 19 nt, Yersinia pestis
gcauacgugccaaaaugcc

SEQ ID NO: 4165824 - RNA, 21 nt, Yersinia pestis
gcauagaaauucaacuugccu

SEQ ID NO: 4165825 - RNA, 17 nt, Yersinia pestis
gcauagacgaaggcacg

SEQ ID NO: 4165826 - RNA, 19 nt, Yersinia pestis
gcauagccggagguuuuuc

SEQ ID NO: 4165827 - RNA, 16 nt, Yersinia pestis
gcauagcuaaccuuaa

SEQ ID NO: 4165828 - RNA, 22 nt, Yersinia pestis
gcauagcuaaccuuaacuacac

SEQ ID NO: 4165829 - RNA, 14 nt, Yersinia pestis
gcauaggccaauag

SEQ ID NO: 4165830 - RNA, 15 nt, Yersinia pestis
gcauaggccaauaga

SEQ ID NO: 4165831 - RNA, 13 nt, Yersinia pestis
gcauaguauccau

SEQ ID NO: 4165832 - RNA, 13 nt, Yersinia pestis
gcauauaaaacac

SEQ ID NO: 4165833 - RNA, 21 nt, Yersinia pestis
gcauauacagcccgguaucac

SEQ ID NO: 4165834 - RNA, 20 nt, Yersinia pestis
gcauauacguuaguuauccu

SEQ ID NO: 4165835 - RNA, 20 nt, Yersinia pestis
gcauaucaaugcaacuggca

SEQ ID NO: 4165836 - RNA, 18 nt, Yersinia pestis
gcauaucccuguuuucua

SEQ ID NO: 4165837 - RNA, 15 nt, Yersinia pestis
gcauaugaaaaaccu

SEQ ID NO: 4165838 - RNA, 19 nt, Yersinia pestis
gcauaugaaaaaccuccgg

SEQ ID NO: 4165839 - RNA, 18 nt, Yersinia pestis
gcauaugaguuucaaaua

SEQ ID NO: 4165840 - RNA, 19 nt, Yersinia pestis
gcauauguagccagauaaa

SEQ ID NO: 4165841 - RNA, 13 nt, Yersinia pestis
gcauauuacccag

SEQ ID NO: 4165842 - RNA, 18 nt, Yersinia pestis
gcauauuauuaaugaaau

SEQ ID NO: 4165843 - RNA, 17 nt, Yersinia pestis
gcauauuauuuugcaca

SEQ ID NO: 4165844 - RNA, 18 nt, Yersinia pestis
gcauauugagcauacugu

SEQ ID NO: 4165845 - RNA, 13 nt, Yersinia pestis
gcauauuucucuu

SEQ ID NO: 4165846 - RNA, 18 nt, Yersinia pestis
gcauauuuuggcaacuca

SEQ ID NO: 4165847 - RNA, 19 nt, Yersinia pestis
gcauauuuuggcaacucag

SEQ ID NO: 4165848 - RNA, 23 nt, Yersinia pestis
gcauauuuuggcaacucagcacg

SEQ ID NO: 4165849 - RNA, 16 nt, Yersinia pestis
gcauauuuuuagucua

SEQ ID NO: 4165850 - RNA, 21 nt, Yersinia pestis
gcaucaaacggcaacuucuac

SEQ ID NO: 4165851 - RNA, 15 nt, Yersinia pestis
gcaucaaccaagaca

SEQ ID NO: 4165852 - RNA, 17 nt, Yersinia pestis
gcaucaauaauaacgaa

SEQ ID NO: 4165853 - RNA, 16 nt, Yersinia pestis
gcaucaccaaacagug

SEQ ID NO: 4165854 - RNA, 20 nt, Yersinia pestis
gcaucaccgguuuacccugc

SEQ ID NO: 4165855 - RNA, 16 nt, Yersinia pestis
gcaucacgauagccag

SEQ ID NO: 4165856 - RNA, 21 nt, Yersinia pestis
gcaucacgauagccagugaca

SEQ ID NO: 4165857 - RNA, 18 nt, Yersinia pestis
gcaucacugacugagugc

SEQ ID NO: 4165858 - RNA, 18 nt, Yersinia pestis
gcaucagacggcagcaac

SEQ ID NO: 4165859 - RNA, 18 nt, Yersinia pestis
gcaucagcaaaguauuua

SEQ ID NO: 4165860 - RNA, 12 nt, Yersinia pestis
gcaucagccagc

SEQ ID NO: 4165861 - RNA, 16 nt, Yersinia pestis
gcaucagcccauugcu

SEQ ID NO: 4165862 - RNA, 18 nt, Yersinia pestis
gcaucagcccauugcugu

SEQ ID NO: 4165863 - RNA, 16 nt, Yersinia pestis
gcaucauaaauaccgc

SEQ ID NO: 4165864 - RNA, 16 nt, Yersinia pestis
gcaucauacugacggg

SEQ ID NO: 4165865 - RNA, 13 nt, Yersinia pestis
gcaucauccagcu

SEQ ID NO: 4165866 - RNA, 13 nt, Yersinia pestis
gcaucauccucau

SEQ ID NO: 4165867 - RNA, 11 nt, Yersinia pestis
gcaucaucgca

SEQ ID NO: 4165868 - RNA, 18 nt, Yersinia pestis
gcauccaagccaucauua

SEQ ID NO: 4165869 - RNA, 19 nt, Yersinia pestis
gcauccaagccaucauuag

SEQ ID NO: 4165870 - RNA, 16 nt, Yersinia pestis
gcauccacugcggcca

SEQ ID NO: 4165871 - RNA, 23 nt, Yersinia pestis
gcauccccacugacaucauuuua

SEQ ID NO: 4165872 - RNA, 16 nt, Yersinia pestis
gcauccccaucgccaa

SEQ ID NO: 4165873 - RNA, 21 nt, Yersinia pestis
gcauccccggcaucccaccuu

SEQ ID NO: 4165874 - RNA, 14 nt, Yersinia pestis
gcauccgcccacac

SEQ ID NO: 4165875 - RNA, 19 nt, Yersinia pestis
gcauccggcgguaaaucug

SEQ ID NO: 4165876 - RNA, 21 nt, Yersinia pestis
gcauccugcaaauuuauccaa

SEQ ID NO: 4165877 - RNA, 17 nt, Yersinia pestis
gcauccuugaucgccaa

SEQ ID NO: 4165878 - RNA, 15 nt, Yersinia pestis
gcaucgacgagcggc

SEQ ID NO: 4165879 - RNA, 20 nt, Yersinia pestis
gcaucgaguccguuaaaaaa

SEQ ID NO: 4165880 - RNA, 21 nt, Yersinia pestis
gcaucgcgaucugacauuugc

SEQ ID NO: 4165881 - RNA, 12 nt, Yersinia pestis
gcaucgcgggcg

SEQ ID NO: 4165882 - RNA, 15 nt, Yersinia pestis
gcaucgcgggcgcgc

SEQ ID NO: 4165883 - RNA, 23 nt, Yersinia pestis
gcaucgcgggcgcgcugcugcuc

SEQ ID NO: 4165884 - RNA, 15 nt, Yersinia pestis
gcaucgucgcuguua

SEQ ID NO: 4165885 - RNA, 19 nt, Yersinia pestis
gcaucuauugugucaauac

SEQ ID NO: 4165886 - RNA, 13 nt, Yersinia pestis
gcaucugccacac

SEQ ID NO: 4165887 - RNA, 22 nt, Yersinia pestis
gcaucuucaaucaacugaacca

SEQ ID NO: 4165888 - RNA, 11 nt, Yersinia pestis
gcaucuuccaa

SEQ ID NO: 4165889 - RNA, 18 nt, Yersinia pestis
gcaucuuccaaaggaagg

SEQ ID NO: 4165890 - RNA, 21 nt, Yersinia pestis
gcaucuuuaccccauugcacc

SEQ ID NO: 4165891 - RNA, 23 nt, Yersinia pestis
gcaucuuuaccccauugcaccaa

SEQ ID NO: 4165892 - RNA, 19 nt, Yersinia pestis
gcaucuuucaguuuuauug

SEQ ID NO: 4165893 - RNA, 15 nt, Yersinia pestis
gcaucuuuugcuauu

SEQ ID NO: 4165894 - RNA, 17 nt, Yersinia pestis
gcaugaaugaaauauca

SEQ ID NO: 4165895 - RNA, 19 nt, Yersinia pestis
gcaugacccaauggagauc

SEQ ID NO: 4165896 - RNA, 18 nt, Yersinia pestis
gcaugccauccugccaac

SEQ ID NO: 4165897 - RNA, 18 nt, Yersinia pestis
gcaugccaugcacuccac

SEQ ID NO: 4165898 - RNA, 17 nt, Yersinia pestis
gcaugcccggucaugau

SEQ ID NO: 4165899 - RNA, 14 nt, Yersinia pestis
gcauggaucacccg

SEQ ID NO: 4165900 - RNA, 16 nt, Yersinia pestis
gcauggucccuacggu

SEQ ID NO: 4165901 - RNA, 20 nt, Yersinia pestis
gcaugugauguggcuugcaa

SEQ ID NO: 4165902 - RNA, 17 nt, Yersinia pestis
gcauguuauuggcuaaa

SEQ ID NO: 4165903 - RNA, 15 nt, Yersinia pestis
gcauguucagccgcu

SEQ ID NO: 4165904 - RNA, 18 nt, Yersinia pestis
gcauguuccuguugcugg

SEQ ID NO: 4165905 - RNA, 15 nt, Yersinia pestis
gcauuaaaauaacaa

SEQ ID NO: 4165906 - RNA, 23 nt, Yersinia pestis
gcauuaauaccguuuucuuucaa

SEQ ID NO: 4165907 - RNA, 18 nt, Yersinia pestis
gcauuacucuuauaaaga

SEQ ID NO: 4165908 - RNA, 15 nt, Yersinia pestis
gcauuagacauucaa

SEQ ID NO: 4165909 - RNA, 15 nt, Yersinia pestis
gcauuaucuuuaauu

SEQ ID NO: 4165910 - RNA, 16 nt, Yersinia pestis
gcauucaggcuuuuuu

SEQ ID NO: 4165911 - RNA, 23 nt, Yersinia pestis
gcauucauaucguccaaagggag

SEQ ID NO: 4165912 - RNA, 20 nt, Yersinia pestis
gcauucauaucuuuaccugu

SEQ ID NO: 4165913 - RNA, 15 nt, Yersinia pestis
gcauucauuucuuug

SEQ ID NO: 4165914 - RNA, 22 nt, Yersinia pestis
gcauucccugcgguuauuugcu

SEQ ID NO: 4165915 - RNA, 16 nt, Yersinia pestis
gcauucugcugguuca

SEQ ID NO: 4165916 - RNA, 14 nt, Yersinia pestis
gcauucuuuaucac

SEQ ID NO: 4165917 - RNA, 17 nt, Yersinia pestis
gcauugaccgccaaauc

SEQ ID NO: 4165918 - RNA, 23 nt, Yersinia pestis
gcauugacgauaucaauaaagaa

SEQ ID NO: 4165919 - RNA, 16 nt, Yersinia pestis
gcauugagguuuucug

SEQ ID NO: 4165920 - RNA, 22 nt, Yersinia pestis
gcauugauaaucuccauugauu

SEQ ID NO: 4165921 - RNA, 23 nt, Yersinia pestis
gcauuggccgacugauuaaccaa

SEQ ID NO: 4165922 - RNA, 18 nt, Yersinia pestis
gcauuggugucccaaacu

SEQ ID NO: 4165923 - RNA, 17 nt, Yersinia pestis
gcauugguugcggauga

SEQ ID NO: 4165924 - RNA, 21 nt, Yersinia pestis
gcauuguaaaauaaggcgaau

SEQ ID NO: 4165925 - RNA, 24 nt, Yersinia pestis
gcauugugcuuuuuggcaaacuca

SEQ ID NO: 4165926 - RNA, 22 nt, Yersinia pestis
gcauuguuuggucgguaagcug

SEQ ID NO: 4165927 - RNA, 15 nt, Yersinia pestis
gcauuucauuaaaug

SEQ ID NO: 4165928 - RNA, 17 nt, Yersinia pestis
gcauuucauuaaaugcu

SEQ ID NO: 4165929 - RNA, 18 nt, Yersinia pestis
gcauuucuuuuucaacuc

SEQ ID NO: 4165930 - RNA, 18 nt, Yersinia pestis
gcauuuuaucuucuucag

SEQ ID NO: 4165931 - RNA, 12 nt, Yersinia pestis
gcauuuucagua

SEQ ID NO: 4165932 - RNA, 22 nt, Yersinia pestis
gcauuuuucuguucagauuuac

SEQ ID NO: 4165933 - RNA, 15 nt, Yersinia pestis
gccaaaaaaagggcg

SEQ ID NO: 4165934 - RNA, 19 nt, Yersinia pestis
gccaaaacagccuaaggcc

SEQ ID NO: 4165935 - RNA, 13 nt, Yersinia pestis
gccaaacaguaaa

SEQ ID NO: 4165936 - RNA, 19 nt, Yersinia pestis
gccaaacgugcuacuuaau

SEQ ID NO: 4165937 - RNA, 23 nt, Yersinia pestis
gccaaacgugcuacuuaauaucu

SEQ ID NO: 4165938 - RNA, 20 nt, Yersinia pestis
gccaaauacauauaaccauc

SEQ ID NO: 4165939 - RNA, 22 nt, Yersinia pestis
gccaaauaucuuucagcaccau

SEQ ID NO: 4165940 - RNA, 19 nt, Yersinia pestis
gccaaaucaucagacagcc

SEQ ID NO: 4165941 - RNA, 17 nt, Yersinia pestis
gccaaaugcaaaccagg

SEQ ID NO: 4165942 - RNA, 12 nt, Yersinia pestis
gccaaauguaga

SEQ ID NO: 4165943 - RNA, 21 nt, Yersinia pestis
gccaacaacuggguggccagu

SEQ ID NO: 4165944 - RNA, 18 nt, Yersinia pestis
gccaacaauugcuccagu

SEQ ID NO: 4165945 - RNA, 15 nt, Yersinia pestis
gccaacaggccccuu

SEQ ID NO: 4165946 - RNA, 12 nt, Yersinia pestis
gccaacagugaa

SEQ ID NO: 4165947 - RNA, 22 nt, Yersinia pestis
gccaaccggauaaaacaauagc

SEQ ID NO: 4165948 - RNA, 20 nt, Yersinia pestis
gccaaccguagugagucagg

SEQ ID NO: 4165949 - RNA, 22 nt, Yersinia pestis
gccaacgauaaugacauaauca

SEQ ID NO: 4165950 - RNA, 14 nt, Yersinia pestis
gccaacgucucuuc

SEQ ID NO: 4165951 - RNA, 20 nt, Yersinia pestis
gccaaggggagccacacacu

SEQ ID NO: 4165952 - RNA, 20 nt, Yersinia pestis
gccaagguccaacucccaaa

SEQ ID NO: 4165953 - RNA, 14 nt, Yersinia pestis
gccaaguuugcagu

SEQ ID NO: 4165954 - RNA, 22 nt, Yersinia pestis
gccaaguuugcagucgcuucau

SEQ ID NO: 4165955 - RNA, 16 nt, Yersinia pestis
gccaauaaccgcagca

SEQ ID NO: 4165956 - RNA, 18 nt, Yersinia pestis
gccaauaaccgcagcagg

SEQ ID NO: 4165957 - RNA, 19 nt, Yersinia pestis
gccaauaaccgcagcaggc

SEQ ID NO: 4165958 - RNA, 22 nt, Yersinia pestis
gccaauagaaaaacacuggcag

SEQ ID NO: 4165959 - RNA, 20 nt, Yersinia pestis
gccaauagacaaaagugacg

SEQ ID NO: 4165960 - RNA, 16 nt, Yersinia pestis
gccaauagcaaaccca

SEQ ID NO: 4165961 - RNA, 15 nt, Yersinia pestis
gccaauaggccccuc

SEQ ID NO: 4165962 - RNA, 18 nt, Yersinia pestis
gccaauauccauauuaaa

SEQ ID NO: 4165963 - RNA, 21 nt, Yersinia pestis
gccaauauguuagcagcacaa

SEQ ID NO: 4165964 - RNA, 16 nt, Yersinia pestis
gccaaucaaaaaaccg

SEQ ID NO: 4165965 - RNA, 12 nt, Yersinia pestis
gccaauccccag

SEQ ID NO: 4165966 - RNA, 21 nt, Yersinia pestis
gccaaucgaacccaaccagac

SEQ ID NO: 4165967 - RNA, 20 nt, Yersinia pestis
gccaaucucuuguuuugcaa

SEQ ID NO: 4165968 - RNA, 23 nt, Yersinia pestis
gccaaugccuuagguaagucagc

SEQ ID NO: 4165969 - RNA, 23 nt, Yersinia pestis
gccaauggaaccgcuaaagucac

SEQ ID NO: 4165970 - RNA, 15 nt, Yersinia pestis
gccaauggccacugc

SEQ ID NO: 4165971 - RNA, 16 nt, Yersinia pestis
gccaauuauucucuga

SEQ ID NO: 4165972 - RNA, 21 nt, Yersinia pestis
gccaauuggucaugaugaaua

SEQ ID NO: 4165973 - RNA, 16 nt, Yersinia pestis
gccacaacccaauaau

SEQ ID NO: 4165974 - RNA, 17 nt, Yersinia pestis
gccacaacccaauaaua

SEQ ID NO: 4165975 - RNA, 13 nt, Yersinia pestis
gccacacaauaca

SEQ ID NO: 4165976 - RNA, 15 nt, Yersinia pestis
gccacacacucaggc

SEQ ID NO: 4165977 - RNA, 20 nt, Yersinia pestis
gccacacagaaucaccaaca

SEQ ID NO: 4165978 - RNA, 14 nt, Yersinia pestis
gccacagcaacagg

SEQ ID NO: 4165979 - RNA, 20 nt, Yersinia pestis
gccacaggcugcauggguaa

SEQ ID NO: 4165980 - RNA, 14 nt, Yersinia pestis
gccaccaaaaaacg

SEQ ID NO: 4165981 - RNA, 19 nt, Yersinia pestis
gccaccaaaugcucagcca

SEQ ID NO: 4165982 - RNA, 17 nt, Yersinia pestis
gccaccagaaucaucag

SEQ ID NO: 4165983 - RNA, 14 nt, Yersinia pestis
gccacccauugcuc

SEQ ID NO: 4165984 - RNA, 19 nt, Yersinia pestis
gccaccccguggcaggccu

SEQ ID NO: 4165985 - RNA, 15 nt, Yersinia pestis
gccacccgcuuucag

SEQ ID NO: 4165986 - RNA, 23 nt, Yersinia pestis
gccacccgcuuucagacaacgcu

SEQ ID NO: 4165987 - RNA, 18 nt, Yersinia pestis
gccacccugccaaaaaau

SEQ ID NO: 4165988 - RNA, 23 nt, Yersinia pestis
gccaccgcacaguuaauuuucac

SEQ ID NO: 4165989 - RNA, 18 nt, Yersinia pestis
gccaccgcauuccagcgu

SEQ ID NO: 4165990 - RNA, 16 nt, Yersinia pestis
gccaccggcaguucau

SEQ ID NO: 4165991 - RNA, 19 nt, Yersinia pestis
gccaccggcaguucauucc

SEQ ID NO: 4165992 - RNA, 18 nt, Yersinia pestis
gccaccuucuuauuuauc

SEQ ID NO: 4165993 - RNA, 22 nt, Yersinia pestis
gccacgaauggcgacuaauggc

SEQ ID NO: 4165994 - RNA, 20 nt, Yersinia pestis
gccacgaccauucgcaggcc

SEQ ID NO: 4165995 - RNA, 22 nt, Yersinia pestis
gccacgaguuuucccugcgcca

SEQ ID NO: 4165996 - RNA, 17 nt, Yersinia pestis
gccacgaugugaagcaa

SEQ ID NO: 4165997 - RNA, 19 nt, Yersinia pestis
gccacgccaguaaacagcc

SEQ ID NO: 4165998 - RNA, 21 nt, Yersinia pestis
gccacgccaguaaacagccag

SEQ ID NO: 4165999 - RNA, 22 nt, Yersinia pestis
gccacgccaguaaacagccagc

SEQ ID NO: 4166000 - RNA, 16 nt, Yersinia pestis
gccacggcauuagaag

SEQ ID NO: 4166001 - RNA, 16 nt, Yersinia pestis
gccacucacauaagaa

SEQ ID NO: 4166002 - RNA, 16 nt, Yersinia pestis
gccacucgcaucgccu

SEQ ID NO: 4166003 - RNA, 21 nt, Yersinia pestis
gccacugacgguaauuguucc

SEQ ID NO: 4166004 - RNA, 14 nt, Yersinia pestis
gccacuggccuguu

SEQ ID NO: 4166005 - RNA, 21 nt, Yersinia pestis
gccacuggccuguugcaauug

SEQ ID NO: 4166006 - RNA, 10 nt, Yersinia pestis
gccacuucgc

SEQ ID NO: 4166007 - RNA, 12 nt, Yersinia pestis
gccacuucggug

SEQ ID NO: 4166008 - RNA, 15 nt, Yersinia pestis
gccacuucgguggcc

SEQ ID NO: 4166009 - RNA, 17 nt, Yersinia pestis
gccacuucgguggcccu

SEQ ID NO: 4166010 - RNA, 18 nt, Yersinia pestis
gccacuucgguggcccuu

SEQ ID NO: 4166011 - RNA, 22 nt, Yersinia pestis
gccagaaacagcccagauggca

SEQ ID NO: 4166012 - RNA, 14 nt, Yersinia pestis
gccagaaagcagcc

SEQ ID NO: 4166013 - RNA, 15 nt, Yersinia pestis
gccagaaucaaccac

SEQ ID NO: 4166014 - RNA, 16 nt, Yersinia pestis
gccagaaucagcccca

SEQ ID NO: 4166015 - RNA, 15 nt, Yersinia pestis
gccagaauuuugcag

SEQ ID NO: 4166016 - RNA, 19 nt, Yersinia pestis
gccagaauuuugcagcgcu

SEQ ID NO: 4166017 - RNA, 20 nt, Yersinia pestis
gccagacacugacaucauca

SEQ ID NO: 4166018 - RNA, 22 nt, Yersinia pestis
gccagacgaguauuccccacug

SEQ ID NO: 4166019 - RNA, 13 nt, Yersinia pestis
gccagacuggccg

SEQ ID NO: 4166020 - RNA, 20 nt, Yersinia pestis
gccagagacauaaagcccgc

SEQ ID NO: 4166021 - RNA, 17 nt, Yersinia pestis
gccagauagaccccuuc

SEQ ID NO: 4166022 - RNA, 17 nt, Yersinia pestis
gccagauagagguggcc

SEQ ID NO: 4166023 - RNA, 20 nt, Yersinia pestis
gccagauagcaucauccagc

SEQ ID NO: 4166024 - RNA, 19 nt, Yersinia pestis
gccagauaugaucaaaaau

SEQ ID NO: 4166025 - RNA, 14 nt, Yersinia pestis
gccagauuauccag

SEQ ID NO: 4166026 - RNA, 16 nt, Yersinia pestis
gccagauuauccagcc

SEQ ID NO: 4166027 - RNA, 16 nt, Yersinia pestis
gccagauugccaauca

SEQ ID NO: 4166028 - RNA, 16 nt, Yersinia pestis
gccagauugugcggcu

SEQ ID NO: 4166029 - RNA, 15 nt, Yersinia pestis
gccagauuuaaauca

SEQ ID NO: 4166030 - RNA, 20 nt, Yersinia pestis
gccagcaaccacgguaucaa

SEQ ID NO: 4166031 - RNA, 21 nt, Yersinia pestis
gccagcaauauauugcucuau

SEQ ID NO: 4166032 - RNA, 20 nt, Yersinia pestis
gccagcaauuggccuuccau

SEQ ID NO: 4166033 - RNA, 22 nt, Yersinia pestis
gccagcacguuuuaaugccaau

SEQ ID NO: 4166034 - RNA, 13 nt, Yersinia pestis
gccagcagaaacc

SEQ ID NO: 4166035 - RNA, 23 nt, Yersinia pestis
gccagcauucaggcuuuuuucua

SEQ ID NO: 4166036 - RNA, 14 nt, Yersinia pestis
gccagcccaucacc

SEQ ID NO: 4166037 - RNA, 21 nt, Yersinia pestis
gccagccccaaucaccggcug

SEQ ID NO: 4166038 - RNA, 22 nt, Yersinia pestis
gccagccccaaucaccggcugg

SEQ ID NO: 4166039 - RNA, 18 nt, Yersinia pestis
gccagccccaauccgccu

SEQ ID NO: 4166040 - RNA, 15 nt, Yersinia pestis
gccagcgccccauca

SEQ ID NO: 4166041 - RNA, 20 nt, Yersinia pestis
gccagcgcuaacgguggcau

SEQ ID NO: 4166042 - RNA, 19 nt, Yersinia pestis
gccagcggcaccgccguca

SEQ ID NO: 4166043 - RNA, 20 nt, Yersinia pestis
gccagcgggaaucaaacucu

SEQ ID NO: 4166044 - RNA, 17 nt, Yersinia pestis
gccagcggguacacugu

SEQ ID NO: 4166045 - RNA, 13 nt, Yersinia pestis
gccagcugcaauu

SEQ ID NO: 4166046 - RNA, 14 nt, Yersinia pestis
gccagcugcaauug

SEQ ID NO: 4166047 - RNA, 18 nt, Yersinia pestis
gccagcugcaauugccgc

SEQ ID NO: 4166048 - RNA, 21 nt, Yersinia pestis
gccagcuuuuuaucauuuaaa

SEQ ID NO: 4166049 - RNA, 19 nt, Yersinia pestis
gccaggauagccgccgcuu

SEQ ID NO: 4166050 - RNA, 17 nt, Yersinia pestis
gccaggcgacaugguca

SEQ ID NO: 4166051 - RNA, 16 nt, Yersinia pestis
gccaggcucccaaggg

SEQ ID NO: 4166052 - RNA, 17 nt, Yersinia pestis
gccagguaagaaagaga

SEQ ID NO: 4166053 - RNA, 13 nt, Yersinia pestis
gccaggucaggaa

SEQ ID NO: 4166054 - RNA, 23 nt, Yersinia pestis
gccaguaacgcuucaucauggau

SEQ ID NO: 4166055 - RNA, 18 nt, Yersinia pestis
gccaguauccagaugauu

SEQ ID NO: 4166056 - RNA, 19 nt, Yersinia pestis
gccaguauuagccagcaga

SEQ ID NO: 4166057 - RNA, 14 nt, Yersinia pestis
gccagucaaugacg

SEQ ID NO: 4166058 - RNA, 14 nt, Yersinia pestis
gccagugaaucagc

SEQ ID NO: 4166059 - RNA, 19 nt, Yersinia pestis
gccagugacaacuuagguu

SEQ ID NO: 4166060 - RNA, 15 nt, Yersinia pestis
gccagugacugagca

SEQ ID NO: 4166061 - RNA, 18 nt, Yersinia pestis
gccagugaugcugcacau

SEQ ID NO: 4166062 - RNA, 20 nt, Yersinia pestis
gccagugaugcugcacauca

SEQ ID NO: 4166063 - RNA, 22 nt, Yersinia pestis
gccagugccaccguaaaaaacc

SEQ ID NO: 4166064 - RNA, 18 nt, Yersinia pestis
gccagugccgcggcggcc

SEQ ID NO: 4166065 - RNA, 15 nt, Yersinia pestis
gccagugcuggcaac

SEQ ID NO: 4166066 - RNA, 22 nt, Yersinia pestis
gccaguggcaucaauauaacgc

SEQ ID NO: 4166067 - RNA, 23 nt, Yersinia pestis
gccagugggcagggcgcaauggc

SEQ ID NO: 4166068 - RNA, 17 nt, Yersinia pestis
gccaguguuuucuccac

SEQ ID NO: 4166069 - RNA, 13 nt, Yersinia pestis
gccaguugcucac

SEQ ID NO: 4166070 - RNA, 19 nt, Yersinia pestis
gccaguuugcgaccaauac

SEQ ID NO: 4166071 - RNA, 22 nt, Yersinia pestis
gccauaaaugggaagggcgccg

SEQ ID NO: 4166072 - RNA, 21 nt, Yersinia pestis
gccauaaccugagcaccagaa

SEQ ID NO: 4166073 - RNA, 20 nt, Yersinia pestis
gccauaagcccccguaucau

SEQ ID NO: 4166074 - RNA, 20 nt, Yersinia pestis
gccauaagcgacgacauuaa

SEQ ID NO: 4166075 - RNA, 22 nt, Yersinia pestis
gccauaagugcacugaacccca

SEQ ID NO: 4166076 - RNA, 13 nt, Yersinia pestis
gccauaaugccgu

SEQ ID NO: 4166077 - RNA, 22 nt, Yersinia pestis
gccauacccaaaccaacaauau

SEQ ID NO: 4166078 - RNA, 17 nt, Yersinia pestis
gccauagcccaugauug

SEQ ID NO: 4166079 - RNA, 18 nt, Yersinia pestis
gccauagccgaucaccgc

SEQ ID NO: 4166080 - RNA, 19 nt, Yersinia pestis
gccauauacgcauaaugcg

SEQ ID NO: 4166081 - RNA, 13 nt, Yersinia pestis
gccauauccaacu

SEQ ID NO: 4166082 - RNA, 21 nt, Yersinia pestis
gccauauguugccaccagcgu

SEQ ID NO: 4166083 - RNA, 15 nt, Yersinia pestis
gccauauucaccaca

SEQ ID NO: 4166084 - RNA, 14 nt, Yersinia pestis
gccaucaauaaagc

SEQ ID NO: 4166085 - RNA, 22 nt, Yersinia pestis
gccaucaauaaagcuggcuaac

SEQ ID NO: 4166086 - RNA, 21 nt, Yersinia pestis
gccaucaccaugccuucugaa

SEQ ID NO: 4166087 - RNA, 16 nt, Yersinia pestis
gccaucaggcaaaagc

SEQ ID NO: 4166088 - RNA, 16 nt, Yersinia pestis
gccaucauauuagcaa

SEQ ID NO: 4166089 - RNA, 20 nt, Yersinia pestis
gccaucaucuucaaccugga

SEQ ID NO: 4166090 - RNA, 20 nt, Yersinia pestis
gccaucccccuuuggccgcu

SEQ ID NO: 4166091 - RNA, 19 nt, Yersinia pestis
gccauccuuuacuccccug

SEQ ID NO: 4166092 - RNA, 23 nt, Yersinia pestis
gccauccuuuacuccccugccua

SEQ ID NO: 4166093 - RNA, 14 nt, Yersinia pestis
gccaucgccaacag

SEQ ID NO: 4166094 - RNA, 17 nt, Yersinia pestis
gccaucgccaacaggcc

SEQ ID NO: 4166095 - RNA, 13 nt, Yersinia pestis
gccaucgccaucg

SEQ ID NO: 4166096 - RNA, 17 nt, Yersinia pestis
gccaucgccccaaagau

SEQ ID NO: 4166097 - RNA, 21 nt, Yersinia pestis
gccaucgcuaaucauauccau

SEQ ID NO: 4166098 - RNA, 15 nt, Yersinia pestis
gccaucuaacugcac

SEQ ID NO: 4166099 - RNA, 17 nt, Yersinia pestis
gccaucuugucgucacc

SEQ ID NO: 4166100 - RNA, 19 nt, Yersinia pestis
gccaucuuguucuaauaau

SEQ ID NO: 4166101 - RNA, 20 nt, Yersinia pestis
gccaucuuguucuaauaaua

SEQ ID NO: 4166102 - RNA, 16 nt, Yersinia pestis
gccaugaaucaaauua

SEQ ID NO: 4166103 - RNA, 12 nt, Yersinia pestis
gccaugagaacc

SEQ ID NO: 4166104 - RNA, 18 nt, Yersinia pestis
gccaugauaaccacaacg

SEQ ID NO: 4166105 - RNA, 18 nt, Yersinia pestis
gccaugcauuaaggcgcg

SEQ ID NO: 4166106 - RNA, 15 nt, Yersinia pestis
gccaugcuggaugaa

SEQ ID NO: 4166107 - RNA, 18 nt, Yersinia pestis
gccauggccgccagcacg

SEQ ID NO: 4166108 - RNA, 17 nt, Yersinia pestis
gccauggcgaaaauccu

SEQ ID NO: 4166109 - RNA, 21 nt, Yersinia pestis
gccauggcgaaaauccuucau

SEQ ID NO: 4166110 - RNA, 14 nt, Yersinia pestis
gccaugggaaauca

SEQ ID NO: 4166111 - RNA, 15 nt, Yersinia pestis
gccaugucaggccac

SEQ ID NO: 4166112 - RNA, 23 nt, Yersinia pestis
gccauguguuuguuuggauaaaa

SEQ ID NO: 4166113 - RNA, 21 nt, Yersinia pestis
gccauuaaggccacugacggu

SEQ ID NO: 4166114 - RNA, 22 nt, Yersinia pestis
gccauuaaggccacugacggua

SEQ ID NO: 4166115 - RNA, 18 nt, Yersinia pestis
gccauuacaucccgccau

SEQ ID NO: 4166116 - RNA, 22 nt, Yersinia pestis
gccauuacaucccgccauggca

SEQ ID NO: 4166117 - RNA, 12 nt, Yersinia pestis
gccauuacccuc

SEQ ID NO: 4166118 - RNA, 19 nt, Yersinia pestis
gccauucauuuaucaagcc

SEQ ID NO: 4166119 - RNA, 19 nt, Yersinia pestis
gccauucauuuuuuauauu

SEQ ID NO: 4166120 - RNA, 14 nt, Yersinia pestis
gccauucuggcgca

SEQ ID NO: 4166121 - RNA, 21 nt, Yersinia pestis
gccauugccgaaccugcaugu

SEQ ID NO: 4166122 - RNA, 19 nt, Yersinia pestis
gccauuggcaaaggccagc

SEQ ID NO: 4166123 - RNA, 17 nt, Yersinia pestis
gccauuuauauaacgac

SEQ ID NO: 4166124 - RNA, 15 nt, Yersinia pestis
gccauuucaccaaua

SEQ ID NO: 4166125 - RNA, 20 nt, Yersinia pestis
gccauuuguuaaucgcugaa

SEQ ID NO: 4166126 - RNA, 13 nt, Yersinia pestis
gccauuuuggguu

SEQ ID NO: 4166127 - RNA, 15 nt, Yersinia pestis
gcccaaaaucaaaua

SEQ ID NO: 4166128 - RNA, 15 nt, Yersinia pestis
gcccaaaucugccug

SEQ ID NO: 4166129 - RNA, 19 nt, Yersinia pestis
gcccaacucuuuagccgcu

SEQ ID NO: 4166130 - RNA, 12 nt, Yersinia pestis
gcccaacuggcg

SEQ ID NO: 4166131 - RNA, 14 nt, Yersinia pestis
gcccaagaauaaua

SEQ ID NO: 4166132 - RNA, 11 nt, Yersinia pestis
gcccaagccau

SEQ ID NO: 4166133 - RNA, 15 nt, Yersinia pestis
gcccaagccauccuu

SEQ ID NO: 4166134 - RNA, 22 nt, Yersinia pestis
gcccaaggcgacuuugaugcca

SEQ ID NO: 4166135 - RNA, 22 nt, Yersinia pestis
gcccaauaaaaacgccuccagu

SEQ ID NO: 4166136 - RNA, 21 nt, Yersinia pestis
gcccaauaagugaaacaaaua

SEQ ID NO: 4166137 - RNA, 18 nt, Yersinia pestis
gcccaaucuaacuggccc

SEQ ID NO: 4166138 - RNA, 20 nt, Yersinia pestis
gcccaaugcugucacuguca

SEQ ID NO: 4166139 - RNA, 17 nt, Yersinia pestis
gcccacaccaaucagcu

SEQ ID NO: 4166140 - RNA, 22 nt, Yersinia pestis
gcccacagggugagucucaggg

SEQ ID NO: 4166141 - RNA, 19 nt, Yersinia pestis
gcccacuggccugagaacc

SEQ ID NO: 4166142 - RNA, 16 nt, Yersinia pestis
gcccagaaaggcaaaa

SEQ ID NO: 4166143 - RNA, 13 nt, Yersinia pestis
gcccagagcgcgg

SEQ ID NO: 4166144 - RNA, 20 nt, Yersinia pestis
gcccagagcgcggcuucagc

SEQ ID NO: 4166145 - RNA, 14 nt, Yersinia pestis
gcccagauauccau

SEQ ID NO: 4166146 - RNA, 21 nt, Yersinia pestis
gcccagauucauuagccagcc

SEQ ID NO: 4166147 - RNA, 20 nt, Yersinia pestis
gcccagccgggguaucauag

SEQ ID NO: 4166148 - RNA, 18 nt, Yersinia pestis
gcccagccugguuuuuua

SEQ ID NO: 4166149 - RNA, 21 nt, Yersinia pestis
gcccaggcaaucucuccccaa

SEQ ID NO: 4166150 - RNA, 23 nt, Yersinia pestis
gcccaguauugcagagcaaaacu

SEQ ID NO: 4166151 - RNA, 14 nt, Yersinia pestis
gcccaguuuaccau

SEQ ID NO: 4166152 - RNA, 14 nt, Yersinia pestis
gcccauagaccugc

SEQ ID NO: 4166153 - RNA, 14 nt, Yersinia pestis
gcccauagccaugg

SEQ ID NO: 4166154 - RNA, 19 nt, Yersinia pestis
gcccauauagcggcguuca

SEQ ID NO: 4166155 - RNA, 21 nt, Yersinia pestis
gcccauauccuuaacagcacg

SEQ ID NO: 4166156 - RNA, 18 nt, Yersinia pestis
gcccaucaaccaccgcca

SEQ ID NO: 4166157 - RNA, 11 nt, Yersinia pestis
gcccaucagca

SEQ ID NO: 4166158 - RNA, 14 nt, Yersinia pestis
gcccaucaugccag

SEQ ID NO: 4166159 - RNA, 16 nt, Yersinia pestis
gcccaucaugccagca

SEQ ID NO: 4166160 - RNA, 14 nt, Yersinia pestis
gcccauccgcagga

SEQ ID NO: 4166161 - RNA, 16 nt, Yersinia pestis
gcccaucuuugauuua

SEQ ID NO: 4166162 - RNA, 23 nt, Yersinia pestis
gcccaugaccacuugguuggcac

SEQ ID NO: 4166163 - RNA, 20 nt, Yersinia pestis
gcccauuaguaaugggauca

SEQ ID NO: 4166164 - RNA, 12 nt, Yersinia pestis
gcccauugcgcu

SEQ ID NO: 4166165 - RNA, 18 nt, Yersinia pestis
gccccaacacuggggcgc

SEQ ID NO: 4166166 - RNA, 15 nt, Yersinia pestis
gccccaaccaucucc

SEQ ID NO: 4166167 - RNA, 15 nt, Yersinia pestis
gccccaaucaccggc

SEQ ID NO: 4166168 - RNA, 16 nt, Yersinia pestis
gccccauggcuaacau

SEQ ID NO: 4166169 - RNA, 19 nt, Yersinia pestis
gcccccaauaagggccacc

SEQ ID NO: 4166170 - RNA, 21 nt, Yersinia pestis
gcccccaauaagggccacccu

SEQ ID NO: 4166171 - RNA, 13 nt, Yersinia pestis
gcccccaaugaca

SEQ ID NO: 4166172 - RNA, 23 nt, Yersinia pestis
gcccccgccuguauccagcagcg

SEQ ID NO: 4166173 - RNA, 15 nt, Yersinia pestis
gcccccuccaacuga

SEQ ID NO: 4166174 - RNA, 13 nt, Yersinia pestis
gcccccucccgau

SEQ ID NO: 4166175 - RNA, 16 nt, Yersinia pestis
gccccgcuaccaagcc

SEQ ID NO: 4166176 - RNA, 17 nt, Yersinia pestis
gccccgcuauugcccau

SEQ ID NO: 4166177 - RNA, 13 nt, Yersinia pestis
gccccucagacug

SEQ ID NO: 4166178 - RNA, 15 nt, Yersinia pestis
gccccuguaaauaaa

SEQ ID NO: 4166179 - RNA, 17 nt, Yersinia pestis
gccccuguuugcgcagc

SEQ ID NO: 4166180 - RNA, 22 nt, Yersinia pestis
gccccuucacggaaaauaaagc

SEQ ID NO: 4166181 - RNA, 13 nt, Yersinia pestis
gccccuucuggug

SEQ ID NO: 4166182 - RNA, 20 nt, Yersinia pestis
gccccuugcuucaguuuugc

SEQ ID NO: 4166183 - RNA, 23 nt, Yersinia pestis
gccccuuguugccgguaggguuc

SEQ ID NO: 4166184 - RNA, 21 nt, Yersinia pestis
gcccgcagcggcuagcagcag

SEQ ID NO: 4166185 - RNA, 17 nt, Yersinia pestis
gcccgcgacgagagaac

SEQ ID NO: 4166186 - RNA, 22 nt, Yersinia pestis
gcccgcgacggagagaacaggc

SEQ ID NO: 4166187 - RNA, 22 nt, Yersinia pestis
gcccgcggccaauagcaaaccc

SEQ ID NO: 4166188 - RNA, 21 nt, Yersinia pestis
gcccgcuagugauagcgggcc

SEQ ID NO: 4166189 - RNA, 22 nt, Yersinia pestis
gcccgcuagugauagcgggccu

SEQ ID NO: 4166190 - RNA, 15 nt, Yersinia pestis
gcccgcuaucacuag

SEQ ID NO: 4166191 - RNA, 21 nt, Yersinia pestis
gcccgcuaucacuagcgggcc

SEQ ID NO: 4166192 - RNA, 22 nt, Yersinia pestis
gcccgcuaucacuagcgggccu

SEQ ID NO: 4166193 - RNA, 14 nt, Yersinia pestis
gcccgcuucccuac

SEQ ID NO: 4166194 - RNA, 23 nt, Yersinia pestis
gcccggcuaaacgcucaaacaau

SEQ ID NO: 4166195 - RNA, 14 nt, Yersinia pestis
gcccguaaacgggc

SEQ ID NO: 4166196 - RNA, 21 nt, Yersinia pestis
gcccuaacaggcgcaucgcga

SEQ ID NO: 4166197 - RNA, 22 nt, Yersinia pestis
gcccuaaccgcuuuuuacccag

SEQ ID NO: 4166198 - RNA, 20 nt, Yersinia pestis
gcccuaauauccucaaaauu

SEQ ID NO: 4166199 - RNA, 19 nt, Yersinia pestis
gcccucccuggcgcggacg

SEQ ID NO: 4166200 - RNA, 12 nt, Yersinia pestis
gcccugaagcaa

SEQ ID NO: 4166201 - RNA, 22 nt, Yersinia pestis
gcccugaauuucaauaacaccg

SEQ ID NO: 4166202 - RNA, 19 nt, Yersinia pestis
gcccugagauucaacccac

SEQ ID NO: 4166203 - RNA, 22 nt, Yersinia pestis
gcccugagguuauugacaaagu

SEQ ID NO: 4166204 - RNA, 14 nt, Yersinia pestis
gcccugaguuaagu

SEQ ID NO: 4166205 - RNA, 18 nt, Yersinia pestis
gcccugaguuaucuguuu

SEQ ID NO: 4166206 - RNA, 14 nt, Yersinia pestis
gcccugccuggcag

SEQ ID NO: 4166207 - RNA, 21 nt, Yersinia pestis
gcccuguaacuuuauugacug

SEQ ID NO: 4166208 - RNA, 18 nt, Yersinia pestis
gcccuguaaugauggcga

SEQ ID NO: 4166209 - RNA, 16 nt, Yersinia pestis
gcccuguugcccagca

SEQ ID NO: 4166210 - RNA, 20 nt, Yersinia pestis
gcccuuaucuacugggccaa

SEQ ID NO: 4166211 - RNA, 21 nt, Yersinia pestis
gcccuucagaugaauccagcc

SEQ ID NO: 4166212 - RNA, 15 nt, Yersinia pestis
gcccuucagcaaaug

SEQ ID NO: 4166213 - RNA, 23 nt, Yersinia pestis
gcccuuguaagauaccaacccac

SEQ ID NO: 4166214 - RNA, 18 nt, Yersinia pestis
gcccuuucgcagcccaau

SEQ ID NO: 4166215 - RNA, 14 nt, Yersinia pestis
gcccuuucuuguug

SEQ ID NO: 4166216 - RNA, 17 nt, Yersinia pestis
gcccuuuugugcaucca

SEQ ID NO: 4166217 - RNA, 16 nt, Yersinia pestis
gcccuuuuugccuccc

SEQ ID NO: 4166218 - RNA, 18 nt, Yersinia pestis
gcccuuuuugguuuucua

SEQ ID NO: 4166219 - RNA, 17 nt, Yersinia pestis
gcccuuuuuuauugcgu

SEQ ID NO: 4166220 - RNA, 15 nt, Yersinia pestis
gccgaaagccaagca

SEQ ID NO: 4166221 - RNA, 20 nt, Yersinia pestis
gccgaaagccaagcaagcgg

SEQ ID NO: 4166222 - RNA, 15 nt, Yersinia pestis
gccgaaaucucacca

SEQ ID NO: 4166223 - RNA, 19 nt, Yersinia pestis
gccgaaccccuagccagcc

SEQ ID NO: 4166224 - RNA, 17 nt, Yersinia pestis
gccgacaaaauccccca

SEQ ID NO: 4166225 - RNA, 20 nt, Yersinia pestis
gccgacaaacccacacccuu

SEQ ID NO: 4166226 - RNA, 12 nt, Yersinia pestis
gccgacugcuga

SEQ ID NO: 4166227 - RNA, 14 nt, Yersinia pestis
gccgagaacagaau

SEQ ID NO: 4166228 - RNA, 18 nt, Yersinia pestis
gccgagcaagugaauaac

SEQ ID NO: 4166229 - RNA, 17 nt, Yersinia pestis
gccgaggugaagacacc

SEQ ID NO: 4166230 - RNA, 16 nt, Yersinia pestis
gccgagguuauagcag

SEQ ID NO: 4166231 - RNA, 13 nt, Yersinia pestis
gccgaguaaguca

SEQ ID NO: 4166232 - RNA, 19 nt, Yersinia pestis
gccgaguucgucgggggug

SEQ ID NO: 4166233 - RNA, 15 nt, Yersinia pestis
gccgauaaucccugc

SEQ ID NO: 4166234 - RNA, 19 nt, Yersinia pestis
gccgauaaucccugccaga

SEQ ID NO: 4166235 - RNA, 14 nt, Yersinia pestis
gccgauacgaucau

SEQ ID NO: 4166236 - RNA, 17 nt, Yersinia pestis
gccgaucaacaggccac

SEQ ID NO: 4166237 - RNA, 18 nt, Yersinia pestis
gccgaucaacaggccacc

SEQ ID NO: 4166238 - RNA, 15 nt, Yersinia pestis
gccgaucauaaauca

SEQ ID NO: 4166239 - RNA, 19 nt, Yersinia pestis
gccgaugaagguaaugcga

SEQ ID NO: 4166240 - RNA, 14 nt, Yersinia pestis
gccgauguuugagc

SEQ ID NO: 4166241 - RNA, 21 nt, Yersinia pestis
gccgcacgaaccguggcgcgg

SEQ ID NO: 4166242 - RNA, 15 nt, Yersinia pestis
gccgcacugccacca

SEQ ID NO: 4166243 - RNA, 14 nt, Yersinia pestis
gccgcagagaugaa

SEQ ID NO: 4166244 - RNA, 13 nt, Yersinia pestis
gccgcagauaaac

SEQ ID NO: 4166245 - RNA, 18 nt, Yersinia pestis
gccgcagcagugccuggu

SEQ ID NO: 4166246 - RNA, 14 nt, Yersinia pestis
gccgcagccagcgu

SEQ ID NO: 4166247 - RNA, 18 nt, Yersinia pestis
gccgcaguuaccggucau

SEQ ID NO: 4166248 - RNA, 16 nt, Yersinia pestis
gccgcaucaaagcgcg

SEQ ID NO: 4166249 - RNA, 17 nt, Yersinia pestis
gccgcaugcaacagaua

SEQ ID NO: 4166250 - RNA, 19 nt, Yersinia pestis
gccgcaugcaacagauaau

SEQ ID NO: 4166251 - RNA, 15 nt, Yersinia pestis
gccgcauucaccacc

SEQ ID NO: 4166252 - RNA, 17 nt, Yersinia pestis
gccgcauucaccaccau

SEQ ID NO: 4166253 - RNA, 15 nt, Yersinia pestis
gccgccaacagugaa

SEQ ID NO: 4166254 - RNA, 21 nt, Yersinia pestis
gccgccagccuugugcuucau

SEQ ID NO: 4166255 - RNA, 13 nt, Yersinia pestis
gccgcccagcgac

SEQ ID NO: 4166256 - RNA, 17 nt, Yersinia pestis
gccgccgccagccccgc

SEQ ID NO: 4166257 - RNA, 14 nt, Yersinia pestis
gccgccucugcucc

SEQ ID NO: 4166258 - RNA, 17 nt, Yersinia pestis
gccgcgcccccagccau

SEQ ID NO: 4166259 - RNA, 17 nt, Yersinia pestis
gccgcgcccuaacaggc

SEQ ID NO: 4166260 - RNA, 20 nt, Yersinia pestis
gccgcgcccuaacaggcgca

SEQ ID NO: 4166261 - RNA, 12 nt, Yersinia pestis
gccgcggcggcc

SEQ ID NO: 4166262 - RNA, 14 nt, Yersinia pestis
gccgcggcggccag

SEQ ID NO: 4166263 - RNA, 13 nt, Yersinia pestis
gccgcggcuggga

SEQ ID NO: 4166264 - RNA, 17 nt, Yersinia pestis
gccgcggugaagaacag

SEQ ID NO: 4166265 - RNA, 18 nt, Yersinia pestis
gccgcuaauuuucccugu

SEQ ID NO: 4166266 - RNA, 16 nt, Yersinia pestis
gccgcuagugagugaa

SEQ ID NO: 4166267 - RNA, 18 nt, Yersinia pestis
gccgcuaucacaucgccc

SEQ ID NO: 4166268 - RNA, 15 nt, Yersinia pestis
gccgcucaugcccca

SEQ ID NO: 4166269 - RNA, 14 nt, Yersinia pestis
gccgcuccagcacu

SEQ ID NO: 4166270 - RNA, 17 nt, Yersinia pestis
gccgcucgguagcaaaa

SEQ ID NO: 4166271 - RNA, 17 nt, Yersinia pestis
gccgcugcgcaagcgcu

SEQ ID NO: 4166272 - RNA, 22 nt, Yersinia pestis
gccgcuucgcugacauuuucua

SEQ ID NO: 4166273 - RNA, 19 nt, Yersinia pestis
gccgcuuguugccacccua

SEQ ID NO: 4166274 - RNA, 13 nt, Yersinia pestis
gccgcuuuagcga

SEQ ID NO: 4166275 - RNA, 21 nt, Yersinia pestis
gccgcuuucaucgauugcugg

SEQ ID NO: 4166276 - RNA, 22 nt, Yersinia pestis
gccgcuuugguugccagauaau

SEQ ID NO: 4166277 - RNA, 18 nt, Yersinia pestis
gccggaaaagagauagca

SEQ ID NO: 4166278 - RNA, 17 nt, Yersinia pestis
gccggagugaugaaacc

SEQ ID NO: 4166279 - RNA, 19 nt, Yersinia pestis
gccggagugaugaaaccaa

SEQ ID NO: 4166280 - RNA, 16 nt, Yersinia pestis
gccggauguaaaacac

SEQ ID NO: 4166281 - RNA, 14 nt, Yersinia pestis
gccggauucaaggc

SEQ ID NO: 4166282 - RNA, 13 nt, Yersinia pestis
gccggcaacagcg

SEQ ID NO: 4166283 - RNA, 18 nt, Yersinia pestis
gccggcaacagcgccugc

SEQ ID NO: 4166284 - RNA, 13 nt, Yersinia pestis
gccggccaacauc

SEQ ID NO: 4166285 - RNA, 14 nt, Yersinia pestis
gccggcuucccugu

SEQ ID NO: 4166286 - RNA, 22 nt, Yersinia pestis
gccggguaugaaguugucagug

SEQ ID NO: 4166287 - RNA, 14 nt, Yersinia pestis
gccgggucaggaag

SEQ ID NO: 4166288 - RNA, 16 nt, Yersinia pestis
gccgguauucagccaa

SEQ ID NO: 4166289 - RNA, 21 nt, Yersinia pestis
gccguaaacugccguaaacaa

SEQ ID NO: 4166290 - RNA, 22 nt, Yersinia pestis
gccguaaugacucgauaaccca

SEQ ID NO: 4166291 - RNA, 16 nt, Yersinia pestis
gccguacaacaauaau

SEQ ID NO: 4166292 - RNA, 13 nt, Yersinia pestis
gccguagcauuca

SEQ ID NO: 4166293 - RNA, 20 nt, Yersinia pestis
gccguauaaacgccuccgau

SEQ ID NO: 4166294 - RNA, 18 nt, Yersinia pestis
gccguaucuuguaguaac

SEQ ID NO: 4166295 - RNA, 16 nt, Yersinia pestis
gccgucagcucuuguu

SEQ ID NO: 4166296 - RNA, 13 nt, Yersinia pestis
gccgucaucaucu

SEQ ID NO: 4166297 - RNA, 12 nt, Yersinia pestis
gccgucuggcua

SEQ ID NO: 4166298 - RNA, 21 nt, Yersinia pestis
gccgucuggcuaauacugcca

SEQ ID NO: 4166299 - RNA, 14 nt, Yersinia pestis
gccgugacuacggu

SEQ ID NO: 4166300 - RNA, 17 nt, Yersinia pestis
gccgugacugccgggau

SEQ ID NO: 4166301 - RNA, 17 nt, Yersinia pestis
gccgugccugcuggcaa

SEQ ID NO: 4166302 - RNA, 18 nt, Yersinia pestis
gccgugccugcuggcaaa

SEQ ID NO: 4166303 - RNA, 11 nt, Yersinia pestis
gccgugcuuga

SEQ ID NO: 4166304 - RNA, 19 nt, Yersinia pestis
gccgugucgggccaauaaa

SEQ ID NO: 4166305 - RNA, 18 nt, Yersinia pestis
gccguuacccccuucacc

SEQ ID NO: 4166306 - RNA, 19 nt, Yersinia pestis
gccguuauagaucuccugc

SEQ ID NO: 4166307 - RNA, 20 nt, Yersinia pestis
gccguuggcuaaauaaccag

SEQ ID NO: 4166308 - RNA, 17 nt, Yersinia pestis
gccguuuaccuugugcg

SEQ ID NO: 4166309 - RNA, 20 nt, Yersinia pestis
gccguuucaggguauaugga

SEQ ID NO: 4166310 - RNA, 14 nt, Yersinia pestis
gccguuuugcucgg

SEQ ID NO: 4166311 - RNA, 18 nt, Yersinia pestis
gccuaaaaaugauuucag

SEQ ID NO: 4166312 - RNA, 19 nt, Yersinia pestis
gccuaaaaaugauuucagg

SEQ ID NO: 4166313 - RNA, 20 nt, Yersinia pestis
gccuaaaaugaauaacgccg

SEQ ID NO: 4166314 - RNA, 12 nt, Yersinia pestis
gccuaaacccca

SEQ ID NO: 4166315 - RNA, 15 nt, Yersinia pestis
gccuaacaaacugaa

SEQ ID NO: 4166316 - RNA, 19 nt, Yersinia pestis
gccuaaggccaucaauaaa

SEQ ID NO: 4166317 - RNA, 23 nt, Yersinia pestis
gccuaauuucgguagcucggccc

SEQ ID NO: 4166318 - RNA, 23 nt, Yersinia pestis
gccuaauuugguacgacgccaga

SEQ ID NO: 4166319 - RNA, 16 nt, Yersinia pestis
gccuacaacuugcugg

SEQ ID NO: 4166320 - RNA, 12 nt, Yersinia pestis
gccuaccugccu

SEQ ID NO: 4166321 - RNA, 15 nt, Yersinia pestis
gccuagcaucauaaa

SEQ ID NO: 4166322 - RNA, 15 nt, Yersinia pestis
gccuagcccaguacc

SEQ ID NO: 4166323 - RNA, 22 nt, Yersinia pestis
gccuaguuaaacucaccgagca

SEQ ID NO: 4166324 - RNA, 17 nt, Yersinia pestis
gccuauaccugcgaaca

SEQ ID NO: 4166325 - RNA, 13 nt, Yersinia pestis
gccuauccucacc

SEQ ID NO: 4166326 - RNA, 14 nt, Yersinia pestis
gccuauccucaccg

SEQ ID NO: 4166327 - RNA, 14 nt, Yersinia pestis
gccuauccucauga

SEQ ID NO: 4166328 - RNA, 15 nt, Yersinia pestis
gccuauccucaugau

SEQ ID NO: 4166329 - RNA, 19 nt, Yersinia pestis
gccuauugaauaacagcua

SEQ ID NO: 4166330 - RNA, 16 nt, Yersinia pestis
gccucaacgcacccca

SEQ ID NO: 4166331 - RNA, 20 nt, Yersinia pestis
gccucaauuuugccuucugc

SEQ ID NO: 4166332 - RNA, 19 nt, Yersinia pestis
gccucacaacuuucccagu

SEQ ID NO: 4166333 - RNA, 13 nt, Yersinia pestis
gccucaccgccag

SEQ ID NO: 4166334 - RNA, 14 nt, Yersinia pestis
gccucaucucauga

SEQ ID NO: 4166335 - RNA, 21 nt, Yersinia pestis
gccuccaacuuaucacuggag

SEQ ID NO: 4166336 - RNA, 16 nt, Yersinia pestis
gccuccagucccccuc

SEQ ID NO: 4166337 - RNA, 13 nt, Yersinia pestis
gccuccagugaua

SEQ ID NO: 4166338 - RNA, 17 nt, Yersinia pestis
gccucccaauuagggga

SEQ ID NO: 4166339 - RNA, 22 nt, Yersinia pestis
gccucgaccugaauaucaccca

SEQ ID NO: 4166340 - RNA, 17 nt, Yersinia pestis
gccucgaccuuaaccgc

SEQ ID NO: 4166341 - RNA, 22 nt, Yersinia pestis
gccucgacuuuauucaaaccgc

SEQ ID NO: 4166342 - RNA, 20 nt, Yersinia pestis
gccucgcggaaaucagcuuc

SEQ ID NO: 4166343 - RNA, 15 nt, Yersinia pestis
gccucuagcuaacag

SEQ ID NO: 4166344 - RNA, 16 nt, Yersinia pestis
gccucuggugccaacg

SEQ ID NO: 4166345 - RNA, 16 nt, Yersinia pestis
gccucuguagccgcag

SEQ ID NO: 4166346 - RNA, 20 nt, Yersinia pestis
gccugaaucugaauggcccg

SEQ ID NO: 4166347 - RNA, 18 nt, Yersinia pestis
gccugaauggaaaaauua

SEQ ID NO: 4166348 - RNA, 15 nt, Yersinia pestis
gccugauccaacauc

SEQ ID NO: 4166349 - RNA, 22 nt, Yersinia pestis
gccugaugagaaugugacucag

SEQ ID NO: 4166350 - RNA, 16 nt, Yersinia pestis
gccugcaccagugcca

SEQ ID NO: 4166351 - RNA, 17 nt, Yersinia pestis
gccugcaccagugccaa

SEQ ID NO: 4166352 - RNA, 18 nt, Yersinia pestis
gccugcaccagugccaau

SEQ ID NO: 4166353 - RNA, 23 nt, Yersinia pestis
gccugcaccagugccaaucccca

SEQ ID NO: 4166354 - RNA, 16 nt, Yersinia pestis
gccugccauacccgcu

SEQ ID NO: 4166355 - RNA, 20 nt, Yersinia pestis
gccugccugcugcuccacca

SEQ ID NO: 4166356 - RNA, 21 nt, Yersinia pestis
gccugcgaauuaucauccaga

SEQ ID NO: 4166357 - RNA, 14 nt, Yersinia pestis
gccugcgacagcac

SEQ ID NO: 4166358 - RNA, 16 nt, Yersinia pestis
gccugcgacagcacgu

SEQ ID NO: 4166359 - RNA, 13 nt, Yersinia pestis
gccugcggccauc

SEQ ID NO: 4166360 - RNA, 14 nt, Yersinia pestis
gccugcggcggcua

SEQ ID NO: 4166361 - RNA, 22 nt, Yersinia pestis
gccugcguaaucguauucucaa

SEQ ID NO: 4166362 - RNA, 14 nt, Yersinia pestis
gccugcugagccaa

SEQ ID NO: 4166363 - RNA, 17 nt, Yersinia pestis
gccugcugagccaaaua

SEQ ID NO: 4166364 - RNA, 15 nt, Yersinia pestis
gccuggaaacgaccu

SEQ ID NO: 4166365 - RNA, 16 nt, Yersinia pestis
gccuggcuugaccuug

SEQ ID NO: 4166366 - RNA, 19 nt, Yersinia pestis
gccugggcauacuguuugc

SEQ ID NO: 4166367 - RNA, 14 nt, Yersinia pestis
gccuggugcaaccg

SEQ ID NO: 4166368 - RNA, 10 nt, Yersinia pestis
gccugguugg

SEQ ID NO: 4166369 - RNA, 16 nt, Yersinia pestis
gccuguaaaucuuguu

SEQ ID NO: 4166370 - RNA, 22 nt, Yersinia pestis
gccuguaccaccaccaacagca

SEQ ID NO: 4166371 - RNA, 16 nt, Yersinia pestis
gccuguauccagcagc

SEQ ID NO: 4166372 - RNA, 23 nt, Yersinia pestis
gccugucccuaucauucaacacu

SEQ ID NO: 4166373 - RNA, 20 nt, Yersinia pestis
gccugugacgcuugaauaua

SEQ ID NO: 4166374 - RNA, 12 nt, Yersinia pestis
gccuguuagggc

SEQ ID NO: 4166375 - RNA, 13 nt, Yersinia pestis
gccuguucucucc

SEQ ID NO: 4166376 - RNA, 20 nt, Yersinia pestis
gccuguuuacguaaauagau

SEQ ID NO: 4166377 - RNA, 18 nt, Yersinia pestis
gccuuaauggccgccauu

SEQ ID NO: 4166378 - RNA, 20 nt, Yersinia pestis
gccuuauaggcgcauaugaa

SEQ ID NO: 4166379 - RNA, 23 nt, Yersinia pestis
gccuuauaggcgcauaugaaaaa

SEQ ID NO: 4166380 - RNA, 22 nt, Yersinia pestis
gccuuaucagcgaaaaauuuca

SEQ ID NO: 4166381 - RNA, 13 nt, Yersinia pestis
gccuucauccagg

SEQ ID NO: 4166382 - RNA, 17 nt, Yersinia pestis
gccuucauguugcaaca

SEQ ID NO: 4166383 - RNA, 18 nt, Yersinia pestis
gccuucauguugcaacau

SEQ ID NO: 4166384 - RNA, 17 nt, Yersinia pestis
gccuucuccuuucuguu

SEQ ID NO: 4166385 - RNA, 14 nt, Yersinia pestis
gccuucugcugcca

SEQ ID NO: 4166386 - RNA, 22 nt, Yersinia pestis
gccuucuuggguggcaauuucu

SEQ ID NO: 4166387 - RNA, 15 nt, Yersinia pestis
gccuugaaacagcag

SEQ ID NO: 4166388 - RNA, 18 nt, Yersinia pestis
gccuugaaacagcagggg

SEQ ID NO: 4166389 - RNA, 15 nt, Yersinia pestis
gccuugaaacucaac

SEQ ID NO: 4166390 - RNA, 13 nt, Yersinia pestis
gccuugaaucaaa

SEQ ID NO: 4166391 - RNA, 15 nt, Yersinia pestis
gccuuggcauguuca

SEQ ID NO: 4166392 - RNA, 17 nt, Yersinia pestis
gccuugugcuucauggc

SEQ ID NO: 4166393 - RNA, 19 nt, Yersinia pestis
gccuuucagcgcugcgccc

SEQ ID NO: 4166394 - RNA, 16 nt, Yersinia pestis
gccuuuguuguuacca

SEQ ID NO: 4166395 - RNA, 19 nt, Yersinia pestis
gccuuuucuuccgccagca

SEQ ID NO: 4166396 - RNA, 18 nt, Yersinia pestis
gccuuuuugcaucaccau

SEQ ID NO: 4166397 - RNA, 18 nt, Yersinia pestis
gccuuuuuuauaauaaug

SEQ ID NO: 4166398 - RNA, 16 nt, Yersinia pestis
gcgaaaauccuucauu

SEQ ID NO: 4166399 - RNA, 13 nt, Yersinia pestis
gcgaaauugacuu

SEQ ID NO: 4166400 - RNA, 12 nt, Yersinia pestis
gcgaagggcgca

SEQ ID NO: 4166401 - RNA, 24 nt, Yersinia pestis
gcgaaggugugcucacaaucuucu

SEQ ID NO: 4166402 - RNA, 13 nt, Yersinia pestis
gcgaaucacauca

SEQ ID NO: 4166403 - RNA, 12 nt, Yersinia pestis
gcgaaucccccc

SEQ ID NO: 4166404 - RNA, 13 nt, Yersinia pestis
gcgaauuaucauc

SEQ ID NO: 4166405 - RNA, 17 nt, Yersinia pestis
gcgaauuaucauccaga

SEQ ID NO: 4166406 - RNA, 19 nt, Yersinia pestis
gcgacaaucaauggccagc

SEQ ID NO: 4166407 - RNA, 21 nt, Yersinia pestis
gcgacaccaagaggcugcgug

SEQ ID NO: 4166408 - RNA, 18 nt, Yersinia pestis
gcgacaggcucagcacaa

SEQ ID NO: 4166409 - RNA, 17 nt, Yersinia pestis
gcgacauuucggccacc

SEQ ID NO: 4166410 - RNA, 14 nt, Yersinia pestis
gcgaccaauucauc

SEQ ID NO: 4166411 - RNA, 12 nt, Yersinia pestis
gcgaccagcaga

SEQ ID NO: 4166412 - RNA, 13 nt, Yersinia pestis
gcgaccagcagaa

SEQ ID NO: 4166413 - RNA, 17 nt, Yersinia pestis
gcgacggagagaacagg

SEQ ID NO: 4166414 - RNA, 15 nt, Yersinia pestis
gcgacgguacugauc

SEQ ID NO: 4166415 - RNA, 19 nt, Yersinia pestis
gcgacgguacugaucauua

SEQ ID NO: 4166416 - RNA, 15 nt, Yersinia pestis
gcgacgugaugccag

SEQ ID NO: 4166417 - RNA, 15 nt, Yersinia pestis
gcgacuaauggccag

SEQ ID NO: 4166418 - RNA, 12 nt, Yersinia pestis
gcgacucauccg

SEQ ID NO: 4166419 - RNA, 20 nt, Yersinia pestis
gcgacugauugaccaucaac

SEQ ID NO: 4166420 - RNA, 19 nt, Yersinia pestis
gcgacugcgcgcugaacgu

SEQ ID NO: 4166421 - RNA, 18 nt, Yersinia pestis
gcgacugugcuuugccau

SEQ ID NO: 4166422 - RNA, 21 nt, Yersinia pestis
gcgacuucagcucccgccgca

SEQ ID NO: 4166423 - RNA, 18 nt, Yersinia pestis
gcgagauagucagcgacg

SEQ ID NO: 4166424 - RNA, 14 nt, Yersinia pestis
gcgagcaaggcauc

SEQ ID NO: 4166425 - RNA, 14 nt, Yersinia pestis
gcgagcaauaccaa

SEQ ID NO: 4166426 - RNA, 18 nt, Yersinia pestis
gcgagcaauaccaaaaau

SEQ ID NO: 4166427 - RNA, 23 nt, Yersinia pestis
gcgagcacugccccgaagcucaa

SEQ ID NO: 4166428 - RNA, 21 nt, Yersinia pestis
gcgagggucgcgcccugcgca

SEQ ID NO: 4166429 - RNA, 15 nt, Yersinia pestis
gcgagucucaucaag

SEQ ID NO: 4166430 - RNA, 17 nt, Yersinia pestis
gcgagugaaccgcgcuc

SEQ ID NO: 4166431 - RNA, 12 nt, Yersinia pestis
gcgauaaaagau

SEQ ID NO: 4166432 - RNA, 18 nt, Yersinia pestis
gcgauacggucaucgccg

SEQ ID NO: 4166433 - RNA, 19 nt, Yersinia pestis
gcgauacggucaucgccgc

SEQ ID NO: 4166434 - RNA, 21 nt, Yersinia pestis
gcgauagaguugauaaacaau

SEQ ID NO: 4166435 - RNA, 12 nt, Yersinia pestis
gcgauauuuauc

SEQ ID NO: 4166436 - RNA, 13 nt, Yersinia pestis
gcgauauuuauca

SEQ ID NO: 4166437 - RNA, 16 nt, Yersinia pestis
gcgaucagguuguucc

SEQ ID NO: 4166438 - RNA, 23 nt, Yersinia pestis
gcgauccaaaacaucggccagcg

SEQ ID NO: 4166439 - RNA, 22 nt, Yersinia pestis
gcgaucuauucucuguaauggc

SEQ ID NO: 4166440 - RNA, 15 nt, Yersinia pestis
gcgaugaaaaacaga

SEQ ID NO: 4166441 - RNA, 20 nt, Yersinia pestis
gcgaugaaaaacagauauac

SEQ ID NO: 4166442 - RNA, 12 nt, Yersinia pestis
gcgaugacugag

SEQ ID NO: 4166443 - RNA, 16 nt, Yersinia pestis
gcgaugaggcucuucu

SEQ ID NO: 4166444 - RNA, 22 nt, Yersinia pestis
gcgaugcgccuguuagggcgcg

SEQ ID NO: 4166445 - RNA, 13 nt, Yersinia pestis
gcgauuaaaauaa

SEQ ID NO: 4166446 - RNA, 16 nt, Yersinia pestis
gcgauuaaaauaaagc

SEQ ID NO: 4166447 - RNA, 16 nt, Yersinia pestis
gcgauuaggacaaaua

SEQ ID NO: 4166448 - RNA, 17 nt, Yersinia pestis
gcgauugugcagagugu

SEQ ID NO: 4166449 - RNA, 17 nt, Yersinia pestis
gcgcaacugccauggaa

SEQ ID NO: 4166450 - RNA, 15 nt, Yersinia pestis
gcgcaccagcucaau

SEQ ID NO: 4166451 - RNA, 18 nt, Yersinia pestis
gcgcaccgaaauagucgc

SEQ ID NO: 4166452 - RNA, 17 nt, Yersinia pestis
gcgcaccggaugccagc

SEQ ID NO: 4166453 - RNA, 19 nt, Yersinia pestis
gcgcaccggaugccagcuu

SEQ ID NO: 4166454 - RNA, 20 nt, Yersinia pestis
gcgcacguaccacggcggga

SEQ ID NO: 4166455 - RNA, 18 nt, Yersinia pestis
gcgcagagaucgauagca

SEQ ID NO: 4166456 - RNA, 10 nt, Yersinia pestis
gcgcagcaaa

SEQ ID NO: 4166457 - RNA, 13 nt, Yersinia pestis
gcgcagccaacgg

SEQ ID NO: 4166458 - RNA, 13 nt, Yersinia pestis
gcgcagccacaug

SEQ ID NO: 4166459 - RNA, 22 nt, Yersinia pestis
gcgcagcccccuuauggcacau

SEQ ID NO: 4166460 - RNA, 18 nt, Yersinia pestis
gcgcaggguuuccaagcu

SEQ ID NO: 4166461 - RNA, 23 nt, Yersinia pestis
gcgcagguuaugcagcucaauca

SEQ ID NO: 4166462 - RNA, 18 nt, Yersinia pestis
gcgcaguacucaccgccg

SEQ ID NO: 4166463 - RNA, 23 nt, Yersinia pestis
gcgcagugccgucaauuaucaaa

SEQ ID NO: 4166464 - RNA, 15 nt, Yersinia pestis
gcgcagugcucgggu

SEQ ID NO: 4166465 - RNA, 22 nt, Yersinia pestis
gcgcauauaggcgaaaggcgca

SEQ ID NO: 4166466 - RNA, 17 nt, Yersinia pestis
gcgcauccccaucgcca

SEQ ID NO: 4166467 - RNA, 18 nt, Yersinia pestis
gcgcaucuuucgaugccc

SEQ ID NO: 4166468 - RNA, 14 nt, Yersinia pestis
gcgcauugauaauc

SEQ ID NO: 4166469 - RNA, 15 nt, Yersinia pestis
gcgcauugauaaucu

SEQ ID NO: 4166470 - RNA, 19 nt, Yersinia pestis
gcgcauugauaaucuccau

SEQ ID NO: 4166471 - RNA, 21 nt, Yersinia pestis
gcgcauuucacccucugcagc

SEQ ID NO: 4166472 - RNA, 20 nt, Yersinia pestis
gcgccaaaacgcgcgccagu

SEQ ID NO: 4166473 - RNA, 19 nt, Yersinia pestis
gcgccaaggauggcgcggc

SEQ ID NO: 4166474 - RNA, 16 nt, Yersinia pestis
gcgccacccauugcuc

SEQ ID NO: 4166475 - RNA, 16 nt, Yersinia pestis
gcgccacgcuccacac

SEQ ID NO: 4166476 - RNA, 20 nt, Yersinia pestis
gcgccacuucuuucacuaau

SEQ ID NO: 4166477 - RNA, 21 nt, Yersinia pestis
gcgccagcaauuggccuucca

SEQ ID NO: 4166478 - RNA, 11 nt, Yersinia pestis
gcgccagcagc

SEQ ID NO: 4166479 - RNA, 22 nt, Yersinia pestis
gcgccagguaagaaagagauga

SEQ ID NO: 4166480 - RNA, 20 nt, Yersinia pestis
gcgccauacaguuaauuuca

SEQ ID NO: 4166481 - RNA, 13 nt, Yersinia pestis
gcgccauacugca

SEQ ID NO: 4166482 - RNA, 20 nt, Yersinia pestis
gcgcccaagcuuggccccuu

SEQ ID NO: 4166483 - RNA, 18 nt, Yersinia pestis
gcgccccgcaacgccgau

SEQ ID NO: 4166484 - RNA, 15 nt, Yersinia pestis
gcgcccgccagguau

SEQ ID NO: 4166485 - RNA, 16 nt, Yersinia pestis
gcgcccuucccauuua

SEQ ID NO: 4166486 - RNA, 17 nt, Yersinia pestis
gcgccgaaauaaaacca

SEQ ID NO: 4166487 - RNA, 17 nt, Yersinia pestis
gcgccggaauaaagcuc

SEQ ID NO: 4166488 - RNA, 22 nt, Yersinia pestis
gcgccguuggcuaaauaaccag

SEQ ID NO: 4166489 - RNA, 18 nt, Yersinia pestis
gcgccuaccugccugcug

SEQ ID NO: 4166490 - RNA, 13 nt, Yersinia pestis
gcgccucacugaa

SEQ ID NO: 4166491 - RNA, 18 nt, Yersinia pestis
gcgccuguuagggcgcgg

SEQ ID NO: 4166492 - RNA, 23 nt, Yersinia pestis
gcgccuguuagggcgcggcuggu

SEQ ID NO: 4166493 - RNA, 23 nt, Yersinia pestis
gcgccuuuuauucuuuggugagc

SEQ ID NO: 4166494 - RNA, 21 nt, Yersinia pestis
gcgcgaaauauugcccuacgg

SEQ ID NO: 4166495 - RNA, 19 nt, Yersinia pestis
gcgcgcacuacccgaauca

SEQ ID NO: 4166496 - RNA, 17 nt, Yersinia pestis
gcgcgcauaguauccau

SEQ ID NO: 4166497 - RNA, 20 nt, Yersinia pestis
gcgcgcuacucccggcagca

SEQ ID NO: 4166498 - RNA, 14 nt, Yersinia pestis
gcgcgcugcugcuc

SEQ ID NO: 4166499 - RNA, 13 nt, Yersinia pestis
gcgcgcuguggcu

SEQ ID NO: 4166500 - RNA, 16 nt, Yersinia pestis
gcgcgcuucgagcccc

SEQ ID NO: 4166501 - RNA, 15 nt, Yersinia pestis
gcgcggcugguaaca

SEQ ID NO: 4166502 - RNA, 21 nt, Yersinia pestis
gcgcgggaaaagguaaacaga

SEQ ID NO: 4166503 - RNA, 17 nt, Yersinia pestis
gcgcggguaauggcggu

SEQ ID NO: 4166504 - RNA, 20 nt, Yersinia pestis
gcgcguaucguccagcagca

SEQ ID NO: 4166505 - RNA, 19 nt, Yersinia pestis
gcgcgucgccauaaccaga

SEQ ID NO: 4166506 - RNA, 16 nt, Yersinia pestis
gcgcguuaaucugcug

SEQ ID NO: 4166507 - RNA, 12 nt, Yersinia pestis
gcgcguuggcag

SEQ ID NO: 4166508 - RNA, 20 nt, Yersinia pestis
gcgcuaagcccgugauaaau

SEQ ID NO: 4166509 - RNA, 20 nt, Yersinia pestis
gcgcuauguuggcaaauaau

SEQ ID NO: 4166510 - RNA, 17 nt, Yersinia pestis
gcgcuccacgccccaac

SEQ ID NO: 4166511 - RNA, 11 nt, Yersinia pestis
gcgcugacggu

SEQ ID NO: 4166512 - RNA, 17 nt, Yersinia pestis
gcgcugaucaucaucaa

SEQ ID NO: 4166513 - RNA, 13 nt, Yersinia pestis
gcgcugcaaagcc

SEQ ID NO: 4166514 - RNA, 15 nt, Yersinia pestis
gcgcugcaucagcag

SEQ ID NO: 4166515 - RNA, 21 nt, Yersinia pestis
gcgcugcaucagcagugacgu

SEQ ID NO: 4166516 - RNA, 19 nt, Yersinia pestis
gcgcugcgucuuuaucgcc

SEQ ID NO: 4166517 - RNA, 22 nt, Yersinia pestis
gcgcugcugguuuuacugaaac

SEQ ID NO: 4166518 - RNA, 17 nt, Yersinia pestis
gcgcuggcguaaaauau

SEQ ID NO: 4166519 - RNA, 15 nt, Yersinia pestis
gcgcuggcuuuuuca

SEQ ID NO: 4166520 - RNA, 22 nt, Yersinia pestis
gcgcugucuuucauucggcaca

SEQ ID NO: 4166521 - RNA, 16 nt, Yersinia pestis
gcgcuguugaucgccg

SEQ ID NO: 4166522 - RNA, 16 nt, Yersinia pestis
gcgcuuacaugaugaa

SEQ ID NO: 4166523 - RNA, 18 nt, Yersinia pestis
gcgcuuaccgucugggcu

SEQ ID NO: 4166524 - RNA, 23 nt, Yersinia pestis
gcgcuuacuuacccgaaucacuu

SEQ ID NO: 4166525 - RNA, 12 nt, Yersinia pestis
gcgcuuccagcg

SEQ ID NO: 4166526 - RNA, 13 nt, Yersinia pestis
gcgcuuccaggcu

SEQ ID NO: 4166527 - RNA, 15 nt, Yersinia pestis
gcgcuucgcacuuca

SEQ ID NO: 4166528 - RNA, 16 nt, Yersinia pestis
gcgcuugccacgccag

SEQ ID NO: 4166529 - RNA, 16 nt, Yersinia pestis
gcggaaauaaggcgca

SEQ ID NO: 4166530 - RNA, 19 nt, Yersinia pestis
gcggaaaugccgauaaaaa

SEQ ID NO: 4166531 - RNA, 14 nt, Yersinia pestis
gcggaauggcaacg

SEQ ID NO: 4166532 - RNA, 13 nt, Yersinia pestis
gcggacaccaacu

SEQ ID NO: 4166533 - RNA, 19 nt, Yersinia pestis
gcggacagcgcgcagccaa

SEQ ID NO: 4166534 - RNA, 21 nt, Yersinia pestis
gcggauaaucuaggccugggu

SEQ ID NO: 4166535 - RNA, 18 nt, Yersinia pestis
gcggauaucgggcggaua

SEQ ID NO: 4166536 - RNA, 15 nt, Yersinia pestis
gcggaucaaccgccc

SEQ ID NO: 4166537 - RNA, 20 nt, Yersinia pestis
gcggauucacccauuaauag

SEQ ID NO: 4166538 - RNA, 18 nt, Yersinia pestis
gcggauuuuguugaggua

SEQ ID NO: 4166539 - RNA, 23 nt, Yersinia pestis
gcggcaagaacaccgucaguaug

SEQ ID NO: 4166540 - RNA, 17 nt, Yersinia pestis
gcggcaagcugugccug

SEQ ID NO: 4166541 - RNA, 16 nt, Yersinia pestis
gcggcaauaagcauua

SEQ ID NO: 4166542 - RNA, 20 nt, Yersinia pestis
gcggcacugacacuccccug

SEQ ID NO: 4166543 - RNA, 19 nt, Yersinia pestis
gcggcagagccaaucccca

SEQ ID NO: 4166544 - RNA, 19 nt, Yersinia pestis
gcggcagcacagagcacaa

SEQ ID NO: 4166545 - RNA, 23 nt, Yersinia pestis
gcggcaggcugaucuucuuguga

SEQ ID NO: 4166546 - RNA, 21 nt, Yersinia pestis
gcggcauaaauucuagcaaca

SEQ ID NO: 4166547 - RNA, 18 nt, Yersinia pestis
gcggccagcaagagcagc

SEQ ID NO: 4166548 - RNA, 16 nt, Yersinia pestis
gcggccagccuugagc

SEQ ID NO: 4166549 - RNA, 18 nt, Yersinia pestis
gcggccagcggcaccgcc

SEQ ID NO: 4166550 - RNA, 13 nt, Yersinia pestis
gcggccagugaug

SEQ ID NO: 4166551 - RNA, 18 nt, Yersinia pestis
gcggccaucaccaugccu

SEQ ID NO: 4166552 - RNA, 18 nt, Yersinia pestis
gcggccaugucaggccac

SEQ ID NO: 4166553 - RNA, 23 nt, Yersinia pestis
gcggccuggguagacauggcaac

SEQ ID NO: 4166554 - RNA, 16 nt, Yersinia pestis
gcggccuuccaaggcu

SEQ ID NO: 4166555 - RNA, 20 nt, Yersinia pestis
gcggcgccgucacguacugg

SEQ ID NO: 4166556 - RNA, 17 nt, Yersinia pestis
gcggcggcuaugugccg

SEQ ID NO: 4166557 - RNA, 16 nt, Yersinia pestis
gcggcuaaagcugcuu

SEQ ID NO: 4166558 - RNA, 18 nt, Yersinia pestis
gcggcucucuuucuccaa

SEQ ID NO: 4166559 - RNA, 13 nt, Yersinia pestis
gcggcugguaaca

SEQ ID NO: 4166560 - RNA, 17 nt, Yersinia pestis
gcggcugguaacagagc

SEQ ID NO: 4166561 - RNA, 15 nt, Yersinia pestis
gcggcuuucauccca

SEQ ID NO: 4166562 - RNA, 21 nt, Yersinia pestis
gcggcuuucugccugugggcu

SEQ ID NO: 4166563 - RNA, 17 nt, Yersinia pestis
gcgggagauagagcagu

SEQ ID NO: 4166564 - RNA, 12 nt, Yersinia pestis
gcgggagucagu

SEQ ID NO: 4166565 - RNA, 22 nt, Yersinia pestis
gcgggcaaaacgacgggcugcu

SEQ ID NO: 4166566 - RNA, 23 nt, Yersinia pestis
gcgggcaacacagcuccccccuc

SEQ ID NO: 4166567 - RNA, 15 nt, Yersinia pestis
gcgggcaucagccca

SEQ ID NO: 4166568 - RNA, 16 nt, Yersinia pestis
gcgggcaucagcccau

SEQ ID NO: 4166569 - RNA, 22 nt, Yersinia pestis
gcgggccuuugcuuuucugccu

SEQ ID NO: 4166570 - RNA, 14 nt, Yersinia pestis
gcgggcgcgcugcu

SEQ ID NO: 4166571 - RNA, 17 nt, Yersinia pestis
gcgggugguccccagag

SEQ ID NO: 4166572 - RNA, 20 nt, Yersinia pestis
gcgggugucuuuaaaaucuu

SEQ ID NO: 4166573 - RNA, 20 nt, Yersinia pestis
gcggguuuuuuuacauauaa

SEQ ID NO: 4166574 - RNA, 21 nt, Yersinia pestis
gcgguaaccagcaucaguagc

SEQ ID NO: 4166575 - RNA, 18 nt, Yersinia pestis
gcgguaaccccggcggcu

SEQ ID NO: 4166576 - RNA, 22 nt, Yersinia pestis
gcgguaauuaauauauaaaaua

SEQ ID NO: 4166577 - RNA, 17 nt, Yersinia pestis
gcgguacuuuuugugau

SEQ ID NO: 4166578 - RNA, 15 nt, Yersinia pestis
gcgguauugaucacg

SEQ ID NO: 4166579 - RNA, 12 nt, Yersinia pestis
gcggugaacagu

SEQ ID NO: 4166580 - RNA, 20 nt, Yersinia pestis
gcgguuaagcuagccaagcu

SEQ ID NO: 4166581 - RNA, 14 nt, Yersinia pestis
gcgguuacguucac

SEQ ID NO: 4166582 - RNA, 18 nt, Yersinia pestis
gcgguuaucacaucaucc

SEQ ID NO: 4166583 - RNA, 14 nt, Yersinia pestis
gcgguugcuguggc

SEQ ID NO: 4166584 - RNA, 17 nt, Yersinia pestis
gcgguugggaaaagugg

SEQ ID NO: 4166585 - RNA, 22 nt, Yersinia pestis
gcgguuuuuccgccgucuggug

SEQ ID NO: 4166586 - RNA, 19 nt, Yersinia pestis
gcgguuuuuucuuucuuca

SEQ ID NO: 4166587 - RNA, 16 nt, Yersinia pestis
gcguaaaauauuguug

SEQ ID NO: 4166588 - RNA, 13 nt, Yersinia pestis
gcguaaagcaccc

SEQ ID NO: 4166589 - RNA, 21 nt, Yersinia pestis
gcguaacugcugggcugguag

SEQ ID NO: 4166590 - RNA, 16 nt, Yersinia pestis
gcguaaucagccgcgg

SEQ ID NO: 4166591 - RNA, 16 nt, Yersinia pestis
gcguacaucaggguga

SEQ ID NO: 4166592 - RNA, 22 nt, Yersinia pestis
gcguaccauauggaugaugcac

SEQ ID NO: 4166593 - RNA, 13 nt, Yersinia pestis
gcguacuguuagu

SEQ ID NO: 4166594 - RNA, 21 nt, Yersinia pestis
gcguacuguuaguucagacgu

SEQ ID NO: 4166595 - RNA, 18 nt, Yersinia pestis
gcguagagccuuuacggg

SEQ ID NO: 4166596 - RNA, 18 nt, Yersinia pestis
gcguaucguccagcagca

SEQ ID NO: 4166597 - RNA, 19 nt, Yersinia pestis
gcguaucguccagcagcag

SEQ ID NO: 4166598 - RNA, 21 nt, Yersinia pestis
gcguauugcuguucgccagau

SEQ ID NO: 4166599 - RNA, 14 nt, Yersinia pestis
gcgucaaauuagca

SEQ ID NO: 4166600 - RNA, 23 nt, Yersinia pestis
gcgucaagccaacccccauuagc

SEQ ID NO: 4166601 - RNA, 18 nt, Yersinia pestis
gcgucaccagaucugggu

SEQ ID NO: 4166602 - RNA, 19 nt, Yersinia pestis
gcgucacuaaauccaaaug

SEQ ID NO: 4166603 - RNA, 22 nt, Yersinia pestis
gcgucacuaaauccaaaugccc

SEQ ID NO: 4166604 - RNA, 17 nt, Yersinia pestis
gcgucagguaaguagaa

SEQ ID NO: 4166605 - RNA, 13 nt, Yersinia pestis
gcgucauaccauu

SEQ ID NO: 4166606 - RNA, 22 nt, Yersinia pestis
gcgucauaccauucucugucuu

SEQ ID NO: 4166607 - RNA, 21 nt, Yersinia pestis
gcgucaucgggguuugucagc

SEQ ID NO: 4166608 - RNA, 16 nt, Yersinia pestis
gcguccgcgccaagga

SEQ ID NO: 4166609 - RNA, 19 nt, Yersinia pestis
gcguccgcgccaaggcaag

SEQ ID NO: 4166610 - RNA, 17 nt, Yersinia pestis
gcguccgcgccagggag

SEQ ID NO: 4166611 - RNA, 16 nt, Yersinia pestis
gcguccgucauccaau

SEQ ID NO: 4166612 - RNA, 11 nt, Yersinia pestis
gcgucucuacg

SEQ ID NO: 4166613 - RNA, 16 nt, Yersinia pestis
gcgucucuacgacgcc

SEQ ID NO: 4166614 - RNA, 15 nt, Yersinia pestis
gcgucuucucaauuu

SEQ ID NO: 4166615 - RNA, 20 nt, Yersinia pestis
gcgucuuuacgaucugccug

SEQ ID NO: 4166616 - RNA, 21 nt, Yersinia pestis
gcgucuuuagauuucaccuau

SEQ ID NO: 4166617 - RNA, 20 nt, Yersinia pestis
gcgucuuucgggcugaugaa

SEQ ID NO: 4166618 - RNA, 23 nt, Yersinia pestis
gcgugaaacguauuauucuuccc

SEQ ID NO: 4166619 - RNA, 17 nt, Yersinia pestis
gcgugacuauucugccu

SEQ ID NO: 4166620 - RNA, 21 nt, Yersinia pestis
gcgugacuauucugccuaucc

SEQ ID NO: 4166621 - RNA, 15 nt, Yersinia pestis
gcgugagaauaauaa

SEQ ID NO: 4166622 - RNA, 17 nt, Yersinia pestis
gcgugaguuccagcccc

SEQ ID NO: 4166623 - RNA, 21 nt, Yersinia pestis
gcgugauauccccaccguggc

SEQ ID NO: 4166624 - RNA, 22 nt, Yersinia pestis
gcgugauuuuuauauuuugaga

SEQ ID NO: 4166625 - RNA, 12 nt, Yersinia pestis
gcgugccgcagu

SEQ ID NO: 4166626 - RNA, 15 nt, Yersinia pestis
gcgugcugcuuccug

SEQ ID NO: 4166627 - RNA, 16 nt, Yersinia pestis
gcgugcugcuuccugc

SEQ ID NO: 4166628 - RNA, 14 nt, Yersinia pestis
gcguggaauuaaua

SEQ ID NO: 4166629 - RNA, 18 nt, Yersinia pestis
gcgugggugaugugacgu

SEQ ID NO: 4166630 - RNA, 15 nt, Yersinia pestis
gcguuaaugccaccc

SEQ ID NO: 4166631 - RNA, 16 nt, Yersinia pestis
gcguuaaugccacccc

SEQ ID NO: 4166632 - RNA, 19 nt, Yersinia pestis
gcguuacacaucaggcugu

SEQ ID NO: 4166633 - RNA, 22 nt, Yersinia pestis
gcguuacacaucaggcuguuga

SEQ ID NO: 4166634 - RNA, 16 nt, Yersinia pestis
gcguuacccacauuaa

SEQ ID NO: 4166635 - RNA, 18 nt, Yersinia pestis
gcguuagcgauuucuagu

SEQ ID NO: 4166636 - RNA, 20 nt, Yersinia pestis
gcguuaucacgguugccgcg

SEQ ID NO: 4166637 - RNA, 20 nt, Yersinia pestis
gcguuaucggcgcaggcaga

SEQ ID NO: 4166638 - RNA, 21 nt, Yersinia pestis
gcguuauugcgacauaaagca

SEQ ID NO: 4166639 - RNA, 15 nt, Yersinia pestis
gcguucaaaaucaaa

SEQ ID NO: 4166640 - RNA, 21 nt, Yersinia pestis
gcguucaaucgugcacccccu

SEQ ID NO: 4166641 - RNA, 14 nt, Yersinia pestis
gcguucagcaauau

SEQ ID NO: 4166642 - RNA, 16 nt, Yersinia pestis
gcguugcccuucuuca

SEQ ID NO: 4166643 - RNA, 15 nt, Yersinia pestis
gcguugcgcugacca

SEQ ID NO: 4166644 - RNA, 15 nt, Yersinia pestis
gcguuguaauaacgc

SEQ ID NO: 4166645 - RNA, 14 nt, Yersinia pestis
gcguuuaaauaccc

SEQ ID NO: 4166646 - RNA, 17 nt, Yersinia pestis
gcguuuucugcauaagc

SEQ ID NO: 4166647 - RNA, 13 nt, Yersinia pestis
gcguuuucuucga

SEQ ID NO: 4166648 - RNA, 19 nt, Yersinia pestis
gcguuuuuauugggcagcg

SEQ ID NO: 4166649 - RNA, 13 nt, Yersinia pestis
gcguuuuuucggg

SEQ ID NO: 4166650 - RNA, 15 nt, Yersinia pestis
gcguuuuuuugccag

SEQ ID NO: 4166651 - RNA, 14 nt, Yersinia pestis
gcuaaaaugaucuu

SEQ ID NO: 4166652 - RNA, 20 nt, Yersinia pestis
gcuaaaccaagguuuacgua

SEQ ID NO: 4166653 - RNA, 21 nt, Yersinia pestis
gcuaaaccauguucuggcaga

SEQ ID NO: 4166654 - RNA, 23 nt, Yersinia pestis
gcuaaacccaaccccaucagcau

SEQ ID NO: 4166655 - RNA, 22 nt, Yersinia pestis
gcuaaacuaaaacagcuaacac

SEQ ID NO: 4166656 - RNA, 16 nt, Yersinia pestis
gcuaaagucacacugu

SEQ ID NO: 4166657 - RNA, 16 nt, Yersinia pestis
gcuaaaucaucaaauu

SEQ ID NO: 4166658 - RNA, 22 nt, Yersinia pestis
gcuaacaccuuuaccuuuacgg

SEQ ID NO: 4166659 - RNA, 13 nt, Yersinia pestis
gcuaacagugacc

SEQ ID NO: 4166660 - RNA, 16 nt, Yersinia pestis
gcuaaccacagcaaug

SEQ ID NO: 4166661 - RNA, 21 nt, Yersinia pestis
gcuaaccaccgucaccaaaua

SEQ ID NO: 4166662 - RNA, 16 nt, Yersinia pestis
gcuaaccccugcaucu

SEQ ID NO: 4166663 - RNA, 13 nt, Yersinia pestis
gcuaaccuuaacu

SEQ ID NO: 4166664 - RNA, 16 nt, Yersinia pestis
gcuaacgucgcuguua

SEQ ID NO: 4166665 - RNA, 24 nt, Yersinia pestis
gcuaacugcugauuuuguagaaug

SEQ ID NO: 4166666 - RNA, 14 nt, Yersinia pestis
gcuaaguacuaucu

SEQ ID NO: 4166667 - RNA, 16 nt, Yersinia pestis
gcuaagucacgcaccc

SEQ ID NO: 4166668 - RNA, 15 nt, Yersinia pestis
gcuaauaauuguuca

SEQ ID NO: 4166669 - RNA, 22 nt, Yersinia pestis
gcuaauaccauuucuuauaucu

SEQ ID NO: 4166670 - RNA, 14 nt, Yersinia pestis
gcuaauacggcuug

SEQ ID NO: 4166671 - RNA, 20 nt, Yersinia pestis
gcuaauacugccaaucgcug

SEQ ID NO: 4166672 - RNA, 17 nt, Yersinia pestis
gcuaauacuggcuaaau

SEQ ID NO: 4166673 - RNA, 16 nt, Yersinia pestis
gcuaauauuuauaaaa

SEQ ID NO: 4166674 - RNA, 14 nt, Yersinia pestis
gcuaaucaguuccc

SEQ ID NO: 4166675 - RNA, 22 nt, Yersinia pestis
gcuaaucccuuuggguggugga

SEQ ID NO: 4166676 - RNA, 22 nt, Yersinia pestis
gcuaaugcccgacgugagcguu

SEQ ID NO: 4166677 - RNA, 18 nt, Yersinia pestis
gcuaauuaauuuaaacaa

SEQ ID NO: 4166678 - RNA, 18 nt, Yersinia pestis
gcuaauuagaugaguggu

SEQ ID NO: 4166679 - RNA, 13 nt, Yersinia pestis
gcuaauucaccaa

SEQ ID NO: 4166680 - RNA, 19 nt, Yersinia pestis
gcuaauucugcgccuauac

SEQ ID NO: 4166681 - RNA, 23 nt, Yersinia pestis
gcuaauucuggguacaacacaaa

SEQ ID NO: 4166682 - RNA, 13 nt, Yersinia pestis
gcuaauuucuccc

SEQ ID NO: 4166683 - RNA, 15 nt, Yersinia pestis
gcuaauuuucccugu

SEQ ID NO: 4166684 - RNA, 21 nt, Yersinia pestis
gcuaccaaggcugguggcuga

SEQ ID NO: 4166685 - RNA, 17 nt, Yersinia pestis
gcuaccaauuauucggg

SEQ ID NO: 4166686 - RNA, 15 nt, Yersinia pestis
gcuaccagcagugca

SEQ ID NO: 4166687 - RNA, 22 nt, Yersinia pestis
gcuacccaauaaccccgugcca

SEQ ID NO: 4166688 - RNA, 22 nt, Yersinia pestis
gcuaccggaaccaacggcaaug

SEQ ID NO: 4166689 - RNA, 13 nt, Yersinia pestis
gcuaccugcacca

SEQ ID NO: 4166690 - RNA, 16 nt, Yersinia pestis
gcuacgcaaaaucagu

SEQ ID NO: 4166691 - RNA, 23 nt, Yersinia pestis
gcuacggaagacaaugcggccuu

SEQ ID NO: 4166692 - RNA, 21 nt, Yersinia pestis
gcuacggauugcaaauccguc

SEQ ID NO: 4166693 - RNA, 22 nt, Yersinia pestis
gcuacugcgcguugccauguug

SEQ ID NO: 4166694 - RNA, 23 nt, Yersinia pestis
gcuacugcuuuuuauugucucua

SEQ ID NO: 4166695 - RNA, 14 nt, Yersinia pestis
gcuacugggcuacc

SEQ ID NO: 4166696 - RNA, 14 nt, Yersinia pestis
gcuacugguaauaa

SEQ ID NO: 4166697 - RNA, 18 nt, Yersinia pestis
gcuacugguaauaaugcu

SEQ ID NO: 4166698 - RNA, 15 nt, Yersinia pestis
gcuacuguuauccag

SEQ ID NO: 4166699 - RNA, 14 nt, Yersinia pestis
gcuacuuuuuucac

SEQ ID NO: 4166700 - RNA, 19 nt, Yersinia pestis
gcuacuuuuuucacauuac

SEQ ID NO: 4166701 - RNA, 16 nt, Yersinia pestis
gcuagcaaauuccgcu

SEQ ID NO: 4166702 - RNA, 14 nt, Yersinia pestis
gcuagccccaauca

SEQ ID NO: 4166703 - RNA, 14 nt, Yersinia pestis
gcuagcuuauccag

SEQ ID NO: 4166704 - RNA, 17 nt, Yersinia pestis
gcuagugauagcgggcc

SEQ ID NO: 4166705 - RNA, 15 nt, Yersinia pestis
gcuagugcugguuga

SEQ ID NO: 4166706 - RNA, 15 nt, Yersinia pestis
gcuauaucaucagca

SEQ ID NO: 4166707 - RNA, 18 nt, Yersinia pestis
gcuaucaccggaugaaac

SEQ ID NO: 4166708 - RNA, 13 nt, Yersinia pestis
gcuaucauccaua

SEQ ID NO: 4166709 - RNA, 19 nt, Yersinia pestis
gcuaucuguuaucugguua

SEQ ID NO: 4166710 - RNA, 18 nt, Yersinia pestis
gcuaucuuaugacgcugc

SEQ ID NO: 4166711 - RNA, 22 nt, Yersinia pestis
gcuaucuuaugacgcugcaccg

SEQ ID NO: 4166712 - RNA, 14 nt, Yersinia pestis
gcuaucuuugccug

SEQ ID NO: 4166713 - RNA, 22 nt, Yersinia pestis
gcuaugccggaggauauuuauu

SEQ ID NO: 4166714 - RNA, 16 nt, Yersinia pestis
gcuaugccuacuggcc

SEQ ID NO: 4166715 - RNA, 15 nt, Yersinia pestis
gcuaugcuaaaaaac

SEQ ID NO: 4166716 - RNA, 14 nt, Yersinia pestis
gcuaugcucagcaa

SEQ ID NO: 4166717 - RNA, 23 nt, Yersinia pestis
gcuauggguaauccccaccaaca

SEQ ID NO: 4166718 - RNA, 17 nt, Yersinia pestis
gcuauuaaacauuuaug

SEQ ID NO: 4166719 - RNA, 20 nt, Yersinia pestis
gcuauuagccagaaauagca

SEQ ID NO: 4166720 - RNA, 18 nt, Yersinia pestis
gcuauugaacauucaucu

SEQ ID NO: 4166721 - RNA, 13 nt, Yersinia pestis
gcuauugaugucu

SEQ ID NO: 4166722 - RNA, 20 nt, Yersinia pestis
gcuauugaugucuaaugaca

SEQ ID NO: 4166723 - RNA, 14 nt, Yersinia pestis
gcuauuuaacaaaa

SEQ ID NO: 4166724 - RNA, 21 nt, Yersinia pestis
gcuauuuacccccaagacuuu

SEQ ID NO: 4166725 - RNA, 14 nt, Yersinia pestis
gcuauuucaauggg

SEQ ID NO: 4166726 - RNA, 12 nt, Yersinia pestis
gcuauuucucuc

SEQ ID NO: 4166727 - RNA, 14 nt, Yersinia pestis
gcucaaacaaugug

SEQ ID NO: 4166728 - RNA, 18 nt, Yersinia pestis
gcucaaauauuugcacaa

SEQ ID NO: 4166729 - RNA, 21 nt, Yersinia pestis
gcucaaauauuugcacaaaua

SEQ ID NO: 4166730 - RNA, 12 nt, Yersinia pestis
gcucaacugcuc

SEQ ID NO: 4166731 - RNA, 16 nt, Yersinia pestis
gcucaacugcucaacu

SEQ ID NO: 4166732 - RNA, 13 nt, Yersinia pestis
gcucaagccucua

SEQ ID NO: 4166733 - RNA, 12 nt, Yersinia pestis
gcucaagcuggc

SEQ ID NO: 4166734 - RNA, 16 nt, Yersinia pestis
gcucaaucucugccug

SEQ ID NO: 4166735 - RNA, 19 nt, Yersinia pestis
gcucaaugugcggaaauaa

SEQ ID NO: 4166736 - RNA, 15 nt, Yersinia pestis
gcucaauuaaccuga

SEQ ID NO: 4166737 - RNA, 12 nt, Yersinia pestis
gcucaccacuga

SEQ ID NO: 4166738 - RNA, 23 nt, Yersinia pestis
gcucaccauaaauucacagcgcg

SEQ ID NO: 4166739 - RNA, 19 nt, Yersinia pestis
gcucacccauuuuauccuc

SEQ ID NO: 4166740 - RNA, 21 nt, Yersinia pestis
gcucacccauuuuauccucuu

SEQ ID NO: 4166741 - RNA, 17 nt, Yersinia pestis
gcucaccgucaacccac

SEQ ID NO: 4166742 - RNA, 17 nt, Yersinia pestis
gcucaccuuguggcaca

SEQ ID NO: 4166743 - RNA, 17 nt, Yersinia pestis
gcucacgcguaaaugga

SEQ ID NO: 4166744 - RNA, 22 nt, Yersinia pestis
gcucacuggaguuaaaucccug

SEQ ID NO: 4166745 - RNA, 20 nt, Yersinia pestis
gcucacuuuuauauccgcca

SEQ ID NO: 4166746 - RNA, 23 nt, Yersinia pestis
gcucacuuuuauauccgccaucc

SEQ ID NO: 4166747 - RNA, 17 nt, Yersinia pestis
gcucacuuuuauccagc

SEQ ID NO: 4166748 - RNA, 20 nt, Yersinia pestis
gcucacuuuuauccagccau

SEQ ID NO: 4166749 - RNA, 23 nt, Yersinia pestis
gcucagaaaauaaagggggcacc

SEQ ID NO: 4166750 - RNA, 14 nt, Yersinia pestis
gcucagccaucucu

SEQ ID NO: 4166751 - RNA, 19 nt, Yersinia pestis
gcucagccuguuggucaua

SEQ ID NO: 4166752 - RNA, 13 nt, Yersinia pestis
gcucaggcgguca

SEQ ID NO: 4166753 - RNA, 18 nt, Yersinia pestis
gcucaggcucaucaccuu

SEQ ID NO: 4166754 - RNA, 22 nt, Yersinia pestis
gcucagggccacuucgguggcc

SEQ ID NO: 4166755 - RNA, 18 nt, Yersinia pestis
gcucaguucgguugccaa

SEQ ID NO: 4166756 - RNA, 15 nt, Yersinia pestis
gcucaguugaugcaa

SEQ ID NO: 4166757 - RNA, 16 nt, Yersinia pestis
gcucauaaagcaucag

SEQ ID NO: 4166758 - RNA, 21 nt, Yersinia pestis
gcucauaccaugccaucaaug

SEQ ID NO: 4166759 - RNA, 23 nt, Yersinia pestis
gcucauaugcagcauccagcuca

SEQ ID NO: 4166760 - RNA, 15 nt, Yersinia pestis
gcucaucauaaaaau

SEQ ID NO: 4166761 - RNA, 17 nt, Yersinia pestis
gcucaucauaaaaauac

SEQ ID NO: 4166762 - RNA, 20 nt, Yersinia pestis
gcucauccaucauugcuaaa

SEQ ID NO: 4166763 - RNA, 11 nt, Yersinia pestis
gcucaucgcca

SEQ ID NO: 4166764 - RNA, 23 nt, Yersinia pestis
gcucaucuaacucauucauaauu

SEQ ID NO: 4166765 - RNA, 21 nt, Yersinia pestis
gcucauguucgcacugcucug

SEQ ID NO: 4166766 - RNA, 16 nt, Yersinia pestis
gcucauuaaacuguuc

SEQ ID NO: 4166767 - RNA, 21 nt, Yersinia pestis
gcucauuaaacuguucuuauu

SEQ ID NO: 4166768 - RNA, 15 nt, Yersinia pestis
gcucauuaccaauac

SEQ ID NO: 4166769 - RNA, 19 nt, Yersinia pestis
gcucauuggcaaauugcug

SEQ ID NO: 4166770 - RNA, 15 nt, Yersinia pestis
gcucauuuuuugggu

SEQ ID NO: 4166771 - RNA, 19 nt, Yersinia pestis
gcuccaaagcuuccaauau

SEQ ID NO: 4166772 - RNA, 14 nt, Yersinia pestis
gcuccaauaaaaaa

SEQ ID NO: 4166773 - RNA, 21 nt, Yersinia pestis
gcuccacuacucaguugcagu

SEQ ID NO: 4166774 - RNA, 11 nt, Yersinia pestis
gcuccagauug

SEQ ID NO: 4166775 - RNA, 15 nt, Yersinia pestis
gcuccagcaacugaa

SEQ ID NO: 4166776 - RNA, 16 nt, Yersinia pestis
gcuccagcucgugcca

SEQ ID NO: 4166777 - RNA, 15 nt, Yersinia pestis
gcuccaguucgacua

SEQ ID NO: 4166778 - RNA, 15 nt, Yersinia pestis
gcuccaucagguuua

SEQ ID NO: 4166779 - RNA, 21 nt, Yersinia pestis
gcuccauuucugguugugcuu

SEQ ID NO: 4166780 - RNA, 22 nt, Yersinia pestis
gcucccaaggguauaacucauc

SEQ ID NO: 4166781 - RNA, 17 nt, Yersinia pestis
gcucccagacuuugcug

SEQ ID NO: 4166782 - RNA, 21 nt, Yersinia pestis
gcucccguaaacguucugcca

SEQ ID NO: 4166783 - RNA, 18 nt, Yersinia pestis
gcucccuccgccagcaag

SEQ ID NO: 4166784 - RNA, 20 nt, Yersinia pestis
gcuccgguuuucacccccac

SEQ ID NO: 4166785 - RNA, 14 nt, Yersinia pestis
gcuccuauagcuca

SEQ ID NO: 4166786 - RNA, 22 nt, Yersinia pestis
gcuccuauagcucagaaaauaa

SEQ ID NO: 4166787 - RNA, 23 nt, Yersinia pestis
gcuccuauagcucagaaaauaaa

SEQ ID NO: 4166788 - RNA, 16 nt, Yersinia pestis
gcuccugauaaugcuu

SEQ ID NO: 4166789 - RNA, 17 nt, Yersinia pestis
gcuccugccgcauccca

SEQ ID NO: 4166790 - RNA, 18 nt, Yersinia pestis
gcuccuuacuauuuucau

SEQ ID NO: 4166791 - RNA, 13 nt, Yersinia pestis
gcucgaagcgcgc

SEQ ID NO: 4166792 - RNA, 17 nt, Yersinia pestis
gcucgagccgcgccauc

SEQ ID NO: 4166793 - RNA, 20 nt, Yersinia pestis
gcucgcuaauuucucccggg

SEQ ID NO: 4166794 - RNA, 18 nt, Yersinia pestis
gcucgcucaacaugccag

SEQ ID NO: 4166795 - RNA, 17 nt, Yersinia pestis
gcucgcugguggcuuga

SEQ ID NO: 4166796 - RNA, 17 nt, Yersinia pestis
gcucgcuguggcuacca

SEQ ID NO: 4166797 - RNA, 16 nt, Yersinia pestis
gcucgguuauuuauca

SEQ ID NO: 4166798 - RNA, 18 nt, Yersinia pestis
gcucgugaucagcagacu

SEQ ID NO: 4166799 - RNA, 19 nt, Yersinia pestis
gcucgugaucagcagacuc

SEQ ID NO: 4166800 - RNA, 17 nt, Yersinia pestis
gcucguugguguugacu

SEQ ID NO: 4166801 - RNA, 18 nt, Yersinia pestis
gcucuaacgucagauaaa

SEQ ID NO: 4166802 - RNA, 11 nt, Yersinia pestis
gcucuacuaau

SEQ ID NO: 4166803 - RNA, 14 nt, Yersinia pestis
gcucuaucgauaaa

SEQ ID NO: 4166804 - RNA, 20 nt, Yersinia pestis
gcucuaugccaguuauuauu

SEQ ID NO: 4166805 - RNA, 16 nt, Yersinia pestis
gcucucauaucccccc

SEQ ID NO: 4166806 - RNA, 18 nt, Yersinia pestis
gcucucauauccccccca

SEQ ID NO: 4166807 - RNA, 14 nt, Yersinia pestis
gcucucgacaaccu

SEQ ID NO: 4166808 - RNA, 18 nt, Yersinia pestis
gcucucugagccauccag

SEQ ID NO: 4166809 - RNA, 17 nt, Yersinia pestis
gcucucuuuuuucucuu

SEQ ID NO: 4166810 - RNA, 21 nt, Yersinia pestis
gcucucuuuuuucucuuucuu

SEQ ID NO: 4166811 - RNA, 16 nt, Yersinia pestis
gcucugacuacugaaa

SEQ ID NO: 4166812 - RNA, 12 nt, Yersinia pestis
gcucugauagua

SEQ ID NO: 4166813 - RNA, 17 nt, Yersinia pestis
gcucugcguuuuucccu

SEQ ID NO: 4166814 - RNA, 15 nt, Yersinia pestis
gcucuggauagcaga

SEQ ID NO: 4166815 - RNA, 15 nt, Yersinia pestis
gcucuggcguacugu

SEQ ID NO: 4166816 - RNA, 14 nt, Yersinia pestis
gcucuggguuaaau

SEQ ID NO: 4166817 - RNA, 15 nt, Yersinia pestis
gcucuguugacucgc

SEQ ID NO: 4166818 - RNA, 18 nt, Yersinia pestis
gcucuguuggugguggcc

SEQ ID NO: 4166819 - RNA, 20 nt, Yersinia pestis
gcucuguuggugguggccug

SEQ ID NO: 4166820 - RNA, 17 nt, Yersinia pestis
gcucuuacucauucgaa

SEQ ID NO: 4166821 - RNA, 14 nt, Yersinia pestis
gcucuucaauuucc

SEQ ID NO: 4166822 - RNA, 16 nt, Yersinia pestis
gcucuucaauuuccau

SEQ ID NO: 4166823 - RNA, 12 nt, Yersinia pestis
gcucuucacauu

SEQ ID NO: 4166824 - RNA, 22 nt, Yersinia pestis
gcucuucaccaaaggaagccga

SEQ ID NO: 4166825 - RNA, 12 nt, Yersinia pestis
gcucuucaucau

SEQ ID NO: 4166826 - RNA, 12 nt, Yersinia pestis
gcucuuccagca

SEQ ID NO: 4166827 - RNA, 12 nt, Yersinia pestis
gcucuucugggc

SEQ ID NO: 4166828 - RNA, 22 nt, Yersinia pestis
gcucuugagguuauugacaaag

SEQ ID NO: 4166829 - RNA, 19 nt, Yersinia pestis
gcucuuuuuugaaguugua

SEQ ID NO: 4166830 - RNA, 12 nt, Yersinia pestis
gcugaaaugcua

SEQ ID NO: 4166831 - RNA, 16 nt, Yersinia pestis
gcugaacccugacggc

SEQ ID NO: 4166832 - RNA, 13 nt, Yersinia pestis
gcugaagacccaa

SEQ ID NO: 4166833 - RNA, 12 nt, Yersinia pestis
gcugaagccagc

SEQ ID NO: 4166834 - RNA, 13 nt, Yersinia pestis
gcugaaggccugc

SEQ ID NO: 4166835 - RNA, 23 nt, Yersinia pestis
gcugaaguggcugaauaucaucu

SEQ ID NO: 4166836 - RNA, 18 nt, Yersinia pestis
gcugaauaucaucuuuuu

SEQ ID NO: 4166837 - RNA, 12 nt, Yersinia pestis
gcugacacgcca

SEQ ID NO: 4166838 - RNA, 17 nt, Yersinia pestis
gcugacagagcggguuu

SEQ ID NO: 4166839 - RNA, 21 nt, Yersinia pestis
gcugaccauggcgaucaaagg

SEQ ID NO: 4166840 - RNA, 16 nt, Yersinia pestis
gcugaccccaaauuug

SEQ ID NO: 4166841 - RNA, 22 nt, Yersinia pestis
gcugaccuguuguaacacuuga

SEQ ID NO: 4166842 - RNA, 19 nt, Yersinia pestis
gcugacggcgguauacaga

SEQ ID NO: 4166843 - RNA, 16 nt, Yersinia pestis
gcugacgucagaucgc

SEQ ID NO: 4166844 - RNA, 23 nt, Yersinia pestis
gcugacuggacaaauaaaacaga

SEQ ID NO: 4166845 - RNA, 16 nt, Yersinia pestis
gcugacuuguggaaca

SEQ ID NO: 4166846 - RNA, 20 nt, Yersinia pestis
gcugacuuguggaacaacag

SEQ ID NO: 4166847 - RNA, 20 nt, Yersinia pestis
gcugagcaacgguuuguauc

SEQ ID NO: 4166848 - RNA, 23 nt, Yersinia pestis
gcugagcauauacagcccgguau

SEQ ID NO: 4166849 - RNA, 19 nt, Yersinia pestis
gcugaggcgacacccgcuu

SEQ ID NO: 4166850 - RNA, 13 nt, Yersinia pestis
gcugagguugaug

SEQ ID NO: 4166851 - RNA, 14 nt, Yersinia pestis
gcugagugaagaca

SEQ ID NO: 4166852 - RNA, 20 nt, Yersinia pestis
gcugagugaagacaucgcca

SEQ ID NO: 4166853 - RNA, 21 nt, Yersinia pestis
gcugagugaagacaucgccag

SEQ ID NO: 4166854 - RNA, 15 nt, Yersinia pestis
gcugauaaccagcag

SEQ ID NO: 4166855 - RNA, 16 nt, Yersinia pestis
gcugauaaccagccaa

SEQ ID NO: 4166856 - RNA, 18 nt, Yersinia pestis
gcugauaaccagccaacc

SEQ ID NO: 4166857 - RNA, 14 nt, Yersinia pestis
gcugauaauuuauu

SEQ ID NO: 4166858 - RNA, 22 nt, Yersinia pestis
gcugauagaaaguugagcagca

SEQ ID NO: 4166859 - RNA, 17 nt, Yersinia pestis
gcugauagccaauaacc

SEQ ID NO: 4166860 - RNA, 13 nt, Yersinia pestis
gcugaucaggaag

SEQ ID NO: 4166861 - RNA, 14 nt, Yersinia pestis
gcugaucaucauca

SEQ ID NO: 4166862 - RNA, 15 nt, Yersinia pestis
gcugaucugccagua

SEQ ID NO: 4166863 - RNA, 14 nt, Yersinia pestis
gcugaucugccccu

SEQ ID NO: 4166864 - RNA, 15 nt, Yersinia pestis
gcugaucugccccug

SEQ ID NO: 4166865 - RNA, 16 nt, Yersinia pestis
gcugaugaauagagga

SEQ ID NO: 4166866 - RNA, 24 nt, Yersinia pestis
gcugaugauuuuggugcuggccug

SEQ ID NO: 4166867 - RNA, 17 nt, Yersinia pestis
gcugaugucauucuauc

SEQ ID NO: 4166868 - RNA, 14 nt, Yersinia pestis
gcugauuaaaccga

SEQ ID NO: 4166869 - RNA, 15 nt, Yersinia pestis
gcugauuaauaucaa

SEQ ID NO: 4166870 - RNA, 17 nt, Yersinia pestis
gcugauuaauaucaaaa

SEQ ID NO: 4166871 - RNA, 20 nt, Yersinia pestis
gcugauuaauaucaaaacug

SEQ ID NO: 4166872 - RNA, 14 nt, Yersinia pestis
gcugauuaaugagg

SEQ ID NO: 4166873 - RNA, 16 nt, Yersinia pestis
gcugauucacuggcaa

SEQ ID NO: 4166874 - RNA, 16 nt, Yersinia pestis
gcugcaacgcagacau

SEQ ID NO: 4166875 - RNA, 13 nt, Yersinia pestis
gcugcaacucauu

SEQ ID NO: 4166876 - RNA, 21 nt, Yersinia pestis
gcugcaacucauuaacaauua

SEQ ID NO: 4166877 - RNA, 21 nt, Yersinia pestis
gcugcaacuccuuaccacugc

SEQ ID NO: 4166878 - RNA, 23 nt, Yersinia pestis
gcugcaacuccuuaccacugcuc

SEQ ID NO: 4166879 - RNA, 16 nt, Yersinia pestis
gcugcaagaguccagc

SEQ ID NO: 4166880 - RNA, 22 nt, Yersinia pestis
gcugcacaaguuggugcaguug

SEQ ID NO: 4166881 - RNA, 21 nt, Yersinia pestis
gcugcacaucauuuauuucca

SEQ ID NO: 4166882 - RNA, 12 nt, Yersinia pestis
gcugcacuuuua

SEQ ID NO: 4166883 - RNA, 23 nt, Yersinia pestis
gcugcagccgcgaugccaucgcu

SEQ ID NO: 4166884 - RNA, 23 nt, Yersinia pestis
gcugcagccgggaugaucaacag

SEQ ID NO: 4166885 - RNA, 18 nt, Yersinia pestis
gcugcagcgcuauuugua

SEQ ID NO: 4166886 - RNA, 12 nt, Yersinia pestis
gcugcagggccu

SEQ ID NO: 4166887 - RNA, 19 nt, Yersinia pestis
gcugccagugccgccgccu

SEQ ID NO: 4166888 - RNA, 21 nt, Yersinia pestis
gcugccagugggauaucugcg

SEQ ID NO: 4166889 - RNA, 13 nt, Yersinia pestis
gcugccauauauu

SEQ ID NO: 4166890 - RNA, 17 nt, Yersinia pestis
gcugcccacauaaagau

SEQ ID NO: 4166891 - RNA, 21 nt, Yersinia pestis
gcugcccuuugcuggcaugga

SEQ ID NO: 4166892 - RNA, 19 nt, Yersinia pestis
gcugccgcaagaaagaaaa

SEQ ID NO: 4166893 - RNA, 23 nt, Yersinia pestis
gcugccuaugcguuggcugccuu

SEQ ID NO: 4166894 - RNA, 16 nt, Yersinia pestis
gcugccugccugcugc

SEQ ID NO: 4166895 - RNA, 17 nt, Yersinia pestis
gcugccuugcugcaacg

SEQ ID NO: 4166896 - RNA, 17 nt, Yersinia pestis
gcugcgcaagcgcugcu

SEQ ID NO: 4166897 - RNA, 21 nt, Yersinia pestis
gcugcgcaccacugucagggc

SEQ ID NO: 4166898 - RNA, 20 nt, Yersinia pestis
gcugcggcuugggagucaga

SEQ ID NO: 4166899 - RNA, 21 nt, Yersinia pestis
gcugcuaauauuuauaaaaaa

SEQ ID NO: 4166900 - RNA, 22 nt, Yersinia pestis
gcugcugcaagaguccagcacu

SEQ ID NO: 4166901 - RNA, 15 nt, Yersinia pestis
gcugcugcagccggg

SEQ ID NO: 4166902 - RNA, 21 nt, Yersinia pestis
gcugcuuucguucaccccagu

SEQ ID NO: 4166903 - RNA, 19 nt, Yersinia pestis
gcugcuuuuacgcaaguaa

SEQ ID NO: 4166904 - RNA, 14 nt, Yersinia pestis
gcugcuuuuuacaa

SEQ ID NO: 4166905 - RNA, 12 nt, Yersinia pestis
gcuggaaauuca

SEQ ID NO: 4166906 - RNA, 20 nt, Yersinia pestis
gcuggagccauaaguaaagc

SEQ ID NO: 4166907 - RNA, 13 nt, Yersinia pestis
gcuggaggcuggc

SEQ ID NO: 4166908 - RNA, 17 nt, Yersinia pestis
gcuggauauaauccaaa

SEQ ID NO: 4166909 - RNA, 13 nt, Yersinia pestis
gcuggaucagcag

SEQ ID NO: 4166910 - RNA, 14 nt, Yersinia pestis
gcuggaucagcaga

SEQ ID NO: 4166911 - RNA, 14 nt, Yersinia pestis
gcuggcaaggcacg

SEQ ID NO: 4166912 - RNA, 17 nt, Yersinia pestis
gcuggcaguucggcuuu

SEQ ID NO: 4166913 - RNA, 14 nt, Yersinia pestis
gcuggcauacugac

SEQ ID NO: 4166914 - RNA, 16 nt, Yersinia pestis
gcuggccauuuaccug

SEQ ID NO: 4166915 - RNA, 17 nt, Yersinia pestis
gcuggcccccaaugaca

SEQ ID NO: 4166916 - RNA, 18 nt, Yersinia pestis
gcuggcccccaaugacac

SEQ ID NO: 4166917 - RNA, 13 nt, Yersinia pestis
gcuggcgagagcu

SEQ ID NO: 4166918 - RNA, 16 nt, Yersinia pestis
gcuggcggauaaaaau

SEQ ID NO: 4166919 - RNA, 20 nt, Yersinia pestis
gcuggcuaauacuggcuaaa

SEQ ID NO: 4166920 - RNA, 16 nt, Yersinia pestis
gcuggcuuuuuuguuu

SEQ ID NO: 4166921 - RNA, 16 nt, Yersinia pestis
gcugggaauuaagaag

SEQ ID NO: 4166922 - RNA, 21 nt, Yersinia pestis
gcuggguugagcaugacccaa

SEQ ID NO: 4166923 - RNA, 13 nt, Yersinia pestis
gcugguaacagag

SEQ ID NO: 4166924 - RNA, 14 nt, Yersinia pestis
gcuggucgcaccca

SEQ ID NO: 4166925 - RNA, 17 nt, Yersinia pestis
gcuggugcggaacagcg

SEQ ID NO: 4166926 - RNA, 16 nt, Yersinia pestis
gcugguggcuugggcu

SEQ ID NO: 4166927 - RNA, 17 nt, Yersinia pestis
gcugguuaucacagcaa

SEQ ID NO: 4166928 - RNA, 19 nt, Yersinia pestis
gcugguuaucacagcaaau

SEQ ID NO: 4166929 - RNA, 20 nt, Yersinia pestis
gcugguuaucacagcaaauu

SEQ ID NO: 4166930 - RNA, 21 nt, Yersinia pestis
gcuguaaaggcaaagaagaau

SEQ ID NO: 4166931 - RNA, 13 nt, Yersinia pestis
gcuguaagcacca

SEQ ID NO: 4166932 - RNA, 17 nt, Yersinia pestis
gcuguacugcugcaacu

SEQ ID NO: 4166933 - RNA, 19 nt, Yersinia pestis
gcuguacugcugcaacuca

SEQ ID NO: 4166934 - RNA, 21 nt, Yersinia pestis
gcuguauuuuucgcaguaacg

SEQ ID NO: 4166935 - RNA, 22 nt, Yersinia pestis
gcugucacugucaaaaccaaua

SEQ ID NO: 4166936 - RNA, 21 nt, Yersinia pestis
gcugucauuccaaccuuguaa

SEQ ID NO: 4166937 - RNA, 19 nt, Yersinia pestis
gcuguccaguugcuggaac

SEQ ID NO: 4166938 - RNA, 12 nt, Yersinia pestis
gcugucgcugug

SEQ ID NO: 4166939 - RNA, 14 nt, Yersinia pestis
gcugucugaauagu

SEQ ID NO: 4166940 - RNA, 22 nt, Yersinia pestis
gcugucuuucauucggcacagc

SEQ ID NO: 4166941 - RNA, 13 nt, Yersinia pestis
gcugugagccaga

SEQ ID NO: 4166942 - RNA, 22 nt, Yersinia pestis
gcuguggaaucggccuucaaua

SEQ ID NO: 4166943 - RNA, 18 nt, Yersinia pestis
gcuguggcgauaaaccga

SEQ ID NO: 4166944 - RNA, 15 nt, Yersinia pestis
gcugugguugccaaa

SEQ ID NO: 4166945 - RNA, 21 nt, Yersinia pestis
gcuguuaagcauugaguacgc

SEQ ID NO: 4166946 - RNA, 14 nt, Yersinia pestis
gcuguuagaugcua

SEQ ID NO: 4166947 - RNA, 13 nt, Yersinia pestis
gcuguuauuacug

SEQ ID NO: 4166948 - RNA, 12 nt, Yersinia pestis
gcuguuccaacc

SEQ ID NO: 4166949 - RNA, 19 nt, Yersinia pestis
gcuguuccaaccaaccuug

SEQ ID NO: 4166950 - RNA, 15 nt, Yersinia pestis
gcuguugcguaccau

SEQ ID NO: 4166951 - RNA, 17 nt, Yersinia pestis
gcuguuggcuauuacug

SEQ ID NO: 4166952 - RNA, 13 nt, Yersinia pestis
gcuguuguucugg

SEQ ID NO: 4166953 - RNA, 19 nt, Yersinia pestis
gcuuaaauaaaacacccuu

SEQ ID NO: 4166954 - RNA, 22 nt, Yersinia pestis
gcuuaacauccgaauuuuuacu

SEQ ID NO: 4166955 - RNA, 13 nt, Yersinia pestis
gcuuaaucauauu

SEQ ID NO: 4166956 - RNA, 22 nt, Yersinia pestis
gcuuaaucaucaucacaaauaa

SEQ ID NO: 4166957 - RNA, 20 nt, Yersinia pestis
gcuuaaucgccagcaaauca

SEQ ID NO: 4166958 - RNA, 22 nt, Yersinia pestis
gcuuaccgucugggcuggugga

SEQ ID NO: 4166959 - RNA, 16 nt, Yersinia pestis
gcuuacuuacccgaau

SEQ ID NO: 4166960 - RNA, 23 nt, Yersinia pestis
gcuuacuuacccgaaucacuuac

SEQ ID NO: 4166961 - RNA, 23 nt, Yersinia pestis
gcuuagcaggcccuuucaccgcu

SEQ ID NO: 4166962 - RNA, 19 nt, Yersinia pestis
gcuuaguauccgcgccaga

SEQ ID NO: 4166963 - RNA, 16 nt, Yersinia pestis
gcuuaguuacaauaaa

SEQ ID NO: 4166964 - RNA, 17 nt, Yersinia pestis
gcuuaucaaagugcuua

SEQ ID NO: 4166965 - RNA, 16 nt, Yersinia pestis
gcuuauccagccgcuc

SEQ ID NO: 4166966 - RNA, 20 nt, Yersinia pestis
gcuuauccccugagaaacau

SEQ ID NO: 4166967 - RNA, 15 nt, Yersinia pestis
gcuuauccugcaacc

SEQ ID NO: 4166968 - RNA, 23 nt, Yersinia pestis
gcuuaucucggggccacgguugg

SEQ ID NO: 4166969 - RNA, 13 nt, Yersinia pestis
gcuuaucuuccag

SEQ ID NO: 4166970 - RNA, 15 nt, Yersinia pestis
gcuuauuaauuaaug

SEQ ID NO: 4166971 - RNA, 18 nt, Yersinia pestis
gcuucacauccaauggca

SEQ ID NO: 4166972 - RNA, 19 nt, Yersinia pestis
gcuucaccgcuuuucuggu

SEQ ID NO: 4166973 - RNA, 21 nt, Yersinia pestis
gcuucaguaaagcgcaggaaa

SEQ ID NO: 4166974 - RNA, 19 nt, Yersinia pestis
gcuucaguuuugcggguga

SEQ ID NO: 4166975 - RNA, 18 nt, Yersinia pestis
gcuucauggcuaaaucca

SEQ ID NO: 4166976 - RNA, 23 nt, Yersinia pestis
gcuucauucguuagcucuucacg

SEQ ID NO: 4166977 - RNA, 15 nt, Yersinia pestis
gcuuccaucacaaau

SEQ ID NO: 4166978 - RNA, 15 nt, Yersinia pestis
gcuuccaucaggaag

SEQ ID NO: 4166979 - RNA, 16 nt, Yersinia pestis
gcuuccgguaaagaag

SEQ ID NO: 4166980 - RNA, 17 nt, Yersinia pestis
gcuuccgguaaagaagc

SEQ ID NO: 4166981 - RNA, 18 nt, Yersinia pestis
gcuuccugcgccacgcuu

SEQ ID NO: 4166982 - RNA, 15 nt, Yersinia pestis
gcuucgagcccccag

SEQ ID NO: 4166983 - RNA, 14 nt, Yersinia pestis
gcuucgccacggca

SEQ ID NO: 4166984 - RNA, 20 nt, Yersinia pestis
gcuucguccagaugccaaau

SEQ ID NO: 4166985 - RNA, 13 nt, Yersinia pestis
gcuucuggauggg

SEQ ID NO: 4166986 - RNA, 18 nt, Yersinia pestis
gcuucuggcgugucaucu

SEQ ID NO: 4166987 - RNA, 15 nt, Yersinia pestis
gcuucugggccaaag

SEQ ID NO: 4166988 - RNA, 23 nt, Yersinia pestis
gcuucugucaguguuaccaagag

SEQ ID NO: 4166989 - RNA, 19 nt, Yersinia pestis
gcuugaaguacggugccag

SEQ ID NO: 4166990 - RNA, 17 nt, Yersinia pestis
gcuugacuaacacgacu

SEQ ID NO: 4166991 - RNA, 18 nt, Yersinia pestis
gcuugagagucgagcggg

SEQ ID NO: 4166992 - RNA, 18 nt, Yersinia pestis
gcuugauuugcuggcgca

SEQ ID NO: 4166993 - RNA, 22 nt, Yersinia pestis
gcuugcauacgcuuaaccagca

SEQ ID NO: 4166994 - RNA, 15 nt, Yersinia pestis
gcuugccaaauauag

SEQ ID NO: 4166995 - RNA, 16 nt, Yersinia pestis
gcuugcgcgccuguuu

SEQ ID NO: 4166996 - RNA, 11 nt, Yersinia pestis
gcuugcugccu

SEQ ID NO: 4166997 - RNA, 17 nt, Yersinia pestis
gcuugcuuugcuucauc

SEQ ID NO: 4166998 - RNA, 19 nt, Yersinia pestis
gcuugcuuugcuucaucca

SEQ ID NO: 4166999 - RNA, 19 nt, Yersinia pestis
gcuuggauuccgucgccaa

SEQ ID NO: 4167000 - RNA, 13 nt, Yersinia pestis
gcuuggcgggcug

SEQ ID NO: 4167001 - RNA, 18 nt, Yersinia pestis
gcuuggcgggcuggccac

SEQ ID NO: 4167002 - RNA, 23 nt, Yersinia pestis
gcuugucaccguaaccauuggca

SEQ ID NO: 4167003 - RNA, 18 nt, Yersinia pestis
gcuugucguauuuccagu

SEQ ID NO: 4167004 - RNA, 16 nt, Yersinia pestis
gcuuguggaaauagaa

SEQ ID NO: 4167005 - RNA, 23 nt, Yersinia pestis
gcuuguugccacccuaucugcuc

SEQ ID NO: 4167006 - RNA, 17 nt, Yersinia pestis
gcuuguuguugauaguu

SEQ ID NO: 4167007 - RNA, 20 nt, Yersinia pestis
gcuuuaagauccaguucagu

SEQ ID NO: 4167008 - RNA, 19 nt, Yersinia pestis
gcuuuaagauccauguaua

SEQ ID NO: 4167009 - RNA, 12 nt, Yersinia pestis
gcuuuaaugagu

SEQ ID NO: 4167010 - RNA, 13 nt, Yersinia pestis
gcuuuaaugaguu

SEQ ID NO: 4167011 - RNA, 23 nt, Yersinia pestis
gcuuuaccuguuucgauccagcu

SEQ ID NO: 4167012 - RNA, 15 nt, Yersinia pestis
gcuuuacgcaacuca

SEQ ID NO: 4167013 - RNA, 21 nt, Yersinia pestis
gcuuuacggcaaggggcuuga

SEQ ID NO: 4167014 - RNA, 14 nt, Yersinia pestis
gcuuuacuccucug

SEQ ID NO: 4167015 - RNA, 15 nt, Yersinia pestis
gcuuuacuccucugc

SEQ ID NO: 4167016 - RNA, 16 nt, Yersinia pestis
gcuuuacuccucugcc

SEQ ID NO: 4167017 - RNA, 17 nt, Yersinia pestis
gcuuuacucuucagccu

SEQ ID NO: 4167018 - RNA, 19 nt, Yersinia pestis
gcuuuacucuucugccuac

SEQ ID NO: 4167019 - RNA, 14 nt, Yersinia pestis
gcuuuagcauugca

SEQ ID NO: 4167020 - RNA, 16 nt, Yersinia pestis
gcuuuagccagucacc

SEQ ID NO: 4167021 - RNA, 15 nt, Yersinia pestis
gcuuuaucccaccac

SEQ ID NO: 4167022 - RNA, 16 nt, Yersinia pestis
gcuuuaucgccaacac

SEQ ID NO: 4167023 - RNA, 14 nt, Yersinia pestis
gcuuuauuauauga

SEQ ID NO: 4167024 - RNA, 23 nt, Yersinia pestis
gcuuuauucuucuucauuuucau

SEQ ID NO: 4167025 - RNA, 14 nt, Yersinia pestis
gcuuucaauaaaac

SEQ ID NO: 4167026 - RNA, 16 nt, Yersinia pestis
gcuuucacgcuccaca

SEQ ID NO: 4167027 - RNA, 22 nt, Yersinia pestis
gcuuucagcacgcuuuccagcu

SEQ ID NO: 4167028 - RNA, 20 nt, Yersinia pestis
gcuuucaucgaaaaaaauac

SEQ ID NO: 4167029 - RNA, 14 nt, Yersinia pestis
gcuuucaucgauug

SEQ ID NO: 4167030 - RNA, 19 nt, Yersinia pestis
gcuuuccagcucuggccag

SEQ ID NO: 4167031 - RNA, 15 nt, Yersinia pestis
gcuuucgacccgccc

SEQ ID NO: 4167032 - RNA, 18 nt, Yersinia pestis
gcuuucggauuaaaaccu

SEQ ID NO: 4167033 - RNA, 22 nt, Yersinia pestis
gcuuucucugcgcuguaagcac

SEQ ID NO: 4167034 - RNA, 17 nt, Yersinia pestis
gcuuucucuugccauug

SEQ ID NO: 4167035 - RNA, 15 nt, Yersinia pestis
gcuuucuugccauaa

SEQ ID NO: 4167036 - RNA, 19 nt, Yersinia pestis
gcuuugacugacaaguuuu

SEQ ID NO: 4167037 - RNA, 19 nt, Yersinia pestis
gcuuugaugccuaauaauu

SEQ ID NO: 4167038 - RNA, 17 nt, Yersinia pestis
gcuuuggucaacagcaa

SEQ ID NO: 4167039 - RNA, 22 nt, Yersinia pestis
gcuuugguugccagauaauguu

SEQ ID NO: 4167040 - RNA, 23 nt, Yersinia pestis
gcuuuuagauaaaggcaaaagca

SEQ ID NO: 4167041 - RNA, 15 nt, Yersinia pestis
gcuuuuaucuaaugg

SEQ ID NO: 4167042 - RNA, 18 nt, Yersinia pestis
gcuuuucgaacugacgau

SEQ ID NO: 4167043 - RNA, 15 nt, Yersinia pestis
gcuuuucugccuauc

SEQ ID NO: 4167044 - RNA, 17 nt, Yersinia pestis
gcuuuugcugcaaacug

SEQ ID NO: 4167045 - RNA, 15 nt, Yersinia pestis
gcuuuuuacgccuau

SEQ ID NO: 4167046 - RNA, 13 nt, Yersinia pestis
gcuuuuuaucauu

SEQ ID NO: 4167047 - RNA, 15 nt, Yersinia pestis
gcuuuuuaucauuua

SEQ ID NO: 4167048 - RNA, 13 nt, Yersinia pestis
gcuuuuucuucca

SEQ ID NO: 4167049 - RNA, 11 nt, Yersinia pestis
gcuuuuugcuu

SEQ ID NO: 4167050 - RNA, 23 nt, Yersinia pestis
gcuuuuuuaauaaaaaacugacu

SEQ ID NO: 4167051 - RNA, 16 nt, Yersinia pestis
gcuuuuuucuagcugu

SEQ ID NO: 4167052 - RNA, 11 nt, Yersinia pestis
ggaaaaaauac

SEQ ID NO: 4167053 - RNA, 13 nt, Yersinia pestis
ggaaaaaucagua

SEQ ID NO: 4167054 - RNA, 13 nt, Yersinia pestis
ggaaaacagcaac

SEQ ID NO: 4167055 - RNA, 15 nt, Yersinia pestis
ggaaaaggcagagag

SEQ ID NO: 4167056 - RNA, 15 nt, Yersinia pestis
ggaaacaaaaccuaa

SEQ ID NO: 4167057 - RNA, 15 nt, Yersinia pestis
ggaaacgucggccag

SEQ ID NO: 4167058 - RNA, 14 nt, Yersinia pestis
ggaaaguaagcaag

SEQ ID NO: 4167059 - RNA, 13 nt, Yersinia pestis
ggaaaguagccau

SEQ ID NO: 4167060 - RNA, 21 nt, Yersinia pestis
ggaaauaaacaucaaagguuu

SEQ ID NO: 4167061 - RNA, 14 nt, Yersinia pestis
ggaacaacaggcgc

SEQ ID NO: 4167062 - RNA, 21 nt, Yersinia pestis
ggaaccgcuaaagucacacug

SEQ ID NO: 4167063 - RNA, 21 nt, Yersinia pestis
ggaacguggguggucauuuaa

SEQ ID NO: 4167064 - RNA, 16 nt, Yersinia pestis
ggaacguugcacccug

SEQ ID NO: 4167065 - RNA, 14 nt, Yersinia pestis
ggaacuuacucccu

SEQ ID NO: 4167066 - RNA, 21 nt, Yersinia pestis
ggaagacuuccagcaccacua

SEQ ID NO: 4167067 - RNA, 19 nt, Yersinia pestis
ggaagcgccgacacccagc

SEQ ID NO: 4167068 - RNA, 17 nt, Yersinia pestis
ggaagguaccugaucag

SEQ ID NO: 4167069 - RNA, 21 nt, Yersinia pestis
ggaauaacugagccgcauaca

SEQ ID NO: 4167070 - RNA, 22 nt, Yersinia pestis
ggaauaccaccccuucguccag

SEQ ID NO: 4167071 - RNA, 18 nt, Yersinia pestis
ggaaucagcguuuuauuc

SEQ ID NO: 4167072 - RNA, 20 nt, Yersinia pestis
ggaaucauuugaacagcauu

SEQ ID NO: 4167073 - RNA, 14 nt, Yersinia pestis
ggaaugacuuucag

SEQ ID NO: 4167074 - RNA, 14 nt, Yersinia pestis
ggaaugcuauauuu

SEQ ID NO: 4167075 - RNA, 23 nt, Yersinia pestis
ggaaugcuauauuuggcuuucag

SEQ ID NO: 4167076 - RNA, 11 nt, Yersinia pestis
ggaauugacua

SEQ ID NO: 4167077 - RNA, 18 nt, Yersinia pestis
ggacaaauaaaacagaac

SEQ ID NO: 4167078 - RNA, 19 nt, Yersinia pestis
ggacagcgcgcagccaacg

SEQ ID NO: 4167079 - RNA, 18 nt, Yersinia pestis
ggacaggcuccuccuugg

SEQ ID NO: 4167080 - RNA, 21 nt, Yersinia pestis
ggacagguuuguagcacucca

SEQ ID NO: 4167081 - RNA, 18 nt, Yersinia pestis
ggacauuuuacucccuga

SEQ ID NO: 4167082 - RNA, 21 nt, Yersinia pestis
ggacgaccuguagcuuuuuaa

SEQ ID NO: 4167083 - RNA, 21 nt, Yersinia pestis
ggacgauaaauucaaauauca

SEQ ID NO: 4167084 - RNA, 21 nt, Yersinia pestis
ggacgcuuuacuccccugccu

SEQ ID NO: 4167085 - RNA, 17 nt, Yersinia pestis
ggacucuuaguuucuac

SEQ ID NO: 4167086 - RNA, 12 nt, Yersinia pestis
ggagaaacauua

SEQ ID NO: 4167087 - RNA, 15 nt, Yersinia pestis
ggagagaaauaggca

SEQ ID NO: 4167088 - RNA, 15 nt, Yersinia pestis
ggagagaacaggcag

SEQ ID NO: 4167089 - RNA, 18 nt, Yersinia pestis
ggagagcagggcccgcca

SEQ ID NO: 4167090 - RNA, 19 nt, Yersinia pestis
ggagaucgcucucacccug

SEQ ID NO: 4167091 - RNA, 18 nt, Yersinia pestis
ggagauuucagacugcug

SEQ ID NO: 4167092 - RNA, 19 nt, Yersinia pestis
ggagauuucagacugcuga

SEQ ID NO: 4167093 - RNA, 15 nt, Yersinia pestis
ggagcaagugcuuca

SEQ ID NO: 4167094 - RNA, 16 nt, Yersinia pestis
ggagcaaguuaacgcu

SEQ ID NO: 4167095 - RNA, 18 nt, Yersinia pestis
ggagcggauaaagcgcug

SEQ ID NO: 4167096 - RNA, 19 nt, Yersinia pestis
ggaggagauuucagacugc

SEQ ID NO: 4167097 - RNA, 21 nt, Yersinia pestis
ggaggagauuucagacugcug

SEQ ID NO: 4167098 - RNA, 15 nt, Yersinia pestis
ggaggagguagcaac

SEQ ID NO: 4167099 - RNA, 17 nt, Yersinia pestis
ggaggauauuuauuuua

SEQ ID NO: 4167100 - RNA, 22 nt, Yersinia pestis
ggaggauauuuauuuugguaaa

SEQ ID NO: 4167101 - RNA, 15 nt, Yersinia pestis
ggaggcguuuccccu

SEQ ID NO: 4167102 - RNA, 12 nt, Yersinia pestis
ggaggcuggcag

SEQ ID NO: 4167103 - RNA, 18 nt, Yersinia pestis
ggagguugccgguuuauu

SEQ ID NO: 4167104 - RNA, 18 nt, Yersinia pestis
ggaguaauuaauaaucga

SEQ ID NO: 4167105 - RNA, 14 nt, Yersinia pestis
ggagugaugaaacc

SEQ ID NO: 4167106 - RNA, 24 nt, Yersinia pestis
cugcuggaaugcagugccacggau

SEQ ID NO: 4167107 - RNA, 20 nt, Yersinia pestis
cugcuggcggaacaguugcu

SEQ ID NO: 4167108 - RNA, 16 nt, Yersinia pestis
cugcugguuuuacuga

SEQ ID NO: 4167109 - RNA, 15 nt, Yersinia pestis
cugcugucgcugugg

SEQ ID NO: 4167110 - RNA, 17 nt, Yersinia pestis
cugcuuaaaccauacuc

SEQ ID NO: 4167111 - RNA, 11 nt, Yersinia pestis
cugcuuaaucc

SEQ ID NO: 4167112 - RNA, 13 nt, Yersinia pestis
cugcuuaccuugu

SEQ ID NO: 4167113 - RNA, 21 nt, Yersinia pestis
cugcuuacucuuccaacucau

SEQ ID NO: 4167114 - RNA, 18 nt, Yersinia pestis
cugcuugauuugcuggcg

SEQ ID NO: 4167115 - RNA, 13 nt, Yersinia pestis
cugcuugcgcguu

SEQ ID NO: 4167116 - RNA, 20 nt, Yersinia pestis
cugcuuuaaaggcuucgcug

SEQ ID NO: 4167117 - RNA, 12 nt, Yersinia pestis
cugcuuuaucgu

SEQ ID NO: 4167118 - RNA, 12 nt, Yersinia pestis
cuggaaacaaaa

SEQ ID NO: 4167119 - RNA, 14 nt, Yersinia pestis
cuggaaacgaccug

SEQ ID NO: 4167120 - RNA, 19 nt, Yersinia pestis
cuggaaacgaccuguacug

SEQ ID NO: 4167121 - RNA, 16 nt, Yersinia pestis
cuggaaaggaauaucu

SEQ ID NO: 4167122 - RNA, 20 nt, Yersinia pestis
cuggaaauauuggcaacaac

SEQ ID NO: 4167123 - RNA, 22 nt, Yersinia pestis
cuggaagccgacgaucuugccc

SEQ ID NO: 4167124 - RNA, 19 nt, Yersinia pestis
cuggaauccaaguucaacu

SEQ ID NO: 4167125 - RNA, 16 nt, Yersinia pestis
cuggaccuuaucauca

SEQ ID NO: 4167126 - RNA, 13 nt, Yersinia pestis
cuggacgcaucag

SEQ ID NO: 4167127 - RNA, 17 nt, Yersinia pestis
cuggacgcaucagaucg

SEQ ID NO: 4167128 - RNA, 14 nt, Yersinia pestis
cuggacugguugcu

SEQ ID NO: 4167129 - RNA, 21 nt, Yersinia pestis
cuggacugguugcugguuaau

SEQ ID NO: 4167130 - RNA, 20 nt, Yersinia pestis
cuggagcauugcgcucugac

SEQ ID NO: 4167131 - RNA, 16 nt, Yersinia pestis
cuggagcuauggaaga

SEQ ID NO: 4167132 - RNA, 14 nt, Yersinia pestis
cuggagcuucuggc

SEQ ID NO: 4167133 - RNA, 15 nt, Yersinia pestis
cuggaggcuggcagg

SEQ ID NO: 4167134 - RNA, 16 nt, Yersinia pestis
cuggaggcuggcaggu

SEQ ID NO: 4167135 - RNA, 11 nt, Yersinia pestis
cuggauaaacu

SEQ ID NO: 4167136 - RNA, 13 nt, Yersinia pestis
cuggauauuuucc

SEQ ID NO: 4167137 - RNA, 20 nt, Yersinia pestis
cuggaucggcauacuccauu

SEQ ID NO: 4167138 - RNA, 15 nt, Yersinia pestis
cuggaucuuuuagcu

SEQ ID NO: 4167139 - RNA, 14 nt, Yersinia pestis
cuggauuugagaau

SEQ ID NO: 4167140 - RNA, 13 nt, Yersinia pestis
cuggcaaaauccc

SEQ ID NO: 4167141 - RNA, 18 nt, Yersinia pestis
cuggcaaaaucccagcag

SEQ ID NO: 4167142 - RNA, 23 nt, Yersinia pestis
cuggcaaacgcugcacaucauuu

SEQ ID NO: 4167143 - RNA, 17 nt, Yersinia pestis
cuggcaaggcacgagcg

SEQ ID NO: 4167144 - RNA, 16 nt, Yersinia pestis
cuggcaauggcuagcu

SEQ ID NO: 4167145 - RNA, 22 nt, Yersinia pestis
cuggcaauuucuguuaccagaa

SEQ ID NO: 4167146 - RNA, 17 nt, Yersinia pestis
cuggcacuggcaauaaa

SEQ ID NO: 4167147 - RNA, 12 nt, Yersinia pestis
cuggcaggaaau

SEQ ID NO: 4167148 - RNA, 22 nt, Yersinia pestis
cuggcaggcucgagcgcuaaua

SEQ ID NO: 4167149 - RNA, 16 nt, Yersinia pestis
cuggcauacaguuuug

SEQ ID NO: 4167150 - RNA, 18 nt, Yersinia pestis
cuggcaugcauuggaaaa

SEQ ID NO: 4167151 - RNA, 12 nt, Yersinia pestis
cuggcauugcau

SEQ ID NO: 4167152 - RNA, 15 nt, Yersinia pestis
cuggcauuuuacugg

SEQ ID NO: 4167153 - RNA, 12 nt, Yersinia pestis
cuggcauuuuuu

SEQ ID NO: 4167154 - RNA, 20 nt, Yersinia pestis
cuggccaaagccgguaucaa

SEQ ID NO: 4167155 - RNA, 15 nt, Yersinia pestis
cuggccacagagugg

SEQ ID NO: 4167156 - RNA, 23 nt, Yersinia pestis
cuggccacccaacgcaauugcac

SEQ ID NO: 4167157 - RNA, 21 nt, Yersinia pestis
cuggccagaagguaagccagu

SEQ ID NO: 4167158 - RNA, 16 nt, Yersinia pestis
cuggcccaguagagca

SEQ ID NO: 4167159 - RNA, 13 nt, Yersinia pestis
cuggccgcaggcg

SEQ ID NO: 4167160 - RNA, 21 nt, Yersinia pestis
cuggccguguuuuucccuacc

SEQ ID NO: 4167161 - RNA, 14 nt, Yersinia pestis
cuggccuauuaaga

SEQ ID NO: 4167162 - RNA, 19 nt, Yersinia pestis
cuggccuauuaagauaauu

SEQ ID NO: 4167163 - RNA, 16 nt, Yersinia pestis
cuggccugagaaccca

SEQ ID NO: 4167164 - RNA, 17 nt, Yersinia pestis
cuggccugagaacccau

SEQ ID NO: 4167165 - RNA, 19 nt, Yersinia pestis
cuggccuggcauuuuacug

SEQ ID NO: 4167166 - RNA, 17 nt, Yersinia pestis
cuggccuguugcaauug

SEQ ID NO: 4167167 - RNA, 14 nt, Yersinia pestis
cuggcgcaaagacu

SEQ ID NO: 4167168 - RNA, 15 nt, Yersinia pestis
cuggcgcagaguauc

SEQ ID NO: 4167169 - RNA, 19 nt, Yersinia pestis
cuggcgcauccccacuugu

SEQ ID NO: 4167170 - RNA, 18 nt, Yersinia pestis
cuggcggaacaguugcuu

SEQ ID NO: 4167171 - RNA, 15 nt, Yersinia pestis
cuggcggauaaaaau

SEQ ID NO: 4167172 - RNA, 19 nt, Yersinia pestis
cuggcggauaacggcggca

SEQ ID NO: 4167173 - RNA, 20 nt, Yersinia pestis
cuggcggauaacggcggcaa

SEQ ID NO: 4167174 - RNA, 18 nt, Yersinia pestis
cuggcgggaauugaaccu

SEQ ID NO: 4167175 - RNA, 19 nt, Yersinia pestis
cuggcgguuucaccuaucg

SEQ ID NO: 4167176 - RNA, 18 nt, Yersinia pestis
cuggcgugcgggcaaaac

SEQ ID NO: 4167177 - RNA, 18 nt, Yersinia pestis
cuggcuaacguggccuua

SEQ ID NO: 4167178 - RNA, 16 nt, Yersinia pestis
cuggcuaauuuuauua

SEQ ID NO: 4167179 - RNA, 15 nt, Yersinia pestis
cuggcuauccugaaa

SEQ ID NO: 4167180 - RNA, 15 nt, Yersinia pestis
cuggcucaaauuugg

SEQ ID NO: 4167181 - RNA, 15 nt, Yersinia pestis
cuggcucggcgcgcu

SEQ ID NO: 4167182 - RNA, 14 nt, Yersinia pestis
cuggcucuauuuuc

SEQ ID NO: 4167183 - RNA, 20 nt, Yersinia pestis
cuggcucugcgaccaaggcu

SEQ ID NO: 4167184 - RNA, 22 nt, Yersinia pestis
cuggcuggcauauuucucuuuc

SEQ ID NO: 4167185 - RNA, 17 nt, Yersinia pestis
cuggcuuuuucacacgc

SEQ ID NO: 4167186 - RNA, 23 nt, Yersinia pestis
cugggacccaucgccguuuugcc

SEQ ID NO: 4167187 - RNA, 17 nt, Yersinia pestis
cugggauccauaggauc

SEQ ID NO: 4167188 - RNA, 20 nt, Yersinia pestis
cugggccacgaugugaagca

SEQ ID NO: 4167189 - RNA, 15 nt, Yersinia pestis
cugggcgacccaaag

SEQ ID NO: 4167190 - RNA, 13 nt, Yersinia pestis
cugggcgauccaa

SEQ ID NO: 4167191 - RNA, 16 nt, Yersinia pestis
cugggcugauggucau

SEQ ID NO: 4167192 - RNA, 22 nt, Yersinia pestis
cuggggcuaucgcgaaaaugaa

SEQ ID NO: 4167193 - RNA, 22 nt, Yersinia pestis
cugggggcuagccgcgccaucc

SEQ ID NO: 4167194 - RNA, 23 nt, Yersinia pestis
cugggggugagcaagggcagcua

SEQ ID NO: 4167195 - RNA, 18 nt, Yersinia pestis
cuggggucaucaacgcac

SEQ ID NO: 4167196 - RNA, 15 nt, Yersinia pestis
cugggguuucuguca

SEQ ID NO: 4167197 - RNA, 21 nt, Yersinia pestis
cuggguuuuauugcaacuggg

SEQ ID NO: 4167198 - RNA, 18 nt, Yersinia pestis
cugguaaaaacaccauau

SEQ ID NO: 4167199 - RNA, 15 nt, Yersinia pestis
cugguaacagagccu

SEQ ID NO: 4167200 - RNA, 16 nt, Yersinia pestis
cugguaacagagccuu

SEQ ID NO: 4167201 - RNA, 22 nt, Yersinia pestis
cugguaagcuggcgcacucauc

SEQ ID NO: 4167202 - RNA, 21 nt, Yersinia pestis
cugguaccaaacaacaacaca

SEQ ID NO: 4167203 - RNA, 21 nt, Yersinia pestis
cugguacggcgcaucgccauc

SEQ ID NO: 4167204 - RNA, 17 nt, Yersinia pestis
cugguagcugcucacga

SEQ ID NO: 4167205 - RNA, 19 nt, Yersinia pestis
cugguagucauauucaggc

SEQ ID NO: 4167206 - RNA, 18 nt, Yersinia pestis
cugguaguuuugcauaau

SEQ ID NO: 4167207 - RNA, 21 nt, Yersinia pestis
cuggucacuaaaacugaagca

SEQ ID NO: 4167208 - RNA, 18 nt, Yersinia pestis
cugguccaacuaaacagg

SEQ ID NO: 4167209 - RNA, 15 nt, Yersinia pestis
cugguccagaucggc

SEQ ID NO: 4167210 - RNA, 18 nt, Yersinia pestis
cuggucgauaagcacucc

SEQ ID NO: 4167211 - RNA, 21 nt, Yersinia pestis
cuggucugccagaauuuugca

SEQ ID NO: 4167212 - RNA, 22 nt, Yersinia pestis
cuggugacccgucagcguccug

SEQ ID NO: 4167213 - RNA, 19 nt, Yersinia pestis
cuggugacuaaauuaaccc

SEQ ID NO: 4167214 - RNA, 20 nt, Yersinia pestis
cuggugaugcucgagcacca

SEQ ID NO: 4167215 - RNA, 13 nt, Yersinia pestis
cugguggcugaga

SEQ ID NO: 4167216 - RNA, 19 nt, Yersinia pestis
cugguggcuugggcuucac

SEQ ID NO: 4167217 - RNA, 16 nt, Yersinia pestis
cuggugguuuuguuaa

SEQ ID NO: 4167218 - RNA, 11 nt, Yersinia pestis
cuggugucaau

SEQ ID NO: 4167219 - RNA, 23 nt, Yersinia pestis
cuggugucacaaucucuggcaac

SEQ ID NO: 4167220 - RNA, 14 nt, Yersinia pestis
cugguuauuggccc

SEQ ID NO: 4167221 - RNA, 18 nt, Yersinia pestis
cugguuauuggcccaucu

SEQ ID NO: 4167222 - RNA, 13 nt, Yersinia pestis
cugguugaaaccu

SEQ ID NO: 4167223 - RNA, 16 nt, Yersinia pestis
cugguugcagcacgcc

SEQ ID NO: 4167224 - RNA, 14 nt, Yersinia pestis
cugguugcuguucu

SEQ ID NO: 4167225 - RNA, 12 nt, Yersinia pestis
cugguugcuuca

SEQ ID NO: 4167226 - RNA, 14 nt, Yersinia pestis
cugguuggauuggu

SEQ ID NO: 4167227 - RNA, 21 nt, Yersinia pestis
cugguuggcggcuuaguauua

SEQ ID NO: 4167228 - RNA, 15 nt, Yersinia pestis
cugguugugcuucag

SEQ ID NO: 4167229 - RNA, 12 nt, Yersinia pestis
cuguaaaacaag

SEQ ID NO: 4167230 - RNA, 13 nt, Yersinia pestis
cuguaaaaucuuu

SEQ ID NO: 4167231 - RNA, 17 nt, Yersinia pestis
cuguaaaggcaaagaag

SEQ ID NO: 4167232 - RNA, 15 nt, Yersinia pestis
cuguaaccgcaagga

SEQ ID NO: 4167233 - RNA, 15 nt, Yersinia pestis
cuguaacuuuauuga

SEQ ID NO: 4167234 - RNA, 14 nt, Yersinia pestis
cuguaaggccaaac

SEQ ID NO: 4167235 - RNA, 23 nt, Yersinia pestis
cuguaagguugaccugcagcggu

SEQ ID NO: 4167236 - RNA, 13 nt, Yersinia pestis
cuguaauccggca

SEQ ID NO: 4167237 - RNA, 19 nt, Yersinia pestis
cuguaauggcgcacauuac

SEQ ID NO: 4167238 - RNA, 15 nt, Yersinia pestis
cuguaaugggugaua

SEQ ID NO: 4167239 - RNA, 17 nt, Yersinia pestis
cuguacaacaagauccc

SEQ ID NO: 4167240 - RNA, 15 nt, Yersinia pestis
cuguacacacaguga

SEQ ID NO: 4167241 - RNA, 12 nt, Yersinia pestis
cuguaccaccac

SEQ ID NO: 4167242 - RNA, 14 nt, Yersinia pestis
cuguaccaccacca

SEQ ID NO: 4167243 - RNA, 16 nt, Yersinia pestis
cuguaccugacccgca

SEQ ID NO: 4167244 - RNA, 13 nt, Yersinia pestis
cuguacucacuca

SEQ ID NO: 4167245 - RNA, 19 nt, Yersinia pestis
cuguacuuuaacuuuaguu

SEQ ID NO: 4167246 - RNA, 13 nt, Yersinia pestis
cuguacuuugauu

SEQ ID NO: 4167247 - RNA, 14 nt, Yersinia pestis
cuguagaacaccug

SEQ ID NO: 4167248 - RNA, 19 nt, Yersinia pestis
cuguagaacuuguucauau

SEQ ID NO: 4167249 - RNA, 20 nt, Yersinia pestis
cuguagcgccagguaagaaa

SEQ ID NO: 4167250 - RNA, 18 nt, Yersinia pestis
cuguaggugucaccaacg

SEQ ID NO: 4167251 - RNA, 13 nt, Yersinia pestis
cuguaguucauca

SEQ ID NO: 4167252 - RNA, 12 nt, Yersinia pestis
cuguauccagca

SEQ ID NO: 4167253 - RNA, 14 nt, Yersinia pestis
cuguauccagcagc

SEQ ID NO: 4167254 - RNA, 14 nt, Yersinia pestis
cuguauuuccugua

SEQ ID NO: 4167255 - RNA, 15 nt, Yersinia pestis
cuguauuuguucuga

SEQ ID NO: 4167256 - RNA, 15 nt, Yersinia pestis
cugucaaaaagcacc

SEQ ID NO: 4167257 - RNA, 13 nt, Yersinia pestis
cugucaccuacca

SEQ ID NO: 4167258 - RNA, 16 nt, Yersinia pestis
cugucaccuaccaccu

SEQ ID NO: 4167259 - RNA, 15 nt, Yersinia pestis
cugucaccugucacc

SEQ ID NO: 4167260 - RNA, 19 nt, Yersinia pestis
cugucaccugucaccuacc

SEQ ID NO: 4167261 - RNA, 13 nt, Yersinia pestis
cugucacugucaa

SEQ ID NO: 4167262 - RNA, 18 nt, Yersinia pestis
cugucagacaguucugua

SEQ ID NO: 4167263 - RNA, 12 nt, Yersinia pestis
cugucagccacc

SEQ ID NO: 4167264 - RNA, 16 nt, Yersinia pestis
cugucagcgaaaaaaa

SEQ ID NO: 4167265 - RNA, 23 nt, Yersinia pestis
cugucagcgaaaaaaaucaagua

SEQ ID NO: 4167266 - RNA, 13 nt, Yersinia pestis
cugucauugcugu

SEQ ID NO: 4167267 - RNA, 23 nt, Yersinia pestis
cugucauuuccuccgcuuuagcu

SEQ ID NO: 4167268 - RNA, 18 nt, Yersinia pestis
cuguccaagaagccaaga

SEQ ID NO: 4167269 - RNA, 22 nt, Yersinia pestis
cuguccgucaaaccaucgcucu

SEQ ID NO: 4167270 - RNA, 17 nt, Yersinia pestis
cuguccuuuaacucaau

SEQ ID NO: 4167271 - RNA, 21 nt, Yersinia pestis
cugucgcagaaaacaggccgc

SEQ ID NO: 4167272 - RNA, 14 nt, Yersinia pestis
cugucggagccuga

SEQ ID NO: 4167273 - RNA, 18 nt, Yersinia pestis
cugucggcgaugaaaaac

SEQ ID NO: 4167274 - RNA, 15 nt, Yersinia pestis
cugucggcgcagcaa

SEQ ID NO: 4167275 - RNA, 12 nt, Yersinia pestis
cugucggguaac

SEQ ID NO: 4167276 - RNA, 20 nt, Yersinia pestis
cugucuccuaucugagguua

SEQ ID NO: 4167277 - RNA, 16 nt, Yersinia pestis
cugucugacggggauu

SEQ ID NO: 4167278 - RNA, 15 nt, Yersinia pestis
cugucugaugauuug

SEQ ID NO: 4167279 - RNA, 17 nt, Yersinia pestis
cugucugcuguugccac

SEQ ID NO: 4167280 - RNA, 21 nt, Yersinia pestis
cugucuuaggugacaggcaaa

SEQ ID NO: 4167281 - RNA, 16 nt, Yersinia pestis
cugugaaauaccgauu

SEQ ID NO: 4167282 - RNA, 22 nt, Yersinia pestis
cugugaauuuaucaggcuaaua

SEQ ID NO: 4167283 - RNA, 14 nt, Yersinia pestis
cugugagcgcagac

SEQ ID NO: 4167284 - RNA, 12 nt, Yersinia pestis
cugugauaacca

SEQ ID NO: 4167285 - RNA, 21 nt, Yersinia pestis
cugugauaaccaacaguuauu

SEQ ID NO: 4167286 - RNA, 23 nt, Yersinia pestis
cugugauaaccaacaguuauuuu

SEQ ID NO: 4167287 - RNA, 20 nt, Yersinia pestis
cugugaucgcugccgcaaga

SEQ ID NO: 4167288 - RNA, 20 nt, Yersinia pestis
cugugauuucagccaggcga

SEQ ID NO: 4167289 - RNA, 19 nt, Yersinia pestis
cugugccaaugccucuuca

SEQ ID NO: 4167290 - RNA, 21 nt, Yersinia pestis
cugugcgauuucacggauauc

SEQ ID NO: 4167291 - RNA, 17 nt, Yersinia pestis
cugugcgcuuugcagua

SEQ ID NO: 4167292 - RNA, 15 nt, Yersinia pestis
cugugcuaaauccca

SEQ ID NO: 4167293 - RNA, 19 nt, Yersinia pestis
cugugcuaaaucccaggcg

SEQ ID NO: 4167294 - RNA, 20 nt, Yersinia pestis
cuguggaaucggccuucaau

SEQ ID NO: 4167295 - RNA, 22 nt, Yersinia pestis
cuguggcuaauaaugcaccaau

SEQ ID NO: 4167296 - RNA, 19 nt, Yersinia pestis
cugugggacugaucaaguu

SEQ ID NO: 4167297 - RNA, 14 nt, Yersinia pestis
cugugguggcgguc

SEQ ID NO: 4167298 - RNA, 17 nt, Yersinia pestis
cugugucgcuauuuccg

SEQ ID NO: 4167299 - RNA, 16 nt, Yersinia pestis
cuguguuuugagcauc

SEQ ID NO: 4167300 - RNA, 22 nt, Yersinia pestis
cuguguuuugagcaucacuuca

SEQ ID NO: 4167301 - RNA, 13 nt, Yersinia pestis
cuguuaacucaug

SEQ ID NO: 4167302 - RNA, 20 nt, Yersinia pestis
cuguuaauccuaaugaacac

SEQ ID NO: 4167303 - RNA, 15 nt, Yersinia pestis
cuguuaccagaaaac

SEQ ID NO: 4167304 - RNA, 22 nt, Yersinia pestis
cuguuaguaacuguaaggccaa

SEQ ID NO: 4167305 - RNA, 20 nt, Yersinia pestis
cuguuauaaggcuaacaccu

SEQ ID NO: 4167306 - RNA, 16 nt, Yersinia pestis
cuguuauuacugucau

SEQ ID NO: 4167307 - RNA, 22 nt, Yersinia pestis
cuguucagauuuaccaugucca

SEQ ID NO: 4167308 - RNA, 11 nt, Yersinia pestis
cuguucaucag

SEQ ID NO: 4167309 - RNA, 13 nt, Yersinia pestis
cuguucaucaggc

SEQ ID NO: 4167310 - RNA, 17 nt, Yersinia pestis
cuguucaucgcaauuca

SEQ ID NO: 4167311 - RNA, 13 nt, Yersinia pestis
cuguuccaaccaa

SEQ ID NO: 4167312 - RNA, 15 nt, Yersinia pestis
cuguuccaacgagug

SEQ ID NO: 4167313 - RNA, 21 nt, Yersinia pestis
cuguucgggcugauuaauauc

SEQ ID NO: 4167314 - RNA, 16 nt, Yersinia pestis
cuguucucucccguug

SEQ ID NO: 4167315 - RNA, 22 nt, Yersinia pestis
cuguucugggggugauauuugu

SEQ ID NO: 4167316 - RNA, 23 nt, Yersinia pestis
cuguugagguacggcucuauuuc

SEQ ID NO: 4167317 - RNA, 18 nt, Yersinia pestis
cuguugcaugaaaucagu

SEQ ID NO: 4167318 - RNA, 11 nt, Yersinia pestis
cuguugccccc

SEQ ID NO: 4167319 - RNA, 18 nt, Yersinia pestis
cuguugccggauuuuuua

SEQ ID NO: 4167320 - RNA, 14 nt, Yersinia pestis
cuguugcuggccag

SEQ ID NO: 4167321 - RNA, 15 nt, Yersinia pestis
cuguuggcaauuuca

SEQ ID NO: 4167322 - RNA, 15 nt, Yersinia pestis
cuguuggcuccugag

SEQ ID NO: 4167323 - RNA, 14 nt, Yersinia pestis
cuguuguugugaca

SEQ ID NO: 4167324 - RNA, 22 nt, Yersinia pestis
cuguuucaaauaaguauuucaa

SEQ ID NO: 4167325 - RNA, 12 nt, Yersinia pestis
cuguuucaacau

SEQ ID NO: 4167326 - RNA, 17 nt, Yersinia pestis
cuguuuccucuucaucu

SEQ ID NO: 4167327 - RNA, 16 nt, Yersinia pestis
cuguuugcuguaaaca

SEQ ID NO: 4167328 - RNA, 18 nt, Yersinia pestis
cuguuuucauuauuuuca

SEQ ID NO: 4167329 - RNA, 17 nt, Yersinia pestis
cuguuuuugaauaggua

SEQ ID NO: 4167330 - RNA, 18 nt, Yersinia pestis
cuguuuuuuaaagaaaaa

SEQ ID NO: 4167331 - RNA, 14 nt, Yersinia pestis
cuguuuuuuauccc

SEQ ID NO: 4167332 - RNA, 15 nt, Yersinia pestis
cuguuuuuuuuaaau

SEQ ID NO: 4167333 - RNA, 18 nt, Yersinia pestis
cuguuuuuuuuaaaugaa

SEQ ID NO: 4167334 - RNA, 15 nt, Yersinia pestis
cuuaaaaaacgauua

SEQ ID NO: 4167335 - RNA, 20 nt, Yersinia pestis
cuuaaaaaaugauaaauucu

SEQ ID NO: 4167336 - RNA, 19 nt, Yersinia pestis
cuuaaaaacccauaagucc

SEQ ID NO: 4167337 - RNA, 13 nt, Yersinia pestis
cuuaaaaaucaaa

SEQ ID NO: 4167338 - RNA, 17 nt, Yersinia pestis
cuuaaaauacugccaau

SEQ ID NO: 4167339 - RNA, 17 nt, Yersinia pestis
cuuaaaauauggcaggu

SEQ ID NO: 4167340 - RNA, 21 nt, Yersinia pestis
cuuaaagccuucaacuaauau

SEQ ID NO: 4167341 - RNA, 22 nt, Yersinia pestis
cuuaaaguuauguuuuuccuuc

SEQ ID NO: 4167342 - RNA, 22 nt, Yersinia pestis
cuuaaauauaccgccaagcgcc

SEQ ID NO: 4167343 - RNA, 21 nt, Yersinia pestis
cuuaacacgaaccuucucugc

SEQ ID NO: 4167344 - RNA, 18 nt, Yersinia pestis
cuuaaccaacaugagcca

SEQ ID NO: 4167345 - RNA, 15 nt, Yersinia pestis
cuuaacgccccgccc

SEQ ID NO: 4167346 - RNA, 17 nt, Yersinia pestis
cuuaacgccccgccccu

SEQ ID NO: 4167347 - RNA, 18 nt, Yersinia pestis
cuuaacgccccgccccug

SEQ ID NO: 4167348 - RNA, 16 nt, Yersinia pestis
cuuaacuacaccgcua

SEQ ID NO: 4167349 - RNA, 13 nt, Yersinia pestis
cuuaacugaaagc

SEQ ID NO: 4167350 - RNA, 11 nt, Yersinia pestis
cuuaacugcac

SEQ ID NO: 4167351 - RNA, 15 nt, Yersinia pestis
cuuaacugcauagcu

SEQ ID NO: 4167352 - RNA, 16 nt, Yersinia pestis
cuuaacugcauagcua

SEQ ID NO: 4167353 - RNA, 20 nt, Yersinia pestis
cuuaagacguaucgcaguua

SEQ ID NO: 4167354 - RNA, 16 nt, Yersinia pestis
cuuaagagagaugcaa

SEQ ID NO: 4167355 - RNA, 10 nt, Yersinia pestis
cuuaauaaua

SEQ ID NO: 4167356 - RNA, 14 nt, Yersinia pestis
cuuaauaauaucaa

SEQ ID NO: 4167357 - RNA, 15 nt, Yersinia pestis
cuuaauaauaucaaa

SEQ ID NO: 4167358 - RNA, 12 nt, Yersinia pestis
cuuaauaaugac

SEQ ID NO: 4167359 - RNA, 18 nt, Yersinia pestis
cuuaaucagcaaaaacaa

SEQ ID NO: 4167360 - RNA, 21 nt, Yersinia pestis
cuuaaucaucaucacaaauaa

SEQ ID NO: 4167361 - RNA, 16 nt, Yersinia pestis
cuuaaucuuuaauuca

SEQ ID NO: 4167362 - RNA, 16 nt, Yersinia pestis
cuuaauggucuucuuu

SEQ ID NO: 4167363 - RNA, 14 nt, Yersinia pestis
cuuaauuaacucuu

SEQ ID NO: 4167364 - RNA, 15 nt, Yersinia pestis
cuuaauuaacucuuc

SEQ ID NO: 4167365 - RNA, 15 nt, Yersinia pestis
cuuaauucccagcca

SEQ ID NO: 4167366 - RNA, 23 nt, Yersinia pestis
cuuaauuggcggaagacuuccag

SEQ ID NO: 4167367 - RNA, 18 nt, Yersinia pestis
cuuacaagaaugcagaua

SEQ ID NO: 4167368 - RNA, 14 nt, Yersinia pestis
cuuacauaaguaag

SEQ ID NO: 4167369 - RNA, 15 nt, Yersinia pestis
cuuacauaaguaagu

SEQ ID NO: 4167370 - RNA, 22 nt, Yersinia pestis
cuuacauucgagcaacuuuuac

SEQ ID NO: 4167371 - RNA, 19 nt, Yersinia pestis
cuuacccgaaucacugacu

SEQ ID NO: 4167372 - RNA, 16 nt, Yersinia pestis
cuuacccgaaucacuu

SEQ ID NO: 4167373 - RNA, 19 nt, Yersinia pestis
cuuaccggccucuuucccc

SEQ ID NO: 4167374 - RNA, 18 nt, Yersinia pestis
cuuaccugaguaagcuca

SEQ ID NO: 4167375 - RNA, 19 nt, Yersinia pestis
cuuaccuucaguuuauuua

SEQ ID NO: 4167376 - RNA, 12 nt, Yersinia pestis
cuuacgagcuaa

SEQ ID NO: 4167377 - RNA, 16 nt, Yersinia pestis
cuuacgagcuaaugcu

SEQ ID NO: 4167378 - RNA, 16 nt, Yersinia pestis
cuuacgcgaugccaac

SEQ ID NO: 4167379 - RNA, 18 nt, Yersinia pestis
cuuacggugauacaucuc

SEQ ID NO: 4167380 - RNA, 18 nt, Yersinia pestis
cuuacuaaaauaucacua

SEQ ID NO: 4167381 - RNA, 18 nt, Yersinia pestis
cuuacuauuuuucucaau

SEQ ID NO: 4167382 - RNA, 18 nt, Yersinia pestis
cuuacucccuuguugccu

SEQ ID NO: 4167383 - RNA, 16 nt, Yersinia pestis
cuuacugcaucaauaa

SEQ ID NO: 4167384 - RNA, 20 nt, Yersinia pestis
cuuacugguaccaaucucca

SEQ ID NO: 4167385 - RNA, 16 nt, Yersinia pestis
cuuacugguuuucugc

SEQ ID NO: 4167386 - RNA, 14 nt, Yersinia pestis
cuuacuguucaccg

SEQ ID NO: 4167387 - RNA, 22 nt, Yersinia pestis
cuuacuguuuucauuauuuuca

SEQ ID NO: 4167388 - RNA, 15 nt, Yersinia pestis
cuuacuucacuucca

SEQ ID NO: 4167389 - RNA, 15 nt, Yersinia pestis
cuuacuuuuuacggc

SEQ ID NO: 4167390 - RNA, 23 nt, Yersinia pestis
cuuacuuuuuacggcuuaucaau

SEQ ID NO: 4167391 - RNA, 16 nt, Yersinia pestis
cuuagcaauaccagcc

SEQ ID NO: 4167392 - RNA, 19 nt, Yersinia pestis
cuuagcacguuuuucagcu

SEQ ID NO: 4167393 - RNA, 21 nt, Yersinia pestis
cuuagcacguuuuucagcuuc

SEQ ID NO: 4167394 - RNA, 18 nt, Yersinia pestis
cuuagcucaguugguuag

SEQ ID NO: 4167395 - RNA, 20 nt, Yersinia pestis
cuuagcuguaaaggcaaaga

SEQ ID NO: 4167396 - RNA, 14 nt, Yersinia pestis
cuuaguauuauagg

SEQ ID NO: 4167397 - RNA, 15 nt, Yersinia pestis
cuuagucauuaagaa

SEQ ID NO: 4167398 - RNA, 16 nt, Yersinia pestis
cuuagucauuaagaau

SEQ ID NO: 4167399 - RNA, 22 nt, Yersinia pestis
cuuagucgccagaagaaaauca

SEQ ID NO: 4167400 - RNA, 14 nt, Yersinia pestis
cuuaguuucuacgg

SEQ ID NO: 4167401 - RNA, 18 nt, Yersinia pestis
cuuauacuaaagaaauaa

SEQ ID NO: 4167402 - RNA, 17 nt, Yersinia pestis
cuuauaggcgcauauga

SEQ ID NO: 4167403 - RNA, 19 nt, Yersinia pestis
cuuauaggcgcauaugaaa

SEQ ID NO: 4167404 - RNA, 20 nt, Yersinia pestis
cuuauaggcgcauaugaaaa

SEQ ID NO: 4167405 - RNA, 21 nt, Yersinia pestis
cuuauaggcgcauaugaaaaa

SEQ ID NO: 4167406 - RNA, 14 nt, Yersinia pestis
cuuauauaaaucca

SEQ ID NO: 4167407 - RNA, 22 nt, Yersinia pestis
cuuaucaaagugcuuaacccac

SEQ ID NO: 4167408 - RNA, 13 nt, Yersinia pestis
cuuaucagcgaaa

SEQ ID NO: 4167409 - RNA, 18 nt, Yersinia pestis
cuuaucauaauccaacuc

SEQ ID NO: 4167410 - RNA, 21 nt, Yersinia pestis
cuuauccccugagaaacaucc

SEQ ID NO: 4167411 - RNA, 15 nt, Yersinia pestis
cuuauccguuaaccc

SEQ ID NO: 4167412 - RNA, 17 nt, Yersinia pestis
cuuauccguuaacccaa

SEQ ID NO: 4167413 - RNA, 15 nt, Yersinia pestis
cuuaucgguuuuuug

SEQ ID NO: 4167414 - RNA, 18 nt, Yersinia pestis
cuuaucgucaaguucaua

SEQ ID NO: 4167415 - RNA, 22 nt, Yersinia pestis
cuuaucuaucucaggcucagcg

SEQ ID NO: 4167416 - RNA, 17 nt, Yersinia pestis
cuuaucuuccagauagc

SEQ ID NO: 4167417 - RNA, 15 nt, Yersinia pestis
cuuauggcguuugau

SEQ ID NO: 4167418 - RNA, 13 nt, Yersinia pestis
cuuauggcuaauc

SEQ ID NO: 4167419 - RNA, 18 nt, Yersinia pestis
cuuauggucgguuuccgc

SEQ ID NO: 4167420 - RNA, 19 nt, Yersinia pestis
cuuauggucgguuuccgcc

SEQ ID NO: 4167421 - RNA, 22 nt, Yersinia pestis
cuuauuacucauuauggauaau

SEQ ID NO: 4167422 - RNA, 16 nt, Yersinia pestis
cuuauuaugacaacug

SEQ ID NO: 4167423 - RNA, 17 nt, Yersinia pestis
cuuauucuaauugauau

SEQ ID NO: 4167424 - RNA, 23 nt, Yersinia pestis
cuuauucuaauugauauuauuua

SEQ ID NO: 4167425 - RNA, 22 nt, Yersinia pestis
cuuauugggcgcgauaaaagau

SEQ ID NO: 4167426 - RNA, 23 nt, Yersinia pestis
cuuauuucacgcuaauuauuuua

SEQ ID NO: 4167427 - RNA, 17 nt, Yersinia pestis
cuuauuugaaauacuua

SEQ ID NO: 4167428 - RNA, 18 nt, Yersinia pestis
cuuauuugaaauacuuau

SEQ ID NO: 4167429 - RNA, 12 nt, Yersinia pestis
cuuauuuuagcu

SEQ ID NO: 4167430 - RNA, 18 nt, Yersinia pestis
cuucaaaaucaccuggcc

SEQ ID NO: 4167431 - RNA, 13 nt, Yersinia pestis
cuucaacuuuuuu

SEQ ID NO: 4167432 - RNA, 13 nt, Yersinia pestis
cuucaagcugccu

SEQ ID NO: 4167433 - RNA, 14 nt, Yersinia pestis
cuucaauaccuugc

SEQ ID NO: 4167434 - RNA, 16 nt, Yersinia pestis
cuucaaucauugagau

SEQ ID NO: 4167435 - RNA, 22 nt, Yersinia pestis
cuucaaucauugagaucaguuc

SEQ ID NO: 4167436 - RNA, 21 nt, Yersinia pestis
cuucaauguuuuuauccaaac

SEQ ID NO: 4167437 - RNA, 16 nt, Yersinia pestis
cuucaauuuccaucug

SEQ ID NO: 4167438 - RNA, 16 nt, Yersinia pestis
cuucaccaaaggaagc

SEQ ID NO: 4167439 - RNA, 14 nt, Yersinia pestis
cuucaccaauacaa

SEQ ID NO: 4167440 - RNA, 18 nt, Yersinia pestis
cuucaccaauacaaacag

SEQ ID NO: 4167441 - RNA, 19 nt, Yersinia pestis
cuucacucagcgcuggcga

SEQ ID NO: 4167442 - RNA, 18 nt, Yersinia pestis
cuucacuuccauaccuuu

SEQ ID NO: 4167443 - RNA, 13 nt, Yersinia pestis
cuucacuucuggg

SEQ ID NO: 4167444 - RNA, 14 nt, Yersinia pestis
cuucacuucugggg

SEQ ID NO: 4167445 - RNA, 20 nt, Yersinia pestis
cuucacuugcaugccuggcu

SEQ ID NO: 4167446 - RNA, 14 nt, Yersinia pestis
cuucacuuuuaaaa

SEQ ID NO: 4167447 - RNA, 13 nt, Yersinia pestis
cuucagacugaaa

SEQ ID NO: 4167448 - RNA, 15 nt, Yersinia pestis
cuucagacugaaagu

SEQ ID NO: 4167449 - RNA, 22 nt, Yersinia pestis
cuucagaugaauccagccaugc

SEQ ID NO: 4167450 - RNA, 14 nt, Yersinia pestis
cuucagccaccaga

SEQ ID NO: 4167451 - RNA, 20 nt, Yersinia pestis
cuucagcccauggcugaaau

SEQ ID NO: 4167452 - RNA, 18 nt, Yersinia pestis
cuucagccuauccucacc

SEQ ID NO: 4167453 - RNA, 23 nt, Yersinia pestis
cuucagcgauacguguaaaaccu

SEQ ID NO: 4167454 - RNA, 19 nt, Yersinia pestis
cuucagcgguagagaucuc

SEQ ID NO: 4167455 - RNA, 9 nt, Yersinia pestis
cuucaggca

SEQ ID NO: 4167456 - RNA, 11 nt, Yersinia pestis
cuucaggccaa

SEQ ID NO: 4167457 - RNA, 14 nt, Yersinia pestis
cuucaggccaagcc

SEQ ID NO: 4167458 - RNA, 20 nt, Yersinia pestis
cuucaggccaagccugugcu

SEQ ID NO: 4167459 - RNA, 19 nt, Yersinia pestis
cuucaggccaauagcccaa

SEQ ID NO: 4167460 - RNA, 21 nt, Yersinia pestis
cuucaguaaagcgcaggaaag

SEQ ID NO: 4167461 - RNA, 16 nt, Yersinia pestis
cuucaguggcuggaaa

SEQ ID NO: 4167462 - RNA, 19 nt, Yersinia pestis
cuucaguuuauuuaagcug

SEQ ID NO: 4167463 - RNA, 20 nt, Yersinia pestis
cuucauaucggccaaguuua

SEQ ID NO: 4167464 - RNA, 17 nt, Yersinia pestis
cuucaucccaaucauca

SEQ ID NO: 4167465 - RNA, 17 nt, Yersinia pestis
cuucaugacgaaaaaca

SEQ ID NO: 4167466 - RNA, 18 nt, Yersinia pestis
cuucauggcuaaauccac

SEQ ID NO: 4167467 - RNA, 14 nt, Yersinia pestis
cuucauguuuauca

SEQ ID NO: 4167468 - RNA, 20 nt, Yersinia pestis
cuucauuaaggagugccauc

SEQ ID NO: 4167469 - RNA, 12 nt, Yersinia pestis
cuucauugcugc

SEQ ID NO: 4167470 - RNA, 15 nt, Yersinia pestis
cuucauuucaggacu

SEQ ID NO: 4167471 - RNA, 15 nt, Yersinia pestis
cuucauuuucaucac

SEQ ID NO: 4167472 - RNA, 13 nt, Yersinia pestis
cuucauuuuucuc

SEQ ID NO: 4167473 - RNA, 13 nt, Yersinia pestis
cuuccaaaggaag

SEQ ID NO: 4167474 - RNA, 16 nt, Yersinia pestis
cuuccaacucaccuaa

SEQ ID NO: 4167475 - RNA, 21 nt, Yersinia pestis
cuuccaacucaccuaaaucau

SEQ ID NO: 4167476 - RNA, 15 nt, Yersinia pestis
cuuccaacuugccgc

SEQ ID NO: 4167477 - RNA, 16 nt, Yersinia pestis
cuuccaauaagugauu

SEQ ID NO: 4167478 - RNA, 14 nt, Yersinia pestis
cuuccaauucauaa

SEQ ID NO: 4167479 - RNA, 22 nt, Yersinia pestis
cuuccaauuggugcuuuaugua

SEQ ID NO: 4167480 - RNA, 12 nt, Yersinia pestis
cuuccaauuucu

SEQ ID NO: 4167481 - RNA, 15 nt, Yersinia pestis
cuuccagcagggcca

SEQ ID NO: 4167482 - RNA, 15 nt, Yersinia pestis
cuuccagcgcccggc

SEQ ID NO: 4167483 - RNA, 23 nt, Yersinia pestis
cuuccagcgcccggcugaccugu

SEQ ID NO: 4167484 - RNA, 19 nt, Yersinia pestis
cuuccagugguuucccuuc

SEQ ID NO: 4167485 - RNA, 10 nt, Yersinia pestis
cuuccaucag

SEQ ID NO: 4167486 - RNA, 22 nt, Yersinia pestis
cuuccaucgucagaaccugcau

SEQ ID NO: 4167487 - RNA, 16 nt, Yersinia pestis
cuuccaugacacauau

SEQ ID NO: 4167488 - RNA, 19 nt, Yersinia pestis
cuuccauuccguuauuaaa

SEQ ID NO: 4167489 - RNA, 22 nt, Yersinia pestis
cuuccauugauggccuugaauc

SEQ ID NO: 4167490 - RNA, 22 nt, Yersinia pestis
cuucccacggguugccauuaau

SEQ ID NO: 4167491 - RNA, 14 nt, Yersinia pestis
cuuccgccagcaga

SEQ ID NO: 4167492 - RNA, 23 nt, Yersinia pestis
cuuccgccgugcggacugccgcg

SEQ ID NO: 4167493 - RNA, 23 nt, Yersinia pestis
cuuccgccucuuuuuccacaccc

SEQ ID NO: 4167494 - RNA, 15 nt, Yersinia pestis
cuuccggcaucuuuu

SEQ ID NO: 4167495 - RNA, 16 nt, Yersinia pestis
cuuccuaacaauauua

SEQ ID NO: 4167496 - RNA, 15 nt, Yersinia pestis
cuuccucaaugcaga

SEQ ID NO: 4167497 - RNA, 22 nt, Yersinia pestis
cuuccucgccguagcauucauu

SEQ ID NO: 4167498 - RNA, 13 nt, Yersinia pestis
cuuccugcccagc

SEQ ID NO: 4167499 - RNA, 14 nt, Yersinia pestis
cuuccuucaauaau

SEQ ID NO: 4167500 - RNA, 19 nt, Yersinia pestis
cuuccuuugcccuuacuau

SEQ ID NO: 4167501 - RNA, 19 nt, Yersinia pestis
cuucgaaacugaucacugg

SEQ ID NO: 4167502 - RNA, 16 nt, Yersinia pestis
cuucgaaagaaauaaa

SEQ ID NO: 4167503 - RNA, 20 nt, Yersinia pestis
cuucgacccagaggguuaac

SEQ ID NO: 4167504 - RNA, 15 nt, Yersinia pestis
cuucgaucauucuag

SEQ ID NO: 4167505 - RNA, 16 nt, Yersinia pestis
cuucgaucauucuagc

SEQ ID NO: 4167506 - RNA, 20 nt, Yersinia pestis
cuucgauggcuuuacgcaac

SEQ ID NO: 4167507 - RNA, 22 nt, Yersinia pestis
cuucgcaccgccgccauagaaa

SEQ ID NO: 4167508 - RNA, 14 nt, Yersinia pestis
cuucgcauucuuua

SEQ ID NO: 4167509 - RNA, 16 nt, Yersinia pestis
cuucgccauuuccauc

SEQ ID NO: 4167510 - RNA, 20 nt, Yersinia pestis
cuucgccguauaaacgccuc

SEQ ID NO: 4167511 - RNA, 22 nt, Yersinia pestis
cuucgccuuucaguucaacagu

SEQ ID NO: 4167512 - RNA, 20 nt, Yersinia pestis
cuucgcgagucacauuuuua

SEQ ID NO: 4167513 - RNA, 13 nt, Yersinia pestis
cuucgcgaucaug

SEQ ID NO: 4167514 - RNA, 14 nt, Yersinia pestis
cuucgcgcaguaaa

SEQ ID NO: 4167515 - RNA, 23 nt, Yersinia pestis
cuucgcggacgcuggcacugcca

SEQ ID NO: 4167516 - RNA, 18 nt, Yersinia pestis
cuucgcuccggucaacgu

SEQ ID NO: 4167517 - RNA, 15 nt, Yersinia pestis
cuucgcuuucaucuu

SEQ ID NO: 4167518 - RNA, 18 nt, Yersinia pestis
cuucggccuugaaacagc

SEQ ID NO: 4167519 - RNA, 21 nt, Yersinia pestis
cuucgggauagggaaaaguua

SEQ ID NO: 4167520 - RNA, 19 nt, Yersinia pestis
cuucggucucuuugaccag

SEQ ID NO: 4167521 - RNA, 21 nt, Yersinia pestis
cuucgguuugagcuugcugcu

SEQ ID NO: 4167522 - RNA, 13 nt, Yersinia pestis
cuucguagccauu

SEQ ID NO: 4167523 - RNA, 17 nt, Yersinia pestis
cuucguagggcacuuuc

SEQ ID NO: 4167524 - RNA, 18 nt, Yersinia pestis
cuucuaaaaucgcacuga

SEQ ID NO: 4167525 - RNA, 17 nt, Yersinia pestis
cuucuacaaauuuuuua

SEQ ID NO: 4167526 - RNA, 18 nt, Yersinia pestis
cuucuaccguaucagccc

SEQ ID NO: 4167527 - RNA, 13 nt, Yersinia pestis
cuucuagcucuuc

SEQ ID NO: 4167528 - RNA, 11 nt, Yersinia pestis
cuucucaauuu

SEQ ID NO: 4167529 - RNA, 21 nt, Yersinia pestis
cuucuccuauccacugugauu

SEQ ID NO: 4167530 - RNA, 21 nt, Yersinia pestis
cuucucgaugccuucuuucaa

SEQ ID NO: 4167531 - RNA, 17 nt, Yersinia pestis
cuucugaacgaccagaa

SEQ ID NO: 4167532 - RNA, 18 nt, Yersinia pestis
cuucugauuuuuuguucu

SEQ ID NO: 4167533 - RNA, 20 nt, Yersinia pestis
cuucugccuauccucaccgu

SEQ ID NO: 4167534 - RNA, 15 nt, Yersinia pestis
cuucuggcgugucau

SEQ ID NO: 4167535 - RNA, 23 nt, Yersinia pestis
cuucugggaucaucgcuugauca

SEQ ID NO: 4167536 - RNA, 19 nt, Yersinia pestis
cuucugguggugucacauu

SEQ ID NO: 4167537 - RNA, 14 nt, Yersinia pestis
cuucuuauuuauca

SEQ ID NO: 4167538 - RNA, 13 nt, Yersinia pestis
cuucuucaaaagc

SEQ ID NO: 4167539 - RNA, 15 nt, Yersinia pestis
cuucuuggguggcaa

SEQ ID NO: 4167540 - RNA, 15 nt, Yersinia pestis
cuucuuuacugcccu

SEQ ID NO: 4167541 - RNA, 20 nt, Yersinia pestis
cuucuuuacugcccucgcaa

SEQ ID NO: 4167542 - RNA, 13 nt, Yersinia pestis
cuucuuuuaaaga

SEQ ID NO: 4167543 - RNA, 18 nt, Yersinia pestis
cuucuuuuaaagaagaau

SEQ ID NO: 4167544 - RNA, 12 nt, Yersinia pestis
cuucuuuuguau

SEQ ID NO: 4167545 - RNA, 20 nt, Yersinia pestis
cuugaaccaauuuuucugua

SEQ ID NO: 4167546 - RNA, 17 nt, Yersinia pestis
cuugaacggugaggaua

SEQ ID NO: 4167547 - RNA, 16 nt, Yersinia pestis
cuugaauaauauucaa

SEQ ID NO: 4167548 - RNA, 15 nt, Yersinia pestis
cuugaauagccagaa

SEQ ID NO: 4167549 - RNA, 15 nt, Yersinia pestis
cuugaaucaaaauac

SEQ ID NO: 4167550 - RNA, 18 nt, Yersinia pestis
cuugaccuugccuugcau

SEQ ID NO: 4167551 - RNA, 21 nt, Yersinia pestis
cuugacgacaauauaauaaug

SEQ ID NO: 4167552 - RNA, 19 nt, Yersinia pestis
cuugacgcguugcccuucu

SEQ ID NO: 4167553 - RNA, 21 nt, Yersinia pestis
cuugacugaccauaaaaggau

SEQ ID NO: 4167554 - RNA, 16 nt, Yersinia pestis
cuugacugcguucugc

SEQ ID NO: 4167555 - RNA, 23 nt, Yersinia pestis
cuugagagaacguucaaccaacu

SEQ ID NO: 4167556 - RNA, 15 nt, Yersinia pestis
cuugagcggcauccu

SEQ ID NO: 4167557 - RNA, 21 nt, Yersinia pestis
cuugagggugaccaucuggcg

SEQ ID NO: 4167558 - RNA, 19 nt, Yersinia pestis
cuugaggugcuugaacaac

SEQ ID NO: 4167559 - RNA, 18 nt, Yersinia pestis
cuugaguauccaauaagc

SEQ ID NO: 4167560 - RNA, 18 nt, Yersinia pestis
cuugauacuugaaacagc

SEQ ID NO: 4167561 - RNA, 22 nt, Yersinia pestis
cuugauagggcugaagacccaa

SEQ ID NO: 4167562 - RNA, 13 nt, Yersinia pestis
cuugauggcauca

SEQ ID NO: 4167563 - RNA, 23 nt, Yersinia pestis
cuugauggcuaauuaauuuaaac

SEQ ID NO: 4167564 - RNA, 19 nt, Yersinia pestis
cuugaugugcucugcuccg

SEQ ID NO: 4167565 - RNA, 20 nt, Yersinia pestis
cuugcaacagcgcucauagc

SEQ ID NO: 4167566 - RNA, 16 nt, Yersinia pestis
cuugcaagguauuuug

SEQ ID NO: 4167567 - RNA, 20 nt, Yersinia pestis
cuugcacuuuuacugguuca

SEQ ID NO: 4167568 - RNA, 17 nt, Yersinia pestis
cuugcagcaacacgccg

SEQ ID NO: 4167569 - RNA, 13 nt, Yersinia pestis
cuugcagcaacag

SEQ ID NO: 4167570 - RNA, 14 nt, Yersinia pestis
cuugcagcaacagg

SEQ ID NO: 4167571 - RNA, 15 nt, Yersinia pestis
cuugcauaucagcaa

SEQ ID NO: 4167572 - RNA, 19 nt, Yersinia pestis
cuugccacgccaguaaaca

SEQ ID NO: 4167573 - RNA, 21 nt, Yersinia pestis
cuugccacgccaguaaacagc

SEQ ID NO: 4167574 - RNA, 15 nt, Yersinia pestis
cuugccauuuugggc

SEQ ID NO: 4167575 - RNA, 22 nt, Yersinia pestis
cuugccauuuugggcuugagca

SEQ ID NO: 4167576 - RNA, 15 nt, Yersinia pestis
cuugccauuuugggu

SEQ ID NO: 4167577 - RNA, 17 nt, Yersinia pestis
cuugcccuuuuuugugu

SEQ ID NO: 4167578 - RNA, 16 nt, Yersinia pestis
cuugcgcgaaauaccc

SEQ ID NO: 4167579 - RNA, 15 nt, Yersinia pestis
cuugcgcgaaauauu

SEQ ID NO: 4167580 - RNA, 13 nt, Yersinia pestis
cuugcgcgccugu

SEQ ID NO: 4167581 - RNA, 21 nt, Yersinia pestis
cuugcgcguuaaucugcugcu

SEQ ID NO: 4167582 - RNA, 15 nt, Yersinia pestis
cuugcgcuccacgcc

SEQ ID NO: 4167583 - RNA, 16 nt, Yersinia pestis
cuugcggaauuucuuc

SEQ ID NO: 4167584 - RNA, 14 nt, Yersinia pestis
cuugcugaugccca

SEQ ID NO: 4167585 - RNA, 15 nt, Yersinia pestis
cuugcugcaaccacu

SEQ ID NO: 4167586 - RNA, 17 nt, Yersinia pestis
cuugcugcaaccacuua

SEQ ID NO: 4167587 - RNA, 14 nt, Yersinia pestis
cuugcugccugccu

SEQ ID NO: 4167588 - RNA, 21 nt, Yersinia pestis
cuugcugguauucaucagcaa

SEQ ID NO: 4167589 - RNA, 22 nt, Yersinia pestis
cuugcuuaucaccccuucacuc

SEQ ID NO: 4167590 - RNA, 21 nt, Yersinia pestis
cuugcuucugaacgaccagaa

SEQ ID NO: 4167591 - RNA, 17 nt, Yersinia pestis
cuugcuugauggcauca

SEQ ID NO: 4167592 - RNA, 15 nt, Yersinia pestis
cuuggaaaacagcaa

SEQ ID NO: 4167593 - RNA, 16 nt, Yersinia pestis
cuuggcaaagagacug

SEQ ID NO: 4167594 - RNA, 17 nt, Yersinia pestis
cuuggcauguucagggu

SEQ ID NO: 4167595 - RNA, 22 nt, Yersinia pestis
cuuggccgauaugaagcacaaa

SEQ ID NO: 4167596 - RNA, 18 nt, Yersinia pestis
cuuggccggucguauuca

SEQ ID NO: 4167597 - RNA, 21 nt, Yersinia pestis
cuuggcgcggacgcuuuacuc

SEQ ID NO: 4167598 - RNA, 15 nt, Yersinia pestis
cuuggcguaacugca

SEQ ID NO: 4167599 - RNA, 18 nt, Yersinia pestis
cuuggcguagcuugauuc

SEQ ID NO: 4167600 - RNA, 18 nt, Yersinia pestis
cuuggcucuggagcucuc

SEQ ID NO: 4167601 - RNA, 20 nt, Yersinia pestis
cuugggagucagaugccgcu

SEQ ID NO: 4167602 - RNA, 18 nt, Yersinia pestis
cuugggccgacucugcau

SEQ ID NO: 4167603 - RNA, 22 nt, Yersinia pestis
cuugggcuucacauccaauggc

SEQ ID NO: 4167604 - RNA, 14 nt, Yersinia pestis
cuugggugaagaca

SEQ ID NO: 4167605 - RNA, 21 nt, Yersinia pestis
cuugguaaugcgcaccagcuc

SEQ ID NO: 4167606 - RNA, 19 nt, Yersinia pestis
cuuggucauaccggcggca

SEQ ID NO: 4167607 - RNA, 19 nt, Yersinia pestis
cuugguccgggauggaaau

SEQ ID NO: 4167608 - RNA, 15 nt, Yersinia pestis
cuuggugaugcugcu

SEQ ID NO: 4167609 - RNA, 19 nt, Yersinia pestis
cuuggugauuuucugugau

SEQ ID NO: 4167610 - RNA, 18 nt, Yersinia pestis
cuugguggagccuguaca

SEQ ID NO: 4167611 - RNA, 16 nt, Yersinia pestis
cuugguugcaaguauu

SEQ ID NO: 4167612 - RNA, 15 nt, Yersinia pestis
cuuguaccugugcca

SEQ ID NO: 4167613 - RNA, 14 nt, Yersinia pestis
cuuguauccuggcc

SEQ ID NO: 4167614 - RNA, 11 nt, Yersinia pestis
cuuguauuuaa

SEQ ID NO: 4167615 - RNA, 15 nt, Yersinia pestis
cuugucaggauuuac

SEQ ID NO: 4167616 - RNA, 17 nt, Yersinia pestis
cuugugcucacgucacc

SEQ ID NO: 4167617 - RNA, 19 nt, Yersinia pestis
cuugugggcaucugucuaa

SEQ ID NO: 4167618 - RNA, 21 nt, Yersinia pestis
cuuguguaauuauauuuaauu

SEQ ID NO: 4167619 - RNA, 13 nt, Yersinia pestis
cuuguucaccaau

SEQ ID NO: 4167620 - RNA, 20 nt, Yersinia pestis
cuuguuguaugucaaugugu

SEQ ID NO: 4167621 - RNA, 19 nt, Yersinia pestis
cuuguuuaucggucacuuu

SEQ ID NO: 4167622 - RNA, 11 nt, Yersinia pestis
cuuguuuuuuu

SEQ ID NO: 4167623 - RNA, 23 nt, Yersinia pestis
cuuuaaaaaaauuaucaucaaua

SEQ ID NO: 4167624 - RNA, 12 nt, Yersinia pestis
cuuuaaagccaa

SEQ ID NO: 4167625 - RNA, 15 nt, Yersinia pestis
cuuuaaagccaaauu

SEQ ID NO: 4167626 - RNA, 13 nt, Yersinia pestis
cuuuaaauccauc

SEQ ID NO: 4167627 - RNA, 16 nt, Yersinia pestis
cuuuaaaucuagcccu

SEQ ID NO: 4167628 - RNA, 15 nt, Yersinia pestis
cuuuaacaauuuauc

SEQ ID NO: 4167629 - RNA, 15 nt, Yersinia pestis
cuuuaacuuccaauu

SEQ ID NO: 4167630 - RNA, 22 nt, Yersinia pestis
cuuuaacuuccaauuucucaaa

SEQ ID NO: 4167631 - RNA, 14 nt, Yersinia pestis
cuuuaauaaaauca

SEQ ID NO: 4167632 - RNA, 16 nt, Yersinia pestis
cuuuaauaaaaucaaa

SEQ ID NO: 4167633 - RNA, 20 nt, Yersinia pestis
cuuuaauagccaaaauaauu

SEQ ID NO: 4167634 - RNA, 16 nt, Yersinia pestis
cuuuaaucaguuucag

SEQ ID NO: 4167635 - RNA, 19 nt, Yersinia pestis
cuuuaaucaguuucaggcg

SEQ ID NO: 4167636 - RNA, 17 nt, Yersinia pestis
cuuuaaucgccugaugc

SEQ ID NO: 4167637 - RNA, 15 nt, Yersinia pestis
cuuuaauuuuucccu

SEQ ID NO: 4167638 - RNA, 14 nt, Yersinia pestis
cuuuaccagccccg

SEQ ID NO: 4167639 - RNA, 18 nt, Yersinia pestis
cuuuacccacggguuaau

SEQ ID NO: 4167640 - RNA, 14 nt, Yersinia pestis
cuuuaccuguuuca

SEQ ID NO: 4167641 - RNA, 21 nt, Yersinia pestis
cuuuacgcaacucagcaauau

SEQ ID NO: 4167642 - RNA, 20 nt, Yersinia pestis
cuuuacgcagcuuguugaua

SEQ ID NO: 4167643 - RNA, 12 nt, Yersinia pestis
cuuuacggcaag

SEQ ID NO: 4167644 - RNA, 20 nt, Yersinia pestis
cuuuacgguuaaaacaguaa

SEQ ID NO: 4167645 - RNA, 16 nt, Yersinia pestis
cuuuacuccucugccu

SEQ ID NO: 4167646 - RNA, 14 nt, Yersinia pestis
cuuuacucuucaau

SEQ ID NO: 4167647 - RNA, 16 nt, Yersinia pestis
cuuuacugcauugaga

SEQ ID NO: 4167648 - RNA, 18 nt, Yersinia pestis
cuuuacugguuugaauuc

SEQ ID NO: 4167649 - RNA, 17 nt, Yersinia pestis
cuuuagccuaccgcuua

SEQ ID NO: 4167650 - RNA, 21 nt, Yersinia pestis
cuuuauacauauguugaguca

SEQ ID NO: 4167651 - RNA, 13 nt, Yersinia pestis
cuuuauauucaau

SEQ ID NO: 4167652 - RNA, 14 nt, Yersinia pestis
cuuuauauucaaua

SEQ ID NO: 4167653 - RNA, 21 nt, Yersinia pestis
cuuuauccaaccaccuuaagu

SEQ ID NO: 4167654 - RNA, 15 nt, Yersinia pestis
cuuuauccacuuggc

SEQ ID NO: 4167655 - RNA, 14 nt, Yersinia pestis
cuuuaucccaccac

SEQ ID NO: 4167656 - RNA, 21 nt, Yersinia pestis
cuuuaucgccagcugcaauug

SEQ ID NO: 4167657 - RNA, 23 nt, Yersinia pestis
cuuuauguacauccaauuuuuuc

SEQ ID NO: 4167658 - RNA, 17 nt, Yersinia pestis
cuuuauguauucuugua

SEQ ID NO: 4167659 - RNA, 21 nt, Yersinia pestis
cuuuauguauucuuguauccu

SEQ ID NO: 4167660 - RNA, 14 nt, Yersinia pestis
cuuuaugucuuuuu

SEQ ID NO: 4167661 - RNA, 18 nt, Yersinia pestis
cuuuauucauucagagua

SEQ ID NO: 4167662 - RNA, 15 nt, Yersinia pestis
cuuuauucuucuuca

SEQ ID NO: 4167663 - RNA, 14 nt, Yersinia pestis
cuuuauugcuccuu

SEQ ID NO: 4167664 - RNA, 19 nt, Yersinia pestis
cuuuauugcuccuuacuau

SEQ ID NO: 4167665 - RNA, 18 nt, Yersinia pestis
cuuuauuuauuuuacugc

SEQ ID NO: 4167666 - RNA, 20 nt, Yersinia pestis
cuuucaaaauugagauauuu

SEQ ID NO: 4167667 - RNA, 11 nt, Yersinia pestis
cuuucaacgca

SEQ ID NO: 4167668 - RNA, 23 nt, Yersinia pestis
cuuucaacuauugcaucuuuaau

SEQ ID NO: 4167669 - RNA, 20 nt, Yersinia pestis
cuuucaaguccugcuucaaa

SEQ ID NO: 4167670 - RNA, 15 nt, Yersinia pestis
cuuucaccagugguc

SEQ ID NO: 4167671 - RNA, 13 nt, Yersinia pestis
cuuucacguuggu

SEQ ID NO: 4167672 - RNA, 21 nt, Yersinia pestis
cuuucaggagugaauuucuuc

SEQ ID NO: 4167673 - RNA, 23 nt, Yersinia pestis
cuuucaggccacgcaauucauca

SEQ ID NO: 4167674 - RNA, 14 nt, Yersinia pestis
cuuucaguuaucua

SEQ ID NO: 4167675 - RNA, 16 nt, Yersinia pestis
cuuucaguucaacagu

SEQ ID NO: 4167676 - RNA, 17 nt, Yersinia pestis
cuuucaguuuuauugua

SEQ ID NO: 4167677 - RNA, 23 nt, Yersinia pestis
cuuucauaucaaaaggauaaccu

SEQ ID NO: 4167678 - RNA, 16 nt, Yersinia pestis
cuuucaucgaaaaaaa

SEQ ID NO: 4167679 - RNA, 19 nt, Yersinia pestis
cuuucaucgaaaaaaauac

SEQ ID NO: 4167680 - RNA, 22 nt, Yersinia pestis
cuuucauuuguuggcaaauuaa

SEQ ID NO: 4167681 - RNA, 18 nt, Yersinia pestis
cuuuccacgcccaacucu

SEQ ID NO: 4167682 - RNA, 20 nt, Yersinia pestis
cuuuccacgcccaacucuuu

SEQ ID NO: 4167683 - RNA, 17 nt, Yersinia pestis
cuuuccacguuuguagc

SEQ ID NO: 4167684 - RNA, 12 nt, Yersinia pestis
cuuuccagcaaa

SEQ ID NO: 4167685 - RNA, 20 nt, Yersinia pestis
cuuuccagcgguuuuuucuu

SEQ ID NO: 4167686 - RNA, 14 nt, Yersinia pestis
cuuuccauccagaa

SEQ ID NO: 4167687 - RNA, 19 nt, Yersinia pestis
cuuucccgcgucgugauga

SEQ ID NO: 4167688 - RNA, 24 nt, Yersinia pestis
cuuuccgcucagcaucuucaauca

SEQ ID NO: 4167689 - RNA, 13 nt, Yersinia pestis
cuuuccugacccg

SEQ ID NO: 4167690 - RNA, 20 nt, Yersinia pestis
cuuucgaguuuauauugcca

SEQ ID NO: 4167691 - RNA, 17 nt, Yersinia pestis
cuuucgauaagcugaca

SEQ ID NO: 4167692 - RNA, 15 nt, Yersinia pestis
cuuucgauagucagc

SEQ ID NO: 4167693 - RNA, 22 nt, Yersinia pestis
cuuucgauagucagcuucacuu

SEQ ID NO: 4167694 - RNA, 15 nt, Yersinia pestis
cuuucgcacuuuaaa

SEQ ID NO: 4167695 - RNA, 21 nt, Yersinia pestis
cuuucgcgaauagagacggaa

SEQ ID NO: 4167696 - RNA, 23 nt, Yersinia pestis
cuuucgcuugcaggucugcaugg

SEQ ID NO: 4167697 - RNA, 15 nt, Yersinia pestis
cuuucguuucugucu

SEQ ID NO: 4167698 - RNA, 20 nt, Yersinia pestis
cuuucguuucugucugaguc

SEQ ID NO: 4167699 - RNA, 22 nt, Yersinia pestis
cuuucucagguguuacacaguu

SEQ ID NO: 4167700 - RNA, 22 nt, Yersinia pestis
cuuucucauuagcgucuuuuuu

SEQ ID NO: 4167701 - RNA, 14 nt, Yersinia pestis
cuuucuccuuugau

SEQ ID NO: 4167702 - RNA, 20 nt, Yersinia pestis
cuuucucgacauccaauuca

SEQ ID NO: 4167703 - RNA, 16 nt, Yersinia pestis
cuuucucgauacaauu

SEQ ID NO: 4167704 - RNA, 23 nt, Yersinia pestis
cuuucucgcguuugaucaaauca

SEQ ID NO: 4167705 - RNA, 22 nt, Yersinia pestis
cuuucucuggcacgcuuucugc

SEQ ID NO: 4167706 - RNA, 17 nt, Yersinia pestis
cuuucugccugugggcu

SEQ ID NO: 4167707 - RNA, 14 nt, Yersinia pestis
cuuucuucagcggu

SEQ ID NO: 4167708 - RNA, 21 nt, Yersinia pestis
cuuucuuuucgcuauuucucu

SEQ ID NO: 4167709 - RNA, 21 nt, Yersinia pestis
cuuugaagcgcucaaguaauu

SEQ ID NO: 4167710 - RNA, 15 nt, Yersinia pestis
cuuugacagcaucug

SEQ ID NO: 4167711 - RNA, 17 nt, Yersinia pestis
cuuugaccauuuguuuu

SEQ ID NO: 4167712 - RNA, 22 nt, Yersinia pestis
cuuugacuaauacugcgguccu

SEQ ID NO: 4167713 - RNA, 21 nt, Yersinia pestis
cuuugagaaaggauuugaaga

SEQ ID NO: 4167714 - RNA, 21 nt, Yersinia pestis
cuuugaguugcguuaacugcg

SEQ ID NO: 4167715 - RNA, 14 nt, Yersinia pestis
cuuugaugccuaau

SEQ ID NO: 4167716 - RNA, 17 nt, Yersinia pestis
cuuugcgcugauaacuu

SEQ ID NO: 4167717 - RNA, 12 nt, Yersinia pestis
cuuugcgugaca

SEQ ID NO: 4167718 - RNA, 17 nt, Yersinia pestis
cuuugcgugacauacuu

SEQ ID NO: 4167719 - RNA, 18 nt, Yersinia pestis
cuuugcguucugucuguu

SEQ ID NO: 4167720 - RNA, 22 nt, Yersinia pestis
cuuugcugcaacgcagacauga

SEQ ID NO: 4167721 - RNA, 14 nt, Yersinia pestis
cuuugcuucaggca

SEQ ID NO: 4167722 - RNA, 21 nt, Yersinia pestis
cuuugcuucgauuuuauauug

SEQ ID NO: 4167723 - RNA, 14 nt, Yersinia pestis
cuuugcuuugacua

SEQ ID NO: 4167724 - RNA, 16 nt, Yersinia pestis
cuuugcuuuucugccu

SEQ ID NO: 4167725 - RNA, 17 nt, Yersinia pestis
cuuugcuuuucugccua

SEQ ID NO: 4167726 - RNA, 14 nt, Yersinia pestis
cuuuggaaccgcca

SEQ ID NO: 4167727 - RNA, 17 nt, Yersinia pestis
cuuuggcaaucacaacc

SEQ ID NO: 4167728 - RNA, 21 nt, Yersinia pestis
cuuuggcaaucacaacccccc

SEQ ID NO: 4167729 - RNA, 18 nt, Yersinia pestis
cuuugggauucaauaagu

SEQ ID NO: 4167730 - RNA, 15 nt, Yersinia pestis
cuuugggcugaucau

SEQ ID NO: 4167731 - RNA, 19 nt, Yersinia pestis
cuuugguccucuuauggua

SEQ ID NO: 4167732 - RNA, 15 nt, Yersinia pestis
cuuuggugaucauga

SEQ ID NO: 4167733 - RNA, 23 nt, Yersinia pestis
cuuugucaauaaccucauuggcg

SEQ ID NO: 4167734 - RNA, 17 nt, Yersinia pestis
cuuuguuauccaucaac

SEQ ID NO: 4167735 - RNA, 18 nt, Yersinia pestis
cuuuuaauuuucagccgu

SEQ ID NO: 4167736 - RNA, 22 nt, Yersinia pestis
cuuuuacaaauuugacauuucc

SEQ ID NO: 4167737 - RNA, 19 nt, Yersinia pestis
cuuuuacgggccuuuuaau

SEQ ID NO: 4167738 - RNA, 22 nt, Yersinia pestis
cuuuuauuggcauuaaacugaa

SEQ ID NO: 4167739 - RNA, 21 nt, Yersinia pestis
cuuuuauugucuuuaauaaaa

SEQ ID NO: 4167740 - RNA, 22 nt, Yersinia pestis
cuuuuauuugauucgucugcca

SEQ ID NO: 4167741 - RNA, 19 nt, Yersinia pestis
cuuuucaguuuuaauuuau

SEQ ID NO: 4167742 - RNA, 18 nt, Yersinia pestis
cuuuuccgccaugagaac

SEQ ID NO: 4167743 - RNA, 19 nt, Yersinia pestis
cuuuucgggcuaaagacac

SEQ ID NO: 4167744 - RNA, 12 nt, Yersinia pestis
cuuuucugccua

SEQ ID NO: 4167745 - RNA, 13 nt, Yersinia pestis
cuuuucugccuau

SEQ ID NO: 4167746 - RNA, 16 nt, Yersinia pestis
cuuuugaauucaccaa

SEQ ID NO: 4167747 - RNA, 20 nt, Yersinia pestis
cuuuugcauauuucucuuug

SEQ ID NO: 4167748 - RNA, 22 nt, Yersinia pestis
cuuuugggucaggguaagcuga

SEQ ID NO: 4167749 - RNA, 13 nt, Yersinia pestis
cuuuuuaaauacc

SEQ ID NO: 4167750 - RNA, 19 nt, Yersinia pestis
cuuuuuaacuuacugcucu

SEQ ID NO: 4167751 - RNA, 14 nt, Yersinia pestis
cuuuuuaauuuaua

SEQ ID NO: 4167752 - RNA, 14 nt, Yersinia pestis
cuuuuuacaauaaa

SEQ ID NO: 4167753 - RNA, 19 nt, Yersinia pestis
cuuuuuacgccuauccuca

SEQ ID NO: 4167754 - RNA, 22 nt, Yersinia pestis
cuuuuuacgccuauccucauga

SEQ ID NO: 4167755 - RNA, 22 nt, Yersinia pestis
cuuuuuacugcguaaccccaac

SEQ ID NO: 4167756 - RNA, 14 nt, Yersinia pestis
cuuuuuacuuuuua

SEQ ID NO: 4167757 - RNA, 19 nt, Yersinia pestis
cuuuuuauguaacaacuga

SEQ ID NO: 4167758 - RNA, 21 nt, Yersinia pestis
cuuuuuauguuaaaucaguga

SEQ ID NO: 4167759 - RNA, 13 nt, Yersinia pestis
cuuuuuauuuaag

SEQ ID NO: 4167760 - RNA, 20 nt, Yersinia pestis
cuuuuucaaucacuucugcu

SEQ ID NO: 4167761 - RNA, 19 nt, Yersinia pestis
cuuuuucagugaugagaau

SEQ ID NO: 4167762 - RNA, 15 nt, Yersinia pestis
cuuuuucuuuuuaac

SEQ ID NO: 4167763 - RNA, 17 nt, Yersinia pestis
cuuuuugaaucaagcau

SEQ ID NO: 4167764 - RNA, 21 nt, Yersinia pestis
cuuuuugcaucgcuucugaac

SEQ ID NO: 4167765 - RNA, 15 nt, Yersinia pestis
cuuuuugccaauaau

SEQ ID NO: 4167766 - RNA, 10 nt, Yersinia pestis
cuuuuugcuu

SEQ ID NO: 4167767 - RNA, 17 nt, Yersinia pestis
cuuuuuggcaaacucag

SEQ ID NO: 4167768 - RNA, 20 nt, Yersinia pestis
cuuuuugguugaacauuucc

SEQ ID NO: 4167769 - RNA, 14 nt, Yersinia pestis
cuuuuuguaagcca

SEQ ID NO: 4167770 - RNA, 17 nt, Yersinia pestis
cuuuuuuaauaaaaaac

SEQ ID NO: 4167771 - RNA, 16 nt, Yersinia pestis
cuuuuuucacauuacg

SEQ ID NO: 4167772 - RNA, 14 nt, Yersinia pestis
cuuuuuucugcaaa

SEQ ID NO: 4167773 - RNA, 17 nt, Yersinia pestis
cuuuuuuguugccacuc

SEQ ID NO: 4167774 - RNA, 18 nt, Yersinia pestis
cuuuuuuguuguuuuuuu

SEQ ID NO: 4167775 - RNA, 16 nt, Yersinia pestis
gaaaaaaauacuauca

SEQ ID NO: 4167776 - RNA, 16 nt, Yersinia pestis
gaaaaaaaucaaguac

SEQ ID NO: 4167777 - RNA, 14 nt, Yersinia pestis
gaaaaaacguuacu

SEQ ID NO: 4167778 - RNA, 21 nt, Yersinia pestis
gaaaaaaggauuuuauuaaau

SEQ ID NO: 4167779 - RNA, 22 nt, Yersinia pestis
gaaaaaauacgcuuucccccau

SEQ ID NO: 4167780 - RNA, 15 nt, Yersinia pestis
gaaaaaauauauucc

SEQ ID NO: 4167781 - RNA, 17 nt, Yersinia pestis
gaaaaaauauauuccuc

SEQ ID NO: 4167782 - RNA, 16 nt, Yersinia pestis
gaaaaaaucuuccuuu

SEQ ID NO: 4167783 - RNA, 17 nt, Yersinia pestis
gaaaaacacuggcagcc

SEQ ID NO: 4167784 - RNA, 21 nt, Yersinia pestis
gaaaaacacuuuauugagaau

SEQ ID NO: 4167785 - RNA, 20 nt, Yersinia pestis
gaaaaaccuccggcuaugcc

SEQ ID NO: 4167786 - RNA, 22 nt, Yersinia pestis
gaaaaaccuccggcuaugccgg

SEQ ID NO: 4167787 - RNA, 19 nt, Yersinia pestis
gaaaaacugugcaaauggc

SEQ ID NO: 4167788 - RNA, 22 nt, Yersinia pestis
gaaaaagcaugguuggucucga

SEQ ID NO: 4167789 - RNA, 18 nt, Yersinia pestis
gaaaaaggccgacugaga

SEQ ID NO: 4167790 - RNA, 23 nt, Yersinia pestis
gaaaaaugagccgaccgucguaa

SEQ ID NO: 4167791 - RNA, 17 nt, Yersinia pestis
gaaaaauuucacuggca

SEQ ID NO: 4167792 - RNA, 14 nt, Yersinia pestis
gaaaacaagccagc

SEQ ID NO: 4167793 - RNA, 15 nt, Yersinia pestis
gaaaacaaguuucac

SEQ ID NO: 4167794 - RNA, 21 nt, Yersinia pestis
gaaaacaaguuucacuuucaa

SEQ ID NO: 4167795 - RNA, 22 nt, Yersinia pestis
gaaaacaaguuucacuuucaac

SEQ ID NO: 4167796 - RNA, 16 nt, Yersinia pestis
gaaaacagcaacacca

SEQ ID NO: 4167797 - RNA, 17 nt, Yersinia pestis
gaaaacagccaccagcc

SEQ ID NO: 4167798 - RNA, 21 nt, Yersinia pestis
gaaaacagccaccagccaacu

SEQ ID NO: 4167799 - RNA, 18 nt, Yersinia pestis
gaaaacccauaccacuga

SEQ ID NO: 4167800 - RNA, 18 nt, Yersinia pestis
gaaaaccuucagcaaaga

SEQ ID NO: 4167801 - RNA, 17 nt, Yersinia pestis
gaaaacguuaacugcag

SEQ ID NO: 4167802 - RNA, 13 nt, Yersinia pestis
gaaaagcaccgca

SEQ ID NO: 4167803 - RNA, 13 nt, Yersinia pestis
gaaaagcagcagu

SEQ ID NO: 4167804 - RNA, 20 nt, Yersinia pestis
gaaaagcagucgacagugua

SEQ ID NO: 4167805 - RNA, 14 nt, Yersinia pestis
gaaaagcgccauca

SEQ ID NO: 4167806 - RNA, 14 nt, Yersinia pestis
gaaaaggcagagag

SEQ ID NO: 4167807 - RNA, 17 nt, Yersinia pestis
gaaaaguggcuaucuga

SEQ ID NO: 4167808 - RNA, 14 nt, Yersinia pestis
gaaaauagccaacc

SEQ ID NO: 4167809 - RNA, 18 nt, Yersinia pestis
gaaaauaugccccauguu

SEQ ID NO: 4167810 - RNA, 21 nt, Yersinia pestis
gaaaauauucuaaguaaaaca

SEQ ID NO: 4167811 - RNA, 14 nt, Yersinia pestis
gaaaaugcggcggc

SEQ ID NO: 4167812 - RNA, 20 nt, Yersinia pestis
gaaaaugguuagauuacagc

SEQ ID NO: 4167813 - RNA, 19 nt, Yersinia pestis
gaaaauuucucuuuuauuc

SEQ ID NO: 4167814 - RNA, 15 nt, Yersinia pestis
gaaacaaaaccaacc

SEQ ID NO: 4167815 - RNA, 23 nt, Yersinia pestis
gaaacacacuucgccgggucagg

SEQ ID NO: 4167816 - RNA, 19 nt, Yersinia pestis
gaaacaccacgcccaauuc

SEQ ID NO: 4167817 - RNA, 18 nt, Yersinia pestis
gaaacagcccagauggca

SEQ ID NO: 4167818 - RNA, 21 nt, Yersinia pestis
gaaacaugcugaagccagcac

SEQ ID NO: 4167819 - RNA, 15 nt, Yersinia pestis
gaaaccaaaaccuuu

SEQ ID NO: 4167820 - RNA, 15 nt, Yersinia pestis
gaaaccagcggcagc

SEQ ID NO: 4167821 - RNA, 19 nt, Yersinia pestis
gaaaccgcugauaaccagc

SEQ ID NO: 4167822 - RNA, 14 nt, Yersinia pestis
gaaaccuaaugcca

SEQ ID NO: 4167823 - RNA, 20 nt, Yersinia pestis
gaaaccuacgccuaaaaaug

SEQ ID NO: 4167824 - RNA, 17 nt, Yersinia pestis
gaaacgauaugcuccag

SEQ ID NO: 4167825 - RNA, 20 nt, Yersinia pestis
gaaacgauuacccaccaccu

SEQ ID NO: 4167826 - RNA, 20 nt, Yersinia pestis
gaaacgccagccucugcgcu

SEQ ID NO: 4167827 - RNA, 19 nt, Yersinia pestis
gaaacgccuccucuuggau

SEQ ID NO: 4167828 - RNA, 13 nt, Yersinia pestis
gaaacuaacgcgu

SEQ ID NO: 4167829 - RNA, 19 nt, Yersinia pestis
gaaacuccagucacuggcc

SEQ ID NO: 4167830 - RNA, 16 nt, Yersinia pestis
gaaacugaucacuggc

SEQ ID NO: 4167831 - RNA, 21 nt, Yersinia pestis
gaaacugccgccaccauauca

SEQ ID NO: 4167832 - RNA, 14 nt, Yersinia pestis
gaaacuucaaaauc

SEQ ID NO: 4167833 - RNA, 15 nt, Yersinia pestis
gaaacuucaaaauca

SEQ ID NO: 4167834 - RNA, 14 nt, Yersinia pestis
gaaagaaauaaaag

SEQ ID NO: 4167835 - RNA, 16 nt, Yersinia pestis
gaaagaaauaaaagaa

SEQ ID NO: 4167836 - RNA, 14 nt, Yersinia pestis
gaaagagccagcac

SEQ ID NO: 4167837 - RNA, 23 nt, Yersinia pestis
gaaagcaauuagcacauaugcag

SEQ ID NO: 4167838 - RNA, 17 nt, Yersinia pestis
gaaagcguauuaucugc

SEQ ID NO: 4167839 - RNA, 23 nt, Yersinia pestis
gaaagcuucaacuuccagugcca

SEQ ID NO: 4167840 - RNA, 16 nt, Yersinia pestis
gaaaggaauaucugug

SEQ ID NO: 4167841 - RNA, 21 nt, Yersinia pestis
gaaaggccggauguaaaacac

SEQ ID NO: 4167842 - RNA, 23 nt, Yersinia pestis
gaaagguagaucggggacaggcu

SEQ ID NO: 4167843 - RNA, 14 nt, Yersinia pestis
gaaaguguauuucu

SEQ ID NO: 4167844 - RNA, 15 nt, Yersinia pestis
gaaaguugagcagca

SEQ ID NO: 4167845 - RNA, 21 nt, Yersinia pestis
gaaaguugagcagcaauaacu

SEQ ID NO: 4167846 - RNA, 19 nt, Yersinia pestis
gaaauaacuggugaugcuc

SEQ ID NO: 4167847 - RNA, 22 nt, Yersinia pestis
gaaauaauaucaagucuugaag

SEQ ID NO: 4167848 - RNA, 15 nt, Yersinia pestis
gaaauaccacggcac

SEQ ID NO: 4167849 - RNA, 13 nt, Yersinia pestis
gaaauacuuauuu

SEQ ID NO: 4167850 - RNA, 13 nt, Yersinia pestis
gaaauagaaaacc

SEQ ID NO: 4167851 - RNA, 15 nt, Yersinia pestis
gaaauagcaacuaaa

SEQ ID NO: 4167852 - RNA, 17 nt, Yersinia pestis
gaaauagcgccugcccu

SEQ ID NO: 4167853 - RNA, 15 nt, Yersinia pestis
gaaauagcugcuucu

SEQ ID NO: 4167854 - RNA, 14 nt, Yersinia pestis
gaaauauaaaacag

SEQ ID NO: 4167855 - RNA, 19 nt, Yersinia pestis
gaaauauacacaagucauu

SEQ ID NO: 4167856 - RNA, 16 nt, Yersinia pestis
gaaauaucaggaugaa

SEQ ID NO: 4167857 - RNA, 15 nt, Yersinia pestis
gaaauauugugcucc

SEQ ID NO: 4167858 - RNA, 15 nt, Yersinia pestis
gaaaucagaucaaca

SEQ ID NO: 4167859 - RNA, 18 nt, Yersinia pestis
gaaaucagaucaacagau

SEQ ID NO: 4167860 - RNA, 12 nt, Yersinia pestis
gaaaucaucaca

SEQ ID NO: 4167861 - RNA, 17 nt, Yersinia pestis
gaaaucaucagcauuga

SEQ ID NO: 4167862 - RNA, 21 nt, Yersinia pestis
gaaaucgauggauguuccugg

SEQ ID NO: 4167863 - RNA, 18 nt, Yersinia pestis
gaaaucgauggccgcccu

SEQ ID NO: 4167864 - RNA, 16 nt, Yersinia pestis
gaaaucuaaguucagc

SEQ ID NO: 4167865 - RNA, 13 nt, Yersinia pestis
gaaaucuauugua

SEQ ID NO: 4167866 - RNA, 12 nt, Yersinia pestis
gaaaucucacca

SEQ ID NO: 4167867 - RNA, 21 nt, Yersinia pestis
gaaaucuccuguggcacauca

SEQ ID NO: 4167868 - RNA, 13 nt, Yersinia pestis
gaaaucugcggca

SEQ ID NO: 4167869 - RNA, 13 nt, Yersinia pestis
gaaaugaauauua

SEQ ID NO: 4167870 - RNA, 17 nt, Yersinia pestis
gaaaugaauauuaggua

SEQ ID NO: 4167871 - RNA, 14 nt, Yersinia pestis
gaaaugacaaauca

SEQ ID NO: 4167872 - RNA, 21 nt, Yersinia pestis
gaaaugccgccugacugcccg

SEQ ID NO: 4167873 - RNA, 20 nt, Yersinia pestis
gaaauuaaaaauuaauuauu

SEQ ID NO: 4167874 - RNA, 14 nt, Yersinia pestis
gaaauuaaggaaaa

SEQ ID NO: 4167875 - RNA, 20 nt, Yersinia pestis
gaaauucaaccucuuguaaa

SEQ ID NO: 4167876 - RNA, 19 nt, Yersinia pestis
gaaauucauuaucaggcac

SEQ ID NO: 4167877 - RNA, 19 nt, Yersinia pestis
gaaauucuguagaguaaaa

SEQ ID NO: 4167878 - RNA, 21 nt, Yersinia pestis
gaaauucuguagaguaaaacu

SEQ ID NO: 4167879 - RNA, 19 nt, Yersinia pestis
gaaauugauaugauuucau

SEQ ID NO: 4167880 - RNA, 20 nt, Yersinia pestis
gaaauuuaagaaaucuauua

SEQ ID NO: 4167881 - RNA, 21 nt, Yersinia pestis
gaaauuuauuugcugcacgca

SEQ ID NO: 4167882 - RNA, 22 nt, Yersinia pestis
gaaauuuuccaucacugcauua

SEQ ID NO: 4167883 - RNA, 14 nt, Yersinia pestis
gaacaaaacaagcc

SEQ ID NO: 4167884 - RNA, 17 nt, Yersinia pestis
gaacaaaacaagcccca

SEQ ID NO: 4167885 - RNA, 22 nt, Yersinia pestis
gaacaaaccccacuaacgcuga

SEQ ID NO: 4167886 - RNA, 20 nt, Yersinia pestis
gaacaaaugggccacaggcu

SEQ ID NO: 4167887 - RNA, 15 nt, Yersinia pestis
gaacaacagcauccg

SEQ ID NO: 4167888 - RNA, 15 nt, Yersinia pestis
gaacaacgaaacaca

SEQ ID NO: 4167889 - RNA, 19 nt, Yersinia pestis
gaacaauaccgccaauauc

SEQ ID NO: 4167890 - RNA, 16 nt, Yersinia pestis
gaacaauccauccggu

SEQ ID NO: 4167891 - RNA, 20 nt, Yersinia pestis
gaacaccagagaugauagca

SEQ ID NO: 4167892 - RNA, 22 nt, Yersinia pestis
gaacaccagagaugauagcaau

SEQ ID NO: 4167893 - RNA, 18 nt, Yersinia pestis
gaacacgcucgcguguca

SEQ ID NO: 4167894 - RNA, 17 nt, Yersinia pestis
gaacagauauugcgcag

SEQ ID NO: 4167895 - RNA, 14 nt, Yersinia pestis
gaacagauugcagg

SEQ ID NO: 4167896 - RNA, 15 nt, Yersinia pestis
gaacagcagaauaau

SEQ ID NO: 4167897 - RNA, 19 nt, Yersinia pestis
gaacagccuaacgggugac

SEQ ID NO: 4167898 - RNA, 13 nt, Yersinia pestis
gaacagccuguac

SEQ ID NO: 4167899 - RNA, 16 nt, Yersinia pestis
gaacagcgccuccagu

SEQ ID NO: 4167900 - RNA, 15 nt, Yersinia pestis
gaacaggcagaucgu

SEQ ID NO: 4167901 - RNA, 23 nt, Yersinia pestis
gaacauagcuauuggcugauuca

SEQ ID NO: 4167902 - RNA, 17 nt, Yersinia pestis
gaacaucaaacccccac

SEQ ID NO: 4167903 - RNA, 21 nt, Yersinia pestis
gaacauucaucuuuugcuauu

SEQ ID NO: 4167904 - RNA, 13 nt, Yersinia pestis
gaacauugcagua

SEQ ID NO: 4167905 - RNA, 18 nt, Yersinia pestis
gaacauugcaguauuuug

SEQ ID NO: 4167906 - RNA, 20 nt, Yersinia pestis
gaaccaaaauucacaacuug

SEQ ID NO: 4167907 - RNA, 21 nt, Yersinia pestis
gaaccaaaauucacaacuugu

SEQ ID NO: 4167908 - RNA, 15 nt, Yersinia pestis
gaaccaaggugguau

SEQ ID NO: 4167909 - RNA, 15 nt, Yersinia pestis
gaaccaauuuuucug

SEQ ID NO: 4167910 - RNA, 23 nt, Yersinia pestis
gaaccaccaagaacgccaaauga

SEQ ID NO: 4167911 - RNA, 12 nt, Yersinia pestis
gaaccagauaac

SEQ ID NO: 4167912 - RNA, 16 nt, Yersinia pestis
gaaccagugaaugcug

SEQ ID NO: 4167913 - RNA, 24 nt, Yersinia pestis
gaaccauaaacaaguugaaccaua

SEQ ID NO: 4167914 - RNA, 19 nt, Yersinia pestis
gaaccaugagaaugcgaca

SEQ ID NO: 4167915 - RNA, 13 nt, Yersinia pestis
gaacccaaccaga

SEQ ID NO: 4167916 - RNA, 17 nt, Yersinia pestis
gaacccuucagcaucga

SEQ ID NO: 4167917 - RNA, 17 nt, Yersinia pestis
gaaccgaauaauauuaa

SEQ ID NO: 4167918 - RNA, 17 nt, Yersinia pestis
gaaccgcgcucugcugg

SEQ ID NO: 4167919 - RNA, 20 nt, Yersinia pestis
gaaccgcuaucugcugacca

SEQ ID NO: 4167920 - RNA, 20 nt, Yersinia pestis
gaaccggggcgauacaccaa

SEQ ID NO: 4167921 - RNA, 16 nt, Yersinia pestis
gaaccugacgcacagc

SEQ ID NO: 4167922 - RNA, 17 nt, Yersinia pestis
gaaccugacgcacagca

SEQ ID NO: 4167923 - RNA, 23 nt, Yersinia pestis
gaaccugcauccccggcauccca

SEQ ID NO: 4167924 - RNA, 14 nt, Yersinia pestis
gaaccuucucugca

SEQ ID NO: 4167925 - RNA, 17 nt, Yersinia pestis
gaacgaggacuuccugc

SEQ ID NO: 4167926 - RNA, 18 nt, Yersinia pestis
gaacgaggacuuccugcc

SEQ ID NO: 4167927 - RNA, 19 nt, Yersinia pestis
gaacgaggcccgauaaacu

SEQ ID NO: 4167928 - RNA, 22 nt, Yersinia pestis
gaacgaggcccgauaaacugac

SEQ ID NO: 4167929 - RNA, 23 nt, Yersinia pestis
gaacgauuuucuuucaccacugc

SEQ ID NO: 4167930 - RNA, 15 nt, Yersinia pestis
gaacgcacaaguaca

SEQ ID NO: 4167931 - RNA, 13 nt, Yersinia pestis
gaacgcacaaugg

SEQ ID NO: 4167932 - RNA, 18 nt, Yersinia pestis
gaacgccucaaaaaccug

SEQ ID NO: 4167933 - RNA, 14 nt, Yersinia pestis
gaacgcgcgugguu

SEQ ID NO: 4167934 - RNA, 16 nt, Yersinia pestis
gaacgcgucacuggcc

SEQ ID NO: 4167935 - RNA, 17 nt, Yersinia pestis
gaacgcgucacuggcca

SEQ ID NO: 4167936 - RNA, 14 nt, Yersinia pestis
gaacgcucuguuga

SEQ ID NO: 4167937 - RNA, 23 nt, Yersinia pestis
gaacggauacccagcacaaugac

SEQ ID NO: 4167938 - RNA, 23 nt, Yersinia pestis
gaacggccaucaauaaagcuggc

SEQ ID NO: 4167939 - RNA, 16 nt, Yersinia pestis
gaacggugaggauagg

SEQ ID NO: 4167940 - RNA, 21 nt, Yersinia pestis
gaacuagcgccgcaucaaagc

SEQ ID NO: 4167941 - RNA, 16 nt, Yersinia pestis
gaacuagguuaaaauc

SEQ ID NO: 4167942 - RNA, 15 nt, Yersinia pestis
gaacucgccuucagg

SEQ ID NO: 4167943 - RNA, 12 nt, Yersinia pestis
gaacuuacuccc

SEQ ID NO: 4167944 - RNA, 14 nt, Yersinia pestis
gaacuuacucccuu

SEQ ID NO: 4167945 - RNA, 19 nt, Yersinia pestis
gaacuucgaaagaaauaaa

SEQ ID NO: 4167946 - RNA, 13 nt, Yersinia pestis
gaagaaacccagu

SEQ ID NO: 4167947 - RNA, 13 nt, Yersinia pestis
gaagacaaugccg

SEQ ID NO: 4167948 - RNA, 21 nt, Yersinia pestis
gaagacacuuugguuugcagc

SEQ ID NO: 4167949 - RNA, 15 nt, Yersinia pestis
gaagacaucgccaga

SEQ ID NO: 4167950 - RNA, 22 nt, Yersinia pestis
gaagacaucgccagauucgcaa

SEQ ID NO: 4167951 - RNA, 16 nt, Yersinia pestis
gaagaccagauaaucg

SEQ ID NO: 4167952 - RNA, 19 nt, Yersinia pestis
gaagacgaguaaugaaauc

SEQ ID NO: 4167953 - RNA, 13 nt, Yersinia pestis
gaagacuuccagc

SEQ ID NO: 4167954 - RNA, 23 nt, Yersinia pestis
gaagagaacaggcagcaaauaaa

SEQ ID NO: 4167955 - RNA, 18 nt, Yersinia pestis
gaagagccugaaucugaa

SEQ ID NO: 4167956 - RNA, 23 nt, Yersinia pestis
gaagagcgccucacugaaacgcu

SEQ ID NO: 4167957 - RNA, 17 nt, Yersinia pestis
gaagaguaaagcguccg

SEQ ID NO: 4167958 - RNA, 22 nt, Yersinia pestis
gaagaguugauccgauaaacuu

SEQ ID NO: 4167959 - RNA, 22 nt, Yersinia pestis
gaagaguuugaucauggcucag

SEQ ID NO: 4167960 - RNA, 20 nt, Yersinia pestis
gaagauagauuucacugccg

SEQ ID NO: 4167961 - RNA, 21 nt, Yersinia pestis
gaagauuuaaauaacagcuaa

SEQ ID NO: 4167962 - RNA, 22 nt, Yersinia pestis
gaagauuuaaauaacagcuaaa

SEQ ID NO: 4167963 - RNA, 15 nt, Yersinia pestis
gaagauuuaacggcu

SEQ ID NO: 4167964 - RNA, 12 nt, Yersinia pestis
gaagcaagaaac

SEQ ID NO: 4167965 - RNA, 13 nt, Yersinia pestis
gaagcaagaaacu

SEQ ID NO: 4167966 - RNA, 19 nt, Yersinia pestis
gaagcaauuugaucaccaa

SEQ ID NO: 4167967 - RNA, 15 nt, Yersinia pestis
gaagcacaaaaagag

SEQ ID NO: 4167968 - RNA, 18 nt, Yersinia pestis
gaagcacguaaaucgguu

SEQ ID NO: 4167969 - RNA, 19 nt, Yersinia pestis
gaagcaguucacugaguug

SEQ ID NO: 4167970 - RNA, 14 nt, Yersinia pestis
gaagccagggucau

SEQ ID NO: 4167971 - RNA, 21 nt, Yersinia pestis
gaagccuacgagagaucguag

SEQ ID NO: 4167972 - RNA, 22 nt, Yersinia pestis
gaagccucaugaaugaggcuga

SEQ ID NO: 4167973 - RNA, 18 nt, Yersinia pestis
gaagcgccgacacccagc

SEQ ID NO: 4167974 - RNA, 15 nt, Yersinia pestis
gaagcggccagguuc

SEQ ID NO: 4167975 - RNA, 14 nt, Yersinia pestis
gaagcguaaagcac

SEQ ID NO: 4167976 - RNA, 15 nt, Yersinia pestis
gaagcguaaagcacc

SEQ ID NO: 4167977 - RNA, 18 nt, Yersinia pestis
gaagcguauaagcagggg

SEQ ID NO: 4167978 - RNA, 18 nt, Yersinia pestis
gaagcucauuaauccccg

SEQ ID NO: 4167979 - RNA, 19 nt, Yersinia pestis
gaaggaauuucacggagaa

SEQ ID NO: 4167980 - RNA, 18 nt, Yersinia pestis
gaaggacuuggcguaacu

SEQ ID NO: 4167981 - RNA, 11 nt, Yersinia pestis
gaaggcacggc

SEQ ID NO: 4167982 - RNA, 19 nt, Yersinia pestis
gaaggccugcugugucgcu

SEQ ID NO: 4167983 - RNA, 16 nt, Yersinia pestis
gaaggcuauuuuuaua

SEQ ID NO: 4167984 - RNA, 21 nt, Yersinia pestis
gaagggaguuacucagcaucc

SEQ ID NO: 4167985 - RNA, 18 nt, Yersinia pestis
gaagggcaaauugccgcu

SEQ ID NO: 4167986 - RNA, 13 nt, Yersinia pestis
gaagggcgcagcc

SEQ ID NO: 4167987 - RNA, 16 nt, Yersinia pestis
gaagggcgccggaggg

SEQ ID NO: 4167988 - RNA, 15 nt, Yersinia pestis
gaaggguauugaaga

SEQ ID NO: 4167989 - RNA, 16 nt, Yersinia pestis
gaagguaacuuaaaau

SEQ ID NO: 4167990 - RNA, 19 nt, Yersinia pestis
gaagguaaucagacugcug

SEQ ID NO: 4167991 - RNA, 15 nt, Yersinia pestis
gaagguagucccuca

SEQ ID NO: 4167992 - RNA, 16 nt, Yersinia pestis
gaagguagucccucaa

SEQ ID NO: 4167993 - RNA, 12 nt, Yersinia pestis
gaagguuccccu

SEQ ID NO: 4167994 - RNA, 13 nt, Yersinia pestis
gaaguacuuauuu

SEQ ID NO: 4167995 - RNA, 20 nt, Yersinia pestis
gaaguauuaauauaauacuu

SEQ ID NO: 4167996 - RNA, 15 nt, Yersinia pestis
gaagugaacgaacac

SEQ ID NO: 4167997 - RNA, 12 nt, Yersinia pestis
gaaguggacacg

SEQ ID NO: 4167998 - RNA, 17 nt, Yersinia pestis
gaaguguuuaccacggc

SEQ ID NO: 4167999 - RNA, 22 nt, Yersinia pestis
gaaguuauugacaggugguucu

SEQ ID NO: 4168000 - RNA, 13 nt, Yersinia pestis
gaauaaaaauaag

SEQ ID NO: 4168001 - RNA, 14 nt, Yersinia pestis
gaauaaaaaugaua

SEQ ID NO: 4168002 - RNA, 13 nt, Yersinia pestis
gaauaaaauccac

SEQ ID NO: 4168003 - RNA, 13 nt, Yersinia pestis
gaauaaaccagca

SEQ ID NO: 4168004 - RNA, 17 nt, Yersinia pestis
gaauaacaaaagcccgu

SEQ ID NO: 4168005 - RNA, 16 nt, Yersinia pestis
gaauaaccuacuccaa

SEQ ID NO: 4168006 - RNA, 17 nt, Yersinia pestis
gaauaacucucaucuau

SEQ ID NO: 4168007 - RNA, 20 nt, Yersinia pestis
gaauaagagagacgggauaa

SEQ ID NO: 4168008 - RNA, 13 nt, Yersinia pestis
gaauaaggcuuac

SEQ ID NO: 4168009 - RNA, 12 nt, Yersinia pestis
gaauaaggguag

SEQ ID NO: 4168010 - RNA, 11 nt, Yersinia pestis
gaauaauacug

SEQ ID NO: 4168011 - RNA, 23 nt, Yersinia pestis
gaauaauccccacggccagagcc

SEQ ID NO: 4168012 - RNA, 21 nt, Yersinia pestis
gaauaaugguauuugaaauau

SEQ ID NO: 4168013 - RNA, 17 nt, Yersinia pestis
gaauaauuacagcuggg

SEQ ID NO: 4168014 - RNA, 14 nt, Yersinia pestis
gaauaccaagccaa

SEQ ID NO: 4168015 - RNA, 21 nt, Yersinia pestis
gaauaccguuuaggaugaaga

SEQ ID NO: 4168016 - RNA, 16 nt, Yersinia pestis
gaauacgauccgcuau

SEQ ID NO: 4168017 - RNA, 19 nt, Yersinia pestis
gaauacguagcccuuugcu

SEQ ID NO: 4168018 - RNA, 18 nt, Yersinia pestis
gaauagaaccggcugaca

SEQ ID NO: 4168019 - RNA, 19 nt, Yersinia pestis
gaauagaccugaugacccg

SEQ ID NO: 4168020 - RNA, 15 nt, Yersinia pestis
gaauagauaacacga

SEQ ID NO: 4168021 - RNA, 20 nt, Yersinia pestis
gaauagcgcugcaucagcag

SEQ ID NO: 4168022 - RNA, 19 nt, Yersinia pestis
gaauauaaauuuaauaaaa

SEQ ID NO: 4168023 - RNA, 21 nt, Yersinia pestis
gaauauaaauuuaauaaaaac

SEQ ID NO: 4168024 - RNA, 18 nt, Yersinia pestis
gaauauacuuuacauaua

SEQ ID NO: 4168025 - RNA, 19 nt, Yersinia pestis
gaauaucaucuuuuucugc

SEQ ID NO: 4168026 - RNA, 14 nt, Yersinia pestis
gaauauccguucag

SEQ ID NO: 4168027 - RNA, 16 nt, Yersinia pestis
gaauaucuagcaacac

SEQ ID NO: 4168028 - RNA, 19 nt, Yersinia pestis
gaauauucaacgccaauac

SEQ ID NO: 4168029 - RNA, 16 nt, Yersinia pestis
gaauauuuaaauuaca

SEQ ID NO: 4168030 - RNA, 19 nt, Yersinia pestis
gaauauuuacggugagaau

SEQ ID NO: 4168031 - RNA, 12 nt, Yersinia pestis
gaaucaacucau

SEQ ID NO: 4168032 - RNA, 13 nt, Yersinia pestis
gaaucacaucauu

SEQ ID NO: 4168033 - RNA, 18 nt, Yersinia pestis
gaaucaccaacaccacca

SEQ ID NO: 4168034 - RNA, 20 nt, Yersinia pestis
gaaucaccgaaagaagacau

SEQ ID NO: 4168035 - RNA, 17 nt, Yersinia pestis
gaaucaccuuucuccau

SEQ ID NO: 4168036 - RNA, 15 nt, Yersinia pestis
gaaucacugacugau

SEQ ID NO: 4168037 - RNA, 12 nt, Yersinia pestis
gaaucacuuauu

SEQ ID NO: 4168038 - RNA, 20 nt, Yersinia pestis
gaaucagauacggcuccaga

SEQ ID NO: 4168039 - RNA, 19 nt, Yersinia pestis
gaaucagccccaagcuuag

SEQ ID NO: 4168040 - RNA, 20 nt, Yersinia pestis
gaaucaguggucuuccgccu

SEQ ID NO: 4168041 - RNA, 20 nt, Yersinia pestis
gaaucauaaugguaccggca

SEQ ID NO: 4168042 - RNA, 15 nt, Yersinia pestis
gaaucaucagacgca

SEQ ID NO: 4168043 - RNA, 14 nt, Yersinia pestis
gaauccagccaugc

SEQ ID NO: 4168044 - RNA, 17 nt, Yersinia pestis
gaaucccuaacgagaaa

SEQ ID NO: 4168045 - RNA, 21 nt, Yersinia pestis
gaaugaaguucaccagcuugg

SEQ ID NO: 4168046 - RNA, 14 nt, Yersinia pestis
gaaugaauucuaua

SEQ ID NO: 4168047 - RNA, 12 nt, Yersinia pestis
gaaugagaugaa

SEQ ID NO: 4168048 - RNA, 15 nt, Yersinia pestis
gaaugagaugaacac

SEQ ID NO: 4168049 - RNA, 14 nt, Yersinia pestis
gaaugaggcugagg

SEQ ID NO: 4168050 - RNA, 19 nt, Yersinia pestis
gaaugaguuuuguccugag

SEQ ID NO: 4168051 - RNA, 16 nt, Yersinia pestis
gaaugaucagaggcug

SEQ ID NO: 4168052 - RNA, 22 nt, Yersinia pestis
gaaugaugguauuaaucaacag

SEQ ID NO: 4168053 - RNA, 15 nt, Yersinia pestis
gaaugauucauugag

SEQ ID NO: 4168054 - RNA, 19 nt, Yersinia pestis
gaaugcacgauaccaccac

SEQ ID NO: 4168055 - RNA, 22 nt, Yersinia pestis
gaaugcacgauaccaccaccaa

SEQ ID NO: 4168056 - RNA, 14 nt, Yersinia pestis
gaaugcagauauca

SEQ ID NO: 4168057 - RNA, 20 nt, Yersinia pestis
gaaugcagggagguuauauu

SEQ ID NO: 4168058 - RNA, 16 nt, Yersinia pestis
gaaugcaucgcaucag

SEQ ID NO: 4168059 - RNA, 22 nt, Yersinia pestis
gaaugcgccgcggcccugaggu

SEQ ID NO: 4168060 - RNA, 21 nt, Yersinia pestis
gaaugcucuuuuuaugcaggg

SEQ ID NO: 4168061 - RNA, 14 nt, Yersinia pestis
gaauggauugaaac

SEQ ID NO: 4168062 - RNA, 17 nt, Yersinia pestis
gaauggcaacguauaau

SEQ ID NO: 4168063 - RNA, 19 nt, Yersinia pestis
gaauggggggcaaccuggu

SEQ ID NO: 4168064 - RNA, 15 nt, Yersinia pestis
gaaugguguaaaugc

SEQ ID NO: 4168065 - RNA, 12 nt, Yersinia pestis
gaaugugagugu

SEQ ID NO: 4168066 - RNA, 13 nt, Yersinia pestis
gaauguuaaaccc

SEQ ID NO: 4168067 - RNA, 16 nt, Yersinia pestis
gaauguuaaacccccu

SEQ ID NO: 4168068 - RNA, 14 nt, Yersinia pestis
gaauuaaaaacccu

SEQ ID NO: 4168069 - RNA, 14 nt, Yersinia pestis
gaauuaacauacaa

SEQ ID NO: 4168070 - RNA, 14 nt, Yersinia pestis
gaauuaagaagccu

SEQ ID NO: 4168071 - RNA, 19 nt, Yersinia pestis
gaauuaagaagccucauga

SEQ ID NO: 4168072 - RNA, 20 nt, Yersinia pestis
gaauuaagaagccucaugaa

SEQ ID NO: 4168073 - RNA, 21 nt, Yersinia pestis
gaauuaagaagccucaugaau

SEQ ID NO: 4168074 - RNA, 16 nt, Yersinia pestis
gaauuaaggaaacuca

SEQ ID NO: 4168075 - RNA, 15 nt, Yersinia pestis
gaauuaauaaaaccu

SEQ ID NO: 4168076 - RNA, 12 nt, Yersinia pestis
gaauuaucauau

SEQ ID NO: 4168077 - RNA, 20 nt, Yersinia pestis
gaauuauuuuggaguauaca

SEQ ID NO: 4168078 - RNA, 12 nt, Yersinia pestis
gaauucaccaaa

SEQ ID NO: 4168079 - RNA, 15 nt, Yersinia pestis
gaauugaugucaauu

SEQ ID NO: 4168080 - RNA, 22 nt, Yersinia pestis
gaauugaugucaauuaaaaacg

SEQ ID NO: 4168081 - RNA, 21 nt, Yersinia pestis
gaauugccccccaauauugga

SEQ ID NO: 4168082 - RNA, 20 nt, Yersinia pestis
gaauuuauccuguacauaua

SEQ ID NO: 4168083 - RNA, 23 nt, Yersinia pestis
gaauuuauccuguacauauauaa

SEQ ID NO: 4168084 - RNA, 11 nt, Yersinia pestis
gaauuucauuu

SEQ ID NO: 4168085 - RNA, 17 nt, Yersinia pestis
gaauuuggaucgccagu

SEQ ID NO: 4168086 - RNA, 13 nt, Yersinia pestis
gaauuuuagucaa

SEQ ID NO: 4168087 - RNA, 16 nt, Yersinia pestis
gaauuuuauucagcaa

SEQ ID NO: 4168088 - RNA, 21 nt, Yersinia pestis
gaauuuucucauuaauaauga

SEQ ID NO: 4168089 - RNA, 16 nt, Yersinia pestis
gaauuuugcagcgcuu

SEQ ID NO: 4168090 - RNA, 16 nt, Yersinia pestis
gacaaaaauaagcgua

SEQ ID NO: 4168091 - RNA, 19 nt, Yersinia pestis
gacaaaagugucauuugga

SEQ ID NO: 4168092 - RNA, 23 nt, Yersinia pestis
gacaaacaaccuaaaaaaaacaa

SEQ ID NO: 4168093 - RNA, 13 nt, Yersinia pestis
gacaaacagauac

SEQ ID NO: 4168094 - RNA, 20 nt, Yersinia pestis
gacaaaccccgaugacgcga

SEQ ID NO: 4168095 - RNA, 19 nt, Yersinia pestis
gacaaauaaaacagaaccc

SEQ ID NO: 4168096 - RNA, 10 nt, Yersinia pestis
gacaaauaag

SEQ ID NO: 4168097 - RNA, 17 nt, Yersinia pestis
gacaaauccuuuuaaaa

SEQ ID NO: 4168098 - RNA, 16 nt, Yersinia pestis
gacaacaaacaguaac

SEQ ID NO: 4168099 - RNA, 18 nt, Yersinia pestis
gacaaccacccgacauca

SEQ ID NO: 4168100 - RNA, 17 nt, Yersinia pestis
gacaacgcuuggcauca

SEQ ID NO: 4168101 - RNA, 17 nt, Yersinia pestis
gacaacgucacuuccau

SEQ ID NO: 4168102 - RNA, 16 nt, Yersinia pestis
gacaacucuucuaucu

SEQ ID NO: 4168103 - RNA, 18 nt, Yersinia pestis
gacaagauugccaccuuc

SEQ ID NO: 4168104 - RNA, 21 nt, Yersinia pestis
gacaagauugccaccuucacc

SEQ ID NO: 4168105 - RNA, 20 nt, Yersinia pestis
gacaagcgcaguagcggcuc

SEQ ID NO: 4168106 - RNA, 16 nt, Yersinia pestis
gacaaggaaaaggcag

SEQ ID NO: 4168107 - RNA, 22 nt, Yersinia pestis
gacaagucaugguacaacugcg

SEQ ID NO: 4168108 - RNA, 18 nt, Yersinia pestis
gacaauagagucacagag

SEQ ID NO: 4168109 - RNA, 15 nt, Yersinia pestis
gacaauauaauaaug

SEQ ID NO: 4168110 - RNA, 21 nt, Yersinia pestis
gacaaucuguuccugauucca

SEQ ID NO: 4168111 - RNA, 15 nt, Yersinia pestis
gacaaugaugaccgg

SEQ ID NO: 4168112 - RNA, 18 nt, Yersinia pestis
gacaaugccaucccccuu

SEQ ID NO: 4168113 - RNA, 12 nt, Yersinia pestis
gacaaugcguua

SEQ ID NO: 4168114 - RNA, 18 nt, Yersinia pestis
gacaauuuccccugcuuc

SEQ ID NO: 4168115 - RNA, 18 nt, Yersinia pestis
gacacaaaugcugugcca

SEQ ID NO: 4168116 - RNA, 17 nt, Yersinia pestis
gacacaaauuacucugc

SEQ ID NO: 4168117 - RNA, 14 nt, Yersinia pestis
gacacaacacauua

SEQ ID NO: 4168118 - RNA, 18 nt, Yersinia pestis
gacacaauagaugcagua

SEQ ID NO: 4168119 - RNA, 22 nt, Yersinia pestis
gacacaauucccguuagguuca

SEQ ID NO: 4168120 - RNA, 15 nt, Yersinia pestis
gacacauaaguguau

SEQ ID NO: 4168121 - RNA, 17 nt, Yersinia pestis
gacaccaagacugaagu

SEQ ID NO: 4168122 - RNA, 14 nt, Yersinia pestis
gacaccaauaccga

SEQ ID NO: 4168123 - RNA, 18 nt, Yersinia pestis
gacaccaaucuuuuucag

SEQ ID NO: 4168124 - RNA, 18 nt, Yersinia pestis
gacacccgcuucauucgc

SEQ ID NO: 4168125 - RNA, 16 nt, Yersinia pestis
gacacccucagaggcc

SEQ ID NO: 4168126 - RNA, 15 nt, Yersinia pestis
gacacgaucauuaua

SEQ ID NO: 4168127 - RNA, 14 nt, Yersinia pestis
gacacgcucaucca

SEQ ID NO: 4168128 - RNA, 24 nt, Yersinia pestis
gacacucagaucccccugcugcca

SEQ ID NO: 4168129 - RNA, 23 nt, Yersinia pestis
gacacucggcgguuugagccacc

SEQ ID NO: 4168130 - RNA, 17 nt, Yersinia pestis
gacacugacaucaucac

SEQ ID NO: 4168131 - RNA, 20 nt, Yersinia pestis
gacacuuugguuugcagcga

SEQ ID NO: 4168132 - RNA, 15 nt, Yersinia pestis
gacacuuuugucgcu

SEQ ID NO: 4168133 - RNA, 15 nt, Yersinia pestis
gacagaauauccagc

SEQ ID NO: 4168134 - RNA, 19 nt, Yersinia pestis
gacagaauauccagcaaau

SEQ ID NO: 4168135 - RNA, 17 nt, Yersinia pestis
gacagauccugccgccu

SEQ ID NO: 4168136 - RNA, 13 nt, Yersinia pestis
gacagcaguuaau

SEQ ID NO: 4168137 - RNA, 21 nt, Yersinia pestis
gacagcaguuaaugcuuaaga

SEQ ID NO: 4168138 - RNA, 12 nt, Yersinia pestis
gacagcgcgcag

SEQ ID NO: 4168139 - RNA, 19 nt, Yersinia pestis
gacagcgcggcuaaauaua

SEQ ID NO: 4168140 - RNA, 16 nt, Yersinia pestis
gacaggcucagcacaa

SEQ ID NO: 4168141 - RNA, 18 nt, Yersinia pestis
gacaggcucagcacaaac

SEQ ID NO: 4168142 - RNA, 14 nt, Yersinia pestis
gacaggcuccuccu

SEQ ID NO: 4168143 - RNA, 23 nt, Yersinia pestis
gacaggcuuuauugagcgaugac

SEQ ID NO: 4168144 - RNA, 21 nt, Yersinia pestis
gacaguaaccgggcuugauua

SEQ ID NO: 4168145 - RNA, 14 nt, Yersinia pestis
gacaguaacuaaag

SEQ ID NO: 4168146 - RNA, 18 nt, Yersinia pestis
gacauaagaugaccacca

SEQ ID NO: 4168147 - RNA, 22 nt, Yersinia pestis
gacauaagaugaccaccaauuu

SEQ ID NO: 4168148 - RNA, 14 nt, Yersinia pestis
gacauacuuugccu

SEQ ID NO: 4168149 - RNA, 15 nt, Yersinia pestis
gacauacuuugccuu

SEQ ID NO: 4168150 - RNA, 11 nt, Yersinia pestis
gacauagagau

SEQ ID NO: 4168151 - RNA, 20 nt, Yersinia pestis
gacauagccggagguuuuuc

SEQ ID NO: 4168152 - RNA, 16 nt, Yersinia pestis
gacauauucaaccgcc

SEQ ID NO: 4168153 - RNA, 17 nt, Yersinia pestis
gacaucagcgccacagu

SEQ ID NO: 4168154 - RNA, 12 nt, Yersinia pestis
gacauccaauuc

SEQ ID NO: 4168155 - RNA, 22 nt, Yersinia pestis
gacauccgcuugcagcaacagg

SEQ ID NO: 4168156 - RNA, 14 nt, Yersinia pestis
gacaucgccagauu

SEQ ID NO: 4168157 - RNA, 15 nt, Yersinia pestis
gacaucugcuuuacu

SEQ ID NO: 4168158 - RNA, 12 nt, Yersinia pestis
gacaucuggcug

SEQ ID NO: 4168159 - RNA, 23 nt, Yersinia pestis
gacaugauuaaaucaagcugcuc

SEQ ID NO: 4168160 - RNA, 23 nt, Yersinia pestis
gacauguuccagugcuuuaucca

SEQ ID NO: 4168161 - RNA, 18 nt, Yersinia pestis
gacauguugcccuuaguu

SEQ ID NO: 4168162 - RNA, 22 nt, Yersinia pestis
gacauuauuggcguaacugcug

SEQ ID NO: 4168163 - RNA, 22 nt, Yersinia pestis
gacauucucuacucgcucacca

SEQ ID NO: 4168164 - RNA, 12 nt, Yersinia pestis
gacauuuucuau

SEQ ID NO: 4168165 - RNA, 15 nt, Yersinia pestis
gacauuuugugcucu

SEQ ID NO: 4168166 - RNA, 12 nt, Yersinia pestis
gacauuuuucua

SEQ ID NO: 4168167 - RNA, 13 nt, Yersinia pestis
gaccaaacagaau

SEQ ID NO: 4168168 - RNA, 14 nt, Yersinia pestis
gaccaaacauuguc

SEQ ID NO: 4168169 - RNA, 16 nt, Yersinia pestis
gaccaaauagcaagcc

SEQ ID NO: 4168170 - RNA, 23 nt, Yersinia pestis
gaccaaauagcaagccaaaacag

SEQ ID NO: 4168171 - RNA, 21 nt, Yersinia pestis
gaccaaauggacgaacagccc

SEQ ID NO: 4168172 - RNA, 16 nt, Yersinia pestis
gaccaacgcuguaauc

SEQ ID NO: 4168173 - RNA, 14 nt, Yersinia pestis
gaccaagcauuuua

SEQ ID NO: 4168174 - RNA, 23 nt, Yersinia pestis
gaccaaucaauacacuggcagug

SEQ ID NO: 4168175 - RNA, 16 nt, Yersinia pestis
gaccaauucaucagcg

SEQ ID NO: 4168176 - RNA, 11 nt, Yersinia pestis
gaccaccaacu

SEQ ID NO: 4168177 - RNA, 20 nt, Yersinia pestis
gaccaccgauacgcgcaccg

SEQ ID NO: 4168178 - RNA, 17 nt, Yersinia pestis
gaccacgcaucaauaau

SEQ ID NO: 4168179 - RNA, 16 nt, Yersinia pestis
gaccacugacaaaaac

SEQ ID NO: 4168180 - RNA, 21 nt, Yersinia pestis
gaccacuugcugaugcccauc

SEQ ID NO: 4168181 - RNA, 22 nt, Yersinia pestis
gaccacuugguuggcaccacgg

SEQ ID NO: 4168182 - RNA, 13 nt, Yersinia pestis
gaccagauagcug

SEQ ID NO: 4168183 - RNA, 18 nt, Yersinia pestis
gaccagcgccgauauaca

SEQ ID NO: 4168184 - RNA, 14 nt, Yersinia pestis
gaccagggcuaaaa

SEQ ID NO: 4168185 - RNA, 14 nt, Yersinia pestis
gaccagugaauaag

SEQ ID NO: 4168186 - RNA, 14 nt, Yersinia pestis
gaccagugcaccca

SEQ ID NO: 4168187 - RNA, 15 nt, Yersinia pestis
gaccaguugacaggu

SEQ ID NO: 4168188 - RNA, 20 nt, Yersinia pestis
gaccauaaaaggauggccca

SEQ ID NO: 4168189 - RNA, 16 nt, Yersinia pestis
gaccaucgaucugggc

SEQ ID NO: 4168190 - RNA, 12 nt, Yersinia pestis
gaccaucugcuu

SEQ ID NO: 4168191 - RNA, 22 nt, Yersinia pestis
gaccaugccaucagaauaggug

SEQ ID NO: 4168192 - RNA, 16 nt, Yersinia pestis
gaccauggcgaugcgu

SEQ ID NO: 4168193 - RNA, 15 nt, Yersinia pestis
gacccaagggcuauu

SEQ ID NO: 4168194 - RNA, 21 nt, Yersinia pestis
gacccaagggcuauugcugug

SEQ ID NO: 4168195 - RNA, 14 nt, Yersinia pestis
gacccaauugcagg

SEQ ID NO: 4168196 - RNA, 23 nt, Yersinia pestis
gacccaucgccguuuugccauua

SEQ ID NO: 4168197 - RNA, 14 nt, Yersinia pestis
gaccccugcugaaa

SEQ ID NO: 4168198 - RNA, 20 nt, Yersinia pestis
gaccccuucuuccagcauca

SEQ ID NO: 4168199 - RNA, 14 nt, Yersinia pestis
gacccguuuauaaa

SEQ ID NO: 4168200 - RNA, 24 nt, Yersinia pestis
gaccgagaagcuucaacuuaauuu

SEQ ID NO: 4168201 - RNA, 23 nt, Yersinia pestis
gaccgccaaauccaagccaccac

SEQ ID NO: 4168202 - RNA, 14 nt, Yersinia pestis
gaccgccagugccg

SEQ ID NO: 4168203 - RNA, 22 nt, Yersinia pestis
gaccgccagugccgcggcggcc

SEQ ID NO: 4168204 - RNA, 21 nt, Yersinia pestis
gaccgcgacacaagccauuuc

SEQ ID NO: 4168205 - RNA, 20 nt, Yersinia pestis
gaccgcguaagccgugccug

SEQ ID NO: 4168206 - RNA, 20 nt, Yersinia pestis
gaccgcuguuugauuaaaac

SEQ ID NO: 4168207 - RNA, 23 nt, Yersinia pestis
gaccgcuguuugauuaaaacccc

SEQ ID NO: 4168208 - RNA, 16 nt, Yersinia pestis
gaccguagaaacuaag

SEQ ID NO: 4168209 - RNA, 13 nt, Yersinia pestis
gaccgucaccaaa

SEQ ID NO: 4168210 - RNA, 18 nt, Yersinia pestis
gaccuauugauaaaaccg

SEQ ID NO: 4168211 - RNA, 13 nt, Yersinia pestis
gaccuccguaggc

SEQ ID NO: 4168212 - RNA, 21 nt, Yersinia pestis
gaccugcaacucuugcgcgaa

SEQ ID NO: 4168213 - RNA, 14 nt, Yersinia pestis
gaccugcugcaccu

SEQ ID NO: 4168214 - RNA, 19 nt, Yersinia pestis
gaccuguagcuuuuuaaau

SEQ ID NO: 4168215 - RNA, 21 nt, Yersinia pestis
gaccuuaucaucacugaaagu

SEQ ID NO: 4168216 - RNA, 18 nt, Yersinia pestis
gacgaaaaccuaauacuu

SEQ ID NO: 4168217 - RNA, 15 nt, Yersinia pestis
gacgaaagauaauuu

SEQ ID NO: 4168218 - RNA, 16 nt, Yersinia pestis
gacgacacaaaugcug

SEQ ID NO: 4168219 - RNA, 22 nt, Yersinia pestis
gacgacauuaauuugcaacgca

SEQ ID NO: 4168220 - RNA, 19 nt, Yersinia pestis
gacgacgcguugauccauc

SEQ ID NO: 4168221 - RNA, 16 nt, Yersinia pestis
gacgagcccaggcgac

SEQ ID NO: 4168222 - RNA, 15 nt, Yersinia pestis
gacgagcggcauuga

SEQ ID NO: 4168223 - RNA, 13 nt, Yersinia pestis
gacgauaacgcgg

SEQ ID NO: 4168224 - RNA, 23 nt, Yersinia pestis
gacgauaacuuuuggcagcacca

SEQ ID NO: 4168225 - RNA, 12 nt, Yersinia pestis
gacgauaaucag

SEQ ID NO: 4168226 - RNA, 19 nt, Yersinia pestis
gacgaucuuguucaccaau

SEQ ID NO: 4168227 - RNA, 18 nt, Yersinia pestis
gacgaucuuucucaacgg

SEQ ID NO: 4168228 - RNA, 24 nt, Yersinia pestis
gacgcacauuacccggccaaccgu

SEQ ID NO: 4168229 - RNA, 20 nt, Yersinia pestis
gacgccguaaauacauccau

SEQ ID NO: 4168230 - RNA, 17 nt, Yersinia pestis
gacgcgaucuugaacgg

SEQ ID NO: 4168231 - RNA, 15 nt, Yersinia pestis
gacgcggugacaaug

SEQ ID NO: 4168232 - RNA, 21 nt, Yersinia pestis
gacgcggugacaaugaauccg

SEQ ID NO: 4168233 - RNA, 22 nt, Yersinia pestis
gacgcuaaccaccgucaccaaa

SEQ ID NO: 4168234 - RNA, 16 nt, Yersinia pestis
gacgcuggcagccuuu

SEQ ID NO: 4168235 - RNA, 20 nt, Yersinia pestis
gacgcuguauacggacaaug

SEQ ID NO: 4168236 - RNA, 22 nt, Yersinia pestis
gacgcuguugacguguuagcug

SEQ ID NO: 4168237 - RNA, 16 nt, Yersinia pestis
gacgcuugaauauagc

SEQ ID NO: 4168238 - RNA, 14 nt, Yersinia pestis
gacggaaacagcac

SEQ ID NO: 4168239 - RNA, 12 nt, Yersinia pestis
gacggcggcgga

SEQ ID NO: 4168240 - RNA, 19 nt, Yersinia pestis
gacggcgguauacagaagc

SEQ ID NO: 4168241 - RNA, 20 nt, Yersinia pestis
gacgggacaaucuguuccug

SEQ ID NO: 4168242 - RNA, 16 nt, Yersinia pestis
gacgguacugaaaucc

SEQ ID NO: 4168243 - RNA, 16 nt, Yersinia pestis
gacggucagccaacga

SEQ ID NO: 4168244 - RNA, 14 nt, Yersinia pestis
gacguaaauggcua

SEQ ID NO: 4168245 - RNA, 17 nt, Yersinia pestis
gacguaucgcaguuaaa

SEQ ID NO: 4168246 - RNA, 15 nt, Yersinia pestis
gacgucauaaauauu

SEQ ID NO: 4168247 - RNA, 13 nt, Yersinia pestis
gacguccaaccca

SEQ ID NO: 4168248 - RNA, 20 nt, Yersinia pestis
gacgugaauaugugcuugcg

SEQ ID NO: 4168249 - RNA, 19 nt, Yersinia pestis
gacgugaggguucaagucc

SEQ ID NO: 4168250 - RNA, 18 nt, Yersinia pestis
gacgugugcuguaagaaa

SEQ ID NO: 4168251 - RNA, 21 nt, Yersinia pestis
gacgugugcuguaagaaaaag

SEQ ID NO: 4168252 - RNA, 21 nt, Yersinia pestis
gacguugcucccaucccucac

SEQ ID NO: 4168253 - RNA, 16 nt, Yersinia pestis
gacguuuaucugauga

SEQ ID NO: 4168254 - RNA, 23 nt, Yersinia pestis
gacguuuaucugaugaaaaaguc

SEQ ID NO: 4168255 - RNA, 17 nt, Yersinia pestis
gacuaaaucgcuuaucu

SEQ ID NO: 4168256 - RNA, 20 nt, Yersinia pestis
gacuaacagaauauugacac

SEQ ID NO: 4168257 - RNA, 14 nt, Yersinia pestis
gacuaaccucugca

SEQ ID NO: 4168258 - RNA, 21 nt, Yersinia pestis
gacuaauugugcagcaucacc

SEQ ID NO: 4168259 - RNA, 16 nt, Yersinia pestis
gacuaccaaaauuuaa

SEQ ID NO: 4168260 - RNA, 17 nt, Yersinia pestis
gacuacugaaaccugac

SEQ ID NO: 4168261 - RNA, 19 nt, Yersinia pestis
gacuaucccuucaaucagc

SEQ ID NO: 4168262 - RNA, 21 nt, Yersinia pestis
gacuauucugccuauccucac

SEQ ID NO: 4168263 - RNA, 23 nt, Yersinia pestis
gacuauucugccuauccucaccg

SEQ ID NO: 4168264 - RNA, 12 nt, Yersinia pestis
gacucaagccuc

SEQ ID NO: 4168265 - RNA, 14 nt, Yersinia pestis
gacucacgucagua

SEQ ID NO: 4168266 - RNA, 15 nt, Yersinia pestis
gacucaucaaaacaa

SEQ ID NO: 4168267 - RNA, 21 nt, Yersinia pestis
gacucaucaaaacaaucacug

SEQ ID NO: 4168268 - RNA, 17 nt, Yersinia pestis
gacuccccgcucggccc

SEQ ID NO: 4168269 - RNA, 17 nt, Yersinia pestis
gacucccugacucccuc

SEQ ID NO: 4168270 - RNA, 15 nt, Yersinia pestis
gacucgaucuugaac

SEQ ID NO: 4168271 - RNA, 21 nt, Yersinia pestis
gacucgaugacaggggauagc

SEQ ID NO: 4168272 - RNA, 18 nt, Yersinia pestis
gacucgggucagugaaaa

SEQ ID NO: 4168273 - RNA, 19 nt, Yersinia pestis
gacucugcuaccaggaagc

SEQ ID NO: 4168274 - RNA, 23 nt, Yersinia pestis
gacugaaaguagaaauaaaaacc

SEQ ID NO: 4168275 - RNA, 18 nt, Yersinia pestis
gacugaaauaaugguuuc

SEQ ID NO: 4168276 - RNA, 21 nt, Yersinia pestis
gacugaaauaaugguuuccag

SEQ ID NO: 4168277 - RNA, 22 nt, Yersinia pestis
gacugaaauaaugguuuccagu

SEQ ID NO: 4168278 - RNA, 20 nt, Yersinia pestis
gacugaacgccucaaaaacc

SEQ ID NO: 4168279 - RNA, 16 nt, Yersinia pestis
gacugaccauaaaagg

SEQ ID NO: 4168280 - RNA, 15 nt, Yersinia pestis
gacugauguaagcuc

SEQ ID NO: 4168281 - RNA, 19 nt, Yersinia pestis
gacugcuaauaccaccacc

SEQ ID NO: 4168282 - RNA, 14 nt, Yersinia pestis
gacugcucuuuccc

SEQ ID NO: 4168283 - RNA, 15 nt, Yersinia pestis
gacugcuggcagggu

SEQ ID NO: 4168284 - RNA, 22 nt, Yersinia pestis
gacuggacaaauaaaacagaac

SEQ ID NO: 4168285 - RNA, 14 nt, Yersinia pestis
gacuggcaggaaau

SEQ ID NO: 4168286 - RNA, 23 nt, Yersinia pestis
gacuggcgauauggcacaggcaa

SEQ ID NO: 4168287 - RNA, 20 nt, Yersinia pestis
gacuggucacucgaugacgu

SEQ ID NO: 4168288 - RNA, 15 nt, Yersinia pestis
gacugguugcugguu

SEQ ID NO: 4168289 - RNA, 19 nt, Yersinia pestis
gacuguaaauauucugacg

SEQ ID NO: 4168290 - RNA, 22 nt, Yersinia pestis
gacuguacggcgcguuucuuag

SEQ ID NO: 4168291 - RNA, 15 nt, Yersinia pestis
gacugucuucaacuu

SEQ ID NO: 4168292 - RNA, 12 nt, Yersinia pestis
gacuguggcugc

SEQ ID NO: 4168293 - RNA, 18 nt, Yersinia pestis
gacuguucguaaugacug

SEQ ID NO: 4168294 - RNA, 13 nt, Yersinia pestis
gacuguuuugcua

SEQ ID NO: 4168295 - RNA, 22 nt, Yersinia pestis
gacuguuuugcuaacugugcca

SEQ ID NO: 4168296 - RNA, 17 nt, Yersinia pestis
gacuuaaaucuuacugg

SEQ ID NO: 4168297 - RNA, 18 nt, Yersinia pestis
gacuucaucacccaacgu

SEQ ID NO: 4168298 - RNA, 18 nt, Yersinia pestis
gacuuccugcccagcggc

SEQ ID NO: 4168299 - RNA, 21 nt, Yersinia pestis
gacuugaacuucgaaagaaau

SEQ ID NO: 4168300 - RNA, 20 nt, Yersinia pestis
gacuugauuaacaucgccac

SEQ ID NO: 4168301 - RNA, 18 nt, Yersinia pestis
gacuugcccaauggcaaa

SEQ ID NO: 4168302 - RNA, 17 nt, Yersinia pestis
gacuuguggaacaacag

SEQ ID NO: 4168303 - RNA, 15 nt, Yersinia pestis
gacuuuaauuaaaaa

SEQ ID NO: 4168304 - RNA, 15 nt, Yersinia pestis
gacuuuaucugccaa

SEQ ID NO: 4168305 - RNA, 18 nt, Yersinia pestis
gacuuuauguacauccaa

SEQ ID NO: 4168306 - RNA, 13 nt, Yersinia pestis
gacuuuccccaga

SEQ ID NO: 4168307 - RNA, 21 nt, Yersinia pestis
gagaaaaaguauugcacugag

SEQ ID NO: 4168308 - RNA, 22 nt, Yersinia pestis
gagaaaaaguauugcacugaga

SEQ ID NO: 4168309 - RNA, 23 nt, Yersinia pestis
gagaaaauuucucuuuuauucuc

SEQ ID NO: 4168310 - RNA, 15 nt, Yersinia pestis
gagaaacaaaaccaa

SEQ ID NO: 4168311 - RNA, 16 nt, Yersinia pestis
gagaaacccauagcaa

SEQ ID NO: 4168312 - RNA, 22 nt, Yersinia pestis
gagaaaggauuugaagacaacu

SEQ ID NO: 4168313 - RNA, 18 nt, Yersinia pestis
gagaaagguuuaccgaug

SEQ ID NO: 4168314 - RNA, 15 nt, Yersinia pestis
gagaacaaugguuca

SEQ ID NO: 4168315 - RNA, 20 nt, Yersinia pestis
gagaacaaugguucaucauu

SEQ ID NO: 4168316 - RNA, 21 nt, Yersinia pestis
gagaacacaaaagacgccuuc

SEQ ID NO: 4168317 - RNA, 18 nt, Yersinia pestis
gagaacgggcaaccugua

SEQ ID NO: 4168318 - RNA, 13 nt, Yersinia pestis
gagaaguuuuugg

SEQ ID NO: 4168319 - RNA, 16 nt, Yersinia pestis
gagaauaaaaaugaua

SEQ ID NO: 4168320 - RNA, 17 nt, Yersinia pestis
gagaauaaaaaugauaa

SEQ ID NO: 4168321 - RNA, 15 nt, Yersinia pestis
gagaauaaaaccuaa

SEQ ID NO: 4168322 - RNA, 19 nt, Yersinia pestis
gagaauagacagaagcgua

SEQ ID NO: 4168323 - RNA, 17 nt, Yersinia pestis
gagaauauagagccguu

SEQ ID NO: 4168324 - RNA, 14 nt, Yersinia pestis
gagaaucaaucaau

SEQ ID NO: 4168325 - RNA, 12 nt, Yersinia pestis
gagaauguaaau

SEQ ID NO: 4168326 - RNA, 17 nt, Yersinia pestis
gagaauguuguuuauga

SEQ ID NO: 4168327 - RNA, 14 nt, Yersinia pestis
gagacaacaguaaa

SEQ ID NO: 4168328 - RNA, 15 nt, Yersinia pestis
gagacaagagcaaug

SEQ ID NO: 4168329 - RNA, 14 nt, Yersinia pestis
gagacauaaagccc

SEQ ID NO: 4168330 - RNA, 20 nt, Yersinia pestis
gagaccagguauuucuccau

SEQ ID NO: 4168331 - RNA, 20 nt, Yersinia pestis
gagacggaaagagccagcac

SEQ ID NO: 4168332 - RNA, 16 nt, Yersinia pestis
gagacuccucuucuuc

SEQ ID NO: 4168333 - RNA, 17 nt, Yersinia pestis
gagacuucgguauggcg

SEQ ID NO: 4168334 - RNA, 13 nt, Yersinia pestis
gagagaacaggca

SEQ ID NO: 4168335 - RNA, 22 nt, Yersinia pestis
gagagaacguucaaccaacuga

SEQ ID NO: 4168336 - RNA, 16 nt, Yersinia pestis
gagagaccagggcacc

SEQ ID NO: 4168337 - RNA, 22 nt, Yersinia pestis
gagagaggccagacacaaugcu

SEQ ID NO: 4168338 - RNA, 12 nt, Yersinia pestis
gagagcagggcc

SEQ ID NO: 4168339 - RNA, 14 nt, Yersinia pestis
gagaggagauuaga

SEQ ID NO: 4168340 - RNA, 15 nt, Yersinia pestis
gagaggcucgcuggu

SEQ ID NO: 4168341 - RNA, 22 nt, Yersinia pestis
gagaggcugaaggcgcuccccu

SEQ ID NO: 4168342 - RNA, 15 nt, Yersinia pestis
gagagugauuccagc

SEQ ID NO: 4168343 - RNA, 16 nt, Yersinia pestis
gagagugauuccagcu

SEQ ID NO: 4168344 - RNA, 13 nt, Yersinia pestis
gagauauaggcau

SEQ ID NO: 4168345 - RNA, 12 nt, Yersinia pestis
gagauaucaaau

SEQ ID NO: 4168346 - RNA, 20 nt, Yersinia pestis
gagauauuugucgcauuuau

SEQ ID NO: 4168347 - RNA, 16 nt, Yersinia pestis
gagaucagugccagua

SEQ ID NO: 4168348 - RNA, 17 nt, Yersinia pestis
gagauccuccauauccu

SEQ ID NO: 4168349 - RNA, 13 nt, Yersinia pestis
gagaucgauagca

SEQ ID NO: 4168350 - RNA, 22 nt, Yersinia pestis
gagaucguaggcuugagguuau

SEQ ID NO: 4168351 - RNA, 15 nt, Yersinia pestis
gagaucguaggcuuu

SEQ ID NO: 4168352 - RNA, 15 nt, Yersinia pestis
gagaugcaaucuaac

SEQ ID NO: 4168353 - RNA, 22 nt, Yersinia pestis
cgcuuuagugacuaauuguuug

SEQ ID NO: 4168354 - RNA, 12 nt, Yersinia pestis
cgcuuuaucgcc

SEQ ID NO: 4168355 - RNA, 20 nt, Yersinia pestis
cgcuuucagcacgcuuucca

SEQ ID NO: 4168356 - RNA, 14 nt, Yersinia pestis
cgcuuucuguucau

SEQ ID NO: 4168357 - RNA, 16 nt, Yersinia pestis
cgcuuuggucaacagc

SEQ ID NO: 4168358 - RNA, 12 nt, Yersinia pestis
cgcuuugugaug

SEQ ID NO: 4168359 - RNA, 16 nt, Yersinia pestis
cgcuuuuaccgaugca

SEQ ID NO: 4168360 - RNA, 22 nt, Yersinia pestis
cgcuuuucgcuaucaauuaaug

SEQ ID NO: 4168361 - RNA, 17 nt, Yersinia pestis
cgcuuuuuagcgaucag

SEQ ID NO: 4168362 - RNA, 16 nt, Yersinia pestis
cgcuuuuucgacaaaa

SEQ ID NO: 4168363 - RNA, 19 nt, Yersinia pestis
cggaaacaccuucacugaa

SEQ ID NO: 4168364 - RNA, 15 nt, Yersinia pestis
cggaaacguccaggg

SEQ ID NO: 4168365 - RNA, 15 nt, Yersinia pestis
cggaaaucagcuuca

SEQ ID NO: 4168366 - RNA, 22 nt, Yersinia pestis
cggaaaugccgauaaaaacuau

SEQ ID NO: 4168367 - RNA, 15 nt, Yersinia pestis
cggaaauuaaaaauu

SEQ ID NO: 4168368 - RNA, 14 nt, Yersinia pestis
cggaaggccagagu

SEQ ID NO: 4168369 - RNA, 18 nt, Yersinia pestis
cggaagguauccaauacc

SEQ ID NO: 4168370 - RNA, 17 nt, Yersinia pestis
cggaagugaguaucuuc

SEQ ID NO: 4168371 - RNA, 20 nt, Yersinia pestis
cggaaucaccuuucuccaug

SEQ ID NO: 4168372 - RNA, 22 nt, Yersinia pestis
cggaaucacugacuuggggcaa

SEQ ID NO: 4168373 - RNA, 14 nt, Yersinia pestis
cggacagcagcacg

SEQ ID NO: 4168374 - RNA, 19 nt, Yersinia pestis
cggacagcgcgcagccaac

SEQ ID NO: 4168375 - RNA, 17 nt, Yersinia pestis
cggacgccccaccgaua

SEQ ID NO: 4168376 - RNA, 19 nt, Yersinia pestis
cggacgcuuuacuccucug

SEQ ID NO: 4168377 - RNA, 16 nt, Yersinia pestis
cggagaauguuaaacc

SEQ ID NO: 4168378 - RNA, 16 nt, Yersinia pestis
cggagagaacaggcag

SEQ ID NO: 4168379 - RNA, 13 nt, Yersinia pestis
cggagcaagggcg

SEQ ID NO: 4168380 - RNA, 22 nt, Yersinia pestis
cggaggauauuuauuugauaau

SEQ ID NO: 4168381 - RNA, 16 nt, Yersinia pestis
cggaggcgauuaaacg

SEQ ID NO: 4168382 - RNA, 22 nt, Yersinia pestis
cggagucuaucugcaguauuug

SEQ ID NO: 4168383 - RNA, 20 nt, Yersinia pestis
cggauaaccgcauucccugc

SEQ ID NO: 4168384 - RNA, 22 nt, Yersinia pestis
cggauaaccgcgaagaggguuu

SEQ ID NO: 4168385 - RNA, 14 nt, Yersinia pestis
cggauacugaccca

SEQ ID NO: 4168386 - RNA, 15 nt, Yersinia pestis
cggauacuguuuggu

SEQ ID NO: 4168387 - RNA, 20 nt, Yersinia pestis
cggauagcgcuucagugauu

SEQ ID NO: 4168388 - RNA, 22 nt, Yersinia pestis
cggaucacuggcuagauagcca

SEQ ID NO: 4168389 - RNA, 13 nt, Yersinia pestis
cggaucagcgccu

SEQ ID NO: 4168390 - RNA, 14 nt, Yersinia pestis
cggaucaucaacca

SEQ ID NO: 4168391 - RNA, 15 nt, Yersinia pestis
cggaugaucagccga

SEQ ID NO: 4168392 - RNA, 17 nt, Yersinia pestis
cggaugcaucgggcaua

SEQ ID NO: 4168393 - RNA, 14 nt, Yersinia pestis
cggaugccagcuua

SEQ ID NO: 4168394 - RNA, 17 nt, Yersinia pestis
cggaugccgcuccagca

SEQ ID NO: 4168395 - RNA, 19 nt, Yersinia pestis
cggaugccggaaucagcca

SEQ ID NO: 4168396 - RNA, 18 nt, Yersinia pestis
cggcaaaagaacgugcug

SEQ ID NO: 4168397 - RNA, 14 nt, Yersinia pestis
cggcaacugccgcu

SEQ ID NO: 4168398 - RNA, 17 nt, Yersinia pestis
cggcaaguugaucaccc

SEQ ID NO: 4168399 - RNA, 23 nt, Yersinia pestis
cggcaaguuguucauagcggcca

SEQ ID NO: 4168400 - RNA, 15 nt, Yersinia pestis
cggcaauagcgauca

SEQ ID NO: 4168401 - RNA, 14 nt, Yersinia pestis
cggcaaucacuggc

SEQ ID NO: 4168402 - RNA, 15 nt, Yersinia pestis
cggcaaugaccauca

SEQ ID NO: 4168403 - RNA, 12 nt, Yersinia pestis
cggcacagccag

SEQ ID NO: 4168404 - RNA, 16 nt, Yersinia pestis
cggcaccaaccauuga

SEQ ID NO: 4168405 - RNA, 21 nt, Yersinia pestis
cggcacucaaauagauagcaa

SEQ ID NO: 4168406 - RNA, 17 nt, Yersinia pestis
cggcagagaucauguag

SEQ ID NO: 4168407 - RNA, 20 nt, Yersinia pestis
cggcagggcgguaacgcaga

SEQ ID NO: 4168408 - RNA, 12 nt, Yersinia pestis
cggcauaacagg

SEQ ID NO: 4168409 - RNA, 17 nt, Yersinia pestis
cggcauaacaggugcag

SEQ ID NO: 4168410 - RNA, 18 nt, Yersinia pestis
cggcauaauuucaggucg

SEQ ID NO: 4168411 - RNA, 17 nt, Yersinia pestis
cggcauacuccauuuuu

SEQ ID NO: 4168412 - RNA, 12 nt, Yersinia pestis
cggcaucagcaa

SEQ ID NO: 4168413 - RNA, 14 nt, Yersinia pestis
cggcaucagcaaag

SEQ ID NO: 4168414 - RNA, 22 nt, Yersinia pestis
cggcaucgaguccguuaaaaaa

SEQ ID NO: 4168415 - RNA, 21 nt, Yersinia pestis
cggcaugauagacgcaucgac

SEQ ID NO: 4168416 - RNA, 15 nt, Yersinia pestis
cggcaugcaacuugg

SEQ ID NO: 4168417 - RNA, 17 nt, Yersinia pestis
cggcaugcaacuuggca

SEQ ID NO: 4168418 - RNA, 23 nt, Yersinia pestis
cggcauuaaugcagguucauuac

SEQ ID NO: 4168419 - RNA, 20 nt, Yersinia pestis
cggccaacugcuggccaacu

SEQ ID NO: 4168420 - RNA, 16 nt, Yersinia pestis
cggccacccgccauca

SEQ ID NO: 4168421 - RNA, 19 nt, Yersinia pestis
cggccacucgcaucgccug

SEQ ID NO: 4168422 - RNA, 23 nt, Yersinia pestis
cggccagcaaccuggcggcccga

SEQ ID NO: 4168423 - RNA, 16 nt, Yersinia pestis
cggccagcauucaggc

SEQ ID NO: 4168424 - RNA, 12 nt, Yersinia pestis
cggccagugaug

SEQ ID NO: 4168425 - RNA, 18 nt, Yersinia pestis
cggccaguguuuucucca

SEQ ID NO: 4168426 - RNA, 18 nt, Yersinia pestis
cggccaucuaacugcaca

SEQ ID NO: 4168427 - RNA, 22 nt, Yersinia pestis
cggccauuuacccgucauccuu

SEQ ID NO: 4168428 - RNA, 17 nt, Yersinia pestis
cggccauuugcucuggc

SEQ ID NO: 4168429 - RNA, 13 nt, Yersinia pestis
cggcccaacuggc

SEQ ID NO: 4168430 - RNA, 14 nt, Yersinia pestis
cggcccggccaggc

SEQ ID NO: 4168431 - RNA, 16 nt, Yersinia pestis
cggcccggccaggcuc

SEQ ID NO: 4168432 - RNA, 13 nt, Yersinia pestis
cggcccucuuggc

SEQ ID NO: 4168433 - RNA, 22 nt, Yersinia pestis
cggcccugagguugcucagcgg

SEQ ID NO: 4168434 - RNA, 14 nt, Yersinia pestis
cggccgggcugaca

SEQ ID NO: 4168435 - RNA, 22 nt, Yersinia pestis
cggccgguuucaccgcuuagca

SEQ ID NO: 4168436 - RNA, 17 nt, Yersinia pestis
cggccuaucaucaccau

SEQ ID NO: 4168437 - RNA, 23 nt, Yersinia pestis
cggcgaaagcauggcagguauca

SEQ ID NO: 4168438 - RNA, 15 nt, Yersinia pestis
cggcgacuuacgucg

SEQ ID NO: 4168439 - RNA, 17 nt, Yersinia pestis
cggcgagcacugccccg

SEQ ID NO: 4168440 - RNA, 21 nt, Yersinia pestis
cggcgauggaccaugccauca

SEQ ID NO: 4168441 - RNA, 14 nt, Yersinia pestis
cggcgcaagcgaua

SEQ ID NO: 4168442 - RNA, 18 nt, Yersinia pestis
cggcgcaagcgauaguua

SEQ ID NO: 4168443 - RNA, 19 nt, Yersinia pestis
cggcgccgucacguacugg

SEQ ID NO: 4168444 - RNA, 15 nt, Yersinia pestis
cggcggaucaagcgc

SEQ ID NO: 4168445 - RNA, 15 nt, Yersinia pestis
cggcggcgcuggcgu

SEQ ID NO: 4168446 - RNA, 14 nt, Yersinia pestis
cggcguaaauaaaa

SEQ ID NO: 4168447 - RNA, 15 nt, Yersinia pestis
cggcgucaaggacgc

SEQ ID NO: 4168448 - RNA, 18 nt, Yersinia pestis
cggcgucgccaccccauu

SEQ ID NO: 4168449 - RNA, 14 nt, Yersinia pestis
cggcgucugauaac

SEQ ID NO: 4168450 - RNA, 15 nt, Yersinia pestis
cggcgucuugaucaa

SEQ ID NO: 4168451 - RNA, 21 nt, Yersinia pestis
cggcguuaaugccacccccag

SEQ ID NO: 4168452 - RNA, 15 nt, Yersinia pestis
cggcguucagcaaua

SEQ ID NO: 4168453 - RNA, 16 nt, Yersinia pestis
cggcuaaccacagcaa

SEQ ID NO: 4168454 - RNA, 23 nt, Yersinia pestis
cggcuaccgugcugccauauauu

SEQ ID NO: 4168455 - RNA, 16 nt, Yersinia pestis
cggcuagcguuaugcu

SEQ ID NO: 4168456 - RNA, 13 nt, Yersinia pestis
cggcuaggcucag

SEQ ID NO: 4168457 - RNA, 20 nt, Yersinia pestis
cggcucacacacuaauaaua

SEQ ID NO: 4168458 - RNA, 21 nt, Yersinia pestis
cggcucaccugcgggauagca

SEQ ID NO: 4168459 - RNA, 15 nt, Yersinia pestis
cggcuccaggcauua

SEQ ID NO: 4168460 - RNA, 17 nt, Yersinia pestis
cggcuccaggcauuaaa

SEQ ID NO: 4168461 - RNA, 20 nt, Yersinia pestis
cggcucuaucgauaaaguca

SEQ ID NO: 4168462 - RNA, 18 nt, Yersinia pestis
cggcucuauuucaugauu

SEQ ID NO: 4168463 - RNA, 17 nt, Yersinia pestis
cggcucucuuucuccaa

SEQ ID NO: 4168464 - RNA, 13 nt, Yersinia pestis
cggcugcaauaag

SEQ ID NO: 4168465 - RNA, 22 nt, Yersinia pestis
cggcuggaaauauuggcaacaa

SEQ ID NO: 4168466 - RNA, 12 nt, Yersinia pestis
cggcugguaaca

SEQ ID NO: 4168467 - RNA, 22 nt, Yersinia pestis
cggcuuaaccaacaacuccacu

SEQ ID NO: 4168468 - RNA, 22 nt, Yersinia pestis
cggcuuaccgccgccagccuug

SEQ ID NO: 4168469 - RNA, 23 nt, Yersinia pestis
cggcuugggagucagaugccgcu

SEQ ID NO: 4168470 - RNA, 16 nt, Yersinia pestis
cggcuuuauaguccuu

SEQ ID NO: 4168471 - RNA, 14 nt, Yersinia pestis
cggcuuucaauaaa

SEQ ID NO: 4168472 - RNA, 16 nt, Yersinia pestis
cggcuuuuaucuucca

SEQ ID NO: 4168473 - RNA, 22 nt, Yersinia pestis
cggcuuuuuaaacuuguaucaa

SEQ ID NO: 4168474 - RNA, 23 nt, Yersinia pestis
cgggaacaggaucugcuccucuu

SEQ ID NO: 4168475 - RNA, 15 nt, Yersinia pestis
cgggacgcguuugcu

SEQ ID NO: 4168476 - RNA, 23 nt, Yersinia pestis
cgggagauuaauacaucaucaaa

SEQ ID NO: 4168477 - RNA, 14 nt, Yersinia pestis
cgggagccgcacaa

SEQ ID NO: 4168478 - RNA, 22 nt, Yersinia pestis
cgggaggaaggcuugaacguga

SEQ ID NO: 4168479 - RNA, 22 nt, Yersinia pestis
cgggaggauaaguuccggcaga

SEQ ID NO: 4168480 - RNA, 12 nt, Yersinia pestis
cgggauaauaga

SEQ ID NO: 4168481 - RNA, 23 nt, Yersinia pestis
cgggaugcgcucgcuugcugccu

SEQ ID NO: 4168482 - RNA, 13 nt, Yersinia pestis
cgggcaccaugcc

SEQ ID NO: 4168483 - RNA, 19 nt, Yersinia pestis
cgggcacgauuugaucacg

SEQ ID NO: 4168484 - RNA, 17 nt, Yersinia pestis
cgggcacuaucaccgcg

SEQ ID NO: 4168485 - RNA, 19 nt, Yersinia pestis
cgggcacuuugucaauaac

SEQ ID NO: 4168486 - RNA, 22 nt, Yersinia pestis
cgggccagcaaccacgguauca

SEQ ID NO: 4168487 - RNA, 20 nt, Yersinia pestis
cgggcgcugagcgggcggca

SEQ ID NO: 4168488 - RNA, 19 nt, Yersinia pestis
cgggcgcuuaaauaaaaca

SEQ ID NO: 4168489 - RNA, 15 nt, Yersinia pestis
cgggcggccucugcu

SEQ ID NO: 4168490 - RNA, 21 nt, Yersinia pestis
cgggcuaucaucaaaggcaau

SEQ ID NO: 4168491 - RNA, 22 nt, Yersinia pestis
cgggcuaucaucaaaggcaaua

SEQ ID NO: 4168492 - RNA, 15 nt, Yersinia pestis
cgggcucaugcagca

SEQ ID NO: 4168493 - RNA, 22 nt, Yersinia pestis
cgggcuggggcaagcucguugg

SEQ ID NO: 4168494 - RNA, 15 nt, Yersinia pestis
cgggcuucaccaucu

SEQ ID NO: 4168495 - RNA, 17 nt, Yersinia pestis
cgggcuuccaucaggaa

SEQ ID NO: 4168496 - RNA, 16 nt, Yersinia pestis
cgggcuugcugcaacc

SEQ ID NO: 4168497 - RNA, 22 nt, Yersinia pestis
cgggcuuuuuuucggcaucuua

SEQ ID NO: 4168498 - RNA, 22 nt, Yersinia pestis
cggggaagagauaaaucggcgg

SEQ ID NO: 4168499 - RNA, 17 nt, Yersinia pestis
cggggauccauaggauc

SEQ ID NO: 4168500 - RNA, 22 nt, Yersinia pestis
cggggcacuccgguggcuuacg

SEQ ID NO: 4168501 - RNA, 16 nt, Yersinia pestis
cggggccaucaucuuc

SEQ ID NO: 4168502 - RNA, 22 nt, Yersinia pestis
cggggguuaaggggcucacccg

SEQ ID NO: 4168503 - RNA, 16 nt, Yersinia pestis
cggggguugucagcag

SEQ ID NO: 4168504 - RNA, 19 nt, Yersinia pestis
cggggucuuuucgguaaua

SEQ ID NO: 4168505 - RNA, 14 nt, Yersinia pestis
cggguauauugccc

SEQ ID NO: 4168506 - RNA, 16 nt, Yersinia pestis
cggguauuugucgucc

SEQ ID NO: 4168507 - RNA, 14 nt, Yersinia pestis
cgggucagcugacg

SEQ ID NO: 4168508 - RNA, 15 nt, Yersinia pestis
cgggucagugaaaaa

SEQ ID NO: 4168509 - RNA, 14 nt, Yersinia pestis
cgggugagugagcg

SEQ ID NO: 4168510 - RNA, 17 nt, Yersinia pestis
cggguggaccuccauca

SEQ ID NO: 4168511 - RNA, 17 nt, Yersinia pestis
cggguggcgcugacggu

SEQ ID NO: 4168512 - RNA, 16 nt, Yersinia pestis
cggguggugaaaucgg

SEQ ID NO: 4168513 - RNA, 16 nt, Yersinia pestis
cggguuaacuuuuucu

SEQ ID NO: 4168514 - RNA, 17 nt, Yersinia pestis
cggguuaacuuuuucua

SEQ ID NO: 4168515 - RNA, 13 nt, Yersinia pestis
cggguucuaaauc

SEQ ID NO: 4168516 - RNA, 15 nt, Yersinia pestis
cggguucuaaauccu

SEQ ID NO: 4168517 - RNA, 20 nt, Yersinia pestis
cggguugcccaucagcauca

SEQ ID NO: 4168518 - RNA, 17 nt, Yersinia pestis
cggguuuacccagccaa

SEQ ID NO: 4168519 - RNA, 15 nt, Yersinia pestis
cggguuuugcaucaa

SEQ ID NO: 4168520 - RNA, 16 nt, Yersinia pestis
cggguuuugucggcgg

SEQ ID NO: 4168521 - RNA, 21 nt, Yersinia pestis
cgguaaauggcgugcacugac

SEQ ID NO: 4168522 - RNA, 17 nt, Yersinia pestis
cgguaacauauaaacca

SEQ ID NO: 4168523 - RNA, 14 nt, Yersinia pestis
cgguaaccagcauc

SEQ ID NO: 4168524 - RNA, 18 nt, Yersinia pestis
cgguaacgcagauaaauc

SEQ ID NO: 4168525 - RNA, 23 nt, Yersinia pestis
cgguaacgcagauaaaucagugg

SEQ ID NO: 4168526 - RNA, 23 nt, Yersinia pestis
cgguaacuuuuuguugcaccaac

SEQ ID NO: 4168527 - RNA, 15 nt, Yersinia pestis
cgguaauaaaucaug

SEQ ID NO: 4168528 - RNA, 22 nt, Yersinia pestis
cgguaauauccacauuggaauu

SEQ ID NO: 4168529 - RNA, 23 nt, Yersinia pestis
cgguaaucccgauauaaauaaaa

SEQ ID NO: 4168530 - RNA, 22 nt, Yersinia pestis
cgguaaugacauauucaaccgc

SEQ ID NO: 4168531 - RNA, 22 nt, Yersinia pestis
cgguaaugagccgcauugaucc

SEQ ID NO: 4168532 - RNA, 17 nt, Yersinia pestis
cgguaauggccaauuuu

SEQ ID NO: 4168533 - RNA, 14 nt, Yersinia pestis
cgguaauuaauaua

SEQ ID NO: 4168534 - RNA, 19 nt, Yersinia pestis
cgguaccggcgguuaucac

SEQ ID NO: 4168535 - RNA, 15 nt, Yersinia pestis
cgguacugaaaucca

SEQ ID NO: 4168536 - RNA, 15 nt, Yersinia pestis
cgguagaccaccaac

SEQ ID NO: 4168537 - RNA, 18 nt, Yersinia pestis
cgguagguuucugggcug

SEQ ID NO: 4168538 - RNA, 14 nt, Yersinia pestis
cgguaguaauaauu

SEQ ID NO: 4168539 - RNA, 24 nt, Yersinia pestis
cgguaucaacaauuuccauaucaa

SEQ ID NO: 4168540 - RNA, 18 nt, Yersinia pestis
cgguauccaucccaacaa

SEQ ID NO: 4168541 - RNA, 15 nt, Yersinia pestis
cgguaucgauaugaa

SEQ ID NO: 4168542 - RNA, 18 nt, Yersinia pestis
cgguauuaccaaucagcg

SEQ ID NO: 4168543 - RNA, 16 nt, Yersinia pestis
cgguauuugaacuuca

SEQ ID NO: 4168544 - RNA, 21 nt, Yersinia pestis
cggucaauaccauauccacgg

SEQ ID NO: 4168545 - RNA, 18 nt, Yersinia pestis
cggucacaccagacagaa

SEQ ID NO: 4168546 - RNA, 21 nt, Yersinia pestis
cggucagguggugcccgacca

SEQ ID NO: 4168547 - RNA, 14 nt, Yersinia pestis
cggucaucagcccu

SEQ ID NO: 4168548 - RNA, 22 nt, Yersinia pestis
cggucauugagcggcaacugua

SEQ ID NO: 4168549 - RNA, 20 nt, Yersinia pestis
cggucauuguagauggccau

SEQ ID NO: 4168550 - RNA, 14 nt, Yersinia pestis
cggucucuggaugc

SEQ ID NO: 4168551 - RNA, 23 nt, Yersinia pestis
cggucugaagagaaauaacccau

SEQ ID NO: 4168552 - RNA, 13 nt, Yersinia pestis
cggucuguuaauc

SEQ ID NO: 4168553 - RNA, 19 nt, Yersinia pestis
cggucuguuaauccuaaug

SEQ ID NO: 4168554 - RNA, 16 nt, Yersinia pestis
cggugaauacguucaa

SEQ ID NO: 4168555 - RNA, 21 nt, Yersinia pestis
cggugacauccgcuugcagca

SEQ ID NO: 4168556 - RNA, 17 nt, Yersinia pestis
cggugacccgugcggca

SEQ ID NO: 4168557 - RNA, 11 nt, Yersinia pestis
cggugaggaua

SEQ ID NO: 4168558 - RNA, 22 nt, Yersinia pestis
cggugauuacugucauuuccuc

SEQ ID NO: 4168559 - RNA, 15 nt, Yersinia pestis
cggugcugacaaaca

SEQ ID NO: 4168560 - RNA, 14 nt, Yersinia pestis
cggugcuggugggc

SEQ ID NO: 4168561 - RNA, 23 nt, Yersinia pestis
cgguggauuacauaacaccaauu

SEQ ID NO: 4168562 - RNA, 21 nt, Yersinia pestis
cgguggcaugccaauuauucu

SEQ ID NO: 4168563 - RNA, 13 nt, Yersinia pestis
cgguggccgccuu

SEQ ID NO: 4168564 - RNA, 19 nt, Yersinia pestis
cggugugacuuucaaucgc

SEQ ID NO: 4168565 - RNA, 14 nt, Yersinia pestis
cgguguggcaccau

SEQ ID NO: 4168566 - RNA, 22 nt, Yersinia pestis
cgguguuagaucggccaaugcu

SEQ ID NO: 4168567 - RNA, 21 nt, Yersinia pestis
cgguguuccacaauguugaua

SEQ ID NO: 4168568 - RNA, 15 nt, Yersinia pestis
cgguguuuggugaag

SEQ ID NO: 4168569 - RNA, 18 nt, Yersinia pestis
cgguguuuuuuuguuacu

SEQ ID NO: 4168570 - RNA, 18 nt, Yersinia pestis
cgguuaaacuucuuuauc

SEQ ID NO: 4168571 - RNA, 19 nt, Yersinia pestis
cgguuaaacuucuuuaucu

SEQ ID NO: 4168572 - RNA, 13 nt, Yersinia pestis
cgguuaaauacag

SEQ ID NO: 4168573 - RNA, 17 nt, Yersinia pestis
cgguuaauugaauugcc

SEQ ID NO: 4168574 - RNA, 16 nt, Yersinia pestis
cgguuacuuccauaaa

SEQ ID NO: 4168575 - RNA, 13 nt, Yersinia pestis
cgguuaucacauc

SEQ ID NO: 4168576 - RNA, 15 nt, Yersinia pestis
cgguuaucuggaauu

SEQ ID NO: 4168577 - RNA, 12 nt, Yersinia pestis
cgguuauuuucu

SEQ ID NO: 4168578 - RNA, 16 nt, Yersinia pestis
cgguucccaugacgau

SEQ ID NO: 4168579 - RNA, 24 nt, Yersinia pestis
cgguucuguaucauauguucgauc

SEQ ID NO: 4168580 - RNA, 18 nt, Yersinia pestis
cgguugacguuugccaaa

SEQ ID NO: 4168581 - RNA, 19 nt, Yersinia pestis
cgguugccagccaggauag

SEQ ID NO: 4168582 - RNA, 20 nt, Yersinia pestis
cgguugcuguaaugccuggu

SEQ ID NO: 4168583 - RNA, 20 nt, Yersinia pestis
cgguuggccguuaugccaac

SEQ ID NO: 4168584 - RNA, 16 nt, Yersinia pestis
cgguuguauacaauug

SEQ ID NO: 4168585 - RNA, 19 nt, Yersinia pestis
cgguugucggcauaacagg

SEQ ID NO: 4168586 - RNA, 16 nt, Yersinia pestis
cgguuucacccucuuu

SEQ ID NO: 4168587 - RNA, 23 nt, Yersinia pestis
cgguuuccugcggggaucgggcu

SEQ ID NO: 4168588 - RNA, 19 nt, Yersinia pestis
cgguuucgcaucaggcuua

SEQ ID NO: 4168589 - RNA, 15 nt, Yersinia pestis
cgguuuuaucaauag

SEQ ID NO: 4168590 - RNA, 17 nt, Yersinia pestis
cgguuuuaucaauaggu

SEQ ID NO: 4168591 - RNA, 14 nt, Yersinia pestis
cguaaaaaacccuc

SEQ ID NO: 4168592 - RNA, 20 nt, Yersinia pestis
cguaaacaaugaccaucuuc

SEQ ID NO: 4168593 - RNA, 18 nt, Yersinia pestis
cguaaacguucugccaau

SEQ ID NO: 4168594 - RNA, 15 nt, Yersinia pestis
cguaaagaaaaaaug

SEQ ID NO: 4168595 - RNA, 14 nt, Yersinia pestis
cguaaagacgccgg

SEQ ID NO: 4168596 - RNA, 14 nt, Yersinia pestis
cguaaagacgccgu

SEQ ID NO: 4168597 - RNA, 11 nt, Yersinia pestis
cguaaauacau

SEQ ID NO: 4168598 - RNA, 15 nt, Yersinia pestis
cguaaauacauccau

SEQ ID NO: 4168599 - RNA, 16 nt, Yersinia pestis
cguaaauacauccaug

SEQ ID NO: 4168600 - RNA, 17 nt, Yersinia pestis
cguaaaucauagccagc

SEQ ID NO: 4168601 - RNA, 18 nt, Yersinia pestis
cguaacaugcagcccgac

SEQ ID NO: 4168602 - RNA, 17 nt, Yersinia pestis
cguaacgaauucagcag

SEQ ID NO: 4168603 - RNA, 19 nt, Yersinia pestis
cguaacgaauucagcagcg

SEQ ID NO: 4168604 - RNA, 12 nt, Yersinia pestis
cguaagauuggg

SEQ ID NO: 4168605 - RNA, 13 nt, Yersinia pestis
cguaauaccacua

SEQ ID NO: 4168606 - RNA, 23 nt, Yersinia pestis
cguaauaguuaaucgcagcagag

SEQ ID NO: 4168607 - RNA, 17 nt, Yersinia pestis
cguaauauuucaagcug

SEQ ID NO: 4168608 - RNA, 16 nt, Yersinia pestis
cguaaucucucacagc

SEQ ID NO: 4168609 - RNA, 17 nt, Yersinia pestis
cguaaucucucacagcg

SEQ ID NO: 4168610 - RNA, 17 nt, Yersinia pestis
cguaauuauuguucaaa

SEQ ID NO: 4168611 - RNA, 19 nt, Yersinia pestis
cguaauucagauaagaucu

SEQ ID NO: 4168612 - RNA, 18 nt, Yersinia pestis
cguaauucccaccacuug

SEQ ID NO: 4168613 - RNA, 15 nt, Yersinia pestis
cguaauuuacuggua

SEQ ID NO: 4168614 - RNA, 21 nt, Yersinia pestis
cguacaaaaauaaacgggcuu

SEQ ID NO: 4168615 - RNA, 19 nt, Yersinia pestis
cguacaacaauaauaagcc

SEQ ID NO: 4168616 - RNA, 21 nt, Yersinia pestis
cguacauauaucacuauuuca

SEQ ID NO: 4168617 - RNA, 15 nt, Yersinia pestis
cguacaucucuuggg

SEQ ID NO: 4168618 - RNA, 11 nt, Yersinia pestis
cguacauuaaa

SEQ ID NO: 4168619 - RNA, 16 nt, Yersinia pestis
cguaccaaaucagcaa

SEQ ID NO: 4168620 - RNA, 13 nt, Yersinia pestis
cguaccacaagcc

SEQ ID NO: 4168621 - RNA, 13 nt, Yersinia pestis
cguacgacgucca

SEQ ID NO: 4168622 - RNA, 18 nt, Yersinia pestis
cguacuggcgcgcuuugg

SEQ ID NO: 4168623 - RNA, 12 nt, Yersinia pestis
cguacuuuccuu

SEQ ID NO: 4168624 - RNA, 20 nt, Yersinia pestis
cguacuuugguugugaucca

SEQ ID NO: 4168625 - RNA, 22 nt, Yersinia pestis
cguagccauuggguauggucag

SEQ ID NO: 4168626 - RNA, 22 nt, Yersinia pestis
cguagcccuuugcuuucaggau

SEQ ID NO: 4168627 - RNA, 14 nt, Yersinia pestis
cguagccguuaaau

SEQ ID NO: 4168628 - RNA, 18 nt, Yersinia pestis
cguagcgguuucgcauca

SEQ ID NO: 4168629 - RNA, 15 nt, Yersinia pestis
cguaggcaaacaugg

SEQ ID NO: 4168630 - RNA, 12 nt, Yersinia pestis
cguaggccaacc

SEQ ID NO: 4168631 - RNA, 12 nt, Yersinia pestis
cguaggcugacc

SEQ ID NO: 4168632 - RNA, 14 nt, Yersinia pestis
cguaggcugaccac

SEQ ID NO: 4168633 - RNA, 14 nt, Yersinia pestis
cguagggauaaauc

SEQ ID NO: 4168634 - RNA, 12 nt, Yersinia pestis
cguagguaauua

SEQ ID NO: 4168635 - RNA, 19 nt, Yersinia pestis
cguagguaguggcugauac

SEQ ID NO: 4168636 - RNA, 16 nt, Yersinia pestis
cguauaacgcagcccc

SEQ ID NO: 4168637 - RNA, 15 nt, Yersinia pestis
cguauagauuauuuu

SEQ ID NO: 4168638 - RNA, 15 nt, Yersinia pestis
cguauauuggccugc

SEQ ID NO: 4168639 - RNA, 23 nt, Yersinia pestis
cguaucacccgccucuaaaucug

SEQ ID NO: 4168640 - RNA, 17 nt, Yersinia pestis
cguaucguccagcagca

SEQ ID NO: 4168641 - RNA, 20 nt, Yersinia pestis
cguaucuuguaguaaccaca

SEQ ID NO: 4168642 - RNA, 15 nt, Yersinia pestis
cguauggggaaaagc

SEQ ID NO: 4168643 - RNA, 19 nt, Yersinia pestis
cguauguuuuuaacaaaau

SEQ ID NO: 4168644 - RNA, 22 nt, Yersinia pestis
cguauuaaaccagugcgccgua

SEQ ID NO: 4168645 - RNA, 14 nt, Yersinia pestis
cguauucagcacug

SEQ ID NO: 4168646 - RNA, 19 nt, Yersinia pestis
cgucaagacaacaaacagu

SEQ ID NO: 4168647 - RNA, 14 nt, Yersinia pestis
cgucaaguucauau

SEQ ID NO: 4168648 - RNA, 18 nt, Yersinia pestis
cgucaauucacugcuagu

SEQ ID NO: 4168649 - RNA, 18 nt, Yersinia pestis
cgucaccacaaaggucag

SEQ ID NO: 4168650 - RNA, 12 nt, Yersinia pestis
cgucaccaucaa

SEQ ID NO: 4168651 - RNA, 23 nt, Yersinia pestis
cgucaccaucaauauaagagaaa

SEQ ID NO: 4168652 - RNA, 19 nt, Yersinia pestis
cgucacggcgcuccaucag

SEQ ID NO: 4168653 - RNA, 21 nt, Yersinia pestis
cgucacgguauuggagcugaa

SEQ ID NO: 4168654 - RNA, 24 nt, Yersinia pestis
cgucacguacuggguguacgcucc

SEQ ID NO: 4168655 - RNA, 17 nt, Yersinia pestis
cgucacuaaauccaaau

SEQ ID NO: 4168656 - RNA, 12 nt, Yersinia pestis
cgucacuuccau

SEQ ID NO: 4168657 - RNA, 16 nt, Yersinia pestis
cgucacuuugacguua

SEQ ID NO: 4168658 - RNA, 13 nt, Yersinia pestis
cgucagaugcuga

SEQ ID NO: 4168659 - RNA, 12 nt, Yersinia pestis
cgucagauuagu

SEQ ID NO: 4168660 - RNA, 21 nt, Yersinia pestis
cgucagucuugcugccaacgc

SEQ ID NO: 4168661 - RNA, 19 nt, Yersinia pestis
cgucagugcgguaaccagc

SEQ ID NO: 4168662 - RNA, 14 nt, Yersinia pestis
cgucauaaauaaag

SEQ ID NO: 4168663 - RNA, 16 nt, Yersinia pestis
cgucauaaauaaagau

SEQ ID NO: 4168664 - RNA, 19 nt, Yersinia pestis
cgucauaccauucucuguc

SEQ ID NO: 4168665 - RNA, 16 nt, Yersinia pestis
cgucaucaucuucuuc

SEQ ID NO: 4168666 - RNA, 14 nt, Yersinia pestis
cgucauccagcacu

SEQ ID NO: 4168667 - RNA, 15 nt, Yersinia pestis
cgucaucgaacccgc

SEQ ID NO: 4168668 - RNA, 13 nt, Yersinia pestis
cgucaugauugag

SEQ ID NO: 4168669 - RNA, 13 nt, Yersinia pestis
cgucauucaccac

SEQ ID NO: 4168670 - RNA, 21 nt, Yersinia pestis
cgucauugaggguugucagca

SEQ ID NO: 4168671 - RNA, 22 nt, Yersinia pestis
cgucauuuccguuaacccaaag

SEQ ID NO: 4168672 - RNA, 21 nt, Yersinia pestis
cgucccauuccguuuaaacuc

SEQ ID NO: 4168673 - RNA, 14 nt, Yersinia pestis
cgucccuaaagcca

SEQ ID NO: 4168674 - RNA, 21 nt, Yersinia pestis
cgucccuaaagccaucgccau

SEQ ID NO: 4168675 - RNA, 18 nt, Yersinia pestis
cguccgcuuagcaggccc

SEQ ID NO: 4168676 - RNA, 12 nt, Yersinia pestis
cguccggcggcu

SEQ ID NO: 4168677 - RNA, 16 nt, Yersinia pestis
cguccggcggcuagca

SEQ ID NO: 4168678 - RNA, 23 nt, Yersinia pestis
cguccuugaugguucagccacca

SEQ ID NO: 4168679 - RNA, 15 nt, Yersinia pestis
cgucgccgcagaaga

SEQ ID NO: 4168680 - RNA, 15 nt, Yersinia pestis
cgucgugauaaacaa

SEQ ID NO: 4168681 - RNA, 22 nt, Yersinia pestis
cgucuaacaguuguuucaauaa

SEQ ID NO: 4168682 - RNA, 16 nt, Yersinia pestis
cgucuaauugcugccc

SEQ ID NO: 4168683 - RNA, 18 nt, Yersinia pestis
cgucuacgcucuccucuc

SEQ ID NO: 4168684 - RNA, 17 nt, Yersinia pestis
cgucuccauuucaacgu

SEQ ID NO: 4168685 - RNA, 19 nt, Yersinia pestis
cgucuccauuucaacguca

SEQ ID NO: 4168686 - RNA, 18 nt, Yersinia pestis
cgucucuaacccauuggu

SEQ ID NO: 4168687 - RNA, 13 nt, Yersinia pestis
cgucucuuuuuca

SEQ ID NO: 4168688 - RNA, 21 nt, Yersinia pestis
cgucugacggguauaucacuu

SEQ ID NO: 4168689 - RNA, 13 nt, Yersinia pestis
cgucugauaaccg

SEQ ID NO: 4168690 - RNA, 16 nt, Yersinia pestis
cgucugcaauagcuca

SEQ ID NO: 4168691 - RNA, 14 nt, Yersinia pestis
cgucugccauugcu

SEQ ID NO: 4168692 - RNA, 21 nt, Yersinia pestis
cgucuggcuaauacugccaau

SEQ ID NO: 4168693 - RNA, 19 nt, Yersinia pestis
cgucuucgcauucuuuauc

SEQ ID NO: 4168694 - RNA, 16 nt, Yersinia pestis
cgucuugaucaacuca

SEQ ID NO: 4168695 - RNA, 21 nt, Yersinia pestis
cgucuuuaucgccagcugcaa

SEQ ID NO: 4168696 - RNA, 21 nt, Yersinia pestis
cgucuuugaccgaaccaccgc

SEQ ID NO: 4168697 - RNA, 17 nt, Yersinia pestis
cgucuuuuaccaaugaa

SEQ ID NO: 4168698 - RNA, 13 nt, Yersinia pestis
cgugaacaucugg

SEQ ID NO: 4168699 - RNA, 17 nt, Yersinia pestis
cgugaacaucuggcgau

SEQ ID NO: 4168700 - RNA, 20 nt, Yersinia pestis
cgugaacauugcaguauuuu

SEQ ID NO: 4168701 - RNA, 16 nt, Yersinia pestis
cgugaauaaaaauaag

SEQ ID NO: 4168702 - RNA, 13 nt, Yersinia pestis
cgugagcaucugg

SEQ ID NO: 4168703 - RNA, 15 nt, Yersinia pestis
cgugagcaucuggcg

SEQ ID NO: 4168704 - RNA, 20 nt, Yersinia pestis
cgugagucagguggcuauuc

SEQ ID NO: 4168705 - RNA, 17 nt, Yersinia pestis
cgugauaugccugaagu

SEQ ID NO: 4168706 - RNA, 16 nt, Yersinia pestis
cgugauggcgcagacc

SEQ ID NO: 4168707 - RNA, 22 nt, Yersinia pestis
cgugauugguaaacugccaaua

SEQ ID NO: 4168708 - RNA, 16 nt, Yersinia pestis
cgugauugguuuaucc

SEQ ID NO: 4168709 - RNA, 21 nt, Yersinia pestis
cgugauuuuuauauuuugaga

SEQ ID NO: 4168710 - RNA, 22 nt, Yersinia pestis
cgugcaauaaagcgauaaauac

SEQ ID NO: 4168711 - RNA, 14 nt, Yersinia pestis
cgugcagaacaaaa

SEQ ID NO: 4168712 - RNA, 14 nt, Yersinia pestis
cgugcagcgcgcag

SEQ ID NO: 4168713 - RNA, 16 nt, Yersinia pestis
cgugcagcgcgcagcc

SEQ ID NO: 4168714 - RNA, 19 nt, Yersinia pestis
cgugcagcgcgcagccaac

SEQ ID NO: 4168715 - RNA, 16 nt, Yersinia pestis
cgugccagauccucuu

SEQ ID NO: 4168716 - RNA, 17 nt, Yersinia pestis
cgugccaggugugccca

SEQ ID NO: 4168717 - RNA, 21 nt, Yersinia pestis
cgugcguuuuugaaauaccac

SEQ ID NO: 4168718 - RNA, 21 nt, Yersinia pestis
cgugcucaucaaccucagccu

SEQ ID NO: 4168719 - RNA, 18 nt, Yersinia pestis
cgugcuuugccuucuagc

SEQ ID NO: 4168720 - RNA, 18 nt, Yersinia pestis
cguggaguagagcuucca

SEQ ID NO: 4168721 - RNA, 21 nt, Yersinia pestis
cguggaguagagcuuccagug

SEQ ID NO: 4168722 - RNA, 17 nt, Yersinia pestis
cguggcauaaucaacgc

SEQ ID NO: 4168723 - RNA, 16 nt, Yersinia pestis
cguggcauugagguug

SEQ ID NO: 4168724 - RNA, 16 nt, Yersinia pestis
cguggcauugagguuu

SEQ ID NO: 4168725 - RNA, 21 nt, Yersinia pestis
cguggccccaagcauagaaga

SEQ ID NO: 4168726 - RNA, 21 nt, Yersinia pestis
cguggcccuuucgcagcccaa

SEQ ID NO: 4168727 - RNA, 15 nt, Yersinia pestis
cgugggcgcagguaa

SEQ ID NO: 4168728 - RNA, 21 nt, Yersinia pestis
cgugggcguagaagaauaucu

SEQ ID NO: 4168729 - RNA, 12 nt, Yersinia pestis
cguggugaugau

SEQ ID NO: 4168730 - RNA, 14 nt, Yersinia pestis
cguggugaugauga

SEQ ID NO: 4168731 - RNA, 19 nt, Yersinia pestis
cgugguuauugcgccauca

SEQ ID NO: 4168732 - RNA, 21 nt, Yersinia pestis
cgugguuuccuggaacgaagc

SEQ ID NO: 4168733 - RNA, 13 nt, Yersinia pestis
cguguaaaaccuu

SEQ ID NO: 4168734 - RNA, 19 nt, Yersinia pestis
cguguaguuauugauuaau

SEQ ID NO: 4168735 - RNA, 23 nt, Yersinia pestis
cguguauaucacuauuucagaca

SEQ ID NO: 4168736 - RNA, 17 nt, Yersinia pestis
cgugucaaaccaauuuc

SEQ ID NO: 4168737 - RNA, 21 nt, Yersinia pestis
cgugucaauauucuguuaguc

SEQ ID NO: 4168738 - RNA, 18 nt, Yersinia pestis
cgugucagacugcugaca

SEQ ID NO: 4168739 - RNA, 21 nt, Yersinia pestis
cgugucagacugcugacaaac

SEQ ID NO: 4168740 - RNA, 13 nt, Yersinia pestis
cgugugauaaacu

SEQ ID NO: 4168741 - RNA, 14 nt, Yersinia pestis
cgugugauuuccau

SEQ ID NO: 4168742 - RNA, 18 nt, Yersinia pestis
cgugugcuguaagaaaaa

SEQ ID NO: 4168743 - RNA, 21 nt, Yersinia pestis
cguguugcaucauuggcuuca

SEQ ID NO: 4168744 - RNA, 14 nt, Yersinia pestis
cguguugccaccug

SEQ ID NO: 4168745 - RNA, 23 nt, Yersinia pestis
cguguuggaguaucagaaacagc

SEQ ID NO: 4168746 - RNA, 23 nt, Yersinia pestis
cguguuucgcuauuucaauggga

SEQ ID NO: 4168747 - RNA, 13 nt, Yersinia pestis
cguuaacccaaag

SEQ ID NO: 4168748 - RNA, 17 nt, Yersinia pestis
cguuaaguucaagaacc

SEQ ID NO: 4168749 - RNA, 19 nt, Yersinia pestis
cguuaauuauagugaaaac

SEQ ID NO: 4168750 - RNA, 18 nt, Yersinia pestis
cguuacaacgagggcuca

SEQ ID NO: 4168751 - RNA, 22 nt, Yersinia pestis
cguuacaacgagggcucaaucu

SEQ ID NO: 4168752 - RNA, 18 nt, Yersinia pestis
cguuacacaaucaguaaa

SEQ ID NO: 4168753 - RNA, 16 nt, Yersinia pestis
cguuacacaucaggcu

SEQ ID NO: 4168754 - RNA, 17 nt, Yersinia pestis
cguuacagcuaaagggu

SEQ ID NO: 4168755 - RNA, 16 nt, Yersinia pestis
cguuacccacauuaaa

SEQ ID NO: 4168756 - RNA, 22 nt, Yersinia pestis
cguuacccccuucaccaauaca

SEQ ID NO: 4168757 - RNA, 13 nt, Yersinia pestis
cguuacugcaucu

SEQ ID NO: 4168758 - RNA, 17 nt, Yersinia pestis
cguuagaggauuuaacu

SEQ ID NO: 4168759 - RNA, 14 nt, Yersinia pestis
cguuagcgauuucu

SEQ ID NO: 4168760 - RNA, 23 nt, Yersinia pestis
cguuagcgauuucuaguggcaac

SEQ ID NO: 4168761 - RNA, 15 nt, Yersinia pestis
cguuagcucuucacg

SEQ ID NO: 4168762 - RNA, 15 nt, Yersinia pestis
cguuauaccucaagc

SEQ ID NO: 4168763 - RNA, 17 nt, Yersinia pestis
cguuauaccucaagcug

SEQ ID NO: 4168764 - RNA, 22 nt, Yersinia pestis
cguuaucaaauacgaccgucac

SEQ ID NO: 4168765 - RNA, 23 nt, Yersinia pestis
cguuaugaauaaaccagcaagcc

SEQ ID NO: 4168766 - RNA, 16 nt, Yersinia pestis
cguuauucucaauuga

SEQ ID NO: 4168767 - RNA, 14 nt, Yersinia pestis
cguucaaaaucaaa

SEQ ID NO: 4168768 - RNA, 13 nt, Yersinia pestis
cguucaaccaacu

SEQ ID NO: 4168769 - RNA, 17 nt, Yersinia pestis
cguucaagagugaguca

SEQ ID NO: 4168770 - RNA, 15 nt, Yersinia pestis
cguucagcaauauga

SEQ ID NO: 4168771 - RNA, 23 nt, Yersinia pestis
cguucccgcaggcggccaaugac

SEQ ID NO: 4168772 - RNA, 12 nt, Yersinia pestis
cguucccuguau

SEQ ID NO: 4168773 - RNA, 15 nt, Yersinia pestis
cguuccucuugagcg

SEQ ID NO: 4168774 - RNA, 15 nt, Yersinia pestis
cguuccuuggcugcc

SEQ ID NO: 4168775 - RNA, 18 nt, Yersinia pestis
cguucguuuacugccuug

SEQ ID NO: 4168776 - RNA, 23 nt, Yersinia pestis
cguucguuuacugccuuguugcc

SEQ ID NO: 4168777 - RNA, 15 nt, Yersinia pestis
cguucuaaaacgucu

SEQ ID NO: 4168778 - RNA, 20 nt, Yersinia pestis
cguucuaucaaugccuuggc

SEQ ID NO: 4168779 - RNA, 23 nt, Yersinia pestis
cguucuccgucgucacuuugacg

SEQ ID NO: 4168780 - RNA, 11 nt, Yersinia pestis
cguucucuggc

SEQ ID NO: 4168781 - RNA, 14 nt, Yersinia pestis
cguucugucacaau

SEQ ID NO: 4168782 - RNA, 17 nt, Yersinia pestis
cguucuuauugaagggc

SEQ ID NO: 4168783 - RNA, 20 nt, Yersinia pestis
cguugagcaaaaauauaccc

SEQ ID NO: 4168784 - RNA, 15 nt, Yersinia pestis
cguugcacccugcuu

SEQ ID NO: 4168785 - RNA, 13 nt, Yersinia pestis
cguugcaggucaa

SEQ ID NO: 4168786 - RNA, 20 nt, Yersinia pestis
cguugccccaucagcacucc

SEQ ID NO: 4168787 - RNA, 15 nt, Yersinia pestis
cguugcuaccagcaa

SEQ ID NO: 4168788 - RNA, 20 nt, Yersinia pestis
cguuggaucaucgggaacag

SEQ ID NO: 4168789 - RNA, 19 nt, Yersinia pestis
cguuggccggccaacaucg

SEQ ID NO: 4168790 - RNA, 20 nt, Yersinia pestis
cguuggcuucuuccacuggu

SEQ ID NO: 4168791 - RNA, 15 nt, Yersinia pestis
cguugggguggcaga

SEQ ID NO: 4168792 - RNA, 13 nt, Yersinia pestis
cguuggucagcaa

SEQ ID NO: 4168793 - RNA, 20 nt, Yersinia pestis
cguuguaccaccaaaccccu

SEQ ID NO: 4168794 - RNA, 19 nt, Yersinia pestis
cguuguauuagccgccagu

SEQ ID NO: 4168795 - RNA, 13 nt, Yersinia pestis
cguuguauuuucc

SEQ ID NO: 4168796 - RNA, 14 nt, Yersinia pestis
cguugucagccaug

SEQ ID NO: 4168797 - RNA, 14 nt, Yersinia pestis
cguuguucaagcac

SEQ ID NO: 4168798 - RNA, 15 nt, Yersinia pestis
cguuuaaaaaauauc

SEQ ID NO: 4168799 - RNA, 22 nt, Yersinia pestis
cguuuaaauaagcuaucauuaa

SEQ ID NO: 4168800 - RNA, 14 nt, Yersinia pestis
cguuuaaugccccu

SEQ ID NO: 4168801 - RNA, 20 nt, Yersinia pestis
cguuuaccuauugcgacggu

SEQ ID NO: 4168802 - RNA, 17 nt, Yersinia pestis
cguuuacgauaagccgc

SEQ ID NO: 4168803 - RNA, 20 nt, Yersinia pestis
cguuuacugcuuaaaccaua

SEQ ID NO: 4168804 - RNA, 19 nt, Yersinia pestis
cguuuauacggcuauuuuu

SEQ ID NO: 4168805 - RNA, 16 nt, Yersinia pestis
cguuucaucuucauca

SEQ ID NO: 4168806 - RNA, 14 nt, Yersinia pestis
cguuuccaaaacuc

SEQ ID NO: 4168807 - RNA, 20 nt, Yersinia pestis
cguuuccaaaacucaugucc

SEQ ID NO: 4168808 - RNA, 21 nt, Yersinia pestis
cguuuccaaaacucaugucca

SEQ ID NO: 4168809 - RNA, 22 nt, Yersinia pestis
cguuucccgauggaacaggauu

SEQ ID NO: 4168810 - RNA, 12 nt, Yersinia pestis
cguuugaucaaa

SEQ ID NO: 4168811 - RNA, 22 nt, Yersinia pestis
cguuugccaaaauccaccagcg

SEQ ID NO: 4168812 - RNA, 21 nt, Yersinia pestis
cguuugcuugcugccugccug

SEQ ID NO: 4168813 - RNA, 20 nt, Yersinia pestis
cguuugggcuaagacuauua

SEQ ID NO: 4168814 - RNA, 18 nt, Yersinia pestis
cguuuuaaugccaauuga

SEQ ID NO: 4168815 - RNA, 12 nt, Yersinia pestis
cguuuuagcauu

SEQ ID NO: 4168816 - RNA, 18 nt, Yersinia pestis
cguuuucuuucaggccac

SEQ ID NO: 4168817 - RNA, 18 nt, Yersinia pestis
cguuuugcagaucaaucg

SEQ ID NO: 4168818 - RNA, 13 nt, Yersinia pestis
cguuuugccauua

SEQ ID NO: 4168819 - RNA, 23 nt, Yersinia pestis
cguuuugggcuugagcagugcgc

SEQ ID NO: 4168820 - RNA, 15 nt, Yersinia pestis
cguuuuguugaacag

SEQ ID NO: 4168821 - RNA, 15 nt, Yersinia pestis
cguuuuugaaauacc

SEQ ID NO: 4168822 - RNA, 18 nt, Yersinia pestis
cguuuuuuuuaucagccc

SEQ ID NO: 4168823 - RNA, 15 nt, Yersinia pestis
cuaaaaaaauucuga

SEQ ID NO: 4168824 - RNA, 19 nt, Yersinia pestis
cuaaaaaccauccccagaa

SEQ ID NO: 4168825 - RNA, 20 nt, Yersinia pestis
cuaaaaacucgcgccugaaa

SEQ ID NO: 4168826 - RNA, 12 nt, Yersinia pestis
cuaaaacuggca

SEQ ID NO: 4168827 - RNA, 20 nt, Yersinia pestis
cuaaaagggaguucaucaaa

SEQ ID NO: 4168828 - RNA, 23 nt, Yersinia pestis
cuaaaauaucaaauuugcaguau

SEQ ID NO: 4168829 - RNA, 19 nt, Yersinia pestis
cuaaaauaucacuauaauu

SEQ ID NO: 4168830 - RNA, 18 nt, Yersinia pestis
cuaaaaugaucuuuauua

SEQ ID NO: 4168831 - RNA, 22 nt, Yersinia pestis
cuaaaauggcacaauccaauuu

SEQ ID NO: 4168832 - RNA, 18 nt, Yersinia pestis
cuaaaauucaaacaaaua

SEQ ID NO: 4168833 - RNA, 16 nt, Yersinia pestis
cuaaacagggcagaaa

SEQ ID NO: 4168834 - RNA, 21 nt, Yersinia pestis
cuaaacagggcagaaaauacc

SEQ ID NO: 4168835 - RNA, 9 nt, Yersinia pestis
cuaaaccac

SEQ ID NO: 4168836 - RNA, 22 nt, Yersinia pestis
cuaaacgaccaauuucaauaau

SEQ ID NO: 4168837 - RNA, 19 nt, Yersinia pestis
cuaaacgccgcgucaauaa

SEQ ID NO: 4168838 - RNA, 21 nt, Yersinia pestis
cuaaacgccgcgucaauaaca

SEQ ID NO: 4168839 - RNA, 18 nt, Yersinia pestis
cuaaacguaaugcgaagc

SEQ ID NO: 4168840 - RNA, 16 nt, Yersinia pestis
cuaaacugaucaucaa

SEQ ID NO: 4168841 - RNA, 21 nt, Yersinia pestis
cuaaagaaauaaucauaucaa

SEQ ID NO: 4168842 - RNA, 22 nt, Yersinia pestis
cuaaagcggaauuugccucugc

SEQ ID NO: 4168843 - RNA, 23 nt, Yersinia pestis
cuaaagcguaagugcaauuauuu

SEQ ID NO: 4168844 - RNA, 14 nt, Yersinia pestis
cuaaagcguggcgc

SEQ ID NO: 4168845 - RNA, 23 nt, Yersinia pestis
cuaaaguguacuguuaacucaug

SEQ ID NO: 4168846 - RNA, 13 nt, Yersinia pestis
cuaaauaauucca

SEQ ID NO: 4168847 - RNA, 18 nt, Yersinia pestis
cuaaauccugcaaauuaa

SEQ ID NO: 4168848 - RNA, 21 nt, Yersinia pestis
cuaaaugcuggcggaaauauc

SEQ ID NO: 4168849 - RNA, 16 nt, Yersinia pestis
cuaaauuaacccgucu

SEQ ID NO: 4168850 - RNA, 13 nt, Yersinia pestis
cuaaauuaauauc

SEQ ID NO: 4168851 - RNA, 24 nt, Yersinia pestis
cuaaauuagaaaacaaguuucacu

SEQ ID NO: 4168852 - RNA, 13 nt, Yersinia pestis
cuaaauuucucgc

SEQ ID NO: 4168853 - RNA, 21 nt, Yersinia pestis
cuaaauuuuguacaacuucuu

SEQ ID NO: 4168854 - RNA, 14 nt, Yersinia pestis
cuaacaaaccuaaa

SEQ ID NO: 4168855 - RNA, 13 nt, Yersinia pestis
cuaacaaacugaa

SEQ ID NO: 4168856 - RNA, 16 nt, Yersinia pestis
cuaacaacagucaaua

SEQ ID NO: 4168857 - RNA, 20 nt, Yersinia pestis
cuaacaacagucaauauacc

SEQ ID NO: 4168858 - RNA, 18 nt, Yersinia pestis
cuaacaacugccgccaug

SEQ ID NO: 4168859 - RNA, 14 nt, Yersinia pestis
cuaacaacuuccac

SEQ ID NO: 4168860 - RNA, 13 nt, Yersinia pestis
cuaacaauauuac

SEQ ID NO: 4168861 - RNA, 18 nt, Yersinia pestis
cuaacaauauuaccaaua

SEQ ID NO: 4168862 - RNA, 22 nt, Yersinia pestis
cuaacagaagaguacgaacaga

SEQ ID NO: 4168863 - RNA, 18 nt, Yersinia pestis
cuaacagggaugaauaua

SEQ ID NO: 4168864 - RNA, 17 nt, Yersinia pestis
cuaacaguuguuucaau

SEQ ID NO: 4168865 - RNA, 20 nt, Yersinia pestis
cuaacaguuguuucaauaaa

SEQ ID NO: 4168866 - RNA, 14 nt, Yersinia pestis
cuaaccacagcaau

SEQ ID NO: 4168867 - RNA, 21 nt, Yersinia pestis
cuaaccaccgucaccaaauau

SEQ ID NO: 4168868 - RNA, 22 nt, Yersinia pestis
cuaaccgaagauaaccggcugg

SEQ ID NO: 4168869 - RNA, 15 nt, Yersinia pestis
cuaaccuuaacugca

SEQ ID NO: 4168870 - RNA, 17 nt, Yersinia pestis
cuaaccuuaacugcaua

SEQ ID NO: 4168871 - RNA, 21 nt, Yersinia pestis
cuaaccuuaacugcauagcua

SEQ ID NO: 4168872 - RNA, 23 nt, Yersinia pestis
cuaacgaaucccacacucuggca

SEQ ID NO: 4168873 - RNA, 14 nt, Yersinia pestis
cuaacgagaaaguc

SEQ ID NO: 4168874 - RNA, 22 nt, Yersinia pestis
cuaacgccgcguuagcuauauu

SEQ ID NO: 4168875 - RNA, 18 nt, Yersinia pestis
cuaacgcuucggcgcggu

SEQ ID NO: 4168876 - RNA, 13 nt, Yersinia pestis
cuaacgcuuuuuc

SEQ ID NO: 4168877 - RNA, 19 nt, Yersinia pestis
cuaacgguggcauugacca

SEQ ID NO: 4168878 - RNA, 12 nt, Yersinia pestis
cuaacguccccu

SEQ ID NO: 4168879 - RNA, 20 nt, Yersinia pestis
cuaacgucgcuguuacucag

SEQ ID NO: 4168880 - RNA, 12 nt, Yersinia pestis
cuaacucuucug

SEQ ID NO: 4168881 - RNA, 17 nt, Yersinia pestis
cuaacucuucuggcaaa

SEQ ID NO: 4168882 - RNA, 16 nt, Yersinia pestis
cuaacugaugcugaca

SEQ ID NO: 4168883 - RNA, 20 nt, Yersinia pestis
cuaacuggcccucuuuuuug

SEQ ID NO: 4168884 - RNA, 15 nt, Yersinia pestis
cuaagacuauuaauu

SEQ ID NO: 4168885 - RNA, 17 nt, Yersinia pestis
cuaagagucacagcauu

SEQ ID NO: 4168886 - RNA, 22 nt, Yersinia pestis
cuaagaguccuuaaaaacccau

SEQ ID NO: 4168887 - RNA, 14 nt, Yersinia pestis
cuaagauucaaaca

SEQ ID NO: 4168888 - RNA, 20 nt, Yersinia pestis
cuaagcggaguuggcuagca

SEQ ID NO: 4168889 - RNA, 15 nt, Yersinia pestis
cuaaggggccaauag

SEQ ID NO: 4168890 - RNA, 18 nt, Yersinia pestis
cuaaggguaaaaucccca

SEQ ID NO: 4168891 - RNA, 20 nt, Yersinia pestis
cuaaguacuaucuauuauua

SEQ ID NO: 4168892 - RNA, 17 nt, Yersinia pestis
cuaagucacgcacccac

SEQ ID NO: 4168893 - RNA, 21 nt, Yersinia pestis
cuaagucacgcacccaccaag

SEQ ID NO: 4168894 - RNA, 17 nt, Yersinia pestis
cuaaguccaagacagaa

SEQ ID NO: 4168895 - RNA, 17 nt, Yersinia pestis
cuaaguuaacaccauca

SEQ ID NO: 4168896 - RNA, 21 nt, Yersinia pestis
cuaaguuaacaccaucaacau

SEQ ID NO: 4168897 - RNA, 23 nt, Yersinia pestis
cuaauaaauaauuuguauucuca

SEQ ID NO: 4168898 - RNA, 22 nt, Yersinia pestis
cuaauaauaauuaaucuuaaug

SEQ ID NO: 4168899 - RNA, 15 nt, Yersinia pestis
cuaauaauuguucau

SEQ ID NO: 4168900 - RNA, 15 nt, Yersinia pestis
cuaauaccaauacca

SEQ ID NO: 4168901 - RNA, 14 nt, Yersinia pestis
cuaauaccacaaca

SEQ ID NO: 4168902 - RNA, 15 nt, Yersinia pestis
cuaauacggcuugca

SEQ ID NO: 4168903 - RNA, 18 nt, Yersinia pestis
cuaauacggguuucugcu

SEQ ID NO: 4168904 - RNA, 22 nt, Yersinia pestis
cuaauacugccaaucgcugcca

SEQ ID NO: 4168905 - RNA, 14 nt, Yersinia pestis
cuaauagcauuuuu

SEQ ID NO: 4168906 - RNA, 13 nt, Yersinia pestis
cuaauauuaaguc

SEQ ID NO: 4168907 - RNA, 12 nt, Yersinia pestis
cuaauauucucu

SEQ ID NO: 4168908 - RNA, 12 nt, Yersinia pestis
cuaauccaaggc

SEQ ID NO: 4168909 - RNA, 13 nt, Yersinia pestis
cuaaucggcuggc

SEQ ID NO: 4168910 - RNA, 16 nt, Yersinia pestis
cuaaucuccucuccgg

SEQ ID NO: 4168911 - RNA, 16 nt, Yersinia pestis
cuaaucucuacauuua

SEQ ID NO: 4168912 - RNA, 17 nt, Yersinia pestis
cuaaugccgagaacaga

SEQ ID NO: 4168913 - RNA, 18 nt, Yersinia pestis
cuaaugcgcucuguauug

SEQ ID NO: 4168914 - RNA, 18 nt, Yersinia pestis
cuaaugucauuuccugua

SEQ ID NO: 4168915 - RNA, 21 nt, Yersinia pestis
cuaaugucauuuccuguauuu

SEQ ID NO: 4168916 - RNA, 16 nt, Yersinia pestis
cuaauguuuguuucuc

SEQ ID NO: 4168917 - RNA, 18 nt, Yersinia pestis
cuaauguuuguuucucug

SEQ ID NO: 4168918 - RNA, 23 nt, Yersinia pestis
cuaauuauuuuauuuaaaauuaa

SEQ ID NO: 4168919 - RNA, 13 nt, Yersinia pestis
cuaauugcugccc

SEQ ID NO: 4168920 - RNA, 17 nt, Yersinia pestis
cuaauuguuauuauuaa

SEQ ID NO: 4168921 - RNA, 19 nt, Yersinia pestis
cuaauuuauaaccuuuuuc

SEQ ID NO: 4168922 - RNA, 23 nt, Yersinia pestis
cuaauuuaucccgagcuaacgcu

SEQ ID NO: 4168923 - RNA, 14 nt, Yersinia pestis
cuaauuucaaauga

SEQ ID NO: 4168924 - RNA, 17 nt, Yersinia pestis
cuaauuucaaaugaacu

SEQ ID NO: 4168925 - RNA, 13 nt, Yersinia pestis
cuaauuucucccg

SEQ ID NO: 4168926 - RNA, 15 nt, Yersinia pestis
cuaauuugacgccgc

SEQ ID NO: 4168927 - RNA, 14 nt, Yersinia pestis
cuacacacagcaau

SEQ ID NO: 4168928 - RNA, 14 nt, Yersinia pestis
cuacagaaaaauaa

SEQ ID NO: 4168929 - RNA, 18 nt, Yersinia pestis
cuacaggcgcaacugcca

SEQ ID NO: 4168930 - RNA, 15 nt, Yersinia pestis
cuacauuuagucuac

SEQ ID NO: 4168931 - RNA, 22 nt, Yersinia pestis
cuacauuuggcgcucauuuccc

SEQ ID NO: 4168932 - RNA, 15 nt, Yersinia pestis
cuaccaccuacaacc

SEQ ID NO: 4168933 - RNA, 22 nt, Yersinia pestis
cuaccaccuacaaccuaccacc

SEQ ID NO: 4168934 - RNA, 14 nt, Yersinia pestis
cuaccaccuaccac

SEQ ID NO: 4168935 - RNA, 15 nt, Yersinia pestis
cuaccaccuaccacc

SEQ ID NO: 4168936 - RNA, 17 nt, Yersinia pestis
cuaccaccuaccaccua

SEQ ID NO: 4168937 - RNA, 22 nt, Yersinia pestis
cuaccacguuuaucugacacaa

SEQ ID NO: 4168938 - RNA, 13 nt, Yersinia pestis
cuaccagcaauac

SEQ ID NO: 4168939 - RNA, 18 nt, Yersinia pestis
cuaccagcagugcagcca

SEQ ID NO: 4168940 - RNA, 21 nt, Yersinia pestis
cuaccaguuuuuuccugcugc

SEQ ID NO: 4168941 - RNA, 19 nt, Yersinia pestis
cuaccaugagugaaaauau

SEQ ID NO: 4168942 - RNA, 21 nt, Yersinia pestis
cuaccaugagugaaaauaugu

SEQ ID NO: 4168943 - RNA, 18 nt, Yersinia pestis
cuacccgaaucacugacu

SEQ ID NO: 4168944 - RNA, 19 nt, Yersinia pestis
cuacccgacaccggcugau

SEQ ID NO: 4168945 - RNA, 21 nt, Yersinia pestis
cuaccgacgauaaucaggcua

SEQ ID NO: 4168946 - RNA, 13 nt, Yersinia pestis
cuaccgcucagau

SEQ ID NO: 4168947 - RNA, 19 nt, Yersinia pestis
cuaccggaaccgccgccuu

SEQ ID NO: 4168948 - RNA, 14 nt, Yersinia pestis
cuaccguaucagcc

SEQ ID NO: 4168949 - RNA, 17 nt, Yersinia pestis
cuaccguaucagccccu

SEQ ID NO: 4168950 - RNA, 14 nt, Yersinia pestis
cuaccguucucugc

SEQ ID NO: 4168951 - RNA, 23 nt, Yersinia pestis
cuaccuccggggccugcggccau

SEQ ID NO: 4168952 - RNA, 21 nt, Yersinia pestis
cuaccugcaccaaucauuaca

SEQ ID NO: 4168953 - RNA, 19 nt, Yersinia pestis
cuaccugccugcugcugug

SEQ ID NO: 4168954 - RNA, 17 nt, Yersinia pestis
cuaccugucaacgacgg

SEQ ID NO: 4168955 - RNA, 21 nt, Yersinia pestis
cuaccuucccguccacuuuca

SEQ ID NO: 4168956 - RNA, 19 nt, Yersinia pestis
cuaccuugcuccgcaauuu

SEQ ID NO: 4168957 - RNA, 19 nt, Yersinia pestis
cuaccuuuugcauauuucu

SEQ ID NO: 4168958 - RNA, 20 nt, Yersinia pestis
cuaccuuuugcauauuucuc

SEQ ID NO: 4168959 - RNA, 17 nt, Yersinia pestis
cuacgccgucaucaucu

SEQ ID NO: 4168960 - RNA, 18 nt, Yersinia pestis
cuacggccuguaccacca

SEQ ID NO: 4168961 - RNA, 21 nt, Yersinia pestis
cuacggcugaucugccccugg

SEQ ID NO: 4168962 - RNA, 14 nt, Yersinia pestis
cuacggcuucccau

SEQ ID NO: 4168963 - RNA, 15 nt, Yersinia pestis
cuacguacuaucuau

SEQ ID NO: 4168964 - RNA, 23 nt, Yersinia pestis
cuacguuguuaucaucaccaccc

SEQ ID NO: 4168965 - RNA, 13 nt, Yersinia pestis
cuacuccaacaac

SEQ ID NO: 4168966 - RNA, 16 nt, Yersinia pestis
cuacuccauccccaac

SEQ ID NO: 4168967 - RNA, 19 nt, Yersinia pestis
cuacuccauccccaacucu

SEQ ID NO: 4168968 - RNA, 16 nt, Yersinia pestis
cuacucguaacgacga

SEQ ID NO: 4168969 - RNA, 21 nt, Yersinia pestis
cuacucguaacgacgaaauag

SEQ ID NO: 4168970 - RNA, 18 nt, Yersinia pestis
cuacugacauuucuuaua

SEQ ID NO: 4168971 - RNA, 22 nt, Yersinia pestis
cuacugcaagccguaauucaga

SEQ ID NO: 4168972 - RNA, 20 nt, Yersinia pestis
cuacuggcccgcccauaaau

SEQ ID NO: 4168973 - RNA, 14 nt, Yersinia pestis
cuacuggcugaagu

SEQ ID NO: 4168974 - RNA, 14 nt, Yersinia pestis
cuacugguagcagc

SEQ ID NO: 4168975 - RNA, 20 nt, Yersinia pestis
cuacuguuauccagcgucac

SEQ ID NO: 4168976 - RNA, 22 nt, Yersinia pestis
cuacuguuauccagcgucaccg

SEQ ID NO: 4168977 - RNA, 14 nt, Yersinia pestis
cuacuuauuuccgc

SEQ ID NO: 4168978 - RNA, 17 nt, Yersinia pestis
cuagaacuauuggucaa

SEQ ID NO: 4168979 - RNA, 17 nt, Yersinia pestis
cuagauaccgccccuca

SEQ ID NO: 4168980 - RNA, 23 nt, Yersinia pestis
cuagauaccgccccucacuucga

SEQ ID NO: 4168981 - RNA, 16 nt, Yersinia pestis
cuagauagccauaaua

SEQ ID NO: 4168982 - RNA, 14 nt, Yersinia pestis
cuagauuuucuuuc

SEQ ID NO: 4168983 - RNA, 15 nt, Yersinia pestis
cuagauuuucuuuca

SEQ ID NO: 4168984 - RNA, 22 nt, Yersinia pestis
cuagcaacaugguuaagagauc

SEQ ID NO: 4168985 - RNA, 19 nt, Yersinia pestis
cuagcagugauuucagugu

SEQ ID NO: 4168986 - RNA, 17 nt, Yersinia pestis
cuagcaucacccgcccu

SEQ ID NO: 4168987 - RNA, 23 nt, Yersinia pestis
cuagccaagcuucaauuugacgc

SEQ ID NO: 4168988 - RNA, 14 nt, Yersinia pestis
cuagccagccaccg

SEQ ID NO: 4168989 - RNA, 20 nt, Yersinia pestis
cuagcccaguaccgcuggug

SEQ ID NO: 4168990 - RNA, 17 nt, Yersinia pestis
cuagcgaaguauuaaua

SEQ ID NO: 4168991 - RNA, 17 nt, Yersinia pestis
cuagcgccgcaucaaag

SEQ ID NO: 4168992 - RNA, 15 nt, Yersinia pestis
cuagcgguuucacga

SEQ ID NO: 4168993 - RNA, 14 nt, Yersinia pestis
cuagcugcugcaag

SEQ ID NO: 4168994 - RNA, 19 nt, Yersinia pestis
cuagcuguuguuguugauu

SEQ ID NO: 4168995 - RNA, 21 nt, Yersinia pestis
cuagcuuggcguguuagcggc

SEQ ID NO: 4168996 - RNA, 17 nt, Yersinia pestis
cuagggcuacugaccug

SEQ ID NO: 4168997 - RNA, 14 nt, Yersinia pestis
cuaguagauaauca

SEQ ID NO: 4168998 - RNA, 19 nt, Yersinia pestis
cuagugagugaauagauaa

SEQ ID NO: 4168999 - RNA, 14 nt, Yersinia pestis
cuagugccacaaca

SEQ ID NO: 4169000 - RNA, 20 nt, Yersinia pestis
cuagugcgcugugcccuacu

SEQ ID NO: 4169001 - RNA, 20 nt, Yersinia pestis
cuaguuaacccuaccuaggc

SEQ ID NO: 4169002 - RNA, 21 nt, Yersinia pestis
cuaguuuuaaacgucagauua

SEQ ID NO: 4169003 - RNA, 14 nt, Yersinia pestis
cuauaaggcucugu

SEQ ID NO: 4169004 - RNA, 22 nt, Yersinia pestis
cuauaaggcucuguuaccagcc

SEQ ID NO: 4169005 - RNA, 23 nt, Yersinia pestis
cuauaaggcucuguuaccagccg

SEQ ID NO: 4169006 - RNA, 14 nt, Yersinia pestis
cuauagacaauacu

SEQ ID NO: 4169007 - RNA, 22 nt, Yersinia pestis
cuauauacccgucauaaauaaa

SEQ ID NO: 4169008 - RNA, 13 nt, Yersinia pestis
cuauauauggaua

SEQ ID NO: 4169009 - RNA, 13 nt, Yersinia pestis
cuauaucucaguu

SEQ ID NO: 4169010 - RNA, 15 nt, Yersinia pestis
cuauaucucaguuga

SEQ ID NO: 4169011 - RNA, 19 nt, Yersinia pestis
cuauaucucaguugaaacc

SEQ ID NO: 4169012 - RNA, 11 nt, Yersinia pestis
cuauauuuggc

SEQ ID NO: 4169013 - RNA, 18 nt, Yersinia pestis
cuaucaacuuugaucccc

SEQ ID NO: 4169014 - RNA, 20 nt, Yersinia pestis
cuaucaauugcuggcuauca

SEQ ID NO: 4169015 - RNA, 23 nt, Yersinia pestis
cuaucagcgcccuacugcaucag

SEQ ID NO: 4169016 - RNA, 17 nt, Yersinia pestis
cuaucaggucaaucuua

SEQ ID NO: 4169017 - RNA, 13 nt, Yersinia pestis
cuaucaucaccau

SEQ ID NO: 4169018 - RNA, 14 nt, Yersinia pestis
cuaucaucaccauu

SEQ ID NO: 4169019 - RNA, 15 nt, Yersinia pestis
cuauccacaaacuca

SEQ ID NO: 4169020 - RNA, 19 nt, Yersinia pestis
cuauccgaaaaauauucuc

SEQ ID NO: 4169021 - RNA, 22 nt, Yersinia pestis
cuauccgaaaaauauucucaau

SEQ ID NO: 4169022 - RNA, 12 nt, Yersinia pestis
cuauccgccccg

SEQ ID NO: 4169023 - RNA, 16 nt, Yersinia pestis
cuauccucuuaauguc

SEQ ID NO: 4169024 - RNA, 20 nt, Yersinia pestis
cuauccucuuaaugucuuua

SEQ ID NO: 4169025 - RNA, 24 nt, Yersinia pestis
cuaucgaguugauauaccgauuac

SEQ ID NO: 4169026 - RNA, 20 nt, Yersinia pestis
cuaucgaugguuggcuauca

SEQ ID NO: 4169027 - RNA, 15 nt, Yersinia pestis
cuaucgccuucaucg

SEQ ID NO: 4169028 - RNA, 22 nt, Yersinia pestis
cuaucgcgaaaaugaagcgaug

SEQ ID NO: 4169029 - RNA, 16 nt, Yersinia pestis
cuaucggguaacggcu

SEQ ID NO: 4169030 - RNA, 21 nt, Yersinia pestis
cuaucuauuuuuauuucuccu

SEQ ID NO: 4169031 - RNA, 21 nt, Yersinia pestis
cuaucucgacaaauccuuuua

SEQ ID NO: 4169032 - RNA, 15 nt, Yersinia pestis
cuaucugcugcggua

SEQ ID NO: 4169033 - RNA, 17 nt, Yersinia pestis
cuaucugguuuaaauuc

SEQ ID NO: 4169034 - RNA, 19 nt, Yersinia pestis
cuaucugguuuaaauucua

SEQ ID NO: 4169035 - RNA, 15 nt, Yersinia pestis
cuaucuuuauugcuc

SEQ ID NO: 4169036 - RNA, 18 nt, Yersinia pestis
cuaucuuuucgauagcca

SEQ ID NO: 4169037 - RNA, 13 nt, Yersinia pestis
cuaugagccggcu

SEQ ID NO: 4169038 - RNA, 18 nt, Yersinia pestis
cuaugcacccauagcuca

SEQ ID NO: 4169039 - RNA, 13 nt, Yersinia pestis
cuaugcuaacucg

SEQ ID NO: 4169040 - RNA, 22 nt, Yersinia pestis
cuaugcucagcaaccaaccuug

SEQ ID NO: 4169041 - RNA, 13 nt, Yersinia pestis
cuauggauaaauc

SEQ ID NO: 4169042 - RNA, 23 nt, Yersinia pestis
cuauggcgguuccaaagcaccaa

SEQ ID NO: 4169043 - RNA, 23 nt, Yersinia pestis
cuaugugauauuuuacuguucug

SEQ ID NO: 4169044 - RNA, 18 nt, Yersinia pestis
cuauguucacguaaauga

SEQ ID NO: 4169045 - RNA, 17 nt, Yersinia pestis
cuauguuggcaaauaau

SEQ ID NO: 4169046 - RNA, 22 nt, Yersinia pestis
cuauuagccagaaauagcacca

SEQ ID NO: 4169047 - RNA, 23 nt, Yersinia pestis
cuauuagccagaaauagcaccau

SEQ ID NO: 4169048 - RNA, 13 nt, Yersinia pestis
cuauuaggcuuua

SEQ ID NO: 4169049 - RNA, 20 nt, Yersinia pestis
cuauuaggcuuuaaccugca

SEQ ID NO: 4169050 - RNA, 16 nt, Yersinia pestis
cuauuaucccaguuuu

SEQ ID NO: 4169051 - RNA, 14 nt, Yersinia pestis
cuauuaugccagcc

SEQ ID NO: 4169052 - RNA, 19 nt, Yersinia pestis
cuauucaaugacuccugaa

SEQ ID NO: 4169053 - RNA, 15 nt, Yersinia pestis
cuauucccuuguuug

SEQ ID NO: 4169054 - RNA, 19 nt, Yersinia pestis
cuauucucgaaaaagagau

SEQ ID NO: 4169055 - RNA, 20 nt, Yersinia pestis
cuauucugccuauccucacc

SEQ ID NO: 4169056 - RNA, 13 nt, Yersinia pestis
cuauugaaaaaau

SEQ ID NO: 4169057 - RNA, 17 nt, Yersinia pestis
cuauugauaaaaccacu

SEQ ID NO: 4169058 - RNA, 13 nt, Yersinia pestis
cuauugcgacggu

SEQ ID NO: 4169059 - RNA, 19 nt, Yersinia pestis
cuauuggcuuaucacuugc

SEQ ID NO: 4169060 - RNA, 15 nt, Yersinia pestis
cuauugugucaauac

SEQ ID NO: 4169061 - RNA, 16 nt, Yersinia pestis
cuauugugucaauacc

SEQ ID NO: 4169062 - RNA, 18 nt, Yersinia pestis
cuauugugucaauaccuu

SEQ ID NO: 4169063 - RNA, 17 nt, Yersinia pestis
cuauuguuacuuuuaau

SEQ ID NO: 4169064 - RNA, 15 nt, Yersinia pestis
cuauuuacauaauaa

SEQ ID NO: 4169065 - RNA, 15 nt, Yersinia pestis
cuauuuacugcauuc

SEQ ID NO: 4169066 - RNA, 19 nt, Yersinia pestis
cuauuuacugcauucugag

SEQ ID NO: 4169067 - RNA, 22 nt, Yersinia pestis
cuauuuacugcauucugagcac

SEQ ID NO: 4169068 - RNA, 19 nt, Yersinia pestis
cuauuuauuuauaaaacca

SEQ ID NO: 4169069 - RNA, 23 nt, Yersinia pestis
cuauuucagggcguauaaacaga

SEQ ID NO: 4169070 - RNA, 14 nt, Yersinia pestis
cuauuuccgaaagc

SEQ ID NO: 4169071 - RNA, 17 nt, Yersinia pestis
cuauuuccgaaagcgcc

SEQ ID NO: 4169072 - RNA, 23 nt, Yersinia pestis
cuauuucggcuuggcucaaugug

SEQ ID NO: 4169073 - RNA, 15 nt, Yersinia pestis
cuauuucucucuacu

SEQ ID NO: 4169074 - RNA, 13 nt, Yersinia pestis
cuauuucuucaua

SEQ ID NO: 4169075 - RNA, 22 nt, Yersinia pestis
cuauuuuaucccaaaagaagac

SEQ ID NO: 4169076 - RNA, 19 nt, Yersinia pestis
cuauuuuuauaaucaucua

SEQ ID NO: 4169077 - RNA, 15 nt, Yersinia pestis
cuauuuuuauacagg

SEQ ID NO: 4169078 - RNA, 21 nt, Yersinia pestis
cuauuuuuauuucuccuuacu

SEQ ID NO: 4169079 - RNA, 12 nt, Yersinia pestis
cuauuuuuuccg

SEQ ID NO: 4169080 - RNA, 16 nt, Yersinia pestis
cucaaaaggauggccc

SEQ ID NO: 4169081 - RNA, 19 nt, Yersinia pestis
cucaaaaggauggcccaag

SEQ ID NO: 4169082 - RNA, 13 nt, Yersinia pestis
cucaaaauacaua

SEQ ID NO: 4169083 - RNA, 14 nt, Yersinia pestis
cucaaaauacauaa

SEQ ID NO: 4169084 - RNA, 18 nt, Yersinia pestis
cucaaacugacuuuacuu

SEQ ID NO: 4169085 - RNA, 17 nt, Yersinia pestis
cucaaagaccacaucaa

SEQ ID NO: 4169086 - RNA, 23 nt, Yersinia pestis
cucaaagaccacaucaaccugau

SEQ ID NO: 4169087 - RNA, 16 nt, Yersinia pestis
cucaaauacuucaaau

SEQ ID NO: 4169088 - RNA, 19 nt, Yersinia pestis
cucaaauacuucaaaugac

SEQ ID NO: 4169089 - RNA, 21 nt, Yersinia pestis
cucaaauauuugcacaaauau

SEQ ID NO: 4169090 - RNA, 16 nt, Yersinia pestis
cucaacagcaucauca

SEQ ID NO: 4169091 - RNA, 14 nt, Yersinia pestis
cucaacucaaaaca

SEQ ID NO: 4169092 - RNA, 15 nt, Yersinia pestis
cucaacucaaaacaa

SEQ ID NO: 4169093 - RNA, 16 nt, Yersinia pestis
cucaacucaaaacaau

SEQ ID NO: 4169094 - RNA, 15 nt, Yersinia pestis
cucaacugcucaacu

SEQ ID NO: 4169095 - RNA, 17 nt, Yersinia pestis
cucaacugcucaacugc

SEQ ID NO: 4169096 - RNA, 19 nt, Yersinia pestis
cucaacugcucaacugcuc

SEQ ID NO: 4169097 - RNA, 14 nt, Yersinia pestis
cucaagaaauuuaa

SEQ ID NO: 4169098 - RNA, 12 nt, Yersinia pestis
cucaagaccugc

SEQ ID NO: 4169099 - RNA, 15 nt, Yersinia pestis
cucaagccucuagga

SEQ ID NO: 4169100 - RNA, 19 nt, Yersinia pestis
cucaagcuggccagugaga

SEQ ID NO: 4169101 - RNA, 17 nt, Yersinia pestis
cucaagggcacaguuua

SEQ ID NO: 4169102 - RNA, 20 nt, Yersinia pestis
cucaaggucuuucgcccaca

SEQ ID NO: 4169103 - RNA, 22 nt, Yersinia pestis
cucaaucggcugguaacugagu

SEQ ID NO: 4169104 - RNA, 15 nt, Yersinia pestis
cucaaucucugccug

SEQ ID NO: 4169105 - RNA, 13 nt, Yersinia pestis
cucaaugauaaaa

SEQ ID NO: 4169106 - RNA, 14 nt, Yersinia pestis
cucaaugcagaugc

SEQ ID NO: 4169107 - RNA, 21 nt, Yersinia pestis
cucaaugccaagucuuauugc

SEQ ID NO: 4169108 - RNA, 16 nt, Yersinia pestis
cucaaugccgcugucu

SEQ ID NO: 4169109 - RNA, 14 nt, Yersinia pestis
cucaaugcuuaaca

SEQ ID NO: 4169110 - RNA, 15 nt, Yersinia pestis
cucaauggcuuuuuu

SEQ ID NO: 4169111 - RNA, 12 nt, Yersinia pestis
cucaauugacug

SEQ ID NO: 4169112 - RNA, 23 nt, Yersinia pestis
cucaauugucuuuggacagucug

SEQ ID NO: 4169113 - RNA, 14 nt, Yersinia pestis
cucacaaaauaacu

SEQ ID NO: 4169114 - RNA, 22 nt, Yersinia pestis
cucaccaagaggaaaugccgcg

SEQ ID NO: 4169115 - RNA, 23 nt, Yersinia pestis
cucaccaagaggaaaugccgcgc

SEQ ID NO: 4169116 - RNA, 12 nt, Yersinia pestis
cucacccauuuu

SEQ ID NO: 4169117 - RNA, 21 nt, Yersinia pestis
cucacccauuuuauccucuuc

SEQ ID NO: 4169118 - RNA, 22 nt, Yersinia pestis
cucaccccacuuuccacguuug

SEQ ID NO: 4169119 - RNA, 18 nt, Yersinia pestis
cucacccgcuugucuuga

SEQ ID NO: 4169120 - RNA, 14 nt, Yersinia pestis
cucaccgagcauau

SEQ ID NO: 4169121 - RNA, 21 nt, Yersinia pestis
cucaccgucaacccacaguug

SEQ ID NO: 4169122 - RNA, 14 nt, Yersinia pestis
cucacgcaaagggc

SEQ ID NO: 4169123 - RNA, 18 nt, Yersinia pestis
cucacgggcuuccaucag

SEQ ID NO: 4169124 - RNA, 20 nt, Yersinia pestis
cucacgguuucuaaaaaaug

SEQ ID NO: 4169125 - RNA, 17 nt, Yersinia pestis
cucacguaccaaaucag

SEQ ID NO: 4169126 - RNA, 14 nt, Yersinia pestis
cucacguauuuuca

SEQ ID NO: 4169127 - RNA, 16 nt, Yersinia pestis
cucacguauuuucauu

SEQ ID NO: 4169128 - RNA, 18 nt, Yersinia pestis
cucacguauuuucauuuu

SEQ ID NO: 4169129 - RNA, 21 nt, Yersinia pestis
cucacgucaccacgcagucag

SEQ ID NO: 4169130 - RNA, 17 nt, Yersinia pestis
cucacuacccuuaggua

SEQ ID NO: 4169131 - RNA, 13 nt, Yersinia pestis
cucacucugugaa

SEQ ID NO: 4169132 - RNA, 22 nt, Yersinia pestis
cucacuggcuuuauuauaugau

SEQ ID NO: 4169133 - RNA, 22 nt, Yersinia pestis
cucacugucgggguagaucagc

SEQ ID NO: 4169134 - RNA, 20 nt, Yersinia pestis
cucacuuguguaaacuccuu

SEQ ID NO: 4169135 - RNA, 23 nt, Yersinia pestis
cucacuuguguaaacuccuugga

SEQ ID NO: 4169136 - RNA, 21 nt, Yersinia pestis
cucacuuuuauauccgccauc

SEQ ID NO: 4169137 - RNA, 14 nt, Yersinia pestis
cucacuuuuaucca

SEQ ID NO: 4169138 - RNA, 17 nt, Yersinia pestis
cucacuuuuauccagcc

SEQ ID NO: 4169139 - RNA, 13 nt, Yersinia pestis
cucagaaaauaaa

SEQ ID NO: 4169140 - RNA, 22 nt, Yersinia pestis
cucagacuaccaaaauuuaaau

SEQ ID NO: 4169141 - RNA, 13 nt, Yersinia pestis
cucagacuucuuc

SEQ ID NO: 4169142 - RNA, 15 nt, Yersinia pestis
cucagagacaucuuu

SEQ ID NO: 4169143 - RNA, 14 nt, Yersinia pestis
cucagcaaccaacc

SEQ ID NO: 4169144 - RNA, 22 nt, Yersinia pestis
cucagcacggauaucuggguuu

SEQ ID NO: 4169145 - RNA, 22 nt, Yersinia pestis
cucagcagagucgcaaaaaaua

SEQ ID NO: 4169146 - RNA, 23 nt, Yersinia pestis
cucagcagagucgcaaaaaauau

SEQ ID NO: 4169147 - RNA, 22 nt, Yersinia pestis
cucagcauauuguaaacuucca

SEQ ID NO: 4169148 - RNA, 13 nt, Yersinia pestis
cucagcaucaccg

SEQ ID NO: 4169149 - RNA, 14 nt, Yersinia pestis
cucagcauccuccu

SEQ ID NO: 4169150 - RNA, 15 nt, Yersinia pestis
cucagcauccuccug

SEQ ID NO: 4169151 - RNA, 17 nt, Yersinia pestis
cucagccucauucauga

SEQ ID NO: 4169152 - RNA, 18 nt, Yersinia pestis
cucagccucauucaugag

SEQ ID NO: 4169153 - RNA, 16 nt, Yersinia pestis
cucagccuuuuuugcu

SEQ ID NO: 4169154 - RNA, 18 nt, Yersinia pestis
cucagcgggcuaaaugcu

SEQ ID NO: 4169155 - RNA, 20 nt, Yersinia pestis
cucagcgggcuaaaugcucg

SEQ ID NO: 4169156 - RNA, 15 nt, Yersinia pestis
cucagcgucacggaa

SEQ ID NO: 4169157 - RNA, 22 nt, Yersinia pestis
cucagcgucacggaaagcaggu

SEQ ID NO: 4169158 - RNA, 20 nt, Yersinia pestis
cucagcugguuagagcacag

SEQ ID NO: 4169159 - RNA, 18 nt, Yersinia pestis
cucagcuugguaaugcgc

SEQ ID NO: 4169160 - RNA, 18 nt, Yersinia pestis
cucaggauuagcuucugc

SEQ ID NO: 4169161 - RNA, 19 nt, Yersinia pestis
cucaggcacauagcuggcu

SEQ ID NO: 4169162 - RNA, 12 nt, Yersinia pestis
cucaggccuugc

SEQ ID NO: 4169163 - RNA, 13 nt, Yersinia pestis
cucaggcucauca

SEQ ID NO: 4169164 - RNA, 19 nt, Yersinia pestis
cucagggcgcuuaugcccu

SEQ ID NO: 4169165 - RNA, 20 nt, Yersinia pestis
cucaguacagucccugugcg

SEQ ID NO: 4169166 - RNA, 17 nt, Yersinia pestis
cucaguaccugaagcua

SEQ ID NO: 4169167 - RNA, 14 nt, Yersinia pestis
cucagucaucgccu

SEQ ID NO: 4169168 - RNA, 21 nt, Yersinia pestis
cucaguuaaacgguaaccauc

SEQ ID NO: 4169169 - RNA, 15 nt, Yersinia pestis
cucaguucagccccc

SEQ ID NO: 4169170 - RNA, 18 nt, Yersinia pestis
cucaguucgguugccaaa

SEQ ID NO: 4169171 - RNA, 20 nt, Yersinia pestis
cucaguuggguaucuuugcu

SEQ ID NO: 4169172 - RNA, 18 nt, Yersinia pestis
cucauaccgaauaauaaa

SEQ ID NO: 4169173 - RNA, 13 nt, Yersinia pestis
cucauacucaguc

SEQ ID NO: 4169174 - RNA, 15 nt, Yersinia pestis
cucauacucagucau

SEQ ID NO: 4169175 - RNA, 13 nt, Yersinia pestis
cucauauaaucau

SEQ ID NO: 4169176 - RNA, 20 nt, Yersinia pestis
cucauauucaaaaucugaua

SEQ ID NO: 4169177 - RNA, 16 nt, Yersinia pestis
cucauauuguccaaag

SEQ ID NO: 4169178 - RNA, 17 nt, Yersinia pestis
cucauauuguccaaagg

SEQ ID NO: 4169179 - RNA, 17 nt, Yersinia pestis
cucaucaaaggagugcc

SEQ ID NO: 4169180 - RNA, 16 nt, Yersinia pestis
cucaucaaccucagcc

SEQ ID NO: 4169181 - RNA, 16 nt, Yersinia pestis
cucaucaacuucugca

SEQ ID NO: 4169182 - RNA, 17 nt, Yersinia pestis
cucaucaaguauuuuac

SEQ ID NO: 4169183 - RNA, 18 nt, Yersinia pestis
cucaucaccaaaaugaca

SEQ ID NO: 4169184 - RNA, 20 nt, Yersinia pestis
cucaucaggcggguaacugu

SEQ ID NO: 4169185 - RNA, 15 nt, Yersinia pestis
cucaucaguaacgcc

SEQ ID NO: 4169186 - RNA, 22 nt, Yersinia pestis
cucaucaguaacgccugauuca

SEQ ID NO: 4169187 - RNA, 15 nt, Yersinia pestis
cucaucauaaaaaua

SEQ ID NO: 4169188 - RNA, 12 nt, Yersinia pestis
cucauccagauu

SEQ ID NO: 4169189 - RNA, 20 nt, Yersinia pestis
cucauccguuuuaacgcugc

SEQ ID NO: 4169190 - RNA, 23 nt, Yersinia pestis
cucauccugcuauuuaacaaaaa

SEQ ID NO: 4169191 - RNA, 23 nt, Yersinia pestis
cucaucgaaauucccguuuuauu

SEQ ID NO: 4169192 - RNA, 20 nt, Yersinia pestis
cucaucgccaaagccgucag

SEQ ID NO: 4169193 - RNA, 22 nt, Yersinia pestis
cucaucgggacgcguuugcuug

SEQ ID NO: 4169194 - RNA, 15 nt, Yersinia pestis
cucaucgggauuaau

SEQ ID NO: 4169195 - RNA, 17 nt, Yersinia pestis
cucaucggguaaaauca

SEQ ID NO: 4169196 - RNA, 18 nt, Yersinia pestis
cucaucggguaaaaucau

SEQ ID NO: 4169197 - RNA, 19 nt, Yersinia pestis
cucaucugcgggcuaacau

SEQ ID NO: 4169198 - RNA, 22 nt, Yersinia pestis
cucaucuugggcgggaucucca

SEQ ID NO: 4169199 - RNA, 13 nt, Yersinia pestis
cucaugaaugagg

SEQ ID NO: 4169200 - RNA, 14 nt, Yersinia pestis
cucaugaaugaggc

SEQ ID NO: 4169201 - RNA, 20 nt, Yersinia pestis
cucaugaaugaggcugaggu

SEQ ID NO: 4169202 - RNA, 12 nt, Yersinia pestis
cucaugacaaaa

SEQ ID NO: 4169203 - RNA, 18 nt, Yersinia pestis
cucaugcucuucauaagc

SEQ ID NO: 4169204 - RNA, 20 nt, Yersinia pestis
cucauuaauagaaucugcug

SEQ ID NO: 4169205 - RNA, 12 nt, Yersinia pestis
cucauuacucag

SEQ ID NO: 4169206 - RNA, 20 nt, Yersinia pestis
cucauuacucagcuugguaa

SEQ ID NO: 4169207 - RNA, 13 nt, Yersinia pestis
cucauucaugagg

SEQ ID NO: 4169208 - RNA, 14 nt, Yersinia pestis
cucauucaugaggc

SEQ ID NO: 4169209 - RNA, 16 nt, Yersinia pestis
cucauucaugaggcuc

SEQ ID NO: 4169210 - RNA, 17 nt, Yersinia pestis
cucauucaugaggcuca

SEQ ID NO: 4169211 - RNA, 16 nt, Yersinia pestis
cucauucaugaggcuu

SEQ ID NO: 4169212 - RNA, 18 nt, Yersinia pestis
cucauucaugaggcuucu

SEQ ID NO: 4169213 - RNA, 17 nt, Yersinia pestis
cucauugcgucagguaa

SEQ ID NO: 4169214 - RNA, 13 nt, Yersinia pestis
cucauuuaaaaua

SEQ ID NO: 4169215 - RNA, 14 nt, Yersinia pestis
cucauuuaaaauac

SEQ ID NO: 4169216 - RNA, 22 nt, Yersinia pestis
cuccaaaugaacuaucgccugg

SEQ ID NO: 4169217 - RNA, 20 nt, Yersinia pestis
cuccaagcacacugguugaa

SEQ ID NO: 4169218 - RNA, 13 nt, Yersinia pestis
cuccaauaacuaa

SEQ ID NO: 4169219 - RNA, 17 nt, Yersinia pestis
cuccaauaauucgugaa

SEQ ID NO: 4169220 - RNA, 17 nt, Yersinia pestis
cuccacacccgccaaac

SEQ ID NO: 4169221 - RNA, 23 nt, Yersinia pestis
cuccacaccuccgcccucuugcu

SEQ ID NO: 4169222 - RNA, 20 nt, Yersinia pestis
cuccacacguguacucauau

SEQ ID NO: 4169223 - RNA, 14 nt, Yersinia pestis
cuccacauauugug

SEQ ID NO: 4169224 - RNA, 19 nt, Yersinia pestis
cuccacauuuuggccuuca

SEQ ID NO: 4169225 - RNA, 15 nt, Yersinia pestis
cuccaccaaugauuu

SEQ ID NO: 4169226 - RNA, 19 nt, Yersinia pestis
cuccacguagaucaacauu

SEQ ID NO: 4169227 - RNA, 16 nt, Yersinia pestis
cuccacuaugcccagu

SEQ ID NO: 4169228 - RNA, 14 nt, Yersinia pestis
cuccagaagcauau

SEQ ID NO: 4169229 - RNA, 18 nt, Yersinia pestis
cuccagaauauaaaagca

SEQ ID NO: 4169230 - RNA, 16 nt, Yersinia pestis
cuccagaauaucuuca

SEQ ID NO: 4169231 - RNA, 17 nt, Yersinia pestis
cuccagccugcgauagc

SEQ ID NO: 4169232 - RNA, 15 nt, Yersinia pestis
cuccagcucgugcca

SEQ ID NO: 4169233 - RNA, 13 nt, Yersinia pestis
cuccaggcauuaa

SEQ ID NO: 4169234 - RNA, 20 nt, Yersinia pestis
cuccaggcauuaaaaucacc

SEQ ID NO: 4169235 - RNA, 24 nt, Yersinia pestis
cuccaggguaauaagugaucagcu

SEQ ID NO: 4169236 - RNA, 17 nt, Yersinia pestis
cuccaguugauacagga

SEQ ID NO: 4169237 - RNA, 18 nt, Yersinia pestis
cuccaguuggcgcacguu

SEQ ID NO: 4169238 - RNA, 13 nt, Yersinia pestis
cuccauauagccc

SEQ ID NO: 4169239 - RNA, 22 nt, Yersinia pestis
cuccaucaagccaccgcuggug

SEQ ID NO: 4169240 - RNA, 19 nt, Yersinia pestis
cuccaucacucuucgugcu

SEQ ID NO: 4169241 - RNA, 18 nt, Yersinia pestis
cuccauccccaacucuuu

SEQ ID NO: 4169242 - RNA, 17 nt, Yersinia pestis
cuccauuuuuuugaugc

SEQ ID NO: 4169243 - RNA, 18 nt, Yersinia pestis
cucccagaauaauaagcc

SEQ ID NO: 4169244 - RNA, 13 nt, Yersinia pestis
cucccauuaauua

SEQ ID NO: 4169245 - RNA, 20 nt, Yersinia pestis
cucccauucgcgccccaaau

SEQ ID NO: 4169246 - RNA, 23 nt, Yersinia pestis
cuccccaaagccuacgagagauc

SEQ ID NO: 4169247 - RNA, 17 nt, Yersinia pestis
cucccccacucgcccca

SEQ ID NO: 4169248 - RNA, 14 nt, Yersinia pestis
cucccgcuaacgca

SEQ ID NO: 4169249 - RNA, 15 nt, Yersinia pestis
cucccgcuaacgcac

SEQ ID NO: 4169250 - RNA, 13 nt, Yersinia pestis
cucccggcagcac

SEQ ID NO: 4169251 - RNA, 16 nt, Yersinia pestis
cucccguagcaaauaa

SEQ ID NO: 4169252 - RNA, 14 nt, Yersinia pestis
cucccucuguauug

SEQ ID NO: 4169253 - RNA, 23 nt, Yersinia pestis
cucccuuuccagcgguuuuuucu

SEQ ID NO: 4169254 - RNA, 16 nt, Yersinia pestis
cucccuuuuccaucac

SEQ ID NO: 4169255 - RNA, 21 nt, Yersinia pestis
cuccggcgcccuucccauuua

SEQ ID NO: 4169256 - RNA, 20 nt, Yersinia pestis
cuccggcgggagaguggcgg

SEQ ID NO: 4169257 - RNA, 20 nt, Yersinia pestis
cuccggcgugaguuccagcc

SEQ ID NO: 4169258 - RNA, 17 nt, Yersinia pestis
cuccggcuaugccggag

SEQ ID NO: 4169259 - RNA, 22 nt, Yersinia pestis
cuccgguaauccuuguaagacc

SEQ ID NO: 4169260 - RNA, 22 nt, Yersinia pestis
cuccgguucuugcgcgcuggga

SEQ ID NO: 4169261 - RNA, 15 nt, Yersinia pestis
cuccgucgcgggcac

SEQ ID NO: 4169262 - RNA, 22 nt, Yersinia pestis
cuccgucgcgggcacuuuguca

SEQ ID NO: 4169263 - RNA, 13 nt, Yersinia pestis
cuccguugaaacc

SEQ ID NO: 4169264 - RNA, 16 nt, Yersinia pestis
cuccguugcaggcacu

SEQ ID NO: 4169265 - RNA, 12 nt, Yersinia pestis
cuccuccagaau

SEQ ID NO: 4169266 - RNA, 13 nt, Yersinia pestis
cuccucugccuau

SEQ ID NO: 4169267 - RNA, 23 nt, Yersinia pestis
cuccucuuuauacauauguugag

SEQ ID NO: 4169268 - RNA, 20 nt, Yersinia pestis
cuccugaaauaaagaacuga

SEQ ID NO: 4169269 - RNA, 18 nt, Yersinia pestis
cuccugaucuucauugcc

SEQ ID NO: 4169270 - RNA, 22 nt, Yersinia pestis
cuccugaucuucauugccuucu

SEQ ID NO: 4169271 - RNA, 13 nt, Yersinia pestis
cuccugauuuaac

SEQ ID NO: 4169272 - RNA, 19 nt, Yersinia pestis
cuccugcaacgccuucaca

SEQ ID NO: 4169273 - RNA, 18 nt, Yersinia pestis
cuccugcccaagaauaau

SEQ ID NO: 4169274 - RNA, 15 nt, Yersinia pestis
cuccuggcaugcauu

SEQ ID NO: 4169275 - RNA, 21 nt, Yersinia pestis
cuccuuaccacugcucacuuu

SEQ ID NO: 4169276 - RNA, 18 nt, Yersinia pestis
cuccuuauacuaaagaaa

SEQ ID NO: 4169277 - RNA, 16 nt, Yersinia pestis
cuccuugaauagccag

SEQ ID NO: 4169278 - RNA, 22 nt, Yersinia pestis
cuccuugaauagccagaagcca

SEQ ID NO: 4169279 - RNA, 23 nt, Yersinia pestis
cuccuuucuuuucgcuauuucuc

SEQ ID NO: 4169280 - RNA, 12 nt, Yersinia pestis
cucgaaaauaac

SEQ ID NO: 4169281 - RNA, 21 nt, Yersinia pestis
cucgaaaucauccgcggcaaa

SEQ ID NO: 4169282 - RNA, 18 nt, Yersinia pestis
cucgaaccgcgccauccu

SEQ ID NO: 4169283 - RNA, 16 nt, Yersinia pestis
cucgaacgauuuucuu

SEQ ID NO: 4169284 - RNA, 21 nt, Yersinia pestis
cucgaacgcuuguggaaauag

SEQ ID NO: 4169285 - RNA, 18 nt, Yersinia pestis
cucgaagcgcgcccuccc

SEQ ID NO: 4169286 - RNA, 17 nt, Yersinia pestis
cucgaauaaacggauuu

SEQ ID NO: 4169287 - RNA, 20 nt, Yersinia pestis
cucgacaccaaaacucccug

SEQ ID NO: 4169288 - RNA, 17 nt, Yersinia pestis
cucgacuuuauucaaac

SEQ ID NO: 4169289 - RNA, 18 nt, Yersinia pestis
cucgagccgcgcccuccc

SEQ ID NO: 4169290 - RNA, 19 nt, Yersinia pestis
cucgagccuacauggaugu

SEQ ID NO: 4169291 - RNA, 22 nt, Yersinia pestis
cucgagccuacuacauggaugu

SEQ ID NO: 4169292 - RNA, 21 nt, Yersinia pestis
cucgaucaccacgucaccuuu

SEQ ID NO: 4169293 - RNA, 21 nt, Yersinia pestis
cucgaucagauacaaccccac

SEQ ID NO: 4169294 - RNA, 18 nt, Yersinia pestis
cucgauugaauaacuucg

SEQ ID NO: 4169295 - RNA, 22 nt, Yersinia pestis
cucgcaaugaaaguggccacuc

SEQ ID NO: 4169296 - RNA, 18 nt, Yersinia pestis
cucgcaauggugauaaac

SEQ ID NO: 4169297 - RNA, 12 nt, Yersinia pestis
cucgccacccgc

SEQ ID NO: 4169298 - RNA, 14 nt, Yersinia pestis
cucgccacccgcuu

SEQ ID NO: 4169299 - RNA, 17 nt, Yersinia pestis
cucgcccaugaccacuu

SEQ ID NO: 4169300 - RNA, 16 nt, Yersinia pestis
cucgccgacaacuuca

SEQ ID NO: 4169301 - RNA, 19 nt, Yersinia pestis
cucgccguggcauaaucaa

SEQ ID NO: 4169302 - RNA, 17 nt, Yersinia pestis
cucgccguggcgacagc

SEQ ID NO: 4169303 - RNA, 19 nt, Yersinia pestis
cucgcggaaaucagcuuca

SEQ ID NO: 4169304 - RNA, 17 nt, Yersinia pestis
cucgcgugucaaaccaa

SEQ ID NO: 4169305 - RNA, 17 nt, Yersinia pestis
cucgcuaugcucagcaa

SEQ ID NO: 4169306 - RNA, 19 nt, Yersinia pestis
cucgcucaacaugccagaa

SEQ ID NO: 4169307 - RNA, 17 nt, Yersinia pestis
cucgcucaccacugagu

SEQ ID NO: 4169308 - RNA, 14 nt, Yersinia pestis
cucggccgggcuga

SEQ ID NO: 4169309 - RNA, 15 nt, Yersinia pestis
cucggcgcauccaug

SEQ ID NO: 4169310 - RNA, 17 nt, Yersinia pestis
cucggcgcgcuugccac

SEQ ID NO: 4169311 - RNA, 15 nt, Yersinia pestis
cucggcucgaaccug

SEQ ID NO: 4169312 - RNA, 22 nt, Yersinia pestis
cucggcucgaaccugaacgcag

SEQ ID NO: 4169313 - RNA, 22 nt, Yersinia pestis
cucgggauaugacuaaacugau

SEQ ID NO: 4169314 - RNA, 22 nt, Yersinia pestis
cucgggucagugaaaaaugaga

SEQ ID NO: 4169315 - RNA, 16 nt, Yersinia pestis
cucgguaacuuaucga

SEQ ID NO: 4169316 - RNA, 16 nt, Yersinia pestis
cucgguaaugagccgc

SEQ ID NO: 4169317 - RNA, 20 nt, Yersinia pestis
cucgguauguacacauuauu

SEQ ID NO: 4169318 - RNA, 17 nt, Yersinia pestis
cucggucgaucgcuuuu

SEQ ID NO: 4169319 - RNA, 22 nt, Yersinia pestis
cucggucugaauaagagagacg

SEQ ID NO: 4169320 - RNA, 17 nt, Yersinia pestis
cucgguuguucagcacc

SEQ ID NO: 4169321 - RNA, 13 nt, Yersinia pestis
cucguauuacccu

SEQ ID NO: 4169322 - RNA, 15 nt, Yersinia pestis
cucgucauucaccac

SEQ ID NO: 4169323 - RNA, 18 nt, Yersinia pestis
cucgucauucaccaccac

SEQ ID NO: 4169324 - RNA, 15 nt, Yersinia pestis
cucguuaucagccac

SEQ ID NO: 4169325 - RNA, 22 nt, Yersinia pestis
cucguuggaucaucgggaacag

SEQ ID NO: 4169326 - RNA, 23 nt, Yersinia pestis
cucuacgacgcccgcagacugcu

SEQ ID NO: 4169327 - RNA, 23 nt, Yersinia pestis
cucuacguauuucgugauuuucu

SEQ ID NO: 4169328 - RNA, 16 nt, Yersinia pestis
cucuacucgcucacca

SEQ ID NO: 4169329 - RNA, 12 nt, Yersinia pestis
cucuacuuucua

SEQ ID NO: 4169330 - RNA, 14 nt, Yersinia pestis
cucuagcuaacagu

SEQ ID NO: 4169331 - RNA, 13 nt, Yersinia pestis
cucuaucucuucc

SEQ ID NO: 4169332 - RNA, 12 nt, Yersinia pestis
cucuaugccgcu

SEQ ID NO: 4169333 - RNA, 15 nt, Yersinia pestis
cucuauugcucauca

SEQ ID NO: 4169334 - RNA, 14 nt, Yersinia pestis
cucucagaacaggu

SEQ ID NO: 4169335 - RNA, 12 nt, Yersinia pestis
cucucauauccc

SEQ ID NO: 4169336 - RNA, 17 nt, Yersinia pestis
cucucauauccccccca

SEQ ID NO: 4169337 - RNA, 18 nt, Yersinia pestis
cucucaucugaacuauug

SEQ ID NO: 4169338 - RNA, 17 nt, Yersinia pestis
cucuccagugcaaauuu

SEQ ID NO: 4169339 - RNA, 13 nt, Yersinia pestis
cucuccaugauau

SEQ ID NO: 4169340 - RNA, 17 nt, Yersinia pestis
cucuccccaagcggcag

SEQ ID NO: 4169341 - RNA, 16 nt, Yersinia pestis
cucuccgucgcgggca

SEQ ID NO: 4169342 - RNA, 19 nt, Yersinia pestis
cucuccgucgcgggcacuu

SEQ ID NO: 4169343 - RNA, 18 nt, Yersinia pestis
cucuccguugcaggcacu

SEQ ID NO: 4169344 - RNA, 15 nt, Yersinia pestis
cucuccuaaaaucua

SEQ ID NO: 4169345 - RNA, 18 nt, Yersinia pestis
cucuccuauaucucaguu

SEQ ID NO: 4169346 - RNA, 16 nt, Yersinia pestis
cucucuccgcaaugcc

SEQ ID NO: 4169347 - RNA, 22 nt, Yersinia pestis
cucucuuuccagcaaaagccuc

SEQ ID NO: 4169348 - RNA, 14 nt, Yersinia pestis
cucucuuuuuucuc

SEQ ID NO: 4169349 - RNA, 17 nt, Yersinia pestis
cucugaauaaaaaauua

SEQ ID NO: 4169350 - RNA, 19 nt, Yersinia pestis
cucugacuacugaaaccug

SEQ ID NO: 4169351 - RNA, 22 nt, Yersinia pestis
cucugacuacugaaaccugacc

SEQ ID NO: 4169352 - RNA, 18 nt, Yersinia pestis
cucugauaguauuagaug

SEQ ID NO: 4169353 - RNA, 16 nt, Yersinia pestis
cucugaugaacggaga

SEQ ID NO: 4169354 - RNA, 18 nt, Yersinia pestis
cucugaugguaucagaaa

SEQ ID NO: 4169355 - RNA, 17 nt, Yersinia pestis
cucugauuguaacaauc

SEQ ID NO: 4169356 - RNA, 19 nt, Yersinia pestis
cucugcaaugcccagagcg

SEQ ID NO: 4169357 - RNA, 18 nt, Yersinia pestis
cucugcaguacagauaau

SEQ ID NO: 4169358 - RNA, 15 nt, Yersinia pestis
cucugccaacgugau

SEQ ID NO: 4169359 - RNA, 13 nt, Yersinia pestis
cucugccgcugaa

SEQ ID NO: 4169360 - RNA, 15 nt, Yersinia pestis
cucugccuauccuca

SEQ ID NO: 4169361 - RNA, 14 nt, Yersinia pestis
cucugcgacaucag

SEQ ID NO: 4169362 - RNA, 17 nt, Yersinia pestis
cucugcgcucauacuca

SEQ ID NO: 4169363 - RNA, 13 nt, Yersinia pestis
cucugcguagcca

SEQ ID NO: 4169364 - RNA, 12 nt, Yersinia pestis
cucugcuaacaa

SEQ ID NO: 4169365 - RNA, 19 nt, Yersinia pestis
cucuggacguuugcugcuu

SEQ ID NO: 4169366 - RNA, 17 nt, Yersinia pestis
cucuggagcucuccacu

SEQ ID NO: 4169367 - RNA, 14 nt, Yersinia pestis
cucuggagcuucug

SEQ ID NO: 4169368 - RNA, 16 nt, Yersinia pestis
cucuggagcuucuggc

SEQ ID NO: 4169369 - RNA, 21 nt, Yersinia pestis
cucuggcaacggcacauccca

SEQ ID NO: 4169370 - RNA, 22 nt, Yersinia pestis
cucuggcaacggcacaucccaa

SEQ ID NO: 4169371 - RNA, 22 nt, Yersinia pestis
cucuggccagcgucuucagugg

SEQ ID NO: 4169372 - RNA, 19 nt, Yersinia pestis
cucuggcgcggacguuuua

SEQ ID NO: 4169373 - RNA, 17 nt, Yersinia pestis
cucuggcuaaugucucu

SEQ ID NO: 4169374 - RNA, 16 nt, Yersinia pestis
cucugggacgugcaua

SEQ ID NO: 4169375 - RNA, 16 nt, Yersinia pestis
cucuggguaagaacag

SEQ ID NO: 4169376 - RNA, 20 nt, Yersinia pestis
cucuguauuguaauaaugga

SEQ ID NO: 4169377 - RNA, 14 nt, Yersinia pestis
cucuguauuuucaa

SEQ ID NO: 4169378 - RNA, 16 nt, Yersinia pestis
cucuguggauugccaa

SEQ ID NO: 4169379 - RNA, 17 nt, Yersinia pestis
cucuguugccggauuuu

SEQ ID NO: 4169380 - RNA, 13 nt, Yersinia pestis
cucuguuuuaaaa

SEQ ID NO: 4169381 - RNA, 22 nt, Yersinia pestis
cucuuaaagaaaauuuacccug

SEQ ID NO: 4169382 - RNA, 17 nt, Yersinia pestis
cucuuaaugucuuuacu

SEQ ID NO: 4169383 - RNA, 12 nt, Yersinia pestis
cucuuauauaaa

SEQ ID NO: 4169384 - RNA, 20 nt, Yersinia pestis
cucuuauauaaauccagccc

SEQ ID NO: 4169385 - RNA, 15 nt, Yersinia pestis
cucuuauuaaaugga

SEQ ID NO: 4169386 - RNA, 11 nt, Yersinia pestis
cucuucaccaa

SEQ ID NO: 4169387 - RNA, 17 nt, Yersinia pestis
cucuucagcaauuuuua

SEQ ID NO: 4169388 - RNA, 20 nt, Yersinia pestis
cucuucagccuauccucacc

SEQ ID NO: 4169389 - RNA, 20 nt, Yersinia pestis
cucuucagguaagccuuucu

SEQ ID NO: 4169390 - RNA, 23 nt, Yersinia pestis
cucuucauaagccagugcuauuc

SEQ ID NO: 4169391 - RNA, 16 nt, Yersinia pestis
cucuuccaauagcagu

SEQ ID NO: 4169392 - RNA, 22 nt, Yersinia pestis
cucuuccagcaacaugccauug

SEQ ID NO: 4169393 - RNA, 13 nt, Yersinia pestis
cucuucugggcug

SEQ ID NO: 4169394 - RNA, 19 nt, Yersinia pestis
cucuucugggcugaacgug

SEQ ID NO: 4169395 - RNA, 16 nt, Yersinia pestis
cucuucuucuuggugu

SEQ ID NO: 4169396 - RNA, 22 nt, Yersinia pestis
cucuucuuuacugcccucgcaa

SEQ ID NO: 4169397 - RNA, 17 nt, Yersinia pestis
cucuugaacggugagga

SEQ ID NO: 4169398 - RNA, 22 nt, Yersinia pestis
cucuugacgccgacaaacccac

SEQ ID NO: 4169399 - RNA, 23 nt, Yersinia pestis
cucuugacgccgacaaacccaca

SEQ ID NO: 4169400 - RNA, 15 nt, Yersinia pestis
cucuugagaaaugaa

SEQ ID NO: 4169401 - RNA, 21 nt, Yersinia pestis
cucuugauuaccaauaauuaa

SEQ ID NO: 4169402 - RNA, 19 nt, Yersinia pestis
cucuugcgcuccacgcccc

SEQ ID NO: 4169403 - RNA, 15 nt, Yersinia pestis
cucuuggcugacucc

SEQ ID NO: 4169404 - RNA, 13 nt, Yersinia pestis
cucuuguaaacca

SEQ ID NO: 4169405 - RNA, 18 nt, Yersinia pestis
cucuuguuuugcaaugcu

SEQ ID NO: 4169406 - RNA, 20 nt, Yersinia pestis
cucuuuaacaauuuaucaga

SEQ ID NO: 4169407 - RNA, 15 nt, Yersinia pestis
cucuuuaaguucacu

SEQ ID NO: 4169408 - RNA, 21 nt, Yersinia pestis
cucuuuauacauauguugagu

SEQ ID NO: 4169409 - RNA, 15 nt, Yersinia pestis
cucuuuauacuuugc

SEQ ID NO: 4169410 - RNA, 16 nt, Yersinia pestis
cucuuuccagcaaaag

SEQ ID NO: 4169411 - RNA, 17 nt, Yersinia pestis
cucuuuccccauuuuuu

SEQ ID NO: 4169412 - RNA, 16 nt, Yersinia pestis
cucuuucccuucaggu

SEQ ID NO: 4169413 - RNA, 16 nt, Yersinia pestis
cucuuucuucucuuca

SEQ ID NO: 4169414 - RNA, 18 nt, Yersinia pestis
cucuuuuugugcuucaua

SEQ ID NO: 4169415 - RNA, 17 nt, Yersinia pestis
cugaaaaaggcaccagc

SEQ ID NO: 4169416 - RNA, 23 nt, Yersinia pestis
cugaaaaaugagucauuaucuga

SEQ ID NO: 4169417 - RNA, 13 nt, Yersinia pestis
cugaaaaucauga

SEQ ID NO: 4169418 - RNA, 17 nt, Yersinia pestis
cugaaacggugaggaua

SEQ ID NO: 4169419 - RNA, 13 nt, Yersinia pestis
cugaaagcaaaca

SEQ ID NO: 4169420 - RNA, 21 nt, Yersinia pestis
cugaaagcaaacaauuaguca

SEQ ID NO: 4169421 - RNA, 16 nt, Yersinia pestis
cugaaaguguauuucu

SEQ ID NO: 4169422 - RNA, 17 nt, Yersinia pestis
cugaaaguguauuucuc

SEQ ID NO: 4169423 - RNA, 19 nt, Yersinia pestis
cugaaaguguauuucucaa

SEQ ID NO: 4169424 - RNA, 18 nt, Yersinia pestis
cugaaauauacacaaguc

SEQ ID NO: 4169425 - RNA, 14 nt, Yersinia pestis
cugaaaugacauug

SEQ ID NO: 4169426 - RNA, 14 nt, Yersinia pestis
cugaaauuuuuuaa

SEQ ID NO: 4169427 - RNA, 21 nt, Yersinia pestis
cugaacaaaauagucaguggg

SEQ ID NO: 4169428 - RNA, 17 nt, Yersinia pestis
cugaacaccauacuuuu

SEQ ID NO: 4169429 - RNA, 19 nt, Yersinia pestis
cugaacgccucaaaaaccu

SEQ ID NO: 4169430 - RNA, 18 nt, Yersinia pestis
cugaacguauauuggccu

SEQ ID NO: 4169431 - RNA, 21 nt, Yersinia pestis
cugaacucaucagcgcccccu

SEQ ID NO: 4169432 - RNA, 20 nt, Yersinia pestis
cugaacuuuaacuuccaauu

SEQ ID NO: 4169433 - RNA, 21 nt, Yersinia pestis
cugaacuuuaacuuccaauuu

SEQ ID NO: 4169434 - RNA, 20 nt, Yersinia pestis
cugaagagaaauaacccaua

SEQ ID NO: 4169435 - RNA, 14 nt, Yersinia pestis
cugaagcaucaaua

SEQ ID NO: 4169436 - RNA, 17 nt, Yersinia pestis
cugaagccuacgagaga

SEQ ID NO: 4169437 - RNA, 15 nt, Yersinia pestis
cugaaggccugcugu

SEQ ID NO: 4169438 - RNA, 22 nt, Yersinia pestis
cugaagggcaaauugccgcuuu

SEQ ID NO: 4169439 - RNA, 13 nt, Yersinia pestis
cugaaguuaaaaa

SEQ ID NO: 4169440 - RNA, 19 nt, Yersinia pestis
cugaauaaaaaauuauuaa

SEQ ID NO: 4169441 - RNA, 22 nt, Yersinia pestis
cugaauaaaaaauuauuaaaua

SEQ ID NO: 4169442 - RNA, 23 nt, Yersinia pestis
cugaauaaaaaauuauuaaauaa

SEQ ID NO: 4169443 - RNA, 14 nt, Yersinia pestis
cugaauaacugaac

SEQ ID NO: 4169444 - RNA, 23 nt, Yersinia pestis
cugaauacacucguggugauuaa

SEQ ID NO: 4169445 - RNA, 14 nt, Yersinia pestis
cugaauaccauaac

SEQ ID NO: 4169446 - RNA, 18 nt, Yersinia pestis
cugaauaggggaauuuuu

SEQ ID NO: 4169447 - RNA, 18 nt, Yersinia pestis
cugaauauaaauuuaaua

SEQ ID NO: 4169448 - RNA, 19 nt, Yersinia pestis
cugaauauaaauuuaauaa

SEQ ID NO: 4169449 - RNA, 20 nt, Yersinia pestis
cugaauauaaauuuaauaaa

SEQ ID NO: 4169450 - RNA, 18 nt, Yersinia pestis
cugaauaucaucuuuuuc

SEQ ID NO: 4169451 - RNA, 20 nt, Yersinia pestis
cugaauaucaucuuuuucug

SEQ ID NO: 4169452 - RNA, 16 nt, Yersinia pestis
cugaauauccguucag

SEQ ID NO: 4169453 - RNA, 19 nt, Yersinia pestis
cugaaucccagaaccucaa

SEQ ID NO: 4169454 - RNA, 23 nt, Yersinia pestis
cugaaucccagaaccucaacauu

SEQ ID NO: 4169455 - RNA, 16 nt, Yersinia pestis
cugaauccccucaaaa

SEQ ID NO: 4169456 - RNA, 15 nt, Yersinia pestis
cugaaucgauaaacc

SEQ ID NO: 4169457 - RNA, 18 nt, Yersinia pestis
cugaaucuguaagucauu

SEQ ID NO: 4169458 - RNA, 23 nt, Yersinia pestis
cugaaugcacgauaccaccacca

SEQ ID NO: 4169459 - RNA, 15 nt, Yersinia pestis
cugaauggaaaaauu

SEQ ID NO: 4169460 - RNA, 16 nt, Yersinia pestis
cugaauggaucacauc

SEQ ID NO: 4169461 - RNA, 22 nt, Yersinia pestis
cugaauggaucacaucacagug

SEQ ID NO: 4169462 - RNA, 22 nt, Yersinia pestis
cugaauggauugaaaccgcuga

SEQ ID NO: 4169463 - RNA, 15 nt, Yersinia pestis
cugaaugucucuggc

SEQ ID NO: 4169464 - RNA, 13 nt, Yersinia pestis
cugaauucuguag

SEQ ID NO: 4169465 - RNA, 16 nt, Yersinia pestis
cugaauugauuuauuc

SEQ ID NO: 4169466 - RNA, 16 nt, Yersinia pestis
cugaauuggaagagcc

SEQ ID NO: 4169467 - RNA, 12 nt, Yersinia pestis
cugaauuucaau

SEQ ID NO: 4169468 - RNA, 17 nt, Yersinia pestis
cugaauuuuuuaccuag

SEQ ID NO: 4169469 - RNA, 14 nt, Yersinia pestis
cugacacacaccag

SEQ ID NO: 4169470 - RNA, 21 nt, Yersinia pestis
cugacaccggggauccauagg

SEQ ID NO: 4169471 - RNA, 14 nt, Yersinia pestis
cugacagccugugc

SEQ ID NO: 4169472 - RNA, 22 nt, Yersinia pestis
cugacauuauuggcguaacugc

SEQ ID NO: 4169473 - RNA, 23 nt, Yersinia pestis
cugacauuauuggcguaacugcu

SEQ ID NO: 4169474 - RNA, 23 nt, Yersinia pestis
cugacauuugcaucuauggauua

SEQ ID NO: 4169475 - RNA, 22 nt, Yersinia pestis
cugacauuuucuaucucaucca

SEQ ID NO: 4169476 - RNA, 13 nt, Yersinia pestis
cugaccaaacauu

SEQ ID NO: 4169477 - RNA, 20 nt, Yersinia pestis
cugaccaaacauugucaccu

SEQ ID NO: 4169478 - RNA, 17 nt, Yersinia pestis
cugaccacaaaaacagu

SEQ ID NO: 4169479 - RNA, 21 nt, Yersinia pestis
cugaccacgauuuaaugguuu

SEQ ID NO: 4169480 - RNA, 21 nt, Yersinia pestis
cugaccagcggugccuugcca

SEQ ID NO: 4169481 - RNA, 16 nt, Yersinia pestis
cugaccccaaauuuga

SEQ ID NO: 4169482 - RNA, 14 nt, Yersinia pestis
cugaccuauugaua

SEQ ID NO: 4169483 - RNA, 22 nt, Yersinia pestis
cugaccuauugauaaaaccacu

SEQ ID NO: 4169484 - RNA, 14 nt, Yersinia pestis
cugacgaaugacuc

SEQ ID NO: 4169485 - RNA, 18 nt, Yersinia pestis
cugacgaugauaaaucag

SEQ ID NO: 4169486 - RNA, 12 nt, Yersinia pestis
cugacgccacca

SEQ ID NO: 4169487 - RNA, 13 nt, Yersinia pestis
cugacggcagaca

SEQ ID NO: 4169488 - RNA, 17 nt, Yersinia pestis
cugacggccagcaaccu

SEQ ID NO: 4169489 - RNA, 22 nt, Yersinia pestis
cugacgggcgcggguaauggcg

SEQ ID NO: 4169490 - RNA, 16 nt, Yersinia pestis
cugacggguauaucac

SEQ ID NO: 4169491 - RNA, 16 nt, Yersinia pestis
cugacgguuucaacau

SEQ ID NO: 4169492 - RNA, 17 nt, Yersinia pestis
cugacguaguguauuca

SEQ ID NO: 4169493 - RNA, 13 nt, Yersinia pestis
cugacgucagauc

SEQ ID NO: 4169494 - RNA, 15 nt, Yersinia pestis
cugacucccucaccg

SEQ ID NO: 4169495 - RNA, 16 nt, Yersinia pestis
cugacucccugacucc

SEQ ID NO: 4169496 - RNA, 17 nt, Yersinia pestis
cugacugaagaauucag

SEQ ID NO: 4169497 - RNA, 20 nt, Yersinia pestis
cugacugccauaauccagaa

SEQ ID NO: 4169498 - RNA, 13 nt, Yersinia pestis
cugacugcuggca

SEQ ID NO: 4169499 - RNA, 14 nt, Yersinia pestis
cugacugcuggcag

SEQ ID NO: 4169500 - RNA, 22 nt, Yersinia pestis
cugacuuguggaacaacaggcg

SEQ ID NO: 4169501 - RNA, 21 nt, Yersinia pestis
cugacuuguuguugaccucaa

SEQ ID NO: 4169502 - RNA, 19 nt, Yersinia pestis
cugagaagcggaauuugcu

SEQ ID NO: 4169503 - RNA, 21 nt, Yersinia pestis
cugagacguccauaaucugga

SEQ ID NO: 4169504 - RNA, 19 nt, Yersinia pestis
cugagagccgcuauaaccu

SEQ ID NO: 4169505 - RNA, 15 nt, Yersinia pestis
cugagauuauuggcg

SEQ ID NO: 4169506 - RNA, 19 nt, Yersinia pestis
cugagccucaugaaugagg

SEQ ID NO: 4169507 - RNA, 12 nt, Yersinia pestis
cugagccuucaa

SEQ ID NO: 4169508 - RNA, 15 nt, Yersinia pestis
cugagcgaacugaau

SEQ ID NO: 4169509 - RNA, 21 nt, Yersinia pestis
cugagcgacauuucggccacc

SEQ ID NO: 4169510 - RNA, 14 nt, Yersinia pestis
cugagcgaucaaua

SEQ ID NO: 4169511 - RNA, 21 nt, Yersinia pestis
cugagcgaucaauacaccaga

SEQ ID NO: 4169512 - RNA, 22 nt, Yersinia pestis
cugagcgaucaauacaccagac

SEQ ID NO: 4169513 - RNA, 21 nt, Yersinia pestis
cugagcuguaaauauaaaaua

SEQ ID NO: 4169514 - RNA, 22 nt, Yersinia pestis
cugaggacggaugguaaagcag

SEQ ID NO: 4169515 - RNA, 23 nt, Yersinia pestis
cugaggccaacacucaugacaaa

SEQ ID NO: 4169516 - RNA, 15 nt, Yersinia pestis
cugaggcguggcaca

SEQ ID NO: 4169517 - RNA, 13 nt, Yersinia pestis
cugagggccacuu

SEQ ID NO: 4169518 - RNA, 22 nt, Yersinia pestis
cugaggggcguuuaaugccccu

SEQ ID NO: 4169519 - RNA, 23 nt, Yersinia pestis
cugagguucccaacggcagaagu

SEQ ID NO: 4169520 - RNA, 17 nt, Yersinia pestis
cugagguugcucagcgg

SEQ ID NO: 4169521 - RNA, 19 nt, Yersinia pestis
cugaguaaauuaaauuuua

SEQ ID NO: 4169522 - RNA, 12 nt, Yersinia pestis
cugaguaauauu

SEQ ID NO: 4169523 - RNA, 14 nt, Yersinia pestis
cugaguaauauuau

SEQ ID NO: 4169524 - RNA, 16 nt, Yersinia pestis
cugaguaauauuauuc

SEQ ID NO: 4169525 - RNA, 17 nt, Yersinia pestis
cugagucaguaauucac

SEQ ID NO: 4169526 - RNA, 13 nt, Yersinia pestis
cugagucagucag

SEQ ID NO: 4169527 - RNA, 22 nt, Yersinia pestis
cugagucgcuugauucucauua

SEQ ID NO: 4169528 - RNA, 20 nt, Yersinia pestis
cugagugggggcgauuaauu

SEQ ID NO: 4169529 - RNA, 11 nt, Yersinia pestis
cugaguucugc

SEQ ID NO: 4169530 - RNA, 16 nt, Yersinia pestis
cugaguucugcugcca

SEQ ID NO: 4169531 - RNA, 15 nt, Yersinia pestis
cugaguuguaaugaa

SEQ ID NO: 4169532 - RNA, 13 nt, Yersinia pestis
cugauaaaacagu

SEQ ID NO: 4169533 - RNA, 15 nt, Yersinia pestis
cugauaaaacaguuc

SEQ ID NO: 4169534 - RNA, 16 nt, Yersinia pestis
cugauagcagaaaccc

SEQ ID NO: 4169535 - RNA, 20 nt, Yersinia pestis
cugauagugauuuuuuucac

SEQ ID NO: 4169536 - RNA, 15 nt, Yersinia pestis
cugauaucucuuuau

SEQ ID NO: 4169537 - RNA, 17 nt, Yersinia pestis
cugauaucucuuuauca

SEQ ID NO: 4169538 - RNA, 22 nt, Yersinia pestis
cugauaucuucacucagcgcug

SEQ ID NO: 4169539 - RNA, 22 nt, Yersinia pestis
cugaucaauaucccgagaaaca

SEQ ID NO: 4169540 - RNA, 13 nt, Yersinia pestis
cugaucacuggca

SEQ ID NO: 4169541 - RNA, 14 nt, Yersinia pestis
cugaucagcauuuc

SEQ ID NO: 4169542 - RNA, 14 nt, Yersinia pestis
cugauccaguuuca

SEQ ID NO: 4169543 - RNA, 11 nt, Yersinia pestis
cugaucgagca

SEQ ID NO: 4169544 - RNA, 14 nt, Yersinia pestis
cugaucgcugugca

SEQ ID NO: 4169545 - RNA, 14 nt, Yersinia pestis
cugaucgugccauu

SEQ ID NO: 4169546 - RNA, 21 nt, Yersinia pestis
cugaucugccccuggcucagu

SEQ ID NO: 4169547 - RNA, 18 nt, Yersinia pestis
cugaucuucauugccuuc

SEQ ID NO: 4169548 - RNA, 21 nt, Yersinia pestis
cugaugacgccguacaaauau

SEQ ID NO: 4169549 - RNA, 16 nt, Yersinia pestis
cugaugacgcgccaua

SEQ ID NO: 4169550 - RNA, 12 nt, Yersinia pestis
cugaugagaggg

SEQ ID NO: 4169551 - RNA, 14 nt, Yersinia pestis
cugaugagagggag

SEQ ID NO: 4169552 - RNA, 23 nt, Yersinia pestis
cugaugagagggaguuauucuga

SEQ ID NO: 4169553 - RNA, 13 nt, Yersinia pestis
cugaugcaccuca

SEQ ID NO: 4169554 - RNA, 19 nt, Yersinia pestis
cugaugcgguagugaugca

SEQ ID NO: 4169555 - RNA, 15 nt, Yersinia pestis
cugaugcuuuucuuu

SEQ ID NO: 4169556 - RNA, 23 nt, Yersinia pestis
cugauguauucccucaauagcua

SEQ ID NO: 4169557 - RNA, 17 nt, Yersinia pestis
cugaugugcauguggaa

SEQ ID NO: 4169558 - RNA, 16 nt, Yersinia pestis
cugauguguauauuuu

SEQ ID NO: 4169559 - RNA, 16 nt, Yersinia pestis
cugauguucgcuggug

SEQ ID NO: 4169560 - RNA, 15 nt, Yersinia pestis
cugauguucugccaa

SEQ ID NO: 4169561 - RNA, 13 nt, Yersinia pestis
cugauguuuugcu

SEQ ID NO: 4169562 - RNA, 11 nt, Yersinia pestis
cugauuaauag

SEQ ID NO: 4169563 - RNA, 15 nt, Yersinia pestis
cugauuaauauccaa

SEQ ID NO: 4169564 - RNA, 22 nt, Yersinia pestis
cugauucaacacggugaauaaa

SEQ ID NO: 4169565 - RNA, 14 nt, Yersinia pestis
cugauucacuggca

SEQ ID NO: 4169566 - RNA, 17 nt, Yersinia pestis
cugauucagauuuacuc

SEQ ID NO: 4169567 - RNA, 19 nt, Yersinia pestis
cugauucgcgaccagcaga

SEQ ID NO: 4169568 - RNA, 22 nt, Yersinia pestis
cugauucgcgaccagcagaagu

SEQ ID NO: 4169569 - RNA, 14 nt, Yersinia pestis
cugauuguaacaau

SEQ ID NO: 4169570 - RNA, 19 nt, Yersinia pestis
cugauuguaacaauccgaa

SEQ ID NO: 4169571 - RNA, 13 nt, Yersinia pestis
cugauuuuuauca

SEQ ID NO: 4169572 - RNA, 23 nt, Yersinia pestis
cugauuuuuucgaguaguuuggc

SEQ ID NO: 4169573 - RNA, 13 nt, Yersinia pestis
cugcaaacgagag

SEQ ID NO: 4169574 - RNA, 17 nt, Yersinia pestis
cugcaaacuggcaggga

SEQ ID NO: 4169575 - RNA, 19 nt, Yersinia pestis
cugcaaauuaaccugcugg

SEQ ID NO: 4169576 - RNA, 22 nt, Yersinia pestis
cugcaaauuagcggauuaauaa

SEQ ID NO: 4169577 - RNA, 19 nt, Yersinia pestis
cugcaaauuuauccaaucu

SEQ ID NO: 4169578 - RNA, 15 nt, Yersinia pestis
cugcaacccacgccc

SEQ ID NO: 4169579 - RNA, 15 nt, Yersinia pestis
cugcaacucuugcgc

SEQ ID NO: 4169580 - RNA, 21 nt, Yersinia pestis
cugcaagaguccagcacuggu

SEQ ID NO: 4169581 - RNA, 16 nt, Yersinia pestis
cugcaagcaauguuca

SEQ ID NO: 4169582 - RNA, 16 nt, Yersinia pestis
cugcaauaacaccagc

SEQ ID NO: 4169583 - RNA, 20 nt, Yersinia pestis
cugcaaugcccagagcgcgg

SEQ ID NO: 4169584 - RNA, 20 nt, Yersinia pestis
cugcaauggcuggcaaggca

SEQ ID NO: 4169585 - RNA, 16 nt, Yersinia pestis
cugcaauuauaagcac

SEQ ID NO: 4169586 - RNA, 14 nt, Yersinia pestis
cugcacaucaagua

SEQ ID NO: 4169587 - RNA, 17 nt, Yersinia pestis
cugcacaucauuuauuu

SEQ ID NO: 4169588 - RNA, 18 nt, Yersinia pestis
cugcaccaaugacuaauu

SEQ ID NO: 4169589 - RNA, 13 nt, Yersinia pestis
cugcaccacgccg

SEQ ID NO: 4169590 - RNA, 16 nt, Yersinia pestis
cugcaccacgccgaac

SEQ ID NO: 4169591 - RNA, 21 nt, Yersinia pestis
cugcaccccaaauguuggaua

SEQ ID NO: 4169592 - RNA, 17 nt, Yersinia pestis
cugcaccuaacaaacgu

SEQ ID NO: 4169593 - RNA, 20 nt, Yersinia pestis
cugcaccuaacaaacguuca

SEQ ID NO: 4169594 - RNA, 16 nt, Yersinia pestis
cugcacguuuaauuuc

SEQ ID NO: 4169595 - RNA, 16 nt, Yersinia pestis
cugcacucauugccug

SEQ ID NO: 4169596 - RNA, 13 nt, Yersinia pestis
cugcacugcucua

SEQ ID NO: 4169597 - RNA, 14 nt, Yersinia pestis
cugcacugcucuau

SEQ ID NO: 4169598 - RNA, 18 nt, Yersinia pestis
cugcagaaucacuggcag

SEQ ID NO: 4169599 - RNA, 20 nt, Yersinia pestis
cugcagcgauauacaucacg

SEQ ID NO: 4169600 - RNA, 23 nt, Yersinia pestis
cugcaggaucuggauuuuccaga

SEQ ID NO: 4169601 - RNA, 14 nt, Yersinia pestis
cugcagggccuuua

SEQ ID NO: 4169602 - RNA, 23 nt, Yersinia pestis
cugcagugaaaagguuaacugca

SEQ ID NO: 4169603 - RNA, 21 nt, Yersinia pestis
cugcaguuuccaacacgauau

SEQ ID NO: 4169604 - RNA, 21 nt, Yersinia pestis
cugcauaaaaauagcccuccc

SEQ ID NO: 4169605 - RNA, 15 nt, Yersinia pestis
cugcauacagaucga

SEQ ID NO: 4169606 - RNA, 15 nt, Yersinia pestis
cugcauagcuaaccu

SEQ ID NO: 4169607 - RNA, 18 nt, Yersinia pestis
cugcauagcuaaccuuaa

SEQ ID NO: 4169608 - RNA, 17 nt, Yersinia pestis
cugcauauccucccgcu

SEQ ID NO: 4169609 - RNA, 15 nt, Yersinia pestis
cugcaucaagccgcu

SEQ ID NO: 4169610 - RNA, 20 nt, Yersinia pestis
cugcaucagcagugacguca

SEQ ID NO: 4169611 - RNA, 13 nt, Yersinia pestis
cugcaucaucaca

SEQ ID NO: 4169612 - RNA, 17 nt, Yersinia pestis
cugcaucaucacauuca

SEQ ID NO: 4169613 - RNA, 13 nt, Yersinia pestis
cugcauuaaaaua

SEQ ID NO: 4169614 - RNA, 17 nt, Yersinia pestis
cugcauugauuaaauca

SEQ ID NO: 4169615 - RNA, 16 nt, Yersinia pestis
cugcauuucaacaaaa

SEQ ID NO: 4169616 - RNA, 13 nt, Yersinia pestis
cugccaaaaaaua

SEQ ID NO: 4169617 - RNA, 21 nt, Yersinia pestis
cugccaaaaaauaagggccac

SEQ ID NO: 4169618 - RNA, 22 nt, Yersinia pestis
cugccaaauauugcacaauagc

SEQ ID NO: 4169619 - RNA, 13 nt, Yersinia pestis
cugccaauaucca

SEQ ID NO: 4169620 - RNA, 20 nt, Yersinia pestis
cugccaauauccauauuaaa

SEQ ID NO: 4169621 - RNA, 20 nt, Yersinia pestis
cugccaauauugaccaacgc

SEQ ID NO: 4169622 - RNA, 14 nt, Yersinia pestis
cugccaaucgcucu

SEQ ID NO: 4169623 - RNA, 23 nt, Yersinia pestis
cugccaaucgcucugcguuuuuc

SEQ ID NO: 4169624 - RNA, 23 nt, Yersinia pestis
cugccacacuuuugcugguguca

SEQ ID NO: 4169625 - RNA, 15 nt, Yersinia pestis
cugccaccaaaugcu

SEQ ID NO: 4169626 - RNA, 17 nt, Yersinia pestis
cugccaccaaaugcuca

SEQ ID NO: 4169627 - RNA, 18 nt, Yersinia pestis
cugccaccgucgcagaac

SEQ ID NO: 4169628 - RNA, 21 nt, Yersinia pestis
cugccaccgucgcagaaccca

SEQ ID NO: 4169629 - RNA, 22 nt, Yersinia pestis
cugccagaaucagccccaagcu

SEQ ID NO: 4169630 - RNA, 16 nt, Yersinia pestis
cugccagaaucgccug

SEQ ID NO: 4169631 - RNA, 19 nt, Yersinia pestis
cugccagauagucaucuuu

SEQ ID NO: 4169632 - RNA, 16 nt, Yersinia pestis
cugccagccauaucca

SEQ ID NO: 4169633 - RNA, 18 nt, Yersinia pestis
cugccagccauauccaaa

SEQ ID NO: 4169634 - RNA, 16 nt, Yersinia pestis
cugccagcccacgagg

SEQ ID NO: 4169635 - RNA, 19 nt, Yersinia pestis
cugccagcguugcagaguu

SEQ ID NO: 4169636 - RNA, 23 nt, Yersinia pestis
cugccagugggauaucugcggug

SEQ ID NO: 4169637 - RNA, 14 nt, Yersinia pestis
cugccauaaccgcu

SEQ ID NO: 4169638 - RNA, 22 nt, Yersinia pestis
cugccauaaccgcuaaggccaa

SEQ ID NO: 4169639 - RNA, 13 nt, Yersinia pestis
cugccauaaucca

SEQ ID NO: 4169640 - RNA, 17 nt, Yersinia pestis
cugccaugggaaaucaa

SEQ ID NO: 4169641 - RNA, 18 nt, Yersinia pestis
cugccaugggaaaucaaa

SEQ ID NO: 4169642 - RNA, 13 nt, Yersinia pestis
cugccauugcuca

SEQ ID NO: 4169643 - RNA, 14 nt, Yersinia pestis
cugcccaaaaucaa

SEQ ID NO: 4169644 - RNA, 15 nt, Yersinia pestis
cugcccaagaauaau

SEQ ID NO: 4169645 - RNA, 22 nt, Yersinia pestis
cugcccagucacuaccgcucag

SEQ ID NO: 4169646 - RNA, 21 nt, Yersinia pestis
cugcccccccgaugacacgau

SEQ ID NO: 4169647 - RNA, 15 nt, Yersinia pestis
cugcccccccuuuca

SEQ ID NO: 4169648 - RNA, 18 nt, Yersinia pestis
cugccccgaagcucaagc

SEQ ID NO: 4169649 - RNA, 16 nt, Yersinia pestis
cugccccucuuuucuu

SEQ ID NO: 4169650 - RNA, 16 nt, Yersinia pestis
cugccgcacugccacc

SEQ ID NO: 4169651 - RNA, 21 nt, Yersinia pestis
cugccgccaccauaucagaac

SEQ ID NO: 4169652 - RNA, 18 nt, Yersinia pestis
cugccgcgccagauucua

SEQ ID NO: 4169653 - RNA, 19 nt, Yersinia pestis
cugccgcgccagauucuag

SEQ ID NO: 4169654 - RNA, 22 nt, Yersinia pestis
cugccggcguuaaugccacccc

SEQ ID NO: 4169655 - RNA, 14 nt, Yersinia pestis
cugccguaaacaau

SEQ ID NO: 4169656 - RNA, 20 nt, Yersinia pestis
cugccgucuaucugccagau

SEQ ID NO: 4169657 - RNA, 12 nt, Yersinia pestis
cugccuauccuc

SEQ ID NO: 4169658 - RNA, 14 nt, Yersinia pestis
cugccuauccucac

SEQ ID NO: 4169659 - RNA, 15 nt, Yersinia pestis
cugccuauccucacc

SEQ ID NO: 4169660 - RNA, 23 nt, Yersinia pestis
cugccuaugcguuggcugccuuc

SEQ ID NO: 4169661 - RNA, 21 nt, Yersinia pestis
cugccuauucuuaccguuuca

SEQ ID NO: 4169662 - RNA, 14 nt, Yersinia pestis
cugccuauuuaucg

SEQ ID NO: 4169663 - RNA, 14 nt, Yersinia pestis
cugccugagguucc

SEQ ID NO: 4169664 - RNA, 13 nt, Yersinia pestis
cugccugaguaau

SEQ ID NO: 4169665 - RNA, 15 nt, Yersinia pestis
cugccugcaccagug

SEQ ID NO: 4169666 - RNA, 14 nt, Yersinia pestis
cugccugccugagg

SEQ ID NO: 4169667 - RNA, 14 nt, Yersinia pestis
cugccugccugcug

SEQ ID NO: 4169668 - RNA, 15 nt, Yersinia pestis
cugccuguucucucc

SEQ ID NO: 4169669 - RNA, 18 nt, Yersinia pestis
cugcgaccaaaagccacc

SEQ ID NO: 4169670 - RNA, 15 nt, Yersinia pestis
cugcgaccaaggcuc

SEQ ID NO: 4169671 - RNA, 22 nt, Yersinia pestis
cugcgaccaaggcucuggcaau

SEQ ID NO: 4169672 - RNA, 14 nt, Yersinia pestis
cugcgagcguuuaa

SEQ ID NO: 4169673 - RNA, 20 nt, Yersinia pestis
cugcgagcguuuaaauaccc

SEQ ID NO: 4169674 - RNA, 13 nt, Yersinia pestis
cugcgaucugccu

SEQ ID NO: 4169675 - RNA, 16 nt, Yersinia pestis
cugcgcauugauaauc

SEQ ID NO: 4169676 - RNA, 18 nt, Yersinia pestis
cugcgcauuucacccucu

SEQ ID NO: 4169677 - RNA, 19 nt, Yersinia pestis
cugcgcauuucacccucug

SEQ ID NO: 4169678 - RNA, 20 nt, Yersinia pestis
cugcgccacccauugcucaa

SEQ ID NO: 4169679 - RNA, 17 nt, Yersinia pestis
cugcgccacgcuuuagc

SEQ ID NO: 4169680 - RNA, 14 nt, Yersinia pestis
cugcgccagcagca

SEQ ID NO: 4169681 - RNA, 23 nt, Yersinia pestis
cugcgcccaaaucugcccccagc

SEQ ID NO: 4169682 - RNA, 13 nt, Yersinia pestis
cugcgccugcgcu

SEQ ID NO: 4169683 - RNA, 23 nt, Yersinia pestis
cugcgcgacaaaaccgauggcuu

SEQ ID NO: 4169684 - RNA, 22 nt, Yersinia pestis
cugcggcacugacacuccccug

SEQ ID NO: 4169685 - RNA, 17 nt, Yersinia pestis
cugcggcgucugauaac

SEQ ID NO: 4169686 - RNA, 12 nt, Yersinia pestis
cugcggcuuucu

SEQ ID NO: 4169687 - RNA, 17 nt, Yersinia pestis
cugcggcuuucugccug

SEQ ID NO: 4169688 - RNA, 18 nt, Yersinia pestis
cugcggcuuucugccugu

SEQ ID NO: 4169689 - RNA, 12 nt, Yersinia pestis
cugcgggcacua

SEQ ID NO: 4169690 - RNA, 21 nt, Yersinia pestis
cugcguauggggauuuuauua

SEQ ID NO: 4169691 - RNA, 23 nt, Yersinia pestis
cugcguauggggauuuuauuaca

SEQ ID NO: 4169692 - RNA, 16 nt, Yersinia pestis
cugcgucuuuaucgcc

SEQ ID NO: 4169693 - RNA, 22 nt, Yersinia pestis
cugcgugaaacgauaugcucca

SEQ ID NO: 4169694 - RNA, 14 nt, Yersinia pestis
cugcguucuucuug

SEQ ID NO: 4169695 - RNA, 22 nt, Yersinia pestis
cugcuaccaggaagcggccagg

SEQ ID NO: 4169696 - RNA, 22 nt, Yersinia pestis
cugcuaucaugauaaauaauaa

SEQ ID NO: 4169697 - RNA, 22 nt, Yersinia pestis
cugcuauuuaacaaaaaauuaa

SEQ ID NO: 4169698 - RNA, 12 nt, Yersinia pestis
cugcucaacugc

SEQ ID NO: 4169699 - RNA, 14 nt, Yersinia pestis
cugcucaacugcuc

SEQ ID NO: 4169700 - RNA, 16 nt, Yersinia pestis
cugcucaacugcucaa

SEQ ID NO: 4169701 - RNA, 17 nt, Yersinia pestis
cugcucaacugcucaac

SEQ ID NO: 4169702 - RNA, 20 nt, Yersinia pestis
cugcucaacugcucaacgcc

SEQ ID NO: 4169703 - RNA, 13 nt, Yersinia pestis
cugcucacgcaaa

SEQ ID NO: 4169704 - RNA, 23 nt, Yersinia pestis
cugcucacgguagguuucugggc

SEQ ID NO: 4169705 - RNA, 15 nt, Yersinia pestis
cugcucauaaagcau

SEQ ID NO: 4169706 - RNA, 16 nt, Yersinia pestis
cugcucauaagauacc

SEQ ID NO: 4169707 - RNA, 17 nt, Yersinia pestis
cugcuccaaagcuucca

SEQ ID NO: 4169708 - RNA, 22 nt, Yersinia pestis
cugcucccguaaacguucugcc

SEQ ID NO: 4169709 - RNA, 23 nt, Yersinia pestis
cugcucccguaaacguucugcca

SEQ ID NO: 4169710 - RNA, 13 nt, Yersinia pestis
cugcucgcccaag

SEQ ID NO: 4169711 - RNA, 15 nt, Yersinia pestis
cugcucgcccaagcg

SEQ ID NO: 4169712 - RNA, 14 nt, Yersinia pestis
cugcucuaucucuu

SEQ ID NO: 4169713 - RNA, 15 nt, Yersinia pestis
cugcucuaucucuuc

SEQ ID NO: 4169714 - RNA, 12 nt, Yersinia pestis
cugcucugcccc

SEQ ID NO: 4169715 - RNA, 15 nt, Yersinia pestis
cugcucuugcucagu

SEQ ID NO: 4169716 - RNA, 20 nt, Yersinia pestis
cugcugaaaaaugagucauu

SEQ ID NO: 4169717 - RNA, 15 nt, Yersinia pestis
cugcugacaaacccc

SEQ ID NO: 4169718 - RNA, 11 nt, Yersinia pestis
cugcugacaac

SEQ ID NO: 4169719 - RNA, 15 nt, Yersinia pestis
cugcugaucgccaau

SEQ ID NO: 4169720 - RNA, 15 nt, Yersinia pestis
cugcuggaaugcagu

SEQ ID NO: 4169721 - RNA, 15 nt, Yersinia pestis
uuucgggcaaaaaaa

SEQ ID NO: 4169722 - RNA, 15 nt, Yersinia pestis
uuucgguaauacuga

SEQ ID NO: 4169723 - RNA, 17 nt, Yersinia pestis
uuucguuuaaaaaauau

SEQ ID NO: 4169724 - RNA, 15 nt, Yersinia pestis
uuucguuucugucug

SEQ ID NO: 4169725 - RNA, 17 nt, Yersinia pestis
uuucuaacaaaccuaaa

SEQ ID NO: 4169726 - RNA, 17 nt, Yersinia pestis
uuucuaccgcuucagca

SEQ ID NO: 4169727 - RNA, 19 nt, Yersinia pestis
uuucuacgccgucaucauc

SEQ ID NO: 4169728 - RNA, 13 nt, Yersinia pestis
uuucuaguggcaa

SEQ ID NO: 4169729 - RNA, 17 nt, Yersinia pestis
uuucuauccgaaaaaua

SEQ ID NO: 4169730 - RNA, 13 nt, Yersinia pestis
uuucuauuuucag

SEQ ID NO: 4169731 - RNA, 16 nt, Yersinia pestis
uuucuauuuucagcau

SEQ ID NO: 4169732 - RNA, 15 nt, Yersinia pestis
uuucucaucgcuuuu

SEQ ID NO: 4169733 - RNA, 20 nt, Yersinia pestis
uuucuccgauucaccuugau

SEQ ID NO: 4169734 - RNA, 17 nt, Yersinia pestis
uuucucgcucaggaucg

SEQ ID NO: 4169735 - RNA, 19 nt, Yersinia pestis
uuucucggccaacaucuuc

SEQ ID NO: 4169736 - RNA, 18 nt, Yersinia pestis
uuucucucuacuucgucu

SEQ ID NO: 4169737 - RNA, 15 nt, Yersinia pestis
uuucucuuugcgcug

SEQ ID NO: 4169738 - RNA, 13 nt, Yersinia pestis
uuucugccuaucu

SEQ ID NO: 4169739 - RNA, 13 nt, Yersinia pestis
uuucugccugugg

SEQ ID NO: 4169740 - RNA, 13 nt, Yersinia pestis
uuucuggaaugag

SEQ ID NO: 4169741 - RNA, 17 nt, Yersinia pestis
uuucuuacuaaaauauc

SEQ ID NO: 4169742 - RNA, 23 nt, Yersinia pestis
uuucuuagaccaccgccauuucc

SEQ ID NO: 4169743 - RNA, 15 nt, Yersinia pestis
uuucuucugagauau

SEQ ID NO: 4169744 - RNA, 11 nt, Yersinia pestis
uuucuugccag

SEQ ID NO: 4169745 - RNA, 14 nt, Yersinia pestis
uuucuuuaugucuu

SEQ ID NO: 4169746 - RNA, 19 nt, Yersinia pestis
uuucuuucaggcugguugg

SEQ ID NO: 4169747 - RNA, 20 nt, Yersinia pestis
uuugaaccgcuaucugcuga

SEQ ID NO: 4169748 - RNA, 23 nt, Yersinia pestis
uuugaacgacaugugaguggugu

SEQ ID NO: 4169749 - RNA, 21 nt, Yersinia pestis
uuugaagacaacucuucuauc

SEQ ID NO: 4169750 - RNA, 13 nt, Yersinia pestis
uuugaauccagug

SEQ ID NO: 4169751 - RNA, 15 nt, Yersinia pestis
uuugaauggcugcca

SEQ ID NO: 4169752 - RNA, 22 nt, Yersinia pestis
uuugaauuuggugguggccugg

SEQ ID NO: 4169753 - RNA, 18 nt, Yersinia pestis
uuugacacgggaucaaca

SEQ ID NO: 4169754 - RNA, 15 nt, Yersinia pestis
uuugacauuuccuug

SEQ ID NO: 4169755 - RNA, 13 nt, Yersinia pestis
uuugaccagggcu

SEQ ID NO: 4169756 - RNA, 14 nt, Yersinia pestis
uuugacuggaauau

SEQ ID NO: 4169757 - RNA, 17 nt, Yersinia pestis
uuugagcuugcugcuga

SEQ ID NO: 4169758 - RNA, 14 nt, Yersinia pestis
uuugaguaacaaga

SEQ ID NO: 4169759 - RNA, 13 nt, Yersinia pestis
uuugaugcuaauu

SEQ ID NO: 4169760 - RNA, 15 nt, Yersinia pestis
uuugauuaaaacccc

SEQ ID NO: 4169761 - RNA, 16 nt, Yersinia pestis
uuugauucaaaaugcc

SEQ ID NO: 4169762 - RNA, 19 nt, Yersinia pestis
uuugauucaaaaugccagu

SEQ ID NO: 4169763 - RNA, 21 nt, Yersinia pestis
uuugauucgucugccauugcu

SEQ ID NO: 4169764 - RNA, 23 nt, Yersinia pestis
uuugcaacgcaggcacugcagaa

SEQ ID NO: 4169765 - RNA, 19 nt, Yersinia pestis
uuugcaauuaauuggccca

SEQ ID NO: 4169766 - RNA, 13 nt, Yersinia pestis
uuugcagaaagua

SEQ ID NO: 4169767 - RNA, 18 nt, Yersinia pestis
uuugcagucgcuucaucc

SEQ ID NO: 4169768 - RNA, 21 nt, Yersinia pestis
uuugcauaauuaugaaaguaa

SEQ ID NO: 4169769 - RNA, 15 nt, Yersinia pestis
uuugcauauuucucu

SEQ ID NO: 4169770 - RNA, 21 nt, Yersinia pestis
uuugccaccuccgcauccggc

SEQ ID NO: 4169771 - RNA, 20 nt, Yersinia pestis
uuugccagugguuggcagcc

SEQ ID NO: 4169772 - RNA, 19 nt, Yersinia pestis
uuugccguauucagcagug

SEQ ID NO: 4169773 - RNA, 13 nt, Yersinia pestis
uuugccucugcua

SEQ ID NO: 4169774 - RNA, 19 nt, Yersinia pestis
uuugcgauacaccauuucc

SEQ ID NO: 4169775 - RNA, 23 nt, Yersinia pestis
uuugcgcagcaaauaaacaaaau

SEQ ID NO: 4169776 - RNA, 20 nt, Yersinia pestis
uuugcguaauaggcugcgca

SEQ ID NO: 4169777 - RNA, 15 nt, Yersinia pestis
uuugcguuaucuuuu

SEQ ID NO: 4169778 - RNA, 13 nt, Yersinia pestis
uuugcugaugcac

SEQ ID NO: 4169779 - RNA, 13 nt, Yersinia pestis
uuugcugcuuaua

SEQ ID NO: 4169780 - RNA, 21 nt, Yersinia pestis
uuugcuguucuaucucaucuu

SEQ ID NO: 4169781 - RNA, 13 nt, Yersinia pestis
uuugcuuuuugcu

SEQ ID NO: 4169782 - RNA, 18 nt, Yersinia pestis
uuugcuuuuugcuuuuug

SEQ ID NO: 4169783 - RNA, 23 nt, Yersinia pestis
uuuggaaccgccauaggcuguuu

SEQ ID NO: 4169784 - RNA, 18 nt, Yersinia pestis
uuuggaucaggaucacca

SEQ ID NO: 4169785 - RNA, 20 nt, Yersinia pestis
uuuggccaccgcgucgccgc

SEQ ID NO: 4169786 - RNA, 21 nt, Yersinia pestis
uuuggccaccgcgucgccgcu

SEQ ID NO: 4169787 - RNA, 18 nt, Yersinia pestis
uuuggcccccuagcgcaa

SEQ ID NO: 4169788 - RNA, 18 nt, Yersinia pestis
uuugggaacaacagcauc

SEQ ID NO: 4169789 - RNA, 16 nt, Yersinia pestis
uuugguagaacugcgg

SEQ ID NO: 4169790 - RNA, 14 nt, Yersinia pestis
uuugguuaaagaag

SEQ ID NO: 4169791 - RNA, 18 nt, Yersinia pestis
uuugguuauaucccaaua

SEQ ID NO: 4169792 - RNA, 18 nt, Yersinia pestis
uuugguuggcuuuaaccc

SEQ ID NO: 4169793 - RNA, 18 nt, Yersinia pestis
uuugguuuuuucaguaca

SEQ ID NO: 4169794 - RNA, 23 nt, Yersinia pestis
uuuguaauaacucagccauugcu

SEQ ID NO: 4169795 - RNA, 15 nt, Yersinia pestis
uuuguacaacuucuu

SEQ ID NO: 4169796 - RNA, 18 nt, Yersinia pestis
uuuguagugaaugacagu

SEQ ID NO: 4169797 - RNA, 15 nt, Yersinia pestis
uuugucaauaaccuc

SEQ ID NO: 4169798 - RNA, 22 nt, Yersinia pestis
uuugucagcagucugagccuca

SEQ ID NO: 4169799 - RNA, 16 nt, Yersinia pestis
uuugucgcucaagccu

SEQ ID NO: 4169800 - RNA, 14 nt, Yersinia pestis
uuugugcaggagua

SEQ ID NO: 4169801 - RNA, 23 nt, Yersinia pestis
uuugugucgggauuuuuuuuccu

SEQ ID NO: 4169802 - RNA, 13 nt, Yersinia pestis
uuuguuaauauuu

SEQ ID NO: 4169803 - RNA, 16 nt, Yersinia pestis
uuuguuaauauuuauc

SEQ ID NO: 4169804 - RNA, 20 nt, Yersinia pestis
uuuguuuccccuaauucucc

SEQ ID NO: 4169805 - RNA, 20 nt, Yersinia pestis
uuuguuuggauaaaaacauu

SEQ ID NO: 4169806 - RNA, 14 nt, Yersinia pestis
uuuguuugugagag

SEQ ID NO: 4169807 - RNA, 15 nt, Yersinia pestis
uuuguuuuucugaca

SEQ ID NO: 4169808 - RNA, 20 nt, Yersinia pestis
uuuuaaaaaaauuaaaauaa

SEQ ID NO: 4169809 - RNA, 16 nt, Yersinia pestis
uuuuaaacgucagauu

SEQ ID NO: 4169810 - RNA, 18 nt, Yersinia pestis
uuuuaaacuuguaucaaa

SEQ ID NO: 4169811 - RNA, 16 nt, Yersinia pestis
uuuuaaagaaugcaac

SEQ ID NO: 4169812 - RNA, 20 nt, Yersinia pestis
uuuuaaauauggguuaaaaa

SEQ ID NO: 4169813 - RNA, 16 nt, Yersinia pestis
uuuuaacguuagagca

SEQ ID NO: 4169814 - RNA, 16 nt, Yersinia pestis
uuuuaauaaaaaacug

SEQ ID NO: 4169815 - RNA, 21 nt, Yersinia pestis
uuuuaauauuguugguuuaaa

SEQ ID NO: 4169816 - RNA, 19 nt, Yersinia pestis
uuuuaaucgacacuuaaau

SEQ ID NO: 4169817 - RNA, 20 nt, Yersinia pestis
uuuuaaucuccuggugguuu

SEQ ID NO: 4169818 - RNA, 20 nt, Yersinia pestis
uuuuaaucucuccaugauau

SEQ ID NO: 4169819 - RNA, 16 nt, Yersinia pestis
uuuuaauuuaaacucu

SEQ ID NO: 4169820 - RNA, 14 nt, Yersinia pestis
uuuuacauuccaca

SEQ ID NO: 4169821 - RNA, 14 nt, Yersinia pestis
uuuuacgaucaacc

SEQ ID NO: 4169822 - RNA, 14 nt, Yersinia pestis
uuuuacgcaaguaa

SEQ ID NO: 4169823 - RNA, 22 nt, Yersinia pestis
uuuuacgccuauccucaugauu

SEQ ID NO: 4169824 - RNA, 16 nt, Yersinia pestis
uuuuacgggccuuuua

SEQ ID NO: 4169825 - RNA, 19 nt, Yersinia pestis
uuuuacgggccuuuuaauu

SEQ ID NO: 4169826 - RNA, 22 nt, Yersinia pestis
uuuuacugggugauguccuguu

SEQ ID NO: 4169827 - RNA, 22 nt, Yersinia pestis
uuuuacugucggucgauuuuua

SEQ ID NO: 4169828 - RNA, 22 nt, Yersinia pestis
uuuuagccgcuucgcugacauu

SEQ ID NO: 4169829 - RNA, 19 nt, Yersinia pestis
uuuuagcgcuaaaucagcc

SEQ ID NO: 4169830 - RNA, 18 nt, Yersinia pestis
uuuuaguaacaaaaugcg

SEQ ID NO: 4169831 - RNA, 20 nt, Yersinia pestis
uuuuaguauuggaaaaauca

SEQ ID NO: 4169832 - RNA, 15 nt, Yersinia pestis
uuuuauaaugagaau

SEQ ID NO: 4169833 - RNA, 20 nt, Yersinia pestis
uuuuauaccggggccaucau

SEQ ID NO: 4169834 - RNA, 16 nt, Yersinia pestis
uuuuauauauccaaaa

SEQ ID NO: 4169835 - RNA, 18 nt, Yersinia pestis
uuuuauauccgccauccu

SEQ ID NO: 4169836 - RNA, 22 nt, Yersinia pestis
uuuuauauccgccauccuucaa

SEQ ID NO: 4169837 - RNA, 14 nt, Yersinia pestis
uuuuauauuccaca

SEQ ID NO: 4169838 - RNA, 16 nt, Yersinia pestis
uuuuaucaacgaagaa

SEQ ID NO: 4169839 - RNA, 12 nt, Yersinia pestis
uuuuaucaauag

SEQ ID NO: 4169840 - RNA, 20 nt, Yersinia pestis
uuuuaucgcaguaauagaaa

SEQ ID NO: 4169841 - RNA, 21 nt, Yersinia pestis
uuuuauggcauaaacugaagu

SEQ ID NO: 4169842 - RNA, 17 nt, Yersinia pestis
uuuuauuaaguuuuuca

SEQ ID NO: 4169843 - RNA, 18 nt, Yersinia pestis
uuuuauucgcguuucauu

SEQ ID NO: 4169844 - RNA, 16 nt, Yersinia pestis
uuuuauugucuuuaau

SEQ ID NO: 4169845 - RNA, 13 nt, Yersinia pestis
uuuucaaccaaca

SEQ ID NO: 4169846 - RNA, 22 nt, Yersinia pestis
uuuucaaucacuucugcugcca

SEQ ID NO: 4169847 - RNA, 18 nt, Yersinia pestis
uuuucacacgcccaggcc

SEQ ID NO: 4169848 - RNA, 22 nt, Yersinia pestis
uuuucacccccacaucaggccg

SEQ ID NO: 4169849 - RNA, 23 nt, Yersinia pestis
uuuucacuccggcaucauccuca

SEQ ID NO: 4169850 - RNA, 23 nt, Yersinia pestis
uuuucaguaucgaagacaaacac

SEQ ID NO: 4169851 - RNA, 15 nt, Yersinia pestis
uuuucaguuuuaauu

SEQ ID NO: 4169852 - RNA, 22 nt, Yersinia pestis
uuuucccaguaagcucuacuaa

SEQ ID NO: 4169853 - RNA, 18 nt, Yersinia pestis
uuuuccgccaugagaacc

SEQ ID NO: 4169854 - RNA, 14 nt, Yersinia pestis
uuuuccggcuuucu

SEQ ID NO: 4169855 - RNA, 15 nt, Yersinia pestis
uuuuccguaaccucc

SEQ ID NO: 4169856 - RNA, 12 nt, Yersinia pestis
uuuuccugcugc

SEQ ID NO: 4169857 - RNA, 14 nt, Yersinia pestis
uuuucgaacuuaac

SEQ ID NO: 4169858 - RNA, 15 nt, Yersinia pestis
uuuucgaacuuaacu

SEQ ID NO: 4169859 - RNA, 14 nt, Yersinia pestis
uuuucgggaaaaaa

SEQ ID NO: 4169860 - RNA, 19 nt, Yersinia pestis
uuuucgucauuauuaaacu

SEQ ID NO: 4169861 - RNA, 20 nt, Yersinia pestis
uuuucuagcuguagcaauau

SEQ ID NO: 4169862 - RNA, 15 nt, Yersinia pestis
uuuucuauaccaauu

SEQ ID NO: 4169863 - RNA, 21 nt, Yersinia pestis
uuuucuccugggcugauauau

SEQ ID NO: 4169864 - RNA, 22 nt, Yersinia pestis
uuuucucuuaaagaaaauuuac

SEQ ID NO: 4169865 - RNA, 22 nt, Yersinia pestis
uuuucugcauaagcaucaguaa

SEQ ID NO: 4169866 - RNA, 15 nt, Yersinia pestis
uuuucuuucaacugc

SEQ ID NO: 4169867 - RNA, 14 nt, Yersinia pestis
uuuucuuucaggcu

SEQ ID NO: 4169868 - RNA, 18 nt, Yersinia pestis
uuuugaaacuuuccugac

SEQ ID NO: 4169869 - RNA, 21 nt, Yersinia pestis
uuuugaaauaacgccacaaua

SEQ ID NO: 4169870 - RNA, 23 nt, Yersinia pestis
uuuugacacgggaucaacauggu

SEQ ID NO: 4169871 - RNA, 23 nt, Yersinia pestis
uuuugaccaugcuuauugccaug

SEQ ID NO: 4169872 - RNA, 20 nt, Yersinia pestis
uuuugauaauuucaguucag

SEQ ID NO: 4169873 - RNA, 15 nt, Yersinia pestis
uuuugaugcuaauuu

SEQ ID NO: 4169874 - RNA, 19 nt, Yersinia pestis
uuuugaugcuaauuucauc

SEQ ID NO: 4169875 - RNA, 17 nt, Yersinia pestis
uuuugcaucaccaucau

SEQ ID NO: 4169876 - RNA, 22 nt, Yersinia pestis
uuuugccggggagucgcuccuc

SEQ ID NO: 4169877 - RNA, 12 nt, Yersinia pestis
uuuuggaaugcu

SEQ ID NO: 4169878 - RNA, 18 nt, Yersinia pestis
uuuuggcuauuaaagccc

SEQ ID NO: 4169879 - RNA, 14 nt, Yersinia pestis
uuuuggcugauaga

SEQ ID NO: 4169880 - RNA, 19 nt, Yersinia pestis
uuuugggaugaaaaauaca

SEQ ID NO: 4169881 - RNA, 17 nt, Yersinia pestis
uuuuggggucugaauau

SEQ ID NO: 4169882 - RNA, 14 nt, Yersinia pestis
uuuugucauuuaau

SEQ ID NO: 4169883 - RNA, 14 nt, Yersinia pestis
uuuuguuaauauuu

SEQ ID NO: 4169884 - RNA, 16 nt, Yersinia pestis
uuuuguuaauauuuau

SEQ ID NO: 4169885 - RNA, 15 nt, Yersinia pestis
uuuuuaaagaaaaaa

SEQ ID NO: 4169886 - RNA, 12 nt, Yersinia pestis
uuuuuaacaaaa

SEQ ID NO: 4169887 - RNA, 15 nt, Yersinia pestis
uuuuuaacgauauag

SEQ ID NO: 4169888 - RNA, 16 nt, Yersinia pestis
uuuuuaacgucagaua

SEQ ID NO: 4169889 - RNA, 21 nt, Yersinia pestis
uuuuuaaugauugauuaucaa

SEQ ID NO: 4169890 - RNA, 13 nt, Yersinia pestis
uuuuuaauuuaaa

SEQ ID NO: 4169891 - RNA, 12 nt, Yersinia pestis
uuuuuacaagca

SEQ ID NO: 4169892 - RNA, 20 nt, Yersinia pestis
uuuuuacagcaaacgucccg

SEQ ID NO: 4169893 - RNA, 14 nt, Yersinia pestis
uuuuuacauuccac

SEQ ID NO: 4169894 - RNA, 15 nt, Yersinia pestis
uuuuuacauuccaca

SEQ ID NO: 4169895 - RNA, 19 nt, Yersinia pestis
uuuuuacgccuauccucau

SEQ ID NO: 4169896 - RNA, 19 nt, Yersinia pestis
uuuuuacgugauauaccac

SEQ ID NO: 4169897 - RNA, 14 nt, Yersinia pestis
uuuuuagcuucgcu

SEQ ID NO: 4169898 - RNA, 16 nt, Yersinia pestis
uuuuuauaaucgauac

SEQ ID NO: 4169899 - RNA, 14 nt, Yersinia pestis
uuuuuauauuccac

SEQ ID NO: 4169900 - RNA, 15 nt, Yersinia pestis
uuuuuauauuccaca

SEQ ID NO: 4169901 - RNA, 20 nt, Yersinia pestis
uuuuuauuucuccuuacuau

SEQ ID NO: 4169902 - RNA, 12 nt, Yersinia pestis
uuuuuauuucuu

SEQ ID NO: 4169903 - RNA, 18 nt, Yersinia pestis
uuuuucaacucagcggcu

SEQ ID NO: 4169904 - RNA, 13 nt, Yersinia pestis
uuuuucaaucacu

SEQ ID NO: 4169905 - RNA, 12 nt, Yersinia pestis
uuuuucagcuuc

SEQ ID NO: 4169906 - RNA, 16 nt, Yersinia pestis
uuuuucagcuucuucu

SEQ ID NO: 4169907 - RNA, 16 nt, Yersinia pestis
uuuuucauaauaauga

SEQ ID NO: 4169908 - RNA, 19 nt, Yersinia pestis
uuuuucaucauauucagcc

SEQ ID NO: 4169909 - RNA, 20 nt, Yersinia pestis
uuuuucauuauuugauauag

SEQ ID NO: 4169910 - RNA, 15 nt, Yersinia pestis
uuuuucgacaaaaaa

SEQ ID NO: 4169911 - RNA, 20 nt, Yersinia pestis
uuuuucgggccacuacggcg

SEQ ID NO: 4169912 - RNA, 17 nt, Yersinia pestis
uuuuucuuuuuaacuua

SEQ ID NO: 4169913 - RNA, 13 nt, Yersinia pestis
uuuuugaaauucu

SEQ ID NO: 4169914 - RNA, 11 nt, Yersinia pestis
uuuuugaccau

SEQ ID NO: 4169915 - RNA, 14 nt, Yersinia pestis
uuuuugcaauuaau

SEQ ID NO: 4169916 - RNA, 12 nt, Yersinia pestis
uuuuuuaaaaaa

SEQ ID NO: 4169917 - RNA, 16 nt, Yersinia pestis
uuuuuuaaaaccaaau

SEQ ID NO: 4169918 - RNA, 21 nt, Yersinia pestis
uuuuuugggaugaaaaauaca

SEQ ID NO: 4169919 - RNA, 16 nt, Yersinia pestis
ugaugagcuguagaac

SEQ ID NO: 4169920 - RNA, 15 nt, Yersinia pestis
ugaugaguaacauaa

SEQ ID NO: 4169921 - RNA, 14 nt, Yersinia pestis
ugaugaguaauuuc

SEQ ID NO: 4169922 - RNA, 15 nt, Yersinia pestis
ugaugauaucaccuu

SEQ ID NO: 4169923 - RNA, 17 nt, Yersinia pestis
ugaugauauugacgggc

SEQ ID NO: 4169924 - RNA, 14 nt, Yersinia pestis
ugaugaugagcgca

SEQ ID NO: 4169925 - RNA, 20 nt, Yersinia pestis
ugaugauuuggcugaauacc

SEQ ID NO: 4169926 - RNA, 17 nt, Yersinia pestis
ugaugcaccgcugucau

SEQ ID NO: 4169927 - RNA, 18 nt, Yersinia pestis
ugaugcaguaaauagucu

SEQ ID NO: 4169928 - RNA, 19 nt, Yersinia pestis
ugaugcaguaucccuggcu

SEQ ID NO: 4169929 - RNA, 16 nt, Yersinia pestis
ugaugcauauuauuaa

SEQ ID NO: 4169930 - RNA, 23 nt, Yersinia pestis
ugaugcauauuauuaaugaaauu

SEQ ID NO: 4169931 - RNA, 14 nt, Yersinia pestis
ugaugccaaauuaa

SEQ ID NO: 4169932 - RNA, 21 nt, Yersinia pestis
ugaugcuaauuucaucucaau

SEQ ID NO: 4169933 - RNA, 18 nt, Yersinia pestis
ugaugcuggguauauaua

SEQ ID NO: 4169934 - RNA, 15 nt, Yersinia pestis
ugaugcuuuucuuuc

SEQ ID NO: 4169935 - RNA, 15 nt, Yersinia pestis
ugauggccguaucau

SEQ ID NO: 4169936 - RNA, 19 nt, Yersinia pestis
ugauggcgauagauuuuca

SEQ ID NO: 4169937 - RNA, 15 nt, Yersinia pestis
ugaugggauuaauaa

SEQ ID NO: 4169938 - RNA, 19 nt, Yersinia pestis
ugaugggauuaauaauggu

SEQ ID NO: 4169939 - RNA, 16 nt, Yersinia pestis
ugauggggcaaucaag

SEQ ID NO: 4169940 - RNA, 13 nt, Yersinia pestis
ugauguaacucag

SEQ ID NO: 4169941 - RNA, 12 nt, Yersinia pestis
ugauguaggcaa

SEQ ID NO: 4169942 - RNA, 20 nt, Yersinia pestis
ugaugucaugauaaaacuau

SEQ ID NO: 4169943 - RNA, 15 nt, Yersinia pestis
ugaugugaaacauaa

SEQ ID NO: 4169944 - RNA, 13 nt, Yersinia pestis
ugauguuauuaau

SEQ ID NO: 4169945 - RNA, 15 nt, Yersinia pestis
ugauguuauuaauga

SEQ ID NO: 4169946 - RNA, 16 nt, Yersinia pestis
ugauguucaauucacu

SEQ ID NO: 4169947 - RNA, 16 nt, Yersinia pestis
ugauguucugccaacc

SEQ ID NO: 4169948 - RNA, 13 nt, Yersinia pestis
ugauuaaaacccc

SEQ ID NO: 4169949 - RNA, 20 nt, Yersinia pestis
ugauuaaaagucaacugcuc

SEQ ID NO: 4169950 - RNA, 19 nt, Yersinia pestis
ugauuaaaccgagccugcu

SEQ ID NO: 4169951 - RNA, 18 nt, Yersinia pestis
ugauuaacauccauugua

SEQ ID NO: 4169952 - RNA, 21 nt, Yersinia pestis
ugauuaaccaagcucgccauc

SEQ ID NO: 4169953 - RNA, 20 nt, Yersinia pestis
ugauuaagcggcaauaacac

SEQ ID NO: 4169954 - RNA, 22 nt, Yersinia pestis
ugauuaauacacgcuuccagua

SEQ ID NO: 4169955 - RNA, 19 nt, Yersinia pestis
ugauuaauaucaaaacuga

SEQ ID NO: 4169956 - RNA, 21 nt, Yersinia pestis
ugauuaauaucaaaacugauu

SEQ ID NO: 4169957 - RNA, 14 nt, Yersinia pestis
ugauuaauuuuuca

SEQ ID NO: 4169958 - RNA, 18 nt, Yersinia pestis
ugauuacgggucagcuca

SEQ ID NO: 4169959 - RNA, 14 nt, Yersinia pestis
ugauuacugucauu

SEQ ID NO: 4169960 - RNA, 17 nt, Yersinia pestis
ugauuaggcauaaauaa

SEQ ID NO: 4169961 - RNA, 18 nt, Yersinia pestis
ugauuaggcauaaauaau

SEQ ID NO: 4169962 - RNA, 20 nt, Yersinia pestis
ugauuaggcauaaauaauaa

SEQ ID NO: 4169963 - RNA, 18 nt, Yersinia pestis
ugauuaucaaguuaaaua

SEQ ID NO: 4169964 - RNA, 13 nt, Yersinia pestis
ugauuauucugcu

SEQ ID NO: 4169965 - RNA, 17 nt, Yersinia pestis
ugauuauuuaaacaaug

SEQ ID NO: 4169966 - RNA, 14 nt, Yersinia pestis
ugauucaaaaugcc

SEQ ID NO: 4169967 - RNA, 17 nt, Yersinia pestis
ugauucaacugccgcaa

SEQ ID NO: 4169968 - RNA, 15 nt, Yersinia pestis
ugauucaauuucgac

SEQ ID NO: 4169969 - RNA, 12 nt, Yersinia pestis
ugauucagaaag

SEQ ID NO: 4169970 - RNA, 18 nt, Yersinia pestis
ugauuccgguacugugcu

SEQ ID NO: 4169971 - RNA, 16 nt, Yersinia pestis
ugauucgcgaccagca

SEQ ID NO: 4169972 - RNA, 18 nt, Yersinia pestis
ugauucgggugagugagc

SEQ ID NO: 4169973 - RNA, 21 nt, Yersinia pestis
ugauucguuuucggugcaugu

SEQ ID NO: 4169974 - RNA, 14 nt, Yersinia pestis
ugauucucuauucu

SEQ ID NO: 4169975 - RNA, 18 nt, Yersinia pestis
ugauugcagaccaaucaa

SEQ ID NO: 4169976 - RNA, 15 nt, Yersinia pestis
ugauugcaucaucag

SEQ ID NO: 4169977 - RNA, 16 nt, Yersinia pestis
ugauuggacgauaacg

SEQ ID NO: 4169978 - RNA, 15 nt, Yersinia pestis
ugauuggauaaaaua

SEQ ID NO: 4169979 - RNA, 19 nt, Yersinia pestis
ugauuggauaaaauauuau

SEQ ID NO: 4169980 - RNA, 22 nt, Yersinia pestis
ugauugguggucuuaucauaau

SEQ ID NO: 4169981 - RNA, 20 nt, Yersinia pestis
ugauuuaaauauuauuuaau

SEQ ID NO: 4169982 - RNA, 15 nt, Yersinia pestis
ugauuucagccaggc

SEQ ID NO: 4169983 - RNA, 13 nt, Yersinia pestis
ugauuugaacgac

SEQ ID NO: 4169984 - RNA, 17 nt, Yersinia pestis
ugauuuuagccucugua

SEQ ID NO: 4169985 - RNA, 14 nt, Yersinia pestis
ugauuuuguagaau

SEQ ID NO: 4169986 - RNA, 11 nt, Yersinia pestis
ugauuuuuaac

SEQ ID NO: 4169987 - RNA, 14 nt, Yersinia pestis
ugauuuuuauauuu

SEQ ID NO: 4169988 - RNA, 18 nt, Yersinia pestis
ugauuuuuauauuuugag

SEQ ID NO: 4169989 - RNA, 14 nt, Yersinia pestis
ugauuuuuuucaug

SEQ ID NO: 4169990 - RNA, 16 nt, Yersinia pestis
ugcaaaaaaagacacu

SEQ ID NO: 4169991 - RNA, 22 nt, Yersinia pestis
ugcaaaaaaagacacuaaccag

SEQ ID NO: 4169992 - RNA, 21 nt, Yersinia pestis
ugcaaaauuccaccauucuca

SEQ ID NO: 4169993 - RNA, 24 nt, Yersinia pestis
ugcaaaccaugggggcaacgguaa

SEQ ID NO: 4169994 - RNA, 15 nt, Yersinia pestis
ugcaaacgagaguau

SEQ ID NO: 4169995 - RNA, 19 nt, Yersinia pestis
ugcaaaucauaagugcauu

SEQ ID NO: 4169996 - RNA, 23 nt, Yersinia pestis
ugcaaaucauaagugcauuuuug

SEQ ID NO: 4169997 - RNA, 14 nt, Yersinia pestis
ugcaaauggcaggg

SEQ ID NO: 4169998 - RNA, 14 nt, Yersinia pestis
ugcaaaugucagau

SEQ ID NO: 4169999 - RNA, 16 nt, Yersinia pestis
ugcaaauuagcggauu

SEQ ID NO: 4170000 - RNA, 21 nt, Yersinia pestis
ugcaaauuuaugcgcuuucuc

SEQ ID NO: 4170001 - RNA, 23 nt, Yersinia pestis
ugcaaauuuaugcgcuuucucga

SEQ ID NO: 4170002 - RNA, 14 nt, Yersinia pestis
ugcaacaacgccag

SEQ ID NO: 4170003 - RNA, 20 nt, Yersinia pestis
ugcaacagcgcucauagcaa

SEQ ID NO: 4170004 - RNA, 14 nt, Yersinia pestis
ugcaaccaacacca

SEQ ID NO: 4170005 - RNA, 18 nt, Yersinia pestis
ugcaaccaguuaaagaau

SEQ ID NO: 4170006 - RNA, 13 nt, Yersinia pestis
ugcaacgccuuca

SEQ ID NO: 4170007 - RNA, 18 nt, Yersinia pestis
ugcaacguuaaagaugaa

SEQ ID NO: 4170008 - RNA, 13 nt, Yersinia pestis
ugcaacuggcauu

SEQ ID NO: 4170009 - RNA, 20 nt, Yersinia pestis
ugcaagcccccaaaguagaa

SEQ ID NO: 4170010 - RNA, 17 nt, Yersinia pestis
ugcaagccguaauucag

SEQ ID NO: 4170011 - RNA, 22 nt, Yersinia pestis
ugcaaguguaugaguaucaaua

SEQ ID NO: 4170012 - RNA, 17 nt, Yersinia pestis
ugcaauaaauucaaaau

SEQ ID NO: 4170013 - RNA, 21 nt, Yersinia pestis
ugcaauaaauucaaaauagag

SEQ ID NO: 4170014 - RNA, 14 nt, Yersinia pestis
ugcaauaacaccag

SEQ ID NO: 4170015 - RNA, 15 nt, Yersinia pestis
ugcaauaacaccagc

SEQ ID NO: 4170016 - RNA, 18 nt, Yersinia pestis
ugcaauaacaccagcagg

SEQ ID NO: 4170017 - RNA, 18 nt, Yersinia pestis
ugcaauagcucauuuuaa

SEQ ID NO: 4170018 - RNA, 22 nt, Yersinia pestis
ugcaauagcucauuuuaaauau

SEQ ID NO: 4170019 - RNA, 17 nt, Yersinia pestis
ugcaaucaagggcgaua

SEQ ID NO: 4170020 - RNA, 15 nt, Yersinia pestis
ugcaaucgcauugcg

SEQ ID NO: 4170021 - RNA, 16 nt, Yersinia pestis
ugcaaucuaacuaaua

SEQ ID NO: 4170022 - RNA, 23 nt, Yersinia pestis
ugcaaugcuuauuucacacuguu

SEQ ID NO: 4170023 - RNA, 17 nt, Yersinia pestis
ugcaauggcuggcaagg

SEQ ID NO: 4170024 - RNA, 23 nt, Yersinia pestis
ugcaauuaauuggcccauaacaa

SEQ ID NO: 4170025 - RNA, 15 nt, Yersinia pestis
ugcaauuauaagcac

SEQ ID NO: 4170026 - RNA, 13 nt, Yersinia pestis
ugcaauuuuauug

SEQ ID NO: 4170027 - RNA, 19 nt, Yersinia pestis
ugcaauuuuauugauuggc

SEQ ID NO: 4170028 - RNA, 13 nt, Yersinia pestis
ugcacaccaucag

SEQ ID NO: 4170029 - RNA, 16 nt, Yersinia pestis
ugcacagcauuuaugc

SEQ ID NO: 4170030 - RNA, 17 nt, Yersinia pestis
ugcacagguaguaagca

SEQ ID NO: 4170031 - RNA, 21 nt, Yersinia pestis
ugcacagguccaucagcaaau

SEQ ID NO: 4170032 - RNA, 15 nt, Yersinia pestis
ugcacaucauuuauu

SEQ ID NO: 4170033 - RNA, 12 nt, Yersinia pestis
ugcaccaaucaa

SEQ ID NO: 4170034 - RNA, 16 nt, Yersinia pestis
ugcacccauagcucag

SEQ ID NO: 4170035 - RNA, 15 nt, Yersinia pestis
ugcacccauggagau

SEQ ID NO: 4170036 - RNA, 13 nt, Yersinia pestis
ugcacccccuucg

SEQ ID NO: 4170037 - RNA, 14 nt, Yersinia pestis
ugcacccccuucgg

SEQ ID NO: 4170038 - RNA, 17 nt, Yersinia pestis
ugcacccggccuugccc

SEQ ID NO: 4170039 - RNA, 20 nt, Yersinia pestis
ugcaccgcugauaaccagca

SEQ ID NO: 4170040 - RNA, 18 nt, Yersinia pestis
ugcacgacaacaaagccg

SEQ ID NO: 4170041 - RNA, 21 nt, Yersinia pestis
ugcacgggaaaugagcgccaa

SEQ ID NO: 4170042 - RNA, 20 nt, Yersinia pestis
ugcacgugaggauucaagaa

SEQ ID NO: 4170043 - RNA, 22 nt, Yersinia pestis
ugcacguuuaauuucacuucca

SEQ ID NO: 4170044 - RNA, 23 nt, Yersinia pestis
ugcacugagagaaccauuauuac

SEQ ID NO: 4170045 - RNA, 12 nt, Yersinia pestis
ugcacugagcca

SEQ ID NO: 4170046 - RNA, 23 nt, Yersinia pestis
ugcacuuuuacugguucauuuuc

SEQ ID NO: 4170047 - RNA, 21 nt, Yersinia pestis
ugcagaaauaaauauccuccg

SEQ ID NO: 4170048 - RNA, 18 nt, Yersinia pestis
ugcagaagggcggccagc

SEQ ID NO: 4170049 - RNA, 19 nt, Yersinia pestis
ugcagaaucacuggcagaa

SEQ ID NO: 4170050 - RNA, 13 nt, Yersinia pestis
ugcagacugcuga

SEQ ID NO: 4170051 - RNA, 15 nt, Yersinia pestis
ugcagagaugcagug

SEQ ID NO: 4170052 - RNA, 20 nt, Yersinia pestis
ugcagagaugcagugucagg

SEQ ID NO: 4170053 - RNA, 20 nt, Yersinia pestis
ugcagagguacccuugcaaa

SEQ ID NO: 4170054 - RNA, 21 nt, Yersinia pestis
ugcagaucaaucgcauuguca

SEQ ID NO: 4170055 - RNA, 19 nt, Yersinia pestis
ugcagaucggcauuauuau

SEQ ID NO: 4170056 - RNA, 21 nt, Yersinia pestis
ugcagauuaguugaccuuggu

SEQ ID NO: 4170057 - RNA, 23 nt, Yersinia pestis
ugcagauuuuugcuuuccacgcc

SEQ ID NO: 4170058 - RNA, 20 nt, Yersinia pestis
ugcagcaacaauaacuuugg

SEQ ID NO: 4170059 - RNA, 21 nt, Yersinia pestis
ugcagcaagccgauaaucaau

SEQ ID NO: 4170060 - RNA, 14 nt, Yersinia pestis
ugcagcauuucagg

SEQ ID NO: 4170061 - RNA, 23 nt, Yersinia pestis
ugcagcauuuucagcaacugacc

SEQ ID NO: 4170062 - RNA, 15 nt, Yersinia pestis
ugcagccaagauccc

SEQ ID NO: 4170063 - RNA, 17 nt, Yersinia pestis
ugcagccaauguuucaa

SEQ ID NO: 4170064 - RNA, 16 nt, Yersinia pestis
ugcagccgggaugauc

SEQ ID NO: 4170065 - RNA, 21 nt, Yersinia pestis
ugcagccguuccuuggcuaua

SEQ ID NO: 4170066 - RNA, 18 nt, Yersinia pestis
ugcagcgauauacaucac

SEQ ID NO: 4170067 - RNA, 14 nt, Yersinia pestis
ugcagcuaaacacg

SEQ ID NO: 4170068 - RNA, 22 nt, Yersinia pestis
ugcagcucaaagaccacaucaa

SEQ ID NO: 4170069 - RNA, 11 nt, Yersinia pestis
ugcagcucaau

SEQ ID NO: 4170070 - RNA, 16 nt, Yersinia pestis
ugcagcucaaucacau

SEQ ID NO: 4170071 - RNA, 19 nt, Yersinia pestis
ugcaggaguugguggcaca

SEQ ID NO: 4170072 - RNA, 22 nt, Yersinia pestis
ugcaggauaaaccuacagccau

SEQ ID NO: 4170073 - RNA, 19 nt, Yersinia pestis
ugcaggauagccaaccccu

SEQ ID NO: 4170074 - RNA, 23 nt, Yersinia pestis
ugcagggcgacauuaaucaucgc

SEQ ID NO: 4170075 - RNA, 20 nt, Yersinia pestis
ugcaggugugcggauggcug

SEQ ID NO: 4170076 - RNA, 12 nt, Yersinia pestis
ugcaguaaaaau

SEQ ID NO: 4170077 - RNA, 17 nt, Yersinia pestis
ugcaguaaaaauauuaa

SEQ ID NO: 4170078 - RNA, 14 nt, Yersinia pestis
ugcaguaaauaguc

SEQ ID NO: 4170079 - RNA, 23 nt, Yersinia pestis
ugcaguaaccccuucgagcaccg

SEQ ID NO: 4170080 - RNA, 17 nt, Yersinia pestis
ugcaguaucccuggcuc

SEQ ID NO: 4170081 - RNA, 16 nt, Yersinia pestis
ugcagugcaaccaaca

SEQ ID NO: 4170082 - RNA, 14 nt, Yersinia pestis
ugcaguuaaggcug

SEQ ID NO: 4170083 - RNA, 18 nt, Yersinia pestis
ugcaguuaaggcuggcug

SEQ ID NO: 4170084 - RNA, 19 nt, Yersinia pestis
ugcaguuaaugacauaucu

SEQ ID NO: 4170085 - RNA, 19 nt, Yersinia pestis
ugcaguuucuaccgcuuca

SEQ ID NO: 4170086 - RNA, 13 nt, Yersinia pestis
ugcauaaaaauag

SEQ ID NO: 4170087 - RNA, 15 nt, Yersinia pestis
ugcauaauggacgaa

SEQ ID NO: 4170088 - RNA, 13 nt, Yersinia pestis
ugcauacaaccgu

SEQ ID NO: 4170089 - RNA, 17 nt, Yersinia pestis
ugcauacagaucgagca

SEQ ID NO: 4170090 - RNA, 17 nt, Yersinia pestis
ugcauagcguuguucaa

SEQ ID NO: 4170091 - RNA, 20 nt, Yersinia pestis
ugcauaucauucgguuauuu

SEQ ID NO: 4170092 - RNA, 20 nt, Yersinia pestis
ugcauauuauuaaugaaauu

SEQ ID NO: 4170093 - RNA, 21 nt, Yersinia pestis
ugcauauuauuuugcacacga

SEQ ID NO: 4170094 - RNA, 12 nt, Yersinia pestis
ugcauauuucuc

SEQ ID NO: 4170095 - RNA, 19 nt, Yersinia pestis
ugcaucaucacauucaaac

SEQ ID NO: 4170096 - RNA, 21 nt, Yersinia pestis
ugcauccgcaaaauggguaua

SEQ ID NO: 4170097 - RNA, 23 nt, Yersinia pestis
ugcaucgcgggcgcgcugcugcu

SEQ ID NO: 4170098 - RNA, 15 nt, Yersinia pestis
ugcaucgcuucugaa

SEQ ID NO: 4170099 - RNA, 19 nt, Yersinia pestis
ugcaucguggucaccgcca

SEQ ID NO: 4170100 - RNA, 20 nt, Yersinia pestis
ugcaucuauugugucaauac

SEQ ID NO: 4170101 - RNA, 21 nt, Yersinia pestis
ugcaucuauugugucaauacc

SEQ ID NO: 4170102 - RNA, 22 nt, Yersinia pestis
ugcaucuauugugucaauaccu

SEQ ID NO: 4170103 - RNA, 20 nt, Yersinia pestis
ugcaucuggugacccgucag

SEQ ID NO: 4170104 - RNA, 21 nt, Yersinia pestis
ugcauguagcugcagccgcga

SEQ ID NO: 4170105 - RNA, 22 nt, Yersinia pestis
ugcauuaucuuuaauuuuuccc

SEQ ID NO: 4170106 - RNA, 18 nt, Yersinia pestis
ugcauucaucaugcuguc

SEQ ID NO: 4170107 - RNA, 12 nt, Yersinia pestis
ugcauugauuaa

SEQ ID NO: 4170108 - RNA, 17 nt, Yersinia pestis
ugcauuuaugaugcauu

SEQ ID NO: 4170109 - RNA, 23 nt, Yersinia pestis
ugcauuucaacaaaacgaacacu

SEQ ID NO: 4170110 - RNA, 17 nt, Yersinia pestis
ugcauuuuuucauucca

SEQ ID NO: 4170111 - RNA, 20 nt, Yersinia pestis
ugccaaaaugccuaccguua

SEQ ID NO: 4170112 - RNA, 19 nt, Yersinia pestis
ugccaaauauagcauguac

SEQ ID NO: 4170113 - RNA, 14 nt, Yersinia pestis
ugccaacaacuggg

SEQ ID NO: 4170114 - RNA, 16 nt, Yersinia pestis
ugccaacaauugcucc

SEQ ID NO: 4170115 - RNA, 21 nt, Yersinia pestis
ugccaacagcgagauagucag

SEQ ID NO: 4170116 - RNA, 14 nt, Yersinia pestis
ugccaaccaaucgg

SEQ ID NO: 4170117 - RNA, 17 nt, Yersinia pestis
ugccaacgucucuucca

SEQ ID NO: 4170118 - RNA, 19 nt, Yersinia pestis
ugccaacgugaucgccgcu

SEQ ID NO: 4170119 - RNA, 19 nt, Yersinia pestis
ugccaagguucgaaaaaac

SEQ ID NO: 4170120 - RNA, 12 nt, Yersinia pestis
ugccaagucuua

SEQ ID NO: 4170121 - RNA, 23 nt, Yersinia pestis
ugccaauaaaguccaccucgaaa

SEQ ID NO: 4170122 - RNA, 22 nt, Yersinia pestis
ugccaauauguuagcagcacaa

SEQ ID NO: 4170123 - RNA, 13 nt, Yersinia pestis
ugccaauauugcc

SEQ ID NO: 4170124 - RNA, 23 nt, Yersinia pestis
ugccaaucgcucugcguuuuucc

SEQ ID NO: 4170125 - RNA, 20 nt, Yersinia pestis
ugccaaugccucuucaauac

SEQ ID NO: 4170126 - RNA, 18 nt, Yersinia pestis
ugccaauuccauauuuaa

SEQ ID NO: 4170127 - RNA, 18 nt, Yersinia pestis
ugccaauuuaacuuucau

SEQ ID NO: 4170128 - RNA, 13 nt, Yersinia pestis
ugccacauuuccc

SEQ ID NO: 4170129 - RNA, 21 nt, Yersinia pestis
ugccacccuaucugcucuugc

SEQ ID NO: 4170130 - RNA, 16 nt, Yersinia pestis
ugccaccugcgguugc

SEQ ID NO: 4170131 - RNA, 14 nt, Yersinia pestis
ugccacgccaguaa

SEQ ID NO: 4170132 - RNA, 19 nt, Yersinia pestis
ugccacggauauccaacgg

SEQ ID NO: 4170133 - RNA, 12 nt, Yersinia pestis
ugccacuguuca

SEQ ID NO: 4170134 - RNA, 18 nt, Yersinia pestis
ugccacuuuacauaaccu

SEQ ID NO: 4170135 - RNA, 20 nt, Yersinia pestis
ugccagaaucgccugcacac

SEQ ID NO: 4170136 - RNA, 22 nt, Yersinia pestis
ugccagaaucgccugcacacgg

SEQ ID NO: 4170137 - RNA, 20 nt, Yersinia pestis
ugccagacacaagauaaaua

SEQ ID NO: 4170138 - RNA, 22 nt, Yersinia pestis
ugccagacacaagauaaauacc

SEQ ID NO: 4170139 - RNA, 14 nt, Yersinia pestis
ugccagagcaauaa

SEQ ID NO: 4170140 - RNA, 17 nt, Yersinia pestis
ugccagauaauguucgu

SEQ ID NO: 4170141 - RNA, 19 nt, Yersinia pestis
ugccagauagaccccuucu

SEQ ID NO: 4170142 - RNA, 13 nt, Yersinia pestis
ugccagauaguca

SEQ ID NO: 4170143 - RNA, 14 nt, Yersinia pestis
ugccagcagcaagu

SEQ ID NO: 4170144 - RNA, 16 nt, Yersinia pestis
ugccagccaggauagc

SEQ ID NO: 4170145 - RNA, 12 nt, Yersinia pestis
ugccagcccauc

SEQ ID NO: 4170146 - RNA, 16 nt, Yersinia pestis
ugccagccccaaucac

SEQ ID NO: 4170147 - RNA, 13 nt, Yersinia pestis
ugccagcccugau

SEQ ID NO: 4170148 - RNA, 16 nt, Yersinia pestis
ugccagccgcaaauag

SEQ ID NO: 4170149 - RNA, 18 nt, Yersinia pestis
ugccagccggugauuggg

SEQ ID NO: 4170150 - RNA, 14 nt, Yersinia pestis
ugccagcgaaaauu

SEQ ID NO: 4170151 - RNA, 14 nt, Yersinia pestis
ugccaguaauucac

SEQ ID NO: 4170152 - RNA, 15 nt, Yersinia pestis
ugccaguagcaauaa

SEQ ID NO: 4170153 - RNA, 11 nt, Yersinia pestis
ugccagugaau

SEQ ID NO: 4170154 - RNA, 18 nt, Yersinia pestis
ugccagugaaucagccag

SEQ ID NO: 4170155 - RNA, 20 nt, Yersinia pestis
ugccaguuauuauuuuuaau

SEQ ID NO: 4170156 - RNA, 21 nt, Yersinia pestis
ugccaguuauuauuuuuaaug

SEQ ID NO: 4170157 - RNA, 22 nt, Yersinia pestis
ugccauaaaguuuuuccucaaa

SEQ ID NO: 4170158 - RNA, 14 nt, Yersinia pestis
ugccauaacaucgu

SEQ ID NO: 4170159 - RNA, 20 nt, Yersinia pestis
ugccauaaccgcuaaggcca

SEQ ID NO: 4170160 - RNA, 21 nt, Yersinia pestis
ugccauaaccgcuaaggccaa

SEQ ID NO: 4170161 - RNA, 22 nt, Yersinia pestis
ugccauaagcggacauggcaac

SEQ ID NO: 4170162 - RNA, 20 nt, Yersinia pestis
ugccauaagugaacaugaug

SEQ ID NO: 4170163 - RNA, 16 nt, Yersinia pestis
ugccauacggcgucuu

SEQ ID NO: 4170164 - RNA, 14 nt, Yersinia pestis
ugccauagcugcug

SEQ ID NO: 4170165 - RNA, 16 nt, Yersinia pestis
ugccaucaaucaguac

SEQ ID NO: 4170166 - RNA, 14 nt, Yersinia pestis
ugccaucaggauuu

SEQ ID NO: 4170167 - RNA, 18 nt, Yersinia pestis
ugccauccauuacauccu

SEQ ID NO: 4170168 - RNA, 12 nt, Yersinia pestis
ugccauccugcc

SEQ ID NO: 4170169 - RNA, 15 nt, Yersinia pestis
ugccaucgccaacag

SEQ ID NO: 4170170 - RNA, 13 nt, Yersinia pestis
ugccaucgcuuug

SEQ ID NO: 4170171 - RNA, 22 nt, Yersinia pestis
ugccaucuuguucuaauaauaa

SEQ ID NO: 4170172 - RNA, 16 nt, Yersinia pestis
ugccaugcacuccacu

SEQ ID NO: 4170173 - RNA, 22 nt, Yersinia pestis
ugccauguugaguuuacgcagu

SEQ ID NO: 4170174 - RNA, 12 nt, Yersinia pestis
ugccauucaagc

SEQ ID NO: 4170175 - RNA, 18 nt, Yersinia pestis
ugccauuuccaauaccaa

SEQ ID NO: 4170176 - RNA, 20 nt, Yersinia pestis
ugcccaacaacgccgcaccg

SEQ ID NO: 4170177 - RNA, 16 nt, Yersinia pestis
ugcccaauggcaaaac

SEQ ID NO: 4170178 - RNA, 20 nt, Yersinia pestis
ugcccacauaaagauagcca

SEQ ID NO: 4170179 - RNA, 14 nt, Yersinia pestis
ugcccagagcgcgg

SEQ ID NO: 4170180 - RNA, 19 nt, Yersinia pestis
ugcccagagcgcggcuuca

SEQ ID NO: 4170181 - RNA, 14 nt, Yersinia pestis
ugcccagccucugg

SEQ ID NO: 4170182 - RNA, 20 nt, Yersinia pestis
ugcccaguuuaccauccacu

SEQ ID NO: 4170183 - RNA, 17 nt, Yersinia pestis
ugcccaucagcaucaau

SEQ ID NO: 4170184 - RNA, 13 nt, Yersinia pestis
ugcccaucaugcc

SEQ ID NO: 4170185 - RNA, 17 nt, Yersinia pestis
ugcccaucaugccagca

SEQ ID NO: 4170186 - RNA, 13 nt, Yersinia pestis
ugccccacuucac

SEQ ID NO: 4170187 - RNA, 23 nt, Yersinia pestis
ugccccaucagcacuccccgccc

SEQ ID NO: 4170188 - RNA, 23 nt, Yersinia pestis
ugcccccagcggugaucgcugcc

SEQ ID NO: 4170189 - RNA, 17 nt, Yersinia pestis
ugcccccuguaacgcua

SEQ ID NO: 4170190 - RNA, 14 nt, Yersinia pestis
ugcccgcgcuucca

SEQ ID NO: 4170191 - RNA, 19 nt, Yersinia pestis
ugcccgcgcuuccaggcug

SEQ ID NO: 4170192 - RNA, 20 nt, Yersinia pestis
ugcccgcguaaucucucaca

SEQ ID NO: 4170193 - RNA, 12 nt, Yersinia pestis
ugcccggcugau

SEQ ID NO: 4170194 - RNA, 17 nt, Yersinia pestis
ugcccgucaauaucauc

SEQ ID NO: 4170195 - RNA, 19 nt, Yersinia pestis
ugcccguuaauauuaaucg

SEQ ID NO: 4170196 - RNA, 13 nt, Yersinia pestis
ugcccuaaacagc

SEQ ID NO: 4170197 - RNA, 18 nt, Yersinia pestis
ugcccuaauaccaauacc

SEQ ID NO: 4170198 - RNA, 16 nt, Yersinia pestis
ugcccuuacuauuuuu

SEQ ID NO: 4170199 - RNA, 22 nt, Yersinia pestis
ugcccuucagaugaauccagcc

SEQ ID NO: 4170200 - RNA, 19 nt, Yersinia pestis
ugccgagaacagaauguug

SEQ ID NO: 4170201 - RNA, 22 nt, Yersinia pestis
ugccgauaaaaacuauccgccc

SEQ ID NO: 4170202 - RNA, 21 nt, Yersinia pestis
ugccgauauagcgcaccaccg

SEQ ID NO: 4170203 - RNA, 15 nt, Yersinia pestis
ugccgaucaucucau

SEQ ID NO: 4170204 - RNA, 18 nt, Yersinia pestis
ugccgaugagcuucuuca

SEQ ID NO: 4170205 - RNA, 21 nt, Yersinia pestis
ugccgcaaacgcucaguuaaa

SEQ ID NO: 4170206 - RNA, 19 nt, Yersinia pestis
ugccgcaagaaagaaaaau

SEQ ID NO: 4170207 - RNA, 16 nt, Yersinia pestis
ugccgcacacagcccu

SEQ ID NO: 4170208 - RNA, 16 nt, Yersinia pestis
ugccgcacugccacca

SEQ ID NO: 4170209 - RNA, 13 nt, Yersinia pestis
ugccgcauuaccc

SEQ ID NO: 4170210 - RNA, 14 nt, Yersinia pestis
ugccgcccugcuca

SEQ ID NO: 4170211 - RNA, 17 nt, Yersinia pestis
ugccgcgcccccagcca

SEQ ID NO: 4170212 - RNA, 19 nt, Yersinia pestis
ugccgcgcccccagccauu

SEQ ID NO: 4170213 - RNA, 23 nt, Yersinia pestis
ugccgcuaacgucgcuguuacuc

SEQ ID NO: 4170214 - RNA, 21 nt, Yersinia pestis
ugccgcugugauuaagcguua

SEQ ID NO: 4170215 - RNA, 16 nt, Yersinia pestis
ugccgcuucauauccu

SEQ ID NO: 4170216 - RNA, 12 nt, Yersinia pestis
ugccgcuuuagu

SEQ ID NO: 4170217 - RNA, 14 nt, Yersinia pestis
ugccggaaauuuau

SEQ ID NO: 4170218 - RNA, 24 nt, Yersinia pestis
ugccggaggauauuuauuucugca

SEQ ID NO: 4170219 - RNA, 15 nt, Yersinia pestis
ugccggcggcgcugg

SEQ ID NO: 4170220 - RNA, 20 nt, Yersinia pestis
ugccggcguuaaugccaccc

SEQ ID NO: 4170221 - RNA, 17 nt, Yersinia pestis
ugccgggcaauguguag

SEQ ID NO: 4170222 - RNA, 20 nt, Yersinia pestis
ugccggggagucgcuccuca

SEQ ID NO: 4170223 - RNA, 16 nt, Yersinia pestis
ugccggugagcacgau

SEQ ID NO: 4170224 - RNA, 15 nt, Yersinia pestis
ugccguaaaauuuaa

SEQ ID NO: 4170225 - RNA, 15 nt, Yersinia pestis
ugccguaaacaauaa

SEQ ID NO: 4170226 - RNA, 22 nt, Yersinia pestis
ugccguagguaauuaaacgcuc

SEQ ID NO: 4170227 - RNA, 21 nt, Yersinia pestis
ugccgucaaugccuguuauaa

SEQ ID NO: 4170228 - RNA, 18 nt, Yersinia pestis
ugccgugucuuccagaca

SEQ ID NO: 4170229 - RNA, 20 nt, Yersinia pestis
ugccguuaauugugaucagu

SEQ ID NO: 4170230 - RNA, 14 nt, Yersinia pestis
ugccguuacccccg

SEQ ID NO: 4170231 - RNA, 22 nt, Yersinia pestis
ugccguuugaugcgcugagcaa

SEQ ID NO: 4170232 - RNA, 23 nt, Yersinia pestis
ugccguuuugcagaucaaucgca

SEQ ID NO: 4170233 - RNA, 20 nt, Yersinia pestis
ugccuaagccuaauggugcu

SEQ ID NO: 4170234 - RNA, 21 nt, Yersinia pestis
ugccuacaacuugcuggaggc

SEQ ID NO: 4170235 - RNA, 15 nt, Yersinia pestis
ugccuacuggccacu

SEQ ID NO: 4170236 - RNA, 23 nt, Yersinia pestis
ugccuauagccgucacuuaaaaa

SEQ ID NO: 4170237 - RNA, 13 nt, Yersinia pestis
ugccuauccucac

SEQ ID NO: 4170238 - RNA, 14 nt, Yersinia pestis
ugccuauccucacc

SEQ ID NO: 4170239 - RNA, 23 nt, Yersinia pestis
ugccuauccucaccguucaagau

SEQ ID NO: 4170240 - RNA, 16 nt, Yersinia pestis
ugccuaucuuaaaaau

SEQ ID NO: 4170241 - RNA, 16 nt, Yersinia pestis
ugccuauuucagggcg

SEQ ID NO: 4170242 - RNA, 23 nt, Yersinia pestis
ugccucacggcuaccagcagcau

SEQ ID NO: 4170243 - RNA, 20 nt, Yersinia pestis
ugccucggcaaguuguucau

SEQ ID NO: 4170244 - RNA, 17 nt, Yersinia pestis
ugccucugcuaacaaca

SEQ ID NO: 4170245 - RNA, 15 nt, Yersinia pestis
ugccugacagccugu

SEQ ID NO: 4170246 - RNA, 19 nt, Yersinia pestis
ugccugauuuuuaucauca

SEQ ID NO: 4170247 - RNA, 12 nt, Yersinia pestis
ugccugcugcug

SEQ ID NO: 4170248 - RNA, 14 nt, Yersinia pestis
ugccugcugcugug

SEQ ID NO: 4170249 - RNA, 20 nt, Yersinia pestis
ugccugcuggcaaacuuuuc

SEQ ID NO: 4170250 - RNA, 24 nt, Yersinia pestis
ugccuggaucaaguuagcaggcag

SEQ ID NO: 4170251 - RNA, 14 nt, Yersinia pestis
ugccugguugguga

SEQ ID NO: 4170252 - RNA, 18 nt, Yersinia pestis
ugccugugcgcuggucgc

SEQ ID NO: 4170253 - RNA, 15 nt, Yersinia pestis
ugccugugggcuaua

SEQ ID NO: 4170254 - RNA, 12 nt, Yersinia pestis
ugccuguucucu

SEQ ID NO: 4170255 - RNA, 17 nt, Yersinia pestis
ugccuuaucuaaccguc

SEQ ID NO: 4170256 - RNA, 17 nt, Yersinia pestis
ugccuuggucucagaac

SEQ ID NO: 4170257 - RNA, 16 nt, Yersinia pestis
ugccuuucuguaacuc

SEQ ID NO: 4170258 - RNA, 23 nt, Yersinia pestis
ugccuuucuguaacucaaauuau

SEQ ID NO: 4170259 - RNA, 13 nt, Yersinia pestis
ugccuuuucuucc

SEQ ID NO: 4170260 - RNA, 14 nt, Yersinia pestis
ugcgaaaaaagaug

SEQ ID NO: 4170261 - RNA, 16 nt, Yersinia pestis
ugcgaaaauuuaacua

SEQ ID NO: 4170262 - RNA, 15 nt, Yersinia pestis
ugcgaagaaaaacac

SEQ ID NO: 4170263 - RNA, 13 nt, Yersinia pestis
ugcgaauuaucau

SEQ ID NO: 4170264 - RNA, 16 nt, Yersinia pestis
ugcgacaauaacgccu

SEQ ID NO: 4170265 - RNA, 20 nt, Yersinia pestis
ugcgacaccaagaggcugcg

SEQ ID NO: 4170266 - RNA, 13 nt, Yersinia pestis
ugcgacaggcuca

SEQ ID NO: 4170267 - RNA, 17 nt, Yersinia pestis
ugcgacgacgacaauga

SEQ ID NO: 4170268 - RNA, 16 nt, Yersinia pestis
ugcgagauauaaacua

SEQ ID NO: 4170269 - RNA, 14 nt, Yersinia pestis
ugcgagcaaggcau

SEQ ID NO: 4170270 - RNA, 21 nt, Yersinia pestis
ugcgauacaccauuuccaggc

SEQ ID NO: 4170271 - RNA, 22 nt, Yersinia pestis
ugcgauacaccauuuccaggcu

SEQ ID NO: 4170272 - RNA, 12 nt, Yersinia pestis
ugcgauccuggc

SEQ ID NO: 4170273 - RNA, 17 nt, Yersinia pestis
ugcgcaagcgcugcuuu

SEQ ID NO: 4170274 - RNA, 12 nt, Yersinia pestis
ugcgcaccagcu

SEQ ID NO: 4170275 - RNA, 14 nt, Yersinia pestis
ugcgcagcaaauaa

SEQ ID NO: 4170276 - RNA, 13 nt, Yersinia pestis
ugcgcaguaaccg

SEQ ID NO: 4170277 - RNA, 17 nt, Yersinia pestis
ugcgccaaguccuccuu

SEQ ID NO: 4170278 - RNA, 13 nt, Yersinia pestis
ugcgccagcagca

SEQ ID NO: 4170279 - RNA, 21 nt, Yersinia pestis
ugcgcccuuaucuaucucagg

SEQ ID NO: 4170280 - RNA, 19 nt, Yersinia pestis
ugcgcccuuuuccgucagc

SEQ ID NO: 4170281 - RNA, 13 nt, Yersinia pestis
ugcgccgcuuugc

SEQ ID NO: 4170282 - RNA, 13 nt, Yersinia pestis
ugcgccuguuagg

SEQ ID NO: 4170283 - RNA, 13 nt, Yersinia pestis
ugcgcgcugggac

SEQ ID NO: 4170284 - RNA, 19 nt, Yersinia pestis
ugcgcguuaaucugcugcu

SEQ ID NO: 4170285 - RNA, 15 nt, Yersinia pestis
ugcgcuaacagcguu

SEQ ID NO: 4170286 - RNA, 18 nt, Yersinia pestis
ugcgcuccauuucugguu

SEQ ID NO: 4170287 - RNA, 15 nt, Yersinia pestis
ugcgcucgcuugcug

SEQ ID NO: 4170288 - RNA, 17 nt, Yersinia pestis
ugcgcugagugauagug

SEQ ID NO: 4170289 - RNA, 16 nt, Yersinia pestis
ugcgcugcgccaauac

SEQ ID NO: 4170290 - RNA, 24 nt, Yersinia pestis
ugcgcuucaucaauauaguaagca

SEQ ID NO: 4170291 - RNA, 16 nt, Yersinia pestis
ugcgcuucgcacuuca

SEQ ID NO: 4170292 - RNA, 20 nt, Yersinia pestis
ugcgcuucgcgcagcaugga

SEQ ID NO: 4170293 - RNA, 14 nt, Yersinia pestis
ugcggaacagcgcc

SEQ ID NO: 4170294 - RNA, 14 nt, Yersinia pestis
ugcggacagcgcgc

SEQ ID NO: 4170295 - RNA, 16 nt, Yersinia pestis
ugcggauauaguuuuu

SEQ ID NO: 4170296 - RNA, 14 nt, Yersinia pestis
ugcggauucaccca

SEQ ID NO: 4170297 - RNA, 23 nt, Yersinia pestis
ugcggauuuuuuugcaauuaauu

SEQ ID NO: 4170298 - RNA, 20 nt, Yersinia pestis
ugcggcacgaucuggcaaaa

SEQ ID NO: 4170299 - RNA, 18 nt, Yersinia pestis
ugcggcggcugaccacaa

SEQ ID NO: 4170300 - RNA, 14 nt, Yersinia pestis
ugcgggaguuuguc

SEQ ID NO: 4170301 - RNA, 17 nt, Yersinia pestis
ugcgggauucgaaccug

SEQ ID NO: 4170302 - RNA, 23 nt, Yersinia pestis
ugcggguauuugucgucccaggc

SEQ ID NO: 4170303 - RNA, 14 nt, Yersinia pestis
ugcgggugccgcau

SEQ ID NO: 4170304 - RNA, 23 nt, Yersinia pestis
ugcgguaaccagcaucaguagca

SEQ ID NO: 4170305 - RNA, 15 nt, Yersinia pestis
ugcgguggcacugac

SEQ ID NO: 4170306 - RNA, 12 nt, Yersinia pestis
ugcgguggccag

SEQ ID NO: 4170307 - RNA, 15 nt, Yersinia pestis
ugcgguggccagagc

SEQ ID NO: 4170308 - RNA, 17 nt, Yersinia pestis
ugcgguuacgggugauu

SEQ ID NO: 4170309 - RNA, 22 nt, Yersinia pestis
ugcgguucuguaucauauguuc

SEQ ID NO: 4170310 - RNA, 14 nt, Yersinia pestis
ugcgguugcugugg

SEQ ID NO: 4170311 - RNA, 15 nt, Yersinia pestis
ugcguaaaugaaauu

SEQ ID NO: 4170312 - RNA, 23 nt, Yersinia pestis
ugcguaccauauggaugaugcac

SEQ ID NO: 4170313 - RNA, 13 nt, Yersinia pestis
ugcguaucauuau

SEQ ID NO: 4170314 - RNA, 19 nt, Yersinia pestis
ugcgugcaauaaagcgaua

SEQ ID NO: 4170315 - RNA, 16 nt, Yersinia pestis
ugcguguggucagcac

SEQ ID NO: 4170316 - RNA, 20 nt, Yersinia pestis
ugcguguucuucucaccccg

SEQ ID NO: 4170317 - RNA, 15 nt, Yersinia pestis
ugcguguugccaccu

SEQ ID NO: 4170318 - RNA, 18 nt, Yersinia pestis
ugcguuaauuacacccaa

SEQ ID NO: 4170319 - RNA, 18 nt, Yersinia pestis
ugcguuuagggacagguu

SEQ ID NO: 4170320 - RNA, 18 nt, Yersinia pestis
ugcguuuuugaaauacca

SEQ ID NO: 4170321 - RNA, 20 nt, Yersinia pestis
ugcuaacaacagucaauaua

SEQ ID NO: 4170322 - RNA, 16 nt, Yersinia pestis
ugcuaaccgaauaaaa

SEQ ID NO: 4170323 - RNA, 18 nt, Yersinia pestis
ugcuaauaccacaacauu

SEQ ID NO: 4170324 - RNA, 20 nt, Yersinia pestis
ugcuaauaccaccaccacac

SEQ ID NO: 4170325 - RNA, 20 nt, Yersinia pestis
ugcuaauuucaucucaauaa

SEQ ID NO: 4170326 - RNA, 19 nt, Yersinia pestis
ugcuacaggcgacccagca

SEQ ID NO: 4170327 - RNA, 13 nt, Yersinia pestis
ugcuaccagcaau

SEQ ID NO: 4170328 - RNA, 14 nt, Yersinia pestis
ugcuacgauaauaa

SEQ ID NO: 4170329 - RNA, 22 nt, Yersinia pestis
ugcuacggauugcaaauccguc

SEQ ID NO: 4170330 - RNA, 14 nt, Yersinia pestis
ugcuacuuaauauc

SEQ ID NO: 4170331 - RNA, 20 nt, Yersinia pestis
ugcuagcagaggcaaauucc

SEQ ID NO: 4170332 - RNA, 13 nt, Yersinia pestis
ugcuaguauuauc

SEQ ID NO: 4170333 - RNA, 18 nt, Yersinia pestis
ugcuauccacaaacucau

SEQ ID NO: 4170334 - RNA, 20 nt, Yersinia pestis
ugcuauggguaauccccacc

SEQ ID NO: 4170335 - RNA, 13 nt, Yersinia pestis
ugcuauugaacau

SEQ ID NO: 4170336 - RNA, 16 nt, Yersinia pestis
ugcuauugaacauuca

SEQ ID NO: 4170337 - RNA, 16 nt, Yersinia pestis
ugcuauuuuauaucga

SEQ ID NO: 4170338 - RNA, 18 nt, Yersinia pestis
ugcucaaacucagcauca

SEQ ID NO: 4170339 - RNA, 16 nt, Yersinia pestis
ugcucaacugcucaac

SEQ ID NO: 4170340 - RNA, 18 nt, Yersinia pestis
ugcucacgcguaaaugga

SEQ ID NO: 4170341 - RNA, 17 nt, Yersinia pestis
ugcucacgguagguuuc

SEQ ID NO: 4170342 - RNA, 16 nt, Yersinia pestis
ugcucacuuuuaucca

SEQ ID NO: 4170343 - RNA, 16 nt, Yersinia pestis
ugcucagcuaaagaac

SEQ ID NO: 4170344 - RNA, 14 nt, Yersinia pestis
ugcucaggccuugc

SEQ ID NO: 4170345 - RNA, 20 nt, Yersinia pestis
ugcucagggccacuucggug

SEQ ID NO: 4170346 - RNA, 16 nt, Yersinia pestis
ugcucauaaagcauca

SEQ ID NO: 4170347 - RNA, 19 nt, Yersinia pestis
ugcucaucaaccucagccu

SEQ ID NO: 4170348 - RNA, 16 nt, Yersinia pestis
ugcucauuaccaauac

SEQ ID NO: 4170349 - RNA, 18 nt, Yersinia pestis
ugcucauuuaaaauacuc

SEQ ID NO: 4170350 - RNA, 18 nt, Yersinia pestis
ugcuccaaagcuuccaau

SEQ ID NO: 4170351 - RNA, 13 nt, Yersinia pestis
ugcucccauguca

SEQ ID NO: 4170352 - RNA, 18 nt, Yersinia pestis
ugcucccggcacuaaaau

SEQ ID NO: 4170353 - RNA, 18 nt, Yersinia pestis
ugcucccguagcaaauaa

SEQ ID NO: 4170354 - RNA, 18 nt, Yersinia pestis
ugcuccgcagugaucagu

SEQ ID NO: 4170355 - RNA, 19 nt, Yersinia pestis
ugcuccgcagugaucaguc

SEQ ID NO: 4170356 - RNA, 12 nt, Yersinia pestis
ugcuccuuacua

SEQ ID NO: 4170357 - RNA, 22 nt, Yersinia pestis
ugcucgaucagcgucagcagau

SEQ ID NO: 4170358 - RNA, 16 nt, Yersinia pestis
ugcucgcuaaucaagc

SEQ ID NO: 4170359 - RNA, 15 nt, Yersinia pestis
ugcucggugaguuua

SEQ ID NO: 4170360 - RNA, 18 nt, Yersinia pestis
ugcucucgcuccagcucg

SEQ ID NO: 4170361 - RNA, 15 nt, Yersinia pestis
ugcucugcaauacug

SEQ ID NO: 4170362 - RNA, 17 nt, Yersinia pestis
ugcucugucaacgcuuc

SEQ ID NO: 4170363 - RNA, 20 nt, Yersinia pestis
ugcucugucaacgcuucagu

SEQ ID NO: 4170364 - RNA, 13 nt, Yersinia pestis
ugcucuucauaag

SEQ ID NO: 4170365 - RNA, 17 nt, Yersinia pestis
ugcugaagccagcaccg

SEQ ID NO: 4170366 - RNA, 14 nt, Yersinia pestis
ugcugacaacccuc

SEQ ID NO: 4170367 - RNA, 18 nt, Yersinia pestis
ugcugaccccaaauuuga

SEQ ID NO: 4170368 - RNA, 20 nt, Yersinia pestis
ugcugacgauaacuuuuggc

SEQ ID NO: 4170369 - RNA, 16 nt, Yersinia pestis
ugcugagccaaauaau

SEQ ID NO: 4170370 - RNA, 20 nt, Yersinia pestis
ugcugaguaaauuaaauuuu

SEQ ID NO: 4170371 - RNA, 14 nt, Yersinia pestis
ugcugagugaagac

SEQ ID NO: 4170372 - RNA, 14 nt, Yersinia pestis
ugcugauaaaauuc

SEQ ID NO: 4170373 - RNA, 16 nt, Yersinia pestis
ugcugaucgagcauca

SEQ ID NO: 4170374 - RNA, 13 nt, Yersinia pestis
ugcugaugucagu

SEQ ID NO: 4170375 - RNA, 21 nt, Yersinia pestis
ugcugaugucagugcuccauc

SEQ ID NO: 4170376 - RNA, 21 nt, Yersinia pestis
ugcugauguuucuuugcgcca

SEQ ID NO: 4170377 - RNA, 16 nt, Yersinia pestis
ugcugcaaccacuuau

SEQ ID NO: 4170378 - RNA, 17 nt, Yersinia pestis
ugcugcaaccacuuauc

SEQ ID NO: 4170379 - RNA, 17 nt, Yersinia pestis
ugcugcaagaguccagc

SEQ ID NO: 4170380 - RNA, 16 nt, Yersinia pestis
ugcugcaaggcauuaa

SEQ ID NO: 4170381 - RNA, 20 nt, Yersinia pestis
ugcugcacaaguuggugcag

SEQ ID NO: 4170382 - RNA, 17 nt, Yersinia pestis
ugcugcccaaaaucaaa

SEQ ID NO: 4170383 - RNA, 15 nt, Yersinia pestis
ugcugcccuuugcug

SEQ ID NO: 4170384 - RNA, 15 nt, Yersinia pestis
ugcugccugccugcu

SEQ ID NO: 4170385 - RNA, 18 nt, Yersinia pestis
ugcugccugccugcugcu

SEQ ID NO: 4170386 - RNA, 19 nt, Yersinia pestis
ugcugccugccugcugcuc

SEQ ID NO: 4170387 - RNA, 20 nt, Yersinia pestis
ugcugccugccugcugcucc

SEQ ID NO: 4170388 - RNA, 15 nt, Yersinia pestis
ugcugccuugcugca

SEQ ID NO: 4170389 - RNA, 16 nt, Yersinia pestis
ugcugccuugcugcaa

SEQ ID NO: 4170390 - RNA, 23 nt, Yersinia pestis
ugcugcucugucaacgcuucagu

SEQ ID NO: 4170391 - RNA, 19 nt, Yersinia pestis
ugcugcugcccgcgaauaa

SEQ ID NO: 4170392 - RNA, 22 nt, Yersinia pestis
ugcuggaacguugcacccugcu

SEQ ID NO: 4170393 - RNA, 15 nt, Yersinia pestis
ugcuggaggcuggca

SEQ ID NO: 4170394 - RNA, 21 nt, Yersinia pestis
ugcuggauuuuuaucuuucug

SEQ ID NO: 4170395 - RNA, 21 nt, Yersinia pestis
ugcuggcaguggcggcaaaag

SEQ ID NO: 4170396 - RNA, 18 nt, Yersinia pestis
ugcuggcauggaugguca

SEQ ID NO: 4170397 - RNA, 13 nt, Yersinia pestis
ugcuggccaguuu

SEQ ID NO: 4170398 - RNA, 15 nt, Yersinia pestis
ugcuggccauuuacc

SEQ ID NO: 4170399 - RNA, 15 nt, Yersinia pestis
ugcuggccugauagu

SEQ ID NO: 4170400 - RNA, 21 nt, Yersinia pestis
ugcuggcuaauacuggcuaaa

SEQ ID NO: 4170401 - RNA, 16 nt, Yersinia pestis
ugcugggggcgguugc

SEQ ID NO: 4170402 - RNA, 15 nt, Yersinia pestis
ugcuggguugcuucg

SEQ ID NO: 4170403 - RNA, 18 nt, Yersinia pestis
ugcugguaaaaacaccau

SEQ ID NO: 4170404 - RNA, 18 nt, Yersinia pestis
ugcuggucuccgcuggca

SEQ ID NO: 4170405 - RNA, 21 nt, Yersinia pestis
ugcuguagcgauaagugcagc

SEQ ID NO: 4170406 - RNA, 15 nt, Yersinia pestis
ugcuguauuuaaccg

SEQ ID NO: 4170407 - RNA, 14 nt, Yersinia pestis
ugcuguauuuuucg

SEQ ID NO: 4170408 - RNA, 23 nt, Yersinia pestis
ugcuguauuuuucgcaguaacgg

SEQ ID NO: 4170409 - RNA, 21 nt, Yersinia pestis
ugcugucgagcaaaucgauac

SEQ ID NO: 4170410 - RNA, 23 nt, Yersinia pestis
ugcugugagccagagacauaaag

SEQ ID NO: 4170411 - RNA, 21 nt, Yersinia pestis
ugcuguggcgauuuaauccaa

SEQ ID NO: 4170412 - RNA, 13 nt, Yersinia pestis
ugcuguugccaca

SEQ ID NO: 4170413 - RNA, 21 nt, Yersinia pestis
ugcuguuguagcgccagguaa

SEQ ID NO: 4170414 - RNA, 22 nt, Yersinia pestis
ugcuguuguuauuacugucacu

SEQ ID NO: 4170415 - RNA, 20 nt, Yersinia pestis
ugcuguuuaccuaucucagu

SEQ ID NO: 4170416 - RNA, 17 nt, Yersinia pestis
ugcuuaaaccauacucc

SEQ ID NO: 4170417 - RNA, 23 nt, Yersinia pestis
ugcuuaaagccuucaacuaauau

SEQ ID NO: 4170418 - RNA, 19 nt, Yersinia pestis
ugcuuaagaggaucuuccu

SEQ ID NO: 4170419 - RNA, 20 nt, Yersinia pestis
ugcuuaccacuggccuccca

SEQ ID NO: 4170420 - RNA, 20 nt, Yersinia pestis
ugcuuacucuuccaacucau

SEQ ID NO: 4170421 - RNA, 14 nt, Yersinia pestis
ugcuuauuucacac

SEQ ID NO: 4170422 - RNA, 23 nt, Yersinia pestis
ugcuucauggcuaaauccacacg

SEQ ID NO: 4170423 - RNA, 16 nt, Yersinia pestis
ugcuuccaggauauuc

SEQ ID NO: 4170424 - RNA, 20 nt, Yersinia pestis
ugcuucuacccuggcggcaa

SEQ ID NO: 4170425 - RNA, 15 nt, Yersinia pestis
ugcuucuuuaaucac

SEQ ID NO: 4170426 - RNA, 14 nt, Yersinia pestis
ugcuugcugccugc

SEQ ID NO: 4170427 - RNA, 18 nt, Yersinia pestis
ugcuuggacucuggaauu

SEQ ID NO: 4170428 - RNA, 18 nt, Yersinia pestis
ugcuuguuguugauaguu

SEQ ID NO: 4170429 - RNA, 22 nt, Yersinia pestis
ugcuuuaaucgccagacuguuc

SEQ ID NO: 4170430 - RNA, 21 nt, Yersinia pestis
ugcuuuaucagauaaggccug

SEQ ID NO: 4170431 - RNA, 16 nt, Yersinia pestis
ugcuuuaucguagcca

SEQ ID NO: 4170432 - RNA, 18 nt, Yersinia pestis
ugcuuuaucguagccaau

SEQ ID NO: 4170433 - RNA, 19 nt, Yersinia pestis
ugcuuuccacgcccaacuc

SEQ ID NO: 4170434 - RNA, 16 nt, Yersinia pestis
ugcuuucuaacaaacc

SEQ ID NO: 4170435 - RNA, 15 nt, Yersinia pestis
ugcuuugcuucaucc

SEQ ID NO: 4170436 - RNA, 12 nt, Yersinia pestis
ugcuuuuaacuc

SEQ ID NO: 4170437 - RNA, 14 nt, Yersinia pestis
ugcuuuuugcuuuu

SEQ ID NO: 4170438 - RNA, 15 nt, Yersinia pestis
ugcuuuuugcuuuuu

SEQ ID NO: 4170439 - RNA, 18 nt, Yersinia pestis
uggaaaaaauaauggcca

SEQ ID NO: 4170440 - RNA, 13 nt, Yersinia pestis
uggaaaacagcaa

SEQ ID NO: 4170441 - RNA, 23 nt, Yersinia pestis
uggaaaaguaggacggugccaug

SEQ ID NO: 4170442 - RNA, 13 nt, Yersinia pestis
uggaaaauacacu

SEQ ID NO: 4170443 - RNA, 16 nt, Yersinia pestis
uggaaacaaaaccuaa

SEQ ID NO: 4170444 - RNA, 15 nt, Yersinia pestis
uggaaacgaccugua

SEQ ID NO: 4170445 - RNA, 16 nt, Yersinia pestis
uggaaauuauuuagaa

SEQ ID NO: 4170446 - RNA, 17 nt, Yersinia pestis
uggaacaggauuuucaa

SEQ ID NO: 4170447 - RNA, 20 nt, Yersinia pestis
uggaagaaucaccgaaagaa

SEQ ID NO: 4170448 - RNA, 22 nt, Yersinia pestis
uggaagauagauuucacugccg

SEQ ID NO: 4170449 - RNA, 20 nt, Yersinia pestis
uggaagccgacgaucuugcc

SEQ ID NO: 4170450 - RNA, 20 nt, Yersinia pestis
uggaagggaguuacucagca

SEQ ID NO: 4170451 - RNA, 15 nt, Yersinia pestis
uggaaguacuuauuu

SEQ ID NO: 4170452 - RNA, 19 nt, Yersinia pestis
uggaaguggccagccugga

SEQ ID NO: 4170453 - RNA, 21 nt, Yersinia pestis
uggaaucggccuucaauaccu

SEQ ID NO: 4170454 - RNA, 15 nt, Yersinia pestis
uggaauuaaaguauc

SEQ ID NO: 4170455 - RNA, 17 nt, Yersinia pestis
uggacaaauaaaacaga

SEQ ID NO: 4170456 - RNA, 23 nt, Yersinia pestis
uggacagaaaacaaucuggcagc

SEQ ID NO: 4170457 - RNA, 15 nt, Yersinia pestis
uggaccuccaucaac

SEQ ID NO: 4170458 - RNA, 23 nt, Yersinia pestis
uggacgaacagccccaaccaucu

SEQ ID NO: 4170459 - RNA, 15 nt, Yersinia pestis
uggacgaacagcuca

SEQ ID NO: 4170460 - RNA, 18 nt, Yersinia pestis
uggacgauaaauucaaau

SEQ ID NO: 4170461 - RNA, 14 nt, Yersinia pestis
uggacgcaucagau

SEQ ID NO: 4170462 - RNA, 14 nt, Yersinia pestis
uggagaucugggcg

SEQ ID NO: 4170463 - RNA, 21 nt, Yersinia pestis
uggagccagcgccgugccaga

SEQ ID NO: 4170464 - RNA, 23 nt, Yersinia pestis
uggagccagcgccgugccagaaa

SEQ ID NO: 4170465 - RNA, 11 nt, Yersinia pestis
uggagccugua

SEQ ID NO: 4170466 - RNA, 22 nt, Yersinia pestis
uggagccuguacauaaauuugu

SEQ ID NO: 4170467 - RNA, 13 nt, Yersinia pestis
uggagccugugca

SEQ ID NO: 4170468 - RNA, 13 nt, Yersinia pestis
uggagcuauggaa

SEQ ID NO: 4170469 - RNA, 14 nt, Yersinia pestis
uggaggcuggcagg

SEQ ID NO: 4170470 - RNA, 22 nt, Yersinia pestis
uggaguuaaaucccugugcuga

SEQ ID NO: 4170471 - RNA, 23 nt, Yersinia pestis
uggauaagugaauaacgcugaau

SEQ ID NO: 4170472 - RNA, 15 nt, Yersinia pestis
uggauaauuuaauua

SEQ ID NO: 4170473 - RNA, 14 nt, Yersinia pestis
uggauaauuucagc

SEQ ID NO: 4170474 - RNA, 14 nt, Yersinia pestis
uggauagcagagaa

SEQ ID NO: 4170475 - RNA, 16 nt, Yersinia pestis
uggauauccacaucac

SEQ ID NO: 4170476 - RNA, 22 nt, Yersinia pestis
uggaucaaguuagcaggcagca

SEQ ID NO: 4170477 - RNA, 19 nt, Yersinia pestis
uggaucacaaugcaaauau

SEQ ID NO: 4170478 - RNA, 13 nt, Yersinia pestis
uggaucacaucac

SEQ ID NO: 4170479 - RNA, 12 nt, Yersinia pestis
uggaucagcaga

SEQ ID NO: 4170480 - RNA, 19 nt, Yersinia pestis
uggaugagccgcagccagc

SEQ ID NO: 4170481 - RNA, 24 nt, Yersinia pestis
uggaugguauuugacauggauugu

SEQ ID NO: 4170482 - RNA, 14 nt, Yersinia pestis
uggauguuccuggc

SEQ ID NO: 4170483 - RNA, 17 nt, Yersinia pestis
uggauguuccuggcccu

SEQ ID NO: 4170484 - RNA, 15 nt, Yersinia pestis
uggauucuugcugca

SEQ ID NO: 4170485 - RNA, 17 nt, Yersinia pestis
uggauugaaaucagauc

SEQ ID NO: 4170486 - RNA, 18 nt, Yersinia pestis
uggauugugaacgguaug

SEQ ID NO: 4170487 - RNA, 13 nt, Yersinia pestis
uggauuuuccaga

SEQ ID NO: 4170488 - RNA, 22 nt, Yersinia pestis
uggcaaaacucaggugaguaaa

SEQ ID NO: 4170489 - RNA, 18 nt, Yersinia pestis
uggcaaaccggacauaau

SEQ ID NO: 4170490 - RNA, 21 nt, Yersinia pestis
uggcaaacgcugcacaucauu

SEQ ID NO: 4170491 - RNA, 13 nt, Yersinia pestis
uggcaaaggccag

SEQ ID NO: 4170492 - RNA, 15 nt, Yersinia pestis
uggcaaauugcuggc

SEQ ID NO: 4170493 - RNA, 18 nt, Yersinia pestis
uggcaaccccugccaaua

SEQ ID NO: 4170494 - RNA, 20 nt, Yersinia pestis
uggcaaccgguaacauauaa

SEQ ID NO: 4170495 - RNA, 22 nt, Yersinia pestis
uggcaacgacuggguaacggau

SEQ ID NO: 4170496 - RNA, 17 nt, Yersinia pestis
uggcaacuaucguccgc

SEQ ID NO: 4170497 - RNA, 15 nt, Yersinia pestis
uggcaacucagcacg

SEQ ID NO: 4170498 - RNA, 21 nt, Yersinia pestis
uggcaacuuaaaaguaggcuu

SEQ ID NO: 4170499 - RNA, 23 nt, Yersinia pestis
uggcaagguaaacggguuuuugu

SEQ ID NO: 4170500 - RNA, 14 nt, Yersinia pestis
uggcaauaaaggca

SEQ ID NO: 4170501 - RNA, 23 nt, Yersinia pestis
uggcaaucacaacccccccgacc

SEQ ID NO: 4170502 - RNA, 17 nt, Yersinia pestis
uggcaauccagcgccug

SEQ ID NO: 4170503 - RNA, 23 nt, Yersinia pestis
uggcaauuaugacguucaguagu

SEQ ID NO: 4170504 - RNA, 14 nt, Yersinia pestis
uggcaauuucucug

SEQ ID NO: 4170505 - RNA, 18 nt, Yersinia pestis
uggcaauuucuguuacca

SEQ ID NO: 4170506 - RNA, 19 nt, Yersinia pestis
uggcaccacggucagagau

SEQ ID NO: 4170507 - RNA, 17 nt, Yersinia pestis
uggcaccucaucccaaa

SEQ ID NO: 4170508 - RNA, 18 nt, Yersinia pestis
uggcacucucuucaucag

SEQ ID NO: 4170509 - RNA, 18 nt, Yersinia pestis
uggcacugccaucaauca

SEQ ID NO: 4170510 - RNA, 17 nt, Yersinia pestis
uggcagaaaucagccau

SEQ ID NO: 4170511 - RNA, 14 nt, Yersinia pestis
uggcagaaguugaa

SEQ ID NO: 4170512 - RNA, 10 nt, Yersinia pestis
uggcagagac

SEQ ID NO: 4170513 - RNA, 16 nt, Yersinia pestis
uggcagauuggcuugc

SEQ ID NO: 4170514 - RNA, 20 nt, Yersinia pestis
uggcagccuuuauccaacca

SEQ ID NO: 4170515 - RNA, 12 nt, Yersinia pestis
uggcaggccagc

SEQ ID NO: 4170516 - RNA, 15 nt, Yersinia pestis
uggcaggccccauca

SEQ ID NO: 4170517 - RNA, 20 nt, Yersinia pestis
uggcaggccuuucggcaaau

SEQ ID NO: 4170518 - RNA, 15 nt, Yersinia pestis
uggcagggccgauaa

SEQ ID NO: 4170519 - RNA, 17 nt, Yersinia pestis
uggcagguaucaauaca

SEQ ID NO: 4170520 - RNA, 15 nt, Yersinia pestis
uggcaggucucgcaa

SEQ ID NO: 4170521 - RNA, 14 nt, Yersinia pestis
uggcauaaucaacg

SEQ ID NO: 4170522 - RNA, 15 nt, Yersinia pestis
uggcauacagcucau

SEQ ID NO: 4170523 - RNA, 19 nt, Yersinia pestis
uggcaucaauauaacgccc

SEQ ID NO: 4170524 - RNA, 16 nt, Yersinia pestis
uggcaucacagaacau

SEQ ID NO: 4170525 - RNA, 22 nt, Yersinia pestis
uggcaucaccgcuaucacugau

SEQ ID NO: 4170526 - RNA, 12 nt, Yersinia pestis
uggcaugacuga

SEQ ID NO: 4170527 - RNA, 17 nt, Yersinia pestis
uggcaugacuuagcacg

SEQ ID NO: 4170528 - RNA, 15 nt, Yersinia pestis
uggcaugccaugcac

SEQ ID NO: 4170529 - RNA, 18 nt, Yersinia pestis
uggcauguucacaucggu

SEQ ID NO: 4170530 - RNA, 18 nt, Yersinia pestis
uggcauuaauuucaccga

SEQ ID NO: 4170531 - RNA, 15 nt, Yersinia pestis
uggcauuuucaguau

SEQ ID NO: 4170532 - RNA, 20 nt, Yersinia pestis
uggcauuuuuuacgguucca

SEQ ID NO: 4170533 - RNA, 20 nt, Yersinia pestis
uggccacccaacgcaauugc

SEQ ID NO: 4170534 - RNA, 15 nt, Yersinia pestis
uggccacucaccuca

SEQ ID NO: 4170535 - RNA, 16 nt, Yersinia pestis
uggccacucaccucag

SEQ ID NO: 4170536 - RNA, 20 nt, Yersinia pestis
uggccacugcgggcaguaac

SEQ ID NO: 4170537 - RNA, 18 nt, Yersinia pestis
uggccacuuccugauggc

SEQ ID NO: 4170538 - RNA, 21 nt, Yersinia pestis
uggccagacacugacaucauc

SEQ ID NO: 4170539 - RNA, 20 nt, Yersinia pestis
uggccagcgggaaucaaacu

SEQ ID NO: 4170540 - RNA, 17 nt, Yersinia pestis
uggccaguaaaaccuga

SEQ ID NO: 4170541 - RNA, 23 nt, Yersinia pestis
uggccaguuuuagucucgcagcc

SEQ ID NO: 4170542 - RNA, 15 nt, Yersinia pestis
uggccauuacgccac

SEQ ID NO: 4170543 - RNA, 20 nt, Yersinia pestis
uggcccaaaugagcagcaau

SEQ ID NO: 4170544 - RNA, 12 nt, Yersinia pestis
uggcccaagcca

SEQ ID NO: 4170545 - RNA, 13 nt, Yersinia pestis
uggcccaagccau

SEQ ID NO: 4170546 - RNA, 15 nt, Yersinia pestis
uggcccaagccaucc

SEQ ID NO: 4170547 - RNA, 17 nt, Yersinia pestis
uggcccaagccauccuu

SEQ ID NO: 4170548 - RNA, 18 nt, Yersinia pestis
uggcccaagccauccuuc

SEQ ID NO: 4170549 - RNA, 23 nt, Yersinia pestis
uggcccaaugcugucacugucaa

SEQ ID NO: 4170550 - RNA, 16 nt, Yersinia pestis
uggcccacuguuaccc

SEQ ID NO: 4170551 - RNA, 15 nt, Yersinia pestis
uggcccaguagagca

SEQ ID NO: 4170552 - RNA, 21 nt, Yersinia pestis
uggcccaguagagcacuucau

SEQ ID NO: 4170553 - RNA, 20 nt, Yersinia pestis
uggccccaauuguuucuucc

SEQ ID NO: 4170554 - RNA, 12 nt, Yersinia pestis
uggcccgcaucu

SEQ ID NO: 4170555 - RNA, 19 nt, Yersinia pestis
uggcccugagguuauugac

SEQ ID NO: 4170556 - RNA, 19 nt, Yersinia pestis
uggcccugauuguuuuuau

SEQ ID NO: 4170557 - RNA, 18 nt, Yersinia pestis
uggccgaaauggaaaggc

SEQ ID NO: 4170558 - RNA, 17 nt, Yersinia pestis
uggccgccgcggugaag

SEQ ID NO: 4170559 - RNA, 23 nt, Yersinia pestis
uggccgcuuugguugccagauaa

SEQ ID NO: 4170560 - RNA, 14 nt, Yersinia pestis
uggccuaacaacug

SEQ ID NO: 4170561 - RNA, 21 nt, Yersinia pestis
uggccuauuaagauaauuauc

SEQ ID NO: 4170562 - RNA, 13 nt, Yersinia pestis
uggccugaugcac

SEQ ID NO: 4170563 - RNA, 11 nt, Yersinia pestis
uggccuucauc

SEQ ID NO: 4170564 - RNA, 20 nt, Yersinia pestis
uggccuugaugugcucugcu

SEQ ID NO: 4170565 - RNA, 22 nt, Yersinia pestis
uggccuugaugugcucugcucc

SEQ ID NO: 4170566 - RNA, 22 nt, Yersinia pestis
uggcgaacauguuggcgggggg

SEQ ID NO: 4170567 - RNA, 20 nt, Yersinia pestis
uggcgacgugaugccaguaa

SEQ ID NO: 4170568 - RNA, 22 nt, Yersinia pestis
uggcgagguaccgcugcccggc

SEQ ID NO: 4170569 - RNA, 23 nt, Yersinia pestis
uggcgauagauuggcaucagugg

SEQ ID NO: 4170570 - RNA, 15 nt, Yersinia pestis
uggcgaucaaaggcg

SEQ ID NO: 4170571 - RNA, 16 nt, Yersinia pestis
uggcgaucaagguuuc

SEQ ID NO: 4170572 - RNA, 19 nt, Yersinia pestis
uggcgcaaagacuuuucca

SEQ ID NO: 4170573 - RNA, 20 nt, Yersinia pestis
uggcgcacaacugcgauaac

SEQ ID NO: 4170574 - RNA, 15 nt, Yersinia pestis
uggcgccucucuggc

SEQ ID NO: 4170575 - RNA, 17 nt, Yersinia pestis
uggcgcggcucgagccu

SEQ ID NO: 4170576 - RNA, 22 nt, Yersinia pestis
uggcgcgguucuaguauucagg

SEQ ID NO: 4170577 - RNA, 18 nt, Yersinia pestis
uggcgcgucaucgcggcg

SEQ ID NO: 4170578 - RNA, 21 nt, Yersinia pestis
uggcgcucauuucccgugcac

SEQ ID NO: 4170579 - RNA, 17 nt, Yersinia pestis
uggcgcucggucaugcg

SEQ ID NO: 4170580 - RNA, 16 nt, Yersinia pestis
uggcgcugaucaucau

SEQ ID NO: 4170581 - RNA, 14 nt, Yersinia pestis
uggcggaaauuaaa

SEQ ID NO: 4170582 - RNA, 22 nt, Yersinia pestis
uggcggaauugguagacgcgcu

SEQ ID NO: 4170583 - RNA, 18 nt, Yersinia pestis
uggcggcagcacagagca

SEQ ID NO: 4170584 - RNA, 15 nt, Yersinia pestis
uggcggccagugaug

SEQ ID NO: 4170585 - RNA, 21 nt, Yersinia pestis
uggcggcuugccugacagccu

SEQ ID NO: 4170586 - RNA, 23 nt, Yersinia pestis
uggcggucgcacugugagcggca

SEQ ID NO: 4170587 - RNA, 14 nt, Yersinia pestis
uggcgguuccaaag

SEQ ID NO: 4170588 - RNA, 17 nt, Yersinia pestis
uggcguaaguacugaug

SEQ ID NO: 4170589 - RNA, 20 nt, Yersinia pestis
uggcguuguaccaccaaacc

SEQ ID NO: 4170590 - RNA, 17 nt, Yersinia pestis
uggcguuucaucuucau

SEQ ID NO: 4170591 - RNA, 14 nt, Yersinia pestis
uggcguuuucuucg

SEQ ID NO: 4170592 - RNA, 17 nt, Yersinia pestis
uggcguuuuuguuacau

SEQ ID NO: 4170593 - RNA, 14 nt, Yersinia pestis
uggcuaaacccaac

SEQ ID NO: 4170594 - RNA, 22 nt, Yersinia pestis
uggcuaagccgcaauaaauggc

SEQ ID NO: 4170595 - RNA, 21 nt, Yersinia pestis
uggcuaauaaugcaccaauca

SEQ ID NO: 4170596 - RNA, 22 nt, Yersinia pestis
uggcuaauaccauuucuuauau

SEQ ID NO: 4170597 - RNA, 21 nt, Yersinia pestis
uggcuaucaauuguuugcuau

SEQ ID NO: 4170598 - RNA, 14 nt, Yersinia pestis
uggcuaucaucccu

SEQ ID NO: 4170599 - RNA, 13 nt, Yersinia pestis
uggcucaaugugc

SEQ ID NO: 4170600 - RNA, 14 nt, Yersinia pestis
uggcucaucaaagg

SEQ ID NO: 4170601 - RNA, 14 nt, Yersinia pestis
uggcucgugaucag

SEQ ID NO: 4170602 - RNA, 14 nt, Yersinia pestis
uggcucucuuuuuu

SEQ ID NO: 4170603 - RNA, 16 nt, Yersinia pestis
uggcucugccaauaaa

SEQ ID NO: 4170604 - RNA, 22 nt, Yersinia pestis
uggcucuggccagcgucuucag

SEQ ID NO: 4170605 - RNA, 22 nt, Yersinia pestis
uggcugaauaucaucuuuuucu

SEQ ID NO: 4170606 - RNA, 16 nt, Yersinia pestis
uggcugagauuuagau

SEQ ID NO: 4170607 - RNA, 23 nt, Yersinia pestis
uggcuguauuguugcucaacaua

SEQ ID NO: 4170608 - RNA, 13 nt, Yersinia pestis
uggcugucugaug

SEQ ID NO: 4170609 - RNA, 19 nt, Yersinia pestis
uggcuuaacaacguuaguu

SEQ ID NO: 4170610 - RNA, 16 nt, Yersinia pestis
uggcuucaaaaucacc

SEQ ID NO: 4170611 - RNA, 13 nt, Yersinia pestis
uggcuucugcuuu

SEQ ID NO: 4170612 - RNA, 20 nt, Yersinia pestis
uggcuuuacgcaacucagca

SEQ ID NO: 4170613 - RNA, 13 nt, Yersinia pestis
uggcuuucuccca

SEQ ID NO: 4170614 - RNA, 14 nt, Yersinia pestis
uggcuuuuucacac

SEQ ID NO: 4170615 - RNA, 13 nt, Yersinia pestis
uggcuuuuuuaau

SEQ ID NO: 4170616 - RNA, 14 nt, Yersinia pestis
uggcuuuuuuaaua

SEQ ID NO: 4170617 - RNA, 19 nt, Yersinia pestis
uggcuuuuuuaauaaaaaa

SEQ ID NO: 4170618 - RNA, 23 nt, Yersinia pestis
uggcuuuuuuaauaaaaaacuga

SEQ ID NO: 4170619 - RNA, 23 nt, Yersinia pestis
ugggaaccccucugcagcgucaa

SEQ ID NO: 4170620 - RNA, 20 nt, Yersinia pestis
ugggaauuaagaagccucau

SEQ ID NO: 4170621 - RNA, 18 nt, Yersinia pestis
ugggauauagaagguuuc

SEQ ID NO: 4170622 - RNA, 14 nt, Yersinia pestis
ugggauaugccgua

SEQ ID NO: 4170623 - RNA, 13 nt, Yersinia pestis
ugggauccauagg

SEQ ID NO: 4170624 - RNA, 20 nt, Yersinia pestis
ugggcaaaggcccaaguaug

SEQ ID NO: 4170625 - RNA, 20 nt, Yersinia pestis
ugggcagaagaguaaagcgu

SEQ ID NO: 4170626 - RNA, 16 nt, Yersinia pestis
ugggcagggcgcaaug

SEQ ID NO: 4170627 - RNA, 20 nt, Yersinia pestis
ugggccacaggcugcauggg

SEQ ID NO: 4170628 - RNA, 22 nt, Yersinia pestis
ugggccaccggucugaauaccg

SEQ ID NO: 4170629 - RNA, 14 nt, Yersinia pestis
ugggccugaguggg

SEQ ID NO: 4170630 - RNA, 13 nt, Yersinia pestis
ugggcgauagucg

SEQ ID NO: 4170631 - RNA, 21 nt, Yersinia pestis
ugggcgggaucuccagaagca

SEQ ID NO: 4170632 - RNA, 16 nt, Yersinia pestis
ugggcggucaucagcc

SEQ ID NO: 4170633 - RNA, 17 nt, Yersinia pestis
ugggcugaagucuuuag

SEQ ID NO: 4170634 - RNA, 21 nt, Yersinia pestis
ugggcuugagcagugcgcggc

SEQ ID NO: 4170635 - RNA, 14 nt, Yersinia pestis
uggggcaguuaacc

SEQ ID NO: 4170636 - RNA, 22 nt, Yersinia pestis
uggggccaccuaauccaaggcg

SEQ ID NO: 4170637 - RNA, 13 nt, Yersinia pestis
ugggggaccagca

SEQ ID NO: 4170638 - RNA, 21 nt, Yersinia pestis
ugggggcaaaacucacaaaau

SEQ ID NO: 4170639 - RNA, 19 nt, Yersinia pestis
ugggggcgcucggcagcug

SEQ ID NO: 4170640 - RNA, 21 nt, Yersinia pestis
uggggucaucaacgcacucag

SEQ ID NO: 4170641 - RNA, 20 nt, Yersinia pestis
uggggugaacgaaagcagcc

SEQ ID NO: 4170642 - RNA, 16 nt, Yersinia pestis
uggggugccugguugg

SEQ ID NO: 4170643 - RNA, 22 nt, Yersinia pestis
uggggugucacaaaguagguua

SEQ ID NO: 4170644 - RNA, 14 nt, Yersinia pestis
ugggguuucuguca

SEQ ID NO: 4170645 - RNA, 21 nt, Yersinia pestis
uggguaacaauucaaugcuuu

SEQ ID NO: 4170646 - RNA, 13 nt, Yersinia pestis
uggguaauaucac

SEQ ID NO: 4170647 - RNA, 17 nt, Yersinia pestis
uggguaauaucaccauu

SEQ ID NO: 4170648 - RNA, 19 nt, Yersinia pestis
uggguaauccccaccaaca

SEQ ID NO: 4170649 - RNA, 19 nt, Yersinia pestis
uggguaaucgguguagccc

SEQ ID NO: 4170650 - RNA, 15 nt, Yersinia pestis
uggguaccguuuauu

SEQ ID NO: 4170651 - RNA, 13 nt, Yersinia pestis
uggguauccagug

SEQ ID NO: 4170652 - RNA, 21 nt, Yersinia pestis
uggguaucuuugcuucaggca

SEQ ID NO: 4170653 - RNA, 16 nt, Yersinia pestis
ugggucaguuuuauua

SEQ ID NO: 4170654 - RNA, 20 nt, Yersinia pestis
ugggucauugcgugcaauaa

SEQ ID NO: 4170655 - RNA, 19 nt, Yersinia pestis
ugggucguugauauuccua

SEQ ID NO: 4170656 - RNA, 14 nt, Yersinia pestis
ugggugaacacaga

SEQ ID NO: 4170657 - RNA, 13 nt, Yersinia pestis
ugggugcugcucc

SEQ ID NO: 4170658 - RNA, 21 nt, Yersinia pestis
ugggugucaggaagcaagaaa

SEQ ID NO: 4170659 - RNA, 21 nt, Yersinia pestis
uggguuaaauagugggcuaaa

SEQ ID NO: 4170660 - RNA, 17 nt, Yersinia pestis
uggguuaccugccuuca

SEQ ID NO: 4170661 - RNA, 16 nt, Yersinia pestis
uggguuauuaacuuca

SEQ ID NO: 4170662 - RNA, 13 nt, Yersinia pestis
uggguucuucaaa

SEQ ID NO: 4170663 - RNA, 20 nt, Yersinia pestis
uggguuucuaucaggagcau

SEQ ID NO: 4170664 - RNA, 14 nt, Yersinia pestis
uggguuugagcagu

SEQ ID NO: 4170665 - RNA, 15 nt, Yersinia pestis
uggguuugagcagug

SEQ ID NO: 4170666 - RNA, 17 nt, Yersinia pestis
ugguaacgcagaaauau

SEQ ID NO: 4170667 - RNA, 21 nt, Yersinia pestis
ugguaaucgucccacaugaac

SEQ ID NO: 4170668 - RNA, 13 nt, Yersinia pestis
ugguaauuucagg

SEQ ID NO: 4170669 - RNA, 20 nt, Yersinia pestis
ugguaauuucggguaacggu

SEQ ID NO: 4170670 - RNA, 16 nt, Yersinia pestis
ugguaccaaucuccaa

SEQ ID NO: 4170671 - RNA, 19 nt, Yersinia pestis
ugguaccaaucuccaauga

SEQ ID NO: 4170672 - RNA, 17 nt, Yersinia pestis
ugguaccggcaccaaga

SEQ ID NO: 4170673 - RNA, 19 nt, Yersinia pestis
ugguacugugucuuuaggg

SEQ ID NO: 4170674 - RNA, 17 nt, Yersinia pestis
ugguaggugcucaucag

SEQ ID NO: 4170675 - RNA, 20 nt, Yersinia pestis
ugguaggugcucaucaggcg

SEQ ID NO: 4170676 - RNA, 14 nt, Yersinia pestis
ugguauaaauggca

SEQ ID NO: 4170677 - RNA, 14 nt, Yersinia pestis
ugguaucggugagu

SEQ ID NO: 4170678 - RNA, 15 nt, Yersinia pestis
ugguauggcgauaug

SEQ ID NO: 4170679 - RNA, 13 nt, Yersinia pestis
uggucaacagcaa

SEQ ID NO: 4170680 - RNA, 19 nt, Yersinia pestis
uggucaaggugauuucaaa

SEQ ID NO: 4170681 - RNA, 14 nt, Yersinia pestis
uggucaauaaaauu

SEQ ID NO: 4170682 - RNA, 14 nt, Yersinia pestis
uggucaaucaaguu

SEQ ID NO: 4170683 - RNA, 20 nt, Yersinia pestis
uggucacccuuuugaauuca

SEQ ID NO: 4170684 - RNA, 22 nt, Yersinia pestis
uggucaccgccaaaugaaaacc

SEQ ID NO: 4170685 - RNA, 14 nt, Yersinia pestis
uggucagcaauaac

SEQ ID NO: 4170686 - RNA, 18 nt, Yersinia pestis
uggucagcacaaacagcu

SEQ ID NO: 4170687 - RNA, 18 nt, Yersinia pestis
uggucagcacuuccaacu

SEQ ID NO: 4170688 - RNA, 17 nt, Yersinia pestis
uggucagcggagcagau

SEQ ID NO: 4170689 - RNA, 14 nt, Yersinia pestis
uggucaguuuaaug

SEQ ID NO: 4170690 - RNA, 19 nt, Yersinia pestis
ugguccacagucaguucau

SEQ ID NO: 4170691 - RNA, 20 nt, Yersinia pestis
uggucccuaacgcaauacgg

SEQ ID NO: 4170692 - RNA, 15 nt, Yersinia pestis
uggucgaugaccugc

SEQ ID NO: 4170693 - RNA, 13 nt, Yersinia pestis
uggucgcacccaa

SEQ ID NO: 4170694 - RNA, 17 nt, Yersinia pestis
uggucgcugggccuacu

SEQ ID NO: 4170695 - RNA, 17 nt, Yersinia pestis
uggucgguuuccgccug

SEQ ID NO: 4170696 - RNA, 19 nt, Yersinia pestis
uggucuaucauuuacggcu

SEQ ID NO: 4170697 - RNA, 14 nt, Yersinia pestis
uggucucagaacaa

SEQ ID NO: 4170698 - RNA, 16 nt, Yersinia pestis
uggugaagaaaccuaa

SEQ ID NO: 4170699 - RNA, 18 nt, Yersinia pestis
uggugagcgccaugcgcu

SEQ ID NO: 4170700 - RNA, 18 nt, Yersinia pestis
uggugauaacugccauac

SEQ ID NO: 4170701 - RNA, 22 nt, Yersinia pestis
uggugaugcugcuggcguuauu

SEQ ID NO: 4170702 - RNA, 23 nt, Yersinia pestis
ugguggauaaaaaacgggcuugg

SEQ ID NO: 4170703 - RNA, 20 nt, Yersinia pestis
ugguggcggucaacccggcu

SEQ ID NO: 4170704 - RNA, 11 nt, Yersinia pestis
ugguggcugcu

SEQ ID NO: 4170705 - RNA, 12 nt, Yersinia pestis
ugguggcugcug

SEQ ID NO: 4170706 - RNA, 14 nt, Yersinia pestis
ugguggcuuuacca

SEQ ID NO: 4170707 - RNA, 19 nt, Yersinia pestis
uggugguugcagugucagu

SEQ ID NO: 4170708 - RNA, 20 nt, Yersinia pestis
uggugucacaaucucuggca

SEQ ID NO: 4170709 - RNA, 12 nt, Yersinia pestis
uggugucuuuac

SEQ ID NO: 4170710 - RNA, 23 nt, Yersinia pestis
ugguuaaaucaccgacaccaacc

SEQ ID NO: 4170711 - RNA, 17 nt, Yersinia pestis
ugguuaaucuacccgaa

SEQ ID NO: 4170712 - RNA, 19 nt, Yersinia pestis
ugguuacgggcuugcugca

SEQ ID NO: 4170713 - RNA, 16 nt, Yersinia pestis
ugguuaguucuucuga

SEQ ID NO: 4170714 - RNA, 23 nt, Yersinia pestis
ugguuaucaagaucaaaagcaga

SEQ ID NO: 4170715 - RNA, 16 nt, Yersinia pestis
ugguucgagacaacgu

SEQ ID NO: 4170716 - RNA, 22 nt, Yersinia pestis
ugguugcacgugaggauucaag

SEQ ID NO: 4170717 - RNA, 22 nt, Yersinia pestis
ugguugcccggcaaacuuaauu

SEQ ID NO: 4170718 - RNA, 20 nt, Yersinia pestis
ugguuggcaccacggucaga

SEQ ID NO: 4170719 - RNA, 13 nt, Yersinia pestis
ugguugucuaugu

SEQ ID NO: 4170720 - RNA, 16 nt, Yersinia pestis
ugguuuauccccuucg

SEQ ID NO: 4170721 - RNA, 20 nt, Yersinia pestis
ugguuucacccgcuaccggu

SEQ ID NO: 4170722 - RNA, 10 nt, Yersinia pestis
ugguuuccau

SEQ ID NO: 4170723 - RNA, 13 nt, Yersinia pestis
ugguuuccgcuga

SEQ ID NO: 4170724 - RNA, 18 nt, Yersinia pestis
ugguuuggugguuuggug

SEQ ID NO: 4170725 - RNA, 16 nt, Yersinia pestis
ugguuugguucuggug

SEQ ID NO: 4170726 - RNA, 14 nt, Yersinia pestis
ugguuuuaauauug

SEQ ID NO: 4170727 - RNA, 15 nt, Yersinia pestis
ugguuuuaucaauag

SEQ ID NO: 4170728 - RNA, 17 nt, Yersinia pestis
ugguuuuaucaauaggu

SEQ ID NO: 4170729 - RNA, 12 nt, Yersinia pestis
ugguuuuuuaaa

SEQ ID NO: 4170730 - RNA, 13 nt, Yersinia pestis
ugguuuuuuaaaa

SEQ ID NO: 4170731 - RNA, 20 nt, Yersinia pestis
uguaaaaacuuaucuaaaaa

SEQ ID NO: 4170732 - RNA, 21 nt, Yersinia pestis
uguaaaaacuuaucuaaaaaa

SEQ ID NO: 4170733 - RNA, 14 nt, Yersinia pestis
uguaaaaaucaccu

SEQ ID NO: 4170734 - RNA, 11 nt, Yersinia pestis
uguaaaacaag

SEQ ID NO: 4170735 - RNA, 18 nt, Yersinia pestis
uguaaaagauagauaacu

SEQ ID NO: 4170736 - RNA, 15 nt, Yersinia pestis
uguaaacuccuugga

SEQ ID NO: 4170737 - RNA, 14 nt, Yersinia pestis
uguaaaggcaaaga

SEQ ID NO: 4170738 - RNA, 16 nt, Yersinia pestis
uguaaauauaaaauaa

SEQ ID NO: 4170739 - RNA, 15 nt, Yersinia pestis
uguaacacauauuuc

SEQ ID NO: 4170740 - RNA, 13 nt, Yersinia pestis
uguaacagcggcg

SEQ ID NO: 4170741 - RNA, 20 nt, Yersinia pestis
uguaacagcggcgauuaucg

SEQ ID NO: 4170742 - RNA, 18 nt, Yersinia pestis
uguaacgaugaauuauca

SEQ ID NO: 4170743 - RNA, 16 nt, Yersinia pestis
uguaagcgugcaaccc

SEQ ID NO: 4170744 - RNA, 20 nt, Yersinia pestis
uguaagcugggaaggcguaa

SEQ ID NO: 4170745 - RNA, 16 nt, Yersinia pestis
uguaaggcaauaccaa

SEQ ID NO: 4170746 - RNA, 17 nt, Yersinia pestis
uguaagucauucuuggu

SEQ ID NO: 4170747 - RNA, 21 nt, Yersinia pestis
uguaauaagcuacgccaugca

SEQ ID NO: 4170748 - RNA, 13 nt, Yersinia pestis
uguaauccaaccc

SEQ ID NO: 4170749 - RNA, 16 nt, Yersinia pestis
uguaauccggcaaaaa

SEQ ID NO: 4170750 - RNA, 15 nt, Yersinia pestis
uguaauuauauuuaa

SEQ ID NO: 4170751 - RNA, 16 nt, Yersinia pestis
uguaauuauauuuaau

SEQ ID NO: 4170752 - RNA, 15 nt, Yersinia pestis
uguaauuguauuaua

SEQ ID NO: 4170753 - RNA, 21 nt, Yersinia pestis
uguaauuuuuacauuccacaa

SEQ ID NO: 4170754 - RNA, 18 nt, Yersinia pestis
uguacaacaagaucccaa

SEQ ID NO: 4170755 - RNA, 16 nt, Yersinia pestis
uguacauaaauuugug

SEQ ID NO: 4170756 - RNA, 22 nt, Yersinia pestis
uguaccccggauagcugauugc

SEQ ID NO: 4170757 - RNA, 21 nt, Yersinia pestis
uguaccgguucauuuagcagc

SEQ ID NO: 4170758 - RNA, 21 nt, Yersinia pestis
uguacggcgcguuucuuagcu

SEQ ID NO: 4170759 - RNA, 13 nt, Yersinia pestis
uguacgggcagga

SEQ ID NO: 4170760 - RNA, 23 nt, Yersinia pestis
uguacggguaaaugauggcggcu

SEQ ID NO: 4170761 - RNA, 14 nt, Yersinia pestis
uguacguauggcau

SEQ ID NO: 4170762 - RNA, 15 nt, Yersinia pestis
uguacuaaaggugua

SEQ ID NO: 4170763 - RNA, 14 nt, Yersinia pestis
uguacuacuucaua

SEQ ID NO: 4170764 - RNA, 15 nt, Yersinia pestis
uguacugggaugaag

SEQ ID NO: 4170765 - RNA, 17 nt, Yersinia pestis
uguagaauguugauaua

SEQ ID NO: 4170766 - RNA, 24 nt, Yersinia pestis
uguagacuuggcuuuuucuuccag

SEQ ID NO: 4170767 - RNA, 15 nt, Yersinia pestis
uguagagaaauucau

SEQ ID NO: 4170768 - RNA, 13 nt, Yersinia pestis
uguagccaaagug

SEQ ID NO: 4170769 - RNA, 19 nt, Yersinia pestis
uguagccaaaguggcauaa

SEQ ID NO: 4170770 - RNA, 17 nt, Yersinia pestis
uguagcgauaagugcag

SEQ ID NO: 4170771 - RNA, 19 nt, Yersinia pestis
uguagcugaacaaacuuau

SEQ ID NO: 4170772 - RNA, 14 nt, Yersinia pestis
uguagcuuuuuaaa

SEQ ID NO: 4170773 - RNA, 19 nt, Yersinia pestis
uguagcuuuuuaaauacca

SEQ ID NO: 4170774 - RNA, 18 nt, Yersinia pestis
uguagugacguaaaaagg

SEQ ID NO: 4170775 - RNA, 14 nt, Yersinia pestis
uguaguggaaguga

SEQ ID NO: 4170776 - RNA, 22 nt, Yersinia pestis
uguaguuaagguuagcuaugca

SEQ ID NO: 4170777 - RNA, 17 nt, Yersinia pestis
uguaguuaaucuacccg

SEQ ID NO: 4170778 - RNA, 18 nt, Yersinia pestis
uguaguucaucauuauua

SEQ ID NO: 4170779 - RNA, 15 nt, Yersinia pestis
uguaguuuuucauua

SEQ ID NO: 4170780 - RNA, 15 nt, Yersinia pestis
uguauaaaaaagaua

SEQ ID NO: 4170781 - RNA, 21 nt, Yersinia pestis
uguauaaaaaagauaauaaaa

SEQ ID NO: 4170782 - RNA, 21 nt, Yersinia pestis
uguauaaccccccugcugaua

SEQ ID NO: 4170783 - RNA, 13 nt, Yersinia pestis
uguauacaauugc

SEQ ID NO: 4170784 - RNA, 19 nt, Yersinia pestis
uguauacaauugccugauu

SEQ ID NO: 4170785 - RNA, 18 nt, Yersinia pestis
uguauagucuccaaauuc

SEQ ID NO: 4170786 - RNA, 20 nt, Yersinia pestis
uguauagucuccaaauucau

SEQ ID NO: 4170787 - RNA, 21 nt, Yersinia pestis
uguauagucuccaaauucauu

SEQ ID NO: 4170788 - RNA, 19 nt, Yersinia pestis
uguauaucacuauuucaga

SEQ ID NO: 4170789 - RNA, 13 nt, Yersinia pestis
uguaucaauaccu

SEQ ID NO: 4170790 - RNA, 15 nt, Yersinia pestis
uguaucaauaccuua

SEQ ID NO: 4170791 - RNA, 12 nt, Yersinia pestis
uguauccagcag

SEQ ID NO: 4170792 - RNA, 16 nt, Yersinia pestis
uguauccaucugauga

SEQ ID NO: 4170793 - RNA, 16 nt, Yersinia pestis
uguauccgaauuauca

SEQ ID NO: 4170794 - RNA, 22 nt, Yersinia pestis
uguauccuggccguguuuuucc

SEQ ID NO: 4170795 - RNA, 19 nt, Yersinia pestis
uguaugacuacccccgcau

SEQ ID NO: 4170796 - RNA, 22 nt, Yersinia pestis
uguaugacuacccccgcauuac

SEQ ID NO: 4170797 - RNA, 17 nt, Yersinia pestis
uguaugaguaucaauau

SEQ ID NO: 4170798 - RNA, 15 nt, Yersinia pestis
uguauuaguuucaaa

SEQ ID NO: 4170799 - RNA, 16 nt, Yersinia pestis
uguauucuuguauccu

SEQ ID NO: 4170800 - RNA, 19 nt, Yersinia pestis
uguauuguugcucaacaua

SEQ ID NO: 4170801 - RNA, 19 nt, Yersinia pestis
uguauuuaaccgcccucuu

SEQ ID NO: 4170802 - RNA, 14 nt, Yersinia pestis
uguauuuccuguau

SEQ ID NO: 4170803 - RNA, 18 nt, Yersinia pestis
uguauuugguuauauccc

SEQ ID NO: 4170804 - RNA, 21 nt, Yersinia pestis
uguauuugguuauaucccaau

SEQ ID NO: 4170805 - RNA, 20 nt, Yersinia pestis
uguauuuuguuuuuuugaua

SEQ ID NO: 4170806 - RNA, 15 nt, Yersinia pestis
ugucaauaaccucag

SEQ ID NO: 4170807 - RNA, 17 nt, Yersinia pestis
ugucaauaaccucagcc

SEQ ID NO: 4170808 - RNA, 18 nt, Yersinia pestis
ugucaauaaccucagccu

SEQ ID NO: 4170809 - RNA, 16 nt, Yersinia pestis
ugucaauaccuuacug

SEQ ID NO: 4170810 - RNA, 21 nt, Yersinia pestis
ugucaauggguuugguuauua

SEQ ID NO: 4170811 - RNA, 16 nt, Yersinia pestis
ugucacaaucucuggc

SEQ ID NO: 4170812 - RNA, 22 nt, Yersinia pestis
ugucaccacggcuuucaauaaa

SEQ ID NO: 4170813 - RNA, 13 nt, Yersinia pestis
ugucaccugagua

SEQ ID NO: 4170814 - RNA, 17 nt, Yersinia pestis
ugucacuugcccugagu

SEQ ID NO: 4170815 - RNA, 14 nt, Yersinia pestis
ugucagacaguucu

SEQ ID NO: 4170816 - RNA, 16 nt, Yersinia pestis
ugucagacaguucugu

SEQ ID NO: 4170817 - RNA, 23 nt, Yersinia pestis
ugucagauaucugcucauuacca

SEQ ID NO: 4170818 - RNA, 14 nt, Yersinia pestis
ugucagcagucuga

SEQ ID NO: 4170819 - RNA, 20 nt, Yersinia pestis
ugucagcagucugaagggua

SEQ ID NO: 4170820 - RNA, 20 nt, Yersinia pestis
ugucaggaaaugcagacucu

SEQ ID NO: 4170821 - RNA, 14 nt, Yersinia pestis
ugucaggaagcaag

SEQ ID NO: 4170822 - RNA, 14 nt, Yersinia pestis
ugucagggcaauaa

SEQ ID NO: 4170823 - RNA, 15 nt, Yersinia pestis
ugucaucacugcuau

SEQ ID NO: 4170824 - RNA, 16 nt, Yersinia pestis
ugucaucccguaggcu

SEQ ID NO: 4170825 - RNA, 14 nt, Yersinia pestis
ugucaugaaaaucu

SEQ ID NO: 4170826 - RNA, 14 nt, Yersinia pestis
ugucauggcacgcu

SEQ ID NO: 4170827 - RNA, 15 nt, Yersinia pestis
ugucauggugcuacc

SEQ ID NO: 4170828 - RNA, 14 nt, Yersinia pestis
ugucauuaauuggu

SEQ ID NO: 4170829 - RNA, 20 nt, Yersinia pestis
ugucauuaccaaugguuuca

SEQ ID NO: 4170830 - RNA, 14 nt, Yersinia pestis
ugucauuccaaccu

SEQ ID NO: 4170831 - RNA, 13 nt, Yersinia pestis
ugucauucuauca

SEQ ID NO: 4170832 - RNA, 20 nt, Yersinia pestis
ugucauugcuguuguuauua

SEQ ID NO: 4170833 - RNA, 15 nt, Yersinia pestis
ugucauuuaauuaaa

SEQ ID NO: 4170834 - RNA, 13 nt, Yersinia pestis
ugucauuuggauu

SEQ ID NO: 4170835 - RNA, 13 nt, Yersinia pestis
uguccaaaggaag

SEQ ID NO: 4170836 - RNA, 16 nt, Yersinia pestis
uguccaaaggaagggg

SEQ ID NO: 4170837 - RNA, 18 nt, Yersinia pestis
uguccacaacaccacuuu

SEQ ID NO: 4170838 - RNA, 21 nt, Yersinia pestis
uguccagggcaaucaggaaag

SEQ ID NO: 4170839 - RNA, 18 nt, Yersinia pestis
uguccauuacuguccuuu

SEQ ID NO: 4170840 - RNA, 19 nt, Yersinia pestis
ugucccaaacucuggaugg

SEQ ID NO: 4170841 - RNA, 20 nt, Yersinia pestis
uguccggguuuacccagcca

SEQ ID NO: 4170842 - RNA, 14 nt, Yersinia pestis
uguccuuuuuucug

SEQ ID NO: 4170843 - RNA, 12 nt, Yersinia pestis
ugucgaaagacg

SEQ ID NO: 4170844 - RNA, 22 nt, Yersinia pestis
ugucgcagaaaacaggccgcua

SEQ ID NO: 4170845 - RNA, 18 nt, Yersinia pestis
ugucgcccugaauuucaa

SEQ ID NO: 4170846 - RNA, 17 nt, Yersinia pestis
ugucgcuguagcgccag

SEQ ID NO: 4170847 - RNA, 21 nt, Yersinia pestis
ugucggcaagcgauacagaua

SEQ ID NO: 4170848 - RNA, 17 nt, Yersinia pestis
ugucggcagguaaugca

SEQ ID NO: 4170849 - RNA, 22 nt, Yersinia pestis
ugucggcgaugaaaaacagaua

SEQ ID NO: 4170850 - RNA, 13 nt, Yersinia pestis
ugucgggccaaua

SEQ ID NO: 4170851 - RNA, 14 nt, Yersinia pestis
ugucgggccaauaa

SEQ ID NO: 4170852 - RNA, 15 nt, Yersinia pestis
ugucggguaacggcu

SEQ ID NO: 4170853 - RNA, 18 nt, Yersinia pestis
ugucggguuaacuuuuuc

SEQ ID NO: 4170854 - RNA, 15 nt, Yersinia pestis
ugucguacuuuccuu

SEQ ID NO: 4170855 - RNA, 13 nt, Yersinia pestis
ugucguauuucca

SEQ ID NO: 4170856 - RNA, 15 nt, Yersinia pestis
ugucgucaucaggau

SEQ ID NO: 4170857 - RNA, 21 nt, Yersinia pestis
ugucguuucugcuuaacucaa

SEQ ID NO: 4170858 - RNA, 18 nt, Yersinia pestis
ugucuauguuugaugguu

SEQ ID NO: 4170859 - RNA, 19 nt, Yersinia pestis
ugucuauuuagucaucaug

SEQ ID NO: 4170860 - RNA, 13 nt, Yersinia pestis
ugucuauuuucau

SEQ ID NO: 4170861 - RNA, 14 nt, Yersinia pestis
ugucucuacucucu

SEQ ID NO: 4170862 - RNA, 18 nt, Yersinia pestis
ugucugaggcguggcaca

SEQ ID NO: 4170863 - RNA, 15 nt, Yersinia pestis
ugucugcuguugcca

SEQ ID NO: 4170864 - RNA, 15 nt, Yersinia pestis
ugucuggcaauccag

SEQ ID NO: 4170865 - RNA, 14 nt, Yersinia pestis
ugucuguaauaaua

SEQ ID NO: 4170866 - RNA, 12 nt, Yersinia pestis
ugucuuaugaua

SEQ ID NO: 4170867 - RNA, 18 nt, Yersinia pestis
ugucuuuaauaaaaucaa

SEQ ID NO: 4170868 - RNA, 19 nt, Yersinia pestis
ugucuuucauucggcacag

SEQ ID NO: 4170869 - RNA, 22 nt, Yersinia pestis
ugugaaacauaauuaaauauua

SEQ ID NO: 4170870 - RNA, 17 nt, Yersinia pestis
ugugaacguacuuuggu

SEQ ID NO: 4170871 - RNA, 17 nt, Yersinia pestis
ugugagguuagaaaaca

SEQ ID NO: 4170872 - RNA, 21 nt, Yersinia pestis
ugugauaaccguucaagaggg

SEQ ID NO: 4170873 - RNA, 23 nt, Yersinia pestis
ugugauccacacagcauucugcu

SEQ ID NO: 4170874 - RNA, 23 nt, Yersinia pestis
ugugauccacacaguauucugcu

SEQ ID NO: 4170875 - RNA, 14 nt, Yersinia pestis
ugugaucgcugccg

SEQ ID NO: 4170876 - RNA, 11 nt, Yersinia pestis
ugugaugaugg

SEQ ID NO: 4170877 - RNA, 15 nt, Yersinia pestis
ugugauuauggcaau

SEQ ID NO: 4170878 - RNA, 22 nt, Yersinia pestis
ugugauuucagccaggcgaucu

SEQ ID NO: 4170879 - RNA, 13 nt, Yersinia pestis
ugugcaaugcaga

SEQ ID NO: 4170880 - RNA, 12 nt, Yersinia pestis
ugugcagcauca

SEQ ID NO: 4170881 - RNA, 17 nt, Yersinia pestis
ugugccaguagcaauaa

SEQ ID NO: 4170882 - RNA, 21 nt, Yersinia pestis
ugugcccuuuuugguuuucua

SEQ ID NO: 4170883 - RNA, 21 nt, Yersinia pestis
ugugccucgucgaggaucacc

SEQ ID NO: 4170884 - RNA, 16 nt, Yersinia pestis
ugugcucugcuccgcc

SEQ ID NO: 4170885 - RNA, 12 nt, Yersinia pestis
ugugcugaauug

SEQ ID NO: 4170886 - RNA, 21 nt, Yersinia pestis
ugugcuugcggaauuucuucu

SEQ ID NO: 4170887 - RNA, 19 nt, Yersinia pestis
ugugcuuugccauucuggg

SEQ ID NO: 4170888 - RNA, 19 nt, Yersinia pestis
uguggaaucggccuucaau

SEQ ID NO: 4170889 - RNA, 18 nt, Yersinia pestis
uguggauccagcaccaca

SEQ ID NO: 4170890 - RNA, 21 nt, Yersinia pestis
uguggcaacucuagcgccagc

SEQ ID NO: 4170891 - RNA, 14 nt, Yersinia pestis
uguggcuaaaccca

SEQ ID NO: 4170892 - RNA, 17 nt, Yersinia pestis
uguguaaacuccuugga

SEQ ID NO: 4170893 - RNA, 19 nt, Yersinia pestis
uguguaccaaaacgaacaa

SEQ ID NO: 4170894 - RNA, 22 nt, Yersinia pestis
uguguaguugaaguucacaccg

SEQ ID NO: 4170895 - RNA, 24 nt, Yersinia pestis
ugugucagaccaaauagcaagcca

SEQ ID NO: 4170896 - RNA, 20 nt, Yersinia pestis
ugugucauuaccuggacgcu

SEQ ID NO: 4170897 - RNA, 16 nt, Yersinia pestis
ugugugaauaucaggc

SEQ ID NO: 4170898 - RNA, 20 nt, Yersinia pestis
ugugugguaccccgugcuuu

SEQ ID NO: 4170899 - RNA, 14 nt, Yersinia pestis
uguguguauuuaaa

SEQ ID NO: 4170900 - RNA, 15 nt, Yersinia pestis
uguguugaaugacgc

SEQ ID NO: 4170901 - RNA, 19 nt, Yersinia pestis
uguguugcgccauaauucc

SEQ ID NO: 4170902 - RNA, 16 nt, Yersinia pestis
uguguuuguuuggaua

SEQ ID NO: 4170903 - RNA, 13 nt, Yersinia pestis
uguguuuuucuua

SEQ ID NO: 4170904 - RNA, 22 nt, Yersinia pestis
uguuaaacccccuguaaccgca

SEQ ID NO: 4170905 - RNA, 17 nt, Yersinia pestis
uguuaaauucgcuuuuc

SEQ ID NO: 4170906 - RNA, 20 nt, Yersinia pestis
uguuaaauucgcuuuucgca

SEQ ID NO: 4170907 - RNA, 22 nt, Yersinia pestis
uguuaacgccauaaggauuugg

SEQ ID NO: 4170908 - RNA, 18 nt, Yersinia pestis
uguuaccagacccugcac

SEQ ID NO: 4170909 - RNA, 18 nt, Yersinia pestis
uguuaccuaaccaaacau

SEQ ID NO: 4170910 - RNA, 15 nt, Yersinia pestis
uguuagcaauuugag

SEQ ID NO: 4170911 - RNA, 13 nt, Yersinia pestis
uguuagcaucuga

SEQ ID NO: 4170912 - RNA, 16 nt, Yersinia pestis
uguuagcccaaggcga

SEQ ID NO: 4170913 - RNA, 11 nt, Yersinia pestis
uguuagcggcu

SEQ ID NO: 4170914 - RNA, 15 nt, Yersinia pestis
uguuagcugcgcgca

SEQ ID NO: 4170915 - RNA, 20 nt, Yersinia pestis
uguuagggcgcggcugguaa

SEQ ID NO: 4170916 - RNA, 18 nt, Yersinia pestis
uguuagucgucugagcca

SEQ ID NO: 4170917 - RNA, 19 nt, Yersinia pestis
uguuaguucagacguacau

SEQ ID NO: 4170918 - RNA, 13 nt, Yersinia pestis
uguuauauuucuu

SEQ ID NO: 4170919 - RNA, 14 nt, Yersinia pestis
uguuauauuucuua

SEQ ID NO: 4170920 - RNA, 20 nt, Yersinia pestis
uguuauccaucaaccacggu

SEQ ID NO: 4170921 - RNA, 18 nt, Yersinia pestis
uguuaugaggggaggcug

SEQ ID NO: 4170922 - RNA, 16 nt, Yersinia pestis
uguuauggauuuuuaa

SEQ ID NO: 4170923 - RNA, 20 nt, Yersinia pestis
uguuauggauuuuuaaggac

SEQ ID NO: 4170924 - RNA, 16 nt, Yersinia pestis
uguuaugguauucaga

SEQ ID NO: 4170925 - RNA, 15 nt, Yersinia pestis
uguuauuacugucac

SEQ ID NO: 4170926 - RNA, 16 nt, Yersinia pestis
uguuauuauuaaauuu

SEQ ID NO: 4170927 - RNA, 20 nt, Yersinia pestis
uguuauugcuccgacaauaa

SEQ ID NO: 4170928 - RNA, 15 nt, Yersinia pestis
uguuauuucugggau

SEQ ID NO: 4170929 - RNA, 20 nt, Yersinia pestis
uguuauuuuucucuuucagc

SEQ ID NO: 4170930 - RNA, 20 nt, Yersinia pestis
uguucaaaucugcuccauca

SEQ ID NO: 4170931 - RNA, 16 nt, Yersinia pestis
uguucaagcaccucaa

SEQ ID NO: 4170932 - RNA, 20 nt, Yersinia pestis
uguucacccacuugccauaa

SEQ ID NO: 4170933 - RNA, 17 nt, Yersinia pestis
uguucagcauuguuggc

SEQ ID NO: 4170934 - RNA, 20 nt, Yersinia pestis
uguucauauaguugcuuauc

SEQ ID NO: 4170935 - RNA, 19 nt, Yersinia pestis
uguucaucgcuuaacggcc

SEQ ID NO: 4170936 - RNA, 13 nt, Yersinia pestis
uguucauugagac

SEQ ID NO: 4170937 - RNA, 23 nt, Yersinia pestis
uguuccacuguaucuuugcuauc

SEQ ID NO: 4170938 - RNA, 20 nt, Yersinia pestis
uguuccagugcguuuuauuc

SEQ ID NO: 4170939 - RNA, 21 nt, Yersinia pestis
uguuccagugcguuuuauuca

SEQ ID NO: 4170940 - RNA, 17 nt, Yersinia pestis
uguuccauaugaacauc

SEQ ID NO: 4170941 - RNA, 22 nt, Yersinia pestis
uguuccggcgcgauguccacaa

SEQ ID NO: 4170942 - RNA, 11 nt, Yersinia pestis
uguuccucagg

SEQ ID NO: 4170943 - RNA, 20 nt, Yersinia pestis
uguucgaucaaaacaauaaa

SEQ ID NO: 4170944 - RNA, 18 nt, Yersinia pestis
uguucgcacugcucugcc

SEQ ID NO: 4170945 - RNA, 19 nt, Yersinia pestis
uguucgcacugcucugccc

SEQ ID NO: 4170946 - RNA, 19 nt, Yersinia pestis
uguucgccagauuauuggc

SEQ ID NO: 4170947 - RNA, 19 nt, Yersinia pestis
uguucggggguugucagca

SEQ ID NO: 4170948 - RNA, 21 nt, Yersinia pestis
uguucggggguugucagcagu

SEQ ID NO: 4170949 - RNA, 14 nt, Yersinia pestis
uguucguagguuug

SEQ ID NO: 4170950 - RNA, 13 nt, Yersinia pestis
uguucgugaaagc

SEQ ID NO: 4170951 - RNA, 19 nt, Yersinia pestis
uguucugauuuagcuaucg

SEQ ID NO: 4170952 - RNA, 15 nt, Yersinia pestis
uguucuuaauuuuau

SEQ ID NO: 4170953 - RNA, 17 nt, Yersinia pestis
uguucuuauugcuaucu

SEQ ID NO: 4170954 - RNA, 15 nt, Yersinia pestis
uguucuuccugugcg

SEQ ID NO: 4170955 - RNA, 16 nt, Yersinia pestis
uguugagucaacucuu

SEQ ID NO: 4170956 - RNA, 17 nt, Yersinia pestis
uguugauacuccauuug

SEQ ID NO: 4170957 - RNA, 14 nt, Yersinia pestis
uguugaucugaguu

SEQ ID NO: 4170958 - RNA, 16 nt, Yersinia pestis
uguugaugaguaaaca

SEQ ID NO: 4170959 - RNA, 21 nt, Yersinia pestis
uguugauuacgggucagcuca

SEQ ID NO: 4170960 - RNA, 22 nt, Yersinia pestis
uguugcaacggucauuggcccg

SEQ ID NO: 4170961 - RNA, 22 nt, Yersinia pestis
uguugcauuuuuucauuccaga

SEQ ID NO: 4170962 - RNA, 21 nt, Yersinia pestis
uguugccaaugggccaagguc

SEQ ID NO: 4170963 - RNA, 15 nt, Yersinia pestis
uguugccacccuauc

SEQ ID NO: 4170964 - RNA, 17 nt, Yersinia pestis
uguugccacccuaucug

SEQ ID NO: 4170965 - RNA, 21 nt, Yersinia pestis
uguugccacccuaucugcucu

SEQ ID NO: 4170966 - RNA, 14 nt, Yersinia pestis
uguugccgcuucau

SEQ ID NO: 4170967 - RNA, 15 nt, Yersinia pestis
uguugcgccauaauu

SEQ ID NO: 4170968 - RNA, 16 nt, Yersinia pestis
uguuggcaaauaaucc

SEQ ID NO: 4170969 - RNA, 15 nt, Yersinia pestis
uguuggcaauuucac

SEQ ID NO: 4170970 - RNA, 15 nt, Yersinia pestis
uguuggcccaagaua

SEQ ID NO: 4170971 - RNA, 13 nt, Yersinia pestis
uguuggcccgcau

SEQ ID NO: 4170972 - RNA, 21 nt, Yersinia pestis
uguuggguaaucaucagggaa

SEQ ID NO: 4170973 - RNA, 16 nt, Yersinia pestis
uguuggguugugguau

SEQ ID NO: 4170974 - RNA, 17 nt, Yersinia pestis
uguuggugaucuggcuu

SEQ ID NO: 4170975 - RNA, 20 nt, Yersinia pestis
uguugugguggcuauuagcc

SEQ ID NO: 4170976 - RNA, 15 nt, Yersinia pestis
uguuguugaccucaa

SEQ ID NO: 4170977 - RNA, 19 nt, Yersinia pestis
uguuuaaaaaggcguuauc

SEQ ID NO: 4170978 - RNA, 12 nt, Yersinia pestis
uguuuaaaucuu

SEQ ID NO: 4170979 - RNA, 15 nt, Yersinia pestis
uguuuaaauugcgcc

SEQ ID NO: 4170980 - RNA, 17 nt, Yersinia pestis
uguuuaacccaaugcuc

SEQ ID NO: 4170981 - RNA, 22 nt, Yersinia pestis
uguuuaacuuucgucaauuuuu

SEQ ID NO: 4170982 - RNA, 14 nt, Yersinia pestis
uguuuauaaauuaa

SEQ ID NO: 4170983 - RNA, 17 nt, Yersinia pestis
uguuuauucucccgaua

SEQ ID NO: 4170984 - RNA, 14 nt, Yersinia pestis
uguuucagacccua

SEQ ID NO: 4170985 - RNA, 12 nt, Yersinia pestis
uguuucagcauc

SEQ ID NO: 4170986 - RNA, 19 nt, Yersinia pestis
uguuucauuucgcuccacc

SEQ ID NO: 4170987 - RNA, 18 nt, Yersinia pestis
uguuuccccuaauucucc

SEQ ID NO: 4170988 - RNA, 17 nt, Yersinia pestis
uguuuccucuucaucua

SEQ ID NO: 4170989 - RNA, 18 nt, Yersinia pestis
uguuucuauccgaaaaau

SEQ ID NO: 4170990 - RNA, 16 nt, Yersinia pestis
uguuucuauuuucagc

SEQ ID NO: 4170991 - RNA, 16 nt, Yersinia pestis
uguuucugauaucuaa

SEQ ID NO: 4170992 - RNA, 22 nt, Yersinia pestis
uguuugauaaggccaugucacu

SEQ ID NO: 4170993 - RNA, 21 nt, Yersinia pestis
uguuugaugguuauguguauu

SEQ ID NO: 4170994 - RNA, 20 nt, Yersinia pestis
uguuuggcauggauaucagc

SEQ ID NO: 4170995 - RNA, 14 nt, Yersinia pestis
uguuugggauaaag

SEQ ID NO: 4170996 - RNA, 15 nt, Yersinia pestis
uguuuggucgccauc

SEQ ID NO: 4170997 - RNA, 19 nt, Yersinia pestis
uguuuguugauguaagcug

SEQ ID NO: 4170998 - RNA, 12 nt, Yersinia pestis
uguuuuaaaaaa

SEQ ID NO: 4170999 - RNA, 17 nt, Yersinia pestis
uguuuucggcuugcaaa

SEQ ID NO: 4171000 - RNA, 19 nt, Yersinia pestis
uguuuugcugccauuucca

SEQ ID NO: 4171001 - RNA, 18 nt, Yersinia pestis
uguuuuuccaaaugaaaa

SEQ ID NO: 4171002 - RNA, 12 nt, Yersinia pestis
uguuuuuuugau

SEQ ID NO: 4171003 - RNA, 17 nt, Yersinia pestis
uuaaaaaaauuaaaaua

SEQ ID NO: 4171004 - RNA, 17 nt, Yersinia pestis
uuaaaaaaauuaucauc

SEQ ID NO: 4171005 - RNA, 13 nt, Yersinia pestis
uuaaaaacccaua

SEQ ID NO: 4171006 - RNA, 15 nt, Yersinia pestis
uuaaaaagccugaau

SEQ ID NO: 4171007 - RNA, 17 nt, Yersinia pestis
uuaaaaagccugaauuc

SEQ ID NO: 4171008 - RNA, 15 nt, Yersinia pestis
uuaaaaauacaacca

SEQ ID NO: 4171009 - RNA, 23 nt, Yersinia pestis
uuaaaaauacaaccaacaaacaa

SEQ ID NO: 4171010 - RNA, 22 nt, Yersinia pestis
uuaaaaauagauuaaaagucua

SEQ ID NO: 4171011 - RNA, 14 nt, Yersinia pestis
uuaaaaaucaaaag

SEQ ID NO: 4171012 - RNA, 13 nt, Yersinia pestis
uuaaaaauccaua

SEQ ID NO: 4171013 - RNA, 13 nt, Yersinia pestis
uuaaaacaggcga

SEQ ID NO: 4171014 - RNA, 22 nt, Yersinia pestis
uuaaaacaggcgaguuucccuu

SEQ ID NO: 4171015 - RNA, 22 nt, Yersinia pestis
uuaaaauaguggcacaaauaaa

SEQ ID NO: 4171016 - RNA, 21 nt, Yersinia pestis
uuaaacauuauuuuucaccug

SEQ ID NO: 4171017 - RNA, 16 nt, Yersinia pestis
uuaaacgcucaucaac

SEQ ID NO: 4171018 - RNA, 16 nt, Yersinia pestis
uuaaacuguuauuggg

SEQ ID NO: 4171019 - RNA, 18 nt, Yersinia pestis
uuaaacuuguaucaaaac

SEQ ID NO: 4171020 - RNA, 13 nt, Yersinia pestis
uuaaacuuugcua

SEQ ID NO: 4171021 - RNA, 22 nt, Yersinia pestis
uuaaagaaaauuuacccugcua

SEQ ID NO: 4171022 - RNA, 20 nt, Yersinia pestis
uuaaagaagaauccacauaa

SEQ ID NO: 4171023 - RNA, 23 nt, Yersinia pestis
uuaaagaagaauccacauaaaaa

SEQ ID NO: 4171024 - RNA, 16 nt, Yersinia pestis
uuaaagaagacgagua

SEQ ID NO: 4171025 - RNA, 14 nt, Yersinia pestis
uuaaagaaugcaac

SEQ ID NO: 4171026 - RNA, 16 nt, Yersinia pestis
uuaaagaaugcaacca

SEQ ID NO: 4171027 - RNA, 13 nt, Yersinia pestis
uuaaagacauauc

SEQ ID NO: 4171028 - RNA, 21 nt, Yersinia pestis
uuaaagacauaucacaguuaa

SEQ ID NO: 4171029 - RNA, 21 nt, Yersinia pestis
uuaaagccauucagcagcaag

SEQ ID NO: 4171030 - RNA, 18 nt, Yersinia pestis
uuaaagcccgcuuaaaua

SEQ ID NO: 4171031 - RNA, 13 nt, Yersinia pestis
uuaaagguaaaag

SEQ ID NO: 4171032 - RNA, 18 nt, Yersinia pestis
uuaaagugagaaggguau

SEQ ID NO: 4171033 - RNA, 15 nt, Yersinia pestis
uuaaaguugauaaag

SEQ ID NO: 4171034 - RNA, 16 nt, Yersinia pestis
uuaaaguuuuuuauuu

SEQ ID NO: 4171035 - RNA, 14 nt, Yersinia pestis
uuaaauaaaacacc

SEQ ID NO: 4171036 - RNA, 20 nt, Yersinia pestis
uuaaauaacagcuaaaauga

SEQ ID NO: 4171037 - RNA, 22 nt, Yersinia pestis
uuaaauaagaaguagaaugaga

SEQ ID NO: 4171038 - RNA, 22 nt, Yersinia pestis
uuaaauaagauccagaacacca

SEQ ID NO: 4171039 - RNA, 15 nt, Yersinia pestis
uuaaauacagaucau

SEQ ID NO: 4171040 - RNA, 11 nt, Yersinia pestis
uuaaauaccag

SEQ ID NO: 4171041 - RNA, 15 nt, Yersinia pestis
uuaaauaccagagac

SEQ ID NO: 4171042 - RNA, 18 nt, Yersinia pestis
uuaaauauuaacauuaau

SEQ ID NO: 4171043 - RNA, 14 nt, Yersinia pestis
uuaaauauuauuua

SEQ ID NO: 4171044 - RNA, 17 nt, Yersinia pestis
uuaaaucuuacugguuu

SEQ ID NO: 4171045 - RNA, 19 nt, Yersinia pestis
uuaaaugaaccaaaauuca

SEQ ID NO: 4171046 - RNA, 14 nt, Yersinia pestis
uuaaaugagaauaa

SEQ ID NO: 4171047 - RNA, 16 nt, Yersinia pestis
uuaaauguauaaaaaa

SEQ ID NO: 4171048 - RNA, 21 nt, Yersinia pestis
uuaaauguauaaaaaagauaa

SEQ ID NO: 4171049 - RNA, 15 nt, Yersinia pestis
uuaaauuaauauuua

SEQ ID NO: 4171050 - RNA, 18 nt, Yersinia pestis
uuaaauuaauauuuaaag

SEQ ID NO: 4171051 - RNA, 21 nt, Yersinia pestis
uuaaauuacgguuuaccaccu

SEQ ID NO: 4171052 - RNA, 21 nt, Yersinia pestis
uuaaauuaucccguucaauaa

SEQ ID NO: 4171053 - RNA, 23 nt, Yersinia pestis
uuaaauuauugaguaacauuaau

SEQ ID NO: 4171054 - RNA, 14 nt, Yersinia pestis
uuaaauuucuucaa

SEQ ID NO: 4171055 - RNA, 14 nt, Yersinia pestis
uuaaauuuuaauua

SEQ ID NO: 4171056 - RNA, 13 nt, Yersinia pestis
uuaaauuuuuaua

SEQ ID NO: 4171057 - RNA, 16 nt, Yersinia pestis
uuaacaaaaaauuaau

SEQ ID NO: 4171058 - RNA, 17 nt, Yersinia pestis
uuaacaaagcuauuuuu

SEQ ID NO: 4171059 - RNA, 19 nt, Yersinia pestis
uuaacaaucagugcaauaa

SEQ ID NO: 4171060 - RNA, 20 nt, Yersinia pestis
uuaacaaucagugcaauaaa

SEQ ID NO: 4171061 - RNA, 15 nt, Yersinia pestis
uuaacacaucaaaau

SEQ ID NO: 4171062 - RNA, 22 nt, Yersinia pestis
uuaacacauuccaguaaaaaaa

SEQ ID NO: 4171063 - RNA, 19 nt, Yersinia pestis
uuaacacccaauaauaaaa

SEQ ID NO: 4171064 - RNA, 20 nt, Yersinia pestis
uuaacacccaauaauaaaaa

SEQ ID NO: 4171065 - RNA, 22 nt, Yersinia pestis
uuaacacccaauaauaaaaaaa

SEQ ID NO: 4171066 - RNA, 21 nt, Yersinia pestis
uuaacacgaaaagcagcaguu

SEQ ID NO: 4171067 - RNA, 15 nt, Yersinia pestis
uuaacagcaucacug

SEQ ID NO: 4171068 - RNA, 17 nt, Yersinia pestis
uuaacaucgccacgaau

SEQ ID NO: 4171069 - RNA, 15 nt, Yersinia pestis
uuaacccaaagcccu

SEQ ID NO: 4171070 - RNA, 15 nt, Yersinia pestis
uuaacccaccaauag

SEQ ID NO: 4171071 - RNA, 13 nt, Yersinia pestis
uuaacccauauua

SEQ ID NO: 4171072 - RNA, 23 nt, Yersinia pestis
uuaaccugagcggcguuguucuc

SEQ ID NO: 4171073 - RNA, 16 nt, Yersinia pestis
uuaaccuguaaaagca

SEQ ID NO: 4171074 - RNA, 23 nt, Yersinia pestis
uuaacgauauaggguauaugccu

SEQ ID NO: 4171075 - RNA, 17 nt, Yersinia pestis
uuaacgauauagucuug

SEQ ID NO: 4171076 - RNA, 14 nt, Yersinia pestis
uuaacgauccucua

SEQ ID NO: 4171077 - RNA, 18 nt, Yersinia pestis
uuaacgucagauaaacaa

SEQ ID NO: 4171078 - RNA, 18 nt, Yersinia pestis
uuaacgucgcugaaaugc

SEQ ID NO: 4171079 - RNA, 13 nt, Yersinia pestis
uuaacucaaauaa

SEQ ID NO: 4171080 - RNA, 20 nt, Yersinia pestis
uuaacucuuuuuaaacuauu

SEQ ID NO: 4171081 - RNA, 12 nt, Yersinia pestis
uuaacugaaagc

SEQ ID NO: 4171082 - RNA, 16 nt, Yersinia pestis
uuaacugcaguaaaaa

SEQ ID NO: 4171083 - RNA, 18 nt, Yersinia pestis
uuaacugcaguaaaaaua

SEQ ID NO: 4171084 - RNA, 20 nt, Yersinia pestis
uuaacugcaguaaaaauauu

SEQ ID NO: 4171085 - RNA, 14 nt, Yersinia pestis
uuaacuuauugauu

SEQ ID NO: 4171086 - RNA, 15 nt, Yersinia pestis
uuaacuucuuccgca

SEQ ID NO: 4171087 - RNA, 12 nt, Yersinia pestis
uuaacuuuauca

SEQ ID NO: 4171088 - RNA, 19 nt, Yersinia pestis
uuaacuuuucuucauugcu

SEQ ID NO: 4171089 - RNA, 22 nt, Yersinia pestis
uuaacuuuucuucauugcugcu

SEQ ID NO: 4171090 - RNA, 19 nt, Yersinia pestis
uuaacuuuuucuaucccua

SEQ ID NO: 4171091 - RNA, 14 nt, Yersinia pestis
uuaagaagccucau

SEQ ID NO: 4171092 - RNA, 12 nt, Yersinia pestis
uuaagacguauc

SEQ ID NO: 4171093 - RNA, 22 nt, Yersinia pestis
uuaaggaaaaguagccaauaga

SEQ ID NO: 4171094 - RNA, 19 nt, Yersinia pestis
uuaaggauggucaacauug

SEQ ID NO: 4171095 - RNA, 16 nt, Yersinia pestis
uuaaggcgcgacugau

SEQ ID NO: 4171096 - RNA, 20 nt, Yersinia pestis
uuaagggggggaagcucccc

SEQ ID NO: 4171097 - RNA, 19 nt, Yersinia pestis
uuaagguuagcuaugcagu

SEQ ID NO: 4171098 - RNA, 22 nt, Yersinia pestis
uuaagguuagcuaugcaguuaa

SEQ ID NO: 4171099 - RNA, 15 nt, Yersinia pestis
uuaagucaaauuuaa

SEQ ID NO: 4171100 - RNA, 22 nt, Yersinia pestis
uuaaguguugccaaccggauaa

SEQ ID NO: 4171101 - RNA, 23 nt, Yersinia pestis
uuaaguuuucuggcaauuucugu

SEQ ID NO: 4171102 - RNA, 16 nt, Yersinia pestis
uuaauaaaaaacugac

SEQ ID NO: 4171103 - RNA, 18 nt, Yersinia pestis
uuaauaaacaugaauaac

SEQ ID NO: 4171104 - RNA, 18 nt, Yersinia pestis
uuaauaaccauaaaauaa

SEQ ID NO: 4171105 - RNA, 14 nt, Yersinia pestis
uuaauaacuuaucu

SEQ ID NO: 4171106 - RNA, 21 nt, Yersinia pestis
uuaauaacuucaguuacucac

SEQ ID NO: 4171107 - RNA, 20 nt, Yersinia pestis
uuaauaagcccaguauugca

SEQ ID NO: 4171108 - RNA, 23 nt, Yersinia pestis
uuaauaauaguuucuggcaaggu

SEQ ID NO: 4171109 - RNA, 18 nt, Yersinia pestis
uuaauacaauagagaaua

SEQ ID NO: 4171110 - RNA, 19 nt, Yersinia pestis
uuaauacacgcuuccagua

SEQ ID NO: 4171111 - RNA, 16 nt, Yersinia pestis
uuaauacaucaucaaa

SEQ ID NO: 4171112 - RNA, 13 nt, Yersinia pestis
uuaauaccaugca

SEQ ID NO: 4171113 - RNA, 18 nt, Yersinia pestis
uuaauacugaacauggau

SEQ ID NO: 4171114 - RNA, 19 nt, Yersinia pestis
uuaauagaagguuaaauuu

SEQ ID NO: 4171115 - RNA, 16 nt, Yersinia pestis
uuaauagaaucugcug

SEQ ID NO: 4171116 - RNA, 20 nt, Yersinia pestis
uuaauagaaucugcugcaaa

SEQ ID NO: 4171117 - RNA, 16 nt, Yersinia pestis
uuaauauauaaaauaa

SEQ ID NO: 4171118 - RNA, 20 nt, Yersinia pestis
uuaauauauaaaauaaauuu

SEQ ID NO: 4171119 - RNA, 17 nt, Yersinia pestis
uuaauaucuuuaaauua

SEQ ID NO: 4171120 - RNA, 19 nt, Yersinia pestis
uuaauaucuuuaaauuauu

SEQ ID NO: 4171121 - RNA, 21 nt, Yersinia pestis
uuaauaucuuuaaauuauuga

SEQ ID NO: 4171122 - RNA, 15 nt, Yersinia pestis
uuaauaugcaaaaaa

SEQ ID NO: 4171123 - RNA, 17 nt, Yersinia pestis
uuaauaugcaaaaaaag

SEQ ID NO: 4171124 - RNA, 22 nt, Yersinia pestis
uuaauaugcaaaaaaagacacu

SEQ ID NO: 4171125 - RNA, 23 nt, Yersinia pestis
uuaauauuuaucugcauuaaaau

SEQ ID NO: 4171126 - RNA, 13 nt, Yersinia pestis
uuaaucaacagau

SEQ ID NO: 4171127 - RNA, 15 nt, Yersinia pestis
uuaaucaagauauua

SEQ ID NO: 4171128 - RNA, 17 nt, Yersinia pestis
uuaaucaucaucacaaa

SEQ ID NO: 4171129 - RNA, 17 nt, Yersinia pestis
uuaaucaucgacuugau

SEQ ID NO: 4171130 - RNA, 23 nt, Yersinia pestis
uuaauccccaugaugauaucacc

SEQ ID NO: 4171131 - RNA, 21 nt, Yersinia pestis
uuaauccccggucacuuaaau

SEQ ID NO: 4171132 - RNA, 23 nt, Yersinia pestis
uuaauccccggucacuuaaauaa

SEQ ID NO: 4171133 - RNA, 22 nt, Yersinia pestis
uuaauccuaaugaacacuuaau

SEQ ID NO: 4171134 - RNA, 13 nt, Yersinia pestis
uuaauccuucacu

SEQ ID NO: 4171135 - RNA, 22 nt, Yersinia pestis
uuaaucgcucauccauaaguau

SEQ ID NO: 4171136 - RNA, 23 nt, Yersinia pestis
uuaaucgcucauccauaaguauu

SEQ ID NO: 4171137 - RNA, 16 nt, Yersinia pestis
uuaaucgcugaacaga

SEQ ID NO: 4171138 - RNA, 17 nt, Yersinia pestis
uuaaucgucuuguuggu

SEQ ID NO: 4171139 - RNA, 17 nt, Yersinia pestis
uuaaucuccuggugguu

SEQ ID NO: 4171140 - RNA, 13 nt, Yersinia pestis
uuaaucugcauca

SEQ ID NO: 4171141 - RNA, 17 nt, Yersinia pestis
uuaaucuuguaaagacg

SEQ ID NO: 4171142 - RNA, 20 nt, Yersinia pestis
uuaaucuuuaauucaucaga

SEQ ID NO: 4171143 - RNA, 16 nt, Yersinia pestis
uuaaugaaauuaguua

SEQ ID NO: 4171144 - RNA, 18 nt, Yersinia pestis
uuaaugagucucacaaaa

SEQ ID NO: 4171145 - RNA, 22 nt, Yersinia pestis
uuaaugagucucacaaaauaau

SEQ ID NO: 4171146 - RNA, 12 nt, Yersinia pestis
uuaaugauaacg

SEQ ID NO: 4171147 - RNA, 20 nt, Yersinia pestis
uuaaugcaggggggcguuau

SEQ ID NO: 4171148 - RNA, 21 nt, Yersinia pestis
uuaauggcaccguggauaaac

SEQ ID NO: 4171149 - RNA, 19 nt, Yersinia pestis
uuaauggggagugcgcgca

SEQ ID NO: 4171150 - RNA, 15 nt, Yersinia pestis
uuaaugguuuccaua

SEQ ID NO: 4171151 - RNA, 16 nt, Yersinia pestis
uuaaugucuuuacuaa

SEQ ID NO: 4171152 - RNA, 18 nt, Yersinia pestis
uuaauuccaugcaaaaua

SEQ ID NO: 4171153 - RNA, 14 nt, Yersinia pestis
uuaauugcugaugu

SEQ ID NO: 4171154 - RNA, 23 nt, Yersinia pestis
uuaauuggcucauaacacuuaau

SEQ ID NO: 4171155 - RNA, 15 nt, Yersinia pestis
uuaauuuaaauaaaa

SEQ ID NO: 4171156 - RNA, 15 nt, Yersinia pestis
uuaauuuaauuuaug

SEQ ID NO: 4171157 - RNA, 20 nt, Yersinia pestis
uuaauuuagccauucaaaaa

SEQ ID NO: 4171158 - RNA, 14 nt, Yersinia pestis
uuaauuuaugaaca

SEQ ID NO: 4171159 - RNA, 15 nt, Yersinia pestis
uuaauuucagucaau

SEQ ID NO: 4171160 - RNA, 17 nt, Yersinia pestis
uuaauuuggcuauugag

SEQ ID NO: 4171161 - RNA, 17 nt, Yersinia pestis
uuaauuuuucauaauaa

SEQ ID NO: 4171162 - RNA, 19 nt, Yersinia pestis
uuacaaauuugacauuucc

SEQ ID NO: 4171163 - RNA, 15 nt, Yersinia pestis
uuacaauuacacacc

SEQ ID NO: 4171164 - RNA, 23 nt, Yersinia pestis
uuacacaauaggcuauuuuacuu

SEQ ID NO: 4171165 - RNA, 21 nt, Yersinia pestis
uuacacacccucaacucaaaa

SEQ ID NO: 4171166 - RNA, 22 nt, Yersinia pestis
uuacacacccucaacucaaaac

SEQ ID NO: 4171167 - RNA, 16 nt, Yersinia pestis
uuacacccaacuuuuu

SEQ ID NO: 4171168 - RNA, 20 nt, Yersinia pestis
uuacaccgugcaauagcuag

SEQ ID NO: 4171169 - RNA, 19 nt, Yersinia pestis
uuacacugucgacugcuuu

SEQ ID NO: 4171170 - RNA, 18 nt, Yersinia pestis
uuacagcaaggcggcaag

SEQ ID NO: 4171171 - RNA, 23 nt, Yersinia pestis
uuacagcaaggcggcaagcaagc

SEQ ID NO: 4171172 - RNA, 17 nt, Yersinia pestis
uuacaggaacguucaau

SEQ ID NO: 4171173 - RNA, 13 nt, Yersinia pestis
uuacaguuuaauu

SEQ ID NO: 4171174 - RNA, 17 nt, Yersinia pestis
uuacauauaauccaaaa

SEQ ID NO: 4171175 - RNA, 19 nt, Yersinia pestis
uuacauauaggaaaugucg

SEQ ID NO: 4171176 - RNA, 21 nt, Yersinia pestis
uuacaucaaccccuuucuuaa

SEQ ID NO: 4171177 - RNA, 13 nt, Yersinia pestis
uuacaucaucuuc

SEQ ID NO: 4171178 - RNA, 23 nt, Yersinia pestis
uuacauuuaaacacucaauaagu

SEQ ID NO: 4171179 - RNA, 11 nt, Yersinia pestis
uuacauuuuua

SEQ ID NO: 4171180 - RNA, 13 nt, Yersinia pestis
uuacauuuuuaac

SEQ ID NO: 4171181 - RNA, 20 nt, Yersinia pestis
uuaccaaaacgccaccagcg

SEQ ID NO: 4171182 - RNA, 20 nt, Yersinia pestis
uuaccaaaagcauccaauac

SEQ ID NO: 4171183 - RNA, 18 nt, Yersinia pestis
uuaccaacagacucacuc

SEQ ID NO: 4171184 - RNA, 15 nt, Yersinia pestis
uuaccaagagagaau

SEQ ID NO: 4171185 - RNA, 11 nt, Yersinia pestis
uuaccacaccu

SEQ ID NO: 4171186 - RNA, 16 nt, Yersinia pestis
uuaccacggccaagua

SEQ ID NO: 4171187 - RNA, 18 nt, Yersinia pestis
uuaccacuauccaacugg

SEQ ID NO: 4171188 - RNA, 17 nt, Yersinia pestis
uuaccacuggccuccca

SEQ ID NO: 4171189 - RNA, 14 nt, Yersinia pestis
uuaccauccacuag

SEQ ID NO: 4171190 - RNA, 22 nt, Yersinia pestis
uuaccauccacuagguccauaa

SEQ ID NO: 4171191 - RNA, 14 nt, Yersinia pestis
uuacccacauuaaa

SEQ ID NO: 4171192 - RNA, 15 nt, Yersinia pestis
uuacccgaaagccau

SEQ ID NO: 4171193 - RNA, 21 nt, Yersinia pestis
uuacccguuacacaaucagua

SEQ ID NO: 4171194 - RNA, 17 nt, Yersinia pestis
uuacccuggucguuacg

SEQ ID NO: 4171195 - RNA, 22 nt, Yersinia pestis
uuaccgagcgucaagccaaccc

SEQ ID NO: 4171196 - RNA, 23 nt, Yersinia pestis
uuaccgauaaaggccgcagauaa

SEQ ID NO: 4171197 - RNA, 16 nt, Yersinia pestis
uuaccgauggugccgu

SEQ ID NO: 4171198 - RNA, 15 nt, Yersinia pestis
uuaccggccucuuuc

SEQ ID NO: 4171199 - RNA, 16 nt, Yersinia pestis
uuaccgggcgaacaga

SEQ ID NO: 4171200 - RNA, 15 nt, Yersinia pestis
uuaccguugauugga

SEQ ID NO: 4171201 - RNA, 20 nt, Yersinia pestis
uuaccuauaaacuugauuca

SEQ ID NO: 4171202 - RNA, 12 nt, Yersinia pestis
uuaccugcauau

SEQ ID NO: 4171203 - RNA, 14 nt, Yersinia pestis
uuaccugcucaacu

SEQ ID NO: 4171204 - RNA, 22 nt, Yersinia pestis
uuaccuguuucgauccagcuac

SEQ ID NO: 4171205 - RNA, 14 nt, Yersinia pestis
uuaccuugugcggu

SEQ ID NO: 4171206 - RNA, 21 nt, Yersinia pestis
uuaccuuguuuguuacugcuu

SEQ ID NO: 4171207 - RNA, 15 nt, Yersinia pestis
uuacgauaaucuccc

SEQ ID NO: 4171208 - RNA, 16 nt, Yersinia pestis
uuacgaucaacccccu

SEQ ID NO: 4171209 - RNA, 22 nt, Yersinia pestis
uuacgaucgauaguaacaccag

SEQ ID NO: 4171210 - RNA, 14 nt, Yersinia pestis
uuacgaucugccug

SEQ ID NO: 4171211 - RNA, 14 nt, Yersinia pestis
uuacgcaacaagcc

SEQ ID NO: 4171212 - RNA, 20 nt, Yersinia pestis
uuacgccugggcauacuguu

SEQ ID NO: 4171213 - RNA, 22 nt, Yersinia pestis
uuacgcuaucaacuuucacccc

SEQ ID NO: 4171214 - RNA, 12 nt, Yersinia pestis
uuacggauauga

SEQ ID NO: 4171215 - RNA, 23 nt, Yersinia pestis
uuacggccgcuaguuugacgcug

SEQ ID NO: 4171216 - RNA, 22 nt, Yersinia pestis
uuacgggucagcucaccaccuc

SEQ ID NO: 4171217 - RNA, 14 nt, Yersinia pestis
uuacguaauaguaa

SEQ ID NO: 4171218 - RNA, 23 nt, Yersinia pestis
uuacguaauaucagcaaaguacc

SEQ ID NO: 4171219 - RNA, 13 nt, Yersinia pestis
uuacguaauucgu

SEQ ID NO: 4171220 - RNA, 14 nt, Yersinia pestis
uuacgucagaaaua

SEQ ID NO: 4171221 - RNA, 15 nt, Yersinia pestis
uuacgucagaaauaa

SEQ ID NO: 4171222 - RNA, 16 nt, Yersinia pestis
uuacgugaucaucuuu

SEQ ID NO: 4171223 - RNA, 17 nt, Yersinia pestis
uuacgugaucaucuuuu

SEQ ID NO: 4171224 - RNA, 14 nt, Yersinia pestis
uuacgugaugaugc

SEQ ID NO: 4171225 - RNA, 19 nt, Yersinia pestis
uuacgugucagacugcuga

SEQ ID NO: 4171226 - RNA, 19 nt, Yersinia pestis
uuacguuucauaugucacc

SEQ ID NO: 4171227 - RNA, 14 nt, Yersinia pestis
uuacuaaaauauca

SEQ ID NO: 4171228 - RNA, 14 nt, Yersinia pestis
uuacuaacuggcug

SEQ ID NO: 4171229 - RNA, 13 nt, Yersinia pestis
uuacuauuuuucu

SEQ ID NO: 4171230 - RNA, 14 nt, Yersinia pestis
uuacucaggaacaa

SEQ ID NO: 4171231 - RNA, 19 nt, Yersinia pestis
uuacucaggauuagcuucu

SEQ ID NO: 4171232 - RNA, 17 nt, Yersinia pestis
uuacucaguucagcccc

SEQ ID NO: 4171233 - RNA, 18 nt, Yersinia pestis
uuacucauuauggauaau

SEQ ID NO: 4171234 - RNA, 14 nt, Yersinia pestis
uuacuccucugccu

SEQ ID NO: 4171235 - RNA, 18 nt, Yersinia pestis
uuacuccucugccuaucc

SEQ ID NO: 4171236 - RNA, 14 nt, Yersinia pestis
uuacucgcuccgag

SEQ ID NO: 4171237 - RNA, 16 nt, Yersinia pestis
uuacucguauaaaaaa

SEQ ID NO: 4171238 - RNA, 15 nt, Yersinia pestis
uuacucguuuuacau

SEQ ID NO: 4171239 - RNA, 17 nt, Yersinia pestis
uuacucugcggcaggcu

SEQ ID NO: 4171240 - RNA, 18 nt, Yersinia pestis
uuacucuucagccuaucc

SEQ ID NO: 4171241 - RNA, 16 nt, Yersinia pestis
uuacugaaaagaggca

SEQ ID NO: 4171242 - RNA, 14 nt, Yersinia pestis
uuacugaucaauaa

SEQ ID NO: 4171243 - RNA, 22 nt, Yersinia pestis
uuacugaucaauaaaaaaguca

SEQ ID NO: 4171244 - RNA, 15 nt, Yersinia pestis
uuacugcaucaauaa

SEQ ID NO: 4171245 - RNA, 14 nt, Yersinia pestis
uuacugcauucuga

SEQ ID NO: 4171246 - RNA, 21 nt, Yersinia pestis
uuacugccugcagcaacaaua

SEQ ID NO: 4171247 - RNA, 20 nt, Yersinia pestis
uuacugcuucuguggcggca

SEQ ID NO: 4171248 - RNA, 15 nt, Yersinia pestis
uuacuggaagcuauu

SEQ ID NO: 4171249 - RNA, 22 nt, Yersinia pestis
uuacuggaagcuauucgccaug

SEQ ID NO: 4171250 - RNA, 16 nt, Yersinia pestis
uuacuguaucaauacc

SEQ ID NO: 4171251 - RNA, 21 nt, Yersinia pestis
uuacuguaucaauaccuuacu

SEQ ID NO: 4171252 - RNA, 21 nt, Yersinia pestis
uuacuugugcgcgggcacggg

SEQ ID NO: 4171253 - RNA, 18 nt, Yersinia pestis
uuacuuuaucguccaugc

SEQ ID NO: 4171254 - RNA, 14 nt, Yersinia pestis
uuacuuuauuuaaa

SEQ ID NO: 4171255 - RNA, 13 nt, Yersinia pestis
uuacuuuuuauua

SEQ ID NO: 4171256 - RNA, 19 nt, Yersinia pestis
uuagaauguguaguugaag

SEQ ID NO: 4171257 - RNA, 17 nt, Yersinia pestis
uuagacagaauuauuua

SEQ ID NO: 4171258 - RNA, 19 nt, Yersinia pestis
uuagacagaauuauuuaua

SEQ ID NO: 4171259 - RNA, 11 nt, Yersinia pestis
uuagacgucag

SEQ ID NO: 4171260 - RNA, 16 nt, Yersinia pestis
uuagaggauuuaacug

SEQ ID NO: 4171261 - RNA, 16 nt, Yersinia pestis
uuagaggcugauaacc

SEQ ID NO: 4171262 - RNA, 20 nt, Yersinia pestis
uuagagguuauugacaaaga

SEQ ID NO: 4171263 - RNA, 20 nt, Yersinia pestis
uuagauaggcuuuccccccu

SEQ ID NO: 4171264 - RNA, 13 nt, Yersinia pestis
uuagaugcuaucu

SEQ ID NO: 4171265 - RNA, 14 nt, Yersinia pestis
uuagauuucaccua

SEQ ID NO: 4171266 - RNA, 21 nt, Yersinia pestis
uuagcaacgguaucccgguga

SEQ ID NO: 4171267 - RNA, 16 nt, Yersinia pestis
uuagcacauaugcagc

SEQ ID NO: 4171268 - RNA, 17 nt, Yersinia pestis
uuagcacauaugcagcu

SEQ ID NO: 4171269 - RNA, 18 nt, Yersinia pestis
uuagcaccggauggucac

SEQ ID NO: 4171270 - RNA, 19 nt, Yersinia pestis
uuagcacguuuuucagcuu

SEQ ID NO: 4171271 - RNA, 12 nt, Yersinia pestis
uuagcagggcau

SEQ ID NO: 4171272 - RNA, 20 nt, Yersinia pestis
uuagcaguauuagcuuuacu

SEQ ID NO: 4171273 - RNA, 20 nt, Yersinia pestis
uuagcauuaccgguaauauu

SEQ ID NO: 4171274 - RNA, 21 nt, Yersinia pestis
uuagccaacgggguauuuaac

SEQ ID NO: 4171275 - RNA, 23 nt, Yersinia pestis
uuagccaagcaaccuuguuuuau

SEQ ID NO: 4171276 - RNA, 20 nt, Yersinia pestis
uuagccauucaaaaauuaaa

SEQ ID NO: 4171277 - RNA, 16 nt, Yersinia pestis
uuagccauuucaaaac

SEQ ID NO: 4171278 - RNA, 15 nt, Yersinia pestis
uuagccgaauauccc

SEQ ID NO: 4171279 - RNA, 17 nt, Yersinia pestis
uuagccgaauaucccac

SEQ ID NO: 4171280 - RNA, 14 nt, Yersinia pestis
uuagcgagaaaguc

SEQ ID NO: 4171281 - RNA, 23 nt, Yersinia pestis
uuagcgaugaccauuuauuucca

SEQ ID NO: 4171282 - RNA, 15 nt, Yersinia pestis
uuagcgaugacugag

SEQ ID NO: 4171283 - RNA, 14 nt, Yersinia pestis
uuagcgauuucuag

SEQ ID NO: 4171284 - RNA, 18 nt, Yersinia pestis
uuagcgcacggggaaaca

SEQ ID NO: 4171285 - RNA, 17 nt, Yersinia pestis
uuagcgccgcuucgguc

SEQ ID NO: 4171286 - RNA, 21 nt, Yersinia pestis
uuagcucaaauauuugcacaa

SEQ ID NO: 4171287 - RNA, 23 nt, Yersinia pestis
uuagcugauuugauauuagccaa

SEQ ID NO: 4171288 - RNA, 13 nt, Yersinia pestis
uuagcugcgcgca

SEQ ID NO: 4171289 - RNA, 19 nt, Yersinia pestis
uuagcuguacuaaaggugu

SEQ ID NO: 4171290 - RNA, 17 nt, Yersinia pestis
uuaggauaaccaauucu

SEQ ID NO: 4171291 - RNA, 18 nt, Yersinia pestis
uuaggauacguucgccgu

SEQ ID NO: 4171292 - RNA, 15 nt, Yersinia pestis
uuaggauuagccgcu

SEQ ID NO: 4171293 - RNA, 16 nt, Yersinia pestis
uuaggcaugauaagca

SEQ ID NO: 4171294 - RNA, 18 nt, Yersinia pestis
uuaggccaauuuggccaa

SEQ ID NO: 4171295 - RNA, 17 nt, Yersinia pestis
uuaggcgggcaguauaa

SEQ ID NO: 4171296 - RNA, 20 nt, Yersinia pestis
uuagggcgcggcugguaaca

SEQ ID NO: 4171297 - RNA, 18 nt, Yersinia pestis
uuagguaauaccaaugcu

SEQ ID NO: 4171298 - RNA, 23 nt, Yersinia pestis
uuagguaaugccacgucaucgaa

SEQ ID NO: 4171299 - RNA, 16 nt, Yersinia pestis
uuaggugaaaauaaua

SEQ ID NO: 4171300 - RNA, 14 nt, Yersinia pestis
uuaggugacaggca

SEQ ID NO: 4171301 - RNA, 18 nt, Yersinia pestis
uuaguaacuguaaggcca

SEQ ID NO: 4171302 - RNA, 12 nt, Yersinia pestis
uuaguaaucaau

SEQ ID NO: 4171303 - RNA, 19 nt, Yersinia pestis
uuagucacuaaagcggaau

SEQ ID NO: 4171304 - RNA, 23 nt, Yersinia pestis
uuagucacucaagccaguaacua

SEQ ID NO: 4171305 - RNA, 15 nt, Yersinia pestis
uuagucuuagacguc

SEQ ID NO: 4171306 - RNA, 20 nt, Yersinia pestis
uuagugaaucaucaauaccc

SEQ ID NO: 4171307 - RNA, 18 nt, Yersinia pestis
uuagugcugccagacaau

SEQ ID NO: 4171308 - RNA, 13 nt, Yersinia pestis
uuaguggcuuuaa

SEQ ID NO: 4171309 - RNA, 19 nt, Yersinia pestis
uuaguuacaauaaaucaau

SEQ ID NO: 4171310 - RNA, 13 nt, Yersinia pestis
uuaguuucuacgg

SEQ ID NO: 4171311 - RNA, 11 nt, Yersinia pestis
uuauaaaacca

SEQ ID NO: 4171312 - RNA, 16 nt, Yersinia pestis
uuauaaacaaucugau

SEQ ID NO: 4171313 - RNA, 15 nt, Yersinia pestis
uuauaaaccaaaugg

SEQ ID NO: 4171314 - RNA, 15 nt, Yersinia pestis
uuauaacuauauucu

SEQ ID NO: 4171315 - RNA, 16 nt, Yersinia pestis
uuauaaggaauauacu

SEQ ID NO: 4171316 - RNA, 23 nt, Yersinia pestis
uuauaaggaauauacuuuacaua

SEQ ID NO: 4171317 - RNA, 13 nt, Yersinia pestis
uuauaauauuaaa

SEQ ID NO: 4171318 - RNA, 19 nt, Yersinia pestis
uuauaauccacugaaauaa

SEQ ID NO: 4171319 - RNA, 20 nt, Yersinia pestis
uuauaaugagaauguaaauu

SEQ ID NO: 4171320 - RNA, 16 nt, Yersinia pestis
uuauaauucauuuuuu

SEQ ID NO: 4171321 - RNA, 21 nt, Yersinia pestis
uuauacauaucuuuauuauca

SEQ ID NO: 4171322 - RNA, 23 nt, Yersinia pestis
uuauacccguuauaccucaagcu

SEQ ID NO: 4171323 - RNA, 23 nt, Yersinia pestis
uuauacccguuauauuucaagcu

SEQ ID NO: 4171324 - RNA, 16 nt, Yersinia pestis
uuauaccuacccuuua

SEQ ID NO: 4171325 - RNA, 12 nt, Yersinia pestis
uuauacugugcg

SEQ ID NO: 4171326 - RNA, 14 nt, Yersinia pestis
uuauagccaaaucu

SEQ ID NO: 4171327 - RNA, 22 nt, Yersinia pestis
uuauagcucaucgguaacuuac

SEQ ID NO: 4171328 - RNA, 21 nt, Yersinia pestis
uuauaggucaucccagcacag

SEQ ID NO: 4171329 - RNA, 20 nt, Yersinia pestis
uuauaguuaaacugauuggu

SEQ ID NO: 4171330 - RNA, 21 nt, Yersinia pestis
uuauauaacgacuauuuaucg

SEQ ID NO: 4171331 - RNA, 12 nt, Yersinia pestis
uuauauaacuag

SEQ ID NO: 4171332 - RNA, 22 nt, Yersinia pestis
uuauauaauugaagauuuaaau

SEQ ID NO: 4171333 - RNA, 13 nt, Yersinia pestis
uuauauauuuuga

SEQ ID NO: 4171334 - RNA, 14 nt, Yersinia pestis
uuauaucuccacca

SEQ ID NO: 4171335 - RNA, 18 nt, Yersinia pestis
uuauaugaucaguggggu

SEQ ID NO: 4171336 - RNA, 14 nt, Yersinia pestis
uuauauuauuuauc

SEQ ID NO: 4171337 - RNA, 16 nt, Yersinia pestis
uuauauugauaaaaau

SEQ ID NO: 4171338 - RNA, 16 nt, Yersinia pestis
uuaucaagaucaaaag

SEQ ID NO: 4171339 - RNA, 15 nt, Yersinia pestis
uuaucaaguuaaaua

SEQ ID NO: 4171340 - RNA, 23 nt, Yersinia pestis
uuaucaaucagacggaauaccac

SEQ ID NO: 4171341 - RNA, 14 nt, Yersinia pestis
uuaucaccaaaagc

SEQ ID NO: 4171342 - RNA, 20 nt, Yersinia pestis
uuaucaccaguauuauuggc

SEQ ID NO: 4171343 - RNA, 14 nt, Yersinia pestis
uuaucacgucgcca

SEQ ID NO: 4171344 - RNA, 19 nt, Yersinia pestis
uuaucacgucgccaauuuu

SEQ ID NO: 4171345 - RNA, 22 nt, Yersinia pestis
uuaucacuguccaagaagccaa

SEQ ID NO: 4171346 - RNA, 19 nt, Yersinia pestis
uuaucagcgaaaaauuuca

SEQ ID NO: 4171347 - RNA, 18 nt, Yersinia pestis
uuaucagggccuacguuc

SEQ ID NO: 4171348 - RNA, 14 nt, Yersinia pestis
uuaucaggugaacg

SEQ ID NO: 4171349 - RNA, 17 nt, Yersinia pestis
uuaucaggugaacgcac

SEQ ID NO: 4171350 - RNA, 21 nt, Yersinia pestis
uuaucaucccuugacugacca

SEQ ID NO: 4171351 - RNA, 17 nt, Yersinia pestis
uuaucaucguaguaaua

SEQ ID NO: 4171352 - RNA, 14 nt, Yersinia pestis
uuaucauuuaaaua

SEQ ID NO: 4171353 - RNA, 21 nt, Yersinia pestis
uuaucauuuaaauacagauca

SEQ ID NO: 4171354 - RNA, 16 nt, Yersinia pestis
uuauccaacuggcgca

SEQ ID NO: 4171355 - RNA, 22 nt, Yersinia pestis
uuauccaauggcucaccuuuca

SEQ ID NO: 4171356 - RNA, 23 nt, Yersinia pestis
uuauccauccccgccucaaugca

SEQ ID NO: 4171357 - RNA, 18 nt, Yersinia pestis
uuaucccaguuuuuaauu

SEQ ID NO: 4171358 - RNA, 11 nt, Yersinia pestis
uuauccccuuc

SEQ ID NO: 4171359 - RNA, 14 nt, Yersinia pestis
uuauccuccauucu

SEQ ID NO: 4171360 - RNA, 15 nt, Yersinia pestis
uuaucgcaauuucag

SEQ ID NO: 4171361 - RNA, 20 nt, Yersinia pestis
uuaucgcaguaauagaaaaa

SEQ ID NO: 4171362 - RNA, 17 nt, Yersinia pestis
uuaucgcuguuuacuga

SEQ ID NO: 4171363 - RNA, 15 nt, Yersinia pestis
uuaucggcaggcuua

SEQ ID NO: 4171364 - RNA, 19 nt, Yersinia pestis
uuaucggugcugacaaaca

SEQ ID NO: 4171365 - RNA, 13 nt, Yersinia pestis
uuaucuaaaacug

SEQ ID NO: 4171366 - RNA, 14 nt, Yersinia pestis
uuaucuacuucuau

SEQ ID NO: 4171367 - RNA, 16 nt, Yersinia pestis
uuaucuaucucaggcu

SEQ ID NO: 4171368 - RNA, 16 nt, Yersinia pestis
uuaucuaucuguucac

SEQ ID NO: 4171369 - RNA, 19 nt, Yersinia pestis
uuaucucacgcugaauaac

SEQ ID NO: 4171370 - RNA, 15 nt, Yersinia pestis
uuaucucccauuaau

SEQ ID NO: 4171371 - RNA, 17 nt, Yersinia pestis
uuaucucccauuaauua

SEQ ID NO: 4171372 - RNA, 19 nt, Yersinia pestis
uuaucucccauuaauuaau

SEQ ID NO: 4171373 - RNA, 13 nt, Yersinia pestis
uuaucuccuguaa

SEQ ID NO: 4171374 - RNA, 22 nt, Yersinia pestis
uuaucugaauagcgcugcauca

SEQ ID NO: 4171375 - RNA, 20 nt, Yersinia pestis
uuaucugagccuucaacaaa

SEQ ID NO: 4171376 - RNA, 17 nt, Yersinia pestis
uuaucugcauuaaaaua

SEQ ID NO: 4171377 - RNA, 22 nt, Yersinia pestis
uuaucugcauuaaaauaacaau

SEQ ID NO: 4171378 - RNA, 21 nt, Yersinia pestis
uuaucugugccagucuaaaau

SEQ ID NO: 4171379 - RNA, 13 nt, Yersinia pestis
uuaucuguuucaa

SEQ ID NO: 4171380 - RNA, 16 nt, Yersinia pestis
uuaucuguuucaaaua

SEQ ID NO: 4171381 - RNA, 18 nt, Yersinia pestis
uuaucuguuucaaauaag

SEQ ID NO: 4171382 - RNA, 14 nt, Yersinia pestis
uuaucuucaauacg

SEQ ID NO: 4171383 - RNA, 15 nt, Yersinia pestis
uuaucuugguuucac

SEQ ID NO: 4171384 - RNA, 18 nt, Yersinia pestis
uuaucuuguaaauaguca

SEQ ID NO: 4171385 - RNA, 23 nt, Yersinia pestis
uuaugaauggggggcaaccuggu

SEQ ID NO: 4171386 - RNA, 17 nt, Yersinia pestis
uuaugaauuaauuuauu

SEQ ID NO: 4171387 - RNA, 17 nt, Yersinia pestis
uuaugaccaauagucac

SEQ ID NO: 4171388 - RNA, 22 nt, Yersinia pestis
uuaugaccaauagucacgucuu

SEQ ID NO: 4171389 - RNA, 23 nt, Yersinia pestis
uuaugaugcuggguauauauaca

SEQ ID NO: 4171390 - RNA, 15 nt, Yersinia pestis
uuaugccacaucagu

SEQ ID NO: 4171391 - RNA, 18 nt, Yersinia pestis
uuaugccgugacugccgg

SEQ ID NO: 4171392 - RNA, 22 nt, Yersinia pestis
uuauggauauggaccugaguca

SEQ ID NO: 4171393 - RNA, 16 nt, Yersinia pestis
uuauggcauaaacuga

SEQ ID NO: 4171394 - RNA, 19 nt, Yersinia pestis
uuauggcguuuuugguuaa

SEQ ID NO: 4171395 - RNA, 18 nt, Yersinia pestis
uuaugggggcaaaacuca

SEQ ID NO: 4171396 - RNA, 19 nt, Yersinia pestis
uuauguaacaacugaacca

SEQ ID NO: 4171397 - RNA, 16 nt, Yersinia pestis
uuauguaguuaaucua

SEQ ID NO: 4171398 - RNA, 19 nt, Yersinia pestis
uuauguuuacugagcagca

SEQ ID NO: 4171399 - RNA, 16 nt, Yersinia pestis
uuauuaaacagucuua

SEQ ID NO: 4171400 - RNA, 23 nt, Yersinia pestis
uuauuaaacagucuuauuacuca

SEQ ID NO: 4171401 - RNA, 17 nt, Yersinia pestis
uuauuaacuucaauuug

SEQ ID NO: 4171402 - RNA, 13 nt, Yersinia pestis
uuauuaaguuuuu

SEQ ID NO: 4171403 - RNA, 23 nt, Yersinia pestis
uuauuaaucaagauauuacuucu

SEQ ID NO: 4171404 - RNA, 11 nt, Yersinia pestis
uuauuacauuu

SEQ ID NO: 4171405 - RNA, 12 nt, Yersinia pestis
uuauuaccuaau

SEQ ID NO: 4171406 - RNA, 18 nt, Yersinia pestis
uuauuaccuaauuuaucc

SEQ ID NO: 4171407 - RNA, 15 nt, Yersinia pestis
uuauuacucauuaug

SEQ ID NO: 4171408 - RNA, 12 nt, Yersinia pestis
uuauuacugaua

SEQ ID NO: 4171409 - RNA, 16 nt, Yersinia pestis
uuauuagacauagaga

SEQ ID NO: 4171410 - RNA, 22 nt, Yersinia pestis
uuauuagagagugauuccagcu

SEQ ID NO: 4171411 - RNA, 18 nt, Yersinia pestis
uuauuagccaaauacccu

SEQ ID NO: 4171412 - RNA, 19 nt, Yersinia pestis
uuauuagcguuacagcuaa

SEQ ID NO: 4171413 - RNA, 17 nt, Yersinia pestis
uuauuauaggcguugau

SEQ ID NO: 4171414 - RNA, 14 nt, Yersinia pestis
uuauuaucaucuuu

SEQ ID NO: 4171415 - RNA, 20 nt, Yersinia pestis
uuauuauguuugcuagggcu

SEQ ID NO: 4171416 - RNA, 12 nt, Yersinia pestis
uuauuauuauuu

SEQ ID NO: 4171417 - RNA, 19 nt, Yersinia pestis
uuauucauaguuaagacaa

SEQ ID NO: 4171418 - RNA, 22 nt, Yersinia pestis
uuauucgacuguuuuuacaauu

SEQ ID NO: 4171419 - RNA, 11 nt, Yersinia pestis
uuauucuaauu

SEQ ID NO: 4171420 - RNA, 15 nt, Yersinia pestis
uuauucucacucuau

SEQ ID NO: 4171421 - RNA, 12 nt, Yersinia pestis
uuauucuuuauu

SEQ ID NO: 4171422 - RNA, 16 nt, Yersinia pestis
uuauucuuuauuuauu

SEQ ID NO: 4171423 - RNA, 17 nt, Yersinia pestis
uuauugaccaccuuauu

SEQ ID NO: 4171424 - RNA, 12 nt, Yersinia pestis
uuauugacugcc

SEQ ID NO: 4171425 - RNA, 18 nt, Yersinia pestis
uuauugacuguaaauauu

SEQ ID NO: 4171426 - RNA, 23 nt, Yersinia pestis
uuauugagaaucacuacgguuua

SEQ ID NO: 4171427 - RNA, 18 nt, Yersinia pestis
uuauugaugagcuguaga

SEQ ID NO: 4171428 - RNA, 19 nt, Yersinia pestis
uuauugcuaaguacuaucu

SEQ ID NO: 4171429 - RNA, 21 nt, Yersinia pestis
uuauugcucucgcuccagcuc

SEQ ID NO: 4171430 - RNA, 17 nt, Yersinia pestis
uuauuggaaguacuuau

SEQ ID NO: 4171431 - RNA, 22 nt, Yersinia pestis
uuauuggaaguacuuauuugaa

SEQ ID NO: 4171432 - RNA, 13 nt, Yersinia pestis
uuauuggcccuuu

SEQ ID NO: 4171433 - RNA, 20 nt, Yersinia pestis
uuauugggcgcgauaaaaga

SEQ ID NO: 4171434 - RNA, 23 nt, Yersinia pestis
uuauuggggacaggcuccuccuu

SEQ ID NO: 4171435 - RNA, 18 nt, Yersinia pestis
uuauuggucaauaaaauu

SEQ ID NO: 4171436 - RNA, 17 nt, Yersinia pestis
uuauuguccgcgcggcu

SEQ ID NO: 4171437 - RNA, 14 nt, Yersinia pestis
uuauugucucuacu

SEQ ID NO: 4171438 - RNA, 20 nt, Yersinia pestis
uuauugucucuacucucugu

SEQ ID NO: 4171439 - RNA, 18 nt, Yersinia pestis
uuauuguggcuaccaauu

SEQ ID NO: 4171440 - RNA, 21 nt, Yersinia pestis
uuauuuaacacauuccaguaa

SEQ ID NO: 4171441 - RNA, 20 nt, Yersinia pestis
uuauuuaagcaguucacucu

SEQ ID NO: 4171442 - RNA, 13 nt, Yersinia pestis
uuauuuaauuaaa

SEQ ID NO: 4171443 - RNA, 11 nt, Yersinia pestis
uuauuuaauuu

SEQ ID NO: 4171444 - RNA, 14 nt, Yersinia pestis
uuauuuacaccgug

SEQ ID NO: 4171445 - RNA, 15 nt, Yersinia pestis
uuauuuacacuuaau

SEQ ID NO: 4171446 - RNA, 17 nt, Yersinia pestis
uuauuuacgauaagaau

SEQ ID NO: 4171447 - RNA, 23 nt, Yersinia pestis
uuauuuagagucuauaaugcuau

SEQ ID NO: 4171448 - RNA, 12 nt, Yersinia pestis
uuauuuauagaa

SEQ ID NO: 4171449 - RNA, 23 nt, Yersinia pestis
uuauuuauaugauaauaguucau

SEQ ID NO: 4171450 - RNA, 14 nt, Yersinia pestis
uuauuuaucauaaa

SEQ ID NO: 4171451 - RNA, 21 nt, Yersinia pestis
uuauuucacuggaaaaagugu

SEQ ID NO: 4171452 - RNA, 21 nt, Yersinia pestis
uuauuucagccaugggcugaa

SEQ ID NO: 4171453 - RNA, 13 nt, Yersinia pestis
uuauuuccagauc

SEQ ID NO: 4171454 - RNA, 12 nt, Yersinia pestis
uuauuugauaua

SEQ ID NO: 4171455 - RNA, 16 nt, Yersinia pestis
uuauuugauauagaca

SEQ ID NO: 4171456 - RNA, 16 nt, Yersinia pestis
uuauuugggguauaua

SEQ ID NO: 4171457 - RNA, 23 nt, Yersinia pestis
uuauuuggugaguaaaugcccca

SEQ ID NO: 4171458 - RNA, 12 nt, Yersinia pestis
uuauuuuaauuu

SEQ ID NO: 4171459 - RNA, 13 nt, Yersinia pestis
uuauuuuaggucc

SEQ ID NO: 4171460 - RNA, 14 nt, Yersinia pestis
uuauuuuauaauga

SEQ ID NO: 4171461 - RNA, 18 nt, Yersinia pestis
uuauuuuaucuacuucua

SEQ ID NO: 4171462 - RNA, 13 nt, Yersinia pestis
uuauuuuauugga

SEQ ID NO: 4171463 - RNA, 15 nt, Yersinia pestis
uuauuuucccuuucu

SEQ ID NO: 4171464 - RNA, 14 nt, Yersinia pestis
uuauuuucgaccaa

SEQ ID NO: 4171465 - RNA, 17 nt, Yersinia pestis
uuauuuuggguauauag

SEQ ID NO: 4171466 - RNA, 21 nt, Yersinia pestis
uuauuuuuuguuuuuauauug

SEQ ID NO: 4171467 - RNA, 19 nt, Yersinia pestis
uucaaaaacgcacgaaaac

SEQ ID NO: 4171468 - RNA, 14 nt, Yersinia pestis
uucaaaacuaauau

SEQ ID NO: 4171469 - RNA, 17 nt, Yersinia pestis
uucaaaaggugcaagca

SEQ ID NO: 4171470 - RNA, 21 nt, Yersinia pestis
uucaaaauagaggaaauaaau

SEQ ID NO: 4171471 - RNA, 20 nt, Yersinia pestis
uucaaaauagucaguaaaau

SEQ ID NO: 4171472 - RNA, 21 nt, Yersinia pestis
uucaaaaucugauacugaacg

SEQ ID NO: 4171473 - RNA, 12 nt, Yersinia pestis
uucaaaaugcca

SEQ ID NO: 4171474 - RNA, 14 nt, Yersinia pestis
uucaaacacuuaug

SEQ ID NO: 4171475 - RNA, 15 nt, Yersinia pestis
uucaaaccgcuggug

SEQ ID NO: 4171476 - RNA, 16 nt, Yersinia pestis
uucaaaguaaaauaaa

SEQ ID NO: 4171477 - RNA, 16 nt, Yersinia pestis
uucaaauaaguacuuc

SEQ ID NO: 4171478 - RNA, 16 nt, Yersinia pestis
uucaaauaaguauuuc

SEQ ID NO: 4171479 - RNA, 22 nt, Yersinia pestis
uucaaauaaguauuucaaauaa

SEQ ID NO: 4171480 - RNA, 18 nt, Yersinia pestis
uucaaauaaguguuucaa

SEQ ID NO: 4171481 - RNA, 21 nt, Yersinia pestis
uucaaauaaguguuucaaaua

SEQ ID NO: 4171482 - RNA, 17 nt, Yersinia pestis
uucaaauagcugguuaa

SEQ ID NO: 4171483 - RNA, 19 nt, Yersinia pestis
uucaacaaauucaccagca

SEQ ID NO: 4171484 - RNA, 20 nt, Yersinia pestis
uucaacacggugaauaaacc

SEQ ID NO: 4171485 - RNA, 18 nt, Yersinia pestis
uucaacaguaucaauacc

SEQ ID NO: 4171486 - RNA, 14 nt, Yersinia pestis
uucaacauccaguu

SEQ ID NO: 4171487 - RNA, 18 nt, Yersinia pestis
uucaaccccuucuucacc

SEQ ID NO: 4171488 - RNA, 12 nt, Yersinia pestis
uucaaccugaau

SEQ ID NO: 4171489 - RNA, 20 nt, Yersinia pestis
uucaacgcaccauccagcaa

SEQ ID NO: 4171490 - RNA, 15 nt, Yersinia pestis
uucaacgcauccaaa

SEQ ID NO: 4171491 - RNA, 15 nt, Yersinia pestis
uucaacgccaauacc

SEQ ID NO: 4171492 - RNA, 19 nt, Yersinia pestis
uucaacucuacauugacua

SEQ ID NO: 4171493 - RNA, 17 nt, Yersinia pestis
uucaacuuccugaaucg

SEQ ID NO: 4171494 - RNA, 14 nt, Yersinia pestis
uucaacuugccuga

SEQ ID NO: 4171495 - RNA, 16 nt, Yersinia pestis
uucaagagcgauagau

SEQ ID NO: 4171496 - RNA, 20 nt, Yersinia pestis
uucaagagcgauagaucgau

SEQ ID NO: 4171497 - RNA, 19 nt, Yersinia pestis
uucaagagggcgguuaaau

SEQ ID NO: 4171498 - RNA, 17 nt, Yersinia pestis
uucaagcagcauguguu

SEQ ID NO: 4171499 - RNA, 19 nt, Yersinia pestis
uucaagccgcgccaucucu

SEQ ID NO: 4171500 - RNA, 21 nt, Yersinia pestis
uucaaguccugcuucaaagaa

SEQ ID NO: 4171501 - RNA, 20 nt, Yersinia pestis
uucaauaauuauaccuaccc

SEQ ID NO: 4171502 - RNA, 12 nt, Yersinia pestis
uucaauaccaua

SEQ ID NO: 4171503 - RNA, 21 nt, Yersinia pestis
uucaauacuggccaugugugu

SEQ ID NO: 4171504 - RNA, 16 nt, Yersinia pestis
uucaauccuacaauau

SEQ ID NO: 4171505 - RNA, 18 nt, Yersinia pestis
uucaaugacuccugaaau

SEQ ID NO: 4171506 - RNA, 21 nt, Yersinia pestis
uucaaugacuccugaaauaaa

SEQ ID NO: 4171507 - RNA, 18 nt, Yersinia pestis
uucaaugagcauaccggu

SEQ ID NO: 4171508 - RNA, 12 nt, Yersinia pestis
uucaaugcuuuc

SEQ ID NO: 4171509 - RNA, 20 nt, Yersinia pestis
uucaauucucccauuuauua

SEQ ID NO: 4171510 - RNA, 15 nt, Yersinia pestis
uucaauuuccaucug

SEQ ID NO: 4171511 - RNA, 22 nt, Yersinia pestis
uucaauuugguaauuuccaaga

SEQ ID NO: 4171512 - RNA, 20 nt, Yersinia pestis
uucacagcagaacaaaacaa

SEQ ID NO: 4171513 - RNA, 19 nt, Yersinia pestis
uucacaucggucaauacca

SEQ ID NO: 4171514 - RNA, 11 nt, Yersinia pestis
uucacauuacg

SEQ ID NO: 4171515 - RNA, 12 nt, Yersinia pestis
uucaccaaaaaa

SEQ ID NO: 4171516 - RNA, 14 nt, Yersinia pestis
uucaccaaaaaaac

SEQ ID NO: 4171517 - RNA, 19 nt, Yersinia pestis
uucaccaaaggaagccgag

SEQ ID NO: 4171518 - RNA, 20 nt, Yersinia pestis
uucaccaaccaaccaucacc

SEQ ID NO: 4171519 - RNA, 14 nt, Yersinia pestis
uucaccaaccaauu

SEQ ID NO: 4171520 - RNA, 19 nt, Yersinia pestis
uucaccacacauaccacac

SEQ ID NO: 4171521 - RNA, 20 nt, Yersinia pestis
uucaccaguggucaucaccg

SEQ ID NO: 4171522 - RNA, 16 nt, Yersinia pestis
uucacccauuaauaga

SEQ ID NO: 4171523 - RNA, 14 nt, Yersinia pestis
uucacccuugauuu

SEQ ID NO: 4171524 - RNA, 16 nt, Yersinia pestis
uucacccuuggcuacc

SEQ ID NO: 4171525 - RNA, 23 nt, Yersinia pestis
uucaccguaucaucaccaaacag

SEQ ID NO: 4171526 - RNA, 17 nt, Yersinia pestis
uucacgauggaaaaaau

SEQ ID NO: 4171527 - RNA, 20 nt, Yersinia pestis
uucacgcaucacaucuugca

SEQ ID NO: 4171528 - RNA, 12 nt, Yersinia pestis
uucacggauauc

SEQ ID NO: 4171529 - RNA, 18 nt, Yersinia pestis
uucacguucaucaauacc

SEQ ID NO: 4171530 - RNA, 15 nt, Yersinia pestis
uucacguugguauac

SEQ ID NO: 4171531 - RNA, 20 nt, Yersinia pestis
uucacuauuuauuaaucuau

SEQ ID NO: 4171532 - RNA, 19 nt, Yersinia pestis
uucacuccggcaucauccu

SEQ ID NO: 4171533 - RNA, 22 nt, Yersinia pestis
uucacuccggcaucauccucau

SEQ ID NO: 4171534 - RNA, 13 nt, Yersinia pestis
uucacugaauacc

SEQ ID NO: 4171535 - RNA, 15 nt, Yersinia pestis
uucacugaaucccag

SEQ ID NO: 4171536 - RNA, 21 nt, Yersinia pestis
uucacugccgaaccuuuugcc

SEQ ID NO: 4171537 - RNA, 22 nt, Yersinia pestis
uucacuggccuauuaagauaau

SEQ ID NO: 4171538 - RNA, 15 nt, Yersinia pestis
uucacuuucaacuau

SEQ ID NO: 4171539 - RNA, 13 nt, Yersinia pestis
uucacuuuuaaaa

SEQ ID NO: 4171540 - RNA, 22 nt, Yersinia pestis
uucagaaaggacaguaauauuu

SEQ ID NO: 4171541 - RNA, 15 nt, Yersinia pestis
uucagaagacaauaa

SEQ ID NO: 4171542 - RNA, 22 nt, Yersinia pestis
uucagaauugugccccuuuuuu

SEQ ID NO: 4171543 - RNA, 20 nt, Yersinia pestis
uucagacaguaaauccugau

SEQ ID NO: 4171544 - RNA, 20 nt, Yersinia pestis
uucagacggcagauccugaa

SEQ ID NO: 4171545 - RNA, 21 nt, Yersinia pestis
uucagacggcagauccugaac

SEQ ID NO: 4171546 - RNA, 10 nt, Yersinia pestis
uucagacucc

SEQ ID NO: 4171547 - RNA, 14 nt, Yersinia pestis
uucagacugaaagu

SEQ ID NO: 4171548 - RNA, 13 nt, Yersinia pestis
uucagacugcuga

SEQ ID NO: 4171549 - RNA, 15 nt, Yersinia pestis
uucagaggaaagaga

SEQ ID NO: 4171550 - RNA, 13 nt, Yersinia pestis
uucagauuuacca

SEQ ID NO: 4171551 - RNA, 21 nt, Yersinia pestis
uucagcaaagagucgcaaaac

SEQ ID NO: 4171552 - RNA, 12 nt, Yersinia pestis
uucagcaccaua

SEQ ID NO: 4171553 - RNA, 16 nt, Yersinia pestis
uucagcacgcuuucca

SEQ ID NO: 4171554 - RNA, 21 nt, Yersinia pestis
uucagcaggggcaaccucuuc

SEQ ID NO: 4171555 - RNA, 23 nt, Yersinia pestis
uucagcccauggcugaaauaacu

SEQ ID NO: 4171556 - RNA, 18 nt, Yersinia pestis
uucagcccccucaauacc

SEQ ID NO: 4171557 - RNA, 21 nt, Yersinia pestis
uucagcccccucaauaccggu

SEQ ID NO: 4171558 - RNA, 14 nt, Yersinia pestis
uucagccuauccuc

SEQ ID NO: 4171559 - RNA, 17 nt, Yersinia pestis
uucagccuauccucacc

SEQ ID NO: 4171560 - RNA, 17 nt, Yersinia pestis
uucagcgucacgauagc

SEQ ID NO: 4171561 - RNA, 16 nt, Yersinia pestis
uucagcgucagucaau

SEQ ID NO: 4171562 - RNA, 23 nt, Yersinia pestis
uucagcucccgccgcaacaguga

SEQ ID NO: 4171563 - RNA, 14 nt, Yersinia pestis
uucagcucugccag

SEQ ID NO: 4171564 - RNA, 14 nt, Yersinia pestis
uucagcucuucaau

SEQ ID NO: 4171565 - RNA, 14 nt, Yersinia pestis
uucagcuugcaaca

SEQ ID NO: 4171566 - RNA, 17 nt, Yersinia pestis
uucagcuugcaacaaaa

SEQ ID NO: 4171567 - RNA, 20 nt, Yersinia pestis
uucaggacugucuucaacuu

SEQ ID NO: 4171568 - RNA, 21 nt, Yersinia pestis
uucaggacugucuucaacuuu

SEQ ID NO: 4171569 - RNA, 22 nt, Yersinia pestis
uucaggagauagccucaccgcc

SEQ ID NO: 4171570 - RNA, 18 nt, Yersinia pestis
uucaggaucgaucuggau

SEQ ID NO: 4171571 - RNA, 21 nt, Yersinia pestis
uucaggcacguaauaccuuaa

SEQ ID NO: 4171572 - RNA, 14 nt, Yersinia pestis
uucaggccgauacg

SEQ ID NO: 4171573 - RNA, 19 nt, Yersinia pestis
uucagggcguauaaacaga

SEQ ID NO: 4171574 - RNA, 13 nt, Yersinia pestis
uucaggguacugu

SEQ ID NO: 4171575 - RNA, 15 nt, Yersinia pestis
uucagguaauuuaua

SEQ ID NO: 4171576 - RNA, 19 nt, Yersinia pestis
uucaguaaagcgcaggaaa

SEQ ID NO: 4171577 - RNA, 19 nt, Yersinia pestis
uucaguagucagagcgcaa

SEQ ID NO: 4171578 - RNA, 15 nt, Yersinia pestis
uucagucaguaggcu

SEQ ID NO: 4171579 - RNA, 23 nt, Yersinia pestis
uucagugauaacaacccuaacac

SEQ ID NO: 4171580 - RNA, 15 nt, Yersinia pestis
uucaguggcuggaaa

SEQ ID NO: 4171581 - RNA, 15 nt, Yersinia pestis
uucaguucagaaagg

SEQ ID NO: 4171582 - RNA, 21 nt, Yersinia pestis
uucaguuuuauuguauaaaac

SEQ ID NO: 4171583 - RNA, 22 nt, Yersinia pestis
uucaguuuuauuguauaaaaca

SEQ ID NO: 4171584 - RNA, 12 nt, Yersinia pestis
uucauaaaucag

SEQ ID NO: 4171585 - RNA, 18 nt, Yersinia pestis
uucauaaauuaaaacuga

SEQ ID NO: 4171586 - RNA, 14 nt, Yersinia pestis
uucauaaucaccuu

SEQ ID NO: 4171587 - RNA, 20 nt, Yersinia pestis
uucauagcggccacgcaaug

SEQ ID NO: 4171588 - RNA, 14 nt, Yersinia pestis
uucauaugacaaau

SEQ ID NO: 4171589 - RNA, 17 nt, Yersinia pestis
uucauaugcgccuauaa

SEQ ID NO: 4171590 - RNA, 21 nt, Yersinia pestis
uucauauucaugguuucaaaa

SEQ ID NO: 4171591 - RNA, 12 nt, Yersinia pestis
uucauauuucuu

SEQ ID NO: 4171592 - RNA, 20 nt, Yersinia pestis
uucaucaaggauaagaaucu

SEQ ID NO: 4171593 - RNA, 16 nt, Yersinia pestis
uucaucaccagucagc

SEQ ID NO: 4171594 - RNA, 20 nt, Yersinia pestis
uucaucauggauaaagccuu

SEQ ID NO: 4171595 - RNA, 15 nt, Yersinia pestis
uucauccaacucacc

SEQ ID NO: 4171596 - RNA, 18 nt, Yersinia pestis
uucauccaacuuaccuug

SEQ ID NO: 4171597 - RNA, 22 nt, Yersinia pestis
uucauccaggguuuugaaauca

SEQ ID NO: 4171598 - RNA, 17 nt, Yersinia pestis
uucaucccaaucaucau

SEQ ID NO: 4171599 - RNA, 18 nt, Yersinia pestis
uucaucccaaucaucauc

SEQ ID NO: 4171600 - RNA, 23 nt, Yersinia pestis
uucaucccuuuagcgucuaacag

SEQ ID NO: 4171601 - RNA, 17 nt, Yersinia pestis
uucauccgcagcaaaac

SEQ ID NO: 4171602 - RNA, 14 nt, Yersinia pestis
uucauccguauuau

SEQ ID NO: 4171603 - RNA, 17 nt, Yersinia pestis
uucauccuaaagauaau

SEQ ID NO: 4171604 - RNA, 18 nt, Yersinia pestis
uucauccuaaagauaauu

SEQ ID NO: 4171605 - RNA, 19 nt, Yersinia pestis
uucaucggauugaacguca

SEQ ID NO: 4171606 - RNA, 17 nt, Yersinia pestis
uucaucguaucgugcag

SEQ ID NO: 4171607 - RNA, 16 nt, Yersinia pestis
uucaucucaauaacua

SEQ ID NO: 4171608 - RNA, 21 nt, Yersinia pestis
uucaucugaccaaacauuguc

SEQ ID NO: 4171609 - RNA, 15 nt, Yersinia pestis
uucaucuuucaagug

SEQ ID NO: 4171610 - RNA, 20 nt, Yersinia pestis
uucaugcuaauaccacaaca

SEQ ID NO: 4171611 - RNA, 14 nt, Yersinia pestis
uucauguugcaaca

SEQ ID NO: 4171612 - RNA, 19 nt, Yersinia pestis
uucauuaaggagugccauc

SEQ ID NO: 4171613 - RNA, 18 nt, Yersinia pestis
uucauuagcucaaauauu

SEQ ID NO: 4171614 - RNA, 13 nt, Yersinia pestis
uucauuagucaau

SEQ ID NO: 4171615 - RNA, 16 nt, Yersinia pestis
uucauucguuagcucu

SEQ ID NO: 4171616 - RNA, 21 nt, Yersinia pestis
uucauucuauuauuuaacccc

SEQ ID NO: 4171617 - RNA, 21 nt, Yersinia pestis
uucauugccgaugucaauaaa

SEQ ID NO: 4171618 - RNA, 18 nt, Yersinia pestis
uucauugguaauuucagg

SEQ ID NO: 4171619 - RNA, 14 nt, Yersinia pestis
uucauuucaggacu

SEQ ID NO: 4171620 - RNA, 12 nt, Yersinia pestis
uucauuucaggu

SEQ ID NO: 4171621 - RNA, 16 nt, Yersinia pestis
uucauuuugcuggaaa

SEQ ID NO: 4171622 - RNA, 15 nt, Yersinia pestis
uucauuuuguauuuu

SEQ ID NO: 4171623 - RNA, 22 nt, Yersinia pestis
uucauuuuuugggaugaaaaau

SEQ ID NO: 4171624 - RNA, 22 nt, Yersinia pestis
uuccaaaugacagcaucaauau

SEQ ID NO: 4171625 - RNA, 17 nt, Yersinia pestis
uuccaaccuuguaacuu

SEQ ID NO: 4171626 - RNA, 13 nt, Yersinia pestis
uuccaauaccaau

SEQ ID NO: 4171627 - RNA, 13 nt, Yersinia pestis
uuccaauauugag

SEQ ID NO: 4171628 - RNA, 22 nt, Yersinia pestis
uuccaauguugccgcuucauau

SEQ ID NO: 4171629 - RNA, 15 nt, Yersinia pestis
uuccaauucauaaua

SEQ ID NO: 4171630 - RNA, 18 nt, Yersinia pestis
uuccacaacagauggcga

SEQ ID NO: 4171631 - RNA, 16 nt, Yersinia pestis
uuccacaauguugaua

SEQ ID NO: 4171632 - RNA, 21 nt, Yersinia pestis
uuccacagguggggcaguuaa

SEQ ID NO: 4171633 - RNA, 15 nt, Yersinia pestis
uuccacccgcugcac

SEQ ID NO: 4171634 - RNA, 17 nt, Yersinia pestis
uuccagauagcgaauca

SEQ ID NO: 4171635 - RNA, 13 nt, Yersinia pestis
uuccagcagggcc

SEQ ID NO: 4171636 - RNA, 23 nt, Yersinia pestis
uuccagcgcccggcugaccuguu

SEQ ID NO: 4171637 - RNA, 19 nt, Yersinia pestis
uuccagcgcuuccacugcg

SEQ ID NO: 4171638 - RNA, 13 nt, Yersinia pestis
uuccaguaaaaaa

SEQ ID NO: 4171639 - RNA, 15 nt, Yersinia pestis
uuccaguaaaaaaau

SEQ ID NO: 4171640 - RNA, 17 nt, Yersinia pestis
uuccaguacugaccacg

SEQ ID NO: 4171641 - RNA, 15 nt, Yersinia pestis
uuccagugguuuccc

SEQ ID NO: 4171642 - RNA, 18 nt, Yersinia pestis
uuccaguucgauauuauu

SEQ ID NO: 4171643 - RNA, 23 nt, Yersinia pestis
uuccauaaacggaacucaucuuu

SEQ ID NO: 4171644 - RNA, 20 nt, Yersinia pestis
uuccauaugaacaucaaacc

SEQ ID NO: 4171645 - RNA, 19 nt, Yersinia pestis
uuccaugacacauauuuca

SEQ ID NO: 4171646 - RNA, 17 nt, Yersinia pestis
uuccaugcaaaauaugg

SEQ ID NO: 4171647 - RNA, 23 nt, Yersinia pestis
uuccaugcccagcguuggcagaa

SEQ ID NO: 4171648 - RNA, 21 nt, Yersinia pestis
uuccauuggagauccguuuuu

SEQ ID NO: 4171649 - RNA, 23 nt, Yersinia pestis
uucccaguaagcucuacuaauau

SEQ ID NO: 4171650 - RNA, 15 nt, Yersinia pestis
uucccauagacggcg

SEQ ID NO: 4171651 - RNA, 10 nt, Yersinia pestis
uucccauuua

SEQ ID NO: 4171652 - RNA, 22 nt, Yersinia pestis
uuccccaccauugcaaacauca

SEQ ID NO: 4171653 - RNA, 14 nt, Yersinia pestis
uuccccccagucac

SEQ ID NO: 4171654 - RNA, 17 nt, Yersinia pestis
uuccccuaauucuccuu

SEQ ID NO: 4171655 - RNA, 19 nt, Yersinia pestis
uucccgauggaacaggauu

SEQ ID NO: 4171656 - RNA, 20 nt, Yersinia pestis
uucccgauuauugugccgcc

SEQ ID NO: 4171657 - RNA, 23 nt, Yersinia pestis
uucccgccaaccaggucaguuuu

SEQ ID NO: 4171658 - RNA, 14 nt, Yersinia pestis
uucccgcucuucac

SEQ ID NO: 4171659 - RNA, 18 nt, Yersinia pestis
uucccguaggcugaccac

SEQ ID NO: 4171660 - RNA, 20 nt, Yersinia pestis
uucccguuagguucaauucc

SEQ ID NO: 4171661 - RNA, 16 nt, Yersinia pestis
uucccuaccguaucaa

SEQ ID NO: 4171662 - RNA, 23 nt, Yersinia pestis
uucccuacugauuggauaaaaua

SEQ ID NO: 4171663 - RNA, 24 nt, Yersinia pestis
uucccuagcgaaguauuaauauaa

SEQ ID NO: 4171664 - RNA, 20 nt, Yersinia pestis
uucccucaauagcuaauaau

SEQ ID NO: 4171665 - RNA, 19 nt, Yersinia pestis
uucccugcaauugcagacg

SEQ ID NO: 4171666 - RNA, 17 nt, Yersinia pestis
uucccuguucucuguuu

SEQ ID NO: 4171667 - RNA, 17 nt, Yersinia pestis
uuccgauaaccagaccg

SEQ ID NO: 4171668 - RNA, 20 nt, Yersinia pestis
uuccgccgccaacagugaau

SEQ ID NO: 4171669 - RNA, 15 nt, Yersinia pestis
uuccggcuuucuaua

SEQ ID NO: 4171670 - RNA, 17 nt, Yersinia pestis
uuccgucccaagaaaag

SEQ ID NO: 4171671 - RNA, 21 nt, Yersinia pestis
uuccgucccaagaaaagcacc

SEQ ID NO: 4171672 - RNA, 23 nt, Yersinia pestis
uuccguuauuaaacagucuuauu

SEQ ID NO: 4171673 - RNA, 14 nt, Yersinia pestis
uuccuaacaauauu

SEQ ID NO: 4171674 - RNA, 18 nt, Yersinia pestis
uuccuaugugauauuuua

SEQ ID NO: 4171675 - RNA, 14 nt, Yersinia pestis
uuccucaucgaaau

SEQ ID NO: 4171676 - RNA, 21 nt, Yersinia pestis
uuccucccagaauaauaagcc

SEQ ID NO: 4171677 - RNA, 15 nt, Yersinia pestis
uuccucgcaggcuug

SEQ ID NO: 4171678 - RNA, 16 nt, Yersinia pestis
uuccugaucaacugcu

SEQ ID NO: 4171679 - RNA, 20 nt, Yersinia pestis
uuccugcgccacgcuuuagc

SEQ ID NO: 4171680 - RNA, 14 nt, Yersinia pestis
uuccuguauuuccu

SEQ ID NO: 4171681 - RNA, 20 nt, Yersinia pestis
uuccuuaacgccccgccccu

SEQ ID NO: 4171682 - RNA, 16 nt, Yersinia pestis
uuccuuaccugaugug

SEQ ID NO: 4171683 - RNA, 13 nt, Yersinia pestis
uuccuuauaaauc

SEQ ID NO: 4171684 - RNA, 20 nt, Yersinia pestis
uuccuucaguucuuuaucug

SEQ ID NO: 4171685 - RNA, 13 nt, Yersinia pestis
uuccuuccucuuu

SEQ ID NO: 4171686 - RNA, 14 nt, Yersinia pestis
uuccuuugcccuua

SEQ ID NO: 4171687 - RNA, 16 nt, Yersinia pestis
uucgaaaacucaaaga

SEQ ID NO: 4171688 - RNA, 22 nt, Yersinia pestis
uucgaagggaauaaugguauuu

SEQ ID NO: 4171689 - RNA, 20 nt, Yersinia pestis
uucgaaugauugacuugacu

SEQ ID NO: 4171690 - RNA, 13 nt, Yersinia pestis
uucgacaaaaaag

SEQ ID NO: 4171691 - RNA, 17 nt, Yersinia pestis
uucgacaggcaauuauc

SEQ ID NO: 4171692 - RNA, 19 nt, Yersinia pestis
uucgacaggcaauuaucca

SEQ ID NO: 4171693 - RNA, 21 nt, Yersinia pestis
uucgacaucagguuguauuuu

SEQ ID NO: 4171694 - RNA, 13 nt, Yersinia pestis
uucgacauucucu

SEQ ID NO: 4171695 - RNA, 17 nt, Yersinia pestis
uucgaccaaacguuuua

SEQ ID NO: 4171696 - RNA, 12 nt, Yersinia pestis
uucgacggguuu

SEQ ID NO: 4171697 - RNA, 20 nt, Yersinia pestis
uucgacggguuuuaccguca

SEQ ID NO: 4171698 - RNA, 15 nt, Yersinia pestis
uucgagcaacuuuua

SEQ ID NO: 4171699 - RNA, 18 nt, Yersinia pestis
uucgaguugaacucauau

SEQ ID NO: 4171700 - RNA, 19 nt, Yersinia pestis
uucgauagucagcuucacu

SEQ ID NO: 4171701 - RNA, 13 nt, Yersinia pestis
uucgaugauuauu

SEQ ID NO: 4171702 - RNA, 18 nt, Yersinia pestis
uucgauuuuauauugaua

SEQ ID NO: 4171703 - RNA, 23 nt, Yersinia pestis
uucgcaaagcgggccagcaacca

SEQ ID NO: 4171704 - RNA, 13 nt, Yersinia pestis
uucgcaagaagcg

SEQ ID NO: 4171705 - RNA, 15 nt, Yersinia pestis
uucgcagccaaaaua

SEQ ID NO: 4171706 - RNA, 12 nt, Yersinia pestis
uucgcaggccag

SEQ ID NO: 4171707 - RNA, 17 nt, Yersinia pestis
uucgcaucuuccaaagg

SEQ ID NO: 4171708 - RNA, 21 nt, Yersinia pestis
uucgccagguucuaccgcuag

SEQ ID NO: 4171709 - RNA, 14 nt, Yersinia pestis
uucgcccacggaug

SEQ ID NO: 4171710 - RNA, 16 nt, Yersinia pestis
uucgcccuaacauuga

SEQ ID NO: 4171711 - RNA, 13 nt, Yersinia pestis
uucgcgaacacaa

SEQ ID NO: 4171712 - RNA, 17 nt, Yersinia pestis
uucgcgaucagacauuu

SEQ ID NO: 4171713 - RNA, 17 nt, Yersinia pestis
uucgcuauuucucucua

SEQ ID NO: 4171714 - RNA, 18 nt, Yersinia pestis
uucgcuauuucucucuac

SEQ ID NO: 4171715 - RNA, 19 nt, Yersinia pestis
uucgcuauuucucucuacu

SEQ ID NO: 4171716 - RNA, 17 nt, Yersinia pestis
uucgcucgcauaaaugu

SEQ ID NO: 4171717 - RNA, 18 nt, Yersinia pestis
uucgcuguaggauuucau

SEQ ID NO: 4171718 - RNA, 14 nt, Yersinia pestis
uucgcuuucaucuu

SEQ ID NO: 4171719 - RNA, 21 nt, Yersinia pestis
uucggauaaccgcauucccug

SEQ ID NO: 4171720 - RNA, 19 nt, Yersinia pestis
uucggcaggcagaaauaau

SEQ ID NO: 4171721 - RNA, 22 nt, Yersinia pestis
uucggcgacuuacgucgcuacg

SEQ ID NO: 4171722 - RNA, 22 nt, Yersinia pestis
uucggcgucccgaauaucgaaa

SEQ ID NO: 4171723 - RNA, 15 nt, Yersinia pestis
uucggcgucgccacc

SEQ ID NO: 4171724 - RNA, 15 nt, Yersinia pestis
uucggcuacuguuuu

SEQ ID NO: 4171725 - RNA, 18 nt, Yersinia pestis
uucgggcugaugaauaga

SEQ ID NO: 4171726 - RNA, 21 nt, Yersinia pestis
uucgguaaugccagcccugau

SEQ ID NO: 4171727 - RNA, 24 nt, Yersinia pestis
uucguagaguugcaguucaucaau

SEQ ID NO: 4171728 - RNA, 21 nt, Yersinia pestis
uucguauguuuuuaacaaaau

SEQ ID NO: 4171729 - RNA, 14 nt, Yersinia pestis
uucgucaccaucaa

SEQ ID NO: 4171730 - RNA, 11 nt, Yersinia pestis
uucgugaaagc

SEQ ID NO: 4171731 - RNA, 12 nt, Yersinia pestis
uucgugaaagca

SEQ ID NO: 4171732 - RNA, 21 nt, Yersinia pestis
uucguuucccccuguaaaaca

SEQ ID NO: 4171733 - RNA, 23 nt, Yersinia pestis
uucguuugggcuaagacuauuaa

SEQ ID NO: 4171734 - RNA, 23 nt, Yersinia pestis
uucuaaaugcuggcggaaauauc

SEQ ID NO: 4171735 - RNA, 19 nt, Yersinia pestis
uucuaaguaaaacaaagua

SEQ ID NO: 4171736 - RNA, 20 nt, Yersinia pestis
uucuacaaauuuuuuauauu

SEQ ID NO: 4171737 - RNA, 15 nt, Yersinia pestis
uucuaccuggcucaa

SEQ ID NO: 4171738 - RNA, 18 nt, Yersinia pestis
uucuacucugucugcugu

SEQ ID NO: 4171739 - RNA, 15 nt, Yersinia pestis
uucuagcaacauggu

SEQ ID NO: 4171740 - RNA, 17 nt, Yersinia pestis
uucuagcucuuccagca

SEQ ID NO: 4171741 - RNA, 24 nt, Yersinia pestis
uucuaguauucaggaaugcucuuu

SEQ ID NO: 4171742 - RNA, 11 nt, Yersinia pestis
uucuauaaaac

SEQ ID NO: 4171743 - RNA, 23 nt, Yersinia pestis
uucuauaaaacgcacacugcaga

SEQ ID NO: 4171744 - RNA, 15 nt, Yersinia pestis
uucuauaccaauuga

SEQ ID NO: 4171745 - RNA, 17 nt, Yersinia pestis
uucuauccgaaaaauau

SEQ ID NO: 4171746 - RNA, 23 nt, Yersinia pestis
uucuaucgggcagguaaauccuu

SEQ ID NO: 4171747 - RNA, 18 nt, Yersinia pestis
uucucaacagcaucauca

SEQ ID NO: 4171748 - RNA, 15 nt, Yersinia pestis
uucucaaucucaaaa

SEQ ID NO: 4171749 - RNA, 17 nt, Yersinia pestis
uucucaauggcuuuuuu

SEQ ID NO: 4171750 - RNA, 11 nt, Yersinia pestis
uucucaccaag

SEQ ID NO: 4171751 - RNA, 12 nt, Yersinia pestis
uucucacucuau

SEQ ID NO: 4171752 - RNA, 21 nt, Yersinia pestis
uucucagguguuacacaguua

SEQ ID NO: 4171753 - RNA, 12 nt, Yersinia pestis
uucucaucauca

SEQ ID NO: 4171754 - RNA, 16 nt, Yersinia pestis
uucucaucgcuuuuuu

SEQ ID NO: 4171755 - RNA, 14 nt, Yersinia pestis
uucucauuaauaau

SEQ ID NO: 4171756 - RNA, 13 nt, Yersinia pestis
uucuccaacaacu

SEQ ID NO: 4171757 - RNA, 19 nt, Yersinia pestis
uucuccaacaacugccccu

SEQ ID NO: 4171758 - RNA, 14 nt, Yersinia pestis
uucuccgauucacc

SEQ ID NO: 4171759 - RNA, 18 nt, Yersinia pestis
uucuccugcgguggccag

SEQ ID NO: 4171760 - RNA, 23 nt, Yersinia pestis
uucuccugcgguggccagagcau

SEQ ID NO: 4171761 - RNA, 17 nt, Yersinia pestis
uucuccuuugauuugaa

SEQ ID NO: 4171762 - RNA, 13 nt, Yersinia pestis
uucucuccuaaaa

SEQ ID NO: 4171763 - RNA, 22 nt, Yersinia pestis
uucucugaugaacggagaugau

SEQ ID NO: 4171764 - RNA, 14 nt, Yersinia pestis
uucucugcucgcau

SEQ ID NO: 4171765 - RNA, 13 nt, Yersinia pestis
uucucuuggcuga

SEQ ID NO: 4171766 - RNA, 15 nt, Yersinia pestis
uucucuuucagcucu

SEQ ID NO: 4171767 - RNA, 21 nt, Yersinia pestis
uucucuuuccgcucagcaucu

SEQ ID NO: 4171768 - RNA, 16 nt, Yersinia pestis
uucugaaaccccaaag

SEQ ID NO: 4171769 - RNA, 18 nt, Yersinia pestis
uucugaacaaaauaguca

SEQ ID NO: 4171770 - RNA, 17 nt, Yersinia pestis
uucugaacgaccagaau

SEQ ID NO: 4171771 - RNA, 14 nt, Yersinia pestis
uucugaagaugcca

SEQ ID NO: 4171772 - RNA, 21 nt, Yersinia pestis
uucugacgccaccauuccgcc

SEQ ID NO: 4171773 - RNA, 23 nt, Yersinia pestis
uucugacgggacaaucuguuccu

SEQ ID NO: 4171774 - RNA, 14 nt, Yersinia pestis
uucugauaaaacag

SEQ ID NO: 4171775 - RNA, 17 nt, Yersinia pestis
uucugcauaagcaucag

SEQ ID NO: 4171776 - RNA, 15 nt, Yersinia pestis
uucugccuauccuca

SEQ ID NO: 4171777 - RNA, 17 nt, Yersinia pestis
uucugccuauccucacc

SEQ ID NO: 4171778 - RNA, 14 nt, Yersinia pestis
uucugcgacuuuau

SEQ ID NO: 4171779 - RNA, 12 nt, Yersinia pestis
uucugcgggagu

SEQ ID NO: 4171780 - RNA, 12 nt, Yersinia pestis
uucugcuuggac

SEQ ID NO: 4171781 - RNA, 23 nt, Yersinia pestis
uucuggaaugagaugaacacaga

SEQ ID NO: 4171782 - RNA, 23 nt, Yersinia pestis
uucuggggcgguuuuccucuuua

SEQ ID NO: 4171783 - RNA, 21 nt, Yersinia pestis
uucuguagcugacacgccaua

SEQ ID NO: 4171784 - RNA, 14 nt, Yersinia pestis
uucuguagugccgc

SEQ ID NO: 4171785 - RNA, 23 nt, Yersinia pestis
uucuguagugccgccagugcuuc

SEQ ID NO: 4171786 - RNA, 13 nt, Yersinia pestis
uucugucaucaag

SEQ ID NO: 4171787 - RNA, 13 nt, Yersinia pestis
uucuguucagauu

SEQ ID NO: 4171788 - RNA, 15 nt, Yersinia pestis
uucuuaauaccuaaa

SEQ ID NO: 4171789 - RNA, 21 nt, Yersinia pestis
uucuuaauaccuaaaauuauc

SEQ ID NO: 4171790 - RNA, 15 nt, Yersinia pestis
uucuuacuaaaauau

SEQ ID NO: 4171791 - RNA, 18 nt, Yersinia pestis
uucuuacuaaaauaucac

SEQ ID NO: 4171792 - RNA, 14 nt, Yersinia pestis
uucuuacuguuuuc

SEQ ID NO: 4171793 - RNA, 17 nt, Yersinia pestis
uucuuaggucaucguca

SEQ ID NO: 4171794 - RNA, 14 nt, Yersinia pestis
uucuuagugcuaca

SEQ ID NO: 4171795 - RNA, 21 nt, Yersinia pestis
uucuucagcgauacguguaaa

SEQ ID NO: 4171796 - RNA, 22 nt, Yersinia pestis
uucuucagcgguagagaucucu

SEQ ID NO: 4171797 - RNA, 19 nt, Yersinia pestis
uucuucauaacgcuuuuuc

SEQ ID NO: 4171798 - RNA, 15 nt, Yersinia pestis
uucuucauugcugcu

SEQ ID NO: 4171799 - RNA, 11 nt, Yersinia pestis
uucuuccaacg

SEQ ID NO: 4171800 - RNA, 22 nt, Yersinia pestis
uucuuccaccauccccugucuu

SEQ ID NO: 4171801 - RNA, 14 nt, Yersinia pestis
uucuuccacuucgc

SEQ ID NO: 4171802 - RNA, 14 nt, Yersinia pestis
uucuucgaucaacg

SEQ ID NO: 4171803 - RNA, 17 nt, Yersinia pestis
uucuugaaaaaauaaau

SEQ ID NO: 4171804 - RNA, 14 nt, Yersinia pestis
uucuugauaccaua

SEQ ID NO: 4171805 - RNA, 22 nt, Yersinia pestis
uucuugucaccugaguaauauu

SEQ ID NO: 4171806 - RNA, 18 nt, Yersinia pestis
uucuuuacgguuaaaaca

SEQ ID NO: 4171807 - RNA, 22 nt, Yersinia pestis
uucuuuacgguuaaaacaguaa

SEQ ID NO: 4171808 - RNA, 13 nt, Yersinia pestis
uucuuucaacgca

SEQ ID NO: 4171809 - RNA, 13 nt, Yersinia pestis
uucuuucucgaua

SEQ ID NO: 4171810 - RNA, 11 nt, Yersinia pestis
uucuuucuuca

SEQ ID NO: 4171811 - RNA, 16 nt, Yersinia pestis
uucuuucuucagcggu

SEQ ID NO: 4171812 - RNA, 17 nt, Yersinia pestis
uucuuuugcuguauuuu

SEQ ID NO: 4171813 - RNA, 16 nt, Yersinia pestis
uugaaaaaauaaaugc

SEQ ID NO: 4171814 - RNA, 12 nt, Yersinia pestis
uugaaacagcag

SEQ ID NO: 4171815 - RNA, 17 nt, Yersinia pestis
uugaaacagcaggggcg

SEQ ID NO: 4171816 - RNA, 21 nt, Yersinia pestis
uugaaaccuacaucacaccca

SEQ ID NO: 4171817 - RNA, 19 nt, Yersinia pestis
uugaaacuuuccugacccg

SEQ ID NO: 4171818 - RNA, 16 nt, Yersinia pestis
uugaaauaacugccag

SEQ ID NO: 4171819 - RNA, 24 nt, Yersinia pestis
uugaaauacuccuugaauagccag

SEQ ID NO: 4171820 - RNA, 14 nt, Yersinia pestis
uugaaaucagauca

SEQ ID NO: 4171821 - RNA, 16 nt, Yersinia pestis
uugaaaugauaacaau

SEQ ID NO: 4171822 - RNA, 20 nt, Yersinia pestis
uugaaauguccacuguacag

SEQ ID NO: 4171823 - RNA, 18 nt, Yersinia pestis
uugaacauucaucuuuug

SEQ ID NO: 4171824 - RNA, 20 nt, Yersinia pestis
uugaaccaauuuuucuguau

SEQ ID NO: 4171825 - RNA, 22 nt, Yersinia pestis
uugaaccgcuaucugcugacca

SEQ ID NO: 4171826 - RNA, 20 nt, Yersinia pestis
uugaaccguaugcuuucauc

SEQ ID NO: 4171827 - RNA, 20 nt, Yersinia pestis
uugaacgacaugugaguggu

SEQ ID NO: 4171828 - RNA, 23 nt, Yersinia pestis
uugaacuucgaaagaaauaaaag

SEQ ID NO: 4171829 - RNA, 16 nt, Yersinia pestis
uugaagauuuaaauaa

SEQ ID NO: 4171830 - RNA, 16 nt, Yersinia pestis
uugaagcgcucaagua

SEQ ID NO: 4171831 - RNA, 22 nt, Yersinia pestis
uugaaguacggugccagcagca

SEQ ID NO: 4171832 - RNA, 16 nt, Yersinia pestis
uugaauauuuuuaauc

SEQ ID NO: 4171833 - RNA, 17 nt, Yersinia pestis
uugaauauuuuuaaucu

SEQ ID NO: 4171834 - RNA, 17 nt, Yersinia pestis
uugacacgagagauaau

SEQ ID NO: 4171835 - RNA, 12 nt, Yersinia pestis
uugacagcaucu

SEQ ID NO: 4171836 - RNA, 14 nt, Yersinia pestis
uugacauuuccuug

SEQ ID NO: 4171837 - RNA, 14 nt, Yersinia pestis
uugaccaacugucg

SEQ ID NO: 4171838 - RNA, 17 nt, Yersinia pestis
uugaccaauaaaaugca

SEQ ID NO: 4171839 - RNA, 19 nt, Yersinia pestis
uugaccgacgcugaacuga

SEQ ID NO: 4171840 - RNA, 20 nt, Yersinia pestis
uugaccuugguaaauaccaa

SEQ ID NO: 4171841 - RNA, 13 nt, Yersinia pestis
uugacgaauuaaa

SEQ ID NO: 4171842 - RNA, 23 nt, Yersinia pestis
uugacgguucgaaaauaaugaau

SEQ ID NO: 4171843 - RNA, 17 nt, Yersinia pestis
uugacgguuuucugaau

SEQ ID NO: 4171844 - RNA, 20 nt, Yersinia pestis
uugacugaccauaaaaggau

SEQ ID NO: 4171845 - RNA, 20 nt, Yersinia pestis
uugacuucggucaagaugcc

SEQ ID NO: 4171846 - RNA, 17 nt, Yersinia pestis
uugacuuuaaaaaaauu

SEQ ID NO: 4171847 - RNA, 13 nt, Yersinia pestis
uugacuuuaauua

SEQ ID NO: 4171848 - RNA, 18 nt, Yersinia pestis
uugacuuuuuuuaaccaa

SEQ ID NO: 4171849 - RNA, 13 nt, Yersinia pestis
uugagaaauauuu

SEQ ID NO: 4171850 - RNA, 13 nt, Yersinia pestis
uugagaaaugaau

SEQ ID NO: 4171851 - RNA, 20 nt, Yersinia pestis
uugagaaguuauucauugcc

SEQ ID NO: 4171852 - RNA, 20 nt, Yersinia pestis
uugagaauuaaggaaacuca

SEQ ID NO: 4171853 - RNA, 22 nt, Yersinia pestis
uugagauagucauuuuauuuag

SEQ ID NO: 4171854 - RNA, 21 nt, Yersinia pestis
uugagcaaaaauauacccgac

SEQ ID NO: 4171855 - RNA, 11 nt, Yersinia pestis
uugagcagcaa

SEQ ID NO: 4171856 - RNA, 22 nt, Yersinia pestis
uugagccaccgagguuaucagc

SEQ ID NO: 4171857 - RNA, 22 nt, Yersinia pestis
uugagccuacgucugaaaaaca

SEQ ID NO: 4171858 - RNA, 16 nt, Yersinia pestis
uugaggagcgauaaca

SEQ ID NO: 4171859 - RNA, 19 nt, Yersinia pestis
uugaggagcgauaacauuu

SEQ ID NO: 4171860 - RNA, 23 nt, Yersinia pestis
uugaguacgcuaagacauuagga

SEQ ID NO: 4171861 - RNA, 22 nt, Yersinia pestis
uugaguagcaggccgacaauac

SEQ ID NO: 4171862 - RNA, 23 nt, Yersinia pestis
uugaguagcaggccgacaauacc

SEQ ID NO: 4171863 - RNA, 17 nt, Yersinia pestis
uugaguaguaaaaccua

SEQ ID NO: 4171864 - RNA, 14 nt, Yersinia pestis
uugaguauacuaaa

SEQ ID NO: 4171865 - RNA, 21 nt, Yersinia pestis
uugaguauuucuuucacuucc

SEQ ID NO: 4171866 - RNA, 18 nt, Yersinia pestis
uugagucgcgacaucaug

SEQ ID NO: 4171867 - RNA, 19 nt, Yersinia pestis
uugagugccgugucuucca

SEQ ID NO: 4171868 - RNA, 13 nt, Yersinia pestis
uugauaaucucca

SEQ ID NO: 4171869 - RNA, 13 nt, Yersinia pestis
uugauaauggcau

SEQ ID NO: 4171870 - RNA, 19 nt, Yersinia pestis
uugauacggcuuacuuuua

SEQ ID NO: 4171871 - RNA, 14 nt, Yersinia pestis
uugauauaccgauu

SEQ ID NO: 4171872 - RNA, 13 nt, Yersinia pestis
uugauauauagaa

SEQ ID NO: 4171873 - RNA, 15 nt, Yersinia pestis
uugauauauagaaau

SEQ ID NO: 4171874 - RNA, 19 nt, Yersinia pestis
uugauaucaauauccgcau

SEQ ID NO: 4171875 - RNA, 18 nt, Yersinia pestis
uugauaucuucggcggcu

SEQ ID NO: 4171876 - RNA, 16 nt, Yersinia pestis
uugauauuauuuauau

SEQ ID NO: 4171877 - RNA, 22 nt, Yersinia pestis
uugaucaguaaacgguugcugu

SEQ ID NO: 4171878 - RNA, 22 nt, Yersinia pestis
uugauccaaauggcugcguucu

SEQ ID NO: 4171879 - RNA, 22 nt, Yersinia pestis
uugauccucguuagucacucaa

SEQ ID NO: 4171880 - RNA, 14 nt, Yersinia pestis
uugaugaaguuauu

SEQ ID NO: 4171881 - RNA, 16 nt, Yersinia pestis
uugaugaguaaacaga

SEQ ID NO: 4171882 - RNA, 15 nt, Yersinia pestis
uugaugaugagcgca

SEQ ID NO: 4171883 - RNA, 14 nt, Yersinia pestis
uugaugccaaggcc

SEQ ID NO: 4171884 - RNA, 18 nt, Yersinia pestis
uugaugcuaauuucaucu

SEQ ID NO: 4171885 - RNA, 18 nt, Yersinia pestis
uugaugcucauuuaaaau

SEQ ID NO: 4171886 - RNA, 20 nt, Yersinia pestis
uugaugguuauguguauuug

SEQ ID NO: 4171887 - RNA, 22 nt, Yersinia pestis
uugauguaagcugggaaggcgu

SEQ ID NO: 4171888 - RNA, 23 nt, Yersinia pestis
uugaugucgggugguugucuaug

SEQ ID NO: 4171889 - RNA, 15 nt, Yersinia pestis
uugauuaaaucagac

SEQ ID NO: 4171890 - RNA, 22 nt, Yersinia pestis
uugauuaacauccauuguauug

SEQ ID NO: 4171891 - RNA, 19 nt, Yersinia pestis
uugauuaccaauaauuaau

SEQ ID NO: 4171892 - RNA, 20 nt, Yersinia pestis
uugauuaggcaugauaagca

SEQ ID NO: 4171893 - RNA, 16 nt, Yersinia pestis
uugauuauaugcguuu

SEQ ID NO: 4171894 - RNA, 15 nt, Yersinia pestis
uugauuaucaaguua

SEQ ID NO: 4171895 - RNA, 19 nt, Yersinia pestis
uugauucaaaaugccaguc

SEQ ID NO: 4171896 - RNA, 22 nt, Yersinia pestis
uugauucaaaaugccagucaau

SEQ ID NO: 4171897 - RNA, 12 nt, Yersinia pestis
uugauucaccag

SEQ ID NO: 4171898 - RNA, 13 nt, Yersinia pestis
uugauugauaacg

SEQ ID NO: 4171899 - RNA, 18 nt, Yersinia pestis
uugauuggcucaugcuua

SEQ ID NO: 4171900 - RNA, 14 nt, Yersinia pestis
uugauuggcuccua

SEQ ID NO: 4171901 - RNA, 13 nt, Yersinia pestis
uugauuuaaauau

SEQ ID NO: 4171902 - RNA, 14 nt, Yersinia pestis
uugauuuuauauug

SEQ ID NO: 4171903 - RNA, 19 nt, Yersinia pestis
uugcaacaacgccagauaa

SEQ ID NO: 4171904 - RNA, 18 nt, Yersinia pestis
uugcaacugagucgcuug

SEQ ID NO: 4171905 - RNA, 23 nt, Yersinia pestis
uugcaacugggcgacaaucaaug

SEQ ID NO: 4171906 - RNA, 21 nt, Yersinia pestis
uugcaaugcuuauuucacacu

SEQ ID NO: 4171907 - RNA, 21 nt, Yersinia pestis
uugcaauuaauuggcccauaa

SEQ ID NO: 4171908 - RNA, 18 nt, Yersinia pestis
uugcaauucauguugcca

SEQ ID NO: 4171909 - RNA, 15 nt, Yersinia pestis
uugcaauuguuuuac

SEQ ID NO: 4171910 - RNA, 17 nt, Yersinia pestis
uugcacacgauuaccug

SEQ ID NO: 4171911 - RNA, 20 nt, Yersinia pestis
uugcacuuuuacugguucau

SEQ ID NO: 4171912 - RNA, 14 nt, Yersinia pestis
uugcagacugcuga

SEQ ID NO: 4171913 - RNA, 22 nt, Yersinia pestis
uugcagagguugcgcacaauca

SEQ ID NO: 4171914 - RNA, 20 nt, Yersinia pestis
uugcagauaccacaucaaac

SEQ ID NO: 4171915 - RNA, 22 nt, Yersinia pestis
uugcagcaagccgauaaucaau

SEQ ID NO: 4171916 - RNA, 13 nt, Yersinia pestis
uugcaggucugca

SEQ ID NO: 4171917 - RNA, 16 nt, Yersinia pestis
uugcagucgcuucauc

SEQ ID NO: 4171918 - RNA, 17 nt, Yersinia pestis
uugcaguucaucaauaa

SEQ ID NO: 4171919 - RNA, 22 nt, Yersinia pestis
uugcauacucaggcccugagau

SEQ ID NO: 4171920 - RNA, 14 nt, Yersinia pestis
uugcauaucagcaa

SEQ ID NO: 4171921 - RNA, 20 nt, Yersinia pestis
uugcauauguagccagauaa

SEQ ID NO: 4171922 - RNA, 14 nt, Yersinia pestis
uugcauauuucucu

SEQ ID NO: 4171923 - RNA, 18 nt, Yersinia pestis
uugcaucaccaucauuac

SEQ ID NO: 4171924 - RNA, 14 nt, Yersinia pestis
uugcaucuuuaauu

SEQ ID NO: 4171925 - RNA, 15 nt, Yersinia pestis
uugcaucuuuaauua

SEQ ID NO: 4171926 - RNA, 23 nt, Yersinia pestis
uugcaugaaaucaguguauuacu

SEQ ID NO: 4171927 - RNA, 20 nt, Yersinia pestis
uugccaaaugcaaaccaggc

SEQ ID NO: 4171928 - RNA, 15 nt, Yersinia pestis
uugccacauuucccu

SEQ ID NO: 4171929 - RNA, 22 nt, Yersinia pestis
uugccacgccaguaaacagcca

SEQ ID NO: 4171930 - RNA, 16 nt, Yersinia pestis
uugccagccaggauag

SEQ ID NO: 4171931 - RNA, 18 nt, Yersinia pestis
uugccagugaaucagcca

SEQ ID NO: 4171932 - RNA, 19 nt, Yersinia pestis
uugccagugcaugcagguc

SEQ ID NO: 4171933 - RNA, 23 nt, Yersinia pestis
uugccauaagcgacgacauuaau

SEQ ID NO: 4171934 - RNA, 21 nt, Yersinia pestis
uugccaucuuguucuaauaau

SEQ ID NO: 4171935 - RNA, 21 nt, Yersinia pestis
uugcccaaucuaacuggcccu

SEQ ID NO: 4171936 - RNA, 15 nt, Yersinia pestis
uugcccaauggcaaa

SEQ ID NO: 4171937 - RNA, 16 nt, Yersinia pestis
uugcccaauggcaaaa

SEQ ID NO: 4171938 - RNA, 15 nt, Yersinia pestis
uugcccccaucacua

SEQ ID NO: 4171939 - RNA, 15 nt, Yersinia pestis
uugcccccugcucca

SEQ ID NO: 4171940 - RNA, 20 nt, Yersinia pestis
uugcccgcgcuuccaggcug

SEQ ID NO: 4171941 - RNA, 21 nt, Yersinia pestis
uugcccgcgcuuccaggcuga

SEQ ID NO: 4171942 - RNA, 16 nt, Yersinia pestis
uugcccugcaauaccg

SEQ ID NO: 4171943 - RNA, 20 nt, Yersinia pestis
uugcccuggagcaagauuuu

SEQ ID NO: 4171944 - RNA, 13 nt, Yersinia pestis
uugcccuucagau

SEQ ID NO: 4171945 - RNA, 14 nt, Yersinia pestis
uugcccuucuucag

SEQ ID NO: 4171946 - RNA, 15 nt, Yersinia pestis
uugccgccgggcagc

SEQ ID NO: 4171947 - RNA, 16 nt, Yersinia pestis
uugccgccuuccugcu

SEQ ID NO: 4171948 - RNA, 17 nt, Yersinia pestis
uugccggaagagaagca

SEQ ID NO: 4171949 - RNA, 23 nt, Yersinia pestis
uugccguuugaugcgcugagcaa

SEQ ID NO: 4171950 - RNA, 15 nt, Yersinia pestis
uugccuacuaccaaa

SEQ ID NO: 4171951 - RNA, 12 nt, Yersinia pestis
uugccuggccca

SEQ ID NO: 4171952 - RNA, 17 nt, Yersinia pestis
uugccuggcccaucuau

SEQ ID NO: 4171953 - RNA, 20 nt, Yersinia pestis
uugccuggccccguuguccc

SEQ ID NO: 4171954 - RNA, 19 nt, Yersinia pestis
uugccuucugcugccagcu

SEQ ID NO: 4171955 - RNA, 15 nt, Yersinia pestis
uugcgaccaauaccg

SEQ ID NO: 4171956 - RNA, 14 nt, Yersinia pestis
uugcgccacaaccc

SEQ ID NO: 4171957 - RNA, 19 nt, Yersinia pestis
uugcgccacaacccaauaa

SEQ ID NO: 4171958 - RNA, 17 nt, Yersinia pestis
uugcgccauacaguuaa

SEQ ID NO: 4171959 - RNA, 19 nt, Yersinia pestis
uugcgccauacaguuaauu

SEQ ID NO: 4171960 - RNA, 21 nt, Yersinia pestis
uugcgccgaaauaaaaccauc

SEQ ID NO: 4171961 - RNA, 13 nt, Yersinia pestis
uugcgccgcuuug

SEQ ID NO: 4171962 - RNA, 14 nt, Yersinia pestis
uugcgccgcuuugc

SEQ ID NO: 4171963 - RNA, 21 nt, Yersinia pestis
uugcgcucugacuacugaaac

SEQ ID NO: 4171964 - RNA, 18 nt, Yersinia pestis
uugcgcuucuuguugagu

SEQ ID NO: 4171965 - RNA, 20 nt, Yersinia pestis
uugcggaagguauccaauac

SEQ ID NO: 4171966 - RNA, 22 nt, Yersinia pestis
uugcggaguaacacuucagacu

SEQ ID NO: 4171967 - RNA, 13 nt, Yersinia pestis
uugcggaucacau

SEQ ID NO: 4171968 - RNA, 22 nt, Yersinia pestis
uugcggcgcacccuccaauaau

SEQ ID NO: 4171969 - RNA, 21 nt, Yersinia pestis
uugcgggcucuuugucaauaa

SEQ ID NO: 4171970 - RNA, 14 nt, Yersinia pestis
uugcgucaccaggc

SEQ ID NO: 4171971 - RNA, 13 nt, Yersinia pestis
uugcgugcaauaa

SEQ ID NO: 4171972 - RNA, 20 nt, Yersinia pestis
uugcuaaauuuuguacaacu

SEQ ID NO: 4171973 - RNA, 18 nt, Yersinia pestis
uugcuauuaaacauuuau

SEQ ID NO: 4171974 - RNA, 18 nt, Yersinia pestis
uugcuauugaacauucau

SEQ ID NO: 4171975 - RNA, 23 nt, Yersinia pestis
uugcucacccauuuuauccucuu

SEQ ID NO: 4171976 - RNA, 16 nt, Yersinia pestis
uugcucagcgcaucaa

SEQ ID NO: 4171977 - RNA, 19 nt, Yersinia pestis
uugcuccaguugauacagg

SEQ ID NO: 4171978 - RNA, 16 nt, Yersinia pestis
uugcucccaucccuca

SEQ ID NO: 4171979 - RNA, 22 nt, Yersinia pestis
uugcuccgacaauaacgcugaa

SEQ ID NO: 4171980 - RNA, 11 nt, Yersinia pestis
uugcugaauca

SEQ ID NO: 4171981 - RNA, 18 nt, Yersinia pestis
uugcugaguggacgauaa

SEQ ID NO: 4171982 - RNA, 21 nt, Yersinia pestis
uugcugaguggacgauaaauu

SEQ ID NO: 4171983 - RNA, 14 nt, Yersinia pestis
uugcugcaaccacu

SEQ ID NO: 4171984 - RNA, 22 nt, Yersinia pestis
uugcugcaacgcagacaugauu

SEQ ID NO: 4171985 - RNA, 20 nt, Yersinia pestis
uugcugcaacgccaaugacg

SEQ ID NO: 4171986 - RNA, 15 nt, Yersinia pestis
uugcugccaacggcu

SEQ ID NO: 4171987 - RNA, 21 nt, Yersinia pestis
uugcugcuguuauuacuguca

SEQ ID NO: 4171988 - RNA, 14 nt, Yersinia pestis
uugcuggcuaucau

SEQ ID NO: 4171989 - RNA, 19 nt, Yersinia pestis
uugcuggcuaucaucccuu

SEQ ID NO: 4171990 - RNA, 22 nt, Yersinia pestis
uugcuguaaacaucgacaccaa

SEQ ID NO: 4171991 - RNA, 18 nt, Yersinia pestis
uugcuguaaugccuggug

SEQ ID NO: 4171992 - RNA, 21 nt, Yersinia pestis
uugcuguuguuauuacuguca

SEQ ID NO: 4171993 - RNA, 14 nt, Yersinia pestis
uugcuuaucgucaa

SEQ ID NO: 4171994 - RNA, 17 nt, Yersinia pestis
uugcuucgauuuuauau

SEQ ID NO: 4171995 - RNA, 18 nt, Yersinia pestis
uugcuugauagcgggcag

SEQ ID NO: 4171996 - RNA, 14 nt, Yersinia pestis
uugcuugauuaccu

SEQ ID NO: 4171997 - RNA, 15 nt, Yersinia pestis
uugcuugcugccugc

SEQ ID NO: 4171998 - RNA, 23 nt, Yersinia pestis
uugcuuugggcuaucgccuucau

SEQ ID NO: 4171999 - RNA, 15 nt, Yersinia pestis
uugcuuuuugccagu

SEQ ID NO: 4172000 - RNA, 14 nt, Yersinia pestis
uuggaaaacagcaa

SEQ ID NO: 4172001 - RNA, 20 nt, Yersinia pestis
uuggaaaugacaaaucagcg

SEQ ID NO: 4172002 - RNA, 16 nt, Yersinia pestis
uuggacuaaccccaau

SEQ ID NO: 4172003 - RNA, 14 nt, Yersinia pestis
uuggacucuggaau

SEQ ID NO: 4172004 - RNA, 15 nt, Yersinia pestis
uuggauaaaauauua

SEQ ID NO: 4172005 - RNA, 17 nt, Yersinia pestis
uuggaucaggaucacca

SEQ ID NO: 4172006 - RNA, 17 nt, Yersinia pestis
uuggaucaucgggaaca

SEQ ID NO: 4172007 - RNA, 20 nt, Yersinia pestis
uuggauccgguugccagcca

SEQ ID NO: 4172008 - RNA, 16 nt, Yersinia pestis
uuggauuggucagguu

SEQ ID NO: 4172009 - RNA, 17 nt, Yersinia pestis
uuggcaaaggccagcgc

SEQ ID NO: 4172010 - RNA, 17 nt, Yersinia pestis
uuggcaaagucaucaaa

SEQ ID NO: 4172011 - RNA, 23 nt, Yersinia pestis
uuggcaaauucaacaaucaauca

SEQ ID NO: 4172012 - RNA, 18 nt, Yersinia pestis
uuggcaggugaagaaaag

SEQ ID NO: 4172013 - RNA, 15 nt, Yersinia pestis
uuggcaugacaucag

SEQ ID NO: 4172014 - RNA, 15 nt, Yersinia pestis
uuggcauguucacau

SEQ ID NO: 4172015 - RNA, 23 nt, Yersinia pestis
uuggcauuaaacugaauaucccc

SEQ ID NO: 4172016 - RNA, 14 nt, Yersinia pestis
uuggccacuggccu

SEQ ID NO: 4172017 - RNA, 21 nt, Yersinia pestis
uuggccauuaaccuaaaaacg

SEQ ID NO: 4172018 - RNA, 13 nt, Yersinia pestis
uuggcccaaucga

SEQ ID NO: 4172019 - RNA, 22 nt, Yersinia pestis
uuggcccacuggccugagaacc

SEQ ID NO: 4172020 - RNA, 16 nt, Yersinia pestis
uuggccgggacuccag

SEQ ID NO: 4172021 - RNA, 12 nt, Yersinia pestis
uuggccguugau

SEQ ID NO: 4172022 - RNA, 18 nt, Yersinia pestis
uuggcggaagacuuccag

SEQ ID NO: 4172023 - RNA, 16 nt, Yersinia pestis
uuggcguagcuugauu

SEQ ID NO: 4172024 - RNA, 18 nt, Yersinia pestis
uuggcuaaaccacggcgu

SEQ ID NO: 4172025 - RNA, 15 nt, Yersinia pestis
uuggcuaaauaacca

SEQ ID NO: 4172026 - RNA, 17 nt, Yersinia pestis
uuggcuaaauaaccaga

SEQ ID NO: 4172027 - RNA, 14 nt, Yersinia pestis
uuggcucaugguug

SEQ ID NO: 4172028 - RNA, 23 nt, Yersinia pestis
uuggcucgugaucagcagacuca

SEQ ID NO: 4172029 - RNA, 14 nt, Yersinia pestis
uuggcuucuggaug

SEQ ID NO: 4172030 - RNA, 18 nt, Yersinia pestis
uuggcuuggacagaaaac

SEQ ID NO: 4172031 - RNA, 16 nt, Yersinia pestis
uugggcaucaacgccc

SEQ ID NO: 4172032 - RNA, 13 nt, Yersinia pestis
uugggcuaaaacu

SEQ ID NO: 4172033 - RNA, 16 nt, Yersinia pestis
uugggcuugagcagug

SEQ ID NO: 4172034 - RNA, 23 nt, Yersinia pestis
uugggcuugagcagugcgcggcg

SEQ ID NO: 4172035 - RNA, 21 nt, Yersinia pestis
uugggguauauauuuuuaauu

SEQ ID NO: 4172036 - RNA, 13 nt, Yersinia pestis
uuggguauaggcc

SEQ ID NO: 4172037 - RNA, 17 nt, Yersinia pestis
uuggguauaugacugug

SEQ ID NO: 4172038 - RNA, 16 nt, Yersinia pestis
uugggucaguuuuauu

SEQ ID NO: 4172039 - RNA, 23 nt, Yersinia pestis
uugggugacaacgucacuuccau

SEQ ID NO: 4172040 - RNA, 22 nt, Yersinia pestis
uuggguuugagcagugcgcggc

SEQ ID NO: 4172041 - RNA, 20 nt, Yersinia pestis
uugguaaaaccgguuuuggu

SEQ ID NO: 4172042 - RNA, 18 nt, Yersinia pestis
uugguaauacugagaccu

SEQ ID NO: 4172043 - RNA, 15 nt, Yersinia pestis
uuggucaauaaaauu

SEQ ID NO: 4172044 - RNA, 19 nt, Yersinia pestis
uuggucaguugaauauucc

SEQ ID NO: 4172045 - RNA, 14 nt, Yersinia pestis
uuggucucagaaca

SEQ ID NO: 4172046 - RNA, 17 nt, Yersinia pestis
uuggucucagaacaaga

SEQ ID NO: 4172047 - RNA, 18 nt, Yersinia pestis
uuggucuuaucagcggua

SEQ ID NO: 4172048 - RNA, 17 nt, Yersinia pestis
uuggugacaaacgcuug

SEQ ID NO: 4172049 - RNA, 22 nt, Yersinia pestis
uuggugccgcuggcauacaguu

SEQ ID NO: 4172050 - RNA, 22 nt, Yersinia pestis
uuggugucccaaacucuggaug

SEQ ID NO: 4172051 - RNA, 20 nt, Yersinia pestis
uugguguguaauuuuuacau

SEQ ID NO: 4172052 - RNA, 15 nt, Yersinia pestis
uugguguugcaaaac

SEQ ID NO: 4172053 - RNA, 23 nt, Yersinia pestis
uugguuagcgccuuuuuuauaau

SEQ ID NO: 4172054 - RNA, 13 nt, Yersinia pestis
uugguugcaagua

SEQ ID NO: 4172055 - RNA, 11 nt, Yersinia pestis
uugguuuauaa

SEQ ID NO: 4172056 - RNA, 14 nt, Yersinia pestis
uugguuuauaacaa

SEQ ID NO: 4172057 - RNA, 23 nt, Yersinia pestis
uuguaacuuuaguaggucacaua

SEQ ID NO: 4172058 - RNA, 20 nt, Yersinia pestis
uuguaagcgauccugcucaa

SEQ ID NO: 4172059 - RNA, 22 nt, Yersinia pestis
uuguaauuguauuauaugcgcu

SEQ ID NO: 4172060 - RNA, 20 nt, Yersinia pestis
uuguaccaccaaaccccucg

SEQ ID NO: 4172061 - RNA, 19 nt, Yersinia pestis
uuguaccgauuuacguguu

SEQ ID NO: 4172062 - RNA, 14 nt, Yersinia pestis
uuguaccuguuuuu

SEQ ID NO: 4172063 - RNA, 12 nt, Yersinia pestis
uuguagcaaacc

SEQ ID NO: 4172064 - RNA, 18 nt, Yersinia pestis
uuguagcccacugacacu

SEQ ID NO: 4172065 - RNA, 19 nt, Yersinia pestis
uuguagcccacugacacug

SEQ ID NO: 4172066 - RNA, 12 nt, Yersinia pestis
uuguagcgccag

SEQ ID NO: 4172067 - RNA, 17 nt, Yersinia pestis
uuguagguuaugacacc

SEQ ID NO: 4172068 - RNA, 14 nt, Yersinia pestis
uuguagugaaugac

SEQ ID NO: 4172069 - RNA, 14 nt, Yersinia pestis
uuguauagucucca

SEQ ID NO: 4172070 - RNA, 12 nt, Yersinia pestis
uuguaugacaag

SEQ ID NO: 4172071 - RNA, 20 nt, Yersinia pestis
uuguauuaccgauaaaggcc

SEQ ID NO: 4172072 - RNA, 19 nt, Yersinia pestis
uuguauugauaaaaauauc

SEQ ID NO: 4172073 - RNA, 18 nt, Yersinia pestis
uuguauuuagagauuauu

SEQ ID NO: 4172074 - RNA, 13 nt, Yersinia pestis
uuguauuuuccug

SEQ ID NO: 4172075 - RNA, 20 nt, Yersinia pestis
uuguauuuuccugaucaacu

SEQ ID NO: 4172076 - RNA, 21 nt, Yersinia pestis
uugucaauaaccucaaaagga

SEQ ID NO: 4172077 - RNA, 22 nt, Yersinia pestis
uugucaauaaccucaaaaggau

SEQ ID NO: 4172078 - RNA, 22 nt, Yersinia pestis
uugucaauaaccucagccucau

SEQ ID NO: 4172079 - RNA, 14 nt, Yersinia pestis
uugucaaucacugg

SEQ ID NO: 4172080 - RNA, 14 nt, Yersinia pestis
uugucaccuaacca

SEQ ID NO: 4172081 - RNA, 23 nt, Yersinia pestis
uugucacggcggccgucacugag

SEQ ID NO: 4172082 - RNA, 23 nt, Yersinia pestis
uugucacugcacuccugucuagg

SEQ ID NO: 4172083 - RNA, 20 nt, Yersinia pestis
uugucagcagucugaaacgc

SEQ ID NO: 4172084 - RNA, 20 nt, Yersinia pestis
uugucagcagucugagggcc

SEQ ID NO: 4172085 - RNA, 13 nt, Yersinia pestis
uugucauacacgg

SEQ ID NO: 4172086 - RNA, 18 nt, Yersinia pestis
uugucauggccugaugca

SEQ ID NO: 4172087 - RNA, 19 nt, Yersinia pestis
uugucauguugaccaaaca

SEQ ID NO: 4172088 - RNA, 16 nt, Yersinia pestis
uuguccaacaucuccg

SEQ ID NO: 4172089 - RNA, 19 nt, Yersinia pestis
uuguccaacaucuccgcca

SEQ ID NO: 4172090 - RNA, 20 nt, Yersinia pestis
uugucggcauaacaggugca

SEQ ID NO: 4172091 - RNA, 21 nt, Yersinia pestis
uugucuuuaauaaaaucaaaa

SEQ ID NO: 4172092 - RNA, 20 nt, Yersinia pestis
uugugcaaaaucagcauaac

SEQ ID NO: 4172093 - RNA, 19 nt, Yersinia pestis
uugugcacucguuguauuu

SEQ ID NO: 4172094 - RNA, 19 nt, Yersinia pestis
uugugcguaaagaaaaaau

SEQ ID NO: 4172095 - RNA, 16 nt, Yersinia pestis
uugugcuuuuuggcaa

SEQ ID NO: 4172096 - RNA, 17 nt, Yersinia pestis
uuguggcuaccaauuau

SEQ ID NO: 4172097 - RNA, 19 nt, Yersinia pestis
uugugggucgccuugccgc

SEQ ID NO: 4172098 - RNA, 17 nt, Yersinia pestis
uugugucaauaccuuac

SEQ ID NO: 4172099 - RNA, 22 nt, Yersinia pestis
uugugucaucgcggaugccuuu

SEQ ID NO: 4172100 - RNA, 20 nt, Yersinia pestis
uuguguuucaucgacucuuu

SEQ ID NO: 4172101 - RNA, 23 nt, Yersinia pestis
uuguuaccuaaccaaacauuguc

SEQ ID NO: 4172102 - RNA, 19 nt, Yersinia pestis
uuguuacugcuuaccuugu

SEQ ID NO: 4172103 - RNA, 17 nt, Yersinia pestis
uuguuauuuuaauuuaa

SEQ ID NO: 4172104 - RNA, 19 nt, Yersinia pestis
uuguucaccucgaugcuuu

SEQ ID NO: 4172105 - RNA, 22 nt, Yersinia pestis
uuguucagcaccaguugaccau

SEQ ID NO: 4172106 - RNA, 22 nt, Yersinia pestis
uuguuccgguucggauucuguu

SEQ ID NO: 4172107 - RNA, 14 nt, Yersinia pestis
uuguucgugaaagc

SEQ ID NO: 4172108 - RNA, 15 nt, Yersinia pestis
uuguucuaauaauaa

SEQ ID NO: 4172109 - RNA, 15 nt, Yersinia pestis
uuguucuuacuguuu

SEQ ID NO: 4172110 - RNA, 20 nt, Yersinia pestis
uuguugaacaguuuuuggua

SEQ ID NO: 4172111 - RNA, 14 nt, Yersinia pestis
uuguugaauaccaa

SEQ ID NO: 4172112 - RNA, 19 nt, Yersinia pestis
uuguugaccucaaaauaca

SEQ ID NO: 4172113 - RNA, 12 nt, Yersinia pestis
uuguugcaauac

SEQ ID NO: 4172114 - RNA, 21 nt, Yersinia pestis
uuguugccuuucuguaacuca

SEQ ID NO: 4172115 - RNA, 14 nt, Yersinia pestis
uuguugcucaacau

SEQ ID NO: 4172116 - RNA, 22 nt, Yersinia pestis
uuguuuaaucaccgcuguggaa

SEQ ID NO: 4172117 - RNA, 16 nt, Yersinia pestis
uuguuuuacggcagua

SEQ ID NO: 4172118 - RNA, 17 nt, Yersinia pestis
uuguuuucaugaugacu

SEQ ID NO: 4172119 - RNA, 22 nt, Yersinia pestis
uuguuuuuucccagaacauaug

SEQ ID NO: 4172120 - RNA, 11 nt, Yersinia pestis
uuuaaaaaaau

SEQ ID NO: 4172121 - RNA, 17 nt, Yersinia pestis
uuuaaaaaaauuaucau

SEQ ID NO: 4172122 - RNA, 13 nt, Yersinia pestis
uuuaaaaaauauc

SEQ ID NO: 4172123 - RNA, 18 nt, Yersinia pestis
uuuaaaaacccucuucaa

SEQ ID NO: 4172124 - RNA, 17 nt, Yersinia pestis
uuuaaaacuguggcuga

SEQ ID NO: 4172125 - RNA, 18 nt, Yersinia pestis
uuuaaacacucaauaagu

SEQ ID NO: 4172126 - RNA, 21 nt, Yersinia pestis
uuuaaaggggggaaacgguuu

SEQ ID NO: 4172127 - RNA, 17 nt, Yersinia pestis
uuuaaaguuuuuuauuu

SEQ ID NO: 4172128 - RNA, 19 nt, Yersinia pestis
uuuaaauaugaucuugaua

SEQ ID NO: 4172129 - RNA, 19 nt, Yersinia pestis
uuuaaauuccgguguuuuu

SEQ ID NO: 4172130 - RNA, 12 nt, Yersinia pestis
uuuaacaaaaaa

SEQ ID NO: 4172131 - RNA, 12 nt, Yersinia pestis
uuuaacaacaac

SEQ ID NO: 4172132 - RNA, 17 nt, Yersinia pestis
uuuaacaauuuaucaga

SEQ ID NO: 4172133 - RNA, 21 nt, Yersinia pestis
uuuaacacauuccaguaaaaa

SEQ ID NO: 4172134 - RNA, 22 nt, Yersinia pestis
uuuaacacauuccaguaaaaaa

SEQ ID NO: 4172135 - RNA, 17 nt, Yersinia pestis
uuuaacccgguuggcua

SEQ ID NO: 4172136 - RNA, 17 nt, Yersinia pestis
uuuaaccgcucaguauu

SEQ ID NO: 4172137 - RNA, 18 nt, Yersinia pestis
uuuaacggcuguuguucu

SEQ ID NO: 4172138 - RNA, 14 nt, Yersinia pestis
uuuaacgucgcuga

SEQ ID NO: 4172139 - RNA, 13 nt, Yersinia pestis
uuuaacucaaaua

SEQ ID NO: 4172140 - RNA, 19 nt, Yersinia pestis
uuuaacucaauuuuggcug

SEQ ID NO: 4172141 - RNA, 19 nt, Yersinia pestis
uuuaacuuccaauuucuca

SEQ ID NO: 4172142 - RNA, 12 nt, Yersinia pestis
uuuaagaaaucu

SEQ ID NO: 4172143 - RNA, 13 nt, Yersinia pestis
uuuaagaaaucua

SEQ ID NO: 4172144 - RNA, 23 nt, Yersinia pestis
uuuaagaaaucuauuaauauacc

SEQ ID NO: 4172145 - RNA, 18 nt, Yersinia pestis
uuuaagcgccuuaagaga

SEQ ID NO: 4172146 - RNA, 23 nt, Yersinia pestis
uuuaaggaacggguaaucggugu

SEQ ID NO: 4172147 - RNA, 22 nt, Yersinia pestis
uuuaaggaucuuucaguuaucu

SEQ ID NO: 4172148 - RNA, 16 nt, Yersinia pestis
uuuaagucugccugga

SEQ ID NO: 4172149 - RNA, 16 nt, Yersinia pestis
uuuaauaugugacaau

SEQ ID NO: 4172150 - RNA, 19 nt, Yersinia pestis
uuuaaucgccugaugcuuu

SEQ ID NO: 4172151 - RNA, 14 nt, Yersinia pestis
uuuaaucugcauca

SEQ ID NO: 4172152 - RNA, 21 nt, Yersinia pestis
uuuaaugaguuggcauucuag

SEQ ID NO: 4172153 - RNA, 19 nt, Yersinia pestis
uuuaaugauugauuaucaa

SEQ ID NO: 4172154 - RNA, 18 nt, Yersinia pestis
uuuaaugguuuccauaau

SEQ ID NO: 4172155 - RNA, 14 nt, Yersinia pestis
uuuaauuaaaaaua

SEQ ID NO: 4172156 - RNA, 18 nt, Yersinia pestis
uuuaauuaguuuaucagu

SEQ ID NO: 4172157 - RNA, 17 nt, Yersinia pestis
uuuaauugcugauguca

SEQ ID NO: 4172158 - RNA, 20 nt, Yersinia pestis
uuuacaaaccauauuauuua

SEQ ID NO: 4172159 - RNA, 23 nt, Yersinia pestis
uuuacaccacuaguuaaaaccag

SEQ ID NO: 4172160 - RNA, 13 nt, Yersinia pestis
uuuacacuuaauc

SEQ ID NO: 4172161 - RNA, 12 nt, Yersinia pestis
uuuacaggaacg

SEQ ID NO: 4172162 - RNA, 13 nt, Yersinia pestis
uuuacaggccaca

SEQ ID NO: 4172163 - RNA, 13 nt, Yersinia pestis
uuuacauuccaca

SEQ ID NO: 4172164 - RNA, 14 nt, Yersinia pestis
uuuacccagccaag

SEQ ID NO: 4172165 - RNA, 10 nt, Yersinia pestis
uuuacccugc

SEQ ID NO: 4172166 - RNA, 13 nt, Yersinia pestis
uuuacccugcuac

SEQ ID NO: 4172167 - RNA, 18 nt, Yersinia pestis
uuuaccuccauauagccc

SEQ ID NO: 4172168 - RNA, 22 nt, Yersinia pestis
uuuaccuguuucgauccagcua

SEQ ID NO: 4172169 - RNA, 14 nt, Yersinia pestis
uuuacgaucggccu

SEQ ID NO: 4172170 - RNA, 16 nt, Yersinia pestis
uuuacggcucaccugg

SEQ ID NO: 4172171 - RNA, 21 nt, Yersinia pestis
uuuacguagggcggccuuugg

SEQ ID NO: 4172172 - RNA, 17 nt, Yersinia pestis
uuuacuaaauuagaaaa

SEQ ID NO: 4172173 - RNA, 20 nt, Yersinia pestis
uuuacuccccugccuauccu

SEQ ID NO: 4172174 - RNA, 18 nt, Yersinia pestis
uuuacuccccugccuauu

SEQ ID NO: 4172175 - RNA, 23 nt, Yersinia pestis
uuuacucgcaauaccaaugucuu

SEQ ID NO: 4172176 - RNA, 15 nt, Yersinia pestis
uuuacugcauugaga

SEQ ID NO: 4172177 - RNA, 18 nt, Yersinia pestis
uuuacugcguaaccccaa

SEQ ID NO: 4172178 - RNA, 15 nt, Yersinia pestis
uuuacugcuuuucua

SEQ ID NO: 4172179 - RNA, 21 nt, Yersinia pestis
uuuacugcuuuucuaccugag

SEQ ID NO: 4172180 - RNA, 21 nt, Yersinia pestis
uuuacuggcgggcauuuucua

SEQ ID NO: 4172181 - RNA, 19 nt, Yersinia pestis
uuuacugggugauguccug

SEQ ID NO: 4172182 - RNA, 17 nt, Yersinia pestis
uuuagaggcugauaacc

SEQ ID NO: 4172183 - RNA, 15 nt, Yersinia pestis
uuuagaugucagauu

SEQ ID NO: 4172184 - RNA, 17 nt, Yersinia pestis
uuuagccccuucacgga

SEQ ID NO: 4172185 - RNA, 13 nt, Yersinia pestis
uuuagcgaugacc

SEQ ID NO: 4172186 - RNA, 15 nt, Yersinia pestis
uuuaggccuauaacc

SEQ ID NO: 4172187 - RNA, 22 nt, Yersinia pestis
uuuagucuauggcgcuaaaggc

SEQ ID NO: 4172188 - RNA, 20 nt, Yersinia pestis
uuuaguugcuauuuccccgc

SEQ ID NO: 4172189 - RNA, 18 nt, Yersinia pestis
uuuauaaaaccacugacc

SEQ ID NO: 4172190 - RNA, 18 nt, Yersinia pestis
uuuauacggcuauuuuua

SEQ ID NO: 4172191 - RNA, 24 nt, Yersinia pestis
uuuauacuuugcgcgcuguggcua

SEQ ID NO: 4172192 - RNA, 15 nt, Yersinia pestis
uuuauauaacagcca

SEQ ID NO: 4172193 - RNA, 15 nt, Yersinia pestis
uuuauauuccacaua

SEQ ID NO: 4172194 - RNA, 19 nt, Yersinia pestis
uuuauauugauaaaaauca

SEQ ID NO: 4172195 - RNA, 12 nt, Yersinia pestis
uuuauauugaug

SEQ ID NO: 4172196 - RNA, 17 nt, Yersinia pestis
uuuauauugccaucuug

SEQ ID NO: 4172197 - RNA, 14 nt, Yersinia pestis
uuuaucaaucagcu

SEQ ID NO: 4172198 - RNA, 19 nt, Yersinia pestis
uuuaucacuuagcucaauc

SEQ ID NO: 4172199 - RNA, 22 nt, Yersinia pestis
uuuaucaguagucaauacaauu

SEQ ID NO: 4172200 - RNA, 13 nt, Yersinia pestis
uuuauccccuucg

SEQ ID NO: 4172201 - RNA, 15 nt, Yersinia pestis
uuuauccuguacaua

SEQ ID NO: 4172202 - RNA, 15 nt, Yersinia pestis
uuuaucgaccacuuu

SEQ ID NO: 4172203 - RNA, 13 nt, Yersinia pestis
uuuaucggcauuu

SEQ ID NO: 4172204 - RNA, 19 nt, Yersinia pestis
uuuaucgugaauaaaaaua

SEQ ID NO: 4172205 - RNA, 16 nt, Yersinia pestis
uuuaucuaaaauaucu

SEQ ID NO: 4172206 - RNA, 15 nt, Yersinia pestis
uuuaucuaucuguuc

SEQ ID NO: 4172207 - RNA, 21 nt, Yersinia pestis
uuuaucucacgcugaauaaca

SEQ ID NO: 4172208 - RNA, 15 nt, Yersinia pestis
uuuaucuuccacucu

SEQ ID NO: 4172209 - RNA, 20 nt, Yersinia pestis
uuuaucuuccacucuuucaa

SEQ ID NO: 4172210 - RNA, 19 nt, Yersinia pestis
uuuaucuuguaaauaguca

SEQ ID NO: 4172211 - RNA, 22 nt, Yersinia pestis
uuuauggaaauuauuuagaaac

SEQ ID NO: 4172212 - RNA, 15 nt, Yersinia pestis
uuuauggcuuauccc

SEQ ID NO: 4172213 - RNA, 15 nt, Yersinia pestis
uuuauguaacacaua

SEQ ID NO: 4172214 - RNA, 21 nt, Yersinia pestis
uuuauguacauccaauuuuuu

SEQ ID NO: 4172215 - RNA, 13 nt, Yersinia pestis
uuuauuaaguuuu

SEQ ID NO: 4172216 - RNA, 15 nt, Yersinia pestis
uuuauuauauauuuu

SEQ ID NO: 4172217 - RNA, 12 nt, Yersinia pestis
uuuauuaucaau

SEQ ID NO: 4172218 - RNA, 18 nt, Yersinia pestis
uuuauuaucaucuuucau

SEQ ID NO: 4172219 - RNA, 16 nt, Yersinia pestis
uuuauucaagugcuca

SEQ ID NO: 4172220 - RNA, 23 nt, Yersinia pestis
uuuauucacagcagaacaaaaca

SEQ ID NO: 4172221 - RNA, 16 nt, Yersinia pestis
uuuauugggaaccccu

SEQ ID NO: 4172222 - RNA, 12 nt, Yersinia pestis
uuuauuguauaa

SEQ ID NO: 4172223 - RNA, 23 nt, Yersinia pestis
uuuauuguuaucaaaucaggccu

SEQ ID NO: 4172224 - RNA, 20 nt, Yersinia pestis
uuuauuuaagcugaaauuuu

SEQ ID NO: 4172225 - RNA, 15 nt, Yersinia pestis
uuuauuuauuuccgc

SEQ ID NO: 4172226 - RNA, 22 nt, Yersinia pestis
uuuauuuccgaauuaaaaauca

SEQ ID NO: 4172227 - RNA, 13 nt, Yersinia pestis
uuucaaaauugag

SEQ ID NO: 4172228 - RNA, 22 nt, Yersinia pestis
uuucaaaccacuguuuuucauu

SEQ ID NO: 4172229 - RNA, 23 nt, Yersinia pestis
uuucaaaguaaaauaaaaaagua

SEQ ID NO: 4172230 - RNA, 23 nt, Yersinia pestis
uuucaaauaguagaucuauuagg

SEQ ID NO: 4172231 - RNA, 15 nt, Yersinia pestis
uuucaacauccaguu

SEQ ID NO: 4172232 - RNA, 20 nt, Yersinia pestis
uuucaagauagcugucagcg

SEQ ID NO: 4172233 - RNA, 23 nt, Yersinia pestis
uuucaagugguagauguauuagu

SEQ ID NO: 4172234 - RNA, 14 nt, Yersinia pestis
uuucaauaacaccg

SEQ ID NO: 4172235 - RNA, 17 nt, Yersinia pestis
uuucaauacuauuccgu

SEQ ID NO: 4172236 - RNA, 15 nt, Yersinia pestis
uuucaaucacuucug

SEQ ID NO: 4172237 - RNA, 17 nt, Yersinia pestis
uuucaaucacuucugcu

SEQ ID NO: 4172238 - RNA, 18 nt, Yersinia pestis
uuucaauucucccauuua

SEQ ID NO: 4172239 - RNA, 21 nt, Yersinia pestis
uuucaauugcccccuagugau

SEQ ID NO: 4172240 - RNA, 19 nt, Yersinia pestis
uuucacacgcccaggccau

SEQ ID NO: 4172241 - RNA, 17 nt, Yersinia pestis
uuucaccaaccaauuug

SEQ ID NO: 4172242 - RNA, 23 nt, Yersinia pestis
uuucacccuugauuuuaccaaca

SEQ ID NO: 4172243 - RNA, 17 nt, Yersinia pestis
uuucagacccuaauauc

SEQ ID NO: 4172244 - RNA, 18 nt, Yersinia pestis
uuucagacugcugacaac

SEQ ID NO: 4172245 - RNA, 14 nt, Yersinia pestis
uuucagauaaaaau

SEQ ID NO: 4172246 - RNA, 15 nt, Yersinia pestis
uuucagcaccauaaa

SEQ ID NO: 4172247 - RNA, 23 nt, Yersinia pestis
uuucagcaccauaaaaacuucag

SEQ ID NO: 4172248 - RNA, 21 nt, Yersinia pestis
uuucagcucuucaauuuccau

SEQ ID NO: 4172249 - RNA, 12 nt, Yersinia pestis
uuucagcugcuu

SEQ ID NO: 4172250 - RNA, 19 nt, Yersinia pestis
uuucagcuucaagguacug

SEQ ID NO: 4172251 - RNA, 19 nt, Yersinia pestis
uuucaggagugaauuucuu

SEQ ID NO: 4172252 - RNA, 16 nt, Yersinia pestis
uuucaggcauaucacu

SEQ ID NO: 4172253 - RNA, 19 nt, Yersinia pestis
uuucagggaguaacuugac

SEQ ID NO: 4172254 - RNA, 14 nt, Yersinia pestis
uuucaggugacuga

SEQ ID NO: 4172255 - RNA, 17 nt, Yersinia pestis
uuucaguaagauacuug

SEQ ID NO: 4172256 - RNA, 16 nt, Yersinia pestis
uuucaguggcuucucu

SEQ ID NO: 4172257 - RNA, 16 nt, Yersinia pestis
uuucaucgcugaauuu

SEQ ID NO: 4172258 - RNA, 18 nt, Yersinia pestis
uuucaucggcaaaaacag

SEQ ID NO: 4172259 - RNA, 15 nt, Yersinia pestis
uuucaucugugccug

SEQ ID NO: 4172260 - RNA, 19 nt, Yersinia pestis
uuucaugauccacaaugau

SEQ ID NO: 4172261 - RNA, 13 nt, Yersinia pestis
uuucaugauucuc

SEQ ID NO: 4172262 - RNA, 17 nt, Yersinia pestis
uuucaugauucucuauu

SEQ ID NO: 4172263 - RNA, 14 nt, Yersinia pestis
uuucauuagucaau

SEQ ID NO: 4172264 - RNA, 14 nt, Yersinia pestis
uuucauuauuuuca

SEQ ID NO: 4172265 - RNA, 15 nt, Yersinia pestis
uuuccaaaugaaaaa

SEQ ID NO: 4172266 - RNA, 14 nt, Yersinia pestis
uuuccaagcuaguc

SEQ ID NO: 4172267 - RNA, 15 nt, Yersinia pestis
uuuccaauaccaauu

SEQ ID NO: 4172268 - RNA, 11 nt, Yersinia pestis
uuuccacaaca

SEQ ID NO: 4172269 - RNA, 17 nt, Yersinia pestis
uuuccagaaucaauggg

SEQ ID NO: 4172270 - RNA, 14 nt, Yersinia pestis
uuuccagcaaaagc

SEQ ID NO: 4172271 - RNA, 14 nt, Yersinia pestis
uuuccaggcuacca

SEQ ID NO: 4172272 - RNA, 15 nt, Yersinia pestis
uuuccaguuucauca

SEQ ID NO: 4172273 - RNA, 13 nt, Yersinia pestis
uuuccaucacugc

SEQ ID NO: 4172274 - RNA, 14 nt, Yersinia pestis
uuuccaucugcaau

SEQ ID NO: 4172275 - RNA, 20 nt, Yersinia pestis
uuuccauuggagauccguuu

SEQ ID NO: 4172276 - RNA, 19 nt, Yersinia pestis
uuucccgcuagcuacccga

SEQ ID NO: 4172277 - RNA, 15 nt, Yersinia pestis
uuucccuuucucagu

SEQ ID NO: 4172278 - RNA, 16 nt, Yersinia pestis
uuuccgccaugagaac

SEQ ID NO: 4172279 - RNA, 14 nt, Yersinia pestis
uuuccuaugugaua

SEQ ID NO: 4172280 - RNA, 16 nt, Yersinia pestis
uuuccucaaacgugau

SEQ ID NO: 4172281 - RNA, 17 nt, Yersinia pestis
uuuccugacccggugac

SEQ ID NO: 4172282 - RNA, 22 nt, Yersinia pestis
uuuccugcacaucaaguacuuc

SEQ ID NO: 4172283 - RNA, 17 nt, Yersinia pestis
uuuccuguauuuccugu

SEQ ID NO: 4172284 - RNA, 18 nt, Yersinia pestis
uuuccuguauuuccugua

SEQ ID NO: 4172285 - RNA, 15 nt, Yersinia pestis
uuucgcuacugagau

SEQ ID NO: 4172286 - RNA, 14 nt, Yersinia pestis
uuucgggcaaaaaa

SEQ ID NO: 4172287 - RNA, 15 nt, Yersinia pestis
ugaccagauagcugu

SEQ ID NO: 4172288 - RNA, 19 nt, Yersinia pestis
ugaccagcauacgugccaa

SEQ ID NO: 4172289 - RNA, 21 nt, Yersinia pestis
ugaccagcauacgugccaaaa

SEQ ID NO: 4172290 - RNA, 16 nt, Yersinia pestis
ugaccagugaauaagu

SEQ ID NO: 4172291 - RNA, 14 nt, Yersinia pestis
ugaccauaaaagga

SEQ ID NO: 4172292 - RNA, 17 nt, Yersinia pestis
ugaccaucaaccgugac

SEQ ID NO: 4172293 - RNA, 22 nt, Yersinia pestis
ugaccaucgaucugggcuaugc

SEQ ID NO: 4172294 - RNA, 18 nt, Yersinia pestis
ugaccaugcuuauugcca

SEQ ID NO: 4172295 - RNA, 21 nt, Yersinia pestis
ugaccauucacgccgcuccug

SEQ ID NO: 4172296 - RNA, 16 nt, Yersinia pestis
ugaccauuuauuucca

SEQ ID NO: 4172297 - RNA, 17 nt, Yersinia pestis
ugacccgucagcguccu

SEQ ID NO: 4172298 - RNA, 17 nt, Yersinia pestis
ugaccgcacugcccagg

SEQ ID NO: 4172299 - RNA, 16 nt, Yersinia pestis
ugaccgguaauaucgg

SEQ ID NO: 4172300 - RNA, 15 nt, Yersinia pestis
ugaccguuguaugug

SEQ ID NO: 4172301 - RNA, 20 nt, Yersinia pestis
ugaccuauugauaaaaccac

SEQ ID NO: 4172302 - RNA, 20 nt, Yersinia pestis
ugaccuauugauaaaaccgc

SEQ ID NO: 4172303 - RNA, 21 nt, Yersinia pestis
ugaccucgacaaucucggcau

SEQ ID NO: 4172304 - RNA, 16 nt, Yersinia pestis
ugaccuguuguaacac

SEQ ID NO: 4172305 - RNA, 15 nt, Yersinia pestis
ugaccuuaauaccgu

SEQ ID NO: 4172306 - RNA, 21 nt, Yersinia pestis
ugaccuuaauaccguguaccc

SEQ ID NO: 4172307 - RNA, 16 nt, Yersinia pestis
ugaccuuacagugaua

SEQ ID NO: 4172308 - RNA, 18 nt, Yersinia pestis
ugaccuugguaaauacca

SEQ ID NO: 4172309 - RNA, 13 nt, Yersinia pestis
ugacgaaaugccg

SEQ ID NO: 4172310 - RNA, 12 nt, Yersinia pestis
ugacgaaugagc

SEQ ID NO: 4172311 - RNA, 14 nt, Yersinia pestis
ugacgaauuaaaac

SEQ ID NO: 4172312 - RNA, 20 nt, Yersinia pestis
ugacgauaguauaaauaccu

SEQ ID NO: 4172313 - RNA, 19 nt, Yersinia pestis
ugacgccaccauuccgcca

SEQ ID NO: 4172314 - RNA, 19 nt, Yersinia pestis
ugacgcgccauacugcaga

SEQ ID NO: 4172315 - RNA, 12 nt, Yersinia pestis
ugacgcgcugcu

SEQ ID NO: 4172316 - RNA, 23 nt, Yersinia pestis
ugacgcguagagccuuuacgggc

SEQ ID NO: 4172317 - RNA, 22 nt, Yersinia pestis
ugacgcguugcccuucuucagc

SEQ ID NO: 4172318 - RNA, 23 nt, Yersinia pestis
ugacgcuaaccaccgucaccaaa

SEQ ID NO: 4172319 - RNA, 15 nt, Yersinia pestis
ugacgcuuauccugc

SEQ ID NO: 4172320 - RNA, 21 nt, Yersinia pestis
ugacggaaaauuaacuuauug

SEQ ID NO: 4172321 - RNA, 15 nt, Yersinia pestis
ugacggagcuaucac

SEQ ID NO: 4172322 - RNA, 20 nt, Yersinia pestis
ugacggcagcgagcacugcc

SEQ ID NO: 4172323 - RNA, 20 nt, Yersinia pestis
ugacggcggcgagcacugcc

SEQ ID NO: 4172324 - RNA, 12 nt, Yersinia pestis
ugacgggucagc

SEQ ID NO: 4172325 - RNA, 17 nt, Yersinia pestis
ugacggugcgauaaaug

SEQ ID NO: 4172326 - RNA, 22 nt, Yersinia pestis
ugacgguugcugggaucaccgc

SEQ ID NO: 4172327 - RNA, 20 nt, Yersinia pestis
ugacgguuucaacauccagu

SEQ ID NO: 4172328 - RNA, 16 nt, Yersinia pestis
ugacguccccggucau

SEQ ID NO: 4172329 - RNA, 15 nt, Yersinia pestis
ugacguuacagaugg

SEQ ID NO: 4172330 - RNA, 17 nt, Yersinia pestis
ugacguucaguaguggc

SEQ ID NO: 4172331 - RNA, 16 nt, Yersinia pestis
ugacguuguuuccauu

SEQ ID NO: 4172332 - RNA, 21 nt, Yersinia pestis
ugacuaaaauucaaacaaaua

SEQ ID NO: 4172333 - RNA, 13 nt, Yersinia pestis
ugacuaaacugau

SEQ ID NO: 4172334 - RNA, 15 nt, Yersinia pestis
ugacuaaauuaaccc

SEQ ID NO: 4172335 - RNA, 23 nt, Yersinia pestis
ugacuaauuaauaaccauaaaau

SEQ ID NO: 4172336 - RNA, 17 nt, Yersinia pestis
ugacuaauugugcagca

SEQ ID NO: 4172337 - RNA, 17 nt, Yersinia pestis
ugacuaccuugcuccgc

SEQ ID NO: 4172338 - RNA, 16 nt, Yersinia pestis
ugacuauucccuuguu

SEQ ID NO: 4172339 - RNA, 15 nt, Yersinia pestis
ugacuauucugccua

SEQ ID NO: 4172340 - RNA, 14 nt, Yersinia pestis
ugacucacgucagu

SEQ ID NO: 4172341 - RNA, 13 nt, Yersinia pestis
ugacucagcgaau

SEQ ID NO: 4172342 - RNA, 21 nt, Yersinia pestis
ugacucgggucagugaaaaau

SEQ ID NO: 4172343 - RNA, 22 nt, Yersinia pestis
ugacucucuuguucuaacgcuu

SEQ ID NO: 4172344 - RNA, 16 nt, Yersinia pestis
ugacugcccgccugcu

SEQ ID NO: 4172345 - RNA, 21 nt, Yersinia pestis
ugacugccgggaucaauuaca

SEQ ID NO: 4172346 - RNA, 14 nt, Yersinia pestis
ugacugcuggcagg

SEQ ID NO: 4172347 - RNA, 14 nt, Yersinia pestis
ugacuggaauauuc

SEQ ID NO: 4172348 - RNA, 12 nt, Yersinia pestis
ugacuggcagga

SEQ ID NO: 4172349 - RNA, 15 nt, Yersinia pestis
ugacuggcuauuaga

SEQ ID NO: 4172350 - RNA, 15 nt, Yersinia pestis
ugacuuagcucaucg

SEQ ID NO: 4172351 - RNA, 17 nt, Yersinia pestis
ugacuuaugacgcgcug

SEQ ID NO: 4172352 - RNA, 21 nt, Yersinia pestis
ugacuuuaaaaaaauuaucau

SEQ ID NO: 4172353 - RNA, 14 nt, Yersinia pestis
ugacuuuuuuuaac

SEQ ID NO: 4172354 - RNA, 23 nt, Yersinia pestis
ugagaaaggauuugaagacaacu

SEQ ID NO: 4172355 - RNA, 12 nt, Yersinia pestis
ugagaaauauuu

SEQ ID NO: 4172356 - RNA, 14 nt, Yersinia pestis
ugagaacucgguau

SEQ ID NO: 4172357 - RNA, 19 nt, Yersinia pestis
ugagaagaaaucauuuagg

SEQ ID NO: 4172358 - RNA, 21 nt, Yersinia pestis
ugagaaggguauugaagauac

SEQ ID NO: 4172359 - RNA, 18 nt, Yersinia pestis
ugagaaguaaaacgugaa

SEQ ID NO: 4172360 - RNA, 14 nt, Yersinia pestis
ugagaagugaaaaa

SEQ ID NO: 4172361 - RNA, 14 nt, Yersinia pestis
ugagaauaaaaccu

SEQ ID NO: 4172362 - RNA, 19 nt, Yersinia pestis
ugagaaucucuccagugca

SEQ ID NO: 4172363 - RNA, 23 nt, Yersinia pestis
ugagacaacaguaaaccggcuaa

SEQ ID NO: 4172364 - RNA, 18 nt, Yersinia pestis
ugagacacaaaaaagaaa

SEQ ID NO: 4172365 - RNA, 17 nt, Yersinia pestis
ugagacagugagguuau

SEQ ID NO: 4172366 - RNA, 21 nt, Yersinia pestis
ugagacagugagguuauugac

SEQ ID NO: 4172367 - RNA, 17 nt, Yersinia pestis
ugagacccgauuucacg

SEQ ID NO: 4172368 - RNA, 19 nt, Yersinia pestis
ugagaccuuccauaacuca

SEQ ID NO: 4172369 - RNA, 14 nt, Yersinia pestis
ugagacuccucuuc

SEQ ID NO: 4172370 - RNA, 12 nt, Yersinia pestis
ugagagaaacuu

SEQ ID NO: 4172371 - RNA, 19 nt, Yersinia pestis
ugagagaccagggcaccaa

SEQ ID NO: 4172372 - RNA, 18 nt, Yersinia pestis
ugagagcgaauggcaaug

SEQ ID NO: 4172373 - RNA, 15 nt, Yersinia pestis
ugagaucuaaaaaau

SEQ ID NO: 4172374 - RNA, 15 nt, Yersinia pestis
ugagaugaacacaga

SEQ ID NO: 4172375 - RNA, 12 nt, Yersinia pestis
ugagauuaucag

SEQ ID NO: 4172376 - RNA, 18 nt, Yersinia pestis
ugagcaaauuuaucagua

SEQ ID NO: 4172377 - RNA, 20 nt, Yersinia pestis
ugagcaagggcagcuaaccc

SEQ ID NO: 4172378 - RNA, 23 nt, Yersinia pestis
ugagcaaucuggcggccgcucac

SEQ ID NO: 4172379 - RNA, 16 nt, Yersinia pestis
ugagcaccgcaggaac

SEQ ID NO: 4172380 - RNA, 22 nt, Yersinia pestis
ugagcacgauuaccauuacuuc

SEQ ID NO: 4172381 - RNA, 19 nt, Yersinia pestis
ugagcacggacagcagcac

SEQ ID NO: 4172382 - RNA, 20 nt, Yersinia pestis
ugagcacggacagcagcacg

SEQ ID NO: 4172383 - RNA, 11 nt, Yersinia pestis
ugagcagugcg

SEQ ID NO: 4172384 - RNA, 23 nt, Yersinia pestis
ugagcauacuguuggcaauuuca

SEQ ID NO: 4172385 - RNA, 18 nt, Yersinia pestis
ugagcaucacuucauaca

SEQ ID NO: 4172386 - RNA, 13 nt, Yersinia pestis
ugagcaucuggcg

SEQ ID NO: 4172387 - RNA, 19 nt, Yersinia pestis
ugagcauuuuaguuuuaua

SEQ ID NO: 4172388 - RNA, 23 nt, Yersinia pestis
ugagcauuuuaguuuuauacccg

SEQ ID NO: 4172389 - RNA, 18 nt, Yersinia pestis
ugagccacacauucaguc

SEQ ID NO: 4172390 - RNA, 19 nt, Yersinia pestis
ugagccaccgcauuccagc

SEQ ID NO: 4172391 - RNA, 22 nt, Yersinia pestis
ugagccaucaaucguacuggcg

SEQ ID NO: 4172392 - RNA, 12 nt, Yersinia pestis
ugagccauuauc

SEQ ID NO: 4172393 - RNA, 20 nt, Yersinia pestis
ugagccucaugaaugaggcu

SEQ ID NO: 4172394 - RNA, 13 nt, Yersinia pestis
ugagccugcggca

SEQ ID NO: 4172395 - RNA, 13 nt, Yersinia pestis
ugagcgagcggua

SEQ ID NO: 4172396 - RNA, 15 nt, Yersinia pestis
ugagcgcagacguug

SEQ ID NO: 4172397 - RNA, 12 nt, Yersinia pestis
ugagcgcauugc

SEQ ID NO: 4172398 - RNA, 23 nt, Yersinia pestis
ugagcgccaugcgcuuucagcac

SEQ ID NO: 4172399 - RNA, 22 nt, Yersinia pestis
ugagcucaccguuacucaggga

SEQ ID NO: 4172400 - RNA, 15 nt, Yersinia pestis
ugagcugaucugcca

SEQ ID NO: 4172401 - RNA, 20 nt, Yersinia pestis
ugagcuguaaauauaaaaua

SEQ ID NO: 4172402 - RNA, 15 nt, Yersinia pestis
ugagcuugcugcuga

SEQ ID NO: 4172403 - RNA, 16 nt, Yersinia pestis
ugaggagccauugauu

SEQ ID NO: 4172404 - RNA, 15 nt, Yersinia pestis
ugaggauaggcagaa

SEQ ID NO: 4172405 - RNA, 20 nt, Yersinia pestis
ugaggauaggcagaggagua

SEQ ID NO: 4172406 - RNA, 20 nt, Yersinia pestis
ugaggauuauaauucauuuu

SEQ ID NO: 4172407 - RNA, 17 nt, Yersinia pestis
ugaggcuaccugcacca

SEQ ID NO: 4172408 - RNA, 18 nt, Yersinia pestis
ugaggcuaccugcaccaa

SEQ ID NO: 4172409 - RNA, 12 nt, Yersinia pestis
ugaggcugaggu

SEQ ID NO: 4172410 - RNA, 22 nt, Yersinia pestis
ugagggccacuucgguggcccu

SEQ ID NO: 4172411 - RNA, 19 nt, Yersinia pestis
ugagggcgucucuacgacg

SEQ ID NO: 4172412 - RNA, 23 nt, Yersinia pestis
ugaggguaagugaauaccgcuaa

SEQ ID NO: 4172413 - RNA, 15 nt, Yersinia pestis
ugaggguugucagca

SEQ ID NO: 4172414 - RNA, 17 nt, Yersinia pestis
ugaggguugucagcagu

SEQ ID NO: 4172415 - RNA, 21 nt, Yersinia pestis
ugaggguugucagcagucuga

SEQ ID NO: 4172416 - RNA, 22 nt, Yersinia pestis
ugaggguugucagcagucugaa

SEQ ID NO: 4172417 - RNA, 14 nt, Yersinia pestis
ugagguaaaccaag

SEQ ID NO: 4172418 - RNA, 18 nt, Yersinia pestis
ugagguuagaaaacaguu

SEQ ID NO: 4172419 - RNA, 21 nt, Yersinia pestis
ugagguuagaaaacaguuacu

SEQ ID NO: 4172420 - RNA, 21 nt, Yersinia pestis
ugagguuagcgagggacgcga

SEQ ID NO: 4172421 - RNA, 17 nt, Yersinia pestis
ugagguuauugacaaag

SEQ ID NO: 4172422 - RNA, 21 nt, Yersinia pestis
ugagguuauugacaaagugcc

SEQ ID NO: 4172423 - RNA, 15 nt, Yersinia pestis
ugaguaaaagauuca

SEQ ID NO: 4172424 - RNA, 17 nt, Yersinia pestis
ugaguaaaagauucaua

SEQ ID NO: 4172425 - RNA, 20 nt, Yersinia pestis
ugaguaaaccguacauuaaa

SEQ ID NO: 4172426 - RNA, 15 nt, Yersinia pestis
ugaguaaauuaaauu

SEQ ID NO: 4172427 - RNA, 20 nt, Yersinia pestis
ugaguaaauuaaauuuuaau

SEQ ID NO: 4172428 - RNA, 12 nt, Yersinia pestis
ugaguaacauua

SEQ ID NO: 4172429 - RNA, 21 nt, Yersinia pestis
ugaguaacgguguggcaccau

SEQ ID NO: 4172430 - RNA, 15 nt, Yersinia pestis
ugaguaagcucaucg

SEQ ID NO: 4172431 - RNA, 17 nt, Yersinia pestis
ugaguaauuucagauaa

SEQ ID NO: 4172432 - RNA, 13 nt, Yersinia pestis
ugaguaguggagc

SEQ ID NO: 4172433 - RNA, 13 nt, Yersinia pestis
ugaguaucaauau

SEQ ID NO: 4172434 - RNA, 16 nt, Yersinia pestis
ugaguauguuugauua

SEQ ID NO: 4172435 - RNA, 17 nt, Yersinia pestis
ugaguauguuugauuaa

SEQ ID NO: 4172436 - RNA, 21 nt, Yersinia pestis
ugaguauguuugauuaagccg

SEQ ID NO: 4172437 - RNA, 21 nt, Yersinia pestis
ugagucacuggggugaaucaa

SEQ ID NO: 4172438 - RNA, 12 nt, Yersinia pestis
ugagucagucag

SEQ ID NO: 4172439 - RNA, 17 nt, Yersinia pestis
ugagugaaaauauguag

SEQ ID NO: 4172440 - RNA, 21 nt, Yersinia pestis
ugagugaaaucuccuguggca

SEQ ID NO: 4172441 - RNA, 17 nt, Yersinia pestis
ugagugaccaagcccaa

SEQ ID NO: 4172442 - RNA, 16 nt, Yersinia pestis
ugagugagacaauuaa

SEQ ID NO: 4172443 - RNA, 14 nt, Yersinia pestis
ugagugaucauauu

SEQ ID NO: 4172444 - RNA, 19 nt, Yersinia pestis
ugagugaucauauuaggca

SEQ ID NO: 4172445 - RNA, 19 nt, Yersinia pestis
ugaguggacgauaaauuca

SEQ ID NO: 4172446 - RNA, 19 nt, Yersinia pestis
ugaguguccacauagcugc

SEQ ID NO: 4172447 - RNA, 18 nt, Yersinia pestis
ugaguuaaaaauaaauuc

SEQ ID NO: 4172448 - RNA, 20 nt, Yersinia pestis
ugaguuacgugagcaucugg

SEQ ID NO: 4172449 - RNA, 13 nt, Yersinia pestis
ugaguuaucuccu

SEQ ID NO: 4172450 - RNA, 16 nt, Yersinia pestis
ugaguuaucuccugua

SEQ ID NO: 4172451 - RNA, 17 nt, Yersinia pestis
ugaguuaucuguuucaa

SEQ ID NO: 4172452 - RNA, 22 nt, Yersinia pestis
ugaguugcccuaaacagcaaca

SEQ ID NO: 4172453 - RNA, 16 nt, Yersinia pestis
ugaguuggcauucuag

SEQ ID NO: 4172454 - RNA, 14 nt, Yersinia pestis
ugaguuucauuagu

SEQ ID NO: 4172455 - RNA, 16 nt, Yersinia pestis
ugaguuucauuaguca

SEQ ID NO: 4172456 - RNA, 14 nt, Yersinia pestis
ugauaaaaaucaau

SEQ ID NO: 4172457 - RNA, 15 nt, Yersinia pestis
ugauaaaaaucaaua

SEQ ID NO: 4172458 - RNA, 19 nt, Yersinia pestis
ugauaaaacacucuuuuug

SEQ ID NO: 4172459 - RNA, 14 nt, Yersinia pestis
ugauaaaaccgcuu

SEQ ID NO: 4172460 - RNA, 17 nt, Yersinia pestis
ugauaaaaguaauuuau

SEQ ID NO: 4172461 - RNA, 16 nt, Yersinia pestis
ugauaaacaauaaaca

SEQ ID NO: 4172462 - RNA, 21 nt, Yersinia pestis
ugauaaacccuacagcaaaca

SEQ ID NO: 4172463 - RNA, 18 nt, Yersinia pestis
ugauaaacuguuuaagcu

SEQ ID NO: 4172464 - RNA, 15 nt, Yersinia pestis
ugauaacaacccuaa

SEQ ID NO: 4172465 - RNA, 20 nt, Yersinia pestis
ugauaacaauaaaaucuuaa

SEQ ID NO: 4172466 - RNA, 15 nt, Yersinia pestis
ugauaacaccggcuu

SEQ ID NO: 4172467 - RNA, 16 nt, Yersinia pestis
ugauaaccacaacgac

SEQ ID NO: 4172468 - RNA, 22 nt, Yersinia pestis
ugauaaccacaacgacagccaa

SEQ ID NO: 4172469 - RNA, 17 nt, Yersinia pestis
ugauaaccguucaagag

SEQ ID NO: 4172470 - RNA, 24 nt, Yersinia pestis
ugauaaccguuuuuucaacuggcu

SEQ ID NO: 4172471 - RNA, 19 nt, Yersinia pestis
ugauaagugaauaaaucaa

SEQ ID NO: 4172472 - RNA, 15 nt, Yersinia pestis
ugauaauaaaaaaac

SEQ ID NO: 4172473 - RNA, 17 nt, Yersinia pestis
ugauaauaguucauuuu

SEQ ID NO: 4172474 - RNA, 16 nt, Yersinia pestis
ugauaaucaaaacacc

SEQ ID NO: 4172475 - RNA, 21 nt, Yersinia pestis
ugauaaugccuuuuaaaugaa

SEQ ID NO: 4172476 - RNA, 22 nt, Yersinia pestis
ugauaaugccuuuuaaaugaag

SEQ ID NO: 4172477 - RNA, 20 nt, Yersinia pestis
ugauaauuaaugcaccuaca

SEQ ID NO: 4172478 - RNA, 22 nt, Yersinia pestis
ugauacaccgucucacccgcuu

SEQ ID NO: 4172479 - RNA, 17 nt, Yersinia pestis
ugauacaucucggcuuu

SEQ ID NO: 4172480 - RNA, 14 nt, Yersinia pestis
ugauacauuuccau

SEQ ID NO: 4172481 - RNA, 16 nt, Yersinia pestis
ugauaccacaauccgg

SEQ ID NO: 4172482 - RNA, 18 nt, Yersinia pestis
ugauaccauugggucagu

SEQ ID NO: 4172483 - RNA, 19 nt, Yersinia pestis
ugauaccguuuuauauuga

SEQ ID NO: 4172484 - RNA, 20 nt, Yersinia pestis
ugauacggccuauuucuuga

SEQ ID NO: 4172485 - RNA, 20 nt, Yersinia pestis
ugauagaaaguugagcagca

SEQ ID NO: 4172486 - RNA, 14 nt, Yersinia pestis
ugauagauuucugc

SEQ ID NO: 4172487 - RNA, 14 nt, Yersinia pestis
ugauagcaaaacac

SEQ ID NO: 4172488 - RNA, 20 nt, Yersinia pestis
ugauagcagaaacccccaac

SEQ ID NO: 4172489 - RNA, 21 nt, Yersinia pestis
ugauagccacaucauuaccca

SEQ ID NO: 4172490 - RNA, 23 nt, Yersinia pestis
ugauagcgacacccucagaggcc

SEQ ID NO: 4172491 - RNA, 19 nt, Yersinia pestis
ugauagcuugggcgauagu

SEQ ID NO: 4172492 - RNA, 13 nt, Yersinia pestis
ugauaggcacggc

SEQ ID NO: 4172493 - RNA, 14 nt, Yersinia pestis
ugauaggucauaua

SEQ ID NO: 4172494 - RNA, 18 nt, Yersinia pestis
ugauaguguaaaaaccau

SEQ ID NO: 4172495 - RNA, 15 nt, Yersinia pestis
ugauauaaagcauuu

SEQ ID NO: 4172496 - RNA, 22 nt, Yersinia pestis
ugauauaagcagcaccaauauc

SEQ ID NO: 4172497 - RNA, 15 nt, Yersinia pestis
ugauaucucuuuauc

SEQ ID NO: 4172498 - RNA, 14 nt, Yersinia pestis
ugauaucuucacuc

SEQ ID NO: 4172499 - RNA, 17 nt, Yersinia pestis
ugauaucuucacucagc

SEQ ID NO: 4172500 - RNA, 14 nt, Yersinia pestis
ugauaugauuucau

SEQ ID NO: 4172501 - RNA, 16 nt, Yersinia pestis
ugauauuccucgcagg

SEQ ID NO: 4172502 - RNA, 23 nt, Yersinia pestis
ugaucaaaucauacgcagccuga

SEQ ID NO: 4172503 - RNA, 13 nt, Yersinia pestis
ugaucaacucacg

SEQ ID NO: 4172504 - RNA, 15 nt, Yersinia pestis
ugaucagcagacuca

SEQ ID NO: 4172505 - RNA, 11 nt, Yersinia pestis
ugaucagcagu

SEQ ID NO: 4172506 - RNA, 13 nt, Yersinia pestis
ugaucaguucagc

SEQ ID NO: 4172507 - RNA, 13 nt, Yersinia pestis
ugaucaucaaacu

SEQ ID NO: 4172508 - RNA, 14 nt, Yersinia pestis
ugaucaucaucaau

SEQ ID NO: 4172509 - RNA, 16 nt, Yersinia pestis
ugaucaucgcaccaua

SEQ ID NO: 4172510 - RNA, 14 nt, Yersinia pestis
ugaucaucuuuuuu

SEQ ID NO: 4172511 - RNA, 16 nt, Yersinia pestis
ugaucaugauuucucg

SEQ ID NO: 4172512 - RNA, 21 nt, Yersinia pestis
ugauccgauaaacuucacaau

SEQ ID NO: 4172513 - RNA, 17 nt, Yersinia pestis
ugauccuggguuuuauu

SEQ ID NO: 4172514 - RNA, 17 nt, Yersinia pestis
ugaucgagcaucaccaa

SEQ ID NO: 4172515 - RNA, 19 nt, Yersinia pestis
ugaucgccgcuaauuuucc

SEQ ID NO: 4172516 - RNA, 17 nt, Yersinia pestis
ugaucgccguacuuggu

SEQ ID NO: 4172517 - RNA, 19 nt, Yersinia pestis
ugaucgcggcaaucaccgg

SEQ ID NO: 4172518 - RNA, 13 nt, Yersinia pestis
ugaucggcauaaa

SEQ ID NO: 4172519 - RNA, 13 nt, Yersinia pestis
ugaucgggcuuua

SEQ ID NO: 4172520 - RNA, 17 nt, Yersinia pestis
ugaucgguuagcuacug

SEQ ID NO: 4172521 - RNA, 20 nt, Yersinia pestis
ugaucuaacguccccugagc

SEQ ID NO: 4172522 - RNA, 17 nt, Yersinia pestis
ugaucugauauuauugc

SEQ ID NO: 4172523 - RNA, 15 nt, Yersinia pestis
ugaucugccaguaaa

SEQ ID NO: 4172524 - RNA, 12 nt, Yersinia pestis
ugaucuggcuuu

SEQ ID NO: 4172525 - RNA, 20 nt, Yersinia pestis
ugaucuugaauaauauucaa

SEQ ID NO: 4172526 - RNA, 21 nt, Yersinia pestis
ugaugaaaccaaaaccuuuac

SEQ ID NO: 4172527 - RNA, 13 nt, Yersinia pestis
ugaugaaauccag

SEQ ID NO: 4172528 - RNA, 16 nt, Yersinia pestis
ugaugaauaccaccau

SEQ ID NO: 4172529 - RNA, 18 nt, Yersinia pestis
ugaugacaaccucucagu

SEQ ID NO: 4172530 - RNA, 14 nt, Yersinia pestis
ugaugacaaugcgu

SEQ ID NO: 4172531 - RNA, 17 nt, Yersinia pestis
ugaugacaaugcguuau

SEQ ID NO: 4172532 - RNA, 22 nt, Yersinia pestis
ugaugacacccguuccuucagc

SEQ ID NO: 4172533 - RNA, 22 nt, Yersinia pestis
ugaugacgccguacaaauauaa

SEQ ID NO: 4172534 - RNA, 17 nt, Yersinia pestis
ugaugacggugaugucc

SEQ ID NO: 4172535 - RNA, 16 nt, Yersinia pestis
ugaugacuauccucgu

SEQ ID NO: 4172536 - RNA, 15 nt, Yersinia pestis
ugaugagaaguaaaa

SEQ ID NO: 4172537 - RNA, 18 nt, Yersinia pestis
ucuucaucuacagacucc

SEQ ID NO: 4172538 - RNA, 14 nt, Yersinia pestis
ucuucauugccuuc

SEQ ID NO: 4172539 - RNA, 15 nt, Yersinia pestis
ucuucauugccuucu

SEQ ID NO: 4172540 - RNA, 21 nt, Yersinia pestis
ucuuccagacaaagugaggga

SEQ ID NO: 4172541 - RNA, 15 nt, Yersinia pestis
ucuuccaucuuaccc

SEQ ID NO: 4172542 - RNA, 23 nt, Yersinia pestis
ucuuccauuuuauuuaacguguu

SEQ ID NO: 4172543 - RNA, 14 nt, Yersinia pestis
ucuucccuguccag

SEQ ID NO: 4172544 - RNA, 21 nt, Yersinia pestis
ucuuccgacaggcuaacaacu

SEQ ID NO: 4172545 - RNA, 18 nt, Yersinia pestis
ucuuccggcguaccacaa

SEQ ID NO: 4172546 - RNA, 13 nt, Yersinia pestis
ucuuccuaacccg

SEQ ID NO: 4172547 - RNA, 20 nt, Yersinia pestis
ucuuccugugcgccacgcuc

SEQ ID NO: 4172548 - RNA, 21 nt, Yersinia pestis
ucuucgaucaacgccucacaa

SEQ ID NO: 4172549 - RNA, 21 nt, Yersinia pestis
ucuucgauuugcucuuuuuug

SEQ ID NO: 4172550 - RNA, 18 nt, Yersinia pestis
ucuucgauuuuagcuuug

SEQ ID NO: 4172551 - RNA, 12 nt, Yersinia pestis
ucuucgccgcau

SEQ ID NO: 4172552 - RNA, 23 nt, Yersinia pestis
ucuucgcgagucacauuuuuaau

SEQ ID NO: 4172553 - RNA, 18 nt, Yersinia pestis
ucuucugauucaauuucg

SEQ ID NO: 4172554 - RNA, 10 nt, Yersinia pestis
ucuucuggaa

SEQ ID NO: 4172555 - RNA, 18 nt, Yersinia pestis
ucuucuggaauggggaug

SEQ ID NO: 4172556 - RNA, 22 nt, Yersinia pestis
ucuucuugugagcgauauuuau

SEQ ID NO: 4172557 - RNA, 19 nt, Yersinia pestis
ucuucuuuauuguuuugua

SEQ ID NO: 4172558 - RNA, 11 nt, Yersinia pestis
ucuugaaaaaa

SEQ ID NO: 4172559 - RNA, 16 nt, Yersinia pestis
ucuugaaaauaugccc

SEQ ID NO: 4172560 - RNA, 22 nt, Yersinia pestis
ucuugaaccaauuuuucuguau

SEQ ID NO: 4172561 - RNA, 12 nt, Yersinia pestis
ucuugaauaaua

SEQ ID NO: 4172562 - RNA, 18 nt, Yersinia pestis
ucuugaauaauauucaau

SEQ ID NO: 4172563 - RNA, 23 nt, Yersinia pestis
ucuugacgguucgaaaauaauga

SEQ ID NO: 4172564 - RNA, 21 nt, Yersinia pestis
ucuugauuaccaauaauuaau

SEQ ID NO: 4172565 - RNA, 23 nt, Yersinia pestis
ucuugcaacaacgccucaucuuc

SEQ ID NO: 4172566 - RNA, 18 nt, Yersinia pestis
ucuugcaaggggcgagcc

SEQ ID NO: 4172567 - RNA, 21 nt, Yersinia pestis
ucuugcaaggggcgagccacg

SEQ ID NO: 4172568 - RNA, 17 nt, Yersinia pestis
ucuugcauacucaggcc

SEQ ID NO: 4172569 - RNA, 20 nt, Yersinia pestis
ucuugccagauggccagauu

SEQ ID NO: 4172570 - RNA, 12 nt, Yersinia pestis
ucuugccagcgg

SEQ ID NO: 4172571 - RNA, 23 nt, Yersinia pestis
ucuugccagcggcggccauccca

SEQ ID NO: 4172572 - RNA, 23 nt, Yersinia pestis
ucuugcucgaucagcgucagcag

SEQ ID NO: 4172573 - RNA, 15 nt, Yersinia pestis
ucuuggauaacagau

SEQ ID NO: 4172574 - RNA, 23 nt, Yersinia pestis
ucuuggauaacagauuugguauu

SEQ ID NO: 4172575 - RNA, 20 nt, Yersinia pestis
ucuuggcacucgaucaaucc

SEQ ID NO: 4172576 - RNA, 21 nt, Yersinia pestis
ucuugggcagcgacaaccugu

SEQ ID NO: 4172577 - RNA, 22 nt, Yersinia pestis
ucuugggcgggaucuccagaag

SEQ ID NO: 4172578 - RNA, 21 nt, Yersinia pestis
ucuugguguugcagucuccau

SEQ ID NO: 4172579 - RNA, 13 nt, Yersinia pestis
ucuuguguaauua

SEQ ID NO: 4172580 - RNA, 15 nt, Yersinia pestis
ucuuguuaauuuaaa

SEQ ID NO: 4172581 - RNA, 13 nt, Yersinia pestis
ucuuguucuaaua

SEQ ID NO: 4172582 - RNA, 14 nt, Yersinia pestis
ucuuuaauaauaga

SEQ ID NO: 4172583 - RNA, 20 nt, Yersinia pestis
ucuuuaaucaccucaaccug

SEQ ID NO: 4172584 - RNA, 18 nt, Yersinia pestis
ucuuuaauuuuucccuug

SEQ ID NO: 4172585 - RNA, 19 nt, Yersinia pestis
ucuuuacgaucugccuguu

SEQ ID NO: 4172586 - RNA, 19 nt, Yersinia pestis
ucuuuacuaaauuagaaaa

SEQ ID NO: 4172587 - RNA, 15 nt, Yersinia pestis
ucuuuauauucaaua

SEQ ID NO: 4172588 - RNA, 17 nt, Yersinia pestis
ucuuuauuauuauuuau

SEQ ID NO: 4172589 - RNA, 23 nt, Yersinia pestis
ucuuuauugcuccuuacuauuuu

SEQ ID NO: 4172590 - RNA, 15 nt, Yersinia pestis
ucuuucaaagugaca

SEQ ID NO: 4172591 - RNA, 16 nt, Yersinia pestis
ucuuucaacugcucau

SEQ ID NO: 4172592 - RNA, 14 nt, Yersinia pestis
ucuuucagcaccau

SEQ ID NO: 4172593 - RNA, 17 nt, Yersinia pestis
ucuuucauaucaaaagg

SEQ ID NO: 4172594 - RNA, 18 nt, Yersinia pestis
ucuuucaucccauaugcu

SEQ ID NO: 4172595 - RNA, 19 nt, Yersinia pestis
ucuuuccggguuuuuaaca

SEQ ID NO: 4172596 - RNA, 21 nt, Yersinia pestis
ucuuucucgauacaauuuuug

SEQ ID NO: 4172597 - RNA, 18 nt, Yersinia pestis
ucuuucuggcuaaacgau

SEQ ID NO: 4172598 - RNA, 16 nt, Yersinia pestis
ucuuucuguucagcau

SEQ ID NO: 4172599 - RNA, 20 nt, Yersinia pestis
ucuuucuguucagcauaaau

SEQ ID NO: 4172600 - RNA, 22 nt, Yersinia pestis
ucuuucuguucagcauaaauau

SEQ ID NO: 4172601 - RNA, 18 nt, Yersinia pestis
ucuuugaccagggcuaaa

SEQ ID NO: 4172602 - RNA, 15 nt, Yersinia pestis
ucuuugauuuaaaua

SEQ ID NO: 4172603 - RNA, 19 nt, Yersinia pestis
ucuuugauuuaaauauuau

SEQ ID NO: 4172604 - RNA, 22 nt, Yersinia pestis
ucuuugcugccaucagccggag

SEQ ID NO: 4172605 - RNA, 14 nt, Yersinia pestis
ucuuugcuucaggc

SEQ ID NO: 4172606 - RNA, 13 nt, Yersinia pestis
ucuuuguuacaua

SEQ ID NO: 4172607 - RNA, 21 nt, Yersinia pestis
ucuuuuagcgcuuuuacauca

SEQ ID NO: 4172608 - RNA, 13 nt, Yersinia pestis
ucuuuucugccaa

SEQ ID NO: 4172609 - RNA, 11 nt, Yersinia pestis
ucuuuuuaauu

SEQ ID NO: 4172610 - RNA, 12 nt, Yersinia pestis
ucuuuuuaauuu

SEQ ID NO: 4172611 - RNA, 22 nt, Yersinia pestis
ugaaaaaaaacacgguugaaaa

SEQ ID NO: 4172612 - RNA, 20 nt, Yersinia pestis
ugaaaaaaagaagaaaaaua

SEQ ID NO: 4172613 - RNA, 13 nt, Yersinia pestis
ugaaaaaauaaug

SEQ ID NO: 4172614 - RNA, 21 nt, Yersinia pestis
ugaaaaacagagggccccgau

SEQ ID NO: 4172615 - RNA, 14 nt, Yersinia pestis
ugaaaaaguccgca

SEQ ID NO: 4172616 - RNA, 21 nt, Yersinia pestis
ugaaaaaucugacucuguaaa

SEQ ID NO: 4172617 - RNA, 18 nt, Yersinia pestis
ugaaaacggcgaggaaga

SEQ ID NO: 4172618 - RNA, 18 nt, Yersinia pestis
ugaaaagguuaacugcag

SEQ ID NO: 4172619 - RNA, 13 nt, Yersinia pestis
ugaaaauaauaac

SEQ ID NO: 4172620 - RNA, 14 nt, Yersinia pestis
ugaaaaucaugaaa

SEQ ID NO: 4172621 - RNA, 16 nt, Yersinia pestis
ugaaaaucaugaaauu

SEQ ID NO: 4172622 - RNA, 22 nt, Yersinia pestis
ugaaacacaacaacggugaaca

SEQ ID NO: 4172623 - RNA, 13 nt, Yersinia pestis
ugaaacacuuauu

SEQ ID NO: 4172624 - RNA, 22 nt, Yersinia pestis
ugaaacacuuauuugaaauacu

SEQ ID NO: 4172625 - RNA, 22 nt, Yersinia pestis
ugaaacagcaggggcguuagcu

SEQ ID NO: 4172626 - RNA, 18 nt, Yersinia pestis
ugaaacauaauuaaauau

SEQ ID NO: 4172627 - RNA, 19 nt, Yersinia pestis
ugaaacauaauuaaauauu

SEQ ID NO: 4172628 - RNA, 20 nt, Yersinia pestis
ugaaacauaauuaaauauua

SEQ ID NO: 4172629 - RNA, 20 nt, Yersinia pestis
ugaaaccaaaaccuuuacca

SEQ ID NO: 4172630 - RNA, 13 nt, Yersinia pestis
ugaaaccacugcg

SEQ ID NO: 4172631 - RNA, 22 nt, Yersinia pestis
ugaaaccuacaucacacccagc

SEQ ID NO: 4172632 - RNA, 18 nt, Yersinia pestis
ugaaacgauaugcuccag

SEQ ID NO: 4172633 - RNA, 19 nt, Yersinia pestis
ugaaacgauaugcuccaga

SEQ ID NO: 4172634 - RNA, 20 nt, Yersinia pestis
ugaaacgauaugcuccagau

SEQ ID NO: 4172635 - RNA, 18 nt, Yersinia pestis
ugaaacggugaggauagg

SEQ ID NO: 4172636 - RNA, 18 nt, Yersinia pestis
ugaaacuuuccugacccg

SEQ ID NO: 4172637 - RNA, 17 nt, Yersinia pestis
ugaaagcacgaucagcu

SEQ ID NO: 4172638 - RNA, 16 nt, Yersinia pestis
ugaaagccaaucucuu

SEQ ID NO: 4172639 - RNA, 21 nt, Yersinia pestis
ugaaagccaaucucuuguuuu

SEQ ID NO: 4172640 - RNA, 14 nt, Yersinia pestis
ugaaagcuaauauu

SEQ ID NO: 4172641 - RNA, 20 nt, Yersinia pestis
ugaaagcuaauauucucuau

SEQ ID NO: 4172642 - RNA, 16 nt, Yersinia pestis
ugaaaggcggugaaca

SEQ ID NO: 4172643 - RNA, 19 nt, Yersinia pestis
ugaaaguggccacucaccu

SEQ ID NO: 4172644 - RNA, 13 nt, Yersinia pestis
ugaaauaacugcc

SEQ ID NO: 4172645 - RNA, 21 nt, Yersinia pestis
ugaaauaccgauuagaaaucg

SEQ ID NO: 4172646 - RNA, 14 nt, Yersinia pestis
ugaaauacuuauuu

SEQ ID NO: 4172647 - RNA, 22 nt, Yersinia pestis
ugaaauuagggguugcaggcug

SEQ ID NO: 4172648 - RNA, 18 nt, Yersinia pestis
ugaaauuaguuaauuuaa

SEQ ID NO: 4172649 - RNA, 19 nt, Yersinia pestis
ugaacaaaccacauuccag

SEQ ID NO: 4172650 - RNA, 21 nt, Yersinia pestis
ugaacaaaccccacuaacgcu

SEQ ID NO: 4172651 - RNA, 18 nt, Yersinia pestis
ugaacaacgcuaugcagc

SEQ ID NO: 4172652 - RNA, 14 nt, Yersinia pestis
ugaacaaugccaua

SEQ ID NO: 4172653 - RNA, 17 nt, Yersinia pestis
ugaacaauugccaggcc

SEQ ID NO: 4172654 - RNA, 18 nt, Yersinia pestis
ugaacacucuuuuuaauu

SEQ ID NO: 4172655 - RNA, 15 nt, Yersinia pestis
ugaacacuuaauucc

SEQ ID NO: 4172656 - RNA, 17 nt, Yersinia pestis
ugaacacuuaauuccau

SEQ ID NO: 4172657 - RNA, 21 nt, Yersinia pestis
ugaacaucuggcgauuuugcg

SEQ ID NO: 4172658 - RNA, 24 nt, Yersinia pestis
ugaaccaaaauucacaacuuguga

SEQ ID NO: 4172659 - RNA, 18 nt, Yersinia pestis
ugaaccagauaacaacaa

SEQ ID NO: 4172660 - RNA, 18 nt, Yersinia pestis
ugaaccaguugaucgucc

SEQ ID NO: 4172661 - RNA, 17 nt, Yersinia pestis
ugaacccuuucagcgcu

SEQ ID NO: 4172662 - RNA, 15 nt, Yersinia pestis
ugaaccgccauugca

SEQ ID NO: 4172663 - RNA, 18 nt, Yersinia pestis
ugaaccgcgcucugcugg

SEQ ID NO: 4172664 - RNA, 23 nt, Yersinia pestis
ugaacgaacacaucuuugcugcc

SEQ ID NO: 4172665 - RNA, 18 nt, Yersinia pestis
ugaacgaggacuuccugc

SEQ ID NO: 4172666 - RNA, 19 nt, Yersinia pestis
ugaacgcccuguaaugggu

SEQ ID NO: 4172667 - RNA, 15 nt, Yersinia pestis
ugaacgcucuuucug

SEQ ID NO: 4172668 - RNA, 16 nt, Yersinia pestis
ugaacguacuuugguu

SEQ ID NO: 4172669 - RNA, 22 nt, Yersinia pestis
ugaacguguuagguaauaccaa

SEQ ID NO: 4172670 - RNA, 14 nt, Yersinia pestis
ugaacuaucgccug

SEQ ID NO: 4172671 - RNA, 20 nt, Yersinia pestis
ugaacucgccuucagguaau

SEQ ID NO: 4172672 - RNA, 15 nt, Yersinia pestis
ugaacuguggcauga

SEQ ID NO: 4172673 - RNA, 18 nt, Yersinia pestis
ugaacuucaaaucgccaa

SEQ ID NO: 4172674 - RNA, 21 nt, Yersinia pestis
ugaacuucaaaucgccaaacu

SEQ ID NO: 4172675 - RNA, 21 nt, Yersinia pestis
ugaacuucgaaagaaauaaaa

SEQ ID NO: 4172676 - RNA, 16 nt, Yersinia pestis
ugaacuuuaacuucca

SEQ ID NO: 4172677 - RNA, 13 nt, Yersinia pestis
ugaagaaaccuaa

SEQ ID NO: 4172678 - RNA, 14 nt, Yersinia pestis
ugaagaaaccuaau

SEQ ID NO: 4172679 - RNA, 16 nt, Yersinia pestis
ugaagacacacuuauu

SEQ ID NO: 4172680 - RNA, 15 nt, Yersinia pestis
ugaagacacccguca

SEQ ID NO: 4172681 - RNA, 20 nt, Yersinia pestis
ugaagaggguuuuuaaauuu

SEQ ID NO: 4172682 - RNA, 21 nt, Yersinia pestis
ugaagagugaccaaagcagua

SEQ ID NO: 4172683 - RNA, 17 nt, Yersinia pestis
ugaagaguuugaucaug

SEQ ID NO: 4172684 - RNA, 22 nt, Yersinia pestis
ugaagauacccuucucuuuauc

SEQ ID NO: 4172685 - RNA, 23 nt, Yersinia pestis
ugaagauacccuucucuuuauca

SEQ ID NO: 4172686 - RNA, 22 nt, Yersinia pestis
ugaagauacccuugagguuauu

SEQ ID NO: 4172687 - RNA, 17 nt, Yersinia pestis
ugaagaugcuucagcca

SEQ ID NO: 4172688 - RNA, 18 nt, Yersinia pestis
ugaagaugcuucagccac

SEQ ID NO: 4172689 - RNA, 14 nt, Yersinia pestis
ugaagcaguucacu

SEQ ID NO: 4172690 - RNA, 17 nt, Yersinia pestis
ugaaggcugauuaauau

SEQ ID NO: 4172691 - RNA, 18 nt, Yersinia pestis
ugaaggcugauuaauauc

SEQ ID NO: 4172692 - RNA, 17 nt, Yersinia pestis
ugaagggcaaaacguga

SEQ ID NO: 4172693 - RNA, 19 nt, Yersinia pestis
ugaagguacgcaccauuga

SEQ ID NO: 4172694 - RNA, 21 nt, Yersinia pestis
ugaagguacgcaccauugagc

SEQ ID NO: 4172695 - RNA, 18 nt, Yersinia pestis
ugaaguaucaccacguug

SEQ ID NO: 4172696 - RNA, 15 nt, Yersinia pestis
ugaaguaugacgggu

SEQ ID NO: 4172697 - RNA, 17 nt, Yersinia pestis
ugaagugugcaaauaaa

SEQ ID NO: 4172698 - RNA, 16 nt, Yersinia pestis
ugaaguuauuuuuauu

SEQ ID NO: 4172699 - RNA, 15 nt, Yersinia pestis
ugaaguugucaguga

SEQ ID NO: 4172700 - RNA, 19 nt, Yersinia pestis
ugaaguuuauacuauuuau

SEQ ID NO: 4172701 - RNA, 13 nt, Yersinia pestis
ugaauaaaucaaa

SEQ ID NO: 4172702 - RNA, 20 nt, Yersinia pestis
ugaauaacuucgcgaacaca

SEQ ID NO: 4172703 - RNA, 15 nt, Yersinia pestis
ugaauaauauucaau

SEQ ID NO: 4172704 - RNA, 14 nt, Yersinia pestis
ugaauaccauaaca

SEQ ID NO: 4172705 - RNA, 15 nt, Yersinia pestis
ugaauaccauaacaa

SEQ ID NO: 4172706 - RNA, 13 nt, Yersinia pestis
ugaauaccgcugg

SEQ ID NO: 4172707 - RNA, 15 nt, Yersinia pestis
ugaauagaggacuau

SEQ ID NO: 4172708 - RNA, 14 nt, Yersinia pestis
ugaauagcgcugca

SEQ ID NO: 4172709 - RNA, 21 nt, Yersinia pestis
ugaauagcgcugcaucagcag

SEQ ID NO: 4172710 - RNA, 18 nt, Yersinia pestis
ugaauagguaaaacaucu

SEQ ID NO: 4172711 - RNA, 17 nt, Yersinia pestis
ugaauaguaacgcgcca

SEQ ID NO: 4172712 - RNA, 18 nt, Yersinia pestis
ugaauauaaauuuaauaa

SEQ ID NO: 4172713 - RNA, 16 nt, Yersinia pestis
ugaauaucaccauauu

SEQ ID NO: 4172714 - RNA, 18 nt, Yersinia pestis
ugaauaucaccauauuca

SEQ ID NO: 4172715 - RNA, 18 nt, Yersinia pestis
ugaauaucacccauaaau

SEQ ID NO: 4172716 - RNA, 13 nt, Yersinia pestis
ugaauaucaucuu

SEQ ID NO: 4172717 - RNA, 15 nt, Yersinia pestis
ugaauauccaauggu

SEQ ID NO: 4172718 - RNA, 13 nt, Yersinia pestis
ugaauauccgccg

SEQ ID NO: 4172719 - RNA, 11 nt, Yersinia pestis
ugaauaucuug

SEQ ID NO: 4172720 - RNA, 13 nt, Yersinia pestis
ugaauauuauuca

SEQ ID NO: 4172721 - RNA, 15 nt, Yersinia pestis
ugaauauuuuuaauc

SEQ ID NO: 4172722 - RNA, 17 nt, Yersinia pestis
ugaauauuuuuaaucug

SEQ ID NO: 4172723 - RNA, 15 nt, Yersinia pestis
ugaaucaaaauaccc

SEQ ID NO: 4172724 - RNA, 17 nt, Yersinia pestis
ugaauccauaagauuga

SEQ ID NO: 4172725 - RNA, 23 nt, Yersinia pestis
ugaaucccagaaccucaacauuc

SEQ ID NO: 4172726 - RNA, 16 nt, Yersinia pestis
ugaaucgccgaaaucu

SEQ ID NO: 4172727 - RNA, 21 nt, Yersinia pestis
ugaaucgccgaaaucucacca

SEQ ID NO: 4172728 - RNA, 14 nt, Yersinia pestis
ugaaugacuggcua

SEQ ID NO: 4172729 - RNA, 17 nt, Yersinia pestis
ugaaugagguuuacauu

SEQ ID NO: 4172730 - RNA, 12 nt, Yersinia pestis
ugaaugauggua

SEQ ID NO: 4172731 - RNA, 19 nt, Yersinia pestis
ugaauggcaacgcgcagug

SEQ ID NO: 4172732 - RNA, 15 nt, Yersinia pestis
ugaauggcugccauc

SEQ ID NO: 4172733 - RNA, 19 nt, Yersinia pestis
ugaauggggggcaaccugg

SEQ ID NO: 4172734 - RNA, 18 nt, Yersinia pestis
ugaauggugcuguauuua

SEQ ID NO: 4172735 - RNA, 18 nt, Yersinia pestis
ugaaugucucuggcgcga

SEQ ID NO: 4172736 - RNA, 22 nt, Yersinia pestis
ugaaugugaguguucauugaga

SEQ ID NO: 4172737 - RNA, 13 nt, Yersinia pestis
ugaauuaacauac

SEQ ID NO: 4172738 - RNA, 14 nt, Yersinia pestis
ugaauuaaccuuac

SEQ ID NO: 4172739 - RNA, 18 nt, Yersinia pestis
ugaauuacguuuuggauc

SEQ ID NO: 4172740 - RNA, 19 nt, Yersinia pestis
ugaauuagguaacuuucca

SEQ ID NO: 4172741 - RNA, 16 nt, Yersinia pestis
ugaauuauuucaguag

SEQ ID NO: 4172742 - RNA, 14 nt, Yersinia pestis
ugaauucaagaagg

SEQ ID NO: 4172743 - RNA, 12 nt, Yersinia pestis
ugaauucaccaa

SEQ ID NO: 4172744 - RNA, 16 nt, Yersinia pestis
ugaauugaugucaauu

SEQ ID NO: 4172745 - RNA, 22 nt, Yersinia pestis
ugaauugauuuauuccucucug

SEQ ID NO: 4172746 - RNA, 12 nt, Yersinia pestis
ugaauuucuucc

SEQ ID NO: 4172747 - RNA, 22 nt, Yersinia pestis
ugaauuuggugguggccugguu

SEQ ID NO: 4172748 - RNA, 19 nt, Yersinia pestis
ugacaaaaacagcacuauc

SEQ ID NO: 4172749 - RNA, 19 nt, Yersinia pestis
ugacaaaggguaauuaauu

SEQ ID NO: 4172750 - RNA, 17 nt, Yersinia pestis
ugacaacaucaaaugaa

SEQ ID NO: 4172751 - RNA, 18 nt, Yersinia pestis
ugacaacaucaaaugaag

SEQ ID NO: 4172752 - RNA, 19 nt, Yersinia pestis
ugacaacgucacuuccauc

SEQ ID NO: 4172753 - RNA, 21 nt, Yersinia pestis
ugacaacguguccgcaccauu

SEQ ID NO: 4172754 - RNA, 17 nt, Yersinia pestis
ugacaaugcguuauaac

SEQ ID NO: 4172755 - RNA, 19 nt, Yersinia pestis
ugacaaugcguuauaacca

SEQ ID NO: 4172756 - RNA, 19 nt, Yersinia pestis
ugacaaugcguuauaacua

SEQ ID NO: 4172757 - RNA, 18 nt, Yersinia pestis
ugacacauauuucaggcu

SEQ ID NO: 4172758 - RNA, 20 nt, Yersinia pestis
ugacaccauugauaauaaua

SEQ ID NO: 4172759 - RNA, 16 nt, Yersinia pestis
ugacacgagaaggguu

SEQ ID NO: 4172760 - RNA, 18 nt, Yersinia pestis
ugacacgggaucaacaug

SEQ ID NO: 4172761 - RNA, 16 nt, Yersinia pestis
ugacacggguauuggc

SEQ ID NO: 4172762 - RNA, 22 nt, Yersinia pestis
ugacacucggcgguuugagcca

SEQ ID NO: 4172763 - RNA, 23 nt, Yersinia pestis
ugacagcauacauccuaaauaau

SEQ ID NO: 4172764 - RNA, 18 nt, Yersinia pestis
ugacagcaucaauaucgc

SEQ ID NO: 4172765 - RNA, 15 nt, Yersinia pestis
ugacaggcaaagacu

SEQ ID NO: 4172766 - RNA, 22 nt, Yersinia pestis
ugacaguagaauaccucacugg

SEQ ID NO: 4172767 - RNA, 17 nt, Yersinia pestis
ugacaguagugaguuaa

SEQ ID NO: 4172768 - RNA, 16 nt, Yersinia pestis
ugacaguauuuguagu

SEQ ID NO: 4172769 - RNA, 22 nt, Yersinia pestis
ugacauaacguuguacggguaa

SEQ ID NO: 4172770 - RNA, 22 nt, Yersinia pestis
ugacaucagccauauguugcca

SEQ ID NO: 4172771 - RNA, 10 nt, Yersinia pestis
ugacaucauc

SEQ ID NO: 4172772 - RNA, 13 nt, Yersinia pestis
ugacaucccagca

SEQ ID NO: 4172773 - RNA, 18 nt, Yersinia pestis
ugacauccgcuugcagca

SEQ ID NO: 4172774 - RNA, 17 nt, Yersinia pestis
ugacaugcuuaauuauu

SEQ ID NO: 4172775 - RNA, 21 nt, Yersinia pestis
ugacauuauuggcguaacugc

SEQ ID NO: 4172776 - RNA, 13 nt, Yersinia pestis
ugacauugcccgc

SEQ ID NO: 4172777 - RNA, 14 nt, Yersinia pestis
ugacauuuccuugu

SEQ ID NO: 4172778 - RNA, 14 nt, Yersinia pestis
ugacauuucuuaua

SEQ ID NO: 4172779 - RNA, 18 nt, Yersinia pestis
ugacauuucuuuuuaugu

SEQ ID NO: 4172780 - RNA, 19 nt, Yersinia pestis
ugaccacaaaaacaguguc

SEQ ID NO: 4172781 - RNA, 18 nt, Yersinia pestis
ugaccacgcaucaauaau

SEQ ID NO: 4172782 - RNA, 20 nt, Yersinia pestis
ugaccacgcaucaauaauaa

SEQ ID NO: 4172783 - RNA, 19 nt, Yersinia pestis
ugaccacugcuucugucag

SEQ ID NO: 4172784 - RNA, 21 nt, Yersinia pestis
ugaccacuugcugaugcccau

SEQ ID NO: 4172785 - RNA, 15 nt, Yersinia pestis
uccuucagacugcug

SEQ ID NO: 4172786 - RNA, 17 nt, Yersinia pestis
uccuugggucaguuuua

SEQ ID NO: 4172787 - RNA, 21 nt, Yersinia pestis
uccuugguaccgauuaugcca

SEQ ID NO: 4172788 - RNA, 15 nt, Yersinia pestis
uccuuguaaggugcu

SEQ ID NO: 4172789 - RNA, 22 nt, Yersinia pestis
uccuuguggauccagcaccaca

SEQ ID NO: 4172790 - RNA, 20 nt, Yersinia pestis
uccuuucuuuucgcuauuuc

SEQ ID NO: 4172791 - RNA, 21 nt, Yersinia pestis
uccuuuuuucugcaaaucagc

SEQ ID NO: 4172792 - RNA, 22 nt, Yersinia pestis
ucgaaaacucaaagauuucauc

SEQ ID NO: 4172793 - RNA, 15 nt, Yersinia pestis
ucgaaaagcgccuuu

SEQ ID NO: 4172794 - RNA, 12 nt, Yersinia pestis
ucgaaaauaacc

SEQ ID NO: 4172795 - RNA, 13 nt, Yersinia pestis
ucgaaaauaauga

SEQ ID NO: 4172796 - RNA, 21 nt, Yersinia pestis
ucgaaacacccuccuauuaau

SEQ ID NO: 4172797 - RNA, 13 nt, Yersinia pestis
ucgaaagaaauaa

SEQ ID NO: 4172798 - RNA, 17 nt, Yersinia pestis
ucgaaagauagcaaaag

SEQ ID NO: 4172799 - RNA, 17 nt, Yersinia pestis
ucgaaauuaaggaaaag

SEQ ID NO: 4172800 - RNA, 19 nt, Yersinia pestis
ucgaacauaaaaaugcacu

SEQ ID NO: 4172801 - RNA, 22 nt, Yersinia pestis
ucgaacauaaaaaugcacugaa

SEQ ID NO: 4172802 - RNA, 14 nt, Yersinia pestis
ucgaacccaaccag

SEQ ID NO: 4172803 - RNA, 18 nt, Yersinia pestis
ucgaaccugaacgcagga

SEQ ID NO: 4172804 - RNA, 17 nt, Yersinia pestis
ucgaacuaucuuuucga

SEQ ID NO: 4172805 - RNA, 21 nt, Yersinia pestis
ucgacaaucucggcauugguu

SEQ ID NO: 4172806 - RNA, 17 nt, Yersinia pestis
ucgacaccauguccaug

SEQ ID NO: 4172807 - RNA, 14 nt, Yersinia pestis
ucgacaccuucaau

SEQ ID NO: 4172808 - RNA, 16 nt, Yersinia pestis
ucgacaccuucaauca

SEQ ID NO: 4172809 - RNA, 21 nt, Yersinia pestis
ucgacaccuucaaucauugag

SEQ ID NO: 4172810 - RNA, 16 nt, Yersinia pestis
ucgacaggcaauuauc

SEQ ID NO: 4172811 - RNA, 15 nt, Yersinia pestis
ucgacaguguaaaaa

SEQ ID NO: 4172812 - RNA, 19 nt, Yersinia pestis
ucgacauaaagaugcaagc

SEQ ID NO: 4172813 - RNA, 18 nt, Yersinia pestis
ucgaccuuaaccgcacaa

SEQ ID NO: 4172814 - RNA, 14 nt, Yersinia pestis
ucgacgauauugau

SEQ ID NO: 4172815 - RNA, 19 nt, Yersinia pestis
ucgacgccagaggcgaucu

SEQ ID NO: 4172816 - RNA, 17 nt, Yersinia pestis
ucgacgcgccauaagcc

SEQ ID NO: 4172817 - RNA, 17 nt, Yersinia pestis
ucgacggccaauuucag

SEQ ID NO: 4172818 - RNA, 20 nt, Yersinia pestis
ucgacucaauaaauccauca

SEQ ID NO: 4172819 - RNA, 21 nt, Yersinia pestis
ucgacucaauaaauccaucaa

SEQ ID NO: 4172820 - RNA, 23 nt, Yersinia pestis
ucgacucugggccgugaguuuuc

SEQ ID NO: 4172821 - RNA, 23 nt, Yersinia pestis
ucgacucuuuuugugcuucauau

SEQ ID NO: 4172822 - RNA, 18 nt, Yersinia pestis
ucgagauguauccaaggc

SEQ ID NO: 4172823 - RNA, 17 nt, Yersinia pestis
ucgagcaacuuuuacug

SEQ ID NO: 4172824 - RNA, 21 nt, Yersinia pestis
ucgagccgcgccauccuuggc

SEQ ID NO: 4172825 - RNA, 17 nt, Yersinia pestis
ucgagccgcgcccuccc

SEQ ID NO: 4172826 - RNA, 13 nt, Yersinia pestis
ucgagccuacaua

SEQ ID NO: 4172827 - RNA, 16 nt, Yersinia pestis
ucgagcgcuaauauua

SEQ ID NO: 4172828 - RNA, 19 nt, Yersinia pestis
ucgagcgggcuucaccauc

SEQ ID NO: 4172829 - RNA, 17 nt, Yersinia pestis
ucgagcggggcaaaaau

SEQ ID NO: 4172830 - RNA, 15 nt, Yersinia pestis
ucgagcuaccggcau

SEQ ID NO: 4172831 - RNA, 20 nt, Yersinia pestis
ucgagcuguuugcuguaaac

SEQ ID NO: 4172832 - RNA, 15 nt, Yersinia pestis
ucgagugugaugaug

SEQ ID NO: 4172833 - RNA, 12 nt, Yersinia pestis
ucgaguuuauau

SEQ ID NO: 4172834 - RNA, 22 nt, Yersinia pestis
ucgauaagcacuccacuggugg

SEQ ID NO: 4172835 - RNA, 22 nt, Yersinia pestis
ucgauacaaaccguugcucagc

SEQ ID NO: 4172836 - RNA, 15 nt, Yersinia pestis
ucgauacccuucauc

SEQ ID NO: 4172837 - RNA, 15 nt, Yersinia pestis
ucgauagcaacaucg

SEQ ID NO: 4172838 - RNA, 16 nt, Yersinia pestis
ucgauagcuuucuccu

SEQ ID NO: 4172839 - RNA, 21 nt, Yersinia pestis
ucgauaguaacaccagcaucc

SEQ ID NO: 4172840 - RNA, 16 nt, Yersinia pestis
ucgauagucagcuuca

SEQ ID NO: 4172841 - RNA, 17 nt, Yersinia pestis
ucgauauggaugguauu

SEQ ID NO: 4172842 - RNA, 17 nt, Yersinia pestis
ucgaucaaaacaauaaa

SEQ ID NO: 4172843 - RNA, 15 nt, Yersinia pestis
ucgaucaaccauuca

SEQ ID NO: 4172844 - RNA, 17 nt, Yersinia pestis
ucgaucacaugcucagu

SEQ ID NO: 4172845 - RNA, 19 nt, Yersinia pestis
ucgaucagcgucagcagau

SEQ ID NO: 4172846 - RNA, 17 nt, Yersinia pestis
ucgauccgaauauguca

SEQ ID NO: 4172847 - RNA, 17 nt, Yersinia pestis
ucgauccgauaauaauu

SEQ ID NO: 4172848 - RNA, 20 nt, Yersinia pestis
ucgaugccggguuggcuccc

SEQ ID NO: 4172849 - RNA, 11 nt, Yersinia pestis
ucgauggcuuu

SEQ ID NO: 4172850 - RNA, 22 nt, Yersinia pestis
ucgaugggugaaagcuaauauu

SEQ ID NO: 4172851 - RNA, 20 nt, Yersinia pestis
ucgauucaucauaccuuacu

SEQ ID NO: 4172852 - RNA, 16 nt, Yersinia pestis
ucgauuuccauauuau

SEQ ID NO: 4172853 - RNA, 13 nt, Yersinia pestis
ucgauuucugcau

SEQ ID NO: 4172854 - RNA, 14 nt, Yersinia pestis
ucgauuuuagcuuu

SEQ ID NO: 4172855 - RNA, 13 nt, Yersinia pestis
ucgauuuuuauuu

SEQ ID NO: 4172856 - RNA, 13 nt, Yersinia pestis
ucgcaaaaugcca

SEQ ID NO: 4172857 - RNA, 16 nt, Yersinia pestis
ucgcaaagcgggccag

SEQ ID NO: 4172858 - RNA, 22 nt, Yersinia pestis
ucgcaaagcgggccagcaacca

SEQ ID NO: 4172859 - RNA, 21 nt, Yersinia pestis
ucgcaaccagcguugagaaga

SEQ ID NO: 4172860 - RNA, 19 nt, Yersinia pestis
ucgcaauauauggccauua

SEQ ID NO: 4172861 - RNA, 18 nt, Yersinia pestis
ucgcaccacaaugauuuc

SEQ ID NO: 4172862 - RNA, 17 nt, Yersinia pestis
ucgcacccuuacccugg

SEQ ID NO: 4172863 - RNA, 19 nt, Yersinia pestis
ucgcaccgaugucuaacaa

SEQ ID NO: 4172864 - RNA, 21 nt, Yersinia pestis
ucgcacugauagcaaucccaa

SEQ ID NO: 4172865 - RNA, 13 nt, Yersinia pestis
ucgcacuucaacc

SEQ ID NO: 4172866 - RNA, 22 nt, Yersinia pestis
ucgcacuucaagcagcaugugu

SEQ ID NO: 4172867 - RNA, 17 nt, Yersinia pestis
ucgcacuugaucagggg

SEQ ID NO: 4172868 - RNA, 18 nt, Yersinia pestis
ucgcacuuuaaauaccca

SEQ ID NO: 4172869 - RNA, 15 nt, Yersinia pestis
ucgcagaacccaggg

SEQ ID NO: 4172870 - RNA, 12 nt, Yersinia pestis
ucgcagcagaga

SEQ ID NO: 4172871 - RNA, 17 nt, Yersinia pestis
ucgcagccaaaauaauc

SEQ ID NO: 4172872 - RNA, 14 nt, Yersinia pestis
ucgcagcuuccagc

SEQ ID NO: 4172873 - RNA, 15 nt, Yersinia pestis
ucgcaggcuucaacu

SEQ ID NO: 4172874 - RNA, 16 nt, Yersinia pestis
ucgcauaggccaauag

SEQ ID NO: 4172875 - RNA, 19 nt, Yersinia pestis
ucgcaucgucgcuguuacc

SEQ ID NO: 4172876 - RNA, 13 nt, Yersinia pestis
ucgcaucuuccaa

SEQ ID NO: 4172877 - RNA, 15 nt, Yersinia pestis
ucgcaucuuccaaag

SEQ ID NO: 4172878 - RNA, 22 nt, Yersinia pestis
ucgcaucuuccaaaggaaggga

SEQ ID NO: 4172879 - RNA, 15 nt, Yersinia pestis
ucgcaugguuaaaac

SEQ ID NO: 4172880 - RNA, 14 nt, Yersinia pestis
ucgcauugucaccc

SEQ ID NO: 4172881 - RNA, 18 nt, Yersinia pestis
ucgccaaacaaauguuua

SEQ ID NO: 4172882 - RNA, 20 nt, Yersinia pestis
ucgccaacaggccuaaugcc

SEQ ID NO: 4172883 - RNA, 18 nt, Yersinia pestis
ucgccagcggguacacug

SEQ ID NO: 4172884 - RNA, 17 nt, Yersinia pestis
ucgcccccucuggcaua

SEQ ID NO: 4172885 - RNA, 20 nt, Yersinia pestis
ucgccccuuagcgcacgggg

SEQ ID NO: 4172886 - RNA, 14 nt, Yersinia pestis
ucgcccucuggugc

SEQ ID NO: 4172887 - RNA, 14 nt, Yersinia pestis
ucgcccuucuucca

SEQ ID NO: 4172888 - RNA, 12 nt, Yersinia pestis
ucgcccuuucuu

SEQ ID NO: 4172889 - RNA, 19 nt, Yersinia pestis
ucgccgcaaauuaacacau

SEQ ID NO: 4172890 - RNA, 16 nt, Yersinia pestis
ucgccgguaauaccga

SEQ ID NO: 4172891 - RNA, 23 nt, Yersinia pestis
ucgccguuacccccuucaccaau

SEQ ID NO: 4172892 - RNA, 13 nt, Yersinia pestis
ucgccuauaaaaa

SEQ ID NO: 4172893 - RNA, 18 nt, Yersinia pestis
ucgccugaugcuuuucuu

SEQ ID NO: 4172894 - RNA, 14 nt, Yersinia pestis
ucgccugcugagcc

SEQ ID NO: 4172895 - RNA, 22 nt, Yersinia pestis
ucgccuuaucagcgaaaaauuu

SEQ ID NO: 4172896 - RNA, 14 nt, Yersinia pestis
ucgccuucuggcaa

SEQ ID NO: 4172897 - RNA, 17 nt, Yersinia pestis
ucgccuugccgcuguug

SEQ ID NO: 4172898 - RNA, 22 nt, Yersinia pestis
ucgccuuucacgcguucaaucu

SEQ ID NO: 4172899 - RNA, 22 nt, Yersinia pestis
ucgcgaccaauucaucagcgcu

SEQ ID NO: 4172900 - RNA, 15 nt, Yersinia pestis
ucgcgaccagcagaa

SEQ ID NO: 4172901 - RNA, 21 nt, Yersinia pestis
ucgcgauaaaauucagccacu

SEQ ID NO: 4172902 - RNA, 22 nt, Yersinia pestis
ucgcgaugcgccuguuagggcg

SEQ ID NO: 4172903 - RNA, 16 nt, Yersinia pestis
ucgcgccuaccugccu

SEQ ID NO: 4172904 - RNA, 18 nt, Yersinia pestis
ucgcgccuaccugccugc

SEQ ID NO: 4172905 - RNA, 13 nt, Yersinia pestis
ucgcgcuucaggu

SEQ ID NO: 4172906 - RNA, 17 nt, Yersinia pestis
ucgcggguuuuuaacuu

SEQ ID NO: 4172907 - RNA, 16 nt, Yersinia pestis
ucgcguuggcuaaaau

SEQ ID NO: 4172908 - RNA, 21 nt, Yersinia pestis
ucgcguuugaucaaaucauac

SEQ ID NO: 4172909 - RNA, 18 nt, Yersinia pestis
ucgcuaaaaccuaauaac

SEQ ID NO: 4172910 - RNA, 19 nt, Yersinia pestis
ucgcuaacucaauaaauuc

SEQ ID NO: 4172911 - RNA, 15 nt, Yersinia pestis
ucgcuaauuucuccc

SEQ ID NO: 4172912 - RNA, 12 nt, Yersinia pestis
ucgcuauuuccg

SEQ ID NO: 4172913 - RNA, 15 nt, Yersinia pestis
ucgcuccucagccuu

SEQ ID NO: 4172914 - RNA, 13 nt, Yersinia pestis
ucgcucuccugcc

SEQ ID NO: 4172915 - RNA, 17 nt, Yersinia pestis
ucgcucugcguuuuucc

SEQ ID NO: 4172916 - RNA, 15 nt, Yersinia pestis
ucgcugaaaugcuau

SEQ ID NO: 4172917 - RNA, 16 nt, Yersinia pestis
ucgcugagacccgauu

SEQ ID NO: 4172918 - RNA, 12 nt, Yersinia pestis
ucgcugccaccg

SEQ ID NO: 4172919 - RNA, 23 nt, Yersinia pestis
ucgcugggccuacuggugccuga

SEQ ID NO: 4172920 - RNA, 20 nt, Yersinia pestis
ucgcugguggcuugaugaua

SEQ ID NO: 4172921 - RNA, 15 nt, Yersinia pestis
ucgcuguagcgccag

SEQ ID NO: 4172922 - RNA, 19 nt, Yersinia pestis
ucgcuguagcgccagguaa

SEQ ID NO: 4172923 - RNA, 14 nt, Yersinia pestis
ucgcuuccaggaca

SEQ ID NO: 4172924 - RNA, 15 nt, Yersinia pestis
ucgcuucgcucggcu

SEQ ID NO: 4172925 - RNA, 12 nt, Yersinia pestis
ucgcuugcugcc

SEQ ID NO: 4172926 - RNA, 13 nt, Yersinia pestis
ucgcuugcugccu

SEQ ID NO: 4172927 - RNA, 20 nt, Yersinia pestis
ucgcuuuugugaucaguuca

SEQ ID NO: 4172928 - RNA, 14 nt, Yersinia pestis
ucggauaaccgcau

SEQ ID NO: 4172929 - RNA, 20 nt, Yersinia pestis
ucggauaaccgcgaagaggg

SEQ ID NO: 4172930 - RNA, 13 nt, Yersinia pestis
ucggaucacgccc

SEQ ID NO: 4172931 - RNA, 16 nt, Yersinia pestis
ucggaucagcgccugc

SEQ ID NO: 4172932 - RNA, 18 nt, Yersinia pestis
ucggaugccgcuccagca

SEQ ID NO: 4172933 - RNA, 19 nt, Yersinia pestis
ucggaugccgcuccagcac

SEQ ID NO: 4172934 - RNA, 19 nt, Yersinia pestis
ucggcaauaauaucuggcg

SEQ ID NO: 4172935 - RNA, 11 nt, Yersinia pestis
ucggcaggcaa

SEQ ID NO: 4172936 - RNA, 16 nt, Yersinia pestis
ucggcauacuccauuu

SEQ ID NO: 4172937 - RNA, 14 nt, Yersinia pestis
ucggccaacaucuu

SEQ ID NO: 4172938 - RNA, 16 nt, Yersinia pestis
ucggccacccgccauc

SEQ ID NO: 4172939 - RNA, 22 nt, Yersinia pestis
ucggccaguguuuucuccacac

SEQ ID NO: 4172940 - RNA, 20 nt, Yersinia pestis
ucggccauauuaccgcugaa

SEQ ID NO: 4172941 - RNA, 16 nt, Yersinia pestis
ucggccauuuacccgu

SEQ ID NO: 4172942 - RNA, 18 nt, Yersinia pestis
ucggccauuuacccguca

SEQ ID NO: 4172943 - RNA, 22 nt, Yersinia pestis
ucggcccaacuugcuggcagga

SEQ ID NO: 4172944 - RNA, 15 nt, Yersinia pestis
ucggccccuuaccua

SEQ ID NO: 4172945 - RNA, 22 nt, Yersinia pestis
ucggcccgcaaccugacugcug

SEQ ID NO: 4172946 - RNA, 17 nt, Yersinia pestis
ucggccuguucucgccg

SEQ ID NO: 4172947 - RNA, 16 nt, Yersinia pestis
ucggcggagagaaugg

SEQ ID NO: 4172948 - RNA, 15 nt, Yersinia pestis
ucggcggccauguca

SEQ ID NO: 4172949 - RNA, 21 nt, Yersinia pestis
ucgggauccgccugcuggcca

SEQ ID NO: 4172950 - RNA, 22 nt, Yersinia pestis
ucgggcuuuacagucgcugcug

SEQ ID NO: 4172951 - RNA, 16 nt, Yersinia pestis
ucggggguugucagca

SEQ ID NO: 4172952 - RNA, 19 nt, Yersinia pestis
ucggggguugucagcaguc

SEQ ID NO: 4172953 - RNA, 19 nt, Yersinia pestis
ucgggguuugucagcaguc

SEQ ID NO: 4172954 - RNA, 13 nt, Yersinia pestis
ucggguagcaucc

SEQ ID NO: 4172955 - RNA, 19 nt, Yersinia pestis
ucggguucuaaauccugca

SEQ ID NO: 4172956 - RNA, 20 nt, Yersinia pestis
ucgguaacuuacaggcugcc

SEQ ID NO: 4172957 - RNA, 20 nt, Yersinia pestis
ucgguaagcuggcuucuuuu

SEQ ID NO: 4172958 - RNA, 22 nt, Yersinia pestis
ucgguacaaucucugggugcug

SEQ ID NO: 4172959 - RNA, 23 nt, Yersinia pestis
ucggugcauguaacuguaacgau

SEQ ID NO: 4172960 - RNA, 11 nt, Yersinia pestis
ucgguggcccu

SEQ ID NO: 4172961 - RNA, 23 nt, Yersinia pestis
ucggugugacuuucaaucgcgau

SEQ ID NO: 4172962 - RNA, 22 nt, Yersinia pestis
ucgguuaauauugaauaaccua

SEQ ID NO: 4172963 - RNA, 19 nt, Yersinia pestis
ucguaacccccagccagaa

SEQ ID NO: 4172964 - RNA, 19 nt, Yersinia pestis
ucguaauggcgauaauauu

SEQ ID NO: 4172965 - RNA, 16 nt, Yersinia pestis
ucguacuuuccuuccu

SEQ ID NO: 4172966 - RNA, 17 nt, Yersinia pestis
ucguaguaauagguggu

SEQ ID NO: 4172967 - RNA, 18 nt, Yersinia pestis
ucguauaacauaauaaau

SEQ ID NO: 4172968 - RNA, 15 nt, Yersinia pestis
ucguauguuuuuaac

SEQ ID NO: 4172969 - RNA, 16 nt, Yersinia pestis
ucgucaaacucggccg

SEQ ID NO: 4172970 - RNA, 21 nt, Yersinia pestis
ucgucagugcgguaaccagca

SEQ ID NO: 4172971 - RNA, 13 nt, Yersinia pestis
ucguccagcagca

SEQ ID NO: 4172972 - RNA, 18 nt, Yersinia pestis
ucgucgaauccaugauga

SEQ ID NO: 4172973 - RNA, 14 nt, Yersinia pestis
ucgucggcccggcc

SEQ ID NO: 4172974 - RNA, 19 nt, Yersinia pestis
ucgucggcccggccaggcu

SEQ ID NO: 4172975 - RNA, 20 nt, Yersinia pestis
ucgucggcccggccaggcuc

SEQ ID NO: 4172976 - RNA, 21 nt, Yersinia pestis
ucgucggcccggccaggcucc

SEQ ID NO: 4172977 - RNA, 15 nt, Yersinia pestis
ucgucguaauauuuc

SEQ ID NO: 4172978 - RNA, 22 nt, Yersinia pestis
ucgucuauagugccuaauaaau

SEQ ID NO: 4172979 - RNA, 14 nt, Yersinia pestis
ucgucuucagcuuc

SEQ ID NO: 4172980 - RNA, 17 nt, Yersinia pestis
ucgucuucgcauucuuu

SEQ ID NO: 4172981 - RNA, 14 nt, Yersinia pestis
ucgugaaagcagaa

SEQ ID NO: 4172982 - RNA, 15 nt, Yersinia pestis
ucgugaauaaaaaua

SEQ ID NO: 4172983 - RNA, 22 nt, Yersinia pestis
ucgugccgcacacagcccugcc

SEQ ID NO: 4172984 - RNA, 21 nt, Yersinia pestis
ucguggaaaucgggugauaaa

SEQ ID NO: 4172985 - RNA, 18 nt, Yersinia pestis
ucguguauaucacuauuu

SEQ ID NO: 4172986 - RNA, 12 nt, Yersinia pestis
ucguguucggua

SEQ ID NO: 4172987 - RNA, 22 nt, Yersinia pestis
ucguuacaucaugaguaaaaga

SEQ ID NO: 4172988 - RNA, 22 nt, Yersinia pestis
ucguuagcacggaauugaucga

SEQ ID NO: 4172989 - RNA, 24 nt, Yersinia pestis
ucguuagcauaaguaucagcggcg

SEQ ID NO: 4172990 - RNA, 20 nt, Yersinia pestis
ucguuagggauucgugucaa

SEQ ID NO: 4172991 - RNA, 15 nt, Yersinia pestis
ucguuauaauauuaa

SEQ ID NO: 4172992 - RNA, 18 nt, Yersinia pestis
ucguugccccaucagcac

SEQ ID NO: 4172993 - RNA, 17 nt, Yersinia pestis
ucguuuaaaaaauaucu

SEQ ID NO: 4172994 - RNA, 19 nt, Yersinia pestis
ucguuuaacucaaauaaac

SEQ ID NO: 4172995 - RNA, 22 nt, Yersinia pestis
ucguuuccagcggcguaucaaa

SEQ ID NO: 4172996 - RNA, 16 nt, Yersinia pestis
ucguuucucuaaaauu

SEQ ID NO: 4172997 - RNA, 13 nt, Yersinia pestis
ucguuucugucug

SEQ ID NO: 4172998 - RNA, 16 nt, Yersinia pestis
ucuaaaauuuuaaguu

SEQ ID NO: 4172999 - RNA, 22 nt, Yersinia pestis
ucuaaauuaauaucuuuaaauu

SEQ ID NO: 4173000 - RNA, 17 nt, Yersinia pestis
ucuaacagggaugaaua

SEQ ID NO: 4173001 - RNA, 17 nt, Yersinia pestis
ucuaaccaggugcagau

SEQ ID NO: 4173002 - RNA, 14 nt, Yersinia pestis
ucuaacuaauaaua

SEQ ID NO: 4173003 - RNA, 15 nt, Yersinia pestis
ucuaacuaauaauaa

SEQ ID NO: 4173004 - RNA, 16 nt, Yersinia pestis
ucuaacuaauaauaau

SEQ ID NO: 4173005 - RNA, 17 nt, Yersinia pestis
ucuaacucauucauaau

SEQ ID NO: 4173006 - RNA, 22 nt, Yersinia pestis
ucuaacugauguauucccucaa

SEQ ID NO: 4173007 - RNA, 16 nt, Yersinia pestis
ucuaaguaaaacaaag

SEQ ID NO: 4173008 - RNA, 17 nt, Yersinia pestis
ucuaagugccaguuaau

SEQ ID NO: 4173009 - RNA, 21 nt, Yersinia pestis
ucuaaucggcuggcaagauaa

SEQ ID NO: 4173010 - RNA, 15 nt, Yersinia pestis
ucuaaucuccucucc

SEQ ID NO: 4173011 - RNA, 15 nt, Yersinia pestis
ucuaauguaauaauc

SEQ ID NO: 4173012 - RNA, 14 nt, Yersinia pestis
ucuaauugcugccc

SEQ ID NO: 4173013 - RNA, 15 nt, Yersinia pestis
ucuaauugcugccca

SEQ ID NO: 4173014 - RNA, 14 nt, Yersinia pestis
ucuaauuuauaacc

SEQ ID NO: 4173015 - RNA, 16 nt, Yersinia pestis
ucuacaaauuuuuuau

SEQ ID NO: 4173016 - RNA, 17 nt, Yersinia pestis
ucuacauaaucuuuacu

SEQ ID NO: 4173017 - RNA, 16 nt, Yersinia pestis
ucuacauugacuaauu

SEQ ID NO: 4173018 - RNA, 23 nt, Yersinia pestis
ucuacauuuagucuacgcucuac

SEQ ID NO: 4173019 - RNA, 17 nt, Yersinia pestis
ucuaccaguuuuuuccu

SEQ ID NO: 4173020 - RNA, 17 nt, Yersinia pestis
ucuacccuggcggcaaa

SEQ ID NO: 4173021 - RNA, 23 nt, Yersinia pestis
ucuaccuucaggccuuuacuguu

SEQ ID NO: 4173022 - RNA, 22 nt, Yersinia pestis
ucuaccuucccguccacuuuca

SEQ ID NO: 4173023 - RNA, 18 nt, Yersinia pestis
ucuacgccgucaucaucu

SEQ ID NO: 4173024 - RNA, 22 nt, Yersinia pestis
ucuacucgcucaccacugaguu

SEQ ID NO: 4173025 - RNA, 14 nt, Yersinia pestis
ucuacuuucuacuc

SEQ ID NO: 4173026 - RNA, 18 nt, Yersinia pestis
ucuagaauucgcccccgu

SEQ ID NO: 4173027 - RNA, 17 nt, Yersinia pestis
ucuagcagugauuucag

SEQ ID NO: 4173028 - RNA, 18 nt, Yersinia pestis
ucuagcagugauuucagu

SEQ ID NO: 4173029 - RNA, 20 nt, Yersinia pestis
ucuagcagugauuucagugu

SEQ ID NO: 4173030 - RNA, 17 nt, Yersinia pestis
ucuagcccuucagcaaa

SEQ ID NO: 4173031 - RNA, 15 nt, Yersinia pestis
ucuagcgccagcaau

SEQ ID NO: 4173032 - RNA, 16 nt, Yersinia pestis
ucuagcuguagcaaua

SEQ ID NO: 4173033 - RNA, 22 nt, Yersinia pestis
ucuaguuugugcugcuaauauu

SEQ ID NO: 4173034 - RNA, 23 nt, Yersinia pestis
ucuauaaaacgcacacugcagau

SEQ ID NO: 4173035 - RNA, 12 nt, Yersinia pestis
ucuauaauucag

SEQ ID NO: 4173036 - RNA, 18 nt, Yersinia pestis
ucuauagagugcaauuuu

SEQ ID NO: 4173037 - RNA, 18 nt, Yersinia pestis
ucuaucaauauauacccg

SEQ ID NO: 4173038 - RNA, 24 nt, Yersinia pestis
ucuaucaggagcauuuguagccug

SEQ ID NO: 4173039 - RNA, 23 nt, Yersinia pestis
ucuaucauuuacggcuuuucgcu

SEQ ID NO: 4173040 - RNA, 14 nt, Yersinia pestis
ucuaucccuauuuu

SEQ ID NO: 4173041 - RNA, 14 nt, Yersinia pestis
ucuauccgaaaaau

SEQ ID NO: 4173042 - RNA, 17 nt, Yersinia pestis
ucuauccgaaaaauauu

SEQ ID NO: 4173043 - RNA, 18 nt, Yersinia pestis
ucuaucgauacccuucau

SEQ ID NO: 4173044 - RNA, 17 nt, Yersinia pestis
ucuaucgggcagguaaa

SEQ ID NO: 4173045 - RNA, 21 nt, Yersinia pestis
ucuaucucggcccgacuaaau

SEQ ID NO: 4173046 - RNA, 21 nt, Yersinia pestis
ucuaucugguuuaaauucuau

SEQ ID NO: 4173047 - RNA, 18 nt, Yersinia pestis
ucuaugccaguuauuauu

SEQ ID NO: 4173048 - RNA, 17 nt, Yersinia pestis
ucuauuaggcaguuccc

SEQ ID NO: 4173049 - RNA, 18 nt, Yersinia pestis
ucuauucugcuuuuugcu

SEQ ID NO: 4173050 - RNA, 14 nt, Yersinia pestis
ucuauugaaaaaau

SEQ ID NO: 4173051 - RNA, 19 nt, Yersinia pestis
ucuauugaaaaaauaaugu

SEQ ID NO: 4173052 - RNA, 20 nt, Yersinia pestis
ucuauugaaaaaauaauguc

SEQ ID NO: 4173053 - RNA, 22 nt, Yersinia pestis
ucuauugugucaauaccuuacu

SEQ ID NO: 4173054 - RNA, 21 nt, Yersinia pestis
ucuauuuauuuauaaaaccac

SEQ ID NO: 4173055 - RNA, 18 nt, Yersinia pestis
ucuauuucaugauucucu

SEQ ID NO: 4173056 - RNA, 13 nt, Yersinia pestis
ucuauuuuuauuu

SEQ ID NO: 4173057 - RNA, 21 nt, Yersinia pestis
ucucaacauaguugaauaacu

SEQ ID NO: 4173058 - RNA, 13 nt, Yersinia pestis
ucucaaccaaaua

SEQ ID NO: 4173059 - RNA, 17 nt, Yersinia pestis
ucucaagacacuauucc

SEQ ID NO: 4173060 - RNA, 22 nt, Yersinia pestis
ucucaaggucuuucgcccacaa

SEQ ID NO: 4173061 - RNA, 22 nt, Yersinia pestis
ucucaauacgcugucugaauag

SEQ ID NO: 4173062 - RNA, 20 nt, Yersinia pestis
ucucacaaaauaauaauucu

SEQ ID NO: 4173063 - RNA, 16 nt, Yersinia pestis
ucucacccaauaagau

SEQ ID NO: 4173064 - RNA, 19 nt, Yersinia pestis
ucucaccugcuuaguuaca

SEQ ID NO: 4173065 - RNA, 20 nt, Yersinia pestis
ucucacgcugaauaacaaaa

SEQ ID NO: 4173066 - RNA, 15 nt, Yersinia pestis
ucucagaauuuuuuu

SEQ ID NO: 4173067 - RNA, 15 nt, Yersinia pestis
ucucaggcucagcgg

SEQ ID NO: 4173068 - RNA, 18 nt, Yersinia pestis
ucucaguugaaacccaca

SEQ ID NO: 4173069 - RNA, 13 nt, Yersinia pestis
ucucaguugaugg

SEQ ID NO: 4173070 - RNA, 14 nt, Yersinia pestis
ucucaucaaggaaa

SEQ ID NO: 4173071 - RNA, 20 nt, Yersinia pestis
ucucaugacaaagaauguua

SEQ ID NO: 4173072 - RNA, 14 nt, Yersinia pestis
ucucauuaauaaug

SEQ ID NO: 4173073 - RNA, 15 nt, Yersinia pestis
ucucauuaauaauga

SEQ ID NO: 4173074 - RNA, 15 nt, Yersinia pestis
ucucauuuagcauua

SEQ ID NO: 4173075 - RNA, 15 nt, Yersinia pestis
ucuccaagcacacug

SEQ ID NO: 4173076 - RNA, 20 nt, Yersinia pestis
ucuccaauggaaauccguuu

SEQ ID NO: 4173077 - RNA, 15 nt, Yersinia pestis
ucuccagaauauaaa

SEQ ID NO: 4173078 - RNA, 18 nt, Yersinia pestis
ucuccagugcaaauuuau

SEQ ID NO: 4173079 - RNA, 14 nt, Yersinia pestis
ucuccaucacucuu

SEQ ID NO: 4173080 - RNA, 17 nt, Yersinia pestis
ucuccaucucuaauugu

SEQ ID NO: 4173081 - RNA, 22 nt, Yersinia pestis
ucuccgucgcgggcacuuuguc

SEQ ID NO: 4173082 - RNA, 23 nt, Yersinia pestis
ucuccguugcaggcacuuuguca

SEQ ID NO: 4173083 - RNA, 21 nt, Yersinia pestis
ucuccuaaaaucuaucgauac

SEQ ID NO: 4173084 - RNA, 21 nt, Yersinia pestis
ucuccuccagaauaucuucaa

SEQ ID NO: 4173085 - RNA, 23 nt, Yersinia pestis
ucuccucuccccuaccucauccg

SEQ ID NO: 4173086 - RNA, 21 nt, Yersinia pestis
ucuccugcccuaauaccaaua

SEQ ID NO: 4173087 - RNA, 15 nt, Yersinia pestis
ucucgagaaauaaau

SEQ ID NO: 4173088 - RNA, 16 nt, Yersinia pestis
ucucgauacaauuuuu

SEQ ID NO: 4173089 - RNA, 15 nt, Yersinia pestis
ucucgauauuaaccc

SEQ ID NO: 4173090 - RNA, 15 nt, Yersinia pestis
ucucgcacucaucuu

SEQ ID NO: 4173091 - RNA, 15 nt, Yersinia pestis
ucucgcagccgccag

SEQ ID NO: 4173092 - RNA, 19 nt, Yersinia pestis
ucucggccaacaucuucca

SEQ ID NO: 4173093 - RNA, 18 nt, Yersinia pestis
ucucggugugacuuucaa

SEQ ID NO: 4173094 - RNA, 14 nt, Yersinia pestis
ucucguucuuaacc

SEQ ID NO: 4173095 - RNA, 18 nt, Yersinia pestis
ucucuaaucgcgcauuuc

SEQ ID NO: 4173096 - RNA, 23 nt, Yersinia pestis
ucucuaccgaucaaacagguaaa

SEQ ID NO: 4173097 - RNA, 21 nt, Yersinia pestis
ucucuaugcguguugccaccu

SEQ ID NO: 4173098 - RNA, 23 nt, Yersinia pestis
ucucuauucugcuuuuugcuuuu

SEQ ID NO: 4173099 - RNA, 16 nt, Yersinia pestis
ucucuauuggcuuauc

SEQ ID NO: 4173100 - RNA, 16 nt, Yersinia pestis
ucucuccuaaaaucua

SEQ ID NO: 4173101 - RNA, 13 nt, Yersinia pestis
ucucucuaugucu

SEQ ID NO: 4173102 - RNA, 22 nt, Yersinia pestis
ucucugccgcugaauugauuua

SEQ ID NO: 4173103 - RNA, 14 nt, Yersinia pestis
ucucugcucgcauu

SEQ ID NO: 4173104 - RNA, 22 nt, Yersinia pestis
ucucuggcaacggcacauccca

SEQ ID NO: 4173105 - RNA, 13 nt, Yersinia pestis
ucucuuacauaaa

SEQ ID NO: 4173106 - RNA, 17 nt, Yersinia pestis
ucucuuacauaaagacc

SEQ ID NO: 4173107 - RNA, 14 nt, Yersinia pestis
ucucuuaccccuuu

SEQ ID NO: 4173108 - RNA, 14 nt, Yersinia pestis
ucucuucagagauu

SEQ ID NO: 4173109 - RNA, 16 nt, Yersinia pestis
ucucuucagagauuca

SEQ ID NO: 4173110 - RNA, 11 nt, Yersinia pestis
ucucuucccac

SEQ ID NO: 4173111 - RNA, 13 nt, Yersinia pestis
ucucuuccuguuc

SEQ ID NO: 4173112 - RNA, 17 nt, Yersinia pestis
ucucuugauuaccaaua

SEQ ID NO: 4173113 - RNA, 21 nt, Yersinia pestis
ucucuuggggaaguggcccuu

SEQ ID NO: 4173114 - RNA, 15 nt, Yersinia pestis
ucucuuuauauucaa

SEQ ID NO: 4173115 - RNA, 18 nt, Yersinia pestis
ucucuuucagcucuucaa

SEQ ID NO: 4173116 - RNA, 15 nt, Yersinia pestis
ucucuuuccagcaaa

SEQ ID NO: 4173117 - RNA, 16 nt, Yersinia pestis
ucucuuuccagcaaaa

SEQ ID NO: 4173118 - RNA, 20 nt, Yersinia pestis
ucucuuucgggcaaaaaaau

SEQ ID NO: 4173119 - RNA, 14 nt, Yersinia pestis
ucucuuucuccaac

SEQ ID NO: 4173120 - RNA, 19 nt, Yersinia pestis
ucucuuucuucucuucaga

SEQ ID NO: 4173121 - RNA, 14 nt, Yersinia pestis
ucugaaacggugag

SEQ ID NO: 4173122 - RNA, 15 nt, Yersinia pestis
ucugaaacuucaaaa

SEQ ID NO: 4173123 - RNA, 16 nt, Yersinia pestis
ucugaaagugcccccu

SEQ ID NO: 4173124 - RNA, 12 nt, Yersinia pestis
ucugaacuauug

SEQ ID NO: 4173125 - RNA, 19 nt, Yersinia pestis
ucugaaggguauugaagau

SEQ ID NO: 4173126 - RNA, 22 nt, Yersinia pestis
ucugaaggguauugaagauacc

SEQ ID NO: 4173127 - RNA, 23 nt, Yersinia pestis
ucugaauaccauaacaauggccg

SEQ ID NO: 4173128 - RNA, 19 nt, Yersinia pestis
ucugaauagcgcugcauca

SEQ ID NO: 4173129 - RNA, 22 nt, Yersinia pestis
ucugaauagcgcugcaucagca

SEQ ID NO: 4173130 - RNA, 13 nt, Yersinia pestis
ucugaccaaacau

SEQ ID NO: 4173131 - RNA, 17 nt, Yersinia pestis
ucugacggguauaucac

SEQ ID NO: 4173132 - RNA, 13 nt, Yersinia pestis
ucugacuaacucu

SEQ ID NO: 4173133 - RNA, 17 nt, Yersinia pestis
ucugacuaacucuucug

SEQ ID NO: 4173134 - RNA, 15 nt, Yersinia pestis
ucugacucuguaaaa

SEQ ID NO: 4173135 - RNA, 18 nt, Yersinia pestis
ucugacucuguaaaaauc

SEQ ID NO: 4173136 - RNA, 19 nt, Yersinia pestis
ucugagccucaugaaugag

SEQ ID NO: 4173137 - RNA, 13 nt, Yersinia pestis
ucugagccuucaa

SEQ ID NO: 4173138 - RNA, 19 nt, Yersinia pestis
ucugaggauguaguccccc

SEQ ID NO: 4173139 - RNA, 19 nt, Yersinia pestis
ucugaggcguggcacaccg

SEQ ID NO: 4173140 - RNA, 22 nt, Yersinia pestis
ucugaggggcguuuaaugcccc

SEQ ID NO: 4173141 - RNA, 20 nt, Yersinia pestis
ucugagguggccauuacgcc

SEQ ID NO: 4173142 - RNA, 14 nt, Yersinia pestis
ucugaguaccagca

SEQ ID NO: 4173143 - RNA, 16 nt, Yersinia pestis
ucugaguaccagcaaa

SEQ ID NO: 4173144 - RNA, 15 nt, Yersinia pestis
ucugagucagucagg

SEQ ID NO: 4173145 - RNA, 18 nt, Yersinia pestis
ucugagucagucagggug

SEQ ID NO: 4173146 - RNA, 19 nt, Yersinia pestis
ucugagucgauagcuuucu

SEQ ID NO: 4173147 - RNA, 21 nt, Yersinia pestis
ucugagucgauagcuuucucc

SEQ ID NO: 4173148 - RNA, 20 nt, Yersinia pestis
ucugagugauuuuccuccca

SEQ ID NO: 4173149 - RNA, 20 nt, Yersinia pestis
ucugauaaccguuuuuucaa

SEQ ID NO: 4173150 - RNA, 14 nt, Yersinia pestis
ucugauacugaacg

SEQ ID NO: 4173151 - RNA, 19 nt, Yersinia pestis
ucugauaucucuuuaucau

SEQ ID NO: 4173152 - RNA, 15 nt, Yersinia pestis
ucugaucgaguucag

SEQ ID NO: 4173153 - RNA, 20 nt, Yersinia pestis
ucugaugaguguuuauucuc

SEQ ID NO: 4173154 - RNA, 17 nt, Yersinia pestis
ucugauguguauauuuu

SEQ ID NO: 4173155 - RNA, 14 nt, Yersinia pestis
ucugauuaccuucu

SEQ ID NO: 4173156 - RNA, 17 nt, Yersinia pestis
ucugcaaauuagcggau

SEQ ID NO: 4173157 - RNA, 13 nt, Yersinia pestis
ucugcaagccccc

SEQ ID NO: 4173158 - RNA, 22 nt, Yersinia pestis
ucugcaagcccccaaaguagaa

SEQ ID NO: 4173159 - RNA, 13 nt, Yersinia pestis
ucugcaauagcuc

SEQ ID NO: 4173160 - RNA, 14 nt, Yersinia pestis
ucugcagaaugaag

SEQ ID NO: 4173161 - RNA, 12 nt, Yersinia pestis
ucugcauaccug

SEQ ID NO: 4173162 - RNA, 22 nt, Yersinia pestis
ucugcaucgguaagauaaccca

SEQ ID NO: 4173163 - RNA, 15 nt, Yersinia pestis
ucugcauuaaaauaa

SEQ ID NO: 4173164 - RNA, 12 nt, Yersinia pestis
ucugccaaccaa

SEQ ID NO: 4173165 - RNA, 13 nt, Yersinia pestis
ucugccaaccagg

SEQ ID NO: 4173166 - RNA, 21 nt, Yersinia pestis
ucugccaauaaaguccaccuc

SEQ ID NO: 4173167 - RNA, 17 nt, Yersinia pestis
ucugccaauucaaggcc

SEQ ID NO: 4173168 - RNA, 18 nt, Yersinia pestis
ucugccaauucaaggcca

SEQ ID NO: 4173169 - RNA, 18 nt, Yersinia pestis
ucugccaauuuggggcug

SEQ ID NO: 4173170 - RNA, 17 nt, Yersinia pestis
ucugccacacugaauuu

SEQ ID NO: 4173171 - RNA, 18 nt, Yersinia pestis
ucugccaccgcuccuuuc

SEQ ID NO: 4173172 - RNA, 22 nt, Yersinia pestis
ucugccagaauuuugcagcgcu

SEQ ID NO: 4173173 - RNA, 19 nt, Yersinia pestis
ucugccagauagucaucuu

SEQ ID NO: 4173174 - RNA, 15 nt, Yersinia pestis
ucugccaugguuggg

SEQ ID NO: 4173175 - RNA, 22 nt, Yersinia pestis
ucugcccagccugguuuuuuaa

SEQ ID NO: 4173176 - RNA, 18 nt, Yersinia pestis
ucugcccuuucucgccua

SEQ ID NO: 4173177 - RNA, 15 nt, Yersinia pestis
ucugccgauuuaaac

SEQ ID NO: 4173178 - RNA, 19 nt, Yersinia pestis
ucugccuauccucaccguu

SEQ ID NO: 4173179 - RNA, 19 nt, Yersinia pestis
ucugccuauucucaccguu

SEQ ID NO: 4173180 - RNA, 22 nt, Yersinia pestis
ucugccugauaccauuggguca

SEQ ID NO: 4173181 - RNA, 17 nt, Yersinia pestis
ucugcgaagccgcugca

SEQ ID NO: 4173182 - RNA, 16 nt, Yersinia pestis
ucugcgaccugaucca

SEQ ID NO: 4173183 - RNA, 20 nt, Yersinia pestis
ucugcgagcguuuaaauacc

SEQ ID NO: 4173184 - RNA, 13 nt, Yersinia pestis
ucugcgcccuuau

SEQ ID NO: 4173185 - RNA, 16 nt, Yersinia pestis
ucugcgccuauaccug

SEQ ID NO: 4173186 - RNA, 20 nt, Yersinia pestis
ucugcggcaagcugugccug

SEQ ID NO: 4173187 - RNA, 22 nt, Yersinia pestis
ucugcggcaagcugugccugag

SEQ ID NO: 4173188 - RNA, 18 nt, Yersinia pestis
ucugcggcaggcugaucu

SEQ ID NO: 4173189 - RNA, 18 nt, Yersinia pestis
ucugcguuuuucccugua

SEQ ID NO: 4173190 - RNA, 18 nt, Yersinia pestis
ucugcuaacaacagucaa

SEQ ID NO: 4173191 - RNA, 20 nt, Yersinia pestis
ucugcuagcaaauuccgcuu

SEQ ID NO: 4173192 - RNA, 22 nt, Yersinia pestis
ucugcucccggcacuaaguguc

SEQ ID NO: 4173193 - RNA, 17 nt, Yersinia pestis
ucugcucuugcucagua

SEQ ID NO: 4173194 - RNA, 16 nt, Yersinia pestis
ucugcugaaaaucaug

SEQ ID NO: 4173195 - RNA, 14 nt, Yersinia pestis
ucugcugggauacu

SEQ ID NO: 4173196 - RNA, 18 nt, Yersinia pestis
ucugcuguugccacagac

SEQ ID NO: 4173197 - RNA, 16 nt, Yersinia pestis
ucugcuuaguuggugc

SEQ ID NO: 4173198 - RNA, 14 nt, Yersinia pestis
ucugcuuuacugcu

SEQ ID NO: 4173199 - RNA, 22 nt, Yersinia pestis
ucuggcaaacgcugcacaucau

SEQ ID NO: 4173200 - RNA, 20 nt, Yersinia pestis
ucuggccagcgucuucagug

SEQ ID NO: 4173201 - RNA, 22 nt, Yersinia pestis
ucuggccagcgucuucaguggc

SEQ ID NO: 4173202 - RNA, 22 nt, Yersinia pestis
ucuggccgaugcgacaauuucc

SEQ ID NO: 4173203 - RNA, 20 nt, Yersinia pestis
ucuggcguagguaguggcug

SEQ ID NO: 4173204 - RNA, 16 nt, Yersinia pestis
ucuggcgugucaucuu

SEQ ID NO: 4173205 - RNA, 23 nt, Yersinia pestis
ucuggcuaaacgaucagaacuaa

SEQ ID NO: 4173206 - RNA, 22 nt, Yersinia pestis
ucuggcuaauacugccaaucgc

SEQ ID NO: 4173207 - RNA, 12 nt, Yersinia pestis
ucuggcuggcau

SEQ ID NO: 4173208 - RNA, 21 nt, Yersinia pestis
ucuggcuggcauauuucucuu

SEQ ID NO: 4173209 - RNA, 19 nt, Yersinia pestis
ucuggcuuaucuuccagau

SEQ ID NO: 4173210 - RNA, 19 nt, Yersinia pestis
ucuggcuuucucaacagca

SEQ ID NO: 4173211 - RNA, 19 nt, Yersinia pestis
ucugggacgugcauaaaac

SEQ ID NO: 4173212 - RNA, 15 nt, Yersinia pestis
ucuggggcaaucaau

SEQ ID NO: 4173213 - RNA, 18 nt, Yersinia pestis
ucuggggguaacgccgcu

SEQ ID NO: 4173214 - RNA, 18 nt, Yersinia pestis
ucugggguuucugucauu

SEQ ID NO: 4173215 - RNA, 13 nt, Yersinia pestis
ucuggguaagaac

SEQ ID NO: 4173216 - RNA, 14 nt, Yersinia pestis
ucuggguaagaaca

SEQ ID NO: 4173217 - RNA, 15 nt, Yersinia pestis
ucuggguaagaacag

SEQ ID NO: 4173218 - RNA, 15 nt, Yersinia pestis
ucugggugcugcucc

SEQ ID NO: 4173219 - RNA, 23 nt, Yersinia pestis
ucugguaccgauaaaaguacaac

SEQ ID NO: 4173220 - RNA, 15 nt, Yersinia pestis
ucugguagcugcuca

SEQ ID NO: 4173221 - RNA, 20 nt, Yersinia pestis
ucugguagucauauucaggc

SEQ ID NO: 4173222 - RNA, 20 nt, Yersinia pestis
ucugguaguuuugcauaauu

SEQ ID NO: 4173223 - RNA, 23 nt, Yersinia pestis
ucuggucacuaaaacugaagcau

SEQ ID NO: 4173224 - RNA, 13 nt, Yersinia pestis
ucuggugccaacg

SEQ ID NO: 4173225 - RNA, 17 nt, Yersinia pestis
ucuggugccguuuugcu

SEQ ID NO: 4173226 - RNA, 13 nt, Yersinia pestis
ucugguugugcuu

SEQ ID NO: 4173227 - RNA, 17 nt, Yersinia pestis
ucugguuugaauccagu

SEQ ID NO: 4173228 - RNA, 16 nt, Yersinia pestis
ucuguaaaaaucaccu

SEQ ID NO: 4173229 - RNA, 13 nt, Yersinia pestis
ucuguaauaauaa

SEQ ID NO: 4173230 - RNA, 18 nt, Yersinia pestis
ucuguacguaaauagguu

SEQ ID NO: 4173231 - RNA, 22 nt, Yersinia pestis
ucugucagcccuaauauccuca

SEQ ID NO: 4173232 - RNA, 19 nt, Yersinia pestis
ucugucgggaacacuuugc

SEQ ID NO: 4173233 - RNA, 14 nt, Yersinia pestis
ucugucguacuuuc

SEQ ID NO: 4173234 - RNA, 13 nt, Yersinia pestis
ucugucugagucg

SEQ ID NO: 4173235 - RNA, 17 nt, Yersinia pestis
ucugucugcuguugcca

SEQ ID NO: 4173236 - RNA, 17 nt, Yersinia pestis
ucuguguaguggggcuu

SEQ ID NO: 4173237 - RNA, 14 nt, Yersinia pestis
ucuguuaccaaugg

SEQ ID NO: 4173238 - RNA, 18 nt, Yersinia pestis
ucuguuggugguggccug

SEQ ID NO: 4173239 - RNA, 23 nt, Yersinia pestis
ucuguuucaaauaaguauuucaa

SEQ ID NO: 4173240 - RNA, 21 nt, Yersinia pestis
ucuguuuccucuucaucuaca

SEQ ID NO: 4173241 - RNA, 18 nt, Yersinia pestis
ucuguuuuguuuccccua

SEQ ID NO: 4173242 - RNA, 22 nt, Yersinia pestis
ucuguuuuguuuccccuaauuc

SEQ ID NO: 4173243 - RNA, 16 nt, Yersinia pestis
ucuguuuuugccaccu

SEQ ID NO: 4173244 - RNA, 14 nt, Yersinia pestis
ucuguuuuuuuuaa

SEQ ID NO: 4173245 - RNA, 11 nt, Yersinia pestis
ucuuaaaaaua

SEQ ID NO: 4173246 - RNA, 23 nt, Yersinia pestis
ucuuaaauugaagaguuugauca

SEQ ID NO: 4173247 - RNA, 20 nt, Yersinia pestis
ucuuaauaauaucaaauguc

SEQ ID NO: 4173248 - RNA, 15 nt, Yersinia pestis
ucuuaauucccagcc

SEQ ID NO: 4173249 - RNA, 15 nt, Yersinia pestis
ucuuaauuuuaucac

SEQ ID NO: 4173250 - RNA, 17 nt, Yersinia pestis
ucuuacauaaagaccca

SEQ ID NO: 4173251 - RNA, 15 nt, Yersinia pestis
ucuuacccaacagug

SEQ ID NO: 4173252 - RNA, 17 nt, Yersinia pestis
ucuuaccggccucuuuc

SEQ ID NO: 4173253 - RNA, 24 nt, Yersinia pestis
ucuuaccuucaguuuauuuaagcu

SEQ ID NO: 4173254 - RNA, 13 nt, Yersinia pestis
ucuuacuaaaaua

SEQ ID NO: 4173255 - RNA, 20 nt, Yersinia pestis
ucuuacugguuuucugcgga

SEQ ID NO: 4173256 - RNA, 21 nt, Yersinia pestis
ucuuacuguuuucauuauuuu

SEQ ID NO: 4173257 - RNA, 22 nt, Yersinia pestis
ucuuagagagagugaagauuuu

SEQ ID NO: 4173258 - RNA, 21 nt, Yersinia pestis
ucuuagguaaugccacgucau

SEQ ID NO: 4173259 - RNA, 17 nt, Yersinia pestis
ucuuaggucaucgucac

SEQ ID NO: 4173260 - RNA, 21 nt, Yersinia pestis
ucuuaggugacaggcaaagac

SEQ ID NO: 4173261 - RNA, 15 nt, Yersinia pestis
ucuuaucaaucaaaa

SEQ ID NO: 4173262 - RNA, 22 nt, Yersinia pestis
ucuuaucaaucaaaaaauaaau

SEQ ID NO: 4173263 - RNA, 14 nt, Yersinia pestis
ucuuauuacucauu

SEQ ID NO: 4173264 - RNA, 20 nt, Yersinia pestis
ucuuauuaggguugguuggu

SEQ ID NO: 4173265 - RNA, 23 nt, Yersinia pestis
ucuuauuaggguugguugguggc

SEQ ID NO: 4173266 - RNA, 19 nt, Yersinia pestis
ucuuauugaagggcaaaac

SEQ ID NO: 4173267 - RNA, 14 nt, Yersinia pestis
ucuuauugcuaucu

SEQ ID NO: 4173268 - RNA, 11 nt, Yersinia pestis
ucuuauuuaac

SEQ ID NO: 4173269 - RNA, 15 nt, Yersinia pestis
ucuuauuuuuuguag

SEQ ID NO: 4173270 - RNA, 12 nt, Yersinia pestis
ucuucaaaagca

SEQ ID NO: 4173271 - RNA, 14 nt, Yersinia pestis
ucuucaacugucac

SEQ ID NO: 4173272 - RNA, 20 nt, Yersinia pestis
ucuucaauuuccaucugcaa

SEQ ID NO: 4173273 - RNA, 13 nt, Yersinia pestis
ucuucaccaauga

SEQ ID NO: 4173274 - RNA, 15 nt, Yersinia pestis
ucuucaccaaugauu

SEQ ID NO: 4173275 - RNA, 22 nt, Yersinia pestis
ucuucacgcucgguuauuuauc

SEQ ID NO: 4173276 - RNA, 22 nt, Yersinia pestis
ucuucacuggaucuuuuagcuc

SEQ ID NO: 4173277 - RNA, 19 nt, Yersinia pestis
ucuucagguaagccuuucu

SEQ ID NO: 4173278 - RNA, 15 nt, Yersinia pestis
ucuucagucaguguu

SEQ ID NO: 4173279 - RNA, 15 nt, Yersinia pestis
ucuucaguggcugga

SEQ ID NO: 4173280 - RNA, 20 nt, Yersinia pestis
ucuucauaacgcuuuuucau

SEQ ID NO: 4173281 - RNA, 20 nt, Yersinia pestis
ucuucauaagccagugcuau

SEQ ID NO: 4173282 - RNA, 14 nt, Yersinia pestis
uaaauaauaaauua

SEQ ID NO: 4173283 - RNA, 15 nt, Yersinia pestis
uaaauaauuuguauu

SEQ ID NO: 4173284 - RNA, 13 nt, Yersinia pestis
uaaauacagauca

SEQ ID NO: 4173285 - RNA, 14 nt, Yersinia pestis
uaaauacauccaug

SEQ ID NO: 4173286 - RNA, 17 nt, Yersinia pestis
uaaauaccaauuucaua

SEQ ID NO: 4173287 - RNA, 15 nt, Yersinia pestis
uaaauaccagagacg

SEQ ID NO: 4173288 - RNA, 22 nt, Yersinia pestis
uaaauacccagcuucuuuuaaa

SEQ ID NO: 4173289 - RNA, 15 nt, Yersinia pestis
uaaauacucuugaga

SEQ ID NO: 4173290 - RNA, 20 nt, Yersinia pestis
uaaauagaaaaaugauuuuu

SEQ ID NO: 4173291 - RNA, 21 nt, Yersinia pestis
uaaauagagugaaguaucacc

SEQ ID NO: 4173292 - RNA, 13 nt, Yersinia pestis
uaaauagugggcu

SEQ ID NO: 4173293 - RNA, 14 nt, Yersinia pestis
uaaauauaaaauaa

SEQ ID NO: 4173294 - RNA, 15 nt, Yersinia pestis
uaaauauaauuucaa

SEQ ID NO: 4173295 - RNA, 20 nt, Yersinia pestis
uaaauauccugcucagcuaa

SEQ ID NO: 4173296 - RNA, 18 nt, Yersinia pestis
uaaauauggcggcaucag

SEQ ID NO: 4173297 - RNA, 13 nt, Yersinia pestis
uaaauauuaacau

SEQ ID NO: 4173298 - RNA, 14 nt, Yersinia pestis
uaaauauuaacauu

SEQ ID NO: 4173299 - RNA, 17 nt, Yersinia pestis
uaaauauuaacauuaau

SEQ ID NO: 4173300 - RNA, 18 nt, Yersinia pestis
uaaauauuaacauuaauc

SEQ ID NO: 4173301 - RNA, 18 nt, Yersinia pestis
uaaauauuaucuucacca

SEQ ID NO: 4173302 - RNA, 15 nt, Yersinia pestis
uaaauauuauuuaau

SEQ ID NO: 4173303 - RNA, 19 nt, Yersinia pestis
uaaauauuauuuaauuaaa

SEQ ID NO: 4173304 - RNA, 21 nt, Yersinia pestis
uaaauauugguacauaggucu

SEQ ID NO: 4173305 - RNA, 21 nt, Yersinia pestis
uaaaucaauucuaucgcugua

SEQ ID NO: 4173306 - RNA, 17 nt, Yersinia pestis
uaaaucacaauuucacc

SEQ ID NO: 4173307 - RNA, 19 nt, Yersinia pestis
uaaaucacgcagcaggcca

SEQ ID NO: 4173308 - RNA, 23 nt, Yersinia pestis
uaaaucagacgagucuauugaaa

SEQ ID NO: 4173309 - RNA, 16 nt, Yersinia pestis
uaaaucaucaaauuca

SEQ ID NO: 4173310 - RNA, 20 nt, Yersinia pestis
uaaaucaugucccuauuaga

SEQ ID NO: 4173311 - RNA, 13 nt, Yersinia pestis
uaaauccagccca

SEQ ID NO: 4173312 - RNA, 15 nt, Yersinia pestis
uaaauccaucaauag

SEQ ID NO: 4173313 - RNA, 17 nt, Yersinia pestis
uaaaucccgcuugucgc

SEQ ID NO: 4173314 - RNA, 20 nt, Yersinia pestis
uaaauccgcuaguuaacccu

SEQ ID NO: 4173315 - RNA, 19 nt, Yersinia pestis
uaaauccuuguaaggugcu

SEQ ID NO: 4173316 - RNA, 22 nt, Yersinia pestis
uaaaucgcuuaucuugguuuca

SEQ ID NO: 4173317 - RNA, 16 nt, Yersinia pestis
uaaaucuacuuuauuc

SEQ ID NO: 4173318 - RNA, 15 nt, Yersinia pestis
uaaaucuuauuuaau

SEQ ID NO: 4173319 - RNA, 14 nt, Yersinia pestis
uaaaugaacgugcc

SEQ ID NO: 4173320 - RNA, 21 nt, Yersinia pestis
uaaaugaagcaguucacugag

SEQ ID NO: 4173321 - RNA, 19 nt, Yersinia pestis
uaaaugaccaacuguaaaa

SEQ ID NO: 4173322 - RNA, 16 nt, Yersinia pestis
uaaaugagaucgcugu

SEQ ID NO: 4173323 - RNA, 22 nt, Yersinia pestis
uaaaugagggauauacccuaua

SEQ ID NO: 4173324 - RNA, 21 nt, Yersinia pestis
uaaaugcaauuuuugcagugc

SEQ ID NO: 4173325 - RNA, 19 nt, Yersinia pestis
uaaaugcucucgagaaaua

SEQ ID NO: 4173326 - RNA, 22 nt, Yersinia pestis
uaaauggcacuggaaacaaaac

SEQ ID NO: 4173327 - RNA, 15 nt, Yersinia pestis
uaaauggcauuuuuu

SEQ ID NO: 4173328 - RNA, 18 nt, Yersinia pestis
uaaauggcgaaaggaaca

SEQ ID NO: 4173329 - RNA, 23 nt, Yersinia pestis
uaaauggcgugcacugacccauu

SEQ ID NO: 4173330 - RNA, 16 nt, Yersinia pestis
uaaauggcuaaacucu

SEQ ID NO: 4173331 - RNA, 17 nt, Yersinia pestis
uaaauggcuaaacucug

SEQ ID NO: 4173332 - RNA, 13 nt, Yersinia pestis
uaaauggcuagau

SEQ ID NO: 4173333 - RNA, 16 nt, Yersinia pestis
uaaauggucaguuuaa

SEQ ID NO: 4173334 - RNA, 16 nt, Yersinia pestis
uaaaugguuuauuuaa

SEQ ID NO: 4173335 - RNA, 18 nt, Yersinia pestis
uaaaugguuuauuuaagc

SEQ ID NO: 4173336 - RNA, 20 nt, Yersinia pestis
uaaauguacagucauuuacu

SEQ ID NO: 4173337 - RNA, 15 nt, Yersinia pestis
uaaauguacuacuuc

SEQ ID NO: 4173338 - RNA, 13 nt, Yersinia pestis
uaaauguucaccg

SEQ ID NO: 4173339 - RNA, 17 nt, Yersinia pestis
uaaauuaaaaagagugu

SEQ ID NO: 4173340 - RNA, 17 nt, Yersinia pestis
uaaauuaaaacugaaaa

SEQ ID NO: 4173341 - RNA, 15 nt, Yersinia pestis
uaaauuaaauuuuaa

SEQ ID NO: 4173342 - RNA, 16 nt, Yersinia pestis
uaaauuaaauuuuaau

SEQ ID NO: 4173343 - RNA, 13 nt, Yersinia pestis
uaaauuaauaucu

SEQ ID NO: 4173344 - RNA, 21 nt, Yersinia pestis
uaaauuaauaucuuuaaauua

SEQ ID NO: 4173345 - RNA, 15 nt, Yersinia pestis
uaaauuaauauuuaa

SEQ ID NO: 4173346 - RNA, 16 nt, Yersinia pestis
uaaauuaauauuuaaa

SEQ ID NO: 4173347 - RNA, 17 nt, Yersinia pestis
uaaauuaauauuuaaag

SEQ ID NO: 4173348 - RNA, 18 nt, Yersinia pestis
uaaauuaauauuuaaagc

SEQ ID NO: 4173349 - RNA, 15 nt, Yersinia pestis
uaaauuacucgccuu

SEQ ID NO: 4173350 - RNA, 19 nt, Yersinia pestis
uaaauuacucguauaaaaa

SEQ ID NO: 4173351 - RNA, 20 nt, Yersinia pestis
uaaauuacucguauaaaaaa

SEQ ID NO: 4173352 - RNA, 14 nt, Yersinia pestis
uaaauuagaaaaca

SEQ ID NO: 4173353 - RNA, 15 nt, Yersinia pestis
uaaauuagaaaacaa

SEQ ID NO: 4173354 - RNA, 19 nt, Yersinia pestis
uaaauuaucccguucaaua

SEQ ID NO: 4173355 - RNA, 20 nt, Yersinia pestis
uaaauuaucccguucaauaa

SEQ ID NO: 4173356 - RNA, 19 nt, Yersinia pestis
uaaauuauugaguaacauu

SEQ ID NO: 4173357 - RNA, 23 nt, Yersinia pestis
uaaauuauugaguaacauuaauc

SEQ ID NO: 4173358 - RNA, 15 nt, Yersinia pestis
uaaauuauuuuaggu

SEQ ID NO: 4173359 - RNA, 13 nt, Yersinia pestis
uaaauucaaaaua

SEQ ID NO: 4173360 - RNA, 14 nt, Yersinia pestis
uaaauucaaaauag

SEQ ID NO: 4173361 - RNA, 15 nt, Yersinia pestis
uaaauucaaaauaga

SEQ ID NO: 4173362 - RNA, 18 nt, Yersinia pestis
uaaauucaaauaucauua

SEQ ID NO: 4173363 - RNA, 20 nt, Yersinia pestis
uaaauucaacuucuccugua

SEQ ID NO: 4173364 - RNA, 16 nt, Yersinia pestis
uaaauuccguggcuua

SEQ ID NO: 4173365 - RNA, 16 nt, Yersinia pestis
uaaauuccuggcggca

SEQ ID NO: 4173366 - RNA, 18 nt, Yersinia pestis
uaaauucuaccuggcuca

SEQ ID NO: 4173367 - RNA, 21 nt, Yersinia pestis
uaaauucuaccuggcucaaau

SEQ ID NO: 4173368 - RNA, 17 nt, Yersinia pestis
uaaauucuugcgcuuca

SEQ ID NO: 4173369 - RNA, 15 nt, Yersinia pestis
uaaauugcgggcugg

SEQ ID NO: 4173370 - RNA, 19 nt, Yersinia pestis
uaaauuggccgauagauuu

SEQ ID NO: 4173371 - RNA, 18 nt, Yersinia pestis
uaaauuuaauaaaaacca

SEQ ID NO: 4173372 - RNA, 14 nt, Yersinia pestis
uaaauuuaauauga

SEQ ID NO: 4173373 - RNA, 22 nt, Yersinia pestis
uaaauuucccuagcgaaguauu

SEQ ID NO: 4173374 - RNA, 17 nt, Yersinia pestis
uaaauuuuuauauaauu

SEQ ID NO: 4173375 - RNA, 15 nt, Yersinia pestis
uaacaaaaaauuaau

SEQ ID NO: 4173376 - RNA, 22 nt, Yersinia pestis
uaacaaaaugcgguggcacuga

SEQ ID NO: 4173377 - RNA, 15 nt, Yersinia pestis
uaacaaaauggaaua

SEQ ID NO: 4173378 - RNA, 12 nt, Yersinia pestis
uaacaaacacau

SEQ ID NO: 4173379 - RNA, 15 nt, Yersinia pestis
uaacaaacacaucca

SEQ ID NO: 4173380 - RNA, 18 nt, Yersinia pestis
uaacaaacugaauggauu

SEQ ID NO: 4173381 - RNA, 21 nt, Yersinia pestis
uaacaaagccgcuuaauuuau

SEQ ID NO: 4173382 - RNA, 20 nt, Yersinia pestis
uaacaaauggucaggaaccc

SEQ ID NO: 4173383 - RNA, 13 nt, Yersinia pestis
uaacaacaauuua

SEQ ID NO: 4173384 - RNA, 16 nt, Yersinia pestis
uaacaacccuaacacc

SEQ ID NO: 4173385 - RNA, 16 nt, Yersinia pestis
uaacaacuuccacaca

SEQ ID NO: 4173386 - RNA, 15 nt, Yersinia pestis
uaacaauaaaaucuu

SEQ ID NO: 4173387 - RNA, 14 nt, Yersinia pestis
uaacaauauucauu

SEQ ID NO: 4173388 - RNA, 14 nt, Yersinia pestis
uaacaaucagugca

SEQ ID NO: 4173389 - RNA, 15 nt, Yersinia pestis
uaacaauccgaacaa

SEQ ID NO: 4173390 - RNA, 17 nt, Yersinia pestis
uaacaauccgaacaaaa

SEQ ID NO: 4173391 - RNA, 20 nt, Yersinia pestis
uaacaauggccggacucauu

SEQ ID NO: 4173392 - RNA, 14 nt, Yersinia pestis
uaacaauuuaucag

SEQ ID NO: 4173393 - RNA, 22 nt, Yersinia pestis
uaacaauuuuauuguuuucguu

SEQ ID NO: 4173394 - RNA, 18 nt, Yersinia pestis
uaacacauuccaguaaaa

SEQ ID NO: 4173395 - RNA, 21 nt, Yersinia pestis
uaacacauuccaguaaaaaaa

SEQ ID NO: 4173396 - RNA, 23 nt, Yersinia pestis
uaacacauuccaguaaaaaaaua

SEQ ID NO: 4173397 - RNA, 20 nt, Yersinia pestis
uaacaccaauugcaggcuuu

SEQ ID NO: 4173398 - RNA, 21 nt, Yersinia pestis
uaacaccagcaggugauacau

SEQ ID NO: 4173399 - RNA, 16 nt, Yersinia pestis
uaacacccaauaauaa

SEQ ID NO: 4173400 - RNA, 21 nt, Yersinia pestis
uaacacccaauaauaaaaaaa

SEQ ID NO: 4173401 - RNA, 18 nt, Yersinia pestis
uaacacgaaaagcagcag

SEQ ID NO: 4173402 - RNA, 20 nt, Yersinia pestis
uaacacggccuauugaauaa

SEQ ID NO: 4173403 - RNA, 23 nt, Yersinia pestis
uaacacggccuauugaauaacag

SEQ ID NO: 4173404 - RNA, 15 nt, Yersinia pestis
uaacacggcuuuuau

SEQ ID NO: 4173405 - RNA, 14 nt, Yersinia pestis
uaacacuuauuaac

SEQ ID NO: 4173406 - RNA, 16 nt, Yersinia pestis
uaacacuuauuaaccu

SEQ ID NO: 4173407 - RNA, 21 nt, Yersinia pestis
uaacacuucagacugaaagua

SEQ ID NO: 4173408 - RNA, 17 nt, Yersinia pestis
uaacacuugaccaaccu

SEQ ID NO: 4173409 - RNA, 21 nt, Yersinia pestis
uaacacuugaccaaccuguuu

SEQ ID NO: 4173410 - RNA, 20 nt, Yersinia pestis
uaacagaagaguacgaacag

SEQ ID NO: 4173411 - RNA, 13 nt, Yersinia pestis
uaacagagcagaa

SEQ ID NO: 4173412 - RNA, 16 nt, Yersinia pestis
uaacagagcagaaagc

SEQ ID NO: 4173413 - RNA, 14 nt, Yersinia pestis
uaacagccccgucu

SEQ ID NO: 4173414 - RNA, 21 nt, Yersinia pestis
uaacagcguugaccaacuguc

SEQ ID NO: 4173415 - RNA, 15 nt, Yersinia pestis
uaacauaaggcuaga

SEQ ID NO: 4173416 - RNA, 20 nt, Yersinia pestis
uaacauacaccaucgcgcug

SEQ ID NO: 4173417 - RNA, 15 nt, Yersinia pestis
uaacauauaaaccag

SEQ ID NO: 4173418 - RNA, 18 nt, Yersinia pestis
uaacauaucaauaagugc

SEQ ID NO: 4173419 - RNA, 17 nt, Yersinia pestis
uaacaucaauguauuaa

SEQ ID NO: 4173420 - RNA, 13 nt, Yersinia pestis
uaacaucauuggu

SEQ ID NO: 4173421 - RNA, 22 nt, Yersinia pestis
uaacaucauugguuuuaauauu

SEQ ID NO: 4173422 - RNA, 12 nt, Yersinia pestis
uaacaugccaca

SEQ ID NO: 4173423 - RNA, 16 nt, Yersinia pestis
uaacaugccacauagc

SEQ ID NO: 4173424 - RNA, 18 nt, Yersinia pestis
uaacaugccacauagcgu

SEQ ID NO: 4173425 - RNA, 13 nt, Yersinia pestis
uaacaugcugaua

SEQ ID NO: 4173426 - RNA, 14 nt, Yersinia pestis
uaacauguagcaca

SEQ ID NO: 4173427 - RNA, 21 nt, Yersinia pestis
uaacauuacuuugaauagcac

SEQ ID NO: 4173428 - RNA, 20 nt, Yersinia pestis
uaacauuuguauuuuuucuu

SEQ ID NO: 4173429 - RNA, 15 nt, Yersinia pestis
uaaccaaacaaauua

SEQ ID NO: 4173430 - RNA, 21 nt, Yersinia pestis
uaaccaacaguuauuuuaauu

SEQ ID NO: 4173431 - RNA, 17 nt, Yersinia pestis
uaaccaauaacauuucg

SEQ ID NO: 4173432 - RNA, 15 nt, Yersinia pestis
uaaccaauucuuagg

SEQ ID NO: 4173433 - RNA, 17 nt, Yersinia pestis
uaaccacacuuggugcu

SEQ ID NO: 4173434 - RNA, 11 nt, Yersinia pestis
uaaccacagca

SEQ ID NO: 4173435 - RNA, 12 nt, Yersinia pestis
uaaccacccacg

SEQ ID NO: 4173436 - RNA, 20 nt, Yersinia pestis
uaaccagacgcaaccaaaac

SEQ ID NO: 4173437 - RNA, 21 nt, Yersinia pestis
uaaccagcaguugcugcucug

SEQ ID NO: 4173438 - RNA, 16 nt, Yersinia pestis
uaaccagcaucaguag

SEQ ID NO: 4173439 - RNA, 20 nt, Yersinia pestis
uaaccaggugcagauaaacu

SEQ ID NO: 4173440 - RNA, 18 nt, Yersinia pestis
uaaccagugccgcccagc

SEQ ID NO: 4173441 - RNA, 13 nt, Yersinia pestis
uaaccaguugagu

SEQ ID NO: 4173442 - RNA, 17 nt, Yersinia pestis
uaaccauaaaauaaaua

SEQ ID NO: 4173443 - RNA, 16 nt, Yersinia pestis
uaaccaucaaauacac

SEQ ID NO: 4173444 - RNA, 20 nt, Yersinia pestis
uaaccauccauauuuggcau

SEQ ID NO: 4173445 - RNA, 16 nt, Yersinia pestis
uaaccaugauguuagg

SEQ ID NO: 4173446 - RNA, 20 nt, Yersinia pestis
uaaccaugauguuaggcguu

SEQ ID NO: 4173447 - RNA, 20 nt, Yersinia pestis
uaaccauuuauauaacagcc

SEQ ID NO: 4173448 - RNA, 12 nt, Yersinia pestis
uaacccaaagug

SEQ ID NO: 4173449 - RNA, 15 nt, Yersinia pestis
uaacccaaugccaua

SEQ ID NO: 4173450 - RNA, 18 nt, Yersinia pestis
uaacccaguugcgccgcu

SEQ ID NO: 4173451 - RNA, 13 nt, Yersinia pestis
uaacccauugguu

SEQ ID NO: 4173452 - RNA, 22 nt, Yersinia pestis
uaacccccaaauagcuggcauc

SEQ ID NO: 4173453 - RNA, 20 nt, Yersinia pestis
uaacccccaagcuuuugcca

SEQ ID NO: 4173454 - RNA, 16 nt, Yersinia pestis
uaaccccgucgccgca

SEQ ID NO: 4173455 - RNA, 16 nt, Yersinia pestis
uaacccgauaaugccc

SEQ ID NO: 4173456 - RNA, 19 nt, Yersinia pestis
uaacccgccuugcggaagg

SEQ ID NO: 4173457 - RNA, 14 nt, Yersinia pestis
uaaccgaauaaaac

SEQ ID NO: 4173458 - RNA, 23 nt, Yersinia pestis
uaaccgauuucagcaccauaaau

SEQ ID NO: 4173459 - RNA, 22 nt, Yersinia pestis
uaaccgccaaaauaucgcgcuu

SEQ ID NO: 4173460 - RNA, 15 nt, Yersinia pestis
uaaccgccgcaggcc

SEQ ID NO: 4173461 - RNA, 20 nt, Yersinia pestis
uaaccgccugugacgcuuga

SEQ ID NO: 4173462 - RNA, 16 nt, Yersinia pestis
uaaccgcuaaggccaa

SEQ ID NO: 4173463 - RNA, 19 nt, Yersinia pestis
uaaccgcuguaaacuggca

SEQ ID NO: 4173464 - RNA, 23 nt, Yersinia pestis
uaaccgucaugcuucaagcugcc

SEQ ID NO: 4173465 - RNA, 22 nt, Yersinia pestis
uaaccguuuuuucaacuggcug

SEQ ID NO: 4173466 - RNA, 16 nt, Yersinia pestis
uaaccuaaaaacguca

SEQ ID NO: 4173467 - RNA, 14 nt, Yersinia pestis
uaaccuacugacau

SEQ ID NO: 4173468 - RNA, 14 nt, Yersinia pestis
uaaccuauacgcuc

SEQ ID NO: 4173469 - RNA, 18 nt, Yersinia pestis
uaaccucacgggcuucca

SEQ ID NO: 4173470 - RNA, 22 nt, Yersinia pestis
uaaccucacgggcuuccaucag

SEQ ID NO: 4173471 - RNA, 13 nt, Yersinia pestis
uaaccucagccuc

SEQ ID NO: 4173472 - RNA, 14 nt, Yersinia pestis
uaaccucagccuca

SEQ ID NO: 4173473 - RNA, 16 nt, Yersinia pestis
uaaccucagccucauu

SEQ ID NO: 4173474 - RNA, 20 nt, Yersinia pestis
uaaccucagccucauucaug

SEQ ID NO: 4173475 - RNA, 21 nt, Yersinia pestis
uaaccucaggcccgcuaucac

SEQ ID NO: 4173476 - RNA, 15 nt, Yersinia pestis
uaaccugcacuuuca

SEQ ID NO: 4173477 - RNA, 16 nt, Yersinia pestis
uaaccugcacuuucau

SEQ ID NO: 4173478 - RNA, 18 nt, Yersinia pestis
uaaccuguaaaagcagcc

SEQ ID NO: 4173479 - RNA, 14 nt, Yersinia pestis
uaaccuucuucauu

SEQ ID NO: 4173480 - RNA, 13 nt, Yersinia pestis
uaacgaacgcucu

SEQ ID NO: 4173481 - RNA, 17 nt, Yersinia pestis
uaacgacgcauuaaucc

SEQ ID NO: 4173482 - RNA, 15 nt, Yersinia pestis
uaacgaggcauaauc

SEQ ID NO: 4173483 - RNA, 14 nt, Yersinia pestis
uaacgauuauuaaa

SEQ ID NO: 4173484 - RNA, 16 nt, Yersinia pestis
uaacgcaaaacgcccu

SEQ ID NO: 4173485 - RNA, 15 nt, Yersinia pestis
uaacgcagauaaauc

SEQ ID NO: 4173486 - RNA, 19 nt, Yersinia pestis
uaacgcccggcaauaauag

SEQ ID NO: 4173487 - RNA, 20 nt, Yersinia pestis
uaacgccgaguaagucaaua

SEQ ID NO: 4173488 - RNA, 21 nt, Yersinia pestis
uaacgccgcuaaaucaucaaa

SEQ ID NO: 4173489 - RNA, 18 nt, Yersinia pestis
uaacgccggaauugcgcu

SEQ ID NO: 4173490 - RNA, 21 nt, Yersinia pestis
uaacgccggauaaauuaauaa

SEQ ID NO: 4173491 - RNA, 21 nt, Yersinia pestis
uaacgcucccuccgccagcaa

SEQ ID NO: 4173492 - RNA, 14 nt, Yersinia pestis
uaacgcucuuguag

SEQ ID NO: 4173493 - RNA, 14 nt, Yersinia pestis
uaacgcugaauaag

SEQ ID NO: 4173494 - RNA, 20 nt, Yersinia pestis
uaacgcuggauaagugaaua

SEQ ID NO: 4173495 - RNA, 20 nt, Yersinia pestis
uaacggaauuucgauaaaag

SEQ ID NO: 4173496 - RNA, 23 nt, Yersinia pestis
uaacggccgccuguauuauuaau

SEQ ID NO: 4173497 - RNA, 15 nt, Yersinia pestis
uaacggcucugccaa

SEQ ID NO: 4173498 - RNA, 12 nt, Yersinia pestis
uaacgggagauu

SEQ ID NO: 4173499 - RNA, 13 nt, Yersinia pestis
uaacgggcggcug

SEQ ID NO: 4173500 - RNA, 18 nt, Yersinia pestis
uaacgguaauuauuuugg

SEQ ID NO: 4173501 - RNA, 21 nt, Yersinia pestis
uaacgguuuaccggggcgauc

SEQ ID NO: 4173502 - RNA, 19 nt, Yersinia pestis
uaacgucgcugaaaugcua

SEQ ID NO: 4173503 - RNA, 21 nt, Yersinia pestis
uaacgucgcugaaaugcuaug

SEQ ID NO: 4173504 - RNA, 17 nt, Yersinia pestis
uaacguugcaaaugcua

SEQ ID NO: 4173505 - RNA, 15 nt, Yersinia pestis
uaacguuucagggug

SEQ ID NO: 4173506 - RNA, 15 nt, Yersinia pestis
uaacuaacaucagcg

SEQ ID NO: 4173507 - RNA, 16 nt, Yersinia pestis
uaacuaacguuuugua

SEQ ID NO: 4173508 - RNA, 18 nt, Yersinia pestis
uaacuaagagucacagca

SEQ ID NO: 4173509 - RNA, 14 nt, Yersinia pestis
uaacuaauaauaau

SEQ ID NO: 4173510 - RNA, 18 nt, Yersinia pestis
uaacucaaccccagccgg

SEQ ID NO: 4173511 - RNA, 15 nt, Yersinia pestis
uaacucaagcguuau

SEQ ID NO: 4173512 - RNA, 16 nt, Yersinia pestis
uaacucaauaaauuca

SEQ ID NO: 4173513 - RNA, 13 nt, Yersinia pestis
uaacucaucagua

SEQ ID NO: 4173514 - RNA, 13 nt, Yersinia pestis
uaacucaugugua

SEQ ID NO: 4173515 - RNA, 20 nt, Yersinia pestis
uaacucauuuaucuaaaacu

SEQ ID NO: 4173516 - RNA, 16 nt, Yersinia pestis
uaacuccaucaggcua

SEQ ID NO: 4173517 - RNA, 19 nt, Yersinia pestis
uaacugagccgcauacaua

SEQ ID NO: 4173518 - RNA, 21 nt, Yersinia pestis
uaacugaguuggaaaugacaa

SEQ ID NO: 4173519 - RNA, 17 nt, Yersinia pestis
uaacugcagugaaaagg

SEQ ID NO: 4173520 - RNA, 15 nt, Yersinia pestis
uaacugcauagcuaa

SEQ ID NO: 4173521 - RNA, 16 nt, Yersinia pestis
uaacugcugcuuuaau

SEQ ID NO: 4173522 - RNA, 15 nt, Yersinia pestis
uaacuggccaauuaa

SEQ ID NO: 4173523 - RNA, 16 nt, Yersinia pestis
uaacuggucuagcgca

SEQ ID NO: 4173524 - RNA, 15 nt, Yersinia pestis
uaacugguggcaggc

SEQ ID NO: 4173525 - RNA, 16 nt, Yersinia pestis
uaacugugcaguaucu

SEQ ID NO: 4173526 - RNA, 14 nt, Yersinia pestis
uaacuguuuuauau

SEQ ID NO: 4173527 - RNA, 17 nt, Yersinia pestis
uaacuuaaaauauggca

SEQ ID NO: 4173528 - RNA, 22 nt, Yersinia pestis
uaacuuaucgaccaacuggcaa

SEQ ID NO: 4173529 - RNA, 19 nt, Yersinia pestis
uaacuuauugauuauaugc

SEQ ID NO: 4173530 - RNA, 14 nt, Yersinia pestis
uaacuucauuuuuc

SEQ ID NO: 4173531 - RNA, 15 nt, Yersinia pestis
uaacuuccaauuucu

SEQ ID NO: 4173532 - RNA, 23 nt, Yersinia pestis
uaacuuccuaacaauauuaccaa

SEQ ID NO: 4173533 - RNA, 22 nt, Yersinia pestis
uaacuugccguaaaauuuaaag

SEQ ID NO: 4173534 - RNA, 16 nt, Yersinia pestis
uaacuuuaguuucuuu

SEQ ID NO: 4173535 - RNA, 13 nt, Yersinia pestis
uaacuuuauugac

SEQ ID NO: 4173536 - RNA, 17 nt, Yersinia pestis
uaacuuuccauccagaa

SEQ ID NO: 4173537 - RNA, 22 nt, Yersinia pestis
uaacuuuucgggcuaaagacac

SEQ ID NO: 4173538 - RNA, 13 nt, Yersinia pestis
uaacuuuucuuca

SEQ ID NO: 4173539 - RNA, 15 nt, Yersinia pestis
uaacuuuuggcagca

SEQ ID NO: 4173540 - RNA, 19 nt, Yersinia pestis
uaacuuuuggcagcaccag

SEQ ID NO: 4173541 - RNA, 19 nt, Yersinia pestis
uaagaaagagaugacccaa

SEQ ID NO: 4173542 - RNA, 16 nt, Yersinia pestis
uaagaaaucaucagca

SEQ ID NO: 4173543 - RNA, 16 nt, Yersinia pestis
uaagaacaacgcugca

SEQ ID NO: 4173544 - RNA, 13 nt, Yersinia pestis
uaagaagacuucg

SEQ ID NO: 4173545 - RNA, 15 nt, Yersinia pestis
uaagaagccucauga

SEQ ID NO: 4173546 - RNA, 17 nt, Yersinia pestis
uaagaaguagaaugaga

SEQ ID NO: 4173547 - RNA, 15 nt, Yersinia pestis
uaagaauaaauaaua

SEQ ID NO: 4173548 - RNA, 23 nt, Yersinia pestis
uaagacaccacaucacgcagcgc

SEQ ID NO: 4173549 - RNA, 20 nt, Yersinia pestis
uaagacguaucgcaguuaaa

SEQ ID NO: 4173550 - RNA, 18 nt, Yersinia pestis
uaagacguuauuauugau

SEQ ID NO: 4173551 - RNA, 19 nt, Yersinia pestis
uaagagcgacucaauaaua

SEQ ID NO: 4173552 - RNA, 18 nt, Yersinia pestis
uaagauaauuauccauuu

SEQ ID NO: 4173553 - RNA, 15 nt, Yersinia pestis
uaagauacuugcguu

SEQ ID NO: 4173554 - RNA, 18 nt, Yersinia pestis
uaagauaggccaccucuu

SEQ ID NO: 4173555 - RNA, 16 nt, Yersinia pestis
uaagaucaauauguuu

SEQ ID NO: 4173556 - RNA, 14 nt, Yersinia pestis
uaagauccaccaca

SEQ ID NO: 4173557 - RNA, 17 nt, Yersinia pestis
uaagauccauguauauu

SEQ ID NO: 4173558 - RNA, 13 nt, Yersinia pestis
uaagaucucagca

SEQ ID NO: 4173559 - RNA, 23 nt, Yersinia pestis
uaagauuacguagacauaaauuu

SEQ ID NO: 4173560 - RNA, 18 nt, Yersinia pestis
uaagcaauaccgacauca

SEQ ID NO: 4173561 - RNA, 16 nt, Yersinia pestis
uaagcacgaauuuuau

SEQ ID NO: 4173562 - RNA, 17 nt, Yersinia pestis
uaagcaggaagauaucg

SEQ ID NO: 4173563 - RNA, 19 nt, Yersinia pestis
uaagcaggggaucgggcug

SEQ ID NO: 4173564 - RNA, 16 nt, Yersinia pestis
uaagcauaaccgguac

SEQ ID NO: 4173565 - RNA, 22 nt, Yersinia pestis
uaagccgcaggcaaacaaugug

SEQ ID NO: 4173566 - RNA, 19 nt, Yersinia pestis
uaagccgugcggcacugcg

SEQ ID NO: 4173567 - RNA, 21 nt, Yersinia pestis
uaagccuaauggugcuauuuc

SEQ ID NO: 4173568 - RNA, 23 nt, Yersinia pestis
uaagccuaauggugcuauuucug

SEQ ID NO: 4173569 - RNA, 18 nt, Yersinia pestis
uaagcgguauccaccuuc

SEQ ID NO: 4173570 - RNA, 20 nt, Yersinia pestis
uaagcgguauccaccuucca

SEQ ID NO: 4173571 - RNA, 14 nt, Yersinia pestis
uaagcgguuucaug

SEQ ID NO: 4173572 - RNA, 20 nt, Yersinia pestis
uaagcguagggauaaaucgc

SEQ ID NO: 4173573 - RNA, 14 nt, Yersinia pestis
uaagcguauuuugu

SEQ ID NO: 4173574 - RNA, 20 nt, Yersinia pestis
uaagcuagagccgcgcuaua

SEQ ID NO: 4173575 - RNA, 15 nt, Yersinia pestis
uaagcucuuccaaua

SEQ ID NO: 4173576 - RNA, 14 nt, Yersinia pestis
uaagcugcagaggu

SEQ ID NO: 4173577 - RNA, 20 nt, Yersinia pestis
uaagcuggcgcacucauccu

SEQ ID NO: 4173578 - RNA, 15 nt, Yersinia pestis
uaaggauuuggaaug

SEQ ID NO: 4173579 - RNA, 13 nt, Yersinia pestis
uaaggcccauuug

SEQ ID NO: 4173580 - RNA, 22 nt, Yersinia pestis
uaaggcccgcaguaauauguaa

SEQ ID NO: 4173581 - RNA, 16 nt, Yersinia pestis
uaaggguaaaaucccc

SEQ ID NO: 4173582 - RNA, 15 nt, Yersinia pestis
uaaggucacuguuuc

SEQ ID NO: 4173583 - RNA, 20 nt, Yersinia pestis
uaaggucacuguuucgccuu

SEQ ID NO: 4173584 - RNA, 21 nt, Yersinia pestis
uaaggugaugaaugacuggcu

SEQ ID NO: 4173585 - RNA, 19 nt, Yersinia pestis
uaaguaauaacucagggcu

SEQ ID NO: 4173586 - RNA, 23 nt, Yersinia pestis
uaaguaucagcggcguauaucgu

SEQ ID NO: 4173587 - RNA, 12 nt, Yersinia pestis
uaagucaaauuu

SEQ ID NO: 4173588 - RNA, 20 nt, Yersinia pestis
uaagucaaauuuaaaguuuu

SEQ ID NO: 4173589 - RNA, 19 nt, Yersinia pestis
uaagucaaugcauuguaaa

SEQ ID NO: 4173590 - RNA, 22 nt, Yersinia pestis
uaagugaacccacgacuauuua

SEQ ID NO: 4173591 - RNA, 22 nt, Yersinia pestis
uaagugauucgggugagugagc

SEQ ID NO: 4173592 - RNA, 16 nt, Yersinia pestis
uaagugccaguuaaua

SEQ ID NO: 4173593 - RNA, 16 nt, Yersinia pestis
uaagugcgggaaagua

SEQ ID NO: 4173594 - RNA, 16 nt, Yersinia pestis
uaaguuaacaccauca

SEQ ID NO: 4173595 - RNA, 13 nt, Yersinia pestis
uaaguuaguggug

SEQ ID NO: 4173596 - RNA, 15 nt, Yersinia pestis
uaaguugaugcagua

SEQ ID NO: 4173597 - RNA, 14 nt, Yersinia pestis
uaauaaaaaacuga

SEQ ID NO: 4173598 - RNA, 16 nt, Yersinia pestis
uaauaaaaaacugacu

SEQ ID NO: 4173599 - RNA, 24 nt, Yersinia pestis
uaauaaaaaccaauggaaaauaca

SEQ ID NO: 4173600 - RNA, 13 nt, Yersinia pestis
uaauaaaaucaaa

SEQ ID NO: 4173601 - RNA, 13 nt, Yersinia pestis
uaauaaauuaaua

SEQ ID NO: 4173602 - RNA, 15 nt, Yersinia pestis
uaauaacgaauuuca

SEQ ID NO: 4173603 - RNA, 20 nt, Yersinia pestis
uaauaacgccgaguaaguca

SEQ ID NO: 4173604 - RNA, 16 nt, Yersinia pestis
uaauaacgguuuuaac

SEQ ID NO: 4173605 - RNA, 22 nt, Yersinia pestis
uaauaagacguuauuauugauu

SEQ ID NO: 4173606 - RNA, 21 nt, Yersinia pestis
uaauaagccgcaggcaaacaa

SEQ ID NO: 4173607 - RNA, 14 nt, Yersinia pestis
uaauaaguuaauaa

SEQ ID NO: 4173608 - RNA, 14 nt, Yersinia pestis
uaauaauagauagu

SEQ ID NO: 4173609 - RNA, 13 nt, Yersinia pestis
uaauaauaucaaa

SEQ ID NO: 4173610 - RNA, 22 nt, Yersinia pestis
uaauaaucuaaauuaauaucuu

SEQ ID NO: 4173611 - RNA, 16 nt, Yersinia pestis
uaauaaugauuauuga

SEQ ID NO: 4173612 - RNA, 21 nt, Yersinia pestis
uaauaauuccaugaaaacccg

SEQ ID NO: 4173613 - RNA, 20 nt, Yersinia pestis
uaauaauucugcuauuaauu

SEQ ID NO: 4173614 - RNA, 21 nt, Yersinia pestis
uaauaauucugcuauuaauua

SEQ ID NO: 4173615 - RNA, 22 nt, Yersinia pestis
uaauaauuuauacauaucagaa

SEQ ID NO: 4173616 - RNA, 20 nt, Yersinia pestis
uaauaauuuuucuuccacca

SEQ ID NO: 4173617 - RNA, 15 nt, Yersinia pestis
uaauacaauagagaa

SEQ ID NO: 4173618 - RNA, 23 nt, Yersinia pestis
uaauacacccgaaggccauugcc

SEQ ID NO: 4173619 - RNA, 22 nt, Yersinia pestis
uaauacacuaggagaaacauua

SEQ ID NO: 4173620 - RNA, 19 nt, Yersinia pestis
uaauacagcaccaccgaug

SEQ ID NO: 4173621 - RNA, 20 nt, Yersinia pestis
uaauacaggcugacauuucu

SEQ ID NO: 4173622 - RNA, 22 nt, Yersinia pestis
uaauacaggcugacauuucuuu

SEQ ID NO: 4173623 - RNA, 16 nt, Yersinia pestis
uaauacaucaucaaaa

SEQ ID NO: 4173624 - RNA, 15 nt, Yersinia pestis
uaauaccacaccuua

SEQ ID NO: 4173625 - RNA, 20 nt, Yersinia pestis
uaauaccauuucuuauaucu

SEQ ID NO: 4173626 - RNA, 11 nt, Yersinia pestis
uaauaccgaua

SEQ ID NO: 4173627 - RNA, 15 nt, Yersinia pestis
uaauacgaucagcgu

SEQ ID NO: 4173628 - RNA, 16 nt, Yersinia pestis
uaauacguuggcggcu

SEQ ID NO: 4173629 - RNA, 13 nt, Yersinia pestis
uaauacucuguua

SEQ ID NO: 4173630 - RNA, 15 nt, Yersinia pestis
uaauacugauagcgg

SEQ ID NO: 4173631 - RNA, 13 nt, Yersinia pestis
uaauacugccaau

SEQ ID NO: 4173632 - RNA, 22 nt, Yersinia pestis
uaauacugcgguccuacccuuu

SEQ ID NO: 4173633 - RNA, 20 nt, Yersinia pestis
uaauagauaguacguagcga

SEQ ID NO: 4173634 - RNA, 14 nt, Yersinia pestis
uaauagauaguacu

SEQ ID NO: 4173635 - RNA, 13 nt, Yersinia pestis
uaauagcaaaaaa

SEQ ID NO: 4173636 - RNA, 21 nt, Yersinia pestis
uaauagccucugucucuggua

SEQ ID NO: 4173637 - RNA, 17 nt, Yersinia pestis
uaauagcgaaagccaaa

SEQ ID NO: 4173638 - RNA, 17 nt, Yersinia pestis
uaauagguuggcauuag

SEQ ID NO: 4173639 - RNA, 23 nt, Yersinia pestis
uaauagugucauaauuaucgcaa

SEQ ID NO: 4173640 - RNA, 21 nt, Yersinia pestis
uaauaguuaaucgcagcagag

SEQ ID NO: 4173641 - RNA, 16 nt, Yersinia pestis
uaauaguucauuuugu

SEQ ID NO: 4173642 - RNA, 21 nt, Yersinia pestis
uaauaguuucuggcaagguaa

SEQ ID NO: 4173643 - RNA, 13 nt, Yersinia pestis
uaauauaauacuu

SEQ ID NO: 4173644 - RNA, 12 nt, Yersinia pestis
uaauauaauuca

SEQ ID NO: 4173645 - RNA, 19 nt, Yersinia pestis
uaauauaauucaauauaua

SEQ ID NO: 4173646 - RNA, 16 nt, Yersinia pestis
uaauauauaaaauaaa

SEQ ID NO: 4173647 - RNA, 21 nt, Yersinia pestis
uaauaucaccauuaacgauga

SEQ ID NO: 4173648 - RNA, 13 nt, Yersinia pestis
uaauaucagcgau

SEQ ID NO: 4173649 - RNA, 16 nt, Yersinia pestis
uaauauccaauuguuu

SEQ ID NO: 4173650 - RNA, 16 nt, Yersinia pestis
uaauaucgguaaaaaa

SEQ ID NO: 4173651 - RNA, 11 nt, Yersinia pestis
uaauaucugcc

SEQ ID NO: 4173652 - RNA, 17 nt, Yersinia pestis
uaauaucuuuaaauuau

SEQ ID NO: 4173653 - RNA, 21 nt, Yersinia pestis
uaauaugaccggacauaagau

SEQ ID NO: 4173654 - RNA, 15 nt, Yersinia pestis
uaauaugccaaaucu

SEQ ID NO: 4173655 - RNA, 14 nt, Yersinia pestis
uaauauuaaaaucc

SEQ ID NO: 4173656 - RNA, 12 nt, Yersinia pestis
uaauauuauuca

SEQ ID NO: 4173657 - RNA, 22 nt, Yersinia pestis
uaauauucaauaggguaauacc

SEQ ID NO: 4173658 - RNA, 16 nt, Yersinia pestis
uaauauuuauaaaaaa

SEQ ID NO: 4173659 - RNA, 15 nt, Yersinia pestis
uaauauuuaucugca

SEQ ID NO: 4173660 - RNA, 14 nt, Yersinia pestis
uaauauuucaaaug

SEQ ID NO: 4173661 - RNA, 23 nt, Yersinia pestis
uaauauuucaagcuguauaugcg

SEQ ID NO: 4173662 - RNA, 17 nt, Yersinia pestis
uaauauuuccguggguu

SEQ ID NO: 4173663 - RNA, 19 nt, Yersinia pestis
uaaucaaacgaucaguuaa

SEQ ID NO: 4173664 - RNA, 20 nt, Yersinia pestis
uaaucaauccuacauucagu

SEQ ID NO: 4173665 - RNA, 18 nt, Yersinia pestis
uaaucaauuaaucaauua

SEQ ID NO: 4173666 - RNA, 19 nt, Yersinia pestis
uaaucaccucaaccugcca

SEQ ID NO: 4173667 - RNA, 18 nt, Yersinia pestis
uaaucagacugcugacaa

SEQ ID NO: 4173668 - RNA, 20 nt, Yersinia pestis
uaaucagcaaaaacaaauaa

SEQ ID NO: 4173669 - RNA, 22 nt, Yersinia pestis
uaaucagcaaaaacaaauaauu

SEQ ID NO: 4173670 - RNA, 16 nt, Yersinia pestis
uaaucagccuucaggg

SEQ ID NO: 4173671 - RNA, 13 nt, Yersinia pestis
uaaucagcguggu

SEQ ID NO: 4173672 - RNA, 15 nt, Yersinia pestis
uaaucaguuucaggc

SEQ ID NO: 4173673 - RNA, 17 nt, Yersinia pestis
uaaucauauuuuccugc

SEQ ID NO: 4173674 - RNA, 20 nt, Yersinia pestis
uaaucaucagggaauugacu

SEQ ID NO: 4173675 - RNA, 17 nt, Yersinia pestis
uaaucaucuacaacauc

SEQ ID NO: 4173676 - RNA, 11 nt, Yersinia pestis
uaaucaugggg

SEQ ID NO: 4173677 - RNA, 20 nt, Yersinia pestis
uaauccaacgggcaauacgu

SEQ ID NO: 4173678 - RNA, 11 nt, Yersinia pestis
uaauccaaggc

SEQ ID NO: 4173679 - RNA, 18 nt, Yersinia pestis
uaauccagaagcugagcc

SEQ ID NO: 4173680 - RNA, 22 nt, Yersinia pestis
uaaucccaccggggagcacuau

SEQ ID NO: 4173681 - RNA, 23 nt, Yersinia pestis
uaauccccaggugcuuauuuauu

SEQ ID NO: 4173682 - RNA, 22 nt, Yersinia pestis
uaauccgccugagauuaaccgc

SEQ ID NO: 4173683 - RNA, 20 nt, Yersinia pestis
uaauccucucuugaaaugau

SEQ ID NO: 4173684 - RNA, 22 nt, Yersinia pestis
uaaucgccgccuccgauucaua

SEQ ID NO: 4173685 - RNA, 21 nt, Yersinia pestis
uaaucgccugaugcuuuucuu

SEQ ID NO: 4173686 - RNA, 23 nt, Yersinia pestis
uaaucgccugcugagccaaauaa

SEQ ID NO: 4173687 - RNA, 15 nt, Yersinia pestis
uaaucggauggucau

SEQ ID NO: 4173688 - RNA, 21 nt, Yersinia pestis
uaaucuaauuucaaaugaacu

SEQ ID NO: 4173689 - RNA, 14 nt, Yersinia pestis
uaaucuauuaauau

SEQ ID NO: 4173690 - RNA, 17 nt, Yersinia pestis
uaaucuauuaauaucga

SEQ ID NO: 4173691 - RNA, 13 nt, Yersinia pestis
uaaucuccaucau

SEQ ID NO: 4173692 - RNA, 15 nt, Yersinia pestis
uaaucuccauugauu

SEQ ID NO: 4173693 - RNA, 15 nt, Yersinia pestis
uaaucuuaaguaaau

SEQ ID NO: 4173694 - RNA, 21 nt, Yersinia pestis
uaaucuuauuuguaaauauua

SEQ ID NO: 4173695 - RNA, 15 nt, Yersinia pestis
uaaucuuguaguaca

SEQ ID NO: 4173696 - RNA, 13 nt, Yersinia pestis
uaaugaaaaggca

SEQ ID NO: 4173697 - RNA, 20 nt, Yersinia pestis
uaaugaaaauagccaaccag

SEQ ID NO: 4173698 - RNA, 22 nt, Yersinia pestis
uaaugaccacgcaucaauaaua

SEQ ID NO: 4173699 - RNA, 13 nt, Yersinia pestis
uaaugacgcuaug

SEQ ID NO: 4173700 - RNA, 15 nt, Yersinia pestis
uaaugagaauguaaa

SEQ ID NO: 4173701 - RNA, 22 nt, Yersinia pestis
uaaugagucucacaaaauaaua

SEQ ID NO: 4173702 - RNA, 15 nt, Yersinia pestis
uaaugaguuggcauu

SEQ ID NO: 4173703 - RNA, 20 nt, Yersinia pestis
uaaugaugagguaauacuca

SEQ ID NO: 4173704 - RNA, 13 nt, Yersinia pestis
uaaugauggcgau

SEQ ID NO: 4173705 - RNA, 14 nt, Yersinia pestis
uaaugauuauugac

SEQ ID NO: 4173706 - RNA, 16 nt, Yersinia pestis
uaaugcaauggcucca

SEQ ID NO: 4173707 - RNA, 19 nt, Yersinia pestis
uaaugcaccaaucaacaua

SEQ ID NO: 4173708 - RNA, 20 nt, Yersinia pestis
uaaugcagguucauuacaca

SEQ ID NO: 4173709 - RNA, 18 nt, Yersinia pestis
uaaugcauaacugcugug

SEQ ID NO: 4173710 - RNA, 18 nt, Yersinia pestis
uaaugcauucugcugguu

SEQ ID NO: 4173711 - RNA, 18 nt, Yersinia pestis
uaaugccacgucaucgaa

SEQ ID NO: 4173712 - RNA, 18 nt, Yersinia pestis
uaaugccccuuuuuuacc

SEQ ID NO: 4173713 - RNA, 21 nt, Yersinia pestis
uaaugccgaaugauucauuga

SEQ ID NO: 4173714 - RNA, 20 nt, Yersinia pestis
uaaugccgcugaucaggaag

SEQ ID NO: 4173715 - RNA, 13 nt, Yersinia pestis
uaaugcgaaaaaa

SEQ ID NO: 4173716 - RNA, 14 nt, Yersinia pestis
uaaugcgaaaaaag

SEQ ID NO: 4173717 - RNA, 18 nt, Yersinia pestis
uaaugcgaagcuuuuauu

SEQ ID NO: 4173718 - RNA, 21 nt, Yersinia pestis
uaaugcgaagcuuuuauugau

SEQ ID NO: 4173719 - RNA, 24 nt, Yersinia pestis
uaaugcgacgacgacaaugaucgu

SEQ ID NO: 4173720 - RNA, 15 nt, Yersinia pestis
uaaugcgcaccagcu

SEQ ID NO: 4173721 - RNA, 16 nt, Yersinia pestis
uaaugcuaaugccacu

SEQ ID NO: 4173722 - RNA, 17 nt, Yersinia pestis
uaaugcuguuguagcgc

SEQ ID NO: 4173723 - RNA, 23 nt, Yersinia pestis
uaaugcuguuguagcgccaggua

SEQ ID NO: 4173724 - RNA, 21 nt, Yersinia pestis
uaauggauugaucauucucug

SEQ ID NO: 4173725 - RNA, 20 nt, Yersinia pestis
uaauggcaccaucggcucua

SEQ ID NO: 4173726 - RNA, 12 nt, Yersinia pestis
uaauggcagcau

SEQ ID NO: 4173727 - RNA, 15 nt, Yersinia pestis
uaauggcauuuucag

SEQ ID NO: 4173728 - RNA, 14 nt, Yersinia pestis
uaauggccuaaauu

SEQ ID NO: 4173729 - RNA, 23 nt, Yersinia pestis
uaauggcgguauagaccaauuca

SEQ ID NO: 4173730 - RNA, 23 nt, Yersinia pestis
uaauggggagugcgcgcagugca

SEQ ID NO: 4173731 - RNA, 15 nt, Yersinia pestis
uaauggucaagguga

SEQ ID NO: 4173732 - RNA, 21 nt, Yersinia pestis
uaauggucaaggugauuucaa

SEQ ID NO: 4173733 - RNA, 16 nt, Yersinia pestis
uaauggugaaccagau

SEQ ID NO: 4173734 - RNA, 19 nt, Yersinia pestis
uaauggugcuauuucuggc

SEQ ID NO: 4173735 - RNA, 20 nt, Yersinia pestis
uaaugguuaccaaaaagcaa

SEQ ID NO: 4173736 - RNA, 20 nt, Yersinia pestis
uaaugguuuccauaaugguu

SEQ ID NO: 4173737 - RNA, 14 nt, Yersinia pestis
uaauguaauaaucu

SEQ ID NO: 4173738 - RNA, 23 nt, Yersinia pestis
uaaugucauuuccuguauuuccu

SEQ ID NO: 4173739 - RNA, 14 nt, Yersinia pestis
uaaugucuuuacua

SEQ ID NO: 4173740 - RNA, 17 nt, Yersinia pestis
uaaugucuuuacuaaau

SEQ ID NO: 4173741 - RNA, 12 nt, Yersinia pestis
uaauguugaucu

SEQ ID NO: 4173742 - RNA, 15 nt, Yersinia pestis
uaauguuuauauuga

SEQ ID NO: 4173743 - RNA, 10 nt, Yersinia pestis
uaauuaaaaa

SEQ ID NO: 4173744 - RNA, 14 nt, Yersinia pestis
uaauuaaaaauaga

SEQ ID NO: 4173745 - RNA, 20 nt, Yersinia pestis
uaauuaaacgcucaucaacc

SEQ ID NO: 4173746 - RNA, 12 nt, Yersinia pestis
uaauuaaauauu

SEQ ID NO: 4173747 - RNA, 14 nt, Yersinia pestis
uaauuaaauauuaa

SEQ ID NO: 4173748 - RNA, 15 nt, Yersinia pestis
uaauuaaauauuaac

SEQ ID NO: 4173749 - RNA, 20 nt, Yersinia pestis
uaauuaaauguauaaaaaag

SEQ ID NO: 4173750 - RNA, 19 nt, Yersinia pestis
uaauuaacacccaauaaua

SEQ ID NO: 4173751 - RNA, 14 nt, Yersinia pestis
uaauuaauauauaa

SEQ ID NO: 4173752 - RNA, 19 nt, Yersinia pestis
uaauuaauauauaaaauaa

SEQ ID NO: 4173753 - RNA, 17 nt, Yersinia pestis
uaauuaauucaaucggc

SEQ ID NO: 4173754 - RNA, 13 nt, Yersinia pestis
uaauuaauuuaaa

SEQ ID NO: 4173755 - RNA, 15 nt, Yersinia pestis
uaauuaccacgacga

SEQ ID NO: 4173756 - RNA, 15 nt, Yersinia pestis
uaauuauagugaaaa

SEQ ID NO: 4173757 - RNA, 22 nt, Yersinia pestis
uaauuauuguggcuaccaauua

SEQ ID NO: 4173758 - RNA, 22 nt, Yersinia pestis
uaauucaauauauacaauccaa

SEQ ID NO: 4173759 - RNA, 15 nt, Yersinia pestis
uaauucaccaauugc

SEQ ID NO: 4173760 - RNA, 19 nt, Yersinia pestis
uaauucaccaauugcgguc

SEQ ID NO: 4173761 - RNA, 16 nt, Yersinia pestis
uaauucagcaaacuca

SEQ ID NO: 4173762 - RNA, 19 nt, Yersinia pestis
uaauucagcaucaaauuau

SEQ ID NO: 4173763 - RNA, 21 nt, Yersinia pestis
uaauucagcaucaaauuauuu

SEQ ID NO: 4173764 - RNA, 16 nt, Yersinia pestis
uaauucaggcaaauuc

SEQ ID NO: 4173765 - RNA, 14 nt, Yersinia pestis
uaauucaucagauu

SEQ ID NO: 4173766 - RNA, 19 nt, Yersinia pestis
uaauucaugcuaauaccac

SEQ ID NO: 4173767 - RNA, 13 nt, Yersinia pestis
uaauucauuauua

SEQ ID NO: 4173768 - RNA, 13 nt, Yersinia pestis
uaauucuccuuuc

SEQ ID NO: 4173769 - RNA, 14 nt, Yersinia pestis
uaauucucucuuuu

SEQ ID NO: 4173770 - RNA, 16 nt, Yersinia pestis
uaauucugcuauuaau

SEQ ID NO: 4173771 - RNA, 19 nt, Yersinia pestis
uaauucuggguacaacaca

SEQ ID NO: 4173772 - RNA, 17 nt, Yersinia pestis
uaauugaagauuuaaau

SEQ ID NO: 4173773 - RNA, 21 nt, Yersinia pestis
uaauugaagauuuaaauaaca

SEQ ID NO: 4173774 - RNA, 22 nt, Yersinia pestis
uaauugaauugccccccaauau

SEQ ID NO: 4173775 - RNA, 15 nt, Yersinia pestis
uaauuggcaauaaug

SEQ ID NO: 4173776 - RNA, 16 nt, Yersinia pestis
uaauuuaaacucuuua

SEQ ID NO: 4173777 - RNA, 17 nt, Yersinia pestis
uaauuuaaauaagaucc

SEQ ID NO: 4173778 - RNA, 21 nt, Yersinia pestis
uaauuuacugguaccaaacaa

SEQ ID NO: 4173779 - RNA, 14 nt, Yersinia pestis
uaauuuauaaacaa

SEQ ID NO: 4173780 - RNA, 18 nt, Yersinia pestis
gagaugcaguaaguauau

SEQ ID NO: 4173781 - RNA, 14 nt, Yersinia pestis
gagauguauccaag

SEQ ID NO: 4173782 - RNA, 16 nt, Yersinia pestis
gagauguauccaaggc

SEQ ID NO: 4173783 - RNA, 20 nt, Yersinia pestis
gagauguucgcagaaaagag

SEQ ID NO: 4173784 - RNA, 12 nt, Yersinia pestis
gagauucugggg

SEQ ID NO: 4173785 - RNA, 14 nt, Yersinia pestis
gagauugaugggau

SEQ ID NO: 4173786 - RNA, 18 nt, Yersinia pestis
gagcaaaacugggcuuga

SEQ ID NO: 4173787 - RNA, 17 nt, Yersinia pestis
gagcaagggcagcuaac

SEQ ID NO: 4173788 - RNA, 13 nt, Yersinia pestis
gagcaccgcagga

SEQ ID NO: 4173789 - RNA, 15 nt, Yersinia pestis
gagcaccgcaggaac

SEQ ID NO: 4173790 - RNA, 16 nt, Yersinia pestis
gagcacgauuaccauu

SEQ ID NO: 4173791 - RNA, 16 nt, Yersinia pestis
gagcacgcagagauga

SEQ ID NO: 4173792 - RNA, 22 nt, Yersinia pestis
gagcagaaagcagcagcuuuug

SEQ ID NO: 4173793 - RNA, 19 nt, Yersinia pestis
gagcagccaacacaccugc

SEQ ID NO: 4173794 - RNA, 20 nt, Yersinia pestis
gagcagccaacacaccugca

SEQ ID NO: 4173795 - RNA, 17 nt, Yersinia pestis
gagcagugcgcggcgcc

SEQ ID NO: 4173796 - RNA, 21 nt, Yersinia pestis
gagcagugcgcggcgccguca

SEQ ID NO: 4173797 - RNA, 22 nt, Yersinia pestis
gagcauaccgguuugggcauca

SEQ ID NO: 4173798 - RNA, 22 nt, Yersinia pestis
gagccagagacauaaagcccgc

SEQ ID NO: 4173799 - RNA, 12 nt, Yersinia pestis
gagccagcacac

SEQ ID NO: 4173800 - RNA, 15 nt, Yersinia pestis
gagccauccaggcaa

SEQ ID NO: 4173801 - RNA, 16 nt, Yersinia pestis
gagccauccaggcaag

SEQ ID NO: 4173802 - RNA, 17 nt, Yersinia pestis
gagccauccaggcaagc

SEQ ID NO: 4173803 - RNA, 16 nt, Yersinia pestis
gagccucaugaaugag

SEQ ID NO: 4173804 - RNA, 21 nt, Yersinia pestis
gagccucaugaaugaggcuga

SEQ ID NO: 4173805 - RNA, 17 nt, Yersinia pestis
gagccuguaucggguga

SEQ ID NO: 4173806 - RNA, 17 nt, Yersinia pestis
gagcgcuauucugacgc

SEQ ID NO: 4173807 - RNA, 13 nt, Yersinia pestis
gagcggcaacugu

SEQ ID NO: 4173808 - RNA, 23 nt, Yersinia pestis
gagcggcauccaguaagcuguug

SEQ ID NO: 4173809 - RNA, 18 nt, Yersinia pestis
gagcgguuuauauuuuug

SEQ ID NO: 4173810 - RNA, 14 nt, Yersinia pestis
gagcgucaagccaa

SEQ ID NO: 4173811 - RNA, 20 nt, Yersinia pestis
gagcgucaagccaaccccca

SEQ ID NO: 4173812 - RNA, 21 nt, Yersinia pestis
gagcuaaugcuauccacaaac

SEQ ID NO: 4173813 - RNA, 24 nt, Yersinia pestis
gagcuaaugcuauccacaaacuca

SEQ ID NO: 4173814 - RNA, 17 nt, Yersinia pestis
gagcuauggaagaacug

SEQ ID NO: 4173815 - RNA, 15 nt, Yersinia pestis
gagcugacgucagau

SEQ ID NO: 4173816 - RNA, 16 nt, Yersinia pestis
gagcugcgauaaucug

SEQ ID NO: 4173817 - RNA, 22 nt, Yersinia pestis
gagcuguagaacuuguucauau

SEQ ID NO: 4173818 - RNA, 15 nt, Yersinia pestis
gagcuguauguuuuc

SEQ ID NO: 4173819 - RNA, 21 nt, Yersinia pestis
gagcuuccagugcauuaucuu

SEQ ID NO: 4173820 - RNA, 16 nt, Yersinia pestis
gagcuucuucaaaagc

SEQ ID NO: 4173821 - RNA, 11 nt, Yersinia pestis
gagcuugcugc

SEQ ID NO: 4173822 - RNA, 13 nt, Yersinia pestis
gagcuugcugcug

SEQ ID NO: 4173823 - RNA, 13 nt, Yersinia pestis
gaggaaacugccg

SEQ ID NO: 4173824 - RNA, 22 nt, Yersinia pestis
gaggaaggcgguuaucuggaau

SEQ ID NO: 4173825 - RNA, 21 nt, Yersinia pestis
gaggaauagccagcguggugu

SEQ ID NO: 4173826 - RNA, 15 nt, Yersinia pestis
gaggacagguggguu

SEQ ID NO: 4173827 - RNA, 21 nt, Yersinia pestis
gaggacuuccugcccagcggc

SEQ ID NO: 4173828 - RNA, 18 nt, Yersinia pestis
gaggagaauuagcgcggu

SEQ ID NO: 4173829 - RNA, 19 nt, Yersinia pestis
gaggauagggugccccaug

SEQ ID NO: 4173830 - RNA, 16 nt, Yersinia pestis
gaggauauuuauuucc

SEQ ID NO: 4173831 - RNA, 12 nt, Yersinia pestis
gaggaucaccac

SEQ ID NO: 4173832 - RNA, 17 nt, Yersinia pestis
gaggauuuuccgcagcu

SEQ ID NO: 4173833 - RNA, 14 nt, Yersinia pestis
gaggcacccgagca

SEQ ID NO: 4173834 - RNA, 13 nt, Yersinia pestis
gaggccaggacuu

SEQ ID NO: 4173835 - RNA, 19 nt, Yersinia pestis
gaggcgcuacugcuuuuua

SEQ ID NO: 4173836 - RNA, 14 nt, Yersinia pestis
gaggcguggcacac

SEQ ID NO: 4173837 - RNA, 16 nt, Yersinia pestis
gaggcucuucugggcu

SEQ ID NO: 4173838 - RNA, 17 nt, Yersinia pestis
gaggcugagguugauga

SEQ ID NO: 4173839 - RNA, 14 nt, Yersinia pestis
gaggcuuuaaucug

SEQ ID NO: 4173840 - RNA, 16 nt, Yersinia pestis
gagggagacgcgcggu

SEQ ID NO: 4173841 - RNA, 17 nt, Yersinia pestis
gagggcuucuggcgugu

SEQ ID NO: 4173842 - RNA, 17 nt, Yersinia pestis
gaggguugucagcaguc

SEQ ID NO: 4173843 - RNA, 19 nt, Yersinia pestis
gaggguugucagcagucug

SEQ ID NO: 4173844 - RNA, 16 nt, Yersinia pestis
gagguacggccagcaa

SEQ ID NO: 4173845 - RNA, 21 nt, Yersinia pestis
gagguggccgagaggcugaag

SEQ ID NO: 4173846 - RNA, 13 nt, Yersinia pestis
gaguaaaacugau

SEQ ID NO: 4173847 - RNA, 13 nt, Yersinia pestis
gaguaaaccguac

SEQ ID NO: 4173848 - RNA, 20 nt, Yersinia pestis
gaguaaauagcaaaacugag

SEQ ID NO: 4173849 - RNA, 15 nt, Yersinia pestis
gaguaaauuaaauuu

SEQ ID NO: 4173850 - RNA, 21 nt, Yersinia pestis
gaguaacaaauggucaggaac

SEQ ID NO: 4173851 - RNA, 22 nt, Yersinia pestis
gaguaacacuucagacugaaag

SEQ ID NO: 4173852 - RNA, 23 nt, Yersinia pestis
gaguaaucgccugcugagccaaa

SEQ ID NO: 4173853 - RNA, 22 nt, Yersinia pestis
gaguaauuucagauaaaaauaa

SEQ ID NO: 4173854 - RNA, 19 nt, Yersinia pestis
gaguagcugugaacguacu

SEQ ID NO: 4173855 - RNA, 15 nt, Yersinia pestis
gaguaguaaaaccua

SEQ ID NO: 4173856 - RNA, 22 nt, Yersinia pestis
gaguauacuaaaacagcucacu

SEQ ID NO: 4173857 - RNA, 13 nt, Yersinia pestis
gagucacagcauu

SEQ ID NO: 4173858 - RNA, 15 nt, Yersinia pestis
gagucacugggguga

SEQ ID NO: 4173859 - RNA, 23 nt, Yersinia pestis
gagucacuggggugaaucaaaac

SEQ ID NO: 4173860 - RNA, 13 nt, Yersinia pestis
gagucagcacaga

SEQ ID NO: 4173861 - RNA, 14 nt, Yersinia pestis
gagucagcacagaa

SEQ ID NO: 4173862 - RNA, 21 nt, Yersinia pestis
gagucaggaaacuggccaacu

SEQ ID NO: 4173863 - RNA, 13 nt, Yersinia pestis
gagucagucaggg

SEQ ID NO: 4173864 - RNA, 21 nt, Yersinia pestis
gagucagucagggugaaagcc

SEQ ID NO: 4173865 - RNA, 13 nt, Yersinia pestis
gagucagucuuug

SEQ ID NO: 4173866 - RNA, 20 nt, Yersinia pestis
gagucccguccgcaccgcca

SEQ ID NO: 4173867 - RNA, 20 nt, Yersinia pestis
gagucgauagcuuucuccuu

SEQ ID NO: 4173868 - RNA, 15 nt, Yersinia pestis
gagucgcaaaacuuc

SEQ ID NO: 4173869 - RNA, 22 nt, Yersinia pestis
gagucgcaaaacuucacuuucu

SEQ ID NO: 4173870 - RNA, 15 nt, Yersinia pestis
gagucgcuccucagc

SEQ ID NO: 4173871 - RNA, 19 nt, Yersinia pestis
gagucgcuccucagccuuu

SEQ ID NO: 4173872 - RNA, 18 nt, Yersinia pestis
gagucuggucgguauuau

SEQ ID NO: 4173873 - RNA, 14 nt, Yersinia pestis
gagugaaggguuga

SEQ ID NO: 4173874 - RNA, 17 nt, Yersinia pestis
gagugaaucgccguuac

SEQ ID NO: 4173875 - RNA, 20 nt, Yersinia pestis
gagugacaacauugccaaau

SEQ ID NO: 4173876 - RNA, 13 nt, Yersinia pestis
gagugagacaauu

SEQ ID NO: 4173877 - RNA, 14 nt, Yersinia pestis
gagugagcgcgggu

SEQ ID NO: 4173878 - RNA, 17 nt, Yersinia pestis
gagugagucaucggggu

SEQ ID NO: 4173879 - RNA, 14 nt, Yersinia pestis
gagugaugaaacca

SEQ ID NO: 4173880 - RNA, 13 nt, Yersinia pestis
gagugauuauucu

SEQ ID NO: 4173881 - RNA, 23 nt, Yersinia pestis
gagugcauccagcguaaacagua

SEQ ID NO: 4173882 - RNA, 14 nt, Yersinia pestis
gagugcggccacac

SEQ ID NO: 4173883 - RNA, 17 nt, Yersinia pestis
gagugguuuaaggcaac

SEQ ID NO: 4173884 - RNA, 13 nt, Yersinia pestis
gagugguuuauaa

SEQ ID NO: 4173885 - RNA, 15 nt, Yersinia pestis
gaguguaaaaagcag

SEQ ID NO: 4173886 - RNA, 18 nt, Yersinia pestis
gaguguaaaaagcagugc

SEQ ID NO: 4173887 - RNA, 20 nt, Yersinia pestis
gaguuaccuugugucaccau

SEQ ID NO: 4173888 - RNA, 23 nt, Yersinia pestis
gaguuacgugagcaucuggcgca

SEQ ID NO: 4173889 - RNA, 19 nt, Yersinia pestis
gaguuaucuguuucaaaua

SEQ ID NO: 4173890 - RNA, 11 nt, Yersinia pestis
gaguucaacgu

SEQ ID NO: 4173891 - RNA, 13 nt, Yersinia pestis
gaguucucaccaa

SEQ ID NO: 4173892 - RNA, 14 nt, Yersinia pestis
gaguucugcugcca

SEQ ID NO: 4173893 - RNA, 14 nt, Yersinia pestis
gaguuuccaguuca

SEQ ID NO: 4173894 - RNA, 18 nt, Yersinia pestis
gaguuucccuuuuccauc

SEQ ID NO: 4173895 - RNA, 14 nt, Yersinia pestis
gaguuucucugcuc

SEQ ID NO: 4173896 - RNA, 21 nt, Yersinia pestis
gaguuuucccugcgccagcag

SEQ ID NO: 4173897 - RNA, 15 nt, Yersinia pestis
gauaaaaaacgggcu

SEQ ID NO: 4173898 - RNA, 12 nt, Yersinia pestis
gauaaaaacauu

SEQ ID NO: 4173899 - RNA, 15 nt, Yersinia pestis
gauaaaaacauugaa

SEQ ID NO: 4173900 - RNA, 15 nt, Yersinia pestis
gauaaaaagaauaag

SEQ ID NO: 4173901 - RNA, 18 nt, Yersinia pestis
gauaaaaauaaucaauga

SEQ ID NO: 4173902 - RNA, 16 nt, Yersinia pestis
gauaaaaaucuuuuaa

SEQ ID NO: 4173903 - RNA, 18 nt, Yersinia pestis
gauaaaaggcuauuuaaa

SEQ ID NO: 4173904 - RNA, 13 nt, Yersinia pestis
gauaaaauacuuc

SEQ ID NO: 4173905 - RNA, 22 nt, Yersinia pestis
gauaaacaauaaacagacuaaa

SEQ ID NO: 4173906 - RNA, 19 nt, Yersinia pestis
gauaaaccgcuauaucauc

SEQ ID NO: 4173907 - RNA, 14 nt, Yersinia pestis
gauaaacuuaucgg

SEQ ID NO: 4173908 - RNA, 20 nt, Yersinia pestis
gauaaagacgucauaaauau

SEQ ID NO: 4173909 - RNA, 23 nt, Yersinia pestis
gauaaaggcaaaagcaucaccaa

SEQ ID NO: 4173910 - RNA, 22 nt, Yersinia pestis
gauaaaggcggugauaaacccu

SEQ ID NO: 4173911 - RNA, 13 nt, Yersinia pestis
gauaaauaaaaua

SEQ ID NO: 4173912 - RNA, 20 nt, Yersinia pestis
gauaaauacaaaauuaacgg

SEQ ID NO: 4173913 - RNA, 21 nt, Yersinia pestis
gauaaauacggucaacgauug

SEQ ID NO: 4173914 - RNA, 13 nt, Yersinia pestis
gauaaaucgccca

SEQ ID NO: 4173915 - RNA, 18 nt, Yersinia pestis
gauaaauucgauaaaagg

SEQ ID NO: 4173916 - RNA, 20 nt, Yersinia pestis
gauaacaauaaaaucuuaau

SEQ ID NO: 4173917 - RNA, 15 nt, Yersinia pestis
gauaacauacaccau

SEQ ID NO: 4173918 - RNA, 12 nt, Yersinia pestis
gauaaccagcag

SEQ ID NO: 4173919 - RNA, 13 nt, Yersinia pestis
gauaaccagcagc

SEQ ID NO: 4173920 - RNA, 17 nt, Yersinia pestis
gauaaccagcaguugcu

SEQ ID NO: 4173921 - RNA, 15 nt, Yersinia pestis
gauaacccccugaca

SEQ ID NO: 4173922 - RNA, 16 nt, Yersinia pestis
gauaacccuaucguca

SEQ ID NO: 4173923 - RNA, 16 nt, Yersinia pestis
gauaaccguucaagag

SEQ ID NO: 4173924 - RNA, 14 nt, Yersinia pestis
gauaaccuucuuca

SEQ ID NO: 4173925 - RNA, 23 nt, Yersinia pestis
gauaacggcuggucgcuggguuc

SEQ ID NO: 4173926 - RNA, 17 nt, Yersinia pestis
gauaacgguaucaguca

SEQ ID NO: 4173927 - RNA, 18 nt, Yersinia pestis
gauaacuccaggguaaua

SEQ ID NO: 4173928 - RNA, 13 nt, Yersinia pestis
gauaacugccaua

SEQ ID NO: 4173929 - RNA, 20 nt, Yersinia pestis
gauaacuuccuuugcccuua

SEQ ID NO: 4173930 - RNA, 21 nt, Yersinia pestis
gauaacuuccuuugcccuuac

SEQ ID NO: 4173931 - RNA, 22 nt, Yersinia pestis
gauaacuuuuuauuucuuuuaa

SEQ ID NO: 4173932 - RNA, 23 nt, Yersinia pestis
gauaagaaucuugggaucagcca

SEQ ID NO: 4173933 - RNA, 20 nt, Yersinia pestis
gauaagagcgacucaauaau

SEQ ID NO: 4173934 - RNA, 23 nt, Yersinia pestis
gauaagcauaaccgguaccggcu

SEQ ID NO: 4173935 - RNA, 20 nt, Yersinia pestis
gauaagcgguuuuaucaaua

SEQ ID NO: 4173936 - RNA, 16 nt, Yersinia pestis
gauaaggcaaggccgu

SEQ ID NO: 4173937 - RNA, 18 nt, Yersinia pestis
gauaaggccuuuuucugu

SEQ ID NO: 4173938 - RNA, 17 nt, Yersinia pestis
gauaagugaauaaauca

SEQ ID NO: 4173939 - RNA, 14 nt, Yersinia pestis
gauaauaaaaaaac

SEQ ID NO: 4173940 - RNA, 21 nt, Yersinia pestis
gauaauaaaacggcucaucgc

SEQ ID NO: 4173941 - RNA, 21 nt, Yersinia pestis
gauaauaaauacccugcacca

SEQ ID NO: 4173942 - RNA, 20 nt, Yersinia pestis
gauaauagcuaaacauccgu

SEQ ID NO: 4173943 - RNA, 20 nt, Yersinia pestis
gauaauaguucauuuuguau

SEQ ID NO: 4173944 - RNA, 21 nt, Yersinia pestis
gauaaucaaaacaccuaguua

SEQ ID NO: 4173945 - RNA, 12 nt, Yersinia pestis
gauaaucuggca

SEQ ID NO: 4173946 - RNA, 21 nt, Yersinia pestis
gauaauuauccauuuucugcc

SEQ ID NO: 4173947 - RNA, 16 nt, Yersinia pestis
gauaauuuaauuaguu

SEQ ID NO: 4173948 - RNA, 23 nt, Yersinia pestis
gauaauuucuacgccgucaucau

SEQ ID NO: 4173949 - RNA, 23 nt, Yersinia pestis
gauacaacaacgggucacagcca

SEQ ID NO: 4173950 - RNA, 15 nt, Yersinia pestis
gauacacaugguugc

SEQ ID NO: 4173951 - RNA, 14 nt, Yersinia pestis
gauacaccaacgca

SEQ ID NO: 4173952 - RNA, 16 nt, Yersinia pestis
gauaccacaauccggu

SEQ ID NO: 4173953 - RNA, 18 nt, Yersinia pestis
gauaccacccguugcauu

SEQ ID NO: 4173954 - RNA, 21 nt, Yersinia pestis
gauacccgccauaaauaaaga

SEQ ID NO: 4173955 - RNA, 18 nt, Yersinia pestis
gauacccuucaucuuuca

SEQ ID NO: 4173956 - RNA, 17 nt, Yersinia pestis
gauaccgccaaucucuc

SEQ ID NO: 4173957 - RNA, 14 nt, Yersinia pestis
gauaccuaaaccuu

SEQ ID NO: 4173958 - RNA, 22 nt, Yersinia pestis
gauaccugagcgcugaguugua

SEQ ID NO: 4173959 - RNA, 19 nt, Yersinia pestis
gauacgcauugaggucagc

SEQ ID NO: 4173960 - RNA, 16 nt, Yersinia pestis
gauacgcgccgcagca

SEQ ID NO: 4173961 - RNA, 15 nt, Yersinia pestis
gauacggcuccagaa

SEQ ID NO: 4173962 - RNA, 17 nt, Yersinia pestis
gauacguguaaaaccuu

SEQ ID NO: 4173963 - RNA, 22 nt, Yersinia pestis
gauacguuuggugccgcuggca

SEQ ID NO: 4173964 - RNA, 17 nt, Yersinia pestis
gauacuacaaucaucgg

SEQ ID NO: 4173965 - RNA, 13 nt, Yersinia pestis
gauacucauugca

SEQ ID NO: 4173966 - RNA, 15 nt, Yersinia pestis
gauacugaaauauac

SEQ ID NO: 4173967 - RNA, 19 nt, Yersinia pestis
gauacugcauuucaacaaa

SEQ ID NO: 4173968 - RNA, 20 nt, Yersinia pestis
gauacugccaucaucauuca

SEQ ID NO: 4173969 - RNA, 22 nt, Yersinia pestis
gauacugccaucaucauucaau

SEQ ID NO: 4173970 - RNA, 20 nt, Yersinia pestis
gauacuugaaacagcagggg

SEQ ID NO: 4173971 - RNA, 17 nt, Yersinia pestis
gauagaccguagaaacc

SEQ ID NO: 4173972 - RNA, 19 nt, Yersinia pestis
gauagagacuucgcgauca

SEQ ID NO: 4173973 - RNA, 19 nt, Yersinia pestis
gauagaguacucggcuacg

SEQ ID NO: 4173974 - RNA, 16 nt, Yersinia pestis
gauagauuucacugcc

SEQ ID NO: 4173975 - RNA, 17 nt, Yersinia pestis
gauagcaaaagaaucag

SEQ ID NO: 4173976 - RNA, 13 nt, Yersinia pestis
gauagcaaucaau

SEQ ID NO: 4173977 - RNA, 13 nt, Yersinia pestis
gauagcaauguca

SEQ ID NO: 4173978 - RNA, 19 nt, Yersinia pestis
gauagccaauaaccgggua

SEQ ID NO: 4173979 - RNA, 17 nt, Yersinia pestis
gauagccauaauaaugc

SEQ ID NO: 4173980 - RNA, 14 nt, Yersinia pestis
gauagccccauaua

SEQ ID NO: 4173981 - RNA, 20 nt, Yersinia pestis
gauagcgggccuuugcuuuu

SEQ ID NO: 4173982 - RNA, 11 nt, Yersinia pestis
gauagcugcuu

SEQ ID NO: 4173983 - RNA, 18 nt, Yersinia pestis
gauaggccaccucuuccu

SEQ ID NO: 4173984 - RNA, 23 nt, Yersinia pestis
gauagggggcaaccauauuaaac

SEQ ID NO: 4173985 - RNA, 22 nt, Yersinia pestis
gauaguggucauuuuguuuucu

SEQ ID NO: 4173986 - RNA, 18 nt, Yersinia pestis
gauagugucacucugguu

SEQ ID NO: 4173987 - RNA, 17 nt, Yersinia pestis
gauaguuaaauuauccc

SEQ ID NO: 4173988 - RNA, 14 nt, Yersinia pestis
gauaguuaucuccc

SEQ ID NO: 4173989 - RNA, 16 nt, Yersinia pestis
gauaguuaucucccau

SEQ ID NO: 4173990 - RNA, 22 nt, Yersinia pestis
gauauaaacuaauaucuuucau

SEQ ID NO: 4173991 - RNA, 15 nt, Yersinia pestis
gauauaaauaaaaua

SEQ ID NO: 4173992 - RNA, 19 nt, Yersinia pestis
gauauagaagguuucaccc

SEQ ID NO: 4173993 - RNA, 14 nt, Yersinia pestis
gauauagagcucag

SEQ ID NO: 4173994 - RNA, 17 nt, Yersinia pestis
gauauagcgcaccaccg

SEQ ID NO: 4173995 - RNA, 18 nt, Yersinia pestis
gauauaggcaucuuucag

SEQ ID NO: 4173996 - RNA, 18 nt, Yersinia pestis
gauauauagaaauaagga

SEQ ID NO: 4173997 - RNA, 16 nt, Yersinia pestis
gauaucaauaaagaac

SEQ ID NO: 4173998 - RNA, 14 nt, Yersinia pestis
gauaucagccagug

SEQ ID NO: 4173999 - RNA, 19 nt, Yersinia pestis
gauauccagugccaaaaua

SEQ ID NO: 4174000 - RNA, 15 nt, Yersinia pestis
gauauccgccaaaga

SEQ ID NO: 4174001 - RNA, 15 nt, Yersinia pestis
gauauccugcgucuc

SEQ ID NO: 4174002 - RNA, 16 nt, Yersinia pestis
gauaucgauggcaacc

SEQ ID NO: 4174003 - RNA, 14 nt, Yersinia pestis
gauaugaauauccg

SEQ ID NO: 4174004 - RNA, 16 nt, Yersinia pestis
gauaugacuaaacuga

SEQ ID NO: 4174005 - RNA, 19 nt, Yersinia pestis
gauaugacuaaacugauca

SEQ ID NO: 4174006 - RNA, 22 nt, Yersinia pestis
gauaugagcgaggagguaugac

SEQ ID NO: 4174007 - RNA, 20 nt, Yersinia pestis
gauaugaugcggaagaaggc

SEQ ID NO: 4174008 - RNA, 23 nt, Yersinia pestis
gauaugauguuacggguaaugaa

SEQ ID NO: 4174009 - RNA, 22 nt, Yersinia pestis
gauaugcauuauugauguuauu

SEQ ID NO: 4174010 - RNA, 22 nt, Yersinia pestis
gauauuaccgagcgucaagcca

SEQ ID NO: 4174011 - RNA, 15 nt, Yersinia pestis
gauauuauucucuac

SEQ ID NO: 4174012 - RNA, 19 nt, Yersinia pestis
gauauucacguuuuuccau

SEQ ID NO: 4174013 - RNA, 14 nt, Yersinia pestis
gauauucagugcaa

SEQ ID NO: 4174014 - RNA, 17 nt, Yersinia pestis
gauauucagugcaauca

SEQ ID NO: 4174015 - RNA, 10 nt, Yersinia pestis
gauauucaua

SEQ ID NO: 4174016 - RNA, 16 nt, Yersinia pestis
gauauucauauuucuu

SEQ ID NO: 4174017 - RNA, 23 nt, Yersinia pestis
gauauuccggugaucuugaccga

SEQ ID NO: 4174018 - RNA, 18 nt, Yersinia pestis
gauauucucaccugcuua

SEQ ID NO: 4174019 - RNA, 16 nt, Yersinia pestis
gauauugauagccaca

SEQ ID NO: 4174020 - RNA, 16 nt, Yersinia pestis
gauauugaugacgcua

SEQ ID NO: 4174021 - RNA, 13 nt, Yersinia pestis
gauauugcgguaa

SEQ ID NO: 4174022 - RNA, 22 nt, Yersinia pestis
gauauugcguguagcgggagau

SEQ ID NO: 4174023 - RNA, 17 nt, Yersinia pestis
gauauuuauuaaaacac

SEQ ID NO: 4174024 - RNA, 13 nt, Yersinia pestis
gauauuuauucga

SEQ ID NO: 4174025 - RNA, 23 nt, Yersinia pestis
gauauuuauuguuaucaaaucag

SEQ ID NO: 4174026 - RNA, 14 nt, Yersinia pestis
gauauuuauuuacu

SEQ ID NO: 4174027 - RNA, 18 nt, Yersinia pestis
gauauuuauuuccagauc

SEQ ID NO: 4174028 - RNA, 17 nt, Yersinia pestis
gauauuuauuucugcaa

SEQ ID NO: 4174029 - RNA, 23 nt, Yersinia pestis
gauauuugggucgguaaccugaa

SEQ ID NO: 4174030 - RNA, 12 nt, Yersinia pestis
gauauuuucggg

SEQ ID NO: 4174031 - RNA, 12 nt, Yersinia pestis
gauauuuugcag

SEQ ID NO: 4174032 - RNA, 22 nt, Yersinia pestis
gaucaaaacaaauuauuagaau

SEQ ID NO: 4174033 - RNA, 22 nt, Yersinia pestis
gaucaaaacaauaaaaagaucu

SEQ ID NO: 4174034 - RNA, 15 nt, Yersinia pestis
gaucaaaagcagaga

SEQ ID NO: 4174035 - RNA, 15 nt, Yersinia pestis
gaucaaaggcgacca

SEQ ID NO: 4174036 - RNA, 23 nt, Yersinia pestis
gaucaaauuauauaagagaugaa

SEQ ID NO: 4174037 - RNA, 13 nt, Yersinia pestis
gaucaaccauuca

SEQ ID NO: 4174038 - RNA, 22 nt, Yersinia pestis
gaucaaguugcugagauaucaa

SEQ ID NO: 4174039 - RNA, 21 nt, Yersinia pestis
gaucaauauguuuguugaugu

SEQ ID NO: 4174040 - RNA, 15 nt, Yersinia pestis
gaucaaucucaucaa

SEQ ID NO: 4174041 - RNA, 21 nt, Yersinia pestis
gaucaauucgaugauuuauau

SEQ ID NO: 4174042 - RNA, 22 nt, Yersinia pestis
gaucaccacgucaccuuucuug

SEQ ID NO: 4174043 - RNA, 14 nt, Yersinia pestis
gaucaccagaucau

SEQ ID NO: 4174044 - RNA, 18 nt, Yersinia pestis
gaucaccagcaaaggcca

SEQ ID NO: 4174045 - RNA, 19 nt, Yersinia pestis
gaucaccaggcucucauau

SEQ ID NO: 4174046 - RNA, 22 nt, Yersinia pestis
gaucaccgaugauaagugaaua

SEQ ID NO: 4174047 - RNA, 18 nt, Yersinia pestis
gaucaccgugccaaaaau

SEQ ID NO: 4174048 - RNA, 15 nt, Yersinia pestis
gaucacgcaaugcca

SEQ ID NO: 4174049 - RNA, 14 nt, Yersinia pestis
gaucagcaagauug

SEQ ID NO: 4174050 - RNA, 13 nt, Yersinia pestis
gaucagcauuucg

SEQ ID NO: 4174051 - RNA, 20 nt, Yersinia pestis
gaucagcuaacaaaaccggg

SEQ ID NO: 4174052 - RNA, 19 nt, Yersinia pestis
gaucagcuuaaucgcauca

SEQ ID NO: 4174053 - RNA, 16 nt, Yersinia pestis
gaucaguaaacgguug

SEQ ID NO: 4174054 - RNA, 16 nt, Yersinia pestis
gaucagugaagagaua

SEQ ID NO: 4174055 - RNA, 13 nt, Yersinia pestis
gaucaguggcuua

SEQ ID NO: 4174056 - RNA, 15 nt, Yersinia pestis
gaucaguuaaucaag

SEQ ID NO: 4174057 - RNA, 17 nt, Yersinia pestis
gaucaguuaaucaagcc

SEQ ID NO: 4174058 - RNA, 18 nt, Yersinia pestis
gaucaguuaaucaagcca

SEQ ID NO: 4174059 - RNA, 14 nt, Yersinia pestis
gaucaguucaguau

SEQ ID NO: 4174060 - RNA, 16 nt, Yersinia pestis
gaucaguuugccuugu

SEQ ID NO: 4174061 - RNA, 16 nt, Yersinia pestis
gaucauaagccgcaga

SEQ ID NO: 4174062 - RNA, 21 nt, Yersinia pestis
gaucauauuaggcaggugaag

SEQ ID NO: 4174063 - RNA, 16 nt, Yersinia pestis
gaucaucaaccagaaa

SEQ ID NO: 4174064 - RNA, 17 nt, Yersinia pestis
gaucaucaacgcgccuu

SEQ ID NO: 4174065 - RNA, 16 nt, Yersinia pestis
gaucaucaggcaggua

SEQ ID NO: 4174066 - RNA, 19 nt, Yersinia pestis
gaucaucgauacaaaccgu

SEQ ID NO: 4174067 - RNA, 17 nt, Yersinia pestis
gaucaucgcaccauaac

SEQ ID NO: 4174068 - RNA, 13 nt, Yersinia pestis
gaucaugaugauc

SEQ ID NO: 4174069 - RNA, 21 nt, Yersinia pestis
gaucauuauuauccucccagc

SEQ ID NO: 4174070 - RNA, 20 nt, Yersinia pestis
gauccaaaacaucggccagc

SEQ ID NO: 4174071 - RNA, 23 nt, Yersinia pestis
gauccaaaacaucggccagcguc

SEQ ID NO: 4174072 - RNA, 12 nt, Yersinia pestis
gauccacauuac

SEQ ID NO: 4174073 - RNA, 16 nt, Yersinia pestis
gauccacuccagugcc

SEQ ID NO: 4174074 - RNA, 17 nt, Yersinia pestis
gauccacuuauaucucc

SEQ ID NO: 4174075 - RNA, 18 nt, Yersinia pestis
gauccacuuauaucucca

SEQ ID NO: 4174076 - RNA, 17 nt, Yersinia pestis
gauccagcaacguaaca

SEQ ID NO: 4174077 - RNA, 18 nt, Yersinia pestis
gauccaguuucaguggcu

SEQ ID NO: 4174078 - RNA, 14 nt, Yersinia pestis
gauccauaggaucc

SEQ ID NO: 4174079 - RNA, 17 nt, Yersinia pestis
gaucccagaauggcaaa

SEQ ID NO: 4174080 - RNA, 22 nt, Yersinia pestis
gauccgcgauaacguuguuucu

SEQ ID NO: 4174081 - RNA, 15 nt, Yersinia pestis
gauccgggaaaaaau

SEQ ID NO: 4174082 - RNA, 17 nt, Yersinia pestis
gauccgggaaaaaauac

SEQ ID NO: 4174083 - RNA, 20 nt, Yersinia pestis
gauccguuuaaucagugaca

SEQ ID NO: 4174084 - RNA, 17 nt, Yersinia pestis
gauccucguuagucacu

SEQ ID NO: 4174085 - RNA, 23 nt, Yersinia pestis
gauccucguuagucacucaagcc

SEQ ID NO: 4174086 - RNA, 23 nt, Yersinia pestis
gauccugaacgaggacuuccugc

SEQ ID NO: 4174087 - RNA, 13 nt, Yersinia pestis
gauccugcaauaa

SEQ ID NO: 4174088 - RNA, 20 nt, Yersinia pestis
gauccugcaauaacaccagc

SEQ ID NO: 4174089 - RNA, 20 nt, Yersinia pestis
gauccugccgccucugcucc

SEQ ID NO: 4174090 - RNA, 19 nt, Yersinia pestis
gauccuggguuuuauugca

SEQ ID NO: 4174091 - RNA, 21 nt, Yersinia pestis
gauccugugcgcuuugcagua

SEQ ID NO: 4174092 - RNA, 17 nt, Yersinia pestis
gaucgaucucuuuauau

SEQ ID NO: 4174093 - RNA, 21 nt, Yersinia pestis
gaucgaucucuuuauauucaa

SEQ ID NO: 4174094 - RNA, 12 nt, Yersinia pestis
gaucgaugccgg

SEQ ID NO: 4174095 - RNA, 14 nt, Yersinia pestis
gaucgcacuucaac

SEQ ID NO: 4174096 - RNA, 19 nt, Yersinia pestis
gaucgccaguuugcgacca

SEQ ID NO: 4174097 - RNA, 17 nt, Yersinia pestis
gaucgcgacgaaaaccu

SEQ ID NO: 4174098 - RNA, 16 nt, Yersinia pestis
gaucgcgaugcgccug

SEQ ID NO: 4174099 - RNA, 18 nt, Yersinia pestis
gaucgcgaugcgccuguu

SEQ ID NO: 4174100 - RNA, 20 nt, Yersinia pestis
gaucgcgcccauccgcagga

SEQ ID NO: 4174101 - RNA, 18 nt, Yersinia pestis
gaucgcucucacccugcg

SEQ ID NO: 4174102 - RNA, 13 nt, Yersinia pestis
gaucgcugccacc

SEQ ID NO: 4174103 - RNA, 14 nt, Yersinia pestis
gaucgcugccaccg

SEQ ID NO: 4174104 - RNA, 17 nt, Yersinia pestis
gaucgcugugguuauca

SEQ ID NO: 4174105 - RNA, 16 nt, Yersinia pestis
gaucggauaguuaucu

SEQ ID NO: 4174106 - RNA, 18 nt, Yersinia pestis
gaucggguggaccuccau

SEQ ID NO: 4174107 - RNA, 14 nt, Yersinia pestis
gaucggguugauga

SEQ ID NO: 4174108 - RNA, 12 nt, Yersinia pestis
gaucguaggcuu

SEQ ID NO: 4174109 - RNA, 12 nt, Yersinia pestis
gaucguugcagg

SEQ ID NO: 4174110 - RNA, 14 nt, Yersinia pestis
gaucucauuuagca

SEQ ID NO: 4174111 - RNA, 15 nt, Yersinia pestis
gaucucuccagccug

SEQ ID NO: 4174112 - RNA, 13 nt, Yersinia pestis
gaucucugcgaca

SEQ ID NO: 4174113 - RNA, 19 nt, Yersinia pestis
gaucucuucagcaauuuuu

SEQ ID NO: 4174114 - RNA, 22 nt, Yersinia pestis
gaucugauaucucuuuaucauu

SEQ ID NO: 4174115 - RNA, 12 nt, Yersinia pestis
gaucugccuuau

SEQ ID NO: 4174116 - RNA, 21 nt, Yersinia pestis
gaucuguuguugugacaggcu

SEQ ID NO: 4174117 - RNA, 19 nt, Yersinia pestis
gaucuugaacggugaggau

SEQ ID NO: 4174118 - RNA, 15 nt, Yersinia pestis
gaucuugauaaacau

SEQ ID NO: 4174119 - RNA, 14 nt, Yersinia pestis
gaucuuuuucauuc

SEQ ID NO: 4174120 - RNA, 20 nt, Yersinia pestis
gaugaaaaauacaaauauaa

SEQ ID NO: 4174121 - RNA, 16 nt, Yersinia pestis
gaugaaacacaacaac

SEQ ID NO: 4174122 - RNA, 12 nt, Yersinia pestis
gaugaaauuuua

SEQ ID NO: 4174123 - RNA, 17 nt, Yersinia pestis
gaugaacugacacacac

SEQ ID NO: 4174124 - RNA, 20 nt, Yersinia pestis
gaugaagguaaugcgaaaaa

SEQ ID NO: 4174125 - RNA, 18 nt, Yersinia pestis
gaugaauaugcuucauca

SEQ ID NO: 4174126 - RNA, 23 nt, Yersinia pestis
gaugaaugacuggcuauuagaau

SEQ ID NO: 4174127 - RNA, 13 nt, Yersinia pestis
gaugaauuuaucc

SEQ ID NO: 4174128 - RNA, 22 nt, Yersinia pestis
gaugacaacaccguaacgcccu

SEQ ID NO: 4174129 - RNA, 22 nt, Yersinia pestis
gaugacaaccucucaguugaug

SEQ ID NO: 4174130 - RNA, 22 nt, Yersinia pestis
gaugacaaugcguuauaaccau

SEQ ID NO: 4174131 - RNA, 20 nt, Yersinia pestis
gaugaccaucgaucugggcu

SEQ ID NO: 4174132 - RNA, 19 nt, Yersinia pestis
gaugaccauuuauuuccac

SEQ ID NO: 4174133 - RNA, 20 nt, Yersinia pestis
gaugaccgugacauuuucac

SEQ ID NO: 4174134 - RNA, 20 nt, Yersinia pestis
gaugacgccguacaaauaua

SEQ ID NO: 4174135 - RNA, 19 nt, Yersinia pestis
gaugagaaugugacucagc

SEQ ID NO: 4174136 - RNA, 16 nt, Yersinia pestis
gaugagucgcugguau

SEQ ID NO: 4174137 - RNA, 13 nt, Yersinia pestis
gaugauaaauaca

SEQ ID NO: 4174138 - RNA, 16 nt, Yersinia pestis
gaugauaaguuugaug

SEQ ID NO: 4174139 - RNA, 18 nt, Yersinia pestis
gaugauaaugccgcccau

SEQ ID NO: 4174140 - RNA, 14 nt, Yersinia pestis
gaugauauacccac

SEQ ID NO: 4174141 - RNA, 14 nt, Yersinia pestis
gaugaucucuggcc

SEQ ID NO: 4174142 - RNA, 20 nt, Yersinia pestis
gaugaucugaugaucaucug

SEQ ID NO: 4174143 - RNA, 20 nt, Yersinia pestis
gaugauuuuuacagcaaacg

SEQ ID NO: 4174144 - RNA, 21 nt, Yersinia pestis
gaugcacaguaggcugaaggc

SEQ ID NO: 4174145 - RNA, 19 nt, Yersinia pestis
gaugcaguaaauagucuug

SEQ ID NO: 4174146 - RNA, 21 nt, Yersinia pestis
gaugcauauuauuaaugaaau

SEQ ID NO: 4174147 - RNA, 23 nt, Yersinia pestis
gaugcauauuauuaaugaaauua

SEQ ID NO: 4174148 - RNA, 20 nt, Yersinia pestis
gaugcauauuugcagaaagu

SEQ ID NO: 4174149 - RNA, 20 nt, Yersinia pestis
gaugccaaucaaaaaaccgg

SEQ ID NO: 4174150 - RNA, 13 nt, Yersinia pestis
gaugccgcuuuag

SEQ ID NO: 4174151 - RNA, 13 nt, Yersinia pestis
gaugccuauuugc

SEQ ID NO: 4174152 - RNA, 20 nt, Yersinia pestis
gaugccuucuuucaaaguga

SEQ ID NO: 4174153 - RNA, 22 nt, Yersinia pestis
gaugccuuggugauacccagca

SEQ ID NO: 4174154 - RNA, 14 nt, Yersinia pestis
gaugccuuguuucu

SEQ ID NO: 4174155 - RNA, 23 nt, Yersinia pestis
gaugcggguuuuuuuacauauaa

SEQ ID NO: 4174156 - RNA, 13 nt, Yersinia pestis
gaugcuaaagcgu

SEQ ID NO: 4174157 - RNA, 22 nt, Yersinia pestis
gaugcuaaagcguaagugcaau

SEQ ID NO: 4174158 - RNA, 17 nt, Yersinia pestis
gaugcuaacaacuucca

SEQ ID NO: 4174159 - RNA, 18 nt, Yersinia pestis
gaugcuaaccgaauaaaa

SEQ ID NO: 4174160 - RNA, 21 nt, Yersinia pestis
gaugcuaaccgaauaaaaccu

SEQ ID NO: 4174161 - RNA, 16 nt, Yersinia pestis
gaugcuagugauaaac

SEQ ID NO: 4174162 - RNA, 17 nt, Yersinia pestis
gaugcuagugauaaacu

SEQ ID NO: 4174163 - RNA, 21 nt, Yersinia pestis
gaugcugacagaacgcaauca

SEQ ID NO: 4174164 - RNA, 18 nt, Yersinia pestis
gaugcugcacaucaacgg

SEQ ID NO: 4174165 - RNA, 14 nt, Yersinia pestis
gaugcuucagccac

SEQ ID NO: 4174166 - RNA, 19 nt, Yersinia pestis
gauggaacaggauuuucaa

SEQ ID NO: 4174167 - RNA, 15 nt, Yersinia pestis
gauggaguaaucauu

SEQ ID NO: 4174168 - RNA, 19 nt, Yersinia pestis
gauggaguaaucauugcca

SEQ ID NO: 4174169 - RNA, 18 nt, Yersinia pestis
gauggauaaauucagccg

SEQ ID NO: 4174170 - RNA, 20 nt, Yersinia pestis
gauggauccccguucuagua

SEQ ID NO: 4174171 - RNA, 20 nt, Yersinia pestis
gauggauuugcacauagccc

SEQ ID NO: 4174172 - RNA, 21 nt, Yersinia pestis
gauggcaaccccugccaauau

SEQ ID NO: 4174173 - RNA, 21 nt, Yersinia pestis
gauggccuugaaucaaaauac

SEQ ID NO: 4174174 - RNA, 21 nt, Yersinia pestis
gauggcgauagauuggcauca

SEQ ID NO: 4174175 - RNA, 22 nt, Yersinia pestis
gauggcggcuggaaaaccaauu

SEQ ID NO: 4174176 - RNA, 14 nt, Yersinia pestis
gauggcguuuucuu

SEQ ID NO: 4174177 - RNA, 21 nt, Yersinia pestis
gauggcuaauuaauuuaaaca

SEQ ID NO: 4174178 - RNA, 22 nt, Yersinia pestis
gaugggcaggguauuuucuccu

SEQ ID NO: 4174179 - RNA, 14 nt, Yersinia pestis
gauggucaacuaaa

SEQ ID NO: 4174180 - RNA, 13 nt, Yersinia pestis
gauggucacccuc

SEQ ID NO: 4174181 - RNA, 20 nt, Yersinia pestis
gauggugccgucaacaggag

SEQ ID NO: 4174182 - RNA, 24 nt, Yersinia pestis
gaugguggcauaacguaaugucug

SEQ ID NO: 4174183 - RNA, 23 nt, Yersinia pestis
gaugguggcucugccaauaaagu

SEQ ID NO: 4174184 - RNA, 12 nt, Yersinia pestis
gauguaacagcg

SEQ ID NO: 4174185 - RNA, 20 nt, Yersinia pestis
gauguagcagaucuauuugc

SEQ ID NO: 4174186 - RNA, 22 nt, Yersinia pestis
gauguagucccccuccggcgcc

SEQ ID NO: 4174187 - RNA, 19 nt, Yersinia pestis
gaugucagauuaguuuuag

SEQ ID NO: 4174188 - RNA, 23 nt, Yersinia pestis
gaugucauaugcgguaaugacuu

SEQ ID NO: 4174189 - RNA, 15 nt, Yersinia pestis
gaugugaaacauaau

SEQ ID NO: 4174190 - RNA, 20 nt, Yersinia pestis
gaugugauccacacagcauu

SEQ ID NO: 4174191 - RNA, 22 nt, Yersinia pestis
gauguggauaauuucagcagca

SEQ ID NO: 4174192 - RNA, 19 nt, Yersinia pestis
gauguuacggguaaugaau

SEQ ID NO: 4174193 - RNA, 12 nt, Yersinia pestis
gauguuaugagg

SEQ ID NO: 4174194 - RNA, 13 nt, Yersinia pestis
gauguuccuggcc

SEQ ID NO: 4174195 - RNA, 15 nt, Yersinia pestis
gauguucgcuccccc

SEQ ID NO: 4174196 - RNA, 15 nt, Yersinia pestis
gauguuuaacccaau

SEQ ID NO: 4174197 - RNA, 16 nt, Yersinia pestis
gauguuuaacccaaug

SEQ ID NO: 4174198 - RNA, 12 nt, Yersinia pestis
gauuaaccuuau

SEQ ID NO: 4174199 - RNA, 20 nt, Yersinia pestis
gauuaaccuuaucaccaacg

SEQ ID NO: 4174200 - RNA, 22 nt, Yersinia pestis
gauuaacggugcgacaaugccc

SEQ ID NO: 4174201 - RNA, 11 nt, Yersinia pestis
gauuaauaaca

SEQ ID NO: 4174202 - RNA, 22 nt, Yersinia pestis
gauuaauaaguaaauauuaucu

SEQ ID NO: 4174203 - RNA, 23 nt, Yersinia pestis
gauuaauuaacacccaauaauaa

SEQ ID NO: 4174204 - RNA, 18 nt, Yersinia pestis
gauuaauuauugggggga

SEQ ID NO: 4174205 - RNA, 13 nt, Yersinia pestis
gauuaccaauaau

SEQ ID NO: 4174206 - RNA, 17 nt, Yersinia pestis
gauuaccugcauauccu

SEQ ID NO: 4174207 - RNA, 19 nt, Yersinia pestis
gauuacucaggaacaagac

SEQ ID NO: 4174208 - RNA, 12 nt, Yersinia pestis
gauuacuggccg

SEQ ID NO: 4174209 - RNA, 17 nt, Yersinia pestis
gauuacugucauuuccu

SEQ ID NO: 4174210 - RNA, 16 nt, Yersinia pestis
gauuagccauaagaua

SEQ ID NO: 4174211 - RNA, 16 nt, Yersinia pestis
gauuagcgagguuuug

SEQ ID NO: 4174212 - RNA, 14 nt, Yersinia pestis
gauuagcuucugcu

SEQ ID NO: 4174213 - RNA, 15 nt, Yersinia pestis
gauuagguuuuauuc

SEQ ID NO: 4174214 - RNA, 18 nt, Yersinia pestis
gauuauguagaucccgug

SEQ ID NO: 4174215 - RNA, 13 nt, Yersinia pestis
gauuauuggcaug

SEQ ID NO: 4174216 - RNA, 15 nt, Yersinia pestis
gauuauuucagcuuc

SEQ ID NO: 4174217 - RNA, 13 nt, Yersinia pestis
gauucacaggcga

SEQ ID NO: 4174218 - RNA, 14 nt, Yersinia pestis
gauucacaggcgag

SEQ ID NO: 4174219 - RNA, 20 nt, Yersinia pestis
gauucacaggcgaguuggcu

SEQ ID NO: 4174220 - RNA, 19 nt, Yersinia pestis
gauucaccaguagcccagc

SEQ ID NO: 4174221 - RNA, 16 nt, Yersinia pestis
gauucacgaauagcgg

SEQ ID NO: 4174222 - RNA, 14 nt, Yersinia pestis
gauucagaaaggua

SEQ ID NO: 4174223 - RNA, 19 nt, Yersinia pestis
gauucauaccuguacuuug

SEQ ID NO: 4174224 - RNA, 11 nt, Yersinia pestis
gauucaucaua

SEQ ID NO: 4174225 - RNA, 18 nt, Yersinia pestis
gauuccgguacugugcug

SEQ ID NO: 4174226 - RNA, 22 nt, Yersinia pestis
gauuccuguugaccaauccggu

SEQ ID NO: 4174227 - RNA, 16 nt, Yersinia pestis
gauucgcgaccagcag

SEQ ID NO: 4174228 - RNA, 23 nt, Yersinia pestis
gauucggcuucgguuugagcuug

SEQ ID NO: 4174229 - RNA, 17 nt, Yersinia pestis
gauucgggugagugagc

SEQ ID NO: 4174230 - RNA, 14 nt, Yersinia pestis
gauucuagcaucgc

SEQ ID NO: 4174231 - RNA, 15 nt, Yersinia pestis
gauucuagcaucgcc

SEQ ID NO: 4174232 - RNA, 15 nt, Yersinia pestis
gauucucggcgggga

SEQ ID NO: 4174233 - RNA, 16 nt, Yersinia pestis
gauucucggcggggag

SEQ ID NO: 4174234 - RNA, 16 nt, Yersinia pestis
gauucucuauucugcu

SEQ ID NO: 4174235 - RNA, 18 nt, Yersinia pestis
gauugaaucaaggcuuua

SEQ ID NO: 4174236 - RNA, 17 nt, Yersinia pestis
gauugacugaaugugaa

SEQ ID NO: 4174237 - RNA, 19 nt, Yersinia pestis
gauugacugaaugugaaga

SEQ ID NO: 4174238 - RNA, 15 nt, Yersinia pestis
gauugaucaguggcu

SEQ ID NO: 4174239 - RNA, 15 nt, Yersinia pestis
gauugcaaauccguc

SEQ ID NO: 4174240 - RNA, 20 nt, Yersinia pestis
gauugcaacaacgccagaua

SEQ ID NO: 4174241 - RNA, 22 nt, Yersinia pestis
gauugcaucaucaguauugacg

SEQ ID NO: 4174242 - RNA, 14 nt, Yersinia pestis
gauugcugccaacg

SEQ ID NO: 4174243 - RNA, 19 nt, Yersinia pestis
gauuggacccgucaccaca

SEQ ID NO: 4174244 - RNA, 22 nt, Yersinia pestis
gauuggagucaugaggcaguga

SEQ ID NO: 4174245 - RNA, 21 nt, Yersinia pestis
gauuggcacccucuagcagcg

SEQ ID NO: 4174246 - RNA, 19 nt, Yersinia pestis
gauugguacgggugugcug

SEQ ID NO: 4174247 - RNA, 18 nt, Yersinia pestis
gauuguuacgccuucagc

SEQ ID NO: 4174248 - RNA, 15 nt, Yersinia pestis
gauuuaaaaucccuc

SEQ ID NO: 4174249 - RNA, 23 nt, Yersinia pestis
gauuuaaauaacagcuaaaauga

SEQ ID NO: 4174250 - RNA, 13 nt, Yersinia pestis
gauuuaaugguuu

SEQ ID NO: 4174251 - RNA, 15 nt, Yersinia pestis
gauuuagacaagcgc

SEQ ID NO: 4174252 - RNA, 21 nt, Yersinia pestis
gauuucaccuauaauuaacag

SEQ ID NO: 4174253 - RNA, 15 nt, Yersinia pestis
gauuucagcaccaua

SEQ ID NO: 4174254 - RNA, 14 nt, Yersinia pestis
gauuucagcugcuu

SEQ ID NO: 4174255 - RNA, 22 nt, Yersinia pestis
gauuucaggucgcaagcaauau

SEQ ID NO: 4174256 - RNA, 15 nt, Yersinia pestis
gauuucaucauucaa

SEQ ID NO: 4174257 - RNA, 18 nt, Yersinia pestis
gauuucaucauucaauac

SEQ ID NO: 4174258 - RNA, 19 nt, Yersinia pestis
gauuucaucggcaaaaaca

SEQ ID NO: 4174259 - RNA, 14 nt, Yersinia pestis
gauuucuucauuua

SEQ ID NO: 4174260 - RNA, 13 nt, Yersinia pestis
gauuugaaccgcu

SEQ ID NO: 4174261 - RNA, 21 nt, Yersinia pestis
gauuugaaccgcuaucugcug

SEQ ID NO: 4174262 - RNA, 19 nt, Yersinia pestis
gauuugcgggcuaaaacug

SEQ ID NO: 4174263 - RNA, 15 nt, Yersinia pestis
gauuuuaagcacugc

SEQ ID NO: 4174264 - RNA, 18 nt, Yersinia pestis
gauuuuggugcuggccug

SEQ ID NO: 4174265 - RNA, 19 nt, Yersinia pestis
gauuuuuaacgucagauaa

SEQ ID NO: 4174266 - RNA, 15 nt, Yersinia pestis
gauuuuuaucuuucu

SEQ ID NO: 4174267 - RNA, 12 nt, Yersinia pestis
gauuuuuuguuc

SEQ ID NO: 4174268 - RNA, 13 nt, Yersinia pestis
gauuuuuuguucu

SEQ ID NO: 4174269 - RNA, 13 nt, Yersinia pestis
gcaaaaaaacuga

SEQ ID NO: 4174270 - RNA, 20 nt, Yersinia pestis
gcaaaaaaauccccggacca

SEQ ID NO: 4174271 - RNA, 14 nt, Yersinia pestis
gcaaaaaauauuaa

SEQ ID NO: 4174272 - RNA, 18 nt, Yersinia pestis
gcaaaaacgccaucaaua

SEQ ID NO: 4174273 - RNA, 17 nt, Yersinia pestis
gcaaaaagaauuaauaa

SEQ ID NO: 4174274 - RNA, 17 nt, Yersinia pestis
gcaaaaauauacccgac

SEQ ID NO: 4174275 - RNA, 14 nt, Yersinia pestis
gcaaaaauuacagu

SEQ ID NO: 4174276 - RNA, 21 nt, Yersinia pestis
gcaaaacagauauuugcugcc

SEQ ID NO: 4174277 - RNA, 18 nt, Yersinia pestis
gcaaaagaacgugcugcg

SEQ ID NO: 4174278 - RNA, 15 nt, Yersinia pestis
gcaaaauagcacaga

SEQ ID NO: 4174279 - RNA, 15 nt, Yersinia pestis
gcaaaaugcucuuca

SEQ ID NO: 4174280 - RNA, 23 nt, Yersinia pestis
gcaaaccaggcaacgacagcaac

SEQ ID NO: 4174281 - RNA, 24 nt, Yersinia pestis
gcaaaccgaauaccauaacgcugc

SEQ ID NO: 4174282 - RNA, 18 nt, Yersinia pestis
gcaaacgaacgaauaauu

SEQ ID NO: 4174283 - RNA, 17 nt, Yersinia pestis
gcaaacgcauuugagua

SEQ ID NO: 4174284 - RNA, 18 nt, Yersinia pestis
gcaaacgcugcacaucau

SEQ ID NO: 4174285 - RNA, 13 nt, Yersinia pestis
gcaaacucagcca

SEQ ID NO: 4174286 - RNA, 19 nt, Yersinia pestis
gcaaacuuaaaaaucaaaa

SEQ ID NO: 4174287 - RNA, 13 nt, Yersinia pestis
gcaaagaagaaua

SEQ ID NO: 4174288 - RNA, 15 nt, Yersinia pestis
gcaaagaagaauaag

SEQ ID NO: 4174289 - RNA, 22 nt, Yersinia pestis
gcaaagacuacacacagcaaua

SEQ ID NO: 4174290 - RNA, 23 nt, Yersinia pestis
gcaaagagaacgggcaaccugua

SEQ ID NO: 4174291 - RNA, 18 nt, Yersinia pestis
gcaaagagacugggcugc

SEQ ID NO: 4174292 - RNA, 13 nt, Yersinia pestis
gcaaagagucgca

SEQ ID NO: 4174293 - RNA, 15 nt, Yersinia pestis
gcaaagcaucaauca

SEQ ID NO: 4174294 - RNA, 16 nt, Yersinia pestis
gcaaagcgggccagca

SEQ ID NO: 4174295 - RNA, 17 nt, Yersinia pestis
gcaaagcgggccagcaa

SEQ ID NO: 4174296 - RNA, 18 nt, Yersinia pestis
gcaaagcgggccagcaac

SEQ ID NO: 4174297 - RNA, 21 nt, Yersinia pestis
gcaaagugcugcaaggcauua

SEQ ID NO: 4174298 - RNA, 21 nt, Yersinia pestis
gcaaauaaagggccugcaaac

SEQ ID NO: 4174299 - RNA, 19 nt, Yersinia pestis
gcaaauaccgggacuacca

SEQ ID NO: 4174300 - RNA, 22 nt, Yersinia pestis
gcaaaucauuuaauuuauccaa

SEQ ID NO: 4174301 - RNA, 18 nt, Yersinia pestis
gcaaauggcuuauuucac

SEQ ID NO: 4174302 - RNA, 12 nt, Yersinia pestis
gcaaaugucaga

SEQ ID NO: 4174303 - RNA, 14 nt, Yersinia pestis
gcaaauuaaugucg

SEQ ID NO: 4174304 - RNA, 16 nt, Yersinia pestis
gcaaauucccaccaua

SEQ ID NO: 4174305 - RNA, 21 nt, Yersinia pestis
gcaaauugcgagcugagcuua

SEQ ID NO: 4174306 - RNA, 17 nt, Yersinia pestis
gcaaauugcugaaaaaa

SEQ ID NO: 4174307 - RNA, 14 nt, Yersinia pestis
gcaaauugcuggcg

SEQ ID NO: 4174308 - RNA, 22 nt, Yersinia pestis
gcaacaaacagccgaucaaccc

SEQ ID NO: 4174309 - RNA, 13 nt, Yersinia pestis
gcaacaacacccg

SEQ ID NO: 4174310 - RNA, 18 nt, Yersinia pestis
gcaacacagucgcacuga

SEQ ID NO: 4174311 - RNA, 23 nt, Yersinia pestis
gcaacacagucgcacugauagca

SEQ ID NO: 4174312 - RNA, 24 nt, Yersinia pestis
gcaacacagucgcacugauagcaa

SEQ ID NO: 4174313 - RNA, 15 nt, Yersinia pestis
gcaacacccaacuca

SEQ ID NO: 4174314 - RNA, 15 nt, Yersinia pestis
gcaacacgaugccag

SEQ ID NO: 4174315 - RNA, 12 nt, Yersinia pestis
gcaacagauaau

SEQ ID NO: 4174316 - RNA, 16 nt, Yersinia pestis
gcaacauuaaaaauac

SEQ ID NO: 4174317 - RNA, 15 nt, Yersinia pestis
gcaaccacuuaucca

SEQ ID NO: 4174318 - RNA, 18 nt, Yersinia pestis
gcaaccacuuauccagcu

SEQ ID NO: 4174319 - RNA, 21 nt, Yersinia pestis
gcaaccacuuauccagcucau

SEQ ID NO: 4174320 - RNA, 21 nt, Yersinia pestis
gcaaccaguuauagcgguggc

SEQ ID NO: 4174321 - RNA, 18 nt, Yersinia pestis
gcaaccccuaauccagca

SEQ ID NO: 4174322 - RNA, 21 nt, Yersinia pestis
gcaacccuuaugccgugacug

SEQ ID NO: 4174323 - RNA, 15 nt, Yersinia pestis
gcaaccgagaagucg

SEQ ID NO: 4174324 - RNA, 20 nt, Yersinia pestis
gcaaccgagaagucggcuuu

SEQ ID NO: 4174325 - RNA, 14 nt, Yersinia pestis
gcaaccuuguuuua

SEQ ID NO: 4174326 - RNA, 15 nt, Yersinia pestis
gcaacgacagcaaca

SEQ ID NO: 4174327 - RNA, 23 nt, Yersinia pestis
gcaacgcacgauccgcccauugc

SEQ ID NO: 4174328 - RNA, 21 nt, Yersinia pestis
gcaacgcaggcacugcagaaa

SEQ ID NO: 4174329 - RNA, 17 nt, Yersinia pestis
gcaacgccgaugaaggu

SEQ ID NO: 4174330 - RNA, 18 nt, Yersinia pestis
gcaacggaagucaaucgg

SEQ ID NO: 4174331 - RNA, 20 nt, Yersinia pestis
gcaacgguuucaacuucaac

SEQ ID NO: 4174332 - RNA, 21 nt, Yersinia pestis
gcaacguaauaucugccaccg

SEQ ID NO: 4174333 - RNA, 18 nt, Yersinia pestis
gcaacguuaaagaugaag

SEQ ID NO: 4174334 - RNA, 16 nt, Yersinia pestis
gcaacguuuuaccugc

SEQ ID NO: 4174335 - RNA, 22 nt, Yersinia pestis
gcaacguuuuaccugcacaggu

SEQ ID NO: 4174336 - RNA, 16 nt, Yersinia pestis
gcaacucuagcgccag

SEQ ID NO: 4174337 - RNA, 22 nt, Yersinia pestis
gcaacugaguaguggagccacu

SEQ ID NO: 4174338 - RNA, 19 nt, Yersinia pestis
gcaacugagucgcuugauu

SEQ ID NO: 4174339 - RNA, 22 nt, Yersinia pestis
gcaacugagucgcuugauucuc

SEQ ID NO: 4174340 - RNA, 21 nt, Yersinia pestis
gcaacuuaaaaguaggcuuau

SEQ ID NO: 4174341 - RNA, 17 nt, Yersinia pestis
gcaagaaacuucauuuc

SEQ ID NO: 4174342 - RNA, 15 nt, Yersinia pestis
gcaagaaagaaaaau

SEQ ID NO: 4174343 - RNA, 17 nt, Yersinia pestis
gcaagaaagaaaaauag

SEQ ID NO: 4174344 - RNA, 14 nt, Yersinia pestis
gcaagaacaaucca

SEQ ID NO: 4174345 - RNA, 12 nt, Yersinia pestis
gcaagaguccag

SEQ ID NO: 4174346 - RNA, 16 nt, Yersinia pestis
gcaagauuuuguagcc

SEQ ID NO: 4174347 - RNA, 16 nt, Yersinia pestis
gcaagcaaccgcaaug

SEQ ID NO: 4174348 - RNA, 17 nt, Yersinia pestis
gcaagcagcucaaaauc

SEQ ID NO: 4174349 - RNA, 17 nt, Yersinia pestis
gcaagccaaaacagccu

SEQ ID NO: 4174350 - RNA, 23 nt, Yersinia pestis
gcaagcccccaaaguagaacugg

SEQ ID NO: 4174351 - RNA, 21 nt, Yersinia pestis
gcaagcgcugcuuuaaaggcu

SEQ ID NO: 4174352 - RNA, 17 nt, Yersinia pestis
gcaagcguaggggacau

SEQ ID NO: 4174353 - RNA, 20 nt, Yersinia pestis
gcaagcguuuuacugcuucu

SEQ ID NO: 4174354 - RNA, 11 nt, Yersinia pestis
gcaaggccagg

SEQ ID NO: 4174355 - RNA, 16 nt, Yersinia pestis
gcaaggcggcaagcaa

SEQ ID NO: 4174356 - RNA, 18 nt, Yersinia pestis
gcaaggggcuugagucgu

SEQ ID NO: 4174357 - RNA, 16 nt, Yersinia pestis
gcaaggucgccucugg

SEQ ID NO: 4174358 - RNA, 13 nt, Yersinia pestis
gcaagguucucgc

SEQ ID NO: 4174359 - RNA, 23 nt, Yersinia pestis
gcaaguaaaagucagcaaaucaa

SEQ ID NO: 4174360 - RNA, 14 nt, Yersinia pestis
gcaagugugcagga

SEQ ID NO: 4174361 - RNA, 13 nt, Yersinia pestis
gcaaguuagguac

SEQ ID NO: 4174362 - RNA, 15 nt, Yersinia pestis
gcaauaaaccacugg

SEQ ID NO: 4174363 - RNA, 23 nt, Yersinia pestis
gcaauaaaggcaagauuucucuu

SEQ ID NO: 4174364 - RNA, 20 nt, Yersinia pestis
gcaauaacaaacacauccag

SEQ ID NO: 4174365 - RNA, 17 nt, Yersinia pestis
gcaauaacaccagcagg

SEQ ID NO: 4174366 - RNA, 18 nt, Yersinia pestis
gcaauaacaccagcaggu

SEQ ID NO: 4174367 - RNA, 16 nt, Yersinia pestis
gcaauaauagccaccg

SEQ ID NO: 4174368 - RNA, 16 nt, Yersinia pestis
gcaauaauaucuggcg

SEQ ID NO: 4174369 - RNA, 13 nt, Yersinia pestis
gcaauagccaugg

SEQ ID NO: 4174370 - RNA, 16 nt, Yersinia pestis
gcaauaggcuauuuua

SEQ ID NO: 4174371 - RNA, 18 nt, Yersinia pestis
gcaauauauggccauuac

SEQ ID NO: 4174372 - RNA, 22 nt, Yersinia pestis
gcaauauauggccauuaccccg

SEQ ID NO: 4174373 - RNA, 21 nt, Yersinia pestis
gcaauaucaaugaaaaaaaga

SEQ ID NO: 4174374 - RNA, 23 nt, Yersinia pestis
gcaauauuggcgcacaacugcga

SEQ ID NO: 4174375 - RNA, 13 nt, Yersinia pestis
gcaaucaauaagc

SEQ ID NO: 4174376 - RNA, 19 nt, Yersinia pestis
gcaaucaauguauugcucc

SEQ ID NO: 4174377 - RNA, 15 nt, Yersinia pestis
gcaaucacaaccccc

SEQ ID NO: 4174378 - RNA, 16 nt, Yersinia pestis
gcaaucagaggccauc

SEQ ID NO: 4174379 - RNA, 15 nt, Yersinia pestis
gcaaucaugaugguc

SEQ ID NO: 4174380 - RNA, 22 nt, Yersinia pestis
gcaaucaugggccaauccaaua

SEQ ID NO: 4174381 - RNA, 14 nt, Yersinia pestis
gcaaucauuuauau

SEQ ID NO: 4174382 - RNA, 22 nt, Yersinia pestis
gcaaucgcauugcguucaauac

SEQ ID NO: 4174383 - RNA, 19 nt, Yersinia pestis
gcaaucucugcaguacaga

SEQ ID NO: 4174384 - RNA, 17 nt, Yersinia pestis
gcaaucugcaagccccc

SEQ ID NO: 4174385 - RNA, 17 nt, Yersinia pestis
gcaaugaccucccuguu

SEQ ID NO: 4174386 - RNA, 19 nt, Yersinia pestis
gcaaugaccuuacagugau

SEQ ID NO: 4174387 - RNA, 21 nt, Yersinia pestis
gcaaugcuaccuguaacauua

SEQ ID NO: 4174388 - RNA, 19 nt, Yersinia pestis
gcaauggaagaaucaccga

SEQ ID NO: 4174389 - RNA, 15 nt, Yersinia pestis
gcaauggcgcucuua

SEQ ID NO: 4174390 - RNA, 23 nt, Yersinia pestis
gcaaugggucauugcgugcaaua

SEQ ID NO: 4174391 - RNA, 14 nt, Yersinia pestis
gcaauggugauaaa

SEQ ID NO: 4174392 - RNA, 21 nt, Yersinia pestis
gcaaugucaccugaaccugac

SEQ ID NO: 4174393 - RNA, 14 nt, Yersinia pestis
gcaauguccccccu

SEQ ID NO: 4174394 - RNA, 15 nt, Yersinia pestis
gcaauguucaaaucu

SEQ ID NO: 4174395 - RNA, 18 nt, Yersinia pestis
gcaauuagcacauaugca

SEQ ID NO: 4174396 - RNA, 20 nt, Yersinia pestis
gcaauucaauauaggguugu

SEQ ID NO: 4174397 - RNA, 19 nt, Yersinia pestis
gcaauucggccauauacgc

SEQ ID NO: 4174398 - RNA, 21 nt, Yersinia pestis
gcaauuggccuuccaucguca

SEQ ID NO: 4174399 - RNA, 21 nt, Yersinia pestis
gcaauuucucuguauuuucaa

SEQ ID NO: 4174400 - RNA, 16 nt, Yersinia pestis
gcaauuugaucaccaa

SEQ ID NO: 4174401 - RNA, 19 nt, Yersinia pestis
gcaauuugcccaucuuuua

SEQ ID NO: 4174402 - RNA, 21 nt, Yersinia pestis
gcaauuuuuagcgcuaaauca

SEQ ID NO: 4174403 - RNA, 23 nt, Yersinia pestis
gcaauuuuuagcgcuaaaucagc

SEQ ID NO: 4174404 - RNA, 23 nt, Yersinia pestis
gcacaaacauggcggcagcacag

SEQ ID NO: 4174405 - RNA, 17 nt, Yersinia pestis
gcacaaacauggcuguc

SEQ ID NO: 4174406 - RNA, 18 nt, Yersinia pestis
gcacaaagcuuacuguuc

SEQ ID NO: 4174407 - RNA, 14 nt, Yersinia pestis
gcacaacggaaggc

SEQ ID NO: 4174408 - RNA, 23 nt, Yersinia pestis
gcacaacggaaggcccagccggg

SEQ ID NO: 4174409 - RNA, 16 nt, Yersinia pestis
gcacaaggcuggucag

SEQ ID NO: 4174410 - RNA, 15 nt, Yersinia pestis
gcacaaucagggcac

SEQ ID NO: 4174411 - RNA, 22 nt, Yersinia pestis
gcacaaucgcgcuguacaacaa

SEQ ID NO: 4174412 - RNA, 14 nt, Yersinia pestis
gcacaaugcauuca

SEQ ID NO: 4174413 - RNA, 17 nt, Yersinia pestis
gcacaauuccaggguug

SEQ ID NO: 4174414 - RNA, 19 nt, Yersinia pestis
gcacacaguuauuaggcau

SEQ ID NO: 4174415 - RNA, 13 nt, Yersinia pestis
gcacacaucuguc

SEQ ID NO: 4174416 - RNA, 12 nt, Yersinia pestis
gcacacccccau

SEQ ID NO: 4174417 - RNA, 14 nt, Yersinia pestis
gcacaccgugcacc

SEQ ID NO: 4174418 - RNA, 22 nt, Yersinia pestis
gcacacgacagcgcggcuaaau

SEQ ID NO: 4174419 - RNA, 22 nt, Yersinia pestis
gcacacucagaugaaaaacugu

SEQ ID NO: 4174420 - RNA, 21 nt, Yersinia pestis
gcacacuuuucacuccggcau

SEQ ID NO: 4174421 - RNA, 12 nt, Yersinia pestis
gcacagacgccc

SEQ ID NO: 4174422 - RNA, 21 nt, Yersinia pestis
gcacagagcgggaacgccaag

SEQ ID NO: 4174423 - RNA, 23 nt, Yersinia pestis
gcacauaccccauuuaucgccaa

SEQ ID NO: 4174424 - RNA, 21 nt, Yersinia pestis
gcacaucauuuauuuccaagc

SEQ ID NO: 4174425 - RNA, 13 nt, Yersinia pestis
gcacaucccaaua

SEQ ID NO: 4174426 - RNA, 18 nt, Yersinia pestis
gcacaucgccauuagacg

SEQ ID NO: 4174427 - RNA, 23 nt, Yersinia pestis
gcacauuacaagugccaaaugga

SEQ ID NO: 4174428 - RNA, 17 nt, Yersinia pestis
gcaccaaccauugacua

SEQ ID NO: 4174429 - RNA, 16 nt, Yersinia pestis
gcaccaagaaaaccca

SEQ ID NO: 4174430 - RNA, 21 nt, Yersinia pestis
gcaccaaucauuacaucaucu

SEQ ID NO: 4174431 - RNA, 22 nt, Yersinia pestis
gcaccaaucauuacaucaucuu

SEQ ID NO: 4174432 - RNA, 23 nt, Yersinia pestis
gcaccaauuuucccaagccuaac

SEQ ID NO: 4174433 - RNA, 16 nt, Yersinia pestis
gcaccacaauggcaga

SEQ ID NO: 4174434 - RNA, 16 nt, Yersinia pestis
gcaccacuaaggucau

SEQ ID NO: 4174435 - RNA, 17 nt, Yersinia pestis
gcaccagaaaguuguuc

SEQ ID NO: 4174436 - RNA, 14 nt, Yersinia pestis
gcaccagcaccaac

SEQ ID NO: 4174437 - RNA, 14 nt, Yersinia pestis
gcaccagcucaaua

SEQ ID NO: 4174438 - RNA, 22 nt, Yersinia pestis
gcaccagggaugggcgccgcuu

SEQ ID NO: 4174439 - RNA, 20 nt, Yersinia pestis
gcaccauaaauuucugguuu

SEQ ID NO: 4174440 - RNA, 17 nt, Yersinia pestis
gcaccauaaccaaucca

SEQ ID NO: 4174441 - RNA, 21 nt, Yersinia pestis
gcaccauaaccaauccaugcc

SEQ ID NO: 4174442 - RNA, 16 nt, Yersinia pestis
gcaccauccagcaaau

SEQ ID NO: 4174443 - RNA, 18 nt, Yersinia pestis
gcaccauccagcaaauca

SEQ ID NO: 4174444 - RNA, 19 nt, Yersinia pestis
gcaccauccagcaaaucau

SEQ ID NO: 4174445 - RNA, 15 nt, Yersinia pestis
gcaccauggaaaaua

SEQ ID NO: 4174446 - RNA, 12 nt, Yersinia pestis
gcacccacaccg

SEQ ID NO: 4174447 - RNA, 19 nt, Yersinia pestis
gcacccacgguaucugcuu

SEQ ID NO: 4174448 - RNA, 19 nt, Yersinia pestis
gcacccauggagauugccu

SEQ ID NO: 4174449 - RNA, 22 nt, Yersinia pestis
gcaccgaugucuaacaaacuca

SEQ ID NO: 4174450 - RNA, 14 nt, Yersinia pestis
gcaccgccgccaua

SEQ ID NO: 4174451 - RNA, 14 nt, Yersinia pestis
gcaccgcugauaac

SEQ ID NO: 4174452 - RNA, 23 nt, Yersinia pestis
gcaccgcuggucgggugcaggcc

SEQ ID NO: 4174453 - RNA, 21 nt, Yersinia pestis
gcaccgcugucauuccaaccu

SEQ ID NO: 4174454 - RNA, 21 nt, Yersinia pestis
gcaccggagcaagggcgcauc

SEQ ID NO: 4174455 - RNA, 20 nt, Yersinia pestis
gcaccggauuuauugcucuc

SEQ ID NO: 4174456 - RNA, 18 nt, Yersinia pestis
gcaccguggauaaacaaa

SEQ ID NO: 4174457 - RNA, 23 nt, Yersinia pestis
gcaccucauuggucgcugggccu

SEQ ID NO: 4174458 - RNA, 15 nt, Yersinia pestis
gcaccuccggcggga

SEQ ID NO: 4174459 - RNA, 19 nt, Yersinia pestis
gcaccucggggcacuucgg

SEQ ID NO: 4174460 - RNA, 20 nt, Yersinia pestis
gcaccucugcugaugucagu

SEQ ID NO: 4174461 - RNA, 22 nt, Yersinia pestis
gcaccuucaacgauauagagcu

SEQ ID NO: 4174462 - RNA, 22 nt, Yersinia pestis
gcacgaaccguggcgcggaugc

SEQ ID NO: 4174463 - RNA, 22 nt, Yersinia pestis
gcacgaaccugagcgaucaaua

SEQ ID NO: 4174464 - RNA, 16 nt, Yersinia pestis
gcacgacaacaaagcc

SEQ ID NO: 4174465 - RNA, 21 nt, Yersinia pestis
gcacgacaacaaagccgcugc

SEQ ID NO: 4174466 - RNA, 21 nt, Yersinia pestis
gcacgacggauuugguuggcu

SEQ ID NO: 4174467 - RNA, 17 nt, Yersinia pestis
gcacgauaccaccacca

SEQ ID NO: 4174468 - RNA, 18 nt, Yersinia pestis
gcacgauuugaucacgca

SEQ ID NO: 4174469 - RNA, 17 nt, Yersinia pestis
gcacgcaggcggcggcu

SEQ ID NO: 4174470 - RNA, 19 nt, Yersinia pestis
gcacgcugcaugccgccuc

SEQ ID NO: 4174471 - RNA, 15 nt, Yersinia pestis
gcacggcaacaggcu

SEQ ID NO: 4174472 - RNA, 14 nt, Yersinia pestis
gcacggcagugauc

SEQ ID NO: 4174473 - RNA, 15 nt, Yersinia pestis
gcacggcaucgcugc

SEQ ID NO: 4174474 - RNA, 14 nt, Yersinia pestis
gcacgugccgcugg

SEQ ID NO: 4174475 - RNA, 13 nt, Yersinia pestis
gcacguuuaaaca

SEQ ID NO: 4174476 - RNA, 13 nt, Yersinia pestis
gcacuaaaauauc

SEQ ID NO: 4174477 - RNA, 15 nt, Yersinia pestis
gcacuaaaaucugcu

SEQ ID NO: 4174478 - RNA, 12 nt, Yersinia pestis
gcacuaucaccg

SEQ ID NO: 4174479 - RNA, 16 nt, Yersinia pestis
gcacucagcauauugu

SEQ ID NO: 4174480 - RNA, 17 nt, Yersinia pestis
gcacuccagauaacaua

SEQ ID NO: 4174481 - RNA, 15 nt, Yersinia pestis
gcacuccugucuagg

SEQ ID NO: 4174482 - RNA, 17 nt, Yersinia pestis
gcacucgaaucacuuau

SEQ ID NO: 4174483 - RNA, 16 nt, Yersinia pestis
gcacugaacaaugcca

SEQ ID NO: 4174484 - RNA, 16 nt, Yersinia pestis
gcacugagagaaccau

SEQ ID NO: 4174485 - RNA, 14 nt, Yersinia pestis
gcacugaguucugc

SEQ ID NO: 4174486 - RNA, 17 nt, Yersinia pestis
gcacugaguucugcugc

SEQ ID NO: 4174487 - RNA, 21 nt, Yersinia pestis
gcacugauuuuuucgaguagu

SEQ ID NO: 4174488 - RNA, 22 nt, Yersinia pestis
gcacugcagaaaaugcggcggc

SEQ ID NO: 4174489 - RNA, 13 nt, Yersinia pestis
gcacugccccgaa

SEQ ID NO: 4174490 - RNA, 16 nt, Yersinia pestis
gcacugcgcgauccca

SEQ ID NO: 4174491 - RNA, 14 nt, Yersinia pestis
gcacugcucugccc

SEQ ID NO: 4174492 - RNA, 17 nt, Yersinia pestis
gcacuggcaauaaagag

SEQ ID NO: 4174493 - RNA, 20 nt, Yersinia pestis
gcacuggcaauaaagaggcc

SEQ ID NO: 4174494 - RNA, 23 nt, Yersinia pestis
gcacuggcaauaaagaggccagu

SEQ ID NO: 4174495 - RNA, 22 nt, Yersinia pestis
gcacugggaucugaucaaucuc

SEQ ID NO: 4174496 - RNA, 12 nt, Yersinia pestis
gcacuggucagu

SEQ ID NO: 4174497 - RNA, 16 nt, Yersinia pestis
gcacuggucaguauaa

SEQ ID NO: 4174498 - RNA, 15 nt, Yersinia pestis
gcacugguugcuuca

SEQ ID NO: 4174499 - RNA, 16 nt, Yersinia pestis
gcacugguuggcggcu

SEQ ID NO: 4174500 - RNA, 15 nt, Yersinia pestis
gcacuucaagcagca

SEQ ID NO: 4174501 - RNA, 13 nt, Yersinia pestis
gcacuucaccugg

SEQ ID NO: 4174502 - RNA, 14 nt, Yersinia pestis
gcacuucauuggcu

SEQ ID NO: 4174503 - RNA, 17 nt, Yersinia pestis
gcacuucauuggcuugg

SEQ ID NO: 4174504 - RNA, 15 nt, Yersinia pestis
gcacuuuaaauaccc

SEQ ID NO: 4174505 - RNA, 16 nt, Yersinia pestis
gcacuuuaaucgccag

SEQ ID NO: 4174506 - RNA, 22 nt, Yersinia pestis
gcacuuuuauacauucgagcua

SEQ ID NO: 4174507 - RNA, 13 nt, Yersinia pestis
gcagaaaagcgaa

SEQ ID NO: 4174508 - RNA, 18 nt, Yersinia pestis
gcagaaaaugcggcggcu

SEQ ID NO: 4174509 - RNA, 14 nt, Yersinia pestis
gcagaaagcagcag

SEQ ID NO: 4174510 - RNA, 13 nt, Yersinia pestis
gcagaaagugacc

SEQ ID NO: 4174511 - RNA, 21 nt, Yersinia pestis
gcagaaagugacccaagauga

SEQ ID NO: 4174512 - RNA, 16 nt, Yersinia pestis
gcagaaauaauaucaa

SEQ ID NO: 4174513 - RNA, 20 nt, Yersinia pestis
gcagaaaucguauuaucaau

SEQ ID NO: 4174514 - RNA, 18 nt, Yersinia pestis
gcagaacaaaacaagccc

SEQ ID NO: 4174515 - RNA, 12 nt, Yersinia pestis
gcagaacccagg

SEQ ID NO: 4174516 - RNA, 19 nt, Yersinia pestis
gcagaagggcggccagcaa

SEQ ID NO: 4174517 - RNA, 20 nt, Yersinia pestis
gcagaaguugaauuugacgu

SEQ ID NO: 4174518 - RNA, 20 nt, Yersinia pestis
gcagacaugauuaaaucaag

SEQ ID NO: 4174519 - RNA, 18 nt, Yersinia pestis
gcagacccgugaacaucu

SEQ ID NO: 4174520 - RNA, 20 nt, Yersinia pestis
gcagacggcguaagccuuca

SEQ ID NO: 4174521 - RNA, 16 nt, Yersinia pestis
gcagacucuuauauaa

SEQ ID NO: 4174522 - RNA, 16 nt, Yersinia pestis
gcagagaggagaauua

SEQ ID NO: 4174523 - RNA, 23 nt, Yersinia pestis
gcagagccaauccccagaagcgc

SEQ ID NO: 4174524 - RNA, 17 nt, Yersinia pestis
gcagaggaguaaagcgu

SEQ ID NO: 4174525 - RNA, 14 nt, Yersinia pestis
gcagaguauccagc

SEQ ID NO: 4174526 - RNA, 13 nt, Yersinia pestis
uaauuuauacaua

SEQ ID NO: 4174527 - RNA, 12 nt, Yersinia pestis
uaauuuauagac

SEQ ID NO: 4174528 - RNA, 14 nt, Yersinia pestis
uaauuuaucaguag

SEQ ID NO: 4174529 - RNA, 17 nt, Yersinia pestis
uaauuucaaaguaaaau

SEQ ID NO: 4174530 - RNA, 17 nt, Yersinia pestis
uaauuucacuaucguua

SEQ ID NO: 4174531 - RNA, 13 nt, Yersinia pestis
uaauuucuugaug

SEQ ID NO: 4174532 - RNA, 12 nt, Yersinia pestis
uaauuugccugg

SEQ ID NO: 4174533 - RNA, 15 nt, Yersinia pestis
uaauuugccuucauc

SEQ ID NO: 4174534 - RNA, 12 nt, Yersinia pestis
uaauuuggcuua

SEQ ID NO: 4174535 - RNA, 21 nt, Yersinia pestis
uaauuuggcuuaaaaaaugau

SEQ ID NO: 4174536 - RNA, 9 nt, Yersinia pestis
uaauuugua

SEQ ID NO: 4174537 - RNA, 12 nt, Yersinia pestis
uaauuuguaaau

SEQ ID NO: 4174538 - RNA, 14 nt, Yersinia pestis
uaauuugucaguaa

SEQ ID NO: 4174539 - RNA, 23 nt, Yersinia pestis
uaauuuuaacccgcuuaaucaua

SEQ ID NO: 4174540 - RNA, 12 nt, Yersinia pestis
uaauuuuucaua

SEQ ID NO: 4174541 - RNA, 13 nt, Yersinia pestis
uaauuuuucuucc

SEQ ID NO: 4174542 - RNA, 19 nt, Yersinia pestis
uaauuuuucuuccaccauc

SEQ ID NO: 4174543 - RNA, 21 nt, Yersinia pestis
uacaaaccacauuuuuuaaaa

SEQ ID NO: 4174544 - RNA, 22 nt, Yersinia pestis
uacaaaccacauuuuuuaaaac

SEQ ID NO: 4174545 - RNA, 14 nt, Yersinia pestis
uacaaauaguaaua

SEQ ID NO: 4174546 - RNA, 21 nt, Yersinia pestis
uacaaauaguaauaauuaauc

SEQ ID NO: 4174547 - RNA, 11 nt, Yersinia pestis
uacaaauauua

SEQ ID NO: 4174548 - RNA, 12 nt, Yersinia pestis
uacaaauuuuuu

SEQ ID NO: 4174549 - RNA, 16 nt, Yersinia pestis
uacaacaagaucccaa

SEQ ID NO: 4174550 - RNA, 13 nt, Yersinia pestis
uacaacaauaaua

SEQ ID NO: 4174551 - RNA, 14 nt, Yersinia pestis
uacaacaauaauaa

SEQ ID NO: 4174552 - RNA, 23 nt, Yersinia pestis
uacaacacaucgaagcugucuuu

SEQ ID NO: 4174553 - RNA, 14 nt, Yersinia pestis
uacaaccuaccacc

SEQ ID NO: 4174554 - RNA, 18 nt, Yersinia pestis
uacaaccuaccaccuacc

SEQ ID NO: 4174555 - RNA, 19 nt, Yersinia pestis
uacaaccuaucccccuucc

SEQ ID NO: 4174556 - RNA, 17 nt, Yersinia pestis
uacaacuucuucauaac

SEQ ID NO: 4174557 - RNA, 22 nt, Yersinia pestis
uacaacuucuucauaacgcuuu

SEQ ID NO: 4174558 - RNA, 16 nt, Yersinia pestis
uacaacuugcuggagg

SEQ ID NO: 4174559 - RNA, 15 nt, Yersinia pestis
uacaagacaagcccg

SEQ ID NO: 4174560 - RNA, 23 nt, Yersinia pestis
uacaagcagcguucaaaucugcu

SEQ ID NO: 4174561 - RNA, 12 nt, Yersinia pestis
uacaaggggcau

SEQ ID NO: 4174562 - RNA, 15 nt, Yersinia pestis
uacaauaaaucaauu

SEQ ID NO: 4174563 - RNA, 17 nt, Yersinia pestis
uacaauagagaauagac

SEQ ID NO: 4174564 - RNA, 22 nt, Yersinia pestis
uacaauagagaauagaccugau

SEQ ID NO: 4174565 - RNA, 18 nt, Yersinia pestis
uacaauccaaccuauaua

SEQ ID NO: 4174566 - RNA, 21 nt, Yersinia pestis
uacaauucgaccguuuuuaca

SEQ ID NO: 4174567 - RNA, 23 nt, Yersinia pestis
uacaauuuuuggucguauucaua

SEQ ID NO: 4174568 - RNA, 13 nt, Yersinia pestis
uacacaagucauu

SEQ ID NO: 4174569 - RNA, 15 nt, Yersinia pestis
uacacaauaggcuau

SEQ ID NO: 4174570 - RNA, 17 nt, Yersinia pestis
uacacaaucaguaaaua

SEQ ID NO: 4174571 - RNA, 13 nt, Yersinia pestis
uacacacucagua

SEQ ID NO: 4174572 - RNA, 15 nt, Yersinia pestis
uacacacucaguaca

SEQ ID NO: 4174573 - RNA, 23 nt, Yersinia pestis
uacacagcacggcaacaggcuuu

SEQ ID NO: 4174574 - RNA, 17 nt, Yersinia pestis
uacacaguuauucccau

SEQ ID NO: 4174575 - RNA, 15 nt, Yersinia pestis
uacacaugaaaauca

SEQ ID NO: 4174576 - RNA, 23 nt, Yersinia pestis
uacaccaccgccgcaacaauaaa

SEQ ID NO: 4174577 - RNA, 17 nt, Yersinia pestis
uacaccagacucugcua

SEQ ID NO: 4174578 - RNA, 18 nt, Yersinia pestis
uacaccauuuccaggcua

SEQ ID NO: 4174579 - RNA, 17 nt, Yersinia pestis
uacaccguuguuggcga

SEQ ID NO: 4174580 - RNA, 18 nt, Yersinia pestis
uacaccuuaaaacagcag

SEQ ID NO: 4174581 - RNA, 19 nt, Yersinia pestis
uacaccuucuuuaucuguc

SEQ ID NO: 4174582 - RNA, 13 nt, Yersinia pestis
uacacgauaaaau

SEQ ID NO: 4174583 - RNA, 21 nt, Yersinia pestis
uacacgcaguacgugacggcg

SEQ ID NO: 4174584 - RNA, 21 nt, Yersinia pestis
uacacgugagaauugcugcuu

SEQ ID NO: 4174585 - RNA, 19 nt, Yersinia pestis
uacacucggucgaucgcuu

SEQ ID NO: 4174586 - RNA, 20 nt, Yersinia pestis
uacacugauugaaguccugg

SEQ ID NO: 4174587 - RNA, 15 nt, Yersinia pestis
uacacuggcagugcc

SEQ ID NO: 4174588 - RNA, 18 nt, Yersinia pestis
uacacugucgacugcuuu

SEQ ID NO: 4174589 - RNA, 16 nt, Yersinia pestis
uacacuuaaucuuauu

SEQ ID NO: 4174590 - RNA, 20 nt, Yersinia pestis
uacacuuucuuugaugcaua

SEQ ID NO: 4174591 - RNA, 13 nt, Yersinia pestis
uacagaauuucau

SEQ ID NO: 4174592 - RNA, 20 nt, Yersinia pestis
uacagauauauccaggcacu

SEQ ID NO: 4174593 - RNA, 23 nt, Yersinia pestis
uacagcaaacaucgguaaaucgc

SEQ ID NO: 4174594 - RNA, 14 nt, Yersinia pestis
uacagcaaauaggu

SEQ ID NO: 4174595 - RNA, 12 nt, Yersinia pestis
uacagcaccauu

SEQ ID NO: 4174596 - RNA, 22 nt, Yersinia pestis
uacagcaccauucaauguaaaa

SEQ ID NO: 4174597 - RNA, 15 nt, Yersinia pestis
uacagcacucaguac

SEQ ID NO: 4174598 - RNA, 19 nt, Yersinia pestis
uacagcagcaguauuagcg

SEQ ID NO: 4174599 - RNA, 20 nt, Yersinia pestis
uacagcagggauucugucag

SEQ ID NO: 4174600 - RNA, 17 nt, Yersinia pestis
uacagcccaagagaaau

SEQ ID NO: 4174601 - RNA, 16 nt, Yersinia pestis
uacagccguguagcau

SEQ ID NO: 4174602 - RNA, 23 nt, Yersinia pestis
uacagcgcuuggugaugcugcug

SEQ ID NO: 4174603 - RNA, 15 nt, Yersinia pestis
uacagcuaaagggua

SEQ ID NO: 4174604 - RNA, 17 nt, Yersinia pestis
uacaggccacacaccag

SEQ ID NO: 4174605 - RNA, 17 nt, Yersinia pestis
uacaggccccaauccac

SEQ ID NO: 4174606 - RNA, 14 nt, Yersinia pestis
uacaggccccuucu

SEQ ID NO: 4174607 - RNA, 18 nt, Yersinia pestis
uacaggggcguuauucuc

SEQ ID NO: 4174608 - RNA, 15 nt, Yersinia pestis
uacagguguaccgcu

SEQ ID NO: 4174609 - RNA, 21 nt, Yersinia pestis
uacagguguaccgcuucgcgc

SEQ ID NO: 4174610 - RNA, 21 nt, Yersinia pestis
uacagguguugaguaacgcca

SEQ ID NO: 4174611 - RNA, 13 nt, Yersinia pestis
uacaguaagguau

SEQ ID NO: 4174612 - RNA, 22 nt, Yersinia pestis
uacaguaagguauugauacagu

SEQ ID NO: 4174613 - RNA, 18 nt, Yersinia pestis
uacagucauuuacugaug

SEQ ID NO: 4174614 - RNA, 16 nt, Yersinia pestis
uacagucgcugcuguu

SEQ ID NO: 4174615 - RNA, 23 nt, Yersinia pestis
uacaguggcgagcgcagggucag

SEQ ID NO: 4174616 - RNA, 15 nt, Yersinia pestis
uacaguuaauuucaa

SEQ ID NO: 4174617 - RNA, 22 nt, Yersinia pestis
uacauaaucuuuacugcauuga

SEQ ID NO: 4174618 - RNA, 16 nt, Yersinia pestis
uacauagaagcucaua

SEQ ID NO: 4174619 - RNA, 15 nt, Yersinia pestis
uacauagauguauuu

SEQ ID NO: 4174620 - RNA, 18 nt, Yersinia pestis
uacauaggucuuuacgca

SEQ ID NO: 4174621 - RNA, 16 nt, Yersinia pestis
uacauauaaccaucaa

SEQ ID NO: 4174622 - RNA, 20 nt, Yersinia pestis
uacauauaaccaucaaauac

SEQ ID NO: 4174623 - RNA, 12 nt, Yersinia pestis
uacauauaucac

SEQ ID NO: 4174624 - RNA, 16 nt, Yersinia pestis
uacaucaaaucagagg

SEQ ID NO: 4174625 - RNA, 13 nt, Yersinia pestis
uacaucacaccca

SEQ ID NO: 4174626 - RNA, 13 nt, Yersinia pestis
uacaucagacacg

SEQ ID NO: 4174627 - RNA, 13 nt, Yersinia pestis
uacaucaggguga

SEQ ID NO: 4174628 - RNA, 22 nt, Yersinia pestis
uacaucagggugaccgcacugc

SEQ ID NO: 4174629 - RNA, 14 nt, Yersinia pestis
uacaucaucuucua

SEQ ID NO: 4174630 - RNA, 13 nt, Yersinia pestis
uacauccaacuuc

SEQ ID NO: 4174631 - RNA, 16 nt, Yersinia pestis
uacauccauguaggcu

SEQ ID NO: 4174632 - RNA, 22 nt, Yersinia pestis
uacaucgaguugaugcaauggc

SEQ ID NO: 4174633 - RNA, 19 nt, Yersinia pestis
uacaucgccaguguugcca

SEQ ID NO: 4174634 - RNA, 17 nt, Yersinia pestis
uacaucgguuagcguuu

SEQ ID NO: 4174635 - RNA, 16 nt, Yersinia pestis
uacaucguagucuaua

SEQ ID NO: 4174636 - RNA, 16 nt, Yersinia pestis
uacaugauugaaaaac

SEQ ID NO: 4174637 - RNA, 16 nt, Yersinia pestis
uacaugcguaaaugaa

SEQ ID NO: 4174638 - RNA, 13 nt, Yersinia pestis
uacaugcuguuca

SEQ ID NO: 4174639 - RNA, 15 nt, Yersinia pestis
uacauuacuggucuc

SEQ ID NO: 4174640 - RNA, 22 nt, Yersinia pestis
uacauucgagcaacuuuuacug

SEQ ID NO: 4174641 - RNA, 13 nt, Yersinia pestis
uacauuuaaacac

SEQ ID NO: 4174642 - RNA, 22 nt, Yersinia pestis
uacauuuaaacacucaauaagu

SEQ ID NO: 4174643 - RNA, 23 nt, Yersinia pestis
uacauuuagucuacgcucuacau

SEQ ID NO: 4174644 - RNA, 19 nt, Yersinia pestis
uaccaaaaagcaacuuggc

SEQ ID NO: 4174645 - RNA, 18 nt, Yersinia pestis
uaccaaaacgaacaaaau

SEQ ID NO: 4174646 - RNA, 15 nt, Yersinia pestis
uaccaaaauuuaaau

SEQ ID NO: 4174647 - RNA, 19 nt, Yersinia pestis
uaccaacucugaaguaaau

SEQ ID NO: 4174648 - RNA, 19 nt, Yersinia pestis
uaccaagacuucaugacua

SEQ ID NO: 4174649 - RNA, 18 nt, Yersinia pestis
uaccaauggugcccauca

SEQ ID NO: 4174650 - RNA, 15 nt, Yersinia pestis
uaccaauguuuaauu

SEQ ID NO: 4174651 - RNA, 15 nt, Yersinia pestis
uaccaauugauguca

SEQ ID NO: 4174652 - RNA, 14 nt, Yersinia pestis
uaccacaucaaacc

SEQ ID NO: 4174653 - RNA, 15 nt, Yersinia pestis
uaccacauuuccuau

SEQ ID NO: 4174654 - RNA, 20 nt, Yersinia pestis
uaccacauuuccuaugugau

SEQ ID NO: 4174655 - RNA, 18 nt, Yersinia pestis
uaccaccaccaacagcau

SEQ ID NO: 4174656 - RNA, 16 nt, Yersinia pestis
uaccaccaccaacccg

SEQ ID NO: 4174657 - RNA, 16 nt, Yersinia pestis
uaccaccaccacaccg

SEQ ID NO: 4174658 - RNA, 15 nt, Yersinia pestis
uaccaccuacaaccu

SEQ ID NO: 4174659 - RNA, 16 nt, Yersinia pestis
uaccaccuacaaccua

SEQ ID NO: 4174660 - RNA, 19 nt, Yersinia pestis
uaccaccuacaaccuacca

SEQ ID NO: 4174661 - RNA, 13 nt, Yersinia pestis
uaccaccuaccac

SEQ ID NO: 4174662 - RNA, 18 nt, Yersinia pestis
uaccaccuaccaccuacc

SEQ ID NO: 4174663 - RNA, 19 nt, Yersinia pestis
uaccaccuaccaccuacca

SEQ ID NO: 4174664 - RNA, 17 nt, Yersinia pestis
uaccacgucuaauugcu

SEQ ID NO: 4174665 - RNA, 20 nt, Yersinia pestis
uaccacgucuaauugcugcc

SEQ ID NO: 4174666 - RNA, 22 nt, Yersinia pestis
uaccacgucuaauugcugccca

SEQ ID NO: 4174667 - RNA, 22 nt, Yersinia pestis
uaccacuagcagagcacgcaga

SEQ ID NO: 4174668 - RNA, 19 nt, Yersinia pestis
uaccacuauccaacugggc

SEQ ID NO: 4174669 - RNA, 14 nt, Yersinia pestis
uaccacugcucacu

SEQ ID NO: 4174670 - RNA, 16 nt, Yersinia pestis
uaccagacccugcacc

SEQ ID NO: 4174671 - RNA, 20 nt, Yersinia pestis
uaccagccgcgcccuaacag

SEQ ID NO: 4174672 - RNA, 17 nt, Yersinia pestis
uaccagcgucaaaccau

SEQ ID NO: 4174673 - RNA, 20 nt, Yersinia pestis
uaccagggcaccuaauucac

SEQ ID NO: 4174674 - RNA, 17 nt, Yersinia pestis
uaccaguaacugaucaa

SEQ ID NO: 4174675 - RNA, 20 nt, Yersinia pestis
uaccaguuuuuuccugcugc

SEQ ID NO: 4174676 - RNA, 16 nt, Yersinia pestis
uaccauaacaauggcc

SEQ ID NO: 4174677 - RNA, 19 nt, Yersinia pestis
uaccauauggaugaugcac

SEQ ID NO: 4174678 - RNA, 18 nt, Yersinia pestis
uaccauccagugccaacc

SEQ ID NO: 4174679 - RNA, 22 nt, Yersinia pestis
uaccaugagugaaaauauguag

SEQ ID NO: 4174680 - RNA, 22 nt, Yersinia pestis
uaccauuuucagacugaaauga

SEQ ID NO: 4174681 - RNA, 14 nt, Yersinia pestis
uacccaaaccaaca

SEQ ID NO: 4174682 - RNA, 14 nt, Yersinia pestis
uacccaaagccagu

SEQ ID NO: 4174683 - RNA, 17 nt, Yersinia pestis
uacccacauucaggccg

SEQ ID NO: 4174684 - RNA, 21 nt, Yersinia pestis
uacccaccagagaccacagau

SEQ ID NO: 4174685 - RNA, 17 nt, Yersinia pestis
uacccagccaagacuuu

SEQ ID NO: 4174686 - RNA, 19 nt, Yersinia pestis
uacccgacaccggcugauu

SEQ ID NO: 4174687 - RNA, 22 nt, Yersinia pestis
uacccgacaccggcugauuacc

SEQ ID NO: 4174688 - RNA, 16 nt, Yersinia pestis
uacccgaguaugguua

SEQ ID NO: 4174689 - RNA, 20 nt, Yersinia pestis
uacccguaauauuucaagcu

SEQ ID NO: 4174690 - RNA, 22 nt, Yersinia pestis
uacccguaggcccacaaucaag

SEQ ID NO: 4174691 - RNA, 20 nt, Yersinia pestis
uacccguuauauuucaagcu

SEQ ID NO: 4174692 - RNA, 23 nt, Yersinia pestis
uacccuaaauaauaucugucuga

SEQ ID NO: 4174693 - RNA, 18 nt, Yersinia pestis
uacccuaauucagauguu

SEQ ID NO: 4174694 - RNA, 15 nt, Yersinia pestis
uacccucgacaccaa

SEQ ID NO: 4174695 - RNA, 16 nt, Yersinia pestis
uacccucgacaccaaa

SEQ ID NO: 4174696 - RNA, 17 nt, Yersinia pestis
uacccucgacaccaaaa

SEQ ID NO: 4174697 - RNA, 17 nt, Yersinia pestis
uacccugcaccauaucc

SEQ ID NO: 4174698 - RNA, 20 nt, Yersinia pestis
uacccuuaacggucagaucc

SEQ ID NO: 4174699 - RNA, 23 nt, Yersinia pestis
uaccgaaauauucgucucaucaa

SEQ ID NO: 4174700 - RNA, 16 nt, Yersinia pestis
uaccgacaccaauacc

SEQ ID NO: 4174701 - RNA, 20 nt, Yersinia pestis
uaccgacaucaacagaggca

SEQ ID NO: 4174702 - RNA, 17 nt, Yersinia pestis
uaccgaguucucaccaa

SEQ ID NO: 4174703 - RNA, 18 nt, Yersinia pestis
uaccgaguucucaccaag

SEQ ID NO: 4174704 - RNA, 20 nt, Yersinia pestis
uaccgauaaaaguacaacua

SEQ ID NO: 4174705 - RNA, 19 nt, Yersinia pestis
uaccgauaauaaauauccu

SEQ ID NO: 4174706 - RNA, 13 nt, Yersinia pestis
uaccgauuucagg

SEQ ID NO: 4174707 - RNA, 23 nt, Yersinia pestis
uaccgcaaccgggccggguugau

SEQ ID NO: 4174708 - RNA, 22 nt, Yersinia pestis
uaccgcauaagacaccacauca

SEQ ID NO: 4174709 - RNA, 13 nt, Yersinia pestis
uaccgccaagcgc

SEQ ID NO: 4174710 - RNA, 18 nt, Yersinia pestis
uaccgccaaucucuccua

SEQ ID NO: 4174711 - RNA, 17 nt, Yersinia pestis
uaccgccacuuuaacug

SEQ ID NO: 4174712 - RNA, 14 nt, Yersinia pestis
uaccgccagaauaa

SEQ ID NO: 4174713 - RNA, 16 nt, Yersinia pestis
uaccggagcuggcauu

SEQ ID NO: 4174714 - RNA, 21 nt, Yersinia pestis
uaccggcgguuaucacaucau

SEQ ID NO: 4174715 - RNA, 18 nt, Yersinia pestis
uaccggcuccugccgcau

SEQ ID NO: 4174716 - RNA, 17 nt, Yersinia pestis
uaccgggcgaacagaaa

SEQ ID NO: 4174717 - RNA, 18 nt, Yersinia pestis
uaccgggcgaacagaaau

SEQ ID NO: 4174718 - RNA, 18 nt, Yersinia pestis
uaccgguuugggcaucaa

SEQ ID NO: 4174719 - RNA, 13 nt, Yersinia pestis
uaccgucauccag

SEQ ID NO: 4174720 - RNA, 15 nt, Yersinia pestis
uaccuaaccaaacau

SEQ ID NO: 4174721 - RNA, 14 nt, Yersinia pestis
uaccuaggccagca

SEQ ID NO: 4174722 - RNA, 19 nt, Yersinia pestis
uaccuauggcgaagagaac

SEQ ID NO: 4174723 - RNA, 15 nt, Yersinia pestis
uaccuauuuuaaaac

SEQ ID NO: 4174724 - RNA, 20 nt, Yersinia pestis
uaccucacuggcuuuauuau

SEQ ID NO: 4174725 - RNA, 23 nt, Yersinia pestis
uaccucauccguaaaaaaccuua

SEQ ID NO: 4174726 - RNA, 16 nt, Yersinia pestis
uaccuccauauccugg

SEQ ID NO: 4174727 - RNA, 16 nt, Yersinia pestis
uaccugagagagguug

SEQ ID NO: 4174728 - RNA, 20 nt, Yersinia pestis
uaccugcaccaaugacuaau

SEQ ID NO: 4174729 - RNA, 15 nt, Yersinia pestis
uaccugcauauccuc

SEQ ID NO: 4174730 - RNA, 20 nt, Yersinia pestis
uaccugcaucaagccgcuua

SEQ ID NO: 4174731 - RNA, 15 nt, Yersinia pestis
uaccugcaucaucac

SEQ ID NO: 4174732 - RNA, 14 nt, Yersinia pestis
uaccugccugcugc

SEQ ID NO: 4174733 - RNA, 14 nt, Yersinia pestis
uaccugcuaaccga

SEQ ID NO: 4174734 - RNA, 16 nt, Yersinia pestis
uaccuguuucaaacau

SEQ ID NO: 4174735 - RNA, 21 nt, Yersinia pestis
uaccuucccguccacuuucac

SEQ ID NO: 4174736 - RNA, 18 nt, Yersinia pestis
uaccuuuaacuguuuuau

SEQ ID NO: 4174737 - RNA, 17 nt, Yersinia pestis
uaccuuuacggccgcua

SEQ ID NO: 4174738 - RNA, 20 nt, Yersinia pestis
uaccuuuugcauauuucucu

SEQ ID NO: 4174739 - RNA, 22 nt, Yersinia pestis
uaccuuuugcauauuucucuuu

SEQ ID NO: 4174740 - RNA, 23 nt, Yersinia pestis
uacgaaauugauaugauuucaua

SEQ ID NO: 4174741 - RNA, 16 nt, Yersinia pestis
uacgaccgucaccaaa

SEQ ID NO: 4174742 - RNA, 21 nt, Yersinia pestis
uacgacgggcacgaauagucu

SEQ ID NO: 4174743 - RNA, 20 nt, Yersinia pestis
uacgagagaucguaggcuug

SEQ ID NO: 4174744 - RNA, 13 nt, Yersinia pestis
uacgaucagcaag

SEQ ID NO: 4174745 - RNA, 17 nt, Yersinia pestis
uacgauccgcuauuuuc

SEQ ID NO: 4174746 - RNA, 20 nt, Yersinia pestis
uacgauccgcuauuuucucu

SEQ ID NO: 4174747 - RNA, 21 nt, Yersinia pestis
uacgauccgcuauuuucucug

SEQ ID NO: 4174748 - RNA, 17 nt, Yersinia pestis
uacgaucgauaguaaca

SEQ ID NO: 4174749 - RNA, 20 nt, Yersinia pestis
uacgaucugccuguucucuc

SEQ ID NO: 4174750 - RNA, 19 nt, Yersinia pestis
uacgauguaaucugaauag

SEQ ID NO: 4174751 - RNA, 17 nt, Yersinia pestis
uacgcaacguaauaucu

SEQ ID NO: 4174752 - RNA, 23 nt, Yersinia pestis
uacgcaacguaauaucugccacc

SEQ ID NO: 4174753 - RNA, 13 nt, Yersinia pestis
uacgcaaguaaaa

SEQ ID NO: 4174754 - RNA, 13 nt, Yersinia pestis
uacgccaagaggg

SEQ ID NO: 4174755 - RNA, 11 nt, Yersinia pestis
uacgccagcag

SEQ ID NO: 4174756 - RNA, 20 nt, Yersinia pestis
uacgccgacaauacugccaa

SEQ ID NO: 4174757 - RNA, 16 nt, Yersinia pestis
uacgccuggcuaacgu

SEQ ID NO: 4174758 - RNA, 19 nt, Yersinia pestis
uacgcuaugaauaagcauu

SEQ ID NO: 4174759 - RNA, 19 nt, Yersinia pestis
uacgcuccguugccugugc

SEQ ID NO: 4174760 - RNA, 19 nt, Yersinia pestis
uacgcucuccucuccccua

SEQ ID NO: 4174761 - RNA, 23 nt, Yersinia pestis
uacggaucuccaguugcacacca

SEQ ID NO: 4174762 - RNA, 13 nt, Yersinia pestis
uacggauugcaaa

SEQ ID NO: 4174763 - RNA, 20 nt, Yersinia pestis
uacggcgaaauauaaaacag

SEQ ID NO: 4174764 - RNA, 18 nt, Yersinia pestis
uacggcgcaucgccaucc

SEQ ID NO: 4174765 - RNA, 16 nt, Yersinia pestis
uacggguauagcggcg

SEQ ID NO: 4174766 - RNA, 17 nt, Yersinia pestis
uacgguaccgcagguca

SEQ ID NO: 4174767 - RNA, 19 nt, Yersinia pestis
uacgguauuugaacuucaa

SEQ ID NO: 4174768 - RNA, 13 nt, Yersinia pestis
uacggucaaaagc

SEQ ID NO: 4174769 - RNA, 12 nt, Yersinia pestis
uacggucacuga

SEQ ID NO: 4174770 - RNA, 16 nt, Yersinia pestis
uacgguccauaaaauc

SEQ ID NO: 4174771 - RNA, 19 nt, Yersinia pestis
uacggugccagcagcaagu

SEQ ID NO: 4174772 - RNA, 15 nt, Yersinia pestis
uacgguguuugguga

SEQ ID NO: 4174773 - RNA, 19 nt, Yersinia pestis
uacgguucacuagccugag

SEQ ID NO: 4174774 - RNA, 14 nt, Yersinia pestis
uacgguucaucauu

SEQ ID NO: 4174775 - RNA, 22 nt, Yersinia pestis
uacgguuuugccaauauugccu

SEQ ID NO: 4174776 - RNA, 20 nt, Yersinia pestis
uacguaaacgaguuuccagu

SEQ ID NO: 4174777 - RNA, 17 nt, Yersinia pestis
uacguaaauagguuuua

SEQ ID NO: 4174778 - RNA, 20 nt, Yersinia pestis
uacguaacgaauucagcagc

SEQ ID NO: 4174779 - RNA, 19 nt, Yersinia pestis
uacguaaucccagaaacgg

SEQ ID NO: 4174780 - RNA, 17 nt, Yersinia pestis
uacguaauuucacgcug

SEQ ID NO: 4174781 - RNA, 16 nt, Yersinia pestis
uacgucaggaauaaag

SEQ ID NO: 4174782 - RNA, 15 nt, Yersinia pestis
uacgugaucaucuuu

SEQ ID NO: 4174783 - RNA, 17 nt, Yersinia pestis
uacgugucagacugcug

SEQ ID NO: 4174784 - RNA, 20 nt, Yersinia pestis
uacgugucagacugcugaca

SEQ ID NO: 4174785 - RNA, 20 nt, Yersinia pestis
uacguguccuuuuuucugca

SEQ ID NO: 4174786 - RNA, 14 nt, Yersinia pestis
uacguugcagguca

SEQ ID NO: 4174787 - RNA, 21 nt, Yersinia pestis
uacguugggcggucaucagcc

SEQ ID NO: 4174788 - RNA, 20 nt, Yersinia pestis
uacguugucaauaaccucag

SEQ ID NO: 4174789 - RNA, 11 nt, Yersinia pestis
uacuaaaacag

SEQ ID NO: 4174790 - RNA, 14 nt, Yersinia pestis
uacuaaaauaucac

SEQ ID NO: 4174791 - RNA, 18 nt, Yersinia pestis
uacuaaauuagaaaacaa

SEQ ID NO: 4174792 - RNA, 13 nt, Yersinia pestis
uacuaucaucauc

SEQ ID NO: 4174793 - RNA, 14 nt, Yersinia pestis
uacuaucuauuauu

SEQ ID NO: 4174794 - RNA, 13 nt, Yersinia pestis
uacuauuuucauu

SEQ ID NO: 4174795 - RNA, 20 nt, Yersinia pestis
uacuauuuuuuauauugcuc

SEQ ID NO: 4174796 - RNA, 19 nt, Yersinia pestis
uacucaaaaaaaauacauu

SEQ ID NO: 4174797 - RNA, 15 nt, Yersinia pestis
uacucagcauccucc

SEQ ID NO: 4174798 - RNA, 21 nt, Yersinia pestis
uacucaggauuagcuucugcu

SEQ ID NO: 4174799 - RNA, 22 nt, Yersinia pestis
uacucaggauuagcuucugcua

SEQ ID NO: 4174800 - RNA, 17 nt, Yersinia pestis
uacucaggcccugagau

SEQ ID NO: 4174801 - RNA, 22 nt, Yersinia pestis
uacucaguugccgccuuccugc

SEQ ID NO: 4174802 - RNA, 18 nt, Yersinia pestis
uacucauauuguccaaag

SEQ ID NO: 4174803 - RNA, 19 nt, Yersinia pestis
uacucauauuguccaaagg

SEQ ID NO: 4174804 - RNA, 22 nt, Yersinia pestis
uacucauauuguccaaaggaag

SEQ ID NO: 4174805 - RNA, 14 nt, Yersinia pestis
uacucaugauggca

SEQ ID NO: 4174806 - RNA, 14 nt, Yersinia pestis
uacucauuauggau

SEQ ID NO: 4174807 - RNA, 13 nt, Yersinia pestis
uacucauugcacc

SEQ ID NO: 4174808 - RNA, 19 nt, Yersinia pestis
uacuccauccccaacucuu

SEQ ID NO: 4174809 - RNA, 19 nt, Yersinia pestis
uacuccauuugaacugugg

SEQ ID NO: 4174810 - RNA, 19 nt, Yersinia pestis
uacuccuugaauagccaga

SEQ ID NO: 4174811 - RNA, 22 nt, Yersinia pestis
uacucgagcguauugccuucuc

SEQ ID NO: 4174812 - RNA, 14 nt, Yersinia pestis
uacucguuuuacau

SEQ ID NO: 4174813 - RNA, 15 nt, Yersinia pestis
uacucuauugcucau

SEQ ID NO: 4174814 - RNA, 20 nt, Yersinia pestis
uacucucgccaaacaaaugu

SEQ ID NO: 4174815 - RNA, 12 nt, Yersinia pestis
uacucucgcccu

SEQ ID NO: 4174816 - RNA, 14 nt, Yersinia pestis
uacucucuguuuug

SEQ ID NO: 4174817 - RNA, 23 nt, Yersinia pestis
uacucugcggcaggcugaucuuc

SEQ ID NO: 4174818 - RNA, 17 nt, Yersinia pestis
uacucuguguagugggg

SEQ ID NO: 4174819 - RNA, 18 nt, Yersinia pestis
uacucuucgaucauucua

SEQ ID NO: 4174820 - RNA, 13 nt, Yersinia pestis
uacugauaaagug

SEQ ID NO: 4174821 - RNA, 22 nt, Yersinia pestis
uacugauaaagugcccaccguu

SEQ ID NO: 4174822 - RNA, 14 nt, Yersinia pestis
uacugauacaacaa

SEQ ID NO: 4174823 - RNA, 19 nt, Yersinia pestis
uacugaugaagccgccgga

SEQ ID NO: 4174824 - RNA, 13 nt, Yersinia pestis
uacugcauuucaa

SEQ ID NO: 4174825 - RNA, 17 nt, Yersinia pestis
uacugcauuucaacaaa

SEQ ID NO: 4174826 - RNA, 15 nt, Yersinia pestis
uacugcggcuuucug

SEQ ID NO: 4174827 - RNA, 20 nt, Yersinia pestis
uacugcggcuuucugccugu

SEQ ID NO: 4174828 - RNA, 18 nt, Yersinia pestis
uacugcgguccuacccuu

SEQ ID NO: 4174829 - RNA, 16 nt, Yersinia pestis
uacugcucuaucucuu

SEQ ID NO: 4174830 - RNA, 15 nt, Yersinia pestis
uacugcuuaccuugu

SEQ ID NO: 4174831 - RNA, 18 nt, Yersinia pestis
uacugcuuuucuaccuga

SEQ ID NO: 4174832 - RNA, 18 nt, Yersinia pestis
uacuggcuaucuuaugac

SEQ ID NO: 4174833 - RNA, 22 nt, Yersinia pestis
uacugggcuuauuaauuaauga

SEQ ID NO: 4174834 - RNA, 17 nt, Yersinia pestis
uacuggucucaaggucu

SEQ ID NO: 4174835 - RNA, 16 nt, Yersinia pestis
uacugucauuuccucc

SEQ ID NO: 4174836 - RNA, 14 nt, Yersinia pestis
uacuguccucaaac

SEQ ID NO: 4174837 - RNA, 17 nt, Yersinia pestis
uacuguggucaguggug

SEQ ID NO: 4174838 - RNA, 14 nt, Yersinia pestis
uacuguuaguucag

SEQ ID NO: 4174839 - RNA, 16 nt, Yersinia pestis
uacuguuccggcgcga

SEQ ID NO: 4174840 - RNA, 22 nt, Yersinia pestis
uacuguucugggggugauauuu

SEQ ID NO: 4174841 - RNA, 13 nt, Yersinia pestis
uacuguuuucauu

SEQ ID NO: 4174842 - RNA, 14 nt, Yersinia pestis
uacuguuuucauua

SEQ ID NO: 4174843 - RNA, 22 nt, Yersinia pestis
uacuuaacaaucagugcaauaa

SEQ ID NO: 4174844 - RNA, 16 nt, Yersinia pestis
uacuuagcaauaauag

SEQ ID NO: 4174845 - RNA, 17 nt, Yersinia pestis
uacuuagcaauaauaga

SEQ ID NO: 4174846 - RNA, 18 nt, Yersinia pestis
uacuucaaaacuaauauu

SEQ ID NO: 4174847 - RNA, 20 nt, Yersinia pestis
uacuucaaaugacauucuuu

SEQ ID NO: 4174848 - RNA, 15 nt, Yersinia pestis
uacuucaggccaaua

SEQ ID NO: 4174849 - RNA, 22 nt, Yersinia pestis
uacuucauaauucagcaaacuc

SEQ ID NO: 4174850 - RNA, 16 nt, Yersinia pestis
uacuuccaauaaguca

SEQ ID NO: 4174851 - RNA, 20 nt, Yersinia pestis
uacuucgaugauuauuuugu

SEQ ID NO: 4174852 - RNA, 16 nt, Yersinia pestis
uacuucuuuuuaacga

SEQ ID NO: 4174853 - RNA, 23 nt, Yersinia pestis
uacuuuauuuaaaauuaauaguu

SEQ ID NO: 4174854 - RNA, 22 nt, Yersinia pestis
uacuuucccauagcuggcuuca

SEQ ID NO: 4174855 - RNA, 13 nt, Yersinia pestis
uacuuuccuuccu

SEQ ID NO: 4174856 - RNA, 20 nt, Yersinia pestis
uacuuugauucaaaaugcca

SEQ ID NO: 4174857 - RNA, 21 nt, Yersinia pestis
uacuuugauucaaaaugccag

SEQ ID NO: 4174858 - RNA, 18 nt, Yersinia pestis
uacuuugcgcgcuguggc

SEQ ID NO: 4174859 - RNA, 23 nt, Yersinia pestis
uagaaaaaucacauacuggcauu

SEQ ID NO: 4174860 - RNA, 16 nt, Yersinia pestis
uagaaaagcgccauca

SEQ ID NO: 4174861 - RNA, 22 nt, Yersinia pestis
uagaaacuaagaguccuuaaaa

SEQ ID NO: 4174862 - RNA, 23 nt, Yersinia pestis
uagaaauauaacugcgaccaaaa

SEQ ID NO: 4174863 - RNA, 22 nt, Yersinia pestis
uagaaauucaacuugccugaaa

SEQ ID NO: 4174864 - RNA, 19 nt, Yersinia pestis
uagaaccggaauaaaucag

SEQ ID NO: 4174865 - RNA, 14 nt, Yersinia pestis
uagaaccggcugac

SEQ ID NO: 4174866 - RNA, 21 nt, Yersinia pestis
uagaacuauuggucaaucuag

SEQ ID NO: 4174867 - RNA, 13 nt, Yersinia pestis
uagaagcggaaua

SEQ ID NO: 4174868 - RNA, 20 nt, Yersinia pestis
uagaauaaguugaugcagua

SEQ ID NO: 4174869 - RNA, 20 nt, Yersinia pestis
uagaauacaggguaaauuau

SEQ ID NO: 4174870 - RNA, 21 nt, Yersinia pestis
uagaauacaggguaaauuauu

SEQ ID NO: 4174871 - RNA, 22 nt, Yersinia pestis
uagaauacaggguaaauuauuu

SEQ ID NO: 4174872 - RNA, 16 nt, Yersinia pestis
uagaauuuaagauacc

SEQ ID NO: 4174873 - RNA, 19 nt, Yersinia pestis
uagaauuuaagauaccagc

SEQ ID NO: 4174874 - RNA, 22 nt, Yersinia pestis
uagaauuuucucauuaauaaug

SEQ ID NO: 4174875 - RNA, 14 nt, Yersinia pestis
uagacaagcgcagu

SEQ ID NO: 4174876 - RNA, 22 nt, Yersinia pestis
uagacagaagcguaaagcaccc

SEQ ID NO: 4174877 - RNA, 16 nt, Yersinia pestis
uagaccaaugaauuac

SEQ ID NO: 4174878 - RNA, 14 nt, Yersinia pestis
uagaccguagaaac

SEQ ID NO: 4174879 - RNA, 12 nt, Yersinia pestis
uagacgaaggca

SEQ ID NO: 4174880 - RNA, 17 nt, Yersinia pestis
uagacgaaggcacggcc

SEQ ID NO: 4174881 - RNA, 12 nt, Yersinia pestis
uagacgacacaa

SEQ ID NO: 4174882 - RNA, 17 nt, Yersinia pestis
uagacgacacaaaugcu

SEQ ID NO: 4174883 - RNA, 20 nt, Yersinia pestis
uagacgacacaaaugcugug

SEQ ID NO: 4174884 - RNA, 14 nt, Yersinia pestis
uagacgucagauua

SEQ ID NO: 4174885 - RNA, 20 nt, Yersinia pestis
uagacgucagauuagcuuua

SEQ ID NO: 4174886 - RNA, 20 nt, Yersinia pestis
uagacgucagauuaguuuua

SEQ ID NO: 4174887 - RNA, 17 nt, Yersinia pestis
uagacuguuuuauuaua

SEQ ID NO: 4174888 - RNA, 21 nt, Yersinia pestis
uagacuguuuuauuauauauu

SEQ ID NO: 4174889 - RNA, 22 nt, Yersinia pestis
uagagagaaaaaguauugcacu

SEQ ID NO: 4174890 - RNA, 18 nt, Yersinia pestis
uagagagaacagcgaauc

SEQ ID NO: 4174891 - RNA, 19 nt, Yersinia pestis
uagagagaacagcgaauca

SEQ ID NO: 4174892 - RNA, 22 nt, Yersinia pestis
uagagcauaacugguggcaggc

SEQ ID NO: 4174893 - RNA, 22 nt, Yersinia pestis
uagagcuguuuggcauggauau

SEQ ID NO: 4174894 - RNA, 19 nt, Yersinia pestis
uagagcuuccagugcauua

SEQ ID NO: 4174895 - RNA, 14 nt, Yersinia pestis
uagaguaaaacuga

SEQ ID NO: 4174896 - RNA, 22 nt, Yersinia pestis
uagagucacagaggaaucaaag

SEQ ID NO: 4174897 - RNA, 19 nt, Yersinia pestis
uagagugaaguaucaccac

SEQ ID NO: 4174898 - RNA, 13 nt, Yersinia pestis
uagagugagaaua

SEQ ID NO: 4174899 - RNA, 14 nt, Yersinia pestis
uagaguugauaaac

SEQ ID NO: 4174900 - RNA, 16 nt, Yersinia pestis
uagaguugauaaacaa

SEQ ID NO: 4174901 - RNA, 17 nt, Yersinia pestis
uagaguugauaaacaau

SEQ ID NO: 4174902 - RNA, 14 nt, Yersinia pestis
uagauacaauucac

SEQ ID NO: 4174903 - RNA, 16 nt, Yersinia pestis
uagauaccgcaaccau

SEQ ID NO: 4174904 - RNA, 16 nt, Yersinia pestis
uagauacugaaauaua

SEQ ID NO: 4174905 - RNA, 16 nt, Yersinia pestis
uagauagaaaucacug

SEQ ID NO: 4174906 - RNA, 17 nt, Yersinia pestis
uagauaguacuuagcaa

SEQ ID NO: 4174907 - RNA, 22 nt, Yersinia pestis
uagaucaacauuccauaccuga

SEQ ID NO: 4174908 - RNA, 19 nt, Yersinia pestis
uagaucgagucaucggguu

SEQ ID NO: 4174909 - RNA, 20 nt, Yersinia pestis
uagaucggguaaaccaauau

SEQ ID NO: 4174910 - RNA, 21 nt, Yersinia pestis
uagaucuccugcaacgccuuc

SEQ ID NO: 4174911 - RNA, 13 nt, Yersinia pestis
uagaugucagauu

SEQ ID NO: 4174912 - RNA, 13 nt, Yersinia pestis
uagauuauuuucu

SEQ ID NO: 4174913 - RNA, 11 nt, Yersinia pestis
uagauugcgcg

SEQ ID NO: 4174914 - RNA, 12 nt, Yersinia pestis
uagauuggcauc

SEQ ID NO: 4174915 - RNA, 18 nt, Yersinia pestis
uagauuuaaccccaauuc

SEQ ID NO: 4174916 - RNA, 15 nt, Yersinia pestis
uagauuucacugccg

SEQ ID NO: 4174917 - RNA, 16 nt, Yersinia pestis
uagauuucacuuuccc

SEQ ID NO: 4174918 - RNA, 17 nt, Yersinia pestis
uagcaaaacugaggucg

SEQ ID NO: 4174919 - RNA, 20 nt, Yersinia pestis
uagcaaacccaccugaaucu

SEQ ID NO: 4174920 - RNA, 15 nt, Yersinia pestis
uagcaacacaucggu

SEQ ID NO: 4174921 - RNA, 13 nt, Yersinia pestis
uagcaacugccaa

SEQ ID NO: 4174922 - RNA, 13 nt, Yersinia pestis
uagcaagccaaaa

SEQ ID NO: 4174923 - RNA, 15 nt, Yersinia pestis
uagcaauauaauaau

SEQ ID NO: 4174924 - RNA, 23 nt, Yersinia pestis
uagcaaucucugcaguacagaua

SEQ ID NO: 4174925 - RNA, 22 nt, Yersinia pestis
uagcaaugagacaagagcaaug

SEQ ID NO: 4174926 - RNA, 14 nt, Yersinia pestis
uagcaggcagcacg

SEQ ID NO: 4174927 - RNA, 15 nt, Yersinia pestis
uagcaguauuagcuu

SEQ ID NO: 4174928 - RNA, 22 nt, Yersinia pestis
uagcaguauuagcuuuacuggu

SEQ ID NO: 4174929 - RNA, 19 nt, Yersinia pestis
uagcauaaguaucagcggc

SEQ ID NO: 4174930 - RNA, 16 nt, Yersinia pestis
uagcaucaucgcacug

SEQ ID NO: 4174931 - RNA, 16 nt, Yersinia pestis
uagcaugaaugaaaua

SEQ ID NO: 4174932 - RNA, 21 nt, Yersinia pestis
uagcauggacgcuuuacucuu

SEQ ID NO: 4174933 - RNA, 16 nt, Yersinia pestis
uagcauggucaucgcu

SEQ ID NO: 4174934 - RNA, 14 nt, Yersinia pestis
uagccaaauagcgg

SEQ ID NO: 4174935 - RNA, 16 nt, Yersinia pestis
uagccacuuaauaaug

SEQ ID NO: 4174936 - RNA, 19 nt, Yersinia pestis
uagccagaaauagcaccau

SEQ ID NO: 4174937 - RNA, 13 nt, Yersinia pestis
uagccagaagcca

SEQ ID NO: 4174938 - RNA, 19 nt, Yersinia pestis
uagccagccaccgcacacu

SEQ ID NO: 4174939 - RNA, 13 nt, Yersinia pestis
uagccagcguggu

SEQ ID NO: 4174940 - RNA, 18 nt, Yersinia pestis
uagccaugagguuuauuc

SEQ ID NO: 4174941 - RNA, 23 nt, Yersinia pestis
uagccaugagguuuauuccuugu

SEQ ID NO: 4174942 - RNA, 20 nt, Yersinia pestis
uagccauucaaaaauuaaau

SEQ ID NO: 4174943 - RNA, 12 nt, Yersinia pestis
uagccauuucaa

SEQ ID NO: 4174944 - RNA, 14 nt, Yersinia pestis
uagcccaaaauaga

SEQ ID NO: 4174945 - RNA, 12 nt, Yersinia pestis
uagcccaaggcg

SEQ ID NO: 4174946 - RNA, 17 nt, Yersinia pestis
uagcccaguaccgcugg

SEQ ID NO: 4174947 - RNA, 12 nt, Yersinia pestis
uagcccagugcg

SEQ ID NO: 4174948 - RNA, 19 nt, Yersinia pestis
uagccccaacacuggggcg

SEQ ID NO: 4174949 - RNA, 13 nt, Yersinia pestis
uagcccuucagca

SEQ ID NO: 4174950 - RNA, 18 nt, Yersinia pestis
uagccgaaccccuagcca

SEQ ID NO: 4174951 - RNA, 14 nt, Yersinia pestis
uagccgccgcuugg

SEQ ID NO: 4174952 - RNA, 20 nt, Yersinia pestis
uagccuuuuugcaucaccau

SEQ ID NO: 4174953 - RNA, 22 nt, Yersinia pestis
uagccuuuuugcaucaccauca

SEQ ID NO: 4174954 - RNA, 21 nt, Yersinia pestis
uagcgaaauaucaggaugaac

SEQ ID NO: 4174955 - RNA, 15 nt, Yersinia pestis
uagcgaaucacauca

SEQ ID NO: 4174956 - RNA, 17 nt, Yersinia pestis
uagcgaaucacaucauu

SEQ ID NO: 4174957 - RNA, 17 nt, Yersinia pestis
uagcgacacccucagag

SEQ ID NO: 4174958 - RNA, 14 nt, Yersinia pestis
uagcgauauaacuc

SEQ ID NO: 4174959 - RNA, 15 nt, Yersinia pestis
uagcgaugacugagu

SEQ ID NO: 4174960 - RNA, 21 nt, Yersinia pestis
uagcgcaaagagaacgggcaa

SEQ ID NO: 4174961 - RNA, 22 nt, Yersinia pestis
uagcgccgauggugugcagcaa

SEQ ID NO: 4174962 - RNA, 18 nt, Yersinia pestis
uagcgcuaagcccgugau

SEQ ID NO: 4174963 - RNA, 17 nt, Yersinia pestis
uagcgcugcagcaucaa

SEQ ID NO: 4174964 - RNA, 17 nt, Yersinia pestis
uagcggguaauaccggg

SEQ ID NO: 4174965 - RNA, 22 nt, Yersinia pestis
uagcgguguuagcccaaggcga

SEQ ID NO: 4174966 - RNA, 13 nt, Yersinia pestis
uagcgugccgcag

SEQ ID NO: 4174967 - RNA, 16 nt, Yersinia pestis
uagcguuaacgauaua

SEQ ID NO: 4174968 - RNA, 14 nt, Yersinia pestis
uagcuaaccuuaac

SEQ ID NO: 4174969 - RNA, 15 nt, Yersinia pestis
uagcuaaccuuaacu

SEQ ID NO: 4174970 - RNA, 13 nt, Yersinia pestis
uagcuaugcaguu

SEQ ID NO: 4174971 - RNA, 19 nt, Yersinia pestis
uagcuauuggcugauucaa

SEQ ID NO: 4174972 - RNA, 13 nt, Yersinia pestis
uagcucaagggca

SEQ ID NO: 4174973 - RNA, 15 nt, Yersinia pestis
uagcucagaaaauaa

SEQ ID NO: 4174974 - RNA, 17 nt, Yersinia pestis
uagcucgccuucauuau

SEQ ID NO: 4174975 - RNA, 13 nt, Yersinia pestis
uagcucuuccagc

SEQ ID NO: 4174976 - RNA, 15 nt, Yersinia pestis
uagcucuuccagcaa

SEQ ID NO: 4174977 - RNA, 18 nt, Yersinia pestis
uagcucuuccagcaacau

SEQ ID NO: 4174978 - RNA, 14 nt, Yersinia pestis
uagcugacacgcca

SEQ ID NO: 4174979 - RNA, 18 nt, Yersinia pestis
uagcugaucgggcuuuac

SEQ ID NO: 4174980 - RNA, 18 nt, Yersinia pestis
uagcugcgcccgguuacu

SEQ ID NO: 4174981 - RNA, 18 nt, Yersinia pestis
uagcuggcggauaaaaau

SEQ ID NO: 4174982 - RNA, 17 nt, Yersinia pestis
uagcugucguaauaguu

SEQ ID NO: 4174983 - RNA, 17 nt, Yersinia pestis
uagcuuaacgcccugcc

SEQ ID NO: 4174984 - RNA, 16 nt, Yersinia pestis
uagcuuauccagaucc

SEQ ID NO: 4174985 - RNA, 23 nt, Yersinia pestis
uagcuuauccccugagaaacauc

SEQ ID NO: 4174986 - RNA, 13 nt, Yersinia pestis
uagcuuuuuaaau

SEQ ID NO: 4174987 - RNA, 14 nt, Yersinia pestis
uagcuuuuuaaaua

SEQ ID NO: 4174988 - RNA, 23 nt, Yersinia pestis
uaggaucgaaugaucagaggcug

SEQ ID NO: 4174989 - RNA, 22 nt, Yersinia pestis
uaggcaagaacauuuccacaau

SEQ ID NO: 4174990 - RNA, 15 nt, Yersinia pestis
uaggcagaauaguca

SEQ ID NO: 4174991 - RNA, 19 nt, Yersinia pestis
uaggcagcaaacgcacaac

SEQ ID NO: 4174992 - RNA, 20 nt, Yersinia pestis
uaggcaggcccgcuucccua

SEQ ID NO: 4174993 - RNA, 13 nt, Yersinia pestis
uaggcaucugcca

SEQ ID NO: 4174994 - RNA, 20 nt, Yersinia pestis
uaggcaucuuucaguuuuau

SEQ ID NO: 4174995 - RNA, 21 nt, Yersinia pestis
uaggccaauagaaaaacacug

SEQ ID NO: 4174996 - RNA, 14 nt, Yersinia pestis
uaggccacuuaaca

SEQ ID NO: 4174997 - RNA, 14 nt, Yersinia pestis
uaggcuacagcuac

SEQ ID NO: 4174998 - RNA, 17 nt, Yersinia pestis
uaggcuauugacaaagu

SEQ ID NO: 4174999 - RNA, 15 nt, Yersinia pestis
uaggcuauuuuacuu

SEQ ID NO: 4175000 - RNA, 18 nt, Yersinia pestis
uaggcuauuuuacuugcc

SEQ ID NO: 4175001 - RNA, 16 nt, Yersinia pestis
uaggcucagcauggaa

SEQ ID NO: 4175002 - RNA, 14 nt, Yersinia pestis
uaggcucgagccgc

SEQ ID NO: 4175003 - RNA, 22 nt, Yersinia pestis
uaggcucgagccgcgccauccu

SEQ ID NO: 4175004 - RNA, 16 nt, Yersinia pestis
uaggcuugagguuauu

SEQ ID NO: 4175005 - RNA, 13 nt, Yersinia pestis
uaggcuuuaaccu

SEQ ID NO: 4175006 - RNA, 14 nt, Yersinia pestis
uaggcuuuuuacuu

SEQ ID NO: 4175007 - RNA, 14 nt, Yersinia pestis
uagggaugaguguu

SEQ ID NO: 4175008 - RNA, 18 nt, Yersinia pestis
uagggauuuuaagcagcc

SEQ ID NO: 4175009 - RNA, 18 nt, Yersinia pestis
uagggccguuuaccuugu

SEQ ID NO: 4175010 - RNA, 21 nt, Yersinia pestis
uaggggccaccaaauaaaaca

SEQ ID NO: 4175011 - RNA, 13 nt, Yersinia pestis
uaggguugugugg

SEQ ID NO: 4175012 - RNA, 16 nt, Yersinia pestis
uaggucagugguuuua

SEQ ID NO: 4175013 - RNA, 17 nt, Yersinia pestis
uaggucagugguuuuau

SEQ ID NO: 4175014 - RNA, 19 nt, Yersinia pestis
uaggugguaccugcacuga

SEQ ID NO: 4175015 - RNA, 20 nt, Yersinia pestis
uaggugguaccugcacugag

SEQ ID NO: 4175016 - RNA, 18 nt, Yersinia pestis
uaguaacaaaaugcggug

SEQ ID NO: 4175017 - RNA, 14 nt, Yersinia pestis
uaguaacuauuuac

SEQ ID NO: 4175018 - RNA, 19 nt, Yersinia pestis
uaguaacuauuuacauaau

SEQ ID NO: 4175019 - RNA, 22 nt, Yersinia pestis
uaguaacuguaaggccaaaccc

SEQ ID NO: 4175020 - RNA, 20 nt, Yersinia pestis
uaguaagcaugccauccugc

SEQ ID NO: 4175021 - RNA, 17 nt, Yersinia pestis
uaguaagcuucgaccca

SEQ ID NO: 4175022 - RNA, 14 nt, Yersinia pestis
uaguaauaauuuuu

SEQ ID NO: 4175023 - RNA, 14 nt, Yersinia pestis
uaguaaugacgcua

SEQ ID NO: 4175024 - RNA, 23 nt, Yersinia pestis
uaguacguagcgauaacagauau

SEQ ID NO: 4175025 - RNA, 17 nt, Yersinia pestis
uaguaggucacauagcu

SEQ ID NO: 4175026 - RNA, 13 nt, Yersinia pestis
uaguauaaauacc

SEQ ID NO: 4175027 - RNA, 18 nt, Yersinia pestis
uagucaauguucucuggg

SEQ ID NO: 4175028 - RNA, 14 nt, Yersinia pestis
uagucaucacuaac

SEQ ID NO: 4175029 - RNA, 14 nt, Yersinia pestis
uagucauuaagaau

SEQ ID NO: 4175030 - RNA, 15 nt, Yersinia pestis
uagucccccuccggc

SEQ ID NO: 4175031 - RNA, 13 nt, Yersinia pestis
uagucggcauuaa

SEQ ID NO: 4175032 - RNA, 17 nt, Yersinia pestis
uagucuccaaauucauu

SEQ ID NO: 4175033 - RNA, 15 nt, Yersinia pestis
uagucuucaucaucc

SEQ ID NO: 4175034 - RNA, 18 nt, Yersinia pestis
uagucuuuuuaauaugug

SEQ ID NO: 4175035 - RNA, 22 nt, Yersinia pestis
uagugaaaacguuaacugcagu

SEQ ID NO: 4175036 - RNA, 19 nt, Yersinia pestis
uagugaaguaauaaaaauc

SEQ ID NO: 4175037 - RNA, 21 nt, Yersinia pestis
uagugagccgugagaauagac

SEQ ID NO: 4175038 - RNA, 15 nt, Yersinia pestis
uagugagucaggaaa

SEQ ID NO: 4175039 - RNA, 16 nt, Yersinia pestis
uagugaguuauucgcc

SEQ ID NO: 4175040 - RNA, 15 nt, Yersinia pestis
uagugaugcaguaaa

SEQ ID NO: 4175041 - RNA, 13 nt, Yersinia pestis
uagugcacagaua

SEQ ID NO: 4175042 - RNA, 13 nt, Yersinia pestis
uagugccacaaca

SEQ ID NO: 4175043 - RNA, 14 nt, Yersinia pestis
uagugccuaauaaa

SEQ ID NO: 4175044 - RNA, 22 nt, Yersinia pestis
uagugcuuccaacucaccuaaa

SEQ ID NO: 4175045 - RNA, 15 nt, Yersinia pestis
uaguggcacaaauaa

SEQ ID NO: 4175046 - RNA, 23 nt, Yersinia pestis
uaguggugagcgccaugcgcuuu

SEQ ID NO: 4175047 - RNA, 15 nt, Yersinia pestis
uaguuaaucgcagca

SEQ ID NO: 4175048 - RNA, 17 nt, Yersinia pestis
uaguuaaucgcagcaga

SEQ ID NO: 4175049 - RNA, 15 nt, Yersinia pestis
uaguuaauuuaauuu

SEQ ID NO: 4175050 - RNA, 21 nt, Yersinia pestis
uaguuaucucccauuaauuaa

SEQ ID NO: 4175051 - RNA, 23 nt, Yersinia pestis
uaguuaucucccauuaauuaauc

SEQ ID NO: 4175052 - RNA, 23 nt, Yersinia pestis
uaguuaucugggcggauaaggau

SEQ ID NO: 4175053 - RNA, 22 nt, Yersinia pestis
uaguuauugauuaauuuuucau

SEQ ID NO: 4175054 - RNA, 20 nt, Yersinia pestis
uaguucaauggucaugcaca

SEQ ID NO: 4175055 - RNA, 22 nt, Yersinia pestis
uaguucacgauggaaaaaauac

SEQ ID NO: 4175056 - RNA, 21 nt, Yersinia pestis
uaguucgccacgcugauacau

SEQ ID NO: 4175057 - RNA, 19 nt, Yersinia pestis
uaguucuucugauaaaaca

SEQ ID NO: 4175058 - RNA, 21 nt, Yersinia pestis
uaguucuucugauaaaacagu

SEQ ID NO: 4175059 - RNA, 13 nt, Yersinia pestis
uaguuuauuuuau

SEQ ID NO: 4175060 - RNA, 17 nt, Yersinia pestis
uaguuuauuuuauuuaa

SEQ ID NO: 4175061 - RNA, 16 nt, Yersinia pestis
uauaaaagcacagaca

SEQ ID NO: 4175062 - RNA, 21 nt, Yersinia pestis
uauaaaagcacagacaaacaa

SEQ ID NO: 4175063 - RNA, 19 nt, Yersinia pestis
uauaaaccggucauacauu

SEQ ID NO: 4175064 - RNA, 21 nt, Yersinia pestis
uauaaacgccuccgaucagcu

SEQ ID NO: 4175065 - RNA, 17 nt, Yersinia pestis
uauaaacuaauaucuuu

SEQ ID NO: 4175066 - RNA, 15 nt, Yersinia pestis
uauaaacuugauuca

SEQ ID NO: 4175067 - RNA, 23 nt, Yersinia pestis
uauaaagcauuuaucauauuaac

SEQ ID NO: 4175068 - RNA, 13 nt, Yersinia pestis
uauaaauaaaaua

SEQ ID NO: 4175069 - RNA, 12 nt, Yersinia pestis
uauaaauuaaaa

SEQ ID NO: 4175070 - RNA, 13 nt, Yersinia pestis
uauaaauuaaaaa

SEQ ID NO: 4175071 - RNA, 17 nt, Yersinia pestis
uauaaauuaaaaagagu

SEQ ID NO: 4175072 - RNA, 22 nt, Yersinia pestis
uauaaauuacucguauaaaaaa

SEQ ID NO: 4175073 - RNA, 14 nt, Yersinia pestis
uauaaauuuaauaa

SEQ ID NO: 4175074 - RNA, 16 nt, Yersinia pestis
uauaaauuuaauaaaa

SEQ ID NO: 4175075 - RNA, 17 nt, Yersinia pestis
uauaaauuuaauaaaaa

SEQ ID NO: 4175076 - RNA, 18 nt, Yersinia pestis
uauaaauuuaauaaaaac

SEQ ID NO: 4175077 - RNA, 15 nt, Yersinia pestis
uauaaauuuuaaguu

SEQ ID NO: 4175078 - RNA, 21 nt, Yersinia pestis
uauaacaauguuuauccgcua

SEQ ID NO: 4175079 - RNA, 12 nt, Yersinia pestis
uauaacauaaua

SEQ ID NO: 4175080 - RNA, 18 nt, Yersinia pestis
uauaacauaauaaauuaa

SEQ ID NO: 4175081 - RNA, 19 nt, Yersinia pestis
uauaacauaauaaauuaau

SEQ ID NO: 4175082 - RNA, 21 nt, Yersinia pestis
uauaacauaauaaauuaauag

SEQ ID NO: 4175083 - RNA, 21 nt, Yersinia pestis
uauaaccauuaacaauauuau

SEQ ID NO: 4175084 - RNA, 16 nt, Yersinia pestis
uauaacgacuauuuau

SEQ ID NO: 4175085 - RNA, 21 nt, Yersinia pestis
uauaacgcccggcaauaauag

SEQ ID NO: 4175086 - RNA, 15 nt, Yersinia pestis
uauaagcaauaccga

SEQ ID NO: 4175087 - RNA, 21 nt, Yersinia pestis
uauaagcagcaccaauaucaa

SEQ ID NO: 4175088 - RNA, 16 nt, Yersinia pestis
uauaagcgcucaaaua

SEQ ID NO: 4175089 - RNA, 19 nt, Yersinia pestis
uauaaguacuuucaaagaa

SEQ ID NO: 4175090 - RNA, 15 nt, Yersinia pestis
uauaaucaucuacaa

SEQ ID NO: 4175091 - RNA, 18 nt, Yersinia pestis
uauaaucaucuacaacau

SEQ ID NO: 4175092 - RNA, 14 nt, Yersinia pestis
uauaauccaaaaua

SEQ ID NO: 4175093 - RNA, 21 nt, Yersinia pestis
uauaauccaaaauaauauaau

SEQ ID NO: 4175094 - RNA, 22 nt, Yersinia pestis
uauaaugaugagguaauacuca

SEQ ID NO: 4175095 - RNA, 22 nt, Yersinia pestis
uauaaugcagggcgacauuaau

SEQ ID NO: 4175096 - RNA, 15 nt, Yersinia pestis
uauaauuaacagcau

SEQ ID NO: 4175097 - RNA, 13 nt, Yersinia pestis
uauaauuauugaa

SEQ ID NO: 4175098 - RNA, 13 nt, Yersinia pestis
uauaauucaauau

SEQ ID NO: 4175099 - RNA, 23 nt, Yersinia pestis
uauaauugaagauuuaaauaaca

SEQ ID NO: 4175100 - RNA, 18 nt, Yersinia pestis
uauaauuucuugucaccu

SEQ ID NO: 4175101 - RNA, 19 nt, Yersinia pestis
uauacaaggcacaucucca

SEQ ID NO: 4175102 - RNA, 19 nt, Yersinia pestis
uauacaauccaaccuauau

SEQ ID NO: 4175103 - RNA, 22 nt, Yersinia pestis
uauacaauugccugauuuuuau

SEQ ID NO: 4175104 - RNA, 22 nt, Yersinia pestis
uauacaccucaacgugauaugc

SEQ ID NO: 4175105 - RNA, 23 nt, Yersinia pestis
uauacauacccgucauaccguua

SEQ ID NO: 4175106 - RNA, 19 nt, Yersinia pestis
uauacauacgucuccauuu

SEQ ID NO: 4175107 - RNA, 19 nt, Yersinia pestis
uauaccaacucugaaguaa

SEQ ID NO: 4175108 - RNA, 23 nt, Yersinia pestis
uauacccaccagagaccacagau

SEQ ID NO: 4175109 - RNA, 15 nt, Yersinia pestis
uauacccgucauaaa

SEQ ID NO: 4175110 - RNA, 15 nt, Yersinia pestis
uauaccgauuaccgg

SEQ ID NO: 4175111 - RNA, 19 nt, Yersinia pestis
uauacggcggcuacuggua

SEQ ID NO: 4175112 - RNA, 14 nt, Yersinia pestis
uauacggcuauuuu

SEQ ID NO: 4175113 - RNA, 13 nt, Yersinia pestis
uauacuaaaacag

SEQ ID NO: 4175114 - RNA, 17 nt, Yersinia pestis
uauacuaaaacagcuca

SEQ ID NO: 4175115 - RNA, 19 nt, Yersinia pestis
uauacuaaaacagcucacu

SEQ ID NO: 4175116 - RNA, 15 nt, Yersinia pestis
uauacuaaagaaaua

SEQ ID NO: 4175117 - RNA, 13 nt, Yersinia pestis
uauacucugucug

SEQ ID NO: 4175118 - RNA, 20 nt, Yersinia pestis
uauagacuguuuuauuauau

SEQ ID NO: 4175119 - RNA, 14 nt, Yersinia pestis
uauagagaaaucua

SEQ ID NO: 4175120 - RNA, 14 nt, Yersinia pestis
uauagagugcaauu

SEQ ID NO: 4175121 - RNA, 17 nt, Yersinia pestis
uauagcaaucauuuaua

SEQ ID NO: 4175122 - RNA, 20 nt, Yersinia pestis
uauagcgguaaccgacauca

SEQ ID NO: 4175123 - RNA, 18 nt, Yersinia pestis
uauaggcuauuuuacuug

SEQ ID NO: 4175124 - RNA, 23 nt, Yersinia pestis
uauaggcucaaugcgaaaaaaua

SEQ ID NO: 4175125 - RNA, 14 nt, Yersinia pestis
uauaggguauaugc

SEQ ID NO: 4175126 - RNA, 17 nt, Yersinia pestis
uauaggguuguguggua

SEQ ID NO: 4175127 - RNA, 13 nt, Yersinia pestis
uauaguuaaaacu

SEQ ID NO: 4175128 - RNA, 22 nt, Yersinia pestis
uauaguuuauuuuauuuaauca

SEQ ID NO: 4175129 - RNA, 16 nt, Yersinia pestis
uauaguuuuuacgcau

SEQ ID NO: 4175130 - RNA, 11 nt, Yersinia pestis
uauauaaaaua

SEQ ID NO: 4175131 - RNA, 16 nt, Yersinia pestis
uauauaaaauaaauuu

SEQ ID NO: 4175132 - RNA, 22 nt, Yersinia pestis
uauauaacagccauuuauauaa

SEQ ID NO: 4175133 - RNA, 23 nt, Yersinia pestis
uauauaauugaagauuuaaauaa

SEQ ID NO: 4175134 - RNA, 13 nt, Yersinia pestis
uauauacagucaa

SEQ ID NO: 4175135 - RNA, 21 nt, Yersinia pestis
uauauacccagcaucauaaga

SEQ ID NO: 4175136 - RNA, 18 nt, Yersinia pestis
uauauacccguaauauuu

SEQ ID NO: 4175137 - RNA, 20 nt, Yersinia pestis
uauauacccgucauaaauaa

SEQ ID NO: 4175138 - RNA, 17 nt, Yersinia pestis
uauauagagaaaucuac

SEQ ID NO: 4175139 - RNA, 18 nt, Yersinia pestis
uauauagcccagcguucu

SEQ ID NO: 4175140 - RNA, 17 nt, Yersinia pestis
uauauauccaaaauaau

SEQ ID NO: 4175141 - RNA, 18 nt, Yersinia pestis
uauauauuuugaauauuu

SEQ ID NO: 4175142 - RNA, 16 nt, Yersinia pestis
uauauauuuuuaauuu

SEQ ID NO: 4175143 - RNA, 15 nt, Yersinia pestis
uauaucaaggcggca

SEQ ID NO: 4175144 - RNA, 18 nt, Yersinia pestis
uauaucaaggcggcagag

SEQ ID NO: 4175145 - RNA, 17 nt, Yersinia pestis
uauaucacuauuucaga

SEQ ID NO: 4175146 - RNA, 17 nt, Yersinia pestis
uauaucacuauuucagg

SEQ ID NO: 4175147 - RNA, 17 nt, Yersinia pestis
uauaucacuucugcugu

SEQ ID NO: 4175148 - RNA, 19 nt, Yersinia pestis
uauaucaguugugggucgc

SEQ ID NO: 4175149 - RNA, 14 nt, Yersinia pestis
uauauccaaaauaa

SEQ ID NO: 4175150 - RNA, 19 nt, Yersinia pestis
uauaucccaauaauagcua

SEQ ID NO: 4175151 - RNA, 16 nt, Yersinia pestis
uauaucuccaccaacg

SEQ ID NO: 4175152 - RNA, 14 nt, Yersinia pestis
uauaugauaauagu

SEQ ID NO: 4175153 - RNA, 16 nt, Yersinia pestis
uauaugcugauaaaau

SEQ ID NO: 4175154 - RNA, 18 nt, Yersinia pestis
uauauguugggaaauaac

SEQ ID NO: 4175155 - RNA, 15 nt, Yersinia pestis
uauauucaauaucac

SEQ ID NO: 4175156 - RNA, 18 nt, Yersinia pestis
uauauucaauaucacuga

SEQ ID NO: 4175157 - RNA, 20 nt, Yersinia pestis
uauauuccacauacaaagca

SEQ ID NO: 4175158 - RNA, 11 nt, Yersinia pestis
uauauuccucg

SEQ ID NO: 4175159 - RNA, 17 nt, Yersinia pestis
uauauucuacaauguca

SEQ ID NO: 4175160 - RNA, 23 nt, Yersinia pestis
uauauucuacaaugucacgcuuu

SEQ ID NO: 4175161 - RNA, 14 nt, Yersinia pestis
uauauugauaaaag

SEQ ID NO: 4175162 - RNA, 22 nt, Yersinia pestis
uauauugaugacugaauuguca

SEQ ID NO: 4175163 - RNA, 17 nt, Yersinia pestis
uauauugcauuuaugau

SEQ ID NO: 4175164 - RNA, 12 nt, Yersinia pestis
uauauuuaauuu

SEQ ID NO: 4175165 - RNA, 15 nt, Yersinia pestis
uauauuuaauuuaaa

SEQ ID NO: 4175166 - RNA, 14 nt, Yersinia pestis
uauauuucaagcua

SEQ ID NO: 4175167 - RNA, 21 nt, Yersinia pestis
uauauuuugaauauuuuuaau

SEQ ID NO: 4175168 - RNA, 22 nt, Yersinia pestis
uauauuuugaauauuuuuaauc

SEQ ID NO: 4175169 - RNA, 13 nt, Yersinia pestis
uauauuuugagau

SEQ ID NO: 4175170 - RNA, 13 nt, Yersinia pestis
uauauuuuucuuu

SEQ ID NO: 4175171 - RNA, 23 nt, Yersinia pestis
uauauuuuuggggucugaauaua

SEQ ID NO: 4175172 - RNA, 12 nt, Yersinia pestis
uaucaaaacuga

SEQ ID NO: 4175173 - RNA, 13 nt, Yersinia pestis
uaucaaaacugau

SEQ ID NO: 4175174 - RNA, 19 nt, Yersinia pestis
uaucaaaacugauuaauag

SEQ ID NO: 4175175 - RNA, 14 nt, Yersinia pestis
uaucaaaaggauaa

SEQ ID NO: 4175176 - RNA, 23 nt, Yersinia pestis
uaucaaacagcacaucgccauua

SEQ ID NO: 4175177 - RNA, 19 nt, Yersinia pestis
uaucaaagugcuuaaccca

SEQ ID NO: 4175178 - RNA, 11 nt, Yersinia pestis
uaucaaaucag

SEQ ID NO: 4175179 - RNA, 21 nt, Yersinia pestis
uaucaacaauuuccauaucaa

SEQ ID NO: 4175180 - RNA, 22 nt, Yersinia pestis
uaucaacguagcugaauugcuu

SEQ ID NO: 4175181 - RNA, 13 nt, Yersinia pestis
uaucaauaccgaa

SEQ ID NO: 4175182 - RNA, 12 nt, Yersinia pestis
uaucaauagguc

SEQ ID NO: 4175183 - RNA, 15 nt, Yersinia pestis
uaucaauaggucagu

SEQ ID NO: 4175184 - RNA, 17 nt, Yersinia pestis
uaucaaucaaaaaauaa

SEQ ID NO: 4175185 - RNA, 24 nt, Yersinia pestis
uaucaaucagcugauaugaaaaau

SEQ ID NO: 4175186 - RNA, 13 nt, Yersinia pestis
uaucaaugaaaau

SEQ ID NO: 4175187 - RNA, 17 nt, Yersinia pestis
uaucaauggggaucugc

SEQ ID NO: 4175188 - RNA, 16 nt, Yersinia pestis
uaucaauugcuggcua

SEQ ID NO: 4175189 - RNA, 19 nt, Yersinia pestis
uaucaauuguuugcuauca

SEQ ID NO: 4175190 - RNA, 13 nt, Yersinia pestis
uaucacaucgccc

SEQ ID NO: 4175191 - RNA, 14 nt, Yersinia pestis
uaucacaucgcccu

SEQ ID NO: 4175192 - RNA, 12 nt, Yersinia pestis
uaucaccagguu

SEQ ID NO: 4175193 - RNA, 18 nt, Yersinia pestis
uaucaccccguuacggcu

SEQ ID NO: 4175194 - RNA, 21 nt, Yersinia pestis
uaucacgcugguuaucacagc

SEQ ID NO: 4175195 - RNA, 19 nt, Yersinia pestis
uaucacuagcgggccucag

SEQ ID NO: 4175196 - RNA, 19 nt, Yersinia pestis
uaucacuauaauuauuucu

SEQ ID NO: 4175197 - RNA, 15 nt, Yersinia pestis
uaucacuauuucagg

SEQ ID NO: 4175198 - RNA, 19 nt, Yersinia pestis
uaucacucgggauaugacu

SEQ ID NO: 4175199 - RNA, 22 nt, Yersinia pestis
uaucacugauacgaugcucacu

SEQ ID NO: 4175200 - RNA, 22 nt, Yersinia pestis
uaucacuguccaagaagccaag

SEQ ID NO: 4175201 - RNA, 16 nt, Yersinia pestis
uaucacuugggcauga

SEQ ID NO: 4175202 - RNA, 16 nt, Yersinia pestis
uaucagaaacagcagg

SEQ ID NO: 4175203 - RNA, 20 nt, Yersinia pestis
uaucagaaauacgcuuucca

SEQ ID NO: 4175204 - RNA, 18 nt, Yersinia pestis
uaucagaaccaagcaaua

SEQ ID NO: 4175205 - RNA, 22 nt, Yersinia pestis
uaucagccccuaaauccugcaa

SEQ ID NO: 4175206 - RNA, 21 nt, Yersinia pestis
uaucagccguuucuuucaaua

SEQ ID NO: 4175207 - RNA, 23 nt, Yersinia pestis
uaucaguaacgccguaucaccgg

SEQ ID NO: 4175208 - RNA, 20 nt, Yersinia pestis
uaucaguagcuagaauaagu

SEQ ID NO: 4175209 - RNA, 15 nt, Yersinia pestis
uaucagucuuuucaa

SEQ ID NO: 4175210 - RNA, 14 nt, Yersinia pestis
uaucaguugguuua

SEQ ID NO: 4175211 - RNA, 19 nt, Yersinia pestis
uaucauaaauaaaagauaa

SEQ ID NO: 4175212 - RNA, 23 nt, Yersinia pestis
uaucauaucgaccaugaauaauu

SEQ ID NO: 4175213 - RNA, 15 nt, Yersinia pestis
uaucauauucaucaa

SEQ ID NO: 4175214 - RNA, 15 nt, Yersinia pestis
uaucaucaccaaaca

SEQ ID NO: 4175215 - RNA, 12 nt, Yersinia pestis
uaucaucaccac

SEQ ID NO: 4175216 - RNA, 13 nt, Yersinia pestis
uaucaucagcaga

SEQ ID NO: 4175217 - RNA, 16 nt, Yersinia pestis
uaucauccccuauaua

SEQ ID NO: 4175218 - RNA, 15 nt, Yersinia pestis
uaucaucccuuaacc

SEQ ID NO: 4175219 - RNA, 14 nt, Yersinia pestis
uaucauuauugauu

SEQ ID NO: 4175220 - RNA, 13 nt, Yersinia pestis
uauccaaaauaau

SEQ ID NO: 4175221 - RNA, 12 nt, Yersinia pestis
uauccaauaagc

SEQ ID NO: 4175222 - RNA, 12 nt, Yersinia pestis
uauccaauaccg

SEQ ID NO: 4175223 - RNA, 15 nt, Yersinia pestis
uauccaauaccgaua

SEQ ID NO: 4175224 - RNA, 12 nt, Yersinia pestis
uauccaauggcu

SEQ ID NO: 4175225 - RNA, 15 nt, Yersinia pestis
uauccaccugaucau

SEQ ID NO: 4175226 - RNA, 22 nt, Yersinia pestis
uauccaccugaucaugccacga

SEQ ID NO: 4175227 - RNA, 14 nt, Yersinia pestis
uauccacuuggcua

SEQ ID NO: 4175228 - RNA, 11 nt, Yersinia pestis
uauccagcccu

SEQ ID NO: 4175229 - RNA, 13 nt, Yersinia pestis
uauccagccgcuc

SEQ ID NO: 4175230 - RNA, 21 nt, Yersinia pestis
uauccagcgucaccgauacuu

SEQ ID NO: 4175231 - RNA, 12 nt, Yersinia pestis
uauccaggcacu

SEQ ID NO: 4175232 - RNA, 17 nt, Yersinia pestis
uauccaggcacugccau

SEQ ID NO: 4175233 - RNA, 21 nt, Yersinia pestis
uauccagguuguaccgccaua

SEQ ID NO: 4175234 - RNA, 23 nt, Yersinia pestis
uauccaucaaccacgguuuaauc

SEQ ID NO: 4175235 - RNA, 23 nt, Yersinia pestis
uauccaucccaacaauuugcgcc

SEQ ID NO: 4175236 - RNA, 19 nt, Yersinia pestis
uauccccugagaaacaucc

SEQ ID NO: 4175237 - RNA, 16 nt, Yersinia pestis
uaucccuauuuuuucc

SEQ ID NO: 4175238 - RNA, 22 nt, Yersinia pestis
uaucccuauuuuuuccgaaaaa

SEQ ID NO: 4175239 - RNA, 13 nt, Yersinia pestis
uaucccuccauca

SEQ ID NO: 4175240 - RNA, 23 nt, Yersinia pestis
uauccgcuuuggucaacagcaaa

SEQ ID NO: 4175241 - RNA, 18 nt, Yersinia pestis
uauccggguggcuuggca

SEQ ID NO: 4175242 - RNA, 17 nt, Yersinia pestis
uauccuaucuuuaccca

SEQ ID NO: 4175243 - RNA, 14 nt, Yersinia pestis
uauccuccauucug

SEQ ID NO: 4175244 - RNA, 17 nt, Yersinia pestis
uauccucggccaguguu

SEQ ID NO: 4175245 - RNA, 20 nt, Yersinia pestis
uauccuggccguguuuuucc

SEQ ID NO: 4175246 - RNA, 16 nt, Yersinia pestis
uauccuuuuuauuuaa

SEQ ID NO: 4175247 - RNA, 20 nt, Yersinia pestis
uaucgaauugaucugauauu

SEQ ID NO: 4175248 - RNA, 14 nt, Yersinia pestis
uaucgacaaucaca

SEQ ID NO: 4175249 - RNA, 13 nt, Yersinia pestis
uaucgacaccaau

SEQ ID NO: 4175250 - RNA, 16 nt, Yersinia pestis
uaucgaucaaaccaga

SEQ ID NO: 4175251 - RNA, 17 nt, Yersinia pestis
uaucgaucaaaccagag

SEQ ID NO: 4175252 - RNA, 16 nt, Yersinia pestis
uaucgaugguuggcua

SEQ ID NO: 4175253 - RNA, 13 nt, Yersinia pestis
uaucgauuucuac

SEQ ID NO: 4175254 - RNA, 13 nt, Yersinia pestis
uaucgcagugcac

SEQ ID NO: 4175255 - RNA, 16 nt, Yersinia pestis
uaucgcuaccuccggg

SEQ ID NO: 4175256 - RNA, 20 nt, Yersinia pestis
uaucgcuacguacuaucuau

SEQ ID NO: 4175257 - RNA, 13 nt, Yersinia pestis
uaucgcucuugag

SEQ ID NO: 4175258 - RNA, 17 nt, Yersinia pestis
uaucgcuguaugguaua

SEQ ID NO: 4175259 - RNA, 15 nt, Yersinia pestis
uaucgcuuuuagaua

SEQ ID NO: 4175260 - RNA, 21 nt, Yersinia pestis
uaucggccauauuaccgcuga

SEQ ID NO: 4175261 - RNA, 17 nt, Yersinia pestis
uaucgggauucacaccg

SEQ ID NO: 4175262 - RNA, 19 nt, Yersinia pestis
uaucgguauuaccaaucag

SEQ ID NO: 4175263 - RNA, 12 nt, Yersinia pestis
uaucgucacugg

SEQ ID NO: 4175264 - RNA, 15 nt, Yersinia pestis
uaucguccagcagca

SEQ ID NO: 4175265 - RNA, 23 nt, Yersinia pestis
uaucgugaacaggccccaaaaua

SEQ ID NO: 4175266 - RNA, 18 nt, Yersinia pestis
uaucgugaccaauaauaa

SEQ ID NO: 4175267 - RNA, 18 nt, Yersinia pestis
uaucguuaucaacgccca

SEQ ID NO: 4175268 - RNA, 21 nt, Yersinia pestis
uaucuacuucuauuacccuaa

SEQ ID NO: 4175269 - RNA, 18 nt, Yersinia pestis
uaucuagcaacacaucgg

SEQ ID NO: 4175270 - RNA, 17 nt, Yersinia pestis
uaucuagcguccaugua

SEQ ID NO: 4175271 - RNA, 16 nt, Yersinia pestis
uaucuaggugcaguaa

SEQ ID NO: 4175272 - RNA, 19 nt, Yersinia pestis
uaucuauuuuuauuucucc

SEQ ID NO: 4175273 - RNA, 14 nt, Yersinia pestis
uaucucauccagca

SEQ ID NO: 4175274 - RNA, 15 nt, Yersinia pestis
uaucucauccagcaa

SEQ ID NO: 4175275 - RNA, 19 nt, Yersinia pestis
uaucuccaccaacggccca

SEQ ID NO: 4175276 - RNA, 19 nt, Yersinia pestis
uaucucccauuaauuaauc

SEQ ID NO: 4175277 - RNA, 17 nt, Yersinia pestis
uaucugacugcuugcca

SEQ ID NO: 4175278 - RNA, 13 nt, Yersinia pestis
uaucugaugaaaa

SEQ ID NO: 4175279 - RNA, 21 nt, Yersinia pestis
uaucugccaauucaaggccag

SEQ ID NO: 4175280 - RNA, 23 nt, Yersinia pestis
uaucugcggugaucaccagauca

SEQ ID NO: 4175281 - RNA, 14 nt, Yersinia pestis
uaucugcguuuucu

SEQ ID NO: 4175282 - RNA, 20 nt, Yersinia pestis
uaucugcugcgguauuaccc

SEQ ID NO: 4175283 - RNA, 16 nt, Yersinia pestis
uaucuguaaucaccag

SEQ ID NO: 4175284 - RNA, 15 nt, Yersinia pestis
uaucuguuucaaaua

SEQ ID NO: 4175285 - RNA, 20 nt, Yersinia pestis
uaucuguuucaaauaaguau

SEQ ID NO: 4175286 - RNA, 16 nt, Yersinia pestis
uaucuuauccacagca

SEQ ID NO: 4175287 - RNA, 14 nt, Yersinia pestis
uaucuucaacuguc

SEQ ID NO: 4175288 - RNA, 15 nt, Yersinia pestis
uaucuuccauagaua

SEQ ID NO: 4175289 - RNA, 20 nt, Yersinia pestis
uaucuucccuguccagccca

SEQ ID NO: 4175290 - RNA, 18 nt, Yersinia pestis
uaucuuguaaauagucau

SEQ ID NO: 4175291 - RNA, 16 nt, Yersinia pestis
uaucuuuaauuuuucc

SEQ ID NO: 4175292 - RNA, 22 nt, Yersinia pestis
uaugaaaaaccuccggcuaugc

SEQ ID NO: 4175293 - RNA, 13 nt, Yersinia pestis
uaugaaaguaaga

SEQ ID NO: 4175294 - RNA, 19 nt, Yersinia pestis
uaugaaugagguuuacauu

SEQ ID NO: 4175295 - RNA, 20 nt, Yersinia pestis
uaugaaugagguuuacauuu

SEQ ID NO: 4175296 - RNA, 16 nt, Yersinia pestis
uaugaauuaauuuauu

SEQ ID NO: 4175297 - RNA, 21 nt, Yersinia pestis
uaugacaaguugucuguaaua

SEQ ID NO: 4175298 - RNA, 19 nt, Yersinia pestis
uaugacagaaaaaucacau

SEQ ID NO: 4175299 - RNA, 22 nt, Yersinia pestis
uaugacauaucgagacuaccgg

SEQ ID NO: 4175300 - RNA, 21 nt, Yersinia pestis
uaugacgccaacuucaagccg

SEQ ID NO: 4175301 - RNA, 14 nt, Yersinia pestis
uaugacgcgcugcu

SEQ ID NO: 4175302 - RNA, 20 nt, Yersinia pestis
uaugaggaucccuucugaaa

SEQ ID NO: 4175303 - RNA, 19 nt, Yersinia pestis
uaugcaguuaagguuagcu

SEQ ID NO: 4175304 - RNA, 23 nt, Yersinia pestis
uaugcaguuaagguuagcuaugc

SEQ ID NO: 4175305 - RNA, 15 nt, Yersinia pestis
uaugcauuauugaug

SEQ ID NO: 4175306 - RNA, 22 nt, Yersinia pestis
uaugcauuauugauguuauuaa

SEQ ID NO: 4175307 - RNA, 16 nt, Yersinia pestis
uaugccaguuauuauu

SEQ ID NO: 4175308 - RNA, 16 nt, Yersinia pestis
uaugccauaacaucgu

SEQ ID NO: 4175309 - RNA, 14 nt, Yersinia pestis
uaugccgacaacca

SEQ ID NO: 4175310 - RNA, 19 nt, Yersinia pestis
uaugccggggauauuuugc

SEQ ID NO: 4175311 - RNA, 16 nt, Yersinia pestis
uaugccuuuucuuccg

SEQ ID NO: 4175312 - RNA, 16 nt, Yersinia pestis
uaugcgcgucaaucca

SEQ ID NO: 4175313 - RNA, 15 nt, Yersinia pestis
uaugcgcuggcucua

SEQ ID NO: 4175314 - RNA, 12 nt, Yersinia pestis
uaugcguugaga

SEQ ID NO: 4175315 - RNA, 23 nt, Yersinia pestis
uaugcucaccgcccccaauaagg

SEQ ID NO: 4175316 - RNA, 13 nt, Yersinia pestis
uaugcucagcaac

SEQ ID NO: 4175317 - RNA, 15 nt, Yersinia pestis
uaugcugauaaaauu

SEQ ID NO: 4175318 - RNA, 16 nt, Yersinia pestis
uaugcuucacaucaua

SEQ ID NO: 4175319 - RNA, 15 nt, Yersinia pestis
uaugcuuucaucuua

SEQ ID NO: 4175320 - RNA, 19 nt, Yersinia pestis
uauggaaauuauuuagaaa

SEQ ID NO: 4175321 - RNA, 17 nt, Yersinia pestis
uauggaaguaauccaga

SEQ ID NO: 4175322 - RNA, 12 nt, Yersinia pestis
uauggaccucac

SEQ ID NO: 4175323 - RNA, 14 nt, Yersinia pestis
uauggauaaauccu

SEQ ID NO: 4175324 - RNA, 22 nt, Yersinia pestis
uauggcauaaacugaaguuaaa

SEQ ID NO: 4175325 - RNA, 14 nt, Yersinia pestis
uaugggcuucgcca

SEQ ID NO: 4175326 - RNA, 22 nt, Yersinia pestis
uaugggcuuuuuuugcauuggu

SEQ ID NO: 4175327 - RNA, 15 nt, Yersinia pestis
uauggggauuuuauu

SEQ ID NO: 4175328 - RNA, 23 nt, Yersinia pestis
uaugucaccuccacuucaagccg

SEQ ID NO: 4175329 - RNA, 20 nt, Yersinia pestis
uaugucagauagaccaauga

SEQ ID NO: 4175330 - RNA, 15 nt, Yersinia pestis
uauguccucaccauu

SEQ ID NO: 4175331 - RNA, 17 nt, Yersinia pestis
uaugugauauuuuacug

SEQ ID NO: 4175332 - RNA, 16 nt, Yersinia pestis
uaugugccaaaaaaag

SEQ ID NO: 4175333 - RNA, 13 nt, Yersinia pestis
uauguuccaucag

SEQ ID NO: 4175334 - RNA, 17 nt, Yersinia pestis
uauguucuuccugugcg

SEQ ID NO: 4175335 - RNA, 14 nt, Yersinia pestis
uauguugcacugac

SEQ ID NO: 4175336 - RNA, 17 nt, Yersinia pestis
uauguuuuuaacaaaau

SEQ ID NO: 4175337 - RNA, 22 nt, Yersinia pestis
uauuaaacgggccgcgcagauu

SEQ ID NO: 4175338 - RNA, 22 nt, Yersinia pestis
uauuaaagcacuaagauucaaa

SEQ ID NO: 4175339 - RNA, 11 nt, Yersinia pestis
uauuaaauaag

SEQ ID NO: 4175340 - RNA, 14 nt, Yersinia pestis
uauuaacauaucaa

SEQ ID NO: 4175341 - RNA, 21 nt, Yersinia pestis
uauuaaccuacugacauuucu

SEQ ID NO: 4175342 - RNA, 16 nt, Yersinia pestis
uauuaacugcagugaa

SEQ ID NO: 4175343 - RNA, 23 nt, Yersinia pestis
uauuaaguuuuucauaaucaccu

SEQ ID NO: 4175344 - RNA, 12 nt, Yersinia pestis
uauuaauauaau

SEQ ID NO: 4175345 - RNA, 19 nt, Yersinia pestis
uauuaaucaacagauaugc

SEQ ID NO: 4175346 - RNA, 17 nt, Yersinia pestis
uauuaaucuauuaauau

SEQ ID NO: 4175347 - RNA, 22 nt, Yersinia pestis
uauuaaugaaauuaguuaauuu

SEQ ID NO: 4175348 - RNA, 19 nt, Yersinia pestis
uauuacaccuuaaaacagc

SEQ ID NO: 4175349 - RNA, 23 nt, Yersinia pestis
uauuacaccuuaaaacagcagcc

SEQ ID NO: 4175350 - RNA, 22 nt, Yersinia pestis
uauuaccaauaugaaauuucac

SEQ ID NO: 4175351 - RNA, 13 nt, Yersinia pestis
uauuacggcccca

SEQ ID NO: 4175352 - RNA, 21 nt, Yersinia pestis
uauuacucagcacauuuuuau

SEQ ID NO: 4175353 - RNA, 12 nt, Yersinia pestis
uauuacugucaa

SEQ ID NO: 4175354 - RNA, 13 nt, Yersinia pestis
uauuacugucaau

SEQ ID NO: 4175355 - RNA, 15 nt, Yersinia pestis
uauuacugucauugc

SEQ ID NO: 4175356 - RNA, 13 nt, Yersinia pestis
uauuacuucuuuu

SEQ ID NO: 4175357 - RNA, 20 nt, Yersinia pestis
uauuagagagugauuccagc

SEQ ID NO: 4175358 - RNA, 14 nt, Yersinia pestis
uauuagccaaauac

SEQ ID NO: 4175359 - RNA, 18 nt, Yersinia pestis
uauuagccaaauacccua

SEQ ID NO: 4175360 - RNA, 18 nt, Yersinia pestis
uauuagccagcagaaacc

SEQ ID NO: 4175361 - RNA, 21 nt, Yersinia pestis
uauuagccgccagucauucac

SEQ ID NO: 4175362 - RNA, 20 nt, Yersinia pestis
uauuaggugcuuguucuguu

SEQ ID NO: 4175363 - RNA, 15 nt, Yersinia pestis
uauuaguccguagaa

SEQ ID NO: 4175364 - RNA, 16 nt, Yersinia pestis
uauuauaaaauucgcu

SEQ ID NO: 4175365 - RNA, 20 nt, Yersinia pestis
uauuaucaucauuacacuga

SEQ ID NO: 4175366 - RNA, 14 nt, Yersinia pestis
uauuaucaucuuuc

SEQ ID NO: 4175367 - RNA, 15 nt, Yersinia pestis
uauuaucaugaagaa

SEQ ID NO: 4175368 - RNA, 19 nt, Yersinia pestis
uauuaucccaguuuuuaau

SEQ ID NO: 4175369 - RNA, 15 nt, Yersinia pestis
uauuauuaauguaca

SEQ ID NO: 4175370 - RNA, 13 nt, Yersinia pestis
uauuauuacuaga

SEQ ID NO: 4175371 - RNA, 11 nt, Yersinia pestis
uauuauuagcc

SEQ ID NO: 4175372 - RNA, 14 nt, Yersinia pestis
uauuauuauuuaua

SEQ ID NO: 4175373 - RNA, 11 nt, Yersinia pestis
uauuauuuauu

SEQ ID NO: 4175374 - RNA, 12 nt, Yersinia pestis
uauuauuuauuu

SEQ ID NO: 4175375 - RNA, 22 nt, Yersinia pestis
uauucaaacggugugcaaugca

SEQ ID NO: 4175376 - RNA, 18 nt, Yersinia pestis
uauucaaccgccagugcc

SEQ ID NO: 4175377 - RNA, 16 nt, Yersinia pestis
uauucaacgccaauac

SEQ ID NO: 4175378 - RNA, 21 nt, Yersinia pestis
uauucaaugacuccugaaaua

SEQ ID NO: 4175379 - RNA, 21 nt, Yersinia pestis
uauucacagcagaacaaaaca

SEQ ID NO: 4175380 - RNA, 17 nt, Yersinia pestis
uauucacguuuuuccau

SEQ ID NO: 4175381 - RNA, 12 nt, Yersinia pestis
uauucagcaagc

SEQ ID NO: 4175382 - RNA, 17 nt, Yersinia pestis
uauucagcagcauuucu

SEQ ID NO: 4175383 - RNA, 20 nt, Yersinia pestis
uauucauaagucagugcuau

SEQ ID NO: 4175384 - RNA, 20 nt, Yersinia pestis
uauucauaucgcuaaaacac

SEQ ID NO: 4175385 - RNA, 17 nt, Yersinia pestis
uauucauauuucuuuga

SEQ ID NO: 4175386 - RNA, 16 nt, Yersinia pestis
uauucaugguuucaaa

SEQ ID NO: 4175387 - RNA, 20 nt, Yersinia pestis
uauucauuaaaaaauaauuu

SEQ ID NO: 4175388 - RNA, 20 nt, Yersinia pestis
uauuccacagaguauacaua

SEQ ID NO: 4175389 - RNA, 19 nt, Yersinia pestis
uauuccgagcaaucaaaag

SEQ ID NO: 4175390 - RNA, 16 nt, Yersinia pestis
uauuccucucugucug

SEQ ID NO: 4175391 - RNA, 18 nt, Yersinia pestis
uauuccuuguggugauga

SEQ ID NO: 4175392 - RNA, 21 nt, Yersinia pestis
uauucgccagauugccaauca

SEQ ID NO: 4175393 - RNA, 15 nt, Yersinia pestis
uauucgcgcuuuaac

SEQ ID NO: 4175394 - RNA, 16 nt, Yersinia pestis
uauucgcuuuauaucc

SEQ ID NO: 4175395 - RNA, 18 nt, Yersinia pestis
uauucgggcaacuaauuc

SEQ ID NO: 4175396 - RNA, 23 nt, Yersinia pestis
uauucgggcaacuaauucuuagg

SEQ ID NO: 4175397 - RNA, 15 nt, Yersinia pestis
uauucgucauucguu

SEQ ID NO: 4175398 - RNA, 21 nt, Yersinia pestis
uauucgucuucgcauucuuua

SEQ ID NO: 4175399 - RNA, 20 nt, Yersinia pestis
uauucuaauugauauuauuu

SEQ ID NO: 4175400 - RNA, 22 nt, Yersinia pestis
uauucuaauugauauuauuuau

SEQ ID NO: 4175401 - RNA, 18 nt, Yersinia pestis
uauucuacaaugucacgc

SEQ ID NO: 4175402 - RNA, 15 nt, Yersinia pestis
uauucucaucaucau

SEQ ID NO: 4175403 - RNA, 23 nt, Yersinia pestis
uauucucugaacgcacuucaauc

SEQ ID NO: 4175404 - RNA, 15 nt, Yersinia pestis
uauucugauaccugc

SEQ ID NO: 4175405 - RNA, 18 nt, Yersinia pestis
uauucuguuguaaccagu

SEQ ID NO: 4175406 - RNA, 16 nt, Yersinia pestis
uauucuuaucaaucaa

SEQ ID NO: 4175407 - RNA, 22 nt, Yersinia pestis
uauucuucuucauuuucaucac

SEQ ID NO: 4175408 - RNA, 15 nt, Yersinia pestis
uauucuuguauccug

SEQ ID NO: 4175409 - RNA, 23 nt, Yersinia pestis
uauugaaccuacccuuauucuua

SEQ ID NO: 4175410 - RNA, 21 nt, Yersinia pestis
uauugaagggcaaaacgugaa

SEQ ID NO: 4175411 - RNA, 15 nt, Yersinia pestis
uauugacaaagugcc

SEQ ID NO: 4175412 - RNA, 21 nt, Yersinia pestis
uauugaccaccuuauuggccc

SEQ ID NO: 4175413 - RNA, 15 nt, Yersinia pestis
uauugagaagaaauc

SEQ ID NO: 4175414 - RNA, 16 nt, Yersinia pestis
uauugaggacaauuca

SEQ ID NO: 4175415 - RNA, 21 nt, Yersinia pestis
uauugauaaaaauauccagca

SEQ ID NO: 4175416 - RNA, 15 nt, Yersinia pestis
uauugauaaaaccac

SEQ ID NO: 4175417 - RNA, 16 nt, Yersinia pestis
uauugauaaaaccacu

SEQ ID NO: 4175418 - RNA, 13 nt, Yersinia pestis
uauugauagccac

SEQ ID NO: 4175419 - RNA, 20 nt, Yersinia pestis
uauugauauagcgguaaccg

SEQ ID NO: 4175420 - RNA, 17 nt, Yersinia pestis
uauugauccaaauggcu

SEQ ID NO: 4175421 - RNA, 19 nt, Yersinia pestis
uauugaugacgcuaaccac

SEQ ID NO: 4175422 - RNA, 13 nt, Yersinia pestis
uauugaugcagug

SEQ ID NO: 4175423 - RNA, 22 nt, Yersinia pestis
uauugauuaagcggcaauaaca

SEQ ID NO: 4175424 - RNA, 19 nt, Yersinia pestis
uauugauuaauuuuucaua

SEQ ID NO: 4175425 - RNA, 19 nt, Yersinia pestis
uauugcacgguguaaauaa

SEQ ID NO: 4175426 - RNA, 16 nt, Yersinia pestis
uauugcaucuuuaauu

SEQ ID NO: 4175427 - RNA, 16 nt, Yersinia pestis
uauugccgcaguccaa

SEQ ID NO: 4175428 - RNA, 22 nt, Yersinia pestis
uauugccgcaguccaaaaaacu

SEQ ID NO: 4175429 - RNA, 18 nt, Yersinia pestis
uauugcuaaguacuaucu

SEQ ID NO: 4175430 - RNA, 19 nt, Yersinia pestis
uauugcuaaguacuaucua

SEQ ID NO: 4175431 - RNA, 22 nt, Yersinia pestis
uauugcucagggccacuucggu

SEQ ID NO: 4175432 - RNA, 13 nt, Yersinia pestis
uauugcuccagag

SEQ ID NO: 4175433 - RNA, 21 nt, Yersinia pestis
uauugcuccgacaauaacgcu

SEQ ID NO: 4175434 - RNA, 16 nt, Yersinia pestis
uauugcucugccgcag

SEQ ID NO: 4175435 - RNA, 19 nt, Yersinia pestis
uauuggagcugaaaauagu

SEQ ID NO: 4175436 - RNA, 16 nt, Yersinia pestis
uauuggccaguugcca

SEQ ID NO: 4175437 - RNA, 14 nt, Yersinia pestis
uauugggaaccccu

SEQ ID NO: 4175438 - RNA, 17 nt, Yersinia pestis
uauuggggacaggcucc

SEQ ID NO: 4175439 - RNA, 22 nt, Yersinia pestis
uauuggggacaggcuccuccuu

SEQ ID NO: 4175440 - RNA, 15 nt, Yersinia pestis
uauuggguuauuaac

SEQ ID NO: 4175441 - RNA, 18 nt, Yersinia pestis
uauuggucguaccaaugg

SEQ ID NO: 4175442 - RNA, 22 nt, Yersinia pestis
uauuggucguaccaauggugcc

SEQ ID NO: 4175443 - RNA, 17 nt, Yersinia pestis
uauugucucuacucucu

SEQ ID NO: 4175444 - RNA, 17 nt, Yersinia pestis
uauuguggauaguaaac

SEQ ID NO: 4175445 - RNA, 13 nt, Yersinia pestis
uauuguuaucaaa

SEQ ID NO: 4175446 - RNA, 20 nt, Yersinia pestis
uauuguugccaauguugcug

SEQ ID NO: 4175447 - RNA, 19 nt, Yersinia pestis
uauuguuuugacuaaaauu

SEQ ID NO: 4175448 - RNA, 18 nt, Yersinia pestis
uauuuaaaauuaauaguu

SEQ ID NO: 4175449 - RNA, 19 nt, Yersinia pestis
uauuuaaaauuaauaguuu

SEQ ID NO: 4175450 - RNA, 18 nt, Yersinia pestis
uauuuaaauuuuuauaua

SEQ ID NO: 4175451 - RNA, 11 nt, Yersinia pestis
uauuuaacaaa

SEQ ID NO: 4175452 - RNA, 15 nt, Yersinia pestis
uauuuaacaaaaaau

SEQ ID NO: 4175453 - RNA, 22 nt, Yersinia pestis
uauuuaagcaguucacucuguu

SEQ ID NO: 4175454 - RNA, 21 nt, Yersinia pestis
uauuuaagcugaaauuuuuua

SEQ ID NO: 4175455 - RNA, 23 nt, Yersinia pestis
uauuuaauuaaauguauaaaaaa

SEQ ID NO: 4175456 - RNA, 12 nt, Yersinia pestis
uauuuaauuuaa

SEQ ID NO: 4175457 - RNA, 14 nt, Yersinia pestis
uauuuaauuuaaau

SEQ ID NO: 4175458 - RNA, 21 nt, Yersinia pestis
uauuuaauuuaaauaaaauaa

SEQ ID NO: 4175459 - RNA, 14 nt, Yersinia pestis
uauuuacaaaccac

SEQ ID NO: 4175460 - RNA, 17 nt, Yersinia pestis
uauuuacaaauaaccgc

SEQ ID NO: 4175461 - RNA, 16 nt, Yersinia pestis
uauuuacauaauaacc

SEQ ID NO: 4175462 - RNA, 22 nt, Yersinia pestis
uauuuacauaauaaccauuuau

SEQ ID NO: 4175463 - RNA, 20 nt, Yersinia pestis
uauuuaccugcucaacugcu

SEQ ID NO: 4175464 - RNA, 17 nt, Yersinia pestis
uauuuacggcgucuuua

SEQ ID NO: 4175465 - RNA, 16 nt, Yersinia pestis
uauuuacuggaagcua

SEQ ID NO: 4175466 - RNA, 17 nt, Yersinia pestis
uauuuauaaaaaaugga

SEQ ID NO: 4175467 - RNA, 15 nt, Yersinia pestis
uauuuauaaaaccac

SEQ ID NO: 4175468 - RNA, 19 nt, Yersinia pestis
uauuuauaugauaauaguu

SEQ ID NO: 4175469 - RNA, 21 nt, Yersinia pestis
uauuuaucugcauuaaaauaa

SEQ ID NO: 4175470 - RNA, 14 nt, Yersinia pestis
uauuuauuaaucua

SEQ ID NO: 4175471 - RNA, 24 nt, Yersinia pestis
uauuuauucgacuguuuuuacaau

SEQ ID NO: 4175472 - RNA, 14 nt, Yersinia pestis
uauuuauuuaauuu

SEQ ID NO: 4175473 - RNA, 17 nt, Yersinia pestis
uauuuauuuacagccac

SEQ ID NO: 4175474 - RNA, 17 nt, Yersinia pestis
uauuuauuuauuuccgc

SEQ ID NO: 4175475 - RNA, 21 nt, Yersinia pestis
uauuuauuuccagaucagcac

SEQ ID NO: 4175476 - RNA, 16 nt, Yersinia pestis
uauuuauuuuccccua

SEQ ID NO: 4175477 - RNA, 16 nt, Yersinia pestis
uauuucaaauaagugu

SEQ ID NO: 4175478 - RNA, 19 nt, Yersinia pestis
uauuucacacuguuuaguu

SEQ ID NO: 4175479 - RNA, 19 nt, Yersinia pestis
uauuucacgcuaauuauuu

SEQ ID NO: 4175480 - RNA, 20 nt, Yersinia pestis
uauuucacgcuaauuauuuu

SEQ ID NO: 4175481 - RNA, 16 nt, Yersinia pestis
uauuucacguucauca

SEQ ID NO: 4175482 - RNA, 16 nt, Yersinia pestis
uauuucagauuuauuu

SEQ ID NO: 4175483 - RNA, 17 nt, Yersinia pestis
uauuucaugauucucua

SEQ ID NO: 4175484 - RNA, 14 nt, Yersinia pestis
uauuucauuagauc

SEQ ID NO: 4175485 - RNA, 16 nt, Yersinia pestis
uauuuccacgacauga

SEQ ID NO: 4175486 - RNA, 18 nt, Yersinia pestis
uauuuccacgacaugagc

SEQ ID NO: 4175487 - RNA, 23 nt, Yersinia pestis
uauuuccgaauuaaaaaucagag

SEQ ID NO: 4175488 - RNA, 23 nt, Yersinia pestis
uauuucgccuuucauacaucauu

SEQ ID NO: 4175489 - RNA, 12 nt, Yersinia pestis
uauuucucucua

SEQ ID NO: 4175490 - RNA, 15 nt, Yersinia pestis
uauuucuuagagaga

SEQ ID NO: 4175491 - RNA, 15 nt, Yersinia pestis
uauuugaaauacuua

SEQ ID NO: 4175492 - RNA, 16 nt, Yersinia pestis
uauuugaaauacuuau

SEQ ID NO: 4175493 - RNA, 13 nt, Yersinia pestis
uauuugaacuuca

SEQ ID NO: 4175494 - RNA, 20 nt, Yersinia pestis
uauuugagauauaggcaucu

SEQ ID NO: 4175495 - RNA, 24 nt, Yersinia pestis
uauuugcagaaaguaaucuuugag

SEQ ID NO: 4175496 - RNA, 23 nt, Yersinia pestis
uauuugcagcggaugauaaauau

SEQ ID NO: 4175497 - RNA, 20 nt, Yersinia pestis
uauuugccguauucagcagu

SEQ ID NO: 4175498 - RNA, 14 nt, Yersinia pestis
uauuuggcauucau

SEQ ID NO: 4175499 - RNA, 16 nt, Yersinia pestis
uauuugggguauauau

SEQ ID NO: 4175500 - RNA, 19 nt, Yersinia pestis
uauuugggguauauauuuu

SEQ ID NO: 4175501 - RNA, 17 nt, Yersinia pestis
uauuuggugaguaaaug

SEQ ID NO: 4175502 - RNA, 19 nt, Yersinia pestis
uauuuggugaguaaaugcc

SEQ ID NO: 4175503 - RNA, 17 nt, Yersinia pestis
uauuuguacauccaacu

SEQ ID NO: 4175504 - RNA, 17 nt, Yersinia pestis
uauuuguagugacguaa

SEQ ID NO: 4175505 - RNA, 22 nt, Yersinia pestis
uauuuguagugacguaaaaagg

SEQ ID NO: 4175506 - RNA, 11 nt, Yersinia pestis
uauuuuacuug

SEQ ID NO: 4175507 - RNA, 17 nt, Yersinia pestis
uauuuuaucuacuucua

SEQ ID NO: 4175508 - RNA, 16 nt, Yersinia pestis
uauuuuaucuuuuagu

SEQ ID NO: 4175509 - RNA, 13 nt, Yersinia pestis
uauuuuaugcccc

SEQ ID NO: 4175510 - RNA, 16 nt, Yersinia pestis
uauuuuauuuaaaauu

SEQ ID NO: 4175511 - RNA, 13 nt, Yersinia pestis
uauuuuauuuaau

SEQ ID NO: 4175512 - RNA, 14 nt, Yersinia pestis
uauuuucaucccaa

SEQ ID NO: 4175513 - RNA, 18 nt, Yersinia pestis
uauuuucauuauuuucaa

SEQ ID NO: 4175514 - RNA, 14 nt, Yersinia pestis
uauuuucccuuucu

SEQ ID NO: 4175515 - RNA, 20 nt, Yersinia pestis
uauuuuccugaucaacugcu

SEQ ID NO: 4175516 - RNA, 15 nt, Yersinia pestis
uauuuucuauaccaa

SEQ ID NO: 4175517 - RNA, 21 nt, Yersinia pestis
uauuuucugauguguauauuu

SEQ ID NO: 4175518 - RNA, 23 nt, Yersinia pestis
uauuuugggcuaaaacucaaaua

SEQ ID NO: 4175519 - RNA, 14 nt, Yersinia pestis
uauuuuuaauuuag

SEQ ID NO: 4175520 - RNA, 18 nt, Yersinia pestis
uauuuuugcauauaaaac

SEQ ID NO: 4175521 - RNA, 20 nt, Yersinia pestis
uauuuuuucuuucaccagug

SEQ ID NO: 4175522 - RNA, 16 nt, Yersinia pestis
uauuuuuuuggcagau

SEQ ID NO: 4175523 - RNA, 14 nt, Yersinia pestis
ucaaaaaagccccc

SEQ ID NO: 4175524 - RNA, 20 nt, Yersinia pestis
ucaaaaaauaggcuaauuua

SEQ ID NO: 4175525 - RNA, 14 nt, Yersinia pestis
ucaaaaacccauua

SEQ ID NO: 4175526 - RNA, 12 nt, Yersinia pestis
ucaaaaaugaua

SEQ ID NO: 4175527 - RNA, 18 nt, Yersinia pestis
ucaaaaauuaaauuaaua

SEQ ID NO: 4175528 - RNA, 12 nt, Yersinia pestis
ucaaaacaauau

SEQ ID NO: 4175529 - RNA, 16 nt, Yersinia pestis
ucaaaaccaauagauu

SEQ ID NO: 4175530 - RNA, 23 nt, Yersinia pestis
ucaaaaccgaugagugaaaucuc

SEQ ID NO: 4175531 - RNA, 21 nt, Yersinia pestis
ucaaaacgccagauaugauca

SEQ ID NO: 4175532 - RNA, 19 nt, Yersinia pestis
ucaaaacuccaucaaaauu

SEQ ID NO: 4175533 - RNA, 14 nt, Yersinia pestis
ucaaaagauaaucu

SEQ ID NO: 4175534 - RNA, 20 nt, Yersinia pestis
ucaaaagcagagaaugagua

SEQ ID NO: 4175535 - RNA, 14 nt, Yersinia pestis
ucaaaagcggcucu

SEQ ID NO: 4175536 - RNA, 21 nt, Yersinia pestis
ucaaaaggauggcccaagcca

SEQ ID NO: 4175537 - RNA, 23 nt, Yersinia pestis
ucaaaaggauggcccaagccauc

SEQ ID NO: 4175538 - RNA, 16 nt, Yersinia pestis
ucaaaagggaucacca

SEQ ID NO: 4175539 - RNA, 21 nt, Yersinia pestis
ucaaaauaaaaauucacaaca

SEQ ID NO: 4175540 - RNA, 13 nt, Yersinia pestis
ucaaaauacauaa

SEQ ID NO: 4175541 - RNA, 16 nt, Yersinia pestis
ucaaaauagaggaaau

SEQ ID NO: 4175542 - RNA, 18 nt, Yersinia pestis
ucaaaauagaggaaauaa

SEQ ID NO: 4175543 - RNA, 21 nt, Yersinia pestis
ucaaaauagaggaaauaaaug

SEQ ID NO: 4175544 - RNA, 13 nt, Yersinia pestis
ucaaaaucaaaaa

SEQ ID NO: 4175545 - RNA, 17 nt, Yersinia pestis
ucaaaaugccagucaau

SEQ ID NO: 4175546 - RNA, 19 nt, Yersinia pestis
ucaaaauuagguuuucccu

SEQ ID NO: 4175547 - RNA, 23 nt, Yersinia pestis
ucaaaauuccgcuucacauuuga

SEQ ID NO: 4175548 - RNA, 15 nt, Yersinia pestis
ucaaacagguaaaac

SEQ ID NO: 4175549 - RNA, 17 nt, Yersinia pestis
ucaaacagguugguaua

SEQ ID NO: 4175550 - RNA, 15 nt, Yersinia pestis
ucaaaccagagaaag

SEQ ID NO: 4175551 - RNA, 21 nt, Yersinia pestis
ucaaaccaucgcucuccugcc

SEQ ID NO: 4175552 - RNA, 20 nt, Yersinia pestis
ucaaacgaucaguuaaucaa

SEQ ID NO: 4175553 - RNA, 18 nt, Yersinia pestis
ucaaacgggugauguuua

SEQ ID NO: 4175554 - RNA, 16 nt, Yersinia pestis
ucaaacucagcgaaua

SEQ ID NO: 4175555 - RNA, 17 nt, Yersinia pestis
ucaaacucagcgaauaa

SEQ ID NO: 4175556 - RNA, 19 nt, Yersinia pestis
ucaaacucagcgaauaaau

SEQ ID NO: 4175557 - RNA, 16 nt, Yersinia pestis
ucaaacuggcccagcu

SEQ ID NO: 4175558 - RNA, 16 nt, Yersinia pestis
ucaaagaccacaucaa

SEQ ID NO: 4175559 - RNA, 12 nt, Yersinia pestis
ucaaauaaguau

SEQ ID NO: 4175560 - RNA, 20 nt, Yersinia pestis
ucaaauacgaccgucaccaa

SEQ ID NO: 4175561 - RNA, 22 nt, Yersinia pestis
ucaaauacuucaaaugacauuc

SEQ ID NO: 4175562 - RNA, 21 nt, Yersinia pestis
ucaaauagauagcaaucaaua

SEQ ID NO: 4175563 - RNA, 23 nt, Yersinia pestis
ucaaauagccugguugaucucaa

SEQ ID NO: 4175564 - RNA, 17 nt, Yersinia pestis
ucaaauaucauuauuuu

SEQ ID NO: 4175565 - RNA, 16 nt, Yersinia pestis
ucaaaucauacgcagc

SEQ ID NO: 4175566 - RNA, 22 nt, Yersinia pestis
ucaaaucugcuccaucaauaac

SEQ ID NO: 4175567 - RNA, 14 nt, Yersinia pestis
ucaaaugauucagu

SEQ ID NO: 4175568 - RNA, 21 nt, Yersinia pestis
ucaaauuugcaguauucaggu

SEQ ID NO: 4175569 - RNA, 21 nt, Yersinia pestis
ucaaauuuuugaucggcgaca

SEQ ID NO: 4175570 - RNA, 15 nt, Yersinia pestis
ucaacaaacaguuca

SEQ ID NO: 4175571 - RNA, 14 nt, Yersinia pestis
ucaacacauaaaau

SEQ ID NO: 4175572 - RNA, 18 nt, Yersinia pestis
ucaacacggugaauaaac

SEQ ID NO: 4175573 - RNA, 19 nt, Yersinia pestis
ucaacacugccugaugcua

SEQ ID NO: 4175574 - RNA, 22 nt, Yersinia pestis
ucaacagauaugcauuauugau

SEQ ID NO: 4175575 - RNA, 19 nt, Yersinia pestis
ucaacagaugaugauuuuu

SEQ ID NO: 4175576 - RNA, 17 nt, Yersinia pestis
ucaacagcaaaagaacc

SEQ ID NO: 4175577 - RNA, 16 nt, Yersinia pestis
ucaacagcaucaucaa

SEQ ID NO: 4175578 - RNA, 12 nt, Yersinia pestis
ucaacagccuuu

SEQ ID NO: 4175579 - RNA, 14 nt, Yersinia pestis
ucaacaucgcaccg

SEQ ID NO: 4175580 - RNA, 17 nt, Yersinia pestis
ucaacaucgcaccgaug

SEQ ID NO: 4175581 - RNA, 18 nt, Yersinia pestis
ucaacauugcucggcuga

SEQ ID NO: 4175582 - RNA, 22 nt, Yersinia pestis
ucaacauugcucggcugacgau

SEQ ID NO: 4175583 - RNA, 17 nt, Yersinia pestis
ucaacauuuaagugcua

SEQ ID NO: 4175584 - RNA, 22 nt, Yersinia pestis
ucaacauuuaagugcuaaucau

SEQ ID NO: 4175585 - RNA, 17 nt, Yersinia pestis
ucaaccacgguaauagc

SEQ ID NO: 4175586 - RNA, 21 nt, Yersinia pestis
ucaaccauucauacugacuua

SEQ ID NO: 4175587 - RNA, 17 nt, Yersinia pestis
ucaaccccuucuucacc

SEQ ID NO: 4175588 - RNA, 22 nt, Yersinia pestis
ucaaccgccagugccaccguaa

SEQ ID NO: 4175589 - RNA, 16 nt, Yersinia pestis
ucaaccucuuguaaac

SEQ ID NO: 4175590 - RNA, 16 nt, Yersinia pestis
ucaaccugaucaucaa

SEQ ID NO: 4175591 - RNA, 17 nt, Yersinia pestis
ucaaccugccagccuga

SEQ ID NO: 4175592 - RNA, 13 nt, Yersinia pestis
ucaaccuuuuccg

SEQ ID NO: 4175593 - RNA, 11 nt, Yersinia pestis
ucaacgauaua

SEQ ID NO: 4175594 - RNA, 20 nt, Yersinia pestis
ucaacgcaccauccagcaaa

SEQ ID NO: 4175595 - RNA, 19 nt, Yersinia pestis
ucaacgcaccccacaaccu

SEQ ID NO: 4175596 - RNA, 19 nt, Yersinia pestis
ucaacgcccagcuuuagca

SEQ ID NO: 4175597 - RNA, 21 nt, Yersinia pestis
ucaacgcccgcggccaauagc

SEQ ID NO: 4175598 - RNA, 22 nt, Yersinia pestis
ucaacgcccgcggccaauagca

SEQ ID NO: 4175599 - RNA, 15 nt, Yersinia pestis
ucaacgcucaaucac

SEQ ID NO: 4175600 - RNA, 22 nt, Yersinia pestis
ucaacgcuccgguuuucacccc

SEQ ID NO: 4175601 - RNA, 20 nt, Yersinia pestis
ucaacggguaauuuacugac

SEQ ID NO: 4175602 - RNA, 16 nt, Yersinia pestis
ucaacguguuguuuuc

SEQ ID NO: 4175603 - RNA, 19 nt, Yersinia pestis
ucaacguguuguuuucaug

SEQ ID NO: 4175604 - RNA, 13 nt, Yersinia pestis
ucaacuaauauua

SEQ ID NO: 4175605 - RNA, 22 nt, Yersinia pestis
ucaacuaccccacauucaguac

SEQ ID NO: 4175606 - RNA, 18 nt, Yersinia pestis
ucaacuauugcaucuuua

SEQ ID NO: 4175607 - RNA, 16 nt, Yersinia pestis
ucaacucaaaacaauu

SEQ ID NO: 4175608 - RNA, 17 nt, Yersinia pestis
ucaacugcucaacugcu

SEQ ID NO: 4175609 - RNA, 14 nt, Yersinia pestis
ucaacuuccgcguu

SEQ ID NO: 4175610 - RNA, 14 nt, Yersinia pestis
ucaacuucugcaaa

SEQ ID NO: 4175611 - RNA, 16 nt, Yersinia pestis
ucaacuuuaauaugca

SEQ ID NO: 4175612 - RNA, 16 nt, Yersinia pestis
ucaacuuucucuggca

SEQ ID NO: 4175613 - RNA, 13 nt, Yersinia pestis
ucaacuuucucuu

SEQ ID NO: 4175614 - RNA, 18 nt, Yersinia pestis
ucaagaaauuuaaaaacc

SEQ ID NO: 4175615 - RNA, 22 nt, Yersinia pestis
ucaagaccgauuuguaagcgga

SEQ ID NO: 4175616 - RNA, 15 nt, Yersinia pestis
ucaagaccugccaau

SEQ ID NO: 4175617 - RNA, 19 nt, Yersinia pestis
ucaagacucaguaaauaua

SEQ ID NO: 4175618 - RNA, 20 nt, Yersinia pestis
ucaagagcgauaaccgcacu

SEQ ID NO: 4175619 - RNA, 18 nt, Yersinia pestis
ucaagaucaaaagcagag

SEQ ID NO: 4175620 - RNA, 13 nt, Yersinia pestis
ucaagaugcaggg

SEQ ID NO: 4175621 - RNA, 18 nt, Yersinia pestis
ucaagauggucauaaaua

SEQ ID NO: 4175622 - RNA, 11 nt, Yersinia pestis
ucaagcaaugg

SEQ ID NO: 4175623 - RNA, 20 nt, Yersinia pestis
ucaagcauucagcuuucucu

SEQ ID NO: 4175624 - RNA, 21 nt, Yersinia pestis
ucaagcauugucauggccuga

SEQ ID NO: 4175625 - RNA, 14 nt, Yersinia pestis
ucaagccaguaacu

SEQ ID NO: 4175626 - RNA, 20 nt, Yersinia pestis
ucaagcccaguuuugcucug

SEQ ID NO: 4175627 - RNA, 17 nt, Yersinia pestis
ucaagccgauaaucccu

SEQ ID NO: 4175628 - RNA, 15 nt, Yersinia pestis
ucaagccgcuuaucu

SEQ ID NO: 4175629 - RNA, 20 nt, Yersinia pestis
ucaagcgcaucggaaaucug

SEQ ID NO: 4175630 - RNA, 16 nt, Yersinia pestis
ucaaggccuucugggc

SEQ ID NO: 4175631 - RNA, 16 nt, Yersinia pestis
ucaaggcggcagagcc

SEQ ID NO: 4175632 - RNA, 15 nt, Yersinia pestis
ucaaggcuacccaau

SEQ ID NO: 4175633 - RNA, 17 nt, Yersinia pestis
ucaaggcuuucuggcga

SEQ ID NO: 4175634 - RNA, 19 nt, Yersinia pestis
ucaagguacccauuauucu

SEQ ID NO: 4175635 - RNA, 16 nt, Yersinia pestis
ucaaguggucuaucau

SEQ ID NO: 4175636 - RNA, 20 nt, Yersinia pestis
ucaaguggucuaucauuuac

SEQ ID NO: 4175637 - RNA, 18 nt, Yersinia pestis
ucaauaaaaaagucacuu

SEQ ID NO: 4175638 - RNA, 22 nt, Yersinia pestis
ucaauaaaaugggccugagugg

SEQ ID NO: 4175639 - RNA, 18 nt, Yersinia pestis
ucaauaaacucuuucauc

SEQ ID NO: 4175640 - RNA, 15 nt, Yersinia pestis
ucaauaaagaacgcg

SEQ ID NO: 4175641 - RNA, 13 nt, Yersinia pestis
ucaauaaauucau

SEQ ID NO: 4175642 - RNA, 18 nt, Yersinia pestis
ucaauaaauucauuagcu

SEQ ID NO: 4175643 - RNA, 13 nt, Yersinia pestis
ucaauaacauuac

SEQ ID NO: 4175644 - RNA, 15 nt, Yersinia pestis
ucaauaacauuacca

SEQ ID NO: 4175645 - RNA, 19 nt, Yersinia pestis
ucaauaaccucacacgauu

SEQ ID NO: 4175646 - RNA, 15 nt, Yersinia pestis
ucaauaagcuggcag

SEQ ID NO: 4175647 - RNA, 21 nt, Yersinia pestis
ucaauaaguagccacuuaaua

SEQ ID NO: 4175648 - RNA, 23 nt, Yersinia pestis
ucaauaaguagccacuuaauaau

SEQ ID NO: 4175649 - RNA, 22 nt, Yersinia pestis
ucaauaagugcaaacuuaaaaa

SEQ ID NO: 4175650 - RNA, 18 nt, Yersinia pestis
ucaauaaguucgucuaau

SEQ ID NO: 4175651 - RNA, 22 nt, Yersinia pestis
ucaauaauaacgaauuucauuu

SEQ ID NO: 4175652 - RNA, 14 nt, Yersinia pestis
ucaauaauuucacu

SEQ ID NO: 4175653 - RNA, 15 nt, Yersinia pestis
ucaauaauuucacua

SEQ ID NO: 4175654 - RNA, 18 nt, Yersinia pestis
ucaauacccugccaccuu

SEQ ID NO: 4175655 - RNA, 14 nt, Yersinia pestis
ucaauaccuuacug

SEQ ID NO: 4175656 - RNA, 17 nt, Yersinia pestis
ucaauaccuuacugcau

SEQ ID NO: 4175657 - RNA, 19 nt, Yersinia pestis
ucaauaccuuacugcauca

SEQ ID NO: 4175658 - RNA, 14 nt, Yersinia pestis
ucaauacgcugucu

SEQ ID NO: 4175659 - RNA, 18 nt, Yersinia pestis
ucaauacguugaauuaaa

SEQ ID NO: 4175660 - RNA, 22 nt, Yersinia pestis
ucaauacguugaauuaaaaacc

SEQ ID NO: 4175661 - RNA, 22 nt, Yersinia pestis
ucaauagcauaaauaucaguga

SEQ ID NO: 4175662 - RNA, 22 nt, Yersinia pestis
ucaauagcguuaacgauauaau

SEQ ID NO: 4175663 - RNA, 15 nt, Yersinia pestis
ucaauaggauuuuca

SEQ ID NO: 4175664 - RNA, 21 nt, Yersinia pestis
ucaauaggauuuucaugaucc

SEQ ID NO: 4175665 - RNA, 19 nt, Yersinia pestis
ucaauaggccagcaaugcu

SEQ ID NO: 4175666 - RNA, 19 nt, Yersinia pestis
ucaauagggcagaccaguu

SEQ ID NO: 4175667 - RNA, 15 nt, Yersinia pestis
ucaauauaagagaaa

SEQ ID NO: 4175668 - RNA, 16 nt, Yersinia pestis
ucaauauaagagaaau

SEQ ID NO: 4175669 - RNA, 15 nt, Yersinia pestis
ucaauauuaauaaug

SEQ ID NO: 4175670 - RNA, 16 nt, Yersinia pestis
ucaauauuaauaaugc

SEQ ID NO: 4175671 - RNA, 15 nt, Yersinia pestis
ucaaucaauugcccc

SEQ ID NO: 4175672 - RNA, 22 nt, Yersinia pestis
ucaaucaauugcccccaucacu

SEQ ID NO: 4175673 - RNA, 15 nt, Yersinia pestis
ucaaucacuggcaau

SEQ ID NO: 4175674 - RNA, 23 nt, Yersinia pestis
ucaaucacuggcaauaauucaga

SEQ ID NO: 4175675 - RNA, 14 nt, Yersinia pestis
ucaaucauuuuuuu

SEQ ID NO: 4175676 - RNA, 16 nt, Yersinia pestis
ucaauccaaucauucu

SEQ ID NO: 4175677 - RNA, 19 nt, Yersinia pestis
ucaauccggcacaggcucu

SEQ ID NO: 4175678 - RNA, 20 nt, Yersinia pestis
ucaauccgggcaaacgccag

SEQ ID NO: 4175679 - RNA, 23 nt, Yersinia pestis
ucaauccgggcaaacgccagugc

SEQ ID NO: 4175680 - RNA, 22 nt, Yersinia pestis
ucaauccuacaauaucuucccu

SEQ ID NO: 4175681 - RNA, 19 nt, Yersinia pestis
ucaaucgccugcugaacuu

SEQ ID NO: 4175682 - RNA, 17 nt, Yersinia pestis
ucaaucgcgaugaaggc

SEQ ID NO: 4175683 - RNA, 14 nt, Yersinia pestis
ucaaucggcagugc

SEQ ID NO: 4175684 - RNA, 19 nt, Yersinia pestis
ucaaucgucaauccaauca

SEQ ID NO: 4175685 - RNA, 16 nt, Yersinia pestis
ucaaucguuuuaauuu

SEQ ID NO: 4175686 - RNA, 23 nt, Yersinia pestis
ucaaucuagaggacggcggccuu

SEQ ID NO: 4175687 - RNA, 16 nt, Yersinia pestis
ucaaucucaucaaucg

SEQ ID NO: 4175688 - RNA, 15 nt, Yersinia pestis
ucaaugaccacuaaa

SEQ ID NO: 4175689 - RNA, 23 nt, Yersinia pestis
ucaaugacgacuggcauuuuuau

SEQ ID NO: 4175690 - RNA, 23 nt, Yersinia pestis
ucaaugacuccugaaauaaagaa

SEQ ID NO: 4175691 - RNA, 14 nt, Yersinia pestis
ucaaugagcauacc

SEQ ID NO: 4175692 - RNA, 18 nt, Yersinia pestis
ucaaugagcauaccgguu

SEQ ID NO: 4175693 - RNA, 19 nt, Yersinia pestis
ucaaugcauuguaaaauaa

SEQ ID NO: 4175694 - RNA, 14 nt, Yersinia pestis
ucaaugccuuggca

SEQ ID NO: 4175695 - RNA, 23 nt, Yersinia pestis
ucaaugcuggcaguggcggcaaa

SEQ ID NO: 4175696 - RNA, 15 nt, Yersinia pestis
ucaaugcuuuccgca

SEQ ID NO: 4175697 - RNA, 19 nt, Yersinia pestis
ucaaugcuuuuguacgaaa

SEQ ID NO: 4175698 - RNA, 23 nt, Yersinia pestis
ucaauggauucuugcugcaaccg

SEQ ID NO: 4175699 - RNA, 12 nt, Yersinia pestis
ucaauggccagc

SEQ ID NO: 4175700 - RNA, 19 nt, Yersinia pestis
ucaauggcguuauguaaaa

SEQ ID NO: 4175701 - RNA, 21 nt, Yersinia pestis
ucaaugggauccgcgauaacg

SEQ ID NO: 4175702 - RNA, 21 nt, Yersinia pestis
ucaauggucaugcacaguugu

SEQ ID NO: 4175703 - RNA, 19 nt, Yersinia pestis
ucaaugugcggaaauaaac

SEQ ID NO: 4175704 - RNA, 22 nt, Yersinia pestis
ucaaugugcggaaauaaacauc

SEQ ID NO: 4175705 - RNA, 21 nt, Yersinia pestis
ucaauguuggcccaagauacu

SEQ ID NO: 4175706 - RNA, 13 nt, Yersinia pestis
ucaauuaucaaaa

SEQ ID NO: 4175707 - RNA, 16 nt, Yersinia pestis
ucaauucgaugauuua

SEQ ID NO: 4175708 - RNA, 16 nt, Yersinia pestis
ucaauucucccauuua

SEQ ID NO: 4175709 - RNA, 16 nt, Yersinia pestis
ucaauugauccugugc

SEQ ID NO: 4175710 - RNA, 22 nt, Yersinia pestis
ucaauuggacuaaccccaauau

SEQ ID NO: 4175711 - RNA, 18 nt, Yersinia pestis
ucaauuuccaucugcaau

SEQ ID NO: 4175712 - RNA, 13 nt, Yersinia pestis
ucacaaaauaaua

SEQ ID NO: 4175713 - RNA, 15 nt, Yersinia pestis
ucacaacagugcaac

SEQ ID NO: 4175714 - RNA, 16 nt, Yersinia pestis
ucacaacuuucccagu

SEQ ID NO: 4175715 - RNA, 15 nt, Yersinia pestis
ucacaacuuuuauug

SEQ ID NO: 4175716 - RNA, 20 nt, Yersinia pestis
ucacaacuuuuauuggcauu

SEQ ID NO: 4175717 - RNA, 18 nt, Yersinia pestis
ucacaauacagcaaauag

SEQ ID NO: 4175718 - RNA, 22 nt, Yersinia pestis
ucacaauacagcaaauagguuu

SEQ ID NO: 4175719 - RNA, 22 nt, Yersinia pestis
ucacaaucgcauugacgauauc

SEQ ID NO: 4175720 - RNA, 18 nt, Yersinia pestis
ucacaaucucuggcaacg

SEQ ID NO: 4175721 - RNA, 22 nt, Yersinia pestis
ucacacacuaauaauaauuaau

SEQ ID NO: 4175722 - RNA, 13 nt, Yersinia pestis
ucacacagccagc

SEQ ID NO: 4175723 - RNA, 17 nt, Yersinia pestis
ucacacagccagccuua

SEQ ID NO: 4175724 - RNA, 16 nt, Yersinia pestis
ucacaccaguuacuuu

SEQ ID NO: 4175725 - RNA, 14 nt, Yersinia pestis
ucacacgcccaggc

SEQ ID NO: 4175726 - RNA, 16 nt, Yersinia pestis
ucacacgcccaggcca

SEQ ID NO: 4175727 - RNA, 23 nt, Yersinia pestis
ucacacuggguaaggcaaacuuu

SEQ ID NO: 4175728 - RNA, 17 nt, Yersinia pestis
ucacacuguuuaguuca

SEQ ID NO: 4175729 - RNA, 19 nt, Yersinia pestis
ucacacuguuuaguucacg

SEQ ID NO: 4175730 - RNA, 18 nt, Yersinia pestis
ucacagacguuuaaauaa

SEQ ID NO: 4175731 - RNA, 12 nt, Yersinia pestis
ucacagauaaac

SEQ ID NO: 4175732 - RNA, 18 nt, Yersinia pestis
ucacagcagaacaaaaca

SEQ ID NO: 4175733 - RNA, 14 nt, Yersinia pestis
ucacagcauucaga

SEQ ID NO: 4175734 - RNA, 22 nt, Yersinia pestis
ucacaggcuucgacaggcaauu

SEQ ID NO: 4175735 - RNA, 15 nt, Yersinia pestis
ucacauaaauaaguu

SEQ ID NO: 4175736 - RNA, 20 nt, Yersinia pestis
ucacauagugcaaaauucca

SEQ ID NO: 4175737 - RNA, 21 nt, Yersinia pestis
ucacaucacagugccaaaaga

SEQ ID NO: 4175738 - RNA, 16 nt, Yersinia pestis
ucacaucauaaucggu

SEQ ID NO: 4175739 - RNA, 14 nt, Yersinia pestis
ucacaucauccacu

SEQ ID NO: 4175740 - RNA, 14 nt, Yersinia pestis
ucacaucaucuuuu

SEQ ID NO: 4175741 - RNA, 15 nt, Yersinia pestis
ucacauccccugccg

SEQ ID NO: 4175742 - RNA, 17 nt, Yersinia pestis
ucacauccgaucagcca

SEQ ID NO: 4175743 - RNA, 19 nt, Yersinia pestis
ucacaucgcccugcucuuc

SEQ ID NO: 4175744 - RNA, 15 nt, Yersinia pestis
ucacaugacugaaca

SEQ ID NO: 4175745 - RNA, 23 nt, Yersinia pestis
ucacaugcggauugaacugcgcu

SEQ ID NO: 4175746 - RNA, 24 nt, Yersinia pestis
ucacaugcggauugaacugcgcua

SEQ ID NO: 4175747 - RNA, 16 nt, Yersinia pestis
ucacaugugcaauuaa

SEQ ID NO: 4175748 - RNA, 14 nt, Yersinia pestis
ucacauuuuuaaua

SEQ ID NO: 4175749 - RNA, 20 nt, Yersinia pestis
ucacauuuuuaauaaugugu

SEQ ID NO: 4175750 - RNA, 19 nt, Yersinia pestis
ucaccaaaaucccaaaaua

SEQ ID NO: 4175751 - RNA, 19 nt, Yersinia pestis
ucaccaaaggaagccgagc

SEQ ID NO: 4175752 - RNA, 17 nt, Yersinia pestis
ucaccaacaccaccauc

SEQ ID NO: 4175753 - RNA, 15 nt, Yersinia pestis
ucaccaaccaaccau

SEQ ID NO: 4175754 - RNA, 21 nt, Yersinia pestis
ucaccaaccaaccaucaccau

SEQ ID NO: 4175755 - RNA, 20 nt, Yersinia pestis
ucaccaauauguucaucagg

SEQ ID NO: 4175756 - RNA, 23 nt, Yersinia pestis
ucaccaauauguucaucagggaa

SEQ ID NO: 4175757 - RNA, 13 nt, Yersinia pestis
ucaccaccacuuu

SEQ ID NO: 4175758 - RNA, 24 nt, Yersinia pestis
ucaccaccauuaacaagcgaccau

SEQ ID NO: 4175759 - RNA, 18 nt, Yersinia pestis
ucaccacgauuagccaua

SEQ ID NO: 4175760 - RNA, 18 nt, Yersinia pestis
ucaccacgcacgauauuc

SEQ ID NO: 4175761 - RNA, 22 nt, Yersinia pestis
ucaccacggcuuucaauaaaac

SEQ ID NO: 4175762 - RNA, 16 nt, Yersinia pestis
ucaccacgucaccuuu

SEQ ID NO: 4175763 - RNA, 14 nt, Yersinia pestis
ucaccagacaacca

SEQ ID NO: 4175764 - RNA, 18 nt, Yersinia pestis
ucaccagacaaccaauac

SEQ ID NO: 4175765 - RNA, 21 nt, Yersinia pestis
ucaccagacaaccaauacaca

SEQ ID NO: 4175766 - RNA, 15 nt, Yersinia pestis
ucaccagaugccgca

SEQ ID NO: 4175767 - RNA, 21 nt, Yersinia pestis
ucaccagaugccgcacacauc

SEQ ID NO: 4175768 - RNA, 14 nt, Yersinia pestis
ucaccauaacugcu

SEQ ID NO: 4175769 - RNA, 14 nt, Yersinia pestis
ucaccauauucauc

SEQ ID NO: 4175770 - RNA, 19 nt, Yersinia pestis
ucaccauccggguuuaucc

SEQ ID NO: 4175771 - RNA, 15 nt, Yersinia pestis
ucaccaucgccccug

SEQ ID NO: 4175772 - RNA, 20 nt, Yersinia pestis
ucaccaucugguucgguaua

SEQ ID NO: 4175773 - RNA, 20 nt, Yersinia pestis
ucaccaugauuucgacauca

SEQ ID NO: 4175774 - RNA, 15 nt, Yersinia pestis
ucaccauuuauugcc

SEQ ID NO: 4175775 - RNA, 18 nt, Yersinia pestis
ucacccaauaagauaaac

SEQ ID NO: 4175776 - RNA, 21 nt, Yersinia pestis
ucacccaauaagauaaacagc

SEQ ID NO: 4175777 - RNA, 19 nt, Yersinia pestis
ucacccauacgaucagcaa

SEQ ID NO: 4175778 - RNA, 14 nt, Yersinia pestis
ucacccauuuuauc

SEQ ID NO: 4175779 - RNA, 15 nt, Yersinia pestis
ucaccccacuuucca

SEQ ID NO: 4175780 - RNA, 14 nt, Yersinia pestis
ucaccccagucacu

SEQ ID NO: 4175781 - RNA, 19 nt, Yersinia pestis
ucaccccagucacugacuu

SEQ ID NO: 4175782 - RNA, 20 nt, Yersinia pestis
ucaccccgcguugucagcca

SEQ ID NO: 4175783 - RNA, 17 nt, Yersinia pestis
ucacccgauacaggcuc

SEQ ID NO: 4175784 - RNA, 19 nt, Yersinia pestis
ucacccgcaaaacugaagc

SEQ ID NO: 4175785 - RNA, 20 nt, Yersinia pestis
ucacccgucaggaugcggau

SEQ ID NO: 4175786 - RNA, 12 nt, Yersinia pestis
ucacccucugca

SEQ ID NO: 4175787 - RNA, 20 nt, Yersinia pestis
ucacccucugcagcuugcaa

SEQ ID NO: 4175788 - RNA, 14 nt, Yersinia pestis
ucacccuggcucug

SEQ ID NO: 4175789 - RNA, 22 nt, Yersinia pestis
ucacccuuuugaauucaccaaa

SEQ ID NO: 4175790 - RNA, 16 nt, Yersinia pestis
ucaccgaaagaagaca

SEQ ID NO: 4175791 - RNA, 15 nt, Yersinia pestis
ucaccgagaucaccu

SEQ ID NO: 4175792 - RNA, 22 nt, Yersinia pestis
ucaccgauacuuccagugguuu

SEQ ID NO: 4175793 - RNA, 23 nt, Yersinia pestis
ucaccgaugauaagugaauaaau

SEQ ID NO: 4175794 - RNA, 23 nt, Yersinia pestis
ucaccgcccccaauaagggccac

SEQ ID NO: 4175795 - RNA, 18 nt, Yersinia pestis
ucaccgccuuucauucug

SEQ ID NO: 4175796 - RNA, 12 nt, Yersinia pestis
ucaccgcgggcu

SEQ ID NO: 4175797 - RNA, 18 nt, Yersinia pestis
ucaccguaaccauuggca

SEQ ID NO: 4175798 - RNA, 24 nt, Yersinia pestis
ucaccguagaacgucaccgccaaa

SEQ ID NO: 4175799 - RNA, 22 nt, Yersinia pestis
ucaccgugacuguuaacaucca

SEQ ID NO: 4175800 - RNA, 18 nt, Yersinia pestis
ucaccguucaagaucgcg

SEQ ID NO: 4175801 - RNA, 12 nt, Yersinia pestis
ucaccuaaauca

SEQ ID NO: 4175802 - RNA, 16 nt, Yersinia pestis
ucaccuaaaucauaca

SEQ ID NO: 4175803 - RNA, 21 nt, Yersinia pestis
ucaccuaccgguguugagguc

SEQ ID NO: 4175804 - RNA, 22 nt, Yersinia pestis
ucaccuauaauuaacagcauca

SEQ ID NO: 4175805 - RNA, 12 nt, Yersinia pestis
ucaccucaucag

SEQ ID NO: 4175806 - RNA, 13 nt, Yersinia pestis
ucaccucaucagu

SEQ ID NO: 4175807 - RNA, 15 nt, Yersinia pestis
ucaccuccacuucaa

SEQ ID NO: 4175808 - RNA, 20 nt, Yersinia pestis
ucaccucgaugcuuucaucg

SEQ ID NO: 4175809 - RNA, 21 nt, Yersinia pestis
ucaccucuucagguaagccuu

SEQ ID NO: 4175810 - RNA, 18 nt, Yersinia pestis
ucaccugaaugccauuca

SEQ ID NO: 4175811 - RNA, 15 nt, Yersinia pestis
ucaccugaguaauau

SEQ ID NO: 4175812 - RNA, 14 nt, Yersinia pestis
ucaccugcuuaguu

SEQ ID NO: 4175813 - RNA, 12 nt, Yersinia pestis
ucaccuggccag

SEQ ID NO: 4175814 - RNA, 16 nt, Yersinia pestis
ucaccugucaccuacc

SEQ ID NO: 4175815 - RNA, 16 nt, Yersinia pestis
ucaccugucaccuguc

SEQ ID NO: 4175816 - RNA, 16 nt, Yersinia pestis
ucaccuugauuaauaa

SEQ ID NO: 4175817 - RNA, 13 nt, Yersinia pestis
ucaccuuggaaaa

SEQ ID NO: 4175818 - RNA, 17 nt, Yersinia pestis
ucaccuuggaaaacagc

SEQ ID NO: 4175819 - RNA, 24 nt, Yersinia pestis
ucaccuuugaucauggcuugugca

SEQ ID NO: 4175820 - RNA, 12 nt, Yersinia pestis
ucacgaauagcg

SEQ ID NO: 4175821 - RNA, 15 nt, Yersinia pestis
ucacgaauaguaucu

SEQ ID NO: 4175822 - RNA, 18 nt, Yersinia pestis
ucacgagggcuuaugcuu

SEQ ID NO: 4175823 - RNA, 18 nt, Yersinia pestis
ucacgagugaacguagcc

SEQ ID NO: 4175824 - RNA, 15 nt, Yersinia pestis
ucacgauaauaucga

SEQ ID NO: 4175825 - RNA, 21 nt, Yersinia pestis
ucacgauagcaaugaccuuac

SEQ ID NO: 4175826 - RNA, 15 nt, Yersinia pestis
ucacgauagccagug

SEQ ID NO: 4175827 - RNA, 15 nt, Yersinia pestis
ucacgauggaaaaaa

SEQ ID NO: 4175828 - RNA, 18 nt, Yersinia pestis
ucacgauggaaaaaauac

SEQ ID NO: 4175829 - RNA, 12 nt, Yersinia pestis
ucacgcaaaggg

SEQ ID NO: 4175830 - RNA, 23 nt, Yersinia pestis
ucacgcaaauaaagggccugcaa

SEQ ID NO: 4175831 - RNA, 13 nt, Yersinia pestis
ucacgcacccacc

SEQ ID NO: 4175832 - RNA, 19 nt, Yersinia pestis
ucacgcacccaccaagggu

SEQ ID NO: 4175833 - RNA, 14 nt, Yersinia pestis
ucacgcacgguaca

SEQ ID NO: 4175834 - RNA, 20 nt, Yersinia pestis
ucacgcacgguacagagggc

SEQ ID NO: 4175835 - RNA, 23 nt, Yersinia pestis
ucacgcagguaguuaguggcuuu

SEQ ID NO: 4175836 - RNA, 21 nt, Yersinia pestis
ucacgcuaccggaaccaacgg

SEQ ID NO: 4175837 - RNA, 14 nt, Yersinia pestis
ucacgcugaauaac

SEQ ID NO: 4175838 - RNA, 22 nt, Yersinia pestis
ucacgcugguuaucacagcaaa

SEQ ID NO: 4175839 - RNA, 20 nt, Yersinia pestis
ucacggaaaucugcggcacu

SEQ ID NO: 4175840 - RNA, 21 nt, Yersinia pestis
ucacggagaauaaaaaugaua

SEQ ID NO: 4175841 - RNA, 17 nt, Yersinia pestis
ucacggcuuugcugugc

SEQ ID NO: 4175842 - RNA, 13 nt, Yersinia pestis
ucacgggcuucca

SEQ ID NO: 4175843 - RNA, 21 nt, Yersinia pestis
ucacgggcuuccaucaggaag

SEQ ID NO: 4175844 - RNA, 18 nt, Yersinia pestis
ucacgguagguuucuggg

SEQ ID NO: 4175845 - RNA, 17 nt, Yersinia pestis
ucacgguucaccccuca

SEQ ID NO: 4175846 - RNA, 16 nt, Yersinia pestis
ucacguaccaaaucag

SEQ ID NO: 4175847 - RNA, 19 nt, Yersinia pestis
ucacguaccaaaucagcaa

SEQ ID NO: 4175848 - RNA, 15 nt, Yersinia pestis
ucacguacugggugu

SEQ ID NO: 4175849 - RNA, 23 nt, Yersinia pestis
ucacguauuuucauuuuaacaac

SEQ ID NO: 4175850 - RNA, 15 nt, Yersinia pestis
ucacgucaguaauga

SEQ ID NO: 4175851 - RNA, 20 nt, Yersinia pestis
ucacguucauccgcagcaaa

SEQ ID NO: 4175852 - RNA, 13 nt, Yersinia pestis
ucacguuuuucca

SEQ ID NO: 4175853 - RNA, 15 nt, Yersinia pestis
ucacguuuuuccauu

SEQ ID NO: 4175854 - RNA, 14 nt, Yersinia pestis
ucacuaaaacugaa

SEQ ID NO: 4175855 - RNA, 16 nt, Yersinia pestis
ucacuaaaacugaagc

SEQ ID NO: 4175856 - RNA, 16 nt, Yersinia pestis
ucacuaaaccuugaau

SEQ ID NO: 4175857 - RNA, 18 nt, Yersinia pestis
ucacuaacgacagauuag

SEQ ID NO: 4175858 - RNA, 14 nt, Yersinia pestis
ucacuacagcauuu

SEQ ID NO: 4175859 - RNA, 13 nt, Yersinia pestis
ucacuagcgggcc

SEQ ID NO: 4175860 - RNA, 15 nt, Yersinia pestis
ucacuauaauuauuu

SEQ ID NO: 4175861 - RNA, 18 nt, Yersinia pestis
ucacuauaauuauuucuc

SEQ ID NO: 4175862 - RNA, 22 nt, Yersinia pestis
ucacuauaauuauuucucugau

SEQ ID NO: 4175863 - RNA, 21 nt, Yersinia pestis
ucacuauuucguguauaucac

SEQ ID NO: 4175864 - RNA, 20 nt, Yersinia pestis
ucacucaauuggacuaaccc

SEQ ID NO: 4175865 - RNA, 20 nt, Yersinia pestis
ucacucuucgugcuuauuuu

SEQ ID NO: 4175866 - RNA, 15 nt, Yersinia pestis
ucacugaccgauuga

SEQ ID NO: 4175867 - RNA, 20 nt, Yersinia pestis
ucacugaugagcuggcaaaa

SEQ ID NO: 4175868 - RNA, 16 nt, Yersinia pestis
ucacugccaucucaug

SEQ ID NO: 4175869 - RNA, 13 nt, Yersinia pestis
ucacuggaaaaag

SEQ ID NO: 4175870 - RNA, 15 nt, Yersinia pestis
ucacuggcaccauuu

SEQ ID NO: 4175871 - RNA, 15 nt, Yersinia pestis
ucacuggcaccgcuu

SEQ ID NO: 4175872 - RNA, 16 nt, Yersinia pestis
ucacuggccgcaggcg

SEQ ID NO: 4175873 - RNA, 19 nt, Yersinia pestis
ucacugucaaaaagcaccu

SEQ ID NO: 4175874 - RNA, 21 nt, Yersinia pestis
ucacugucaaaaagcaccuuu

SEQ ID NO: 4175875 - RNA, 15 nt, Yersinia pestis
ucacugucagacagu

SEQ ID NO: 4175876 - RNA, 17 nt, Yersinia pestis
ucacuguccaagaagcc

SEQ ID NO: 4175877 - RNA, 22 nt, Yersinia pestis
ucacugucuauuuuuauaauca

SEQ ID NO: 4175878 - RNA, 14 nt, Yersinia pestis
ucacugugcuuuuc

SEQ ID NO: 4175879 - RNA, 13 nt, Yersinia pestis
ucacuguuagcua

SEQ ID NO: 4175880 - RNA, 18 nt, Yersinia pestis
ucacuuaaaaaucaauaa

SEQ ID NO: 4175881 - RNA, 18 nt, Yersinia pestis
ucacuucaauguuuuuau

SEQ ID NO: 4175882 - RNA, 18 nt, Yersinia pestis
ucacuucgauucaucaua

SEQ ID NO: 4175883 - RNA, 15 nt, Yersinia pestis
ucacuucgcggacgc

SEQ ID NO: 4175884 - RNA, 14 nt, Yersinia pestis
ucacuucugcugcc

SEQ ID NO: 4175885 - RNA, 19 nt, Yersinia pestis
ucacuuuuaugacggcauc

SEQ ID NO: 4175886 - RNA, 15 nt, Yersinia pestis
ucacuuuuugucaau

SEQ ID NO: 4175887 - RNA, 21 nt, Yersinia pestis
ucagaaaggacaguaauauuu

SEQ ID NO: 4175888 - RNA, 22 nt, Yersinia pestis
ucagaaaggacaguaauauuuu

SEQ ID NO: 4175889 - RNA, 20 nt, Yersinia pestis
ucagaaauaaauucaucuca

SEQ ID NO: 4175890 - RNA, 17 nt, Yersinia pestis
ucagacacguaaaacag

SEQ ID NO: 4175891 - RNA, 14 nt, Yersinia pestis
ucagacagccauca

SEQ ID NO: 4175892 - RNA, 13 nt, Yersinia pestis
ucagacauuuuuc

SEQ ID NO: 4175893 - RNA, 20 nt, Yersinia pestis
ucagacauuuuucuauuucu

SEQ ID NO: 4175894 - RNA, 23 nt, Yersinia pestis
ucagacauuuuucuauuucuggu

SEQ ID NO: 4175895 - RNA, 20 nt, Yersinia pestis
ucagacgacgugcagcgcgc

SEQ ID NO: 4175896 - RNA, 17 nt, Yersinia pestis
ucagacggcagcaacga

SEQ ID NO: 4175897 - RNA, 19 nt, Yersinia pestis
ucagacuaccaaaauuuaa

SEQ ID NO: 4175898 - RNA, 17 nt, Yersinia pestis
ucagacugcugacaaac

SEQ ID NO: 4175899 - RNA, 16 nt, Yersinia pestis
ucagacugcugacaac

SEQ ID NO: 4175900 - RNA, 18 nt, Yersinia pestis
ucagacuucuuccaucuu

SEQ ID NO: 4175901 - RNA, 12 nt, Yersinia pestis
ucagagcagcau

SEQ ID NO: 4175902 - RNA, 22 nt, Yersinia pestis
ucagagcucgcuagucaucacu

SEQ ID NO: 4175903 - RNA, 23 nt, Yersinia pestis
ucagagucugucauggcacgcuu

SEQ ID NO: 4175904 - RNA, 13 nt, Yersinia pestis
ucagauaagaucu

SEQ ID NO: 4175905 - RNA, 15 nt, Yersinia pestis
ucagauacggcucca

SEQ ID NO: 4175906 - RNA, 18 nt, Yersinia pestis
ucagauacggcuccagaa

SEQ ID NO: 4175907 - RNA, 13 nt, Yersinia pestis
ucagauaucugcu

SEQ ID NO: 4175908 - RNA, 21 nt, Yersinia pestis
ucagauaucugcucauuacca

SEQ ID NO: 4175909 - RNA, 14 nt, Yersinia pestis
ucagaucaacagau

SEQ ID NO: 4175910 - RNA, 22 nt, Yersinia pestis
ucagaucaacagauuuuccauc

SEQ ID NO: 4175911 - RNA, 22 nt, Yersinia pestis
ucagaucauugccgagguuaua

SEQ ID NO: 4175912 - RNA, 14 nt, Yersinia pestis
ucagaucgcgucau

SEQ ID NO: 4175913 - RNA, 17 nt, Yersinia pestis
ucagaugaucaaauuau

SEQ ID NO: 4175914 - RNA, 16 nt, Yersinia pestis
ucagaugcugacgggc

SEQ ID NO: 4175915 - RNA, 21 nt, Yersinia pestis
ucagauuagucuuagacguca

SEQ ID NO: 4175916 - RNA, 19 nt, Yersinia pestis
ucagauuaguuuuagacgu

SEQ ID NO: 4175917 - RNA, 21 nt, Yersinia pestis
ucagauuaguuuuagacguca

SEQ ID NO: 4175918 - RNA, 16 nt, Yersinia pestis
ucagcaaaaauaacgu

SEQ ID NO: 4175919 - RNA, 17 nt, Yersinia pestis
ucagcaaaguauuuaua

SEQ ID NO: 4175920 - RNA, 14 nt, Yersinia pestis
ucagcaaaucaaac

SEQ ID NO: 4175921 - RNA, 13 nt, Yersinia pestis
ucagcaaaucuug

SEQ ID NO: 4175922 - RNA, 15 nt, Yersinia pestis
ucagcaaauuuugca

SEQ ID NO: 4175923 - RNA, 20 nt, Yersinia pestis
ucagcaacuugguaccaguc

SEQ ID NO: 4175924 - RNA, 15 nt, Yersinia pestis
ucagcaagcugcuca

SEQ ID NO: 4175925 - RNA, 17 nt, Yersinia pestis
ucagcaagcugcucaau

SEQ ID NO: 4175926 - RNA, 21 nt, Yersinia pestis
ucagcaagcugcucaaugcgu

SEQ ID NO: 4175927 - RNA, 18 nt, Yersinia pestis
ucagcaagguucucgcug

SEQ ID NO: 4175928 - RNA, 18 nt, Yersinia pestis
ucagcacgcuuuccagcu

SEQ ID NO: 4175929 - RNA, 15 nt, Yersinia pestis
ucagcacugcuuuuu

SEQ ID NO: 4175930 - RNA, 11 nt, Yersinia pestis
ucagcagagag

SEQ ID NO: 4175931 - RNA, 15 nt, Yersinia pestis
ucagcagucugaaau

SEQ ID NO: 4175932 - RNA, 21 nt, Yersinia pestis
ucagcagucugaaaucuccuc

SEQ ID NO: 4175933 - RNA, 19 nt, Yersinia pestis
ucagcagucugagccucau

SEQ ID NO: 4175934 - RNA, 22 nt, Yersinia pestis
ucagcagucugagccucaugaa

SEQ ID NO: 4175935 - RNA, 17 nt, Yersinia pestis
ucagcagucugaggccc

SEQ ID NO: 4175936 - RNA, 13 nt, Yersinia pestis
ucagcauaucccu

SEQ ID NO: 4175937 - RNA, 15 nt, Yersinia pestis
ucagcauauuaccca

SEQ ID NO: 4175938 - RNA, 20 nt, Yersinia pestis
ucagcaucccagccaccaug

SEQ ID NO: 4175939 - RNA, 16 nt, Yersinia pestis
ucagcaucuucaauca

SEQ ID NO: 4175940 - RNA, 14 nt, Yersinia pestis
ucagcauggaagau

SEQ ID NO: 4175941 - RNA, 16 nt, Yersinia pestis
ucagcauucucacuua

SEQ ID NO: 4175942 - RNA, 18 nt, Yersinia pestis
ucagcauugauggccuug

SEQ ID NO: 4175943 - RNA, 21 nt, Yersinia pestis
ucagccaaagcauucgcgguu

SEQ ID NO: 4175944 - RNA, 23 nt, Yersinia pestis
ucagccaagucagggaucaccuc

SEQ ID NO: 4175945 - RNA, 22 nt, Yersinia pestis
ucagccacaaaaguucacauga

SEQ ID NO: 4175946 - RNA, 13 nt, Yersinia pestis
ucagccacaucaa

SEQ ID NO: 4175947 - RNA, 12 nt, Yersinia pestis
ucagccaccauu

SEQ ID NO: 4175948 - RNA, 13 nt, Yersinia pestis
ucagccauaacuu

SEQ ID NO: 4175949 - RNA, 16 nt, Yersinia pestis
ucagcccaucuuugau

SEQ ID NO: 4175950 - RNA, 19 nt, Yersinia pestis
ucagcccuaauauccucaa

SEQ ID NO: 4175951 - RNA, 15 nt, Yersinia pestis
ucagccgauguuuga

SEQ ID NO: 4175952 - RNA, 19 nt, Yersinia pestis
ucagccgcgaaaaaccaug

SEQ ID NO: 4175953 - RNA, 20 nt, Yersinia pestis
ucagccgcggcgcuggcaug

SEQ ID NO: 4175954 - RNA, 21 nt, Yersinia pestis
ucagccggagugaugaaacca

SEQ ID NO: 4175955 - RNA, 23 nt, Yersinia pestis
ucagccggagugaugaaaccaaa

SEQ ID NO: 4175956 - RNA, 13 nt, Yersinia pestis
ucagccuauccuc

SEQ ID NO: 4175957 - RNA, 15 nt, Yersinia pestis
ucagccuauccucac

SEQ ID NO: 4175958 - RNA, 19 nt, Yersinia pestis
ucagccuauccucaccguu

SEQ ID NO: 4175959 - RNA, 15 nt, Yersinia pestis
ucagccucauucaug

SEQ ID NO: 4175960 - RNA, 20 nt, Yersinia pestis
ucagccucauucaugaggcu

SEQ ID NO: 4175961 - RNA, 11 nt, Yersinia pestis
ucagccucuga

SEQ ID NO: 4175962 - RNA, 15 nt, Yersinia pestis
ucagccuguugguca

SEQ ID NO: 4175963 - RNA, 15 nt, Yersinia pestis
ucagcgaaaaauuuc

SEQ ID NO: 4175964 - RNA, 17 nt, Yersinia pestis
ucagcgccuuugccccg

SEQ ID NO: 4175965 - RNA, 14 nt, Yersinia pestis
ucagcgcuggcuuu

SEQ ID NO: 4175966 - RNA, 16 nt, Yersinia pestis
ucagcgggaaagcgua

SEQ ID NO: 4175967 - RNA, 21 nt, Yersinia pestis
ucagcguagccguuaaauauc

SEQ ID NO: 4175968 - RNA, 15 nt, Yersinia pestis
ucagcguauagccuu

SEQ ID NO: 4175969 - RNA, 17 nt, Yersinia pestis
ucagcguauggggaaaa

SEQ ID NO: 4175970 - RNA, 15 nt, Yersinia pestis
ucagcguauugugau

SEQ ID NO: 4175971 - RNA, 14 nt, Yersinia pestis
ucagcgucacgaua

SEQ ID NO: 4175972 - RNA, 16 nt, Yersinia pestis
ucagcgucacggaaag

SEQ ID NO: 4175973 - RNA, 14 nt, Yersinia pestis
ucagcgucagcaga

SEQ ID NO: 4175974 - RNA, 13 nt, Yersinia pestis
ucagcgugaauuc

SEQ ID NO: 4175975 - RNA, 22 nt, Yersinia pestis
ucagcgugacguuaucucaacc

SEQ ID NO: 4175976 - RNA, 17 nt, Yersinia pestis
ucagcguggaauuaaua

SEQ ID NO: 4175977 - RNA, 15 nt, Yersinia pestis
ucagcguugacacca

SEQ ID NO: 4175978 - RNA, 13 nt, Yersinia pestis
ucagcuagccugc

SEQ ID NO: 4175979 - RNA, 15 nt, Yersinia pestis
ucagcucauuaaacu

SEQ ID NO: 4175980 - RNA, 15 nt, Yersinia pestis
ucagcugacgcagca

SEQ ID NO: 4175981 - RNA, 22 nt, Yersinia pestis
ucagcugguuagagcacagcac

SEQ ID NO: 4175982 - RNA, 21 nt, Yersinia pestis
ucagcuuaccgguaaguaauu

SEQ ID NO: 4175983 - RNA, 23 nt, Yersinia pestis
ucagcuucuucugggucuaucag

SEQ ID NO: 4175984 - RNA, 17 nt, Yersinia pestis
ucagcuuucucugcgcu

SEQ ID NO: 4175985 - RNA, 14 nt, Yersinia pestis
ucaggaaauuacca

SEQ ID NO: 4175986 - RNA, 13 nt, Yersinia pestis
ucaggaagagaaa

SEQ ID NO: 4175987 - RNA, 19 nt, Yersinia pestis
ucaggaagagaaaagcaga

SEQ ID NO: 4175988 - RNA, 23 nt, Yersinia pestis
ucaggaugaugaauaccaccauc

SEQ ID NO: 4175989 - RNA, 23 nt, Yersinia pestis
ucaggauuggagucaugaggcag

SEQ ID NO: 4175990 - RNA, 17 nt, Yersinia pestis
ucaggcauaucacuauu

SEQ ID NO: 4175991 - RNA, 21 nt, Yersinia pestis
ucaggccgcgccacaacgcau

SEQ ID NO: 4175992 - RNA, 13 nt, Yersinia pestis
ucaggcucaucac

SEQ ID NO: 4175993 - RNA, 18 nt, Yersinia pestis
ucaggcuguugacauaaa

SEQ ID NO: 4175994 - RNA, 16 nt, Yersinia pestis
ucagggagucagggag

SEQ ID NO: 4175995 - RNA, 14 nt, Yersinia pestis
ucagggaucaccuc

SEQ ID NO: 4175996 - RNA, 13 nt, Yersinia pestis
ucagggcaauaac

SEQ ID NO: 4175997 - RNA, 21 nt, Yersinia pestis
ucagggcaauaacaaacacau

SEQ ID NO: 4175998 - RNA, 12 nt, Yersinia pestis
ucagggccacuu

SEQ ID NO: 4175999 - RNA, 22 nt, Yersinia pestis
ucagggccacuucgguggcccu

SEQ ID NO: 4176000 - RNA, 22 nt, Yersinia pestis
ucaggggcaauuaucuuaucca

SEQ ID NO: 4176001 - RNA, 22 nt, Yersinia pestis
ucagguaucgcuuucagcaggg

SEQ ID NO: 4176002 - RNA, 16 nt, Yersinia pestis
ucaggucgauuacaua

SEQ ID NO: 4176003 - RNA, 23 nt, Yersinia pestis
ucaggugaguaaacaccuucaga

SEQ ID NO: 4176004 - RNA, 16 nt, Yersinia pestis
ucagguguuguauaac

SEQ ID NO: 4176005 - RNA, 15 nt, Yersinia pestis
ucagguucaauuccc

SEQ ID NO: 4176006 - RNA, 13 nt, Yersinia pestis
ucagguuguuccg

SEQ ID NO: 4176007 - RNA, 12 nt, Yersinia pestis
ucaguaaaacca

SEQ ID NO: 4176008 - RNA, 20 nt, Yersinia pestis
ucaguaaauauaauuucaaa

SEQ ID NO: 4176009 - RNA, 12 nt, Yersinia pestis
ucaguaacgccu

SEQ ID NO: 4176010 - RNA, 17 nt, Yersinia pestis
ucaguaagauacuugcg

SEQ ID NO: 4176011 - RNA, 17 nt, Yersinia pestis
ucaguaauucacccuuu

SEQ ID NO: 4176012 - RNA, 19 nt, Yersinia pestis
ucaguacagucccugugcg

SEQ ID NO: 4176013 - RNA, 23 nt, Yersinia pestis
ucaguacauaaaccgugugcuuc

SEQ ID NO: 4176014 - RNA, 13 nt, Yersinia pestis
ucaguaccaccac

SEQ ID NO: 4176015 - RNA, 15 nt, Yersinia pestis
ucaguaccaccacca

SEQ ID NO: 4176016 - RNA, 18 nt, Yersinia pestis
ucaguagucaauacaauu

SEQ ID NO: 4176017 - RNA, 12 nt, Yersinia pestis
ucaguauaaauu

SEQ ID NO: 4176018 - RNA, 13 nt, Yersinia pestis
ucaguauaaauug

SEQ ID NO: 4176019 - RNA, 15 nt, Yersinia pestis
ucaguauuggucuua

SEQ ID NO: 4176020 - RNA, 20 nt, Yersinia pestis
ucagucacuuugggcugauc

SEQ ID NO: 4176021 - RNA, 18 nt, Yersinia pestis
ucagucagggugaaagcc

SEQ ID NO: 4176022 - RNA, 21 nt, Yersinia pestis
ucagucaguguuucuauuuuc

SEQ ID NO: 4176023 - RNA, 21 nt, Yersinia pestis
ucagugaaagggaaguuucuu

SEQ ID NO: 4176024 - RNA, 20 nt, Yersinia pestis
ucagugaaggaugaauaaau

SEQ ID NO: 4176025 - RNA, 20 nt, Yersinia pestis
ucagugacugggggugagca

SEQ ID NO: 4176026 - RNA, 19 nt, Yersinia pestis
ucagugcacggcagugauc

SEQ ID NO: 4176027 - RNA, 13 nt, Yersinia pestis
ucaguggcuggaa

SEQ ID NO: 4176028 - RNA, 23 nt, Yersinia pestis
ucaguggugguagauacaauuca

SEQ ID NO: 4176029 - RNA, 16 nt, Yersinia pestis
ucagugucaguucgac

SEQ ID NO: 4176030 - RNA, 22 nt, Yersinia pestis
ucagugugugugcgcugaguga

SEQ ID NO: 4176031 - RNA, 16 nt, Yersinia pestis
ucaguguuagccccuc

SEQ ID NO: 4176032 - RNA, 23 nt, Yersinia pestis
ucaguguuucuauuuucagcaua

SEQ ID NO: 4176033 - RNA, 15 nt, Yersinia pestis
ucaguucagaaagga

SEQ ID NO: 4176034 - RNA, 14 nt, Yersinia pestis
ucaguuccugauuc

SEQ ID NO: 4176035 - RNA, 13 nt, Yersinia pestis
ucaguugauuuua

SEQ ID NO: 4176036 - RNA, 20 nt, Yersinia pestis
ucaguuuacaugauugaaaa

SEQ ID NO: 4176037 - RNA, 21 nt, Yersinia pestis
ucaguuuagcuaaauuuaaga

SEQ ID NO: 4176038 - RNA, 17 nt, Yersinia pestis
ucaguuuuaauuuauga

SEQ ID NO: 4176039 - RNA, 19 nt, Yersinia pestis
ucaguuuuauuguauaaaa

SEQ ID NO: 4176040 - RNA, 20 nt, Yersinia pestis
ucauaaaaacgcaacacagu

SEQ ID NO: 4176041 - RNA, 14 nt, Yersinia pestis
ucauaaaaauacau

SEQ ID NO: 4176042 - RNA, 19 nt, Yersinia pestis
ucauaaaaauacauaucaa

SEQ ID NO: 4176043 - RNA, 20 nt, Yersinia pestis
ucauaaauauuuuaugcccc

SEQ ID NO: 4176044 - RNA, 21 nt, Yersinia pestis
ucauaaauauuuuaugccccc

SEQ ID NO: 4176045 - RNA, 22 nt, Yersinia pestis
ucauaaaucacaauuucacccc

SEQ ID NO: 4176046 - RNA, 12 nt, Yersinia pestis
ucauaaauuaaa

SEQ ID NO: 4176047 - RNA, 17 nt, Yersinia pestis
ucauaaauuaaaacuga

SEQ ID NO: 4176048 - RNA, 18 nt, Yersinia pestis
ucauaacuaagagucaca

SEQ ID NO: 4176049 - RNA, 23 nt, Yersinia pestis
ucauaacuaagagucacagcauu

SEQ ID NO: 4176050 - RNA, 23 nt, Yersinia pestis
ucauaagacuaacagaauauuga

SEQ ID NO: 4176051 - RNA, 22 nt, Yersinia pestis
ucauaagccagugcuauucaua

SEQ ID NO: 4176052 - RNA, 13 nt, Yersinia pestis
ucauaauaaugau

SEQ ID NO: 4176053 - RNA, 15 nt, Yersinia pestis
ucauaauaaugauua

SEQ ID NO: 4176054 - RNA, 13 nt, Yersinia pestis
ucauaauuuugau

SEQ ID NO: 4176055 - RNA, 16 nt, Yersinia pestis
ucauacacaugaaaau

SEQ ID NO: 4176056 - RNA, 18 nt, Yersinia pestis
ucauacacggucuggcaa

SEQ ID NO: 4176057 - RNA, 13 nt, Yersinia pestis
ucauacaucauuu

SEQ ID NO: 4176058 - RNA, 18 nt, Yersinia pestis
ucauacaucauuugagcu

SEQ ID NO: 4176059 - RNA, 19 nt, Yersinia pestis
ucauaccauucucugucuu

SEQ ID NO: 4176060 - RNA, 16 nt, Yersinia pestis
ucauaccggcuucacg

SEQ ID NO: 4176061 - RNA, 19 nt, Yersinia pestis
ucauaccuuacuuccaaua

SEQ ID NO: 4176062 - RNA, 22 nt, Yersinia pestis
ucauaccuuacuuccaauaagu

SEQ ID NO: 4176063 - RNA, 12 nt, Yersinia pestis
ucauacucaguc

SEQ ID NO: 4176064 - RNA, 19 nt, Yersinia pestis
ucauacucccccauuuccu

SEQ ID NO: 4176065 - RNA, 20 nt, Yersinia pestis
ucauagccaucccaauaauu

SEQ ID NO: 4176066 - RNA, 16 nt, Yersinia pestis
ucauauaagcaauacc

SEQ ID NO: 4176067 - RNA, 22 nt, Yersinia pestis
ucauauacaccgcaccacgauu

SEQ ID NO: 4176068 - RNA, 13 nt, Yersinia pestis
ucauauauuaaau

SEQ ID NO: 4176069 - RNA, 14 nt, Yersinia pestis
ucauaucaaaauaa

SEQ ID NO: 4176070 - RNA, 15 nt, Yersinia pestis
ucauaucaaaauaaa

SEQ ID NO: 4176071 - RNA, 17 nt, Yersinia pestis
ucauaucgaucaaccau

SEQ ID NO: 4176072 - RNA, 18 nt, Yersinia pestis
ucauaucgaucaaccauu

SEQ ID NO: 4176073 - RNA, 15 nt, Yersinia pestis
ucauaucgcuaaaac

SEQ ID NO: 4176074 - RNA, 16 nt, Yersinia pestis
ucauaucgcuaaaaca

SEQ ID NO: 4176075 - RNA, 19 nt, Yersinia pestis
ucauaucuuuaccuguuuc

SEQ ID NO: 4176076 - RNA, 16 nt, Yersinia pestis
ucauaugcgcgucaau

SEQ ID NO: 4176077 - RNA, 19 nt, Yersinia pestis
ucauaugcgguaaugacuu

SEQ ID NO: 4176078 - RNA, 21 nt, Yersinia pestis
ucauauucagccgauguguuu

SEQ ID NO: 4176079 - RNA, 21 nt, Yersinia pestis
ucauauucaugguuucaaaau

SEQ ID NO: 4176080 - RNA, 13 nt, Yersinia pestis
ucauauuggccag

SEQ ID NO: 4176081 - RNA, 15 nt, Yersinia pestis
ucauauuguuaauuu

SEQ ID NO: 4176082 - RNA, 21 nt, Yersinia pestis
ucaucaaaauugauggucugu

SEQ ID NO: 4176083 - RNA, 12 nt, Yersinia pestis
ucaucaaaggca

SEQ ID NO: 4176084 - RNA, 15 nt, Yersinia pestis
ucaucaaauucaggu

SEQ ID NO: 4176085 - RNA, 21 nt, Yersinia pestis
ucaucaaccgggauaucaaau

SEQ ID NO: 4176086 - RNA, 15 nt, Yersinia pestis
ucaucaaccucagcc

SEQ ID NO: 4176087 - RNA, 16 nt, Yersinia pestis
ucaucaaguauuuuac

SEQ ID NO: 4176088 - RNA, 15 nt, Yersinia pestis
ucaucaauaccgaaa

SEQ ID NO: 4176089 - RNA, 22 nt, Yersinia pestis
ucaucacauucaaacacuuaug

SEQ ID NO: 4176090 - RNA, 19 nt, Yersinia pestis
ucaucaccagucagccuua

SEQ ID NO: 4176091 - RNA, 13 nt, Yersinia pestis
ucaucaccauuca

SEQ ID NO: 4176092 - RNA, 20 nt, Yersinia pestis
ucaucaccguugaaaugucc

SEQ ID NO: 4176093 - RNA, 17 nt, Yersinia pestis
ucaucaccuuccaaacu

SEQ ID NO: 4176094 - RNA, 20 nt, Yersinia pestis
ucaucacuaacgacagauua

SEQ ID NO: 4176095 - RNA, 13 nt, Yersinia pestis
ucaucacugcuau

SEQ ID NO: 4176096 - RNA, 16 nt, Yersinia pestis
ucaucagagucuguca

SEQ ID NO: 4176097 - RNA, 13 nt, Yersinia pestis
ucaucagcgccuu

SEQ ID NO: 4176098 - RNA, 14 nt, Yersinia pestis
ucaucagcgcuggc

SEQ ID NO: 4176099 - RNA, 14 nt, Yersinia pestis
ucaucauaaaaaua

SEQ ID NO: 4176100 - RNA, 18 nt, Yersinia pestis
ucaucauaaaaauacaua

SEQ ID NO: 4176101 - RNA, 23 nt, Yersinia pestis
ucaucaucaauggauucuugcug

SEQ ID NO: 4176102 - RNA, 13 nt, Yersinia pestis
ucaucaucauauu

SEQ ID NO: 4176103 - RNA, 13 nt, Yersinia pestis
ucaucauuuuuua

SEQ ID NO: 4176104 - RNA, 18 nt, Yersinia pestis
ucauccaacucaccauuu

SEQ ID NO: 4176105 - RNA, 15 nt, Yersinia pestis
ucauccaacuuaccu

SEQ ID NO: 4176106 - RNA, 14 nt, Yersinia pestis
ucauccauaaguau

SEQ ID NO: 4176107 - RNA, 16 nt, Yersinia pestis
ucaucccaaucaucau

SEQ ID NO: 4176108 - RNA, 23 nt, Yersinia pestis
ucaucccaaucaucaucccaguc

SEQ ID NO: 4176109 - RNA, 21 nt, Yersinia pestis
ucaucccagucgucuucagcu

SEQ ID NO: 4176110 - RNA, 15 nt, Yersinia pestis
ucaucccuaaaauca

SEQ ID NO: 4176111 - RNA, 13 nt, Yersinia pestis
ucaucccuuuagc

SEQ ID NO: 4176112 - RNA, 20 nt, Yersinia pestis
ucaucccuuuagcgucuaac

SEQ ID NO: 4176113 - RNA, 16 nt, Yersinia pestis
ucauccgcucagcaaa

SEQ ID NO: 4176114 - RNA, 19 nt, Yersinia pestis
ucauccgcucagcaaaaau

SEQ ID NO: 4176115 - RNA, 17 nt, Yersinia pestis
ucauccguaaaaaaccu

SEQ ID NO: 4176116 - RNA, 14 nt, Yersinia pestis
ucauccuaaagaua

SEQ ID NO: 4176117 - RNA, 14 nt, Yersinia pestis
ucauccucauugag

SEQ ID NO: 4176118 - RNA, 17 nt, Yersinia pestis
ucauccugcuauuuaac

SEQ ID NO: 4176119 - RNA, 15 nt, Yersinia pestis
ucaucgaaaaaaaua

SEQ ID NO: 4176120 - RNA, 19 nt, Yersinia pestis
ucaucgaaaaaaauacuau

SEQ ID NO: 4176121 - RNA, 16 nt, Yersinia pestis
ucaucgacucuuuuug

SEQ ID NO: 4176122 - RNA, 23 nt, Yersinia pestis
ucaucgacuugaugaaguuauuu

SEQ ID NO: 4176123 - RNA, 18 nt, Yersinia pestis
ucaucgauugcuggcgcu

SEQ ID NO: 4176124 - RNA, 14 nt, Yersinia pestis
ucaucgcaccauaa

SEQ ID NO: 4176125 - RNA, 23 nt, Yersinia pestis
ucaucgcaccauaaccaauccau

SEQ ID NO: 4176126 - RNA, 11 nt, Yersinia pestis
ucaucgccgca

SEQ ID NO: 4176127 - RNA, 16 nt, Yersinia pestis
ucaucgcggaugccuu

SEQ ID NO: 4176128 - RNA, 17 nt, Yersinia pestis
ucaucgcggaugccuuu

SEQ ID NO: 4176129 - RNA, 18 nt, Yersinia pestis
ucaucgcggguuuuuaac

SEQ ID NO: 4176130 - RNA, 20 nt, Yersinia pestis
ucaucgcggguuuuuaacuu

SEQ ID NO: 4176131 - RNA, 18 nt, Yersinia pestis
ucaucgcuaaauacugcu

SEQ ID NO: 4176132 - RNA, 17 nt, Yersinia pestis
ucaucggcaaaaacagu

SEQ ID NO: 4176133 - RNA, 21 nt, Yersinia pestis
ucaucggcauacuccuuaauc

SEQ ID NO: 4176134 - RNA, 22 nt, Yersinia pestis
ucaucgggaacaggaucugcuc

SEQ ID NO: 4176135 - RNA, 21 nt, Yersinia pestis
ucaucggggguugucugcaga

SEQ ID NO: 4176136 - RNA, 22 nt, Yersinia pestis
ucaucggggguugucugcagaa

SEQ ID NO: 4176137 - RNA, 16 nt, Yersinia pestis
ucaucgggguuuguca

SEQ ID NO: 4176138 - RNA, 19 nt, Yersinia pestis
ucaucgggguuugucagca

SEQ ID NO: 4176139 - RNA, 20 nt, Yersinia pestis
ucaucgggguuugucagcag

SEQ ID NO: 4176140 - RNA, 15 nt, Yersinia pestis
ucaucguaaccccca

SEQ ID NO: 4176141 - RNA, 19 nt, Yersinia pestis
ucaucuacaacaucaucgu

SEQ ID NO: 4176142 - RNA, 16 nt, Yersinia pestis
ucaucucaauaacuau

SEQ ID NO: 4176143 - RNA, 22 nt, Yersinia pestis
ucaucugcgguaaccaauaaca

SEQ ID NO: 4176144 - RNA, 20 nt, Yersinia pestis
ucaucuggugaaugcgggcc

SEQ ID NO: 4176145 - RNA, 23 nt, Yersinia pestis
ucaucugguuuuuuuauaaauua

SEQ ID NO: 4176146 - RNA, 14 nt, Yersinia pestis
ucaucuucaucagg

SEQ ID NO: 4176147 - RNA, 17 nt, Yersinia pestis
ucaucuucaucagggaa

SEQ ID NO: 4176148 - RNA, 17 nt, Yersinia pestis
ucaucuucuucauccca

SEQ ID NO: 4176149 - RNA, 17 nt, Yersinia pestis
ucaucuugaaaauaugc

SEQ ID NO: 4176150 - RNA, 19 nt, Yersinia pestis
ucaucuugggcgggaucuc

SEQ ID NO: 4176151 - RNA, 16 nt, Yersinia pestis
ucaucuuuaauaauag

SEQ ID NO: 4176152 - RNA, 17 nt, Yersinia pestis
ucaucuuuaauaauaga

SEQ ID NO: 4176153 - RNA, 13 nt, Yersinia pestis
ucaucuuucucau

SEQ ID NO: 4176154 - RNA, 18 nt, Yersinia pestis
ucaucuuucucauuagcg

SEQ ID NO: 4176155 - RNA, 17 nt, Yersinia pestis
ucaucuuuugcuauuaa

SEQ ID NO: 4176156 - RNA, 15 nt, Yersinia pestis
ucaucuuuuucugcc

SEQ ID NO: 4176157 - RNA, 14 nt, Yersinia pestis
ucaucuuuuuuaau

SEQ ID NO: 4176158 - RNA, 22 nt, Yersinia pestis
ucaucuuuuuuuuuauuaucau

SEQ ID NO: 4176159 - RNA, 15 nt, Yersinia pestis
ucaugaaugaggcug

SEQ ID NO: 4176160 - RNA, 16 nt, Yersinia pestis
ucaugaaugaggcuga

SEQ ID NO: 4176161 - RNA, 13 nt, Yersinia pestis
ucaugacaaaaau

SEQ ID NO: 4176162 - RNA, 22 nt, Yersinia pestis
ucaugacgaaaaacaccuauuu

SEQ ID NO: 4176163 - RNA, 12 nt, Yersinia pestis
ucaugaggcagu

SEQ ID NO: 4176164 - RNA, 16 nt, Yersinia pestis
ucaugaggcucagacu

SEQ ID NO: 4176165 - RNA, 12 nt, Yersinia pestis
ucaugaugacuu

SEQ ID NO: 4176166 - RNA, 14 nt, Yersinia pestis
ucaugauucucuau

SEQ ID NO: 4176167 - RNA, 13 nt, Yersinia pestis
ucaugcucacaau

SEQ ID NO: 4176168 - RNA, 19 nt, Yersinia pestis
ucaugcucacaaucaucgu

SEQ ID NO: 4176169 - RNA, 20 nt, Yersinia pestis
ucaugcugucauuggugcug

SEQ ID NO: 4176170 - RNA, 21 nt, Yersinia pestis
ucauggccaugaaucaaauua

SEQ ID NO: 4176171 - RNA, 18 nt, Yersinia pestis
ucauggccugaugcaccu

SEQ ID NO: 4176172 - RNA, 23 nt, Yersinia pestis
ucauggcgcuuuagccagucacc

SEQ ID NO: 4176173 - RNA, 16 nt, Yersinia pestis
ucaugguacaacugcg

SEQ ID NO: 4176174 - RNA, 22 nt, Yersinia pestis
ucaugguuggauacugcauuuc

SEQ ID NO: 4176175 - RNA, 12 nt, Yersinia pestis
ucauguaacaca

SEQ ID NO: 4176176 - RNA, 13 nt, Yersinia pestis
ucauguaagccaa

SEQ ID NO: 4176177 - RNA, 21 nt, Yersinia pestis
ucauguaaggcaauaccaaua

SEQ ID NO: 4176178 - RNA, 17 nt, Yersinia pestis
ucauguucgcacugcuc

SEQ ID NO: 4176179 - RNA, 13 nt, Yersinia pestis
ucauguugcaaca

SEQ ID NO: 4176180 - RNA, 17 nt, Yersinia pestis
ucauuaaaaaauaauuu

SEQ ID NO: 4176181 - RNA, 19 nt, Yersinia pestis
ucauuaacacaucuauuuu

SEQ ID NO: 4176182 - RNA, 20 nt, Yersinia pestis
ucauuaaccgccgcagguau

SEQ ID NO: 4176183 - RNA, 19 nt, Yersinia pestis
ucauuaauccccaggugcu

SEQ ID NO: 4176184 - RNA, 23 nt, Yersinia pestis
ucauuaauccccggucacuuaaa

SEQ ID NO: 4176185 - RNA, 14 nt, Yersinia pestis
ucauuacacugaau

SEQ ID NO: 4176186 - RNA, 13 nt, Yersinia pestis
ucauuacaucauc

SEQ ID NO: 4176187 - RNA, 15 nt, Yersinia pestis
ucauuacaucaucuu

SEQ ID NO: 4176188 - RNA, 16 nt, Yersinia pestis
ucauuaccaauaccau

SEQ ID NO: 4176189 - RNA, 22 nt, Yersinia pestis
ucauuacccucauguaagccaa

SEQ ID NO: 4176190 - RNA, 14 nt, Yersinia pestis
ucauuacucagcuu

SEQ ID NO: 4176191 - RNA, 21 nt, Yersinia pestis
ucauuagccagccaauggcca

SEQ ID NO: 4176192 - RNA, 20 nt, Yersinia pestis
ucauuagccguuguucaccc

SEQ ID NO: 4176193 - RNA, 13 nt, Yersinia pestis
ucauuagucugag

SEQ ID NO: 4176194 - RNA, 19 nt, Yersinia pestis
ucauuagugcccaacggca

SEQ ID NO: 4176195 - RNA, 21 nt, Yersinia pestis
ucauuaucccccuaugcuaac

SEQ ID NO: 4176196 - RNA, 14 nt, Yersinia pestis
ucauuauggauaau

SEQ ID NO: 4176197 - RNA, 20 nt, Yersinia pestis
ucauuauuaaacuugcucuu

SEQ ID NO: 4176198 - RNA, 23 nt, Yersinia pestis
ucauuauuaaacuugcucuuuca

SEQ ID NO: 4176199 - RNA, 16 nt, Yersinia pestis
ucauuauuugauauag

SEQ ID NO: 4176200 - RNA, 19 nt, Yersinia pestis
ucauuauuuucaaccaguu

SEQ ID NO: 4176201 - RNA, 22 nt, Yersinia pestis
ucauuauuuucaaccaguuaga

SEQ ID NO: 4176202 - RNA, 13 nt, Yersinia pestis
ucauuauuuucac

SEQ ID NO: 4176203 - RNA, 15 nt, Yersinia pestis
ucauucaugaggcuc

SEQ ID NO: 4176204 - RNA, 15 nt, Yersinia pestis
ucauucaugaggcuu

SEQ ID NO: 4176205 - RNA, 16 nt, Yersinia pestis
ucauucauuuuaaaaa

SEQ ID NO: 4176206 - RNA, 14 nt, Yersinia pestis
ucauuccgccuguu

SEQ ID NO: 4176207 - RNA, 19 nt, Yersinia pestis
ucauucgacggguuuuacc

SEQ ID NO: 4176208 - RNA, 22 nt, Yersinia pestis
ucauugagaucaguucaguauu

SEQ ID NO: 4176209 - RNA, 18 nt, Yersinia pestis
ucauugagcauaucaauc

SEQ ID NO: 4176210 - RNA, 19 nt, Yersinia pestis
ucauugaggguugucagca

SEQ ID NO: 4176211 - RNA, 20 nt, Yersinia pestis
ucauugauauugcgguaaau

SEQ ID NO: 4176212 - RNA, 13 nt, Yersinia pestis
ucauugcccccuu

SEQ ID NO: 4176213 - RNA, 18 nt, Yersinia pestis
ucauugcuguuguuauua

SEQ ID NO: 4176214 - RNA, 19 nt, Yersinia pestis
ucauugguuaacuuauagc

SEQ ID NO: 4176215 - RNA, 19 nt, Yersinia pestis
ucauuguagauggccaucu

SEQ ID NO: 4176216 - RNA, 12 nt, Yersinia pestis
ucauuuaaauac

SEQ ID NO: 4176217 - RNA, 11 nt, Yersinia pestis
ucauuuaacug

SEQ ID NO: 4176218 - RNA, 13 nt, Yersinia pestis
ucauuuaauuaaa

SEQ ID NO: 4176219 - RNA, 17 nt, Yersinia pestis
ucauuuaucuaaaacug

SEQ ID NO: 4176220 - RNA, 21 nt, Yersinia pestis
ucauuuaucuaaaacugccua

SEQ ID NO: 4176221 - RNA, 14 nt, Yersinia pestis
ucauuucagguaaa

SEQ ID NO: 4176222 - RNA, 17 nt, Yersinia pestis
ucauuuccguuaaccca

SEQ ID NO: 4176223 - RNA, 22 nt, Yersinia pestis
ucauuuccguuaacccaaagcc

SEQ ID NO: 4176224 - RNA, 20 nt, Yersinia pestis
ucauuuccuccgcuuuagcu

SEQ ID NO: 4176225 - RNA, 20 nt, Yersinia pestis
ucauuugaccuccguaggcc

SEQ ID NO: 4176226 - RNA, 16 nt, Yersinia pestis
ucauuuuaacaauuuu

SEQ ID NO: 4176227 - RNA, 16 nt, Yersinia pestis
ucauuuuccugcauau

SEQ ID NO: 4176228 - RNA, 14 nt, Yersinia pestis
ucauuuucuguuga

SEQ ID NO: 4176229 - RNA, 16 nt, Yersinia pestis
ucauuuuguuuucucu

SEQ ID NO: 4176230 - RNA, 17 nt, Yersinia pestis
ucauuuuguuuucucuu

SEQ ID NO: 4176231 - RNA, 18 nt, Yersinia pestis
ucauuuuuaaguggcauc

SEQ ID NO: 4176232 - RNA, 13 nt, Yersinia pestis
ucauuuuucccuu

SEQ ID NO: 4176233 - RNA, 22 nt, Yersinia pestis
ucauuuuuugggaugaaaaaua

SEQ ID NO: 4176234 - RNA, 20 nt, Yersinia pestis
uccaaaacaucggccagcgu

SEQ ID NO: 4176235 - RNA, 22 nt, Yersinia pestis
uccaaagcaccaacuaagcaga

SEQ ID NO: 4176236 - RNA, 14 nt, Yersinia pestis
uccaaaggaagggg

SEQ ID NO: 4176237 - RNA, 20 nt, Yersinia pestis
uccaaaugacagcaucaaua

SEQ ID NO: 4176238 - RNA, 12 nt, Yersinia pestis
uccaaccaaccu

SEQ ID NO: 4176239 - RNA, 20 nt, Yersinia pestis
uccaaccagagauuguuuuc

SEQ ID NO: 4176240 - RNA, 17 nt, Yersinia pestis
uccaacgcacaccccca

SEQ ID NO: 4176241 - RNA, 14 nt, Yersinia pestis
uccaacugacgcca

SEQ ID NO: 4176242 - RNA, 15 nt, Yersinia pestis
uccaacugagugagc

SEQ ID NO: 4176243 - RNA, 17 nt, Yersinia pestis
uccaacugauaauucag

SEQ ID NO: 4176244 - RNA, 18 nt, Yersinia pestis
uccaacuucuuccauuaa

SEQ ID NO: 4176245 - RNA, 14 nt, Yersinia pestis
uccaagacggacgu

SEQ ID NO: 4176246 - RNA, 18 nt, Yersinia pestis
uccaagacggacgugaau

SEQ ID NO: 4176247 - RNA, 14 nt, Yersinia pestis
uccaagaugauaaa

SEQ ID NO: 4176248 - RNA, 23 nt, Yersinia pestis
uccaagcacacugguugaaaccu

SEQ ID NO: 4176249 - RNA, 21 nt, Yersinia pestis
uccaaggcggauguggguuca

SEQ ID NO: 4176250 - RNA, 20 nt, Yersinia pestis
uccaauaagucacuuuccuu

SEQ ID NO: 4176251 - RNA, 23 nt, Yersinia pestis
uccaauaaugccgaaugauucau

SEQ ID NO: 4176252 - RNA, 20 nt, Yersinia pestis
uccaaucauucugucaucaa

SEQ ID NO: 4176253 - RNA, 23 nt, Yersinia pestis
uccaaugaauaucuugcauacaa

SEQ ID NO: 4176254 - RNA, 22 nt, Yersinia pestis
uccaaugacuauucccuuguuu

SEQ ID NO: 4176255 - RNA, 15 nt, Yersinia pestis
uccacaaacucaugc

SEQ ID NO: 4176256 - RNA, 18 nt, Yersinia pestis
uccacaacagauggcgau

SEQ ID NO: 4176257 - RNA, 16 nt, Yersinia pestis
uccacacaguauucug

SEQ ID NO: 4176258 - RNA, 15 nt, Yersinia pestis
uccacaccaacagac

SEQ ID NO: 4176259 - RNA, 21 nt, Yersinia pestis
uccacacccucucuuuccagc

SEQ ID NO: 4176260 - RNA, 18 nt, Yersinia pestis
uccacauaaaaagaaaaa

SEQ ID NO: 4176261 - RNA, 21 nt, Yersinia pestis
uccacauaaaaagaaaaaaac

SEQ ID NO: 4176262 - RNA, 12 nt, Yersinia pestis
uccacauugauc

SEQ ID NO: 4176263 - RNA, 23 nt, Yersinia pestis
uccaccaacggcccaauauugau

SEQ ID NO: 4176264 - RNA, 22 nt, Yersinia pestis
uccacccggcauuguuggcccg

SEQ ID NO: 4176265 - RNA, 19 nt, Yersinia pestis
uccaccugacgaaaugccg

SEQ ID NO: 4176266 - RNA, 15 nt, Yersinia pestis
uccaccugaucaugc

SEQ ID NO: 4176267 - RNA, 16 nt, Yersinia pestis
uccacgcccaacucuu

SEQ ID NO: 4176268 - RNA, 17 nt, Yersinia pestis
uccacgcccaacucuuu

SEQ ID NO: 4176269 - RNA, 17 nt, Yersinia pestis
uccacgccccaacggua

SEQ ID NO: 4176270 - RNA, 19 nt, Yersinia pestis
uccacgcugaaacuuuuca

SEQ ID NO: 4176271 - RNA, 22 nt, Yersinia pestis
uccacgcugaaacuuuucaguu

SEQ ID NO: 4176272 - RNA, 21 nt, Yersinia pestis
uccacgcuuuaagcuaauucu

SEQ ID NO: 4176273 - RNA, 22 nt, Yersinia pestis
uccacgcuuuaagcuaauucug

SEQ ID NO: 4176274 - RNA, 21 nt, Yersinia pestis
uccacgggcgcaauggaagaa

SEQ ID NO: 4176275 - RNA, 15 nt, Yersinia pestis
uccacgggcucaugc

SEQ ID NO: 4176276 - RNA, 19 nt, Yersinia pestis
uccacgugcuuacuggccu

SEQ ID NO: 4176277 - RNA, 20 nt, Yersinia pestis
uccacgugcuuacuggccug

SEQ ID NO: 4176278 - RNA, 22 nt, Yersinia pestis
uccacuacuuauuuccgcgccg

SEQ ID NO: 4176279 - RNA, 19 nt, Yersinia pestis
uccacuagcaucacccgcc

SEQ ID NO: 4176280 - RNA, 15 nt, Yersinia pestis
uccacugaccgggaa

SEQ ID NO: 4176281 - RNA, 21 nt, Yersinia pestis
uccacugcggccacucgcauc

SEQ ID NO: 4176282 - RNA, 20 nt, Yersinia pestis
uccacugcguacucacccca

SEQ ID NO: 4176283 - RNA, 11 nt, Yersinia pestis
uccacuuauau

SEQ ID NO: 4176284 - RNA, 20 nt, Yersinia pestis
uccacuugugguaaccccgu

SEQ ID NO: 4176285 - RNA, 21 nt, Yersinia pestis
uccacuuuaccgauuucaggu

SEQ ID NO: 4176286 - RNA, 12 nt, Yersinia pestis
uccacuuucacc

SEQ ID NO: 4176287 - RNA, 15 nt, Yersinia pestis
uccacuuuucagaua

SEQ ID NO: 4176288 - RNA, 17 nt, Yersinia pestis
uccacuuuuucucuccu

SEQ ID NO: 4176289 - RNA, 20 nt, Yersinia pestis
uccagaacaauaccgccaau

SEQ ID NO: 4176290 - RNA, 13 nt, Yersinia pestis
uccagaacaccaa

SEQ ID NO: 4176291 - RNA, 13 nt, Yersinia pestis
uccagaagccauu

SEQ ID NO: 4176292 - RNA, 23 nt, Yersinia pestis
uccagaauauaaaagcacagaca

SEQ ID NO: 4176293 - RNA, 18 nt, Yersinia pestis
uccagaauaucuucaacu

SEQ ID NO: 4176294 - RNA, 17 nt, Yersinia pestis
uccagaccgcguaagcc

SEQ ID NO: 4176295 - RNA, 19 nt, Yersinia pestis
uccagaccgcguaagccgu

SEQ ID NO: 4176296 - RNA, 22 nt, Yersinia pestis
uccagauagcgaaucacaucau

SEQ ID NO: 4176297 - RNA, 13 nt, Yersinia pestis
uccagaucggcaa

SEQ ID NO: 4176298 - RNA, 23 nt, Yersinia pestis
uccagaugaauauguuccaucag

SEQ ID NO: 4176299 - RNA, 20 nt, Yersinia pestis
uccagauuacgcaucgucag

SEQ ID NO: 4176300 - RNA, 14 nt, Yersinia pestis
uccagcaacucaag

SEQ ID NO: 4176301 - RNA, 20 nt, Yersinia pestis
uccagcaccacaauggcaga

SEQ ID NO: 4176302 - RNA, 15 nt, Yersinia pestis
uccagcaccccuuca

SEQ ID NO: 4176303 - RNA, 20 nt, Yersinia pestis
uccagcagccucuaacauac

SEQ ID NO: 4176304 - RNA, 15 nt, Yersinia pestis
uccagcaucgcugag

SEQ ID NO: 4176305 - RNA, 18 nt, Yersinia pestis
uccagccaccccguggca

SEQ ID NO: 4176306 - RNA, 15 nt, Yersinia pestis
uccagccugguuggu

SEQ ID NO: 4176307 - RNA, 17 nt, Yersinia pestis
uccagcgaacguaguug

SEQ ID NO: 4176308 - RNA, 16 nt, Yersinia pestis
uccagcgccaucagcg

SEQ ID NO: 4176309 - RNA, 16 nt, Yersinia pestis
uccagcgcuuccagcg

SEQ ID NO: 4176310 - RNA, 15 nt, Yersinia pestis
uccaggacauccagc

SEQ ID NO: 4176311 - RNA, 19 nt, Yersinia pestis
uccaggacauccagcggug

SEQ ID NO: 4176312 - RNA, 12 nt, Yersinia pestis
uccaggcauuaa

SEQ ID NO: 4176313 - RNA, 14 nt, Yersinia pestis
uccaggcuggccac

SEQ ID NO: 4176314 - RNA, 18 nt, Yersinia pestis
uccagggcaaucaggaaa

SEQ ID NO: 4176315 - RNA, 19 nt, Yersinia pestis
uccaggguuuugaaaucau

SEQ ID NO: 4176316 - RNA, 17 nt, Yersinia pestis
uccaguaaaagaauaaa

SEQ ID NO: 4176317 - RNA, 18 nt, Yersinia pestis
uccaguaagcuguugacc

SEQ ID NO: 4176318 - RNA, 14 nt, Yersinia pestis
uccaguaauaccuu

SEQ ID NO: 4176319 - RNA, 14 nt, Yersinia pestis
uccaguacugacca

SEQ ID NO: 4176320 - RNA, 15 nt, Yersinia pestis
uccagugaaaucauc

SEQ ID NO: 4176321 - RNA, 17 nt, Yersinia pestis
uccagugaaaucaucac

SEQ ID NO: 4176322 - RNA, 22 nt, Yersinia pestis
uccagugauaaguuggaggcgu

SEQ ID NO: 4176323 - RNA, 16 nt, Yersinia pestis
uccagugcaaauuuau

SEQ ID NO: 4176324 - RNA, 14 nt, Yersinia pestis
uccagugccaaaau

SEQ ID NO: 4176325 - RNA, 15 nt, Yersinia pestis
uccaguuaucaucgu

SEQ ID NO: 4176326 - RNA, 20 nt, Yersinia pestis
uccauaaacggaacucaucu

SEQ ID NO: 4176327 - RNA, 21 nt, Yersinia pestis
uccauaaacggaacucaucuu

SEQ ID NO: 4176328 - RNA, 23 nt, Yersinia pestis
uccauaaacggaacucaucuuuc

SEQ ID NO: 4176329 - RNA, 21 nt, Yersinia pestis
uccauaacauccuaaaaagcg

SEQ ID NO: 4176330 - RNA, 16 nt, Yersinia pestis
uccauaaguauuuauu

SEQ ID NO: 4176331 - RNA, 15 nt, Yersinia pestis
uccauacgaauuuuu

SEQ ID NO: 4176332 - RNA, 21 nt, Yersinia pestis
uccauagaugcaaaugucaga

SEQ ID NO: 4176333 - RNA, 22 nt, Yersinia pestis
uccauagaugcaaaugucagau

SEQ ID NO: 4176334 - RNA, 20 nt, Yersinia pestis
uccauauagccccaacacug

SEQ ID NO: 4176335 - RNA, 11 nt, Yersinia pestis
uccaucaggaa

SEQ ID NO: 4176336 - RNA, 13 nt, Yersinia pestis
uccaucaggucag

SEQ ID NO: 4176337 - RNA, 23 nt, Yersinia pestis
uccaucggccagugcgccggccu

SEQ ID NO: 4176338 - RNA, 23 nt, Yersinia pestis
uccaucuaauagaauagauccca

SEQ ID NO: 4176339 - RNA, 17 nt, Yersinia pestis
uccaugaaaacccgccu

SEQ ID NO: 4176340 - RNA, 17 nt, Yersinia pestis
uccaugacacauauuuc

SEQ ID NO: 4176341 - RNA, 22 nt, Yersinia pestis
uccaugacacauauuucaggcu

SEQ ID NO: 4176342 - RNA, 13 nt, Yersinia pestis
uccauggcugaga

SEQ ID NO: 4176343 - RNA, 19 nt, Yersinia pestis
uccaugggccucgcuucug

SEQ ID NO: 4176344 - RNA, 18 nt, Yersinia pestis
uccauguucucuccuaaa

SEQ ID NO: 4176345 - RNA, 15 nt, Yersinia pestis
uccauuacagcaccu

SEQ ID NO: 4176346 - RNA, 20 nt, Yersinia pestis
uccauuacuguccuuuaacu

SEQ ID NO: 4176347 - RNA, 18 nt, Yersinia pestis
uccauuagcguauuaaac

SEQ ID NO: 4176348 - RNA, 13 nt, Yersinia pestis
uccauucagagcg

SEQ ID NO: 4176349 - RNA, 13 nt, Yersinia pestis
uccauucugcaga

SEQ ID NO: 4176350 - RNA, 14 nt, Yersinia pestis
uccauucugcagau

SEQ ID NO: 4176351 - RNA, 13 nt, Yersinia pestis
uccauuuaaucgc

SEQ ID NO: 4176352 - RNA, 13 nt, Yersinia pestis
uccauuucugguu

SEQ ID NO: 4176353 - RNA, 17 nt, Yersinia pestis
uccauuuuauuuaacgu

SEQ ID NO: 4176354 - RNA, 12 nt, Yersinia pestis
ucccaaaauaug

SEQ ID NO: 4176355 - RNA, 15 nt, Yersinia pestis
ucccaacggcagaag

SEQ ID NO: 4176356 - RNA, 17 nt, Yersinia pestis
ucccaagaaaagcaccg

SEQ ID NO: 4176357 - RNA, 19 nt, Yersinia pestis
ucccaagaaaagcaccgca

SEQ ID NO: 4176358 - RNA, 13 nt, Yersinia pestis
ucccaagccuaac

SEQ ID NO: 4176359 - RNA, 22 nt, Yersinia pestis
ucccaaugaauauuauucaguu

SEQ ID NO: 4176360 - RNA, 12 nt, Yersinia pestis
ucccacaugaac

SEQ ID NO: 4176361 - RNA, 18 nt, Yersinia pestis
ucccagaacauaugccca

SEQ ID NO: 4176362 - RNA, 12 nt, Yersinia pestis
ucccagccacca

SEQ ID NO: 4176363 - RNA, 14 nt, Yersinia pestis
ucccaggccuccgc

SEQ ID NO: 4176364 - RNA, 17 nt, Yersinia pestis
ucccagucauaaauauc

SEQ ID NO: 4176365 - RNA, 14 nt, Yersinia pestis
ucccagucgucuuc

SEQ ID NO: 4176366 - RNA, 16 nt, Yersinia pestis
ucccaguuuuuaauuu

SEQ ID NO: 4176367 - RNA, 13 nt, Yersinia pestis
ucccauacccacu

SEQ ID NO: 4176368 - RNA, 16 nt, Yersinia pestis
ucccauacccacuaau

SEQ ID NO: 4176369 - RNA, 18 nt, Yersinia pestis
ucccauacccacuaauac

SEQ ID NO: 4176370 - RNA, 13 nt, Yersinia pestis
ucccaucccucac

SEQ ID NO: 4176371 - RNA, 23 nt, Yersinia pestis
ucccaucgaacgcgucacuggcc

SEQ ID NO: 4176372 - RNA, 20 nt, Yersinia pestis
ucccaugcuggcccaguaga

SEQ ID NO: 4176373 - RNA, 14 nt, Yersinia pestis
ucccauuaauuaau

SEQ ID NO: 4176374 - RNA, 13 nt, Yersinia pestis
uccccaacucuuu

SEQ ID NO: 4176375 - RNA, 16 nt, Yersinia pestis
uccccaacucuuucaa

SEQ ID NO: 4176376 - RNA, 12 nt, Yersinia pestis
uccccaccaaca

SEQ ID NO: 4176377 - RNA, 21 nt, Yersinia pestis
uccccaccauugcaaacauca

SEQ ID NO: 4176378 - RNA, 18 nt, Yersinia pestis
uccccacggcgacguuca

SEQ ID NO: 4176379 - RNA, 20 nt, Yersinia pestis
uccccaggugcuuauuuauu

SEQ ID NO: 4176380 - RNA, 21 nt, Yersinia pestis
uccccauaagcgggguauuuu

SEQ ID NO: 4176381 - RNA, 17 nt, Yersinia pestis
ucccccacgaucuccuc

SEQ ID NO: 4176382 - RNA, 15 nt, Yersinia pestis
uccccccuucaucga

SEQ ID NO: 4176383 - RNA, 17 nt, Yersinia pestis
uccccccuucaucgaca

SEQ ID NO: 4176384 - RNA, 15 nt, Yersinia pestis
uccccccuuuuucaa

SEQ ID NO: 4176385 - RNA, 18 nt, Yersinia pestis
ucccccgcgccgacugcu

SEQ ID NO: 4176386 - RNA, 15 nt, Yersinia pestis
uccccgcuaacugcu

SEQ ID NO: 4176387 - RNA, 18 nt, Yersinia pestis
uccccgcuugggugagga

SEQ ID NO: 4176388 - RNA, 14 nt, Yersinia pestis
uccccuggcggcua

SEQ ID NO: 4176389 - RNA, 16 nt, Yersinia pestis
ucccgagcuaacgcuu

SEQ ID NO: 4176390 - RNA, 19 nt, Yersinia pestis
ucccgauacccauuuuaau

SEQ ID NO: 4176391 - RNA, 21 nt, Yersinia pestis
ucccgauacucauugcaccuc

SEQ ID NO: 4176392 - RNA, 19 nt, Yersinia pestis
ucccgauauaaauaaaaua

SEQ ID NO: 4176393 - RNA, 19 nt, Yersinia pestis
ucccgaugauugcaucauc

SEQ ID NO: 4176394 - RNA, 15 nt, Yersinia pestis
ucccgggaauaauca

SEQ ID NO: 4176395 - RNA, 17 nt, Yersinia pestis
ucccguaggccuuaacc

SEQ ID NO: 4176396 - RNA, 16 nt, Yersinia pestis
ucccgucaccagucgu

SEQ ID NO: 4176397 - RNA, 20 nt, Yersinia pestis
ucccgucagguucaauuccc

SEQ ID NO: 4176398 - RNA, 17 nt, Yersinia pestis
ucccgugugauuuccau

SEQ ID NO: 4176399 - RNA, 18 nt, Yersinia pestis
ucccuacgggaaauaacu

SEQ ID NO: 4176400 - RNA, 21 nt, Yersinia pestis
ucccuacgguaccgcagguca

SEQ ID NO: 4176401 - RNA, 18 nt, Yersinia pestis
ucccuagcgaaguauuaa

SEQ ID NO: 4176402 - RNA, 19 nt, Yersinia pestis
ucccucaccgccauuuacu

SEQ ID NO: 4176403 - RNA, 12 nt, Yersinia pestis
ucccucagugag

SEQ ID NO: 4176404 - RNA, 11 nt, Yersinia pestis
ucccucggcuu

SEQ ID NO: 4176405 - RNA, 13 nt, Yersinia pestis
ucccucggcuuau

SEQ ID NO: 4176406 - RNA, 21 nt, Yersinia pestis
ucccucuguauugauccccaa

SEQ ID NO: 4176407 - RNA, 15 nt, Yersinia pestis
ucccugaacgccuug

SEQ ID NO: 4176408 - RNA, 14 nt, Yersinia pestis
ucccugguuugcca

SEQ ID NO: 4176409 - RNA, 18 nt, Yersinia pestis
ucccuucggcaugcaacu

SEQ ID NO: 4176410 - RNA, 13 nt, Yersinia pestis
ucccuucugaaac

SEQ ID NO: 4176411 - RNA, 14 nt, Yersinia pestis
ucccuuguugccuu

SEQ ID NO: 4176412 - RNA, 14 nt, Yersinia pestis
ucccuuuccucucu

SEQ ID NO: 4176413 - RNA, 15 nt, Yersinia pestis
ucccuuuuaccgaaa

SEQ ID NO: 4176414 - RNA, 17 nt, Yersinia pestis
uccgacgaccacuuugu

SEQ ID NO: 4176415 - RNA, 19 nt, Yersinia pestis
uccgagccuguugaaaccu

SEQ ID NO: 4176416 - RNA, 15 nt, Yersinia pestis
uccgaguuauugaua

SEQ ID NO: 4176417 - RNA, 17 nt, Yersinia pestis
uccgauaauaauuccau

SEQ ID NO: 4176418 - RNA, 14 nt, Yersinia pestis
uccgcaauagccaa

SEQ ID NO: 4176419 - RNA, 16 nt, Yersinia pestis
uccgcacggcuacugc

SEQ ID NO: 4176420 - RNA, 21 nt, Yersinia pestis
uccgcagugauauuauuuauu

SEQ ID NO: 4176421 - RNA, 20 nt, Yersinia pestis
uccgccaguugcucacggug

SEQ ID NO: 4176422 - RNA, 15 nt, Yersinia pestis
uccgccauccuucaa

SEQ ID NO: 4176423 - RNA, 15 nt, Yersinia pestis
uccgcccucuugcug

SEQ ID NO: 4176424 - RNA, 16 nt, Yersinia pestis
uccgccucaucucaug

SEQ ID NO: 4176425 - RNA, 22 nt, Yersinia pestis
uccgccucuuuuuccacacccu

SEQ ID NO: 4176426 - RNA, 23 nt, Yersinia pestis
uccgccugaccgacgagggcuuc

SEQ ID NO: 4176427 - RNA, 17 nt, Yersinia pestis
uccgccugagauuaacc

SEQ ID NO: 4176428 - RNA, 17 nt, Yersinia pestis
uccgccuguuuucaggc

SEQ ID NO: 4176429 - RNA, 14 nt, Yersinia pestis
uccgcgccaaggca

SEQ ID NO: 4176430 - RNA, 15 nt, Yersinia pestis
uccgcuauuuuccac

SEQ ID NO: 4176431 - RNA, 19 nt, Yersinia pestis
uccgcuccugauuuaaccu

SEQ ID NO: 4176432 - RNA, 14 nt, Yersinia pestis
uccgcuuccaucac

SEQ ID NO: 4176433 - RNA, 22 nt, Yersinia pestis
uccgcuucucagucgcgaugcg

SEQ ID NO: 4176434 - RNA, 15 nt, Yersinia pestis
uccgcuugcagcaac

SEQ ID NO: 4176435 - RNA, 19 nt, Yersinia pestis
uccggauuaaauucuaccu

SEQ ID NO: 4176436 - RNA, 23 nt, Yersinia pestis
uccggcaaaaacgccaucaauaa

SEQ ID NO: 4176437 - RNA, 22 nt, Yersinia pestis
uccggcaaccaguuauagcggu

SEQ ID NO: 4176438 - RNA, 16 nt, Yersinia pestis
uccggcuaugccggag

SEQ ID NO: 4176439 - RNA, 21 nt, Yersinia pestis
uccgggucaaacucagcgaau

SEQ ID NO: 4176440 - RNA, 19 nt, Yersinia pestis
uccgggugauguuccccca

SEQ ID NO: 4176441 - RNA, 15 nt, Yersinia pestis
uccgguguuuuugac

SEQ ID NO: 4176442 - RNA, 19 nt, Yersinia pestis
uccguaacccgccucgcuu

SEQ ID NO: 4176443 - RNA, 11 nt, Yersinia pestis
uccguagaaau

SEQ ID NO: 4176444 - RNA, 21 nt, Yersinia pestis
uccgucccaagaaaagcaccg

SEQ ID NO: 4176445 - RNA, 14 nt, Yersinia pestis
uccgugcugguccu

SEQ ID NO: 4176446 - RNA, 17 nt, Yersinia pestis
uccguguaguuauugau

SEQ ID NO: 4176447 - RNA, 12 nt, Yersinia pestis
uccguuaaaaaa

SEQ ID NO: 4176448 - RNA, 19 nt, Yersinia pestis
uccguuaacccaaagccau

SEQ ID NO: 4176449 - RNA, 15 nt, Yersinia pestis
uccguuaucaucccu

SEQ ID NO: 4176450 - RNA, 13 nt, Yersinia pestis
uccguugaaaccu

SEQ ID NO: 4176451 - RNA, 15 nt, Yersinia pestis
uccguugguugcacg

SEQ ID NO: 4176452 - RNA, 14 nt, Yersinia pestis
uccguuuaaucagu

SEQ ID NO: 4176453 - RNA, 19 nt, Yersinia pestis
uccuaagguagugagauga

SEQ ID NO: 4176454 - RNA, 20 nt, Yersinia pestis
uccuacgccggagucuaucu

SEQ ID NO: 4176455 - RNA, 12 nt, Yersinia pestis
uccuagaggcuu

SEQ ID NO: 4176456 - RNA, 13 nt, Yersinia pestis
uccuauaaauuuu

SEQ ID NO: 4176457 - RNA, 13 nt, Yersinia pestis
uccuauagcucag

SEQ ID NO: 4176458 - RNA, 15 nt, Yersinia pestis
uccuauauacaaggc

SEQ ID NO: 4176459 - RNA, 22 nt, Yersinia pestis
uccuauaucucaguugaaaccc

SEQ ID NO: 4176460 - RNA, 14 nt, Yersinia pestis
uccuauucagcagc

SEQ ID NO: 4176461 - RNA, 18 nt, Yersinia pestis
uccucaagaaccugucgc

SEQ ID NO: 4176462 - RNA, 13 nt, Yersinia pestis
uccucaccguuca

SEQ ID NO: 4176463 - RNA, 14 nt, Yersinia pestis
uccuccgacauagc

SEQ ID NO: 4176464 - RNA, 23 nt, Yersinia pestis
uccuccgacauagccggagguuu

SEQ ID NO: 4176465 - RNA, 18 nt, Yersinia pestis
uccuccugaucuucauug

SEQ ID NO: 4176466 - RNA, 23 nt, Yersinia pestis
uccucggguuuuauaccggggcc

SEQ ID NO: 4176467 - RNA, 21 nt, Yersinia pestis
uccucuacguauuucgugauu

SEQ ID NO: 4176468 - RNA, 21 nt, Yersinia pestis
uccucucaccaagauaccgag

SEQ ID NO: 4176469 - RNA, 22 nt, Yersinia pestis
uccucugaauaaaaaauuauua

SEQ ID NO: 4176470 - RNA, 14 nt, Yersinia pestis
uccucugccuaucc

SEQ ID NO: 4176471 - RNA, 21 nt, Yersinia pestis
uccucugccuauccucaccgu

SEQ ID NO: 4176472 - RNA, 14 nt, Yersinia pestis
uccucugccuauuc

SEQ ID NO: 4176473 - RNA, 23 nt, Yersinia pestis
uccucugccuauucucaccguuu

SEQ ID NO: 4176474 - RNA, 17 nt, Yersinia pestis
uccucuuaugguagcaa

SEQ ID NO: 4176475 - RNA, 19 nt, Yersinia pestis
uccucuucuccguaagaca

SEQ ID NO: 4176476 - RNA, 12 nt, Yersinia pestis
uccucuucuucg

SEQ ID NO: 4176477 - RNA, 14 nt, Yersinia pestis
uccucuuucuuaau

SEQ ID NO: 4176478 - RNA, 19 nt, Yersinia pestis
uccucuuucuuaauaauau

SEQ ID NO: 4176479 - RNA, 14 nt, Yersinia pestis
uccugaaauaaaga

SEQ ID NO: 4176480 - RNA, 11 nt, Yersinia pestis
uccugaauaau

SEQ ID NO: 4176481 - RNA, 23 nt, Yersinia pestis
uccugaauaauacugucaaaauc

SEQ ID NO: 4176482 - RNA, 21 nt, Yersinia pestis
uccugaaucgccgaaaucuca

SEQ ID NO: 4176483 - RNA, 16 nt, Yersinia pestis
uccugacgaugauaaa

SEQ ID NO: 4176484 - RNA, 18 nt, Yersinia pestis
uccugauauuccggugau

SEQ ID NO: 4176485 - RNA, 15 nt, Yersinia pestis
uccugaucaacugcu

SEQ ID NO: 4176486 - RNA, 16 nt, Yersinia pestis
uccugaucaacugcug

SEQ ID NO: 4176487 - RNA, 21 nt, Yersinia pestis
uccugaucuucauugccuucu

SEQ ID NO: 4176488 - RNA, 17 nt, Yersinia pestis
uccugauuacucaggaa

SEQ ID NO: 4176489 - RNA, 13 nt, Yersinia pestis
uccugauuccaaa

SEQ ID NO: 4176490 - RNA, 24 nt, Yersinia pestis
uccugauucgcgaccagcagaagu

SEQ ID NO: 4176491 - RNA, 15 nt, Yersinia pestis
uccugauuuaguuua

SEQ ID NO: 4176492 - RNA, 19 nt, Yersinia pestis
uccugcaaauuaaccugcu

SEQ ID NO: 4176493 - RNA, 14 nt, Yersinia pestis
uccugcaacgccuu

SEQ ID NO: 4176494 - RNA, 17 nt, Yersinia pestis
uccugcaaugcauaagc

SEQ ID NO: 4176495 - RNA, 20 nt, Yersinia pestis
uccugcauauuauuuugcac

SEQ ID NO: 4176496 - RNA, 19 nt, Yersinia pestis
uccugcccaagaauaauaa

SEQ ID NO: 4176497 - RNA, 17 nt, Yersinia pestis
uccugccgccucugcuc

SEQ ID NO: 4176498 - RNA, 23 nt, Yersinia pestis
uccugccgccucugcuccgguaa

SEQ ID NO: 4176499 - RNA, 20 nt, Yersinia pestis
uccugcgucucuaacccauu

SEQ ID NO: 4176500 - RNA, 23 nt, Yersinia pestis
uccuggaaccagugaaugcugcg

SEQ ID NO: 4176501 - RNA, 15 nt, Yersinia pestis
uccuggaacgaagcc

SEQ ID NO: 4176502 - RNA, 20 nt, Yersinia pestis
uccuggaacgaagccgcaga

SEQ ID NO: 4176503 - RNA, 18 nt, Yersinia pestis
uccuggauauucauauuu

SEQ ID NO: 4176504 - RNA, 18 nt, Yersinia pestis
uccuggccguguuuuucc

SEQ ID NO: 4176505 - RNA, 16 nt, Yersinia pestis
uccuggcgauccagug

SEQ ID NO: 4176506 - RNA, 16 nt, Yersinia pestis
uccuggcguaauauug

SEQ ID NO: 4176507 - RNA, 11 nt, Yersinia pestis
uccuguauuuc

SEQ ID NO: 4176508 - RNA, 16 nt, Yersinia pestis
uccuguauuuccugua

SEQ ID NO: 4176509 - RNA, 15 nt, Yersinia pestis
uccuguugcuggcca

SEQ ID NO: 4176510 - RNA, 15 nt, Yersinia pestis
uccuguugugguggc

SEQ ID NO: 4176511 - RNA, 20 nt, Yersinia pestis
uccuguuuuugaauagguaa

SEQ ID NO: 4176512 - RNA, 11 nt, Yersinia pestis
uccuuaaaaac

SEQ ID NO: 4176513 - RNA, 19 nt, Yersinia pestis
uccuuaccacugcucacuu

SEQ ID NO: 4176514 - RNA, 13 nt, Yersinia pestis
uccuuauacuaaa

SEQ ID NO: 4176515 - RNA, 14 nt, Yersinia pestis
uccuucaaguuguc

SEQ ID NO: 4176516 - RNA, 13 nt, Yersinia pestis
uccuucaauggca

SEQ ID NO: 4176517 - RNA, 16 nt, Yersinia pestis
uccuucaauggcauuu

SEQ ID NO: 4176518 - RNA, 23 nt, Yersinia pestis
uccuucacuuacucucuccgcaa

SEQ ID NO: 4176519 - RNA, 20 nt, Yersinia pestis
cgccugacugcccgccugcu

SEQ ID NO: 4176520 - RNA, 22 nt, Yersinia pestis
cgccugauaaaauuaccgcccc

SEQ ID NO: 4176521 - RNA, 15 nt, Yersinia pestis
cgccugauccaacau

SEQ ID NO: 4176522 - RNA, 22 nt, Yersinia pestis
cgccugcccucguaauagccga

SEQ ID NO: 4176523 - RNA, 23 nt, Yersinia pestis
cgccugcugaacuuuaacuucca

SEQ ID NO: 4176524 - RNA, 12 nt, Yersinia pestis
cgccugggaucc

SEQ ID NO: 4176525 - RNA, 16 nt, Yersinia pestis
cgccuguauccagcag

SEQ ID NO: 4176526 - RNA, 20 nt, Yersinia pestis
cgccuguauuuuaaugccga

SEQ ID NO: 4176527 - RNA, 19 nt, Yersinia pestis
cgccuguuagggcgcggcu

SEQ ID NO: 4176528 - RNA, 22 nt, Yersinia pestis
cgccuguuucggcaggcagaaa

SEQ ID NO: 4176529 - RNA, 14 nt, Yersinia pestis
cgccuuaaaugcgu

SEQ ID NO: 4176530 - RNA, 16 nt, Yersinia pestis
cgccuuaccgcaauuu

SEQ ID NO: 4176531 - RNA, 19 nt, Yersinia pestis
cgccuucccacaaacucca

SEQ ID NO: 4176532 - RNA, 16 nt, Yersinia pestis
cgccuugccgcuguug

SEQ ID NO: 4176533 - RNA, 16 nt, Yersinia pestis
cgccuuucccgcuagc

SEQ ID NO: 4176534 - RNA, 19 nt, Yersinia pestis
cgccuuuuuuauaauaaug

SEQ ID NO: 4176535 - RNA, 13 nt, Yersinia pestis
cgcgaauaacaga

SEQ ID NO: 4176536 - RNA, 17 nt, Yersinia pestis
cgcgaauaacagacguu

SEQ ID NO: 4176537 - RNA, 21 nt, Yersinia pestis
cgcgaauccccccauucacac

SEQ ID NO: 4176538 - RNA, 17 nt, Yersinia pestis
cgcgacgguacugauca

SEQ ID NO: 4176539 - RNA, 17 nt, Yersinia pestis
cgcgacucaagccucua

SEQ ID NO: 4176540 - RNA, 22 nt, Yersinia pestis
cgcgagugaaccgcgcucugcu

SEQ ID NO: 4176541 - RNA, 20 nt, Yersinia pestis
cgcgauaucugcauaacugg

SEQ ID NO: 4176542 - RNA, 16 nt, Yersinia pestis
cgcgaucacaauacag

SEQ ID NO: 4176543 - RNA, 17 nt, Yersinia pestis
cgcgaucagacauuuuu

SEQ ID NO: 4176544 - RNA, 18 nt, Yersinia pestis
cgcgaugacacaauuccc

SEQ ID NO: 4176545 - RNA, 14 nt, Yersinia pestis
cgcgaugcgccugu

SEQ ID NO: 4176546 - RNA, 23 nt, Yersinia pestis
cgcgcagugccgucaauuaucaa

SEQ ID NO: 4176547 - RNA, 15 nt, Yersinia pestis
cgcgccacuucuuuc

SEQ ID NO: 4176548 - RNA, 16 nt, Yersinia pestis
cgcgccagauucuagc

SEQ ID NO: 4176549 - RNA, 16 nt, Yersinia pestis
cgcgccauccuugccu

SEQ ID NO: 4176550 - RNA, 15 nt, Yersinia pestis
cgcgccgacugcuga

SEQ ID NO: 4176551 - RNA, 15 nt, Yersinia pestis
cgcgccgacuguucg

SEQ ID NO: 4176552 - RNA, 13 nt, Yersinia pestis
cgcgccugcucac

SEQ ID NO: 4176553 - RNA, 11 nt, Yersinia pestis
cgcgcuaacca

SEQ ID NO: 4176554 - RNA, 23 nt, Yersinia pestis
cgcgcuguggcuaauaaugcacc

SEQ ID NO: 4176555 - RNA, 17 nt, Yersinia pestis
cgcgcuuuugauuuucu

SEQ ID NO: 4176556 - RNA, 16 nt, Yersinia pestis
cgcggaaaucagcuuc

SEQ ID NO: 4176557 - RNA, 20 nt, Yersinia pestis
cgcggacaccaacuggcggc

SEQ ID NO: 4176558 - RNA, 19 nt, Yersinia pestis
cgcggacgcuuuacuccuc

SEQ ID NO: 4176559 - RNA, 18 nt, Yersinia pestis
cgcggacguuuuacucuu

SEQ ID NO: 4176560 - RNA, 20 nt, Yersinia pestis
cgcggcugguaacagagccu

SEQ ID NO: 4176561 - RNA, 20 nt, Yersinia pestis
cgcggcuuaccgccgccagc

SEQ ID NO: 4176562 - RNA, 21 nt, Yersinia pestis
cgcgggaaaaaccacgcuguu

SEQ ID NO: 4176563 - RNA, 22 nt, Yersinia pestis
cgcggguuaucacauaaauaag

SEQ ID NO: 4176564 - RNA, 19 nt, Yersinia pestis
cgcgguaacgaaucugcac

SEQ ID NO: 4176565 - RNA, 23 nt, Yersinia pestis
cgcgguaacuaacaucagcgauu

SEQ ID NO: 4176566 - RNA, 18 nt, Yersinia pestis
cgcgguauuuggcauuca

SEQ ID NO: 4176567 - RNA, 14 nt, Yersinia pestis
cgcgguuacaccaa

SEQ ID NO: 4176568 - RNA, 18 nt, Yersinia pestis
cgcgguuggguucaauuc

SEQ ID NO: 4176569 - RNA, 22 nt, Yersinia pestis
cgcgguuggguucaauucccaa

SEQ ID NO: 4176570 - RNA, 24 nt, Yersinia pestis
cgcgguuugguacaugcuguucac

SEQ ID NO: 4176571 - RNA, 14 nt, Yersinia pestis
cgcgucacuggcca

SEQ ID NO: 4176572 - RNA, 16 nt, Yersinia pestis
cgcguuaaucugcugc

SEQ ID NO: 4176573 - RNA, 23 nt, Yersinia pestis
cgcguuauugcgacauaaagcaa

SEQ ID NO: 4176574 - RNA, 16 nt, Yersinia pestis
cgcguucagagcagca

SEQ ID NO: 4176575 - RNA, 17 nt, Yersinia pestis
cgcguugauccauccau

SEQ ID NO: 4176576 - RNA, 12 nt, Yersinia pestis
cgcguuugauca

SEQ ID NO: 4176577 - RNA, 16 nt, Yersinia pestis
cgcguuugcuugcugc

SEQ ID NO: 4176578 - RNA, 14 nt, Yersinia pestis
cgcuaaaucaucaa

SEQ ID NO: 4176579 - RNA, 14 nt, Yersinia pestis
cgcuaacaugccac

SEQ ID NO: 4176580 - RNA, 13 nt, Yersinia pestis
cgcuaaccuuaac

SEQ ID NO: 4176581 - RNA, 14 nt, Yersinia pestis
cgcuaacguuuauu

SEQ ID NO: 4176582 - RNA, 17 nt, Yersinia pestis
cgcuaaucaagccuuca

SEQ ID NO: 4176583 - RNA, 18 nt, Yersinia pestis
cgcuaaucauauccauaa

SEQ ID NO: 4176584 - RNA, 13 nt, Yersinia pestis
cgcuaccaugagu

SEQ ID NO: 4176585 - RNA, 22 nt, Yersinia pestis
cgcuacgccucuauuuaucgcg

SEQ ID NO: 4176586 - RNA, 14 nt, Yersinia pestis
cgcuagauuuucuu

SEQ ID NO: 4176587 - RNA, 15 nt, Yersinia pestis
cgcuauaucaucagc

SEQ ID NO: 4176588 - RNA, 12 nt, Yersinia pestis
cgcuaucacauc

SEQ ID NO: 4176589 - RNA, 12 nt, Yersinia pestis
cgcuaugcuaaa

SEQ ID NO: 4176590 - RNA, 22 nt, Yersinia pestis
cgcuauugcccaucaugccagc

SEQ ID NO: 4176591 - RNA, 24 nt, Yersinia pestis
cgcuauuucaaugggaugcccaca

SEQ ID NO: 4176592 - RNA, 14 nt, Yersinia pestis
cgcucaauuaaccu

SEQ ID NO: 4176593 - RNA, 22 nt, Yersinia pestis
cgcucacuuuuauauccgccau

SEQ ID NO: 4176594 - RNA, 19 nt, Yersinia pestis
cgcucauaccaugccauca

SEQ ID NO: 4176595 - RNA, 20 nt, Yersinia pestis
cgcuccacacaaaaacgcuc

SEQ ID NO: 4176596 - RNA, 14 nt, Yersinia pestis
cgcuccacacccgc

SEQ ID NO: 4176597 - RNA, 22 nt, Yersinia pestis
cgcuccaggcuggccacuucca

SEQ ID NO: 4176598 - RNA, 13 nt, Yersinia pestis
cgcuccagguuca

SEQ ID NO: 4176599 - RNA, 16 nt, Yersinia pestis
cgcuccaucagguuua

SEQ ID NO: 4176600 - RNA, 20 nt, Yersinia pestis
cgcucccuccgccagcaagu

SEQ ID NO: 4176601 - RNA, 21 nt, Yersinia pestis
cgcuccguugccugugcgcug

SEQ ID NO: 4176602 - RNA, 12 nt, Yersinia pestis
cgcuccucagcc

SEQ ID NO: 4176603 - RNA, 12 nt, Yersinia pestis
cgcucggcgcuc

SEQ ID NO: 4176604 - RNA, 21 nt, Yersinia pestis
cgcucuaacgucagauaaaaa

SEQ ID NO: 4176605 - RNA, 16 nt, Yersinia pestis
cgcucuggguuaaauu

SEQ ID NO: 4176606 - RNA, 21 nt, Yersinia pestis
cgcucuguugacucgcggcag

SEQ ID NO: 4176607 - RNA, 17 nt, Yersinia pestis
cgcugaccauggcgauc

SEQ ID NO: 4176608 - RNA, 19 nt, Yersinia pestis
cgcugacguaauaccggca

SEQ ID NO: 4176609 - RNA, 18 nt, Yersinia pestis
cgcugacuuguggaacaa

SEQ ID NO: 4176610 - RNA, 23 nt, Yersinia pestis
cgcugagguucuccaacaaccgu

SEQ ID NO: 4176611 - RNA, 14 nt, Yersinia pestis
cgcugauaaccagc

SEQ ID NO: 4176612 - RNA, 18 nt, Yersinia pestis
cgcugauaacuuccuuug

SEQ ID NO: 4176613 - RNA, 20 nt, Yersinia pestis
cgcugauguaggcaauacac

SEQ ID NO: 4176614 - RNA, 16 nt, Yersinia pestis
cgcugauuaaccugua

SEQ ID NO: 4176615 - RNA, 15 nt, Yersinia pestis
cgcugcaucagcagu

SEQ ID NO: 4176616 - RNA, 18 nt, Yersinia pestis
cgcugcgcaagcgcugcu

SEQ ID NO: 4176617 - RNA, 19 nt, Yersinia pestis
cgcugcgcaagcgcugcuu

SEQ ID NO: 4176618 - RNA, 21 nt, Yersinia pestis
cgcugcuuuuacgcaaguaaa

SEQ ID NO: 4176619 - RNA, 14 nt, Yersinia pestis
cgcuggcauacuga

SEQ ID NO: 4176620 - RNA, 20 nt, Yersinia pestis
cgcuggcgauaaucucgugg

SEQ ID NO: 4176621 - RNA, 17 nt, Yersinia pestis
cgcuggcuuucucccau

SEQ ID NO: 4176622 - RNA, 19 nt, Yersinia pestis
cgcugguggcuugaugaua

SEQ ID NO: 4176623 - RNA, 19 nt, Yersinia pestis
cgcugguuaucacagcaaa

SEQ ID NO: 4176624 - RNA, 19 nt, Yersinia pestis
cgcuguaaucuuggcacuc

SEQ ID NO: 4176625 - RNA, 21 nt, Yersinia pestis
cgcuguacaacaagaucccaa

SEQ ID NO: 4176626 - RNA, 16 nt, Yersinia pestis
cgcugucugaauagug

SEQ ID NO: 4176627 - RNA, 13 nt, Yersinia pestis
cgcuguucaucgc

SEQ ID NO: 4176628 - RNA, 18 nt, Yersinia pestis
cgcuguucaucgcaauuc

SEQ ID NO: 4176629 - RNA, 19 nt, Yersinia pestis
cgcuguuugauuaaaaccc

SEQ ID NO: 4176630 - RNA, 17 nt, Yersinia pestis
cgcuuagcaggcccuuu

SEQ ID NO: 4176631 - RNA, 15 nt, Yersinia pestis
cgcuuaucccuccau

SEQ ID NO: 4176632 - RNA, 20 nt, Yersinia pestis
cgcuucacauuugaaaugca

SEQ ID NO: 4176633 - RNA, 22 nt, Yersinia pestis
cgcuuccagcgcuuccacugcg

SEQ ID NO: 4176634 - RNA, 18 nt, Yersinia pestis
cgcuucgcacuucaagca

SEQ ID NO: 4176635 - RNA, 15 nt, Yersinia pestis
cgcuucguccagaug

SEQ ID NO: 4176636 - RNA, 24 nt, Yersinia pestis
cgcuugauggccacacugucauca

SEQ ID NO: 4176637 - RNA, 12 nt, Yersinia pestis
cgcuugauugau

SEQ ID NO: 4176638 - RNA, 19 nt, Yersinia pestis
cgcuugcaggucugcaugg

SEQ ID NO: 4176639 - RNA, 15 nt, Yersinia pestis
cgcuuggcaucacag

SEQ ID NO: 4176640 - RNA, 12 nt, Yersinia pestis
cgcuuggcucug

SEQ ID NO: 4176641 - RNA, 18 nt, Yersinia pestis
cgcuuggugaugcugcug

SEQ ID NO: 4176642 - RNA, 19 nt, Yersinia pestis
cgcuuuacucuucugccua

SEQ ID NO: 4176643 - RNA, 20 nt, Yersinia pestis KIM
ucgguaacuuacaggcugcc

SEQ ID NO: 4176644 - RNA, 15 nt, Yersinia pestis KIM
ucgguaaucaauuuu

SEQ ID NO: 4176645 - RNA, 22 nt, Yersinia pestis KIM
ucgguacaaucucugggugcug

SEQ ID NO: 4176646 - RNA, 18 nt, Yersinia pestis KIM
ucgguaccgccagaauaa

SEQ ID NO: 4176647 - RNA, 19 nt, Yersinia pestis KIM
ucgguaggcgggugaaaua

SEQ ID NO: 4176648 - RNA, 20 nt, Yersinia pestis KIM
ucggucacacuggcacgggc

SEQ ID NO: 4176649 - RNA, 16 nt, Yersinia pestis KIM
ucggucuauaaaaccg

SEQ ID NO: 4176650 - RNA, 12 nt, Yersinia pestis KIM
ucggugcaaaac

SEQ ID NO: 4176651 - RNA, 21 nt, Yersinia pestis KIM
ucgguuagcuguccucuacca

SEQ ID NO: 4176652 - RNA, 14 nt, Yersinia pestis KIM
ucgguugccgccuu

SEQ ID NO: 4176653 - RNA, 16 nt, Yersinia pestis KIM
ucguacacuuuagcca

SEQ ID NO: 4176654 - RNA, 20 nt, Yersinia pestis KIM
ucguacaucuccgcuauuuu

SEQ ID NO: 4176655 - RNA, 16 nt, Yersinia pestis KIM
ucguacuuuccuuccu

SEQ ID NO: 4176656 - RNA, 18 nt, Yersinia pestis KIM
ucguauaacauaauaaau

SEQ ID NO: 4176657 - RNA, 23 nt, Yersinia pestis KIM
ucguaugaauggaaguuaaaaaa

SEQ ID NO: 4176658 - RNA, 15 nt, Yersinia pestis KIM
ucgucaaguucauau

SEQ ID NO: 4176659 - RNA, 20 nt, Yersinia pestis KIM
ucgucacacuggugcucacu

SEQ ID NO: 4176660 - RNA, 13 nt, Yersinia pestis KIM
ucgucagccccug

SEQ ID NO: 4176661 - RNA, 21 nt, Yersinia pestis KIM
ucgucagugcgguaaccagca

SEQ ID NO: 4176662 - RNA, 20 nt, Yersinia pestis KIM
ucgucccaggccuccgcaaa

SEQ ID NO: 4176663 - RNA, 20 nt, Yersinia pestis KIM
ucgucgaacauuuucuaagc

SEQ ID NO: 4176664 - RNA, 14 nt, Yersinia pestis KIM
ucgucgagaauaac

SEQ ID NO: 4176665 - RNA, 17 nt, Yersinia pestis KIM
ucgucgaggaucaccac

SEQ ID NO: 4176666 - RNA, 14 nt, Yersinia pestis KIM
ucgucggcccggcc

SEQ ID NO: 4176667 - RNA, 20 nt, Yersinia pestis KIM
ucgucggcccggccaggcuc

SEQ ID NO: 4176668 - RNA, 21 nt, Yersinia pestis KIM
ucgucggcccggccaggcucc

SEQ ID NO: 4176669 - RNA, 15 nt, Yersinia pestis KIM
ucgucguaauauuuc

SEQ ID NO: 4176670 - RNA, 14 nt, Yersinia pestis KIM
ucgucuucgacagc

SEQ ID NO: 4176671 - RNA, 24 nt, Yersinia pestis KIM
ucgugaaaacuuucuuucaguaau

SEQ ID NO: 4176672 - RNA, 14 nt, Yersinia pestis KIM
ucgugaaagcagaa

SEQ ID NO: 4176673 - RNA, 21 nt, Yersinia pestis KIM
ucgugaaguuuauacuauuua

SEQ ID NO: 4176674 - RNA, 21 nt, Yersinia pestis KIM
ucgugaucaaccgaggcgcug

SEQ ID NO: 4176675 - RNA, 20 nt, Yersinia pestis KIM
ucgugcgggauucgaaccug

SEQ ID NO: 4176676 - RNA, 21 nt, Yersinia pestis KIM
ucguggaaaucgggugauaaa

SEQ ID NO: 4176677 - RNA, 20 nt, Yersinia pestis KIM
ucguggaguagagcuuccag

SEQ ID NO: 4176678 - RNA, 18 nt, Yersinia pestis KIM
ucguguaacacgaggcgc

SEQ ID NO: 4176679 - RNA, 19 nt, Yersinia pestis KIM
ucguguauaucacuauuuc

SEQ ID NO: 4176680 - RNA, 19 nt, Yersinia pestis KIM
ucguuacucgguccaucug

SEQ ID NO: 4176681 - RNA, 20 nt, Yersinia pestis KIM
ucguuagggauucgugucaa

SEQ ID NO: 4176682 - RNA, 23 nt, Yersinia pestis KIM
ucguuagugaaguaauaaaaauc

SEQ ID NO: 4176683 - RNA, 17 nt, Yersinia pestis KIM
ucguuauauaaauggcu

SEQ ID NO: 4176684 - RNA, 18 nt, Yersinia pestis KIM
ucguuauauaaauggcug

SEQ ID NO: 4176685 - RNA, 18 nt, Yersinia pestis KIM
ucguucgcccuucuucca

SEQ ID NO: 4176686 - RNA, 22 nt, Yersinia pestis KIM
ucguugaccuuagauaaauaga

SEQ ID NO: 4176687 - RNA, 17 nt, Yersinia pestis KIM
ucguuuaaaaaauaucu

SEQ ID NO: 4176688 - RNA, 19 nt, Yersinia pestis KIM
ucguuuaacucaaauaaac

SEQ ID NO: 4176689 - RNA, 15 nt, Yersinia pestis KIM
ucguuuacuugaugg

SEQ ID NO: 4176690 - RNA, 20 nt, Yersinia pestis KIM
ucguuucccccuguaaaaca

SEQ ID NO: 4176691 - RNA, 15 nt, Yersinia pestis KIM
ucguuucucuaaaau

SEQ ID NO: 4176692 - RNA, 14 nt, Yersinia pestis KIM
ucguuucugucuga

SEQ ID NO: 4176693 - RNA, 16 nt, Yersinia pestis KIM
ucguuuguaccuguuc

SEQ ID NO: 4176694 - RNA, 15 nt, Yersinia pestis KIM
ucuaaaaucgcacug

SEQ ID NO: 4176695 - RNA, 21 nt, Yersinia pestis KIM
ucuaaacgaccaauuucaaua

SEQ ID NO: 4176696 - RNA, 17 nt, Yersinia pestis KIM
ucuaaauccugcaaauu

SEQ ID NO: 4176697 - RNA, 20 nt, Yersinia pestis KIM
ucuaaauugcuuaaaaaaag

SEQ ID NO: 4176698 - RNA, 15 nt, Yersinia pestis KIM
ucuaacauacucaga

SEQ ID NO: 4176699 - RNA, 14 nt, Yersinia pestis KIM
ucuaacuaauaaua

SEQ ID NO: 4176700 - RNA, 16 nt, Yersinia pestis KIM
ucuaacuaauaauaau

SEQ ID NO: 4176701 - RNA, 17 nt, Yersinia pestis KIM
ucuaacucauucauaau

SEQ ID NO: 4176702 - RNA, 19 nt, Yersinia pestis KIM
ucuaacugauguauucccu

SEQ ID NO: 4176703 - RNA, 15 nt, Yersinia pestis KIM
ucuaagcugccugug

SEQ ID NO: 4176704 - RNA, 19 nt, Yersinia pestis KIM
ucuaagggaaauacccaaa

SEQ ID NO: 4176705 - RNA, 15 nt, Yersinia pestis KIM
ucuaauaaugagcca

SEQ ID NO: 4176706 - RNA, 21 nt, Yersinia pestis KIM
ucuaauagggccuccaacugc

SEQ ID NO: 4176707 - RNA, 18 nt, Yersinia pestis KIM
ucuaaugacuacuaauca

SEQ ID NO: 4176708 - RNA, 22 nt, Yersinia pestis KIM
ucuaaugacuacuaaucaaucu

SEQ ID NO: 4176709 - RNA, 15 nt, Yersinia pestis KIM
ucuaauuuucucaga

SEQ ID NO: 4176710 - RNA, 11 nt, Yersinia pestis KIM
ucuacaacauc

SEQ ID NO: 4176711 - RNA, 16 nt, Yersinia pestis KIM
ucuacagggaaaaacg

SEQ ID NO: 4176712 - RNA, 16 nt, Yersinia pestis KIM
ucuacagggcauaucg

SEQ ID NO: 4176713 - RNA, 17 nt, Yersinia pestis KIM
ucuacauaaucuuuacu

SEQ ID NO: 4176714 - RNA, 16 nt, Yersinia pestis KIM
ucuacauugacuaauu

SEQ ID NO: 4176715 - RNA, 23 nt, Yersinia pestis KIM
ucuaccuucaggccuuuacuguu

SEQ ID NO: 4176716 - RNA, 22 nt, Yersinia pestis KIM
ucuacucgcucaccacugaguu

SEQ ID NO: 4176717 - RNA, 19 nt, Yersinia pestis KIM
ucuagaauuugaucagcca

SEQ ID NO: 4176718 - RNA, 23 nt, Yersinia pestis KIM
ucuagaccugaggauaaaaacua

SEQ ID NO: 4176719 - RNA, 15 nt, Yersinia pestis KIM
accuaaccaaacauu

SEQ ID NO: 4176720 - RNA, 22 nt, Yersinia pestis KIM
accuaaccaaacauugucaccu

SEQ ID NO: 4176721 - RNA, 16 nt, Yersinia pestis KIM
accuaacgccaaaaug

SEQ ID NO: 4176722 - RNA, 20 nt, Yersinia pestis KIM
accuaauaacgcucaucacg

SEQ ID NO: 4176723 - RNA, 16 nt, Yersinia pestis KIM
accuaauacagcacca

SEQ ID NO: 4176724 - RNA, 18 nt, Yersinia pestis KIM
accuaaugcaauggcucc

SEQ ID NO: 4176725 - RNA, 20 nt, Yersinia pestis KIM
accuacaggcuggauugauu

SEQ ID NO: 4176726 - RNA, 16 nt, Yersinia pestis KIM
accuaccgcaccaaug

SEQ ID NO: 4176727 - RNA, 19 nt, Yersinia pestis KIM
accuaccgcaccaaugccg

SEQ ID NO: 4176728 - RNA, 18 nt, Yersinia pestis KIM
accuacgccauuaaaagg

SEQ ID NO: 4176729 - RNA, 19 nt, Yersinia pestis KIM
accuauaauuaacagcauc

SEQ ID NO: 4176730 - RNA, 18 nt, Yersinia pestis KIM
accuaucgccgccgccag

SEQ ID NO: 4176731 - RNA, 21 nt, Yersinia pestis KIM
accuaucgccgccgccagccc

SEQ ID NO: 4176732 - RNA, 22 nt, Yersinia pestis KIM
accuaucguuuguaccuguuca

SEQ ID NO: 4176733 - RNA, 15 nt, Yersinia pestis KIM
accuauugauaaaac

SEQ ID NO: 4176734 - RNA, 16 nt, Yersinia pestis KIM
accuauugauaaaacc

SEQ ID NO: 4176735 - RNA, 17 nt, Yersinia pestis KIM
accuauugauaaaacca

SEQ ID NO: 4176736 - RNA, 13 nt, Yersinia pestis KIM
accuauugauguu

SEQ ID NO: 4176737 - RNA, 14 nt, Yersinia pestis KIM
accucaaaaggaug

SEQ ID NO: 4176738 - RNA, 19 nt, Yersinia pestis KIM
accucaaaaggauggccca

SEQ ID NO: 4176739 - RNA, 22 nt, Yersinia pestis KIM
accucaccguuaauggcaccau

SEQ ID NO: 4176740 - RNA, 13 nt, Yersinia pestis KIM
accucagaaaaau

SEQ ID NO: 4176741 - RNA, 17 nt, Yersinia pestis KIM
accucagggagccaaua

SEQ ID NO: 4176742 - RNA, 15 nt, Yersinia pestis KIM
accucagucaucgcc

SEQ ID NO: 4176743 - RNA, 14 nt, Yersinia pestis KIM
accucaucacccgc

SEQ ID NO: 4176744 - RNA, 16 nt, Yersinia pestis KIM
accuccaaaugucagg

SEQ ID NO: 4176745 - RNA, 15 nt, Yersinia pestis KIM
accuccauauccugg

SEQ ID NO: 4176746 - RNA, 22 nt, Yersinia pestis KIM
accuccggugguuucgccgcca

SEQ ID NO: 4176747 - RNA, 14 nt, Yersinia pestis KIM
accuccguaggcca

SEQ ID NO: 4176748 - RNA, 15 nt, Yersinia pestis KIM
accuccguaggccaa

SEQ ID NO: 4176749 - RNA, 17 nt, Yersinia pestis KIM
accucgaaaucauccgc

SEQ ID NO: 4176750 - RNA, 21 nt, Yersinia pestis KIM
accucgaagggauaucucacc

SEQ ID NO: 4176751 - RNA, 22 nt, Yersinia pestis KIM
accucggcgucagcaucaaacu

SEQ ID NO: 4176752 - RNA, 16 nt, Yersinia pestis KIM
accucgggcgcuuaaa

SEQ ID NO: 4176753 - RNA, 20 nt, Yersinia pestis KIM
accucgggcgcuuaaauaaa

SEQ ID NO: 4176754 - RNA, 14 nt, Yersinia pestis KIM
accucguuggcuac

SEQ ID NO: 4176755 - RNA, 18 nt, Yersinia pestis KIM
accucuaaucuccucucc

SEQ ID NO: 4176756 - RNA, 15 nt, Yersinia pestis KIM
accucuucagguaag

SEQ ID NO: 4176757 - RNA, 17 nt, Yersinia pestis KIM
accucuuguaaaccagc

SEQ ID NO: 4176758 - RNA, 16 nt, Yersinia pestis KIM
accugaaccugacgca

SEQ ID NO: 4176759 - RNA, 17 nt, Yersinia pestis KIM
accugaaugccauucaa

SEQ ID NO: 4176760 - RNA, 16 nt, Yersinia pestis KIM
accugacacugcaucu

SEQ ID NO: 4176761 - RNA, 20 nt, Yersinia pestis KIM
accugacgaaaugccgccug

SEQ ID NO: 4176762 - RNA, 14 nt, Yersinia pestis KIM
accugacuguggcu

SEQ ID NO: 4176763 - RNA, 19 nt, Yersinia pestis KIM
accugaggauaaaaacuac

SEQ ID NO: 4176764 - RNA, 22 nt, Yersinia pestis KIM
accugaguagcauaaaaaucaa

SEQ ID NO: 4176765 - RNA, 17 nt, Yersinia pestis KIM
accugauccaguuucag

SEQ ID NO: 4176766 - RNA, 19 nt, Yersinia pestis KIM
accugauuccuaagcaaau

SEQ ID NO: 4176767 - RNA, 20 nt, Yersinia pestis KIM
accugauuuaccgucuuuuu

SEQ ID NO: 4176768 - RNA, 19 nt, Yersinia pestis KIM
accugcaacgccagugacu

SEQ ID NO: 4176769 - RNA, 22 nt, Yersinia pestis KIM
accugcaacguuaaagaugaag

SEQ ID NO: 4176770 - RNA, 21 nt, Yersinia pestis KIM
accugcaauaaccagaauaau

SEQ ID NO: 4176771 - RNA, 16 nt, Yersinia pestis KIM
accugcaaugccuaaa

SEQ ID NO: 4176772 - RNA, 19 nt, Yersinia pestis KIM
accugcaccaaucauuaca

SEQ ID NO: 4176773 - RNA, 19 nt, Yersinia pestis KIM
accugcacgcuuaaagcau

SEQ ID NO: 4176774 - RNA, 15 nt, Yersinia pestis KIM
accugcaucaucaca

SEQ ID NO: 4176775 - RNA, 16 nt, Yersinia pestis KIM
accugcccagacucaa

SEQ ID NO: 4176776 - RNA, 19 nt, Yersinia pestis KIM
accugcgaccaauugauua

SEQ ID NO: 4176777 - RNA, 18 nt, Yersinia pestis KIM
accugcuaucaugauaaa

SEQ ID NO: 4176778 - RNA, 12 nt, Yersinia pestis KIM
accugcucaacu

SEQ ID NO: 4176779 - RNA, 18 nt, Yersinia pestis KIM
accugcucaacugcucaa

SEQ ID NO: 4176780 - RNA, 16 nt, Yersinia pestis KIM
accugcuggcgcaacu

SEQ ID NO: 4176781 - RNA, 15 nt, Yersinia pestis KIM
accugcuuaguuaca

SEQ ID NO: 4176782 - RNA, 21 nt, Yersinia pestis KIM
accuggacgcuggcagccuuu

SEQ ID NO: 4176783 - RNA, 18 nt, Yersinia pestis KIM
accugggcgcucuuuacg

SEQ ID NO: 4176784 - RNA, 16 nt, Yersinia pestis KIM
accuguagcucauacu

SEQ ID NO: 4176785 - RNA, 21 nt, Yersinia pestis KIM
accuguuacaucagagcucaa

SEQ ID NO: 4176786 - RNA, 13 nt, Yersinia pestis KIM
accuguuugcaac

SEQ ID NO: 4176787 - RNA, 22 nt, Yersinia pestis KIM
accuguuuuuguuguucuugau

SEQ ID NO: 4176788 - RNA, 12 nt, Yersinia pestis KIM
accuuaaaacag

SEQ ID NO: 4176789 - RNA, 17 nt, Yersinia pestis KIM
accuuaaguaaguuuaa

SEQ ID NO: 4176790 - RNA, 14 nt, Yersinia pestis KIM
accuuacugcauca

SEQ ID NO: 4176791 - RNA, 15 nt, Yersinia pestis KIM
accuuacuguaucaa

SEQ ID NO: 4176792 - RNA, 13 nt, Yersinia pestis KIM
accuuagauaaau

SEQ ID NO: 4176793 - RNA, 22 nt, Yersinia pestis KIM
accuuagauaaauagacucauc

SEQ ID NO: 4176794 - RNA, 12 nt, Yersinia pestis KIM
accuuauccaau

SEQ ID NO: 4176795 - RNA, 17 nt, Yersinia pestis KIM
accuuaucuggccccug

SEQ ID NO: 4176796 - RNA, 21 nt, Yersinia pestis KIM
accuuaucuggccccugaaua

SEQ ID NO: 4176797 - RNA, 13 nt, Yersinia pestis KIM
accuucaaucauu

SEQ ID NO: 4176798 - RNA, 15 nt, Yersinia pestis KIM
accuucacauuuucu

SEQ ID NO: 4176799 - RNA, 16 nt, Yersinia pestis KIM
accuucacgcucuugc

SEQ ID NO: 4176800 - RNA, 20 nt, Yersinia pestis KIM
accuucacgcucuugcucuu

SEQ ID NO: 4176801 - RNA, 21 nt, Yersinia pestis KIM
accuucacuggggagaucagu

SEQ ID NO: 4176802 - RNA, 18 nt, Yersinia pestis KIM
accuucaguuuauuuaag

SEQ ID NO: 4176803 - RNA, 19 nt, Yersinia pestis KIM
accuuccauaacucaccuu

SEQ ID NO: 4176804 - RNA, 20 nt, Yersinia pestis KIM
accuuccgucccaagaaaag

SEQ ID NO: 4176805 - RNA, 14 nt, Yersinia pestis KIM
accuucgagagcua

SEQ ID NO: 4176806 - RNA, 13 nt, Yersinia pestis KIM
accuucuuaauga

SEQ ID NO: 4176807 - RNA, 14 nt, Yersinia pestis KIM
accuugauccgcca

SEQ ID NO: 4176808 - RNA, 17 nt, Yersinia pestis KIM
accuugcgccaaguccu

SEQ ID NO: 4176809 - RNA, 15 nt, Yersinia pestis KIM
accuuggaaaacagc

SEQ ID NO: 4176810 - RNA, 20 nt, Yersinia pestis KIM
accuuggauggcgaaacaau

SEQ ID NO: 4176811 - RNA, 23 nt, Yersinia pestis KIM
accuugguaucuguuuuugccac

SEQ ID NO: 4176812 - RNA, 23 nt, Yersinia pestis KIM
accuugguuugauagcaaaacac

SEQ ID NO: 4176813 - RNA, 16 nt, Yersinia pestis KIM
accuugugucaccaug

SEQ ID NO: 4176814 - RNA, 19 nt, Yersinia pestis KIM
accuuuacaauuacacacc

SEQ ID NO: 4176815 - RNA, 14 nt, Yersinia pestis KIM
accuuuauguaaca

SEQ ID NO: 4176816 - RNA, 22 nt, Yersinia pestis KIM
accuuucagguaagcagagaau

SEQ ID NO: 4176817 - RNA, 20 nt, Yersinia pestis KIM
accuuucuaauuauuaaaca

SEQ ID NO: 4176818 - RNA, 18 nt, Yersinia pestis KIM
accuuugaucauggcuug

SEQ ID NO: 4176819 - RNA, 19 nt, Yersinia pestis KIM
accuuuuuaggguuguugg

SEQ ID NO: 4176820 - RNA, 14 nt, Yersinia pestis KIM
acgaaaaccuaaua

SEQ ID NO: 4176821 - RNA, 16 nt, Yersinia pestis KIM
acgaaaaccuaauacu

SEQ ID NO: 4176822 - RNA, 15 nt, Yersinia pestis KIM
acgaaacgcauaaga

SEQ ID NO: 4176823 - RNA, 16 nt, Yersinia pestis KIM
acgaaacgcauaagaa

SEQ ID NO: 4176824 - RNA, 19 nt, Yersinia pestis KIM
acgaaagagaacacaaaag

SEQ ID NO: 4176825 - RNA, 20 nt, Yersinia pestis KIM
acgaaagauaauuuagcaaa

SEQ ID NO: 4176826 - RNA, 18 nt, Yersinia pestis KIM
acgaaauagcgccugccc

SEQ ID NO: 4176827 - RNA, 23 nt, Yersinia pestis KIM
acgaaaugucgaaagauagcaaa

SEQ ID NO: 4176828 - RNA, 16 nt, Yersinia pestis KIM
acgaaauuuaagaaau

SEQ ID NO: 4176829 - RNA, 18 nt, Yersinia pestis KIM
acgaacagugccaacagc

SEQ ID NO: 4176830 - RNA, 21 nt, Yersinia pestis KIM
acgaacccgauaacccacagc

SEQ ID NO: 4176831 - RNA, 20 nt, Yersinia pestis KIM
acgaaggcaacaacacccga

SEQ ID NO: 4176832 - RNA, 21 nt, Yersinia pestis KIM
acgaauaacucucaucuaucg

SEQ ID NO: 4176833 - RNA, 22 nt, Yersinia pestis KIM
acgaaugagcaguaauagcaaa

SEQ ID NO: 4176834 - RNA, 18 nt, Yersinia pestis KIM
acgaauggcgacuaaugg

SEQ ID NO: 4176835 - RNA, 21 nt, Yersinia pestis KIM
acgacaauccuaucguuuauu

SEQ ID NO: 4176836 - RNA, 19 nt, Yersinia pestis KIM
acgacacaaaugcugugcc

SEQ ID NO: 4176837 - RNA, 21 nt, Yersinia pestis KIM
acgacagauuauuguuaucca

SEQ ID NO: 4176838 - RNA, 23 nt, Yersinia pestis KIM
acgacagcagcaggccauauucc

SEQ ID NO: 4176839 - RNA, 17 nt, Yersinia pestis KIM
acgaccaguaagugauu

SEQ ID NO: 4176840 - RNA, 16 nt, Yersinia pestis KIM
acgaccgucaccaaau

SEQ ID NO: 4176841 - RNA, 14 nt, Yersinia pestis KIM
acgaccuucaucuc

SEQ ID NO: 4176842 - RNA, 14 nt, Yersinia pestis KIM
acgaccuugccaag

SEQ ID NO: 4176843 - RNA, 16 nt, Yersinia pestis KIM
acgacgcccccgccag

SEQ ID NO: 4176844 - RNA, 21 nt, Yersinia pestis KIM
acgacgugcucgucuucgaca

SEQ ID NO: 4176845 - RNA, 18 nt, Yersinia pestis KIM
acgacuucgucaucguaa

SEQ ID NO: 4176846 - RNA, 21 nt, Yersinia pestis KIM
acgaggacuuccugcccagcg

SEQ ID NO: 4176847 - RNA, 17 nt, Yersinia pestis KIM
acgagggcucaaucucu

SEQ ID NO: 4176848 - RNA, 20 nt, Yersinia pestis KIM
acgaguaaaaagauggccuc

SEQ ID NO: 4176849 - RNA, 13 nt, Yersinia pestis KIM
acgaguaaauaca

SEQ ID NO: 4176850 - RNA, 16 nt, Yersinia pestis KIM
acgaguaaauagcaaa

SEQ ID NO: 4176851 - RNA, 12 nt, Yersinia pestis KIM
acgaguauuccc

SEQ ID NO: 4176852 - RNA, 19 nt, Yersinia pestis KIM
acgaguuguacgugaagau

SEQ ID NO: 4176853 - RNA, 15 nt, Yersinia pestis KIM
acgauaacuuuuggc

SEQ ID NO: 4176854 - RNA, 16 nt, Yersinia pestis KIM
acgauaagaauauuua

SEQ ID NO: 4176855 - RNA, 16 nt, Yersinia pestis KIM
acgauaagaaugaaua

SEQ ID NO: 4176856 - RNA, 16 nt, Yersinia pestis KIM
acgauaauuugcagcc

SEQ ID NO: 4176857 - RNA, 16 nt, Yersinia pestis KIM
acgauagccagugaca

SEQ ID NO: 4176858 - RNA, 19 nt, Yersinia pestis KIM
acgauauagagcucagcuu

SEQ ID NO: 4176859 - RNA, 13 nt, Yersinia pestis KIM
acgauaucaccag

SEQ ID NO: 4176860 - RNA, 19 nt, Yersinia pestis KIM
acgaucaacccccugugga

SEQ ID NO: 4176861 - RNA, 14 nt, Yersinia pestis KIM
acgaucacugcuuu

SEQ ID NO: 4176862 - RNA, 16 nt, Yersinia pestis KIM
acgaucagaacguuaa

SEQ ID NO: 4176863 - RNA, 14 nt, Yersinia pestis KIM
acgaucauuauaua

SEQ ID NO: 4176864 - RNA, 23 nt, Yersinia pestis KIM
acgauccacgauugguugcauuu

SEQ ID NO: 4176865 - RNA, 21 nt, Yersinia pestis KIM
acgaucccucggugauaaguu

SEQ ID NO: 4176866 - RNA, 23 nt, Yersinia pestis KIM
acgaucgauaguaacaccagcau

SEQ ID NO: 4176867 - RNA, 19 nt, Yersinia pestis KIM
acgaucugccuguucucuc

SEQ ID NO: 4176868 - RNA, 18 nt, Yersinia pestis KIM
acgaucuugcccaaugcc

SEQ ID NO: 4176869 - RNA, 16 nt, Yersinia pestis KIM
acgaugccgauaaaga

SEQ ID NO: 4176870 - RNA, 22 nt, Yersinia pestis KIM
acgauggaguggucaugcucac

SEQ ID NO: 4176871 - RNA, 13 nt, Yersinia pestis KIM
acgaugucggcag

SEQ ID NO: 4176872 - RNA, 17 nt, Yersinia pestis KIM
acgauuacccaccaccu

SEQ ID NO: 4176873 - RNA, 15 nt, Yersinia pestis KIM
acgauuaccugcaua

SEQ ID NO: 4176874 - RNA, 20 nt, Yersinia pestis KIM
acgauuaccugcauauccuc

SEQ ID NO: 4176875 - RNA, 22 nt, Yersinia pestis KIM
acgauuaucucuuacauaaaga

SEQ ID NO: 4176876 - RNA, 19 nt, Yersinia pestis KIM
acgauuguuacgccuucag

SEQ ID NO: 4176877 - RNA, 23 nt, Yersinia pestis KIM
acgauuguuacgccuucagcgau

SEQ ID NO: 4176878 - RNA, 16 nt, Yersinia pestis KIM
acgauuuucuuucacc

SEQ ID NO: 4176879 - RNA, 16 nt, Yersinia pestis KIM
acgcaaacggguggcc

SEQ ID NO: 4176880 - RNA, 17 nt, Yersinia pestis KIM
acgcaaagggcaacaau

SEQ ID NO: 4176881 - RNA, 11 nt, Yersinia pestis KIM
acgcaaguaaa

SEQ ID NO: 4176882 - RNA, 21 nt, Yersinia pestis KIM
acgcacacgaaucaggcggcu

SEQ ID NO: 4176883 - RNA, 18 nt, Yersinia pestis KIM
acgcacaucaauccgcau

SEQ ID NO: 4176884 - RNA, 15 nt, Yersinia pestis KIM
acgcaccauccagca

SEQ ID NO: 4176885 - RNA, 16 nt, Yersinia pestis KIM
acgcaccauccagcaa

SEQ ID NO: 4176886 - RNA, 18 nt, Yersinia pestis KIM
acgcaccauccagcaaau

SEQ ID NO: 4176887 - RNA, 16 nt, Yersinia pestis KIM
acgcacucgaaucacu

SEQ ID NO: 4176888 - RNA, 19 nt, Yersinia pestis KIM
acgcagaauaacggcagua

SEQ ID NO: 4176889 - RNA, 23 nt, Yersinia pestis KIM
acgcagagucucaccgcuggaag

SEQ ID NO: 4176890 - RNA, 12 nt, Yersinia pestis KIM
acgcagcgcuug

SEQ ID NO: 4176891 - RNA, 19 nt, Yersinia pestis KIM
acgcaggcacugcagaaaa

SEQ ID NO: 4176892 - RNA, 12 nt, Yersinia pestis KIM
acgcaggcggug

SEQ ID NO: 4176893 - RNA, 18 nt, Yersinia pestis KIM
acgcaggcggugaucauc

SEQ ID NO: 4176894 - RNA, 15 nt, Yersinia pestis KIM
acgcaguacgugacg

SEQ ID NO: 4176895 - RNA, 16 nt, Yersinia pestis KIM
acgcaguacgugacgg

SEQ ID NO: 4176896 - RNA, 17 nt, Yersinia pestis KIM
acgcauucaucagggca

SEQ ID NO: 4176897 - RNA, 13 nt, Yersinia pestis KIM
acgccaauaccgg

SEQ ID NO: 4176898 - RNA, 14 nt, Yersinia pestis KIM
acgccaauucacgc

SEQ ID NO: 4176899 - RNA, 19 nt, Yersinia pestis KIM
acgccacuacgaccccaac

SEQ ID NO: 4176900 - RNA, 16 nt, Yersinia pestis KIM
acgccacuuaucccaa

SEQ ID NO: 4176901 - RNA, 18 nt, Yersinia pestis KIM
acgccacuuaucccaacu

SEQ ID NO: 4176902 - RNA, 22 nt, Yersinia pestis KIM
acgccagauagcaucauccagc

SEQ ID NO: 4176903 - RNA, 16 nt, Yersinia pestis KIM
acgccagccucugcgc

SEQ ID NO: 4176904 - RNA, 19 nt, Yersinia pestis KIM
acgccaguaaacagccagc

SEQ ID NO: 4176905 - RNA, 21 nt, Yersinia pestis KIM
acgccaguugggauguucagc

SEQ ID NO: 4176906 - RNA, 12 nt, Yersinia pestis KIM
acgccaucaaua

SEQ ID NO: 4176907 - RNA, 13 nt, Yersinia pestis KIM
acgccauccacuc

SEQ ID NO: 4176908 - RNA, 22 nt, Yersinia pestis KIM
acgccaugcagcuaaaagaugc

SEQ ID NO: 4176909 - RNA, 14 nt, Yersinia pestis KIM
acgcccaaaucugc

SEQ ID NO: 4176910 - RNA, 17 nt, Yersinia pestis KIM
acgcccaggccauagca

SEQ ID NO: 4176911 - RNA, 15 nt, Yersinia pestis KIM
acgccccaugcaccu

SEQ ID NO: 4176912 - RNA, 19 nt, Yersinia pestis KIM
acgccgcuaaaucaucaaa

SEQ ID NO: 4176913 - RNA, 12 nt, Yersinia pestis KIM
acgccgcuacaa

SEQ ID NO: 4176914 - RNA, 15 nt, Yersinia pestis KIM
acgccgcucaauuaa

SEQ ID NO: 4176915 - RNA, 13 nt, Yersinia pestis KIM
acgccuauccuca

SEQ ID NO: 4176916 - RNA, 17 nt, Yersinia pestis KIM
acgccuauccucaugau

SEQ ID NO: 4176917 - RNA, 14 nt, Yersinia pestis KIM
acgccugggaucca

SEQ ID NO: 4176918 - RNA, 20 nt, Yersinia pestis KIM
acgccugggauccauaggau

SEQ ID NO: 4176919 - RNA, 14 nt, Yersinia pestis KIM
acgcgccgcagcag

SEQ ID NO: 4176920 - RNA, 22 nt, Yersinia pestis KIM
acgcgccuccaguuuuccagag

SEQ ID NO: 4176921 - RNA, 18 nt, Yersinia pestis KIM
acgcggcuuuuaucuucc

SEQ ID NO: 4176922 - RNA, 19 nt, Yersinia pestis KIM
acgcgguugggcuucgguc

SEQ ID NO: 4176923 - RNA, 13 nt, Yersinia pestis KIM
acgcguagagccu

SEQ ID NO: 4176924 - RNA, 23 nt, Yersinia pestis KIM
acgcguucaaucuucgcaccuag

SEQ ID NO: 4176925 - RNA, 18 nt, Yersinia pestis KIM
acgcguucaccgcuggca

SEQ ID NO: 4176926 - RNA, 12 nt, Yersinia pestis KIM
acgcuaauuaaa

SEQ ID NO: 4176927 - RNA, 20 nt, Yersinia pestis KIM
acgcuaccaugagugaaaau

SEQ ID NO: 4176928 - RNA, 18 nt, Yersinia pestis KIM
acgcucaccaucgccuuu

SEQ ID NO: 4176929 - RNA, 21 nt, Yersinia pestis KIM
acgcucauaccaugccaucaa

SEQ ID NO: 4176930 - RNA, 16 nt, Yersinia pestis KIM
acgcucaucaaccggg

SEQ ID NO: 4176931 - RNA, 19 nt, Yersinia pestis KIM
acgcucauccaacguaaac

SEQ ID NO: 4176932 - RNA, 17 nt, Yersinia pestis KIM
acgcucaucgguaccag

SEQ ID NO: 4176933 - RNA, 22 nt, Yersinia pestis KIM
acgcuccgguuuucacccccac

SEQ ID NO: 4176934 - RNA, 15 nt, Yersinia pestis KIM
acgcuccucacuuug

SEQ ID NO: 4176935 - RNA, 18 nt, Yersinia pestis KIM
acgcucgcugcuggaagu

SEQ ID NO: 4176936 - RNA, 21 nt, Yersinia pestis KIM
acgcucgguuguucagcacca

SEQ ID NO: 4176937 - RNA, 16 nt, Yersinia pestis KIM
acgcucuaacgucaga

SEQ ID NO: 4176938 - RNA, 18 nt, Yersinia pestis KIM
acgcugaaacuuuucagu

SEQ ID NO: 4176939 - RNA, 15 nt, Yersinia pestis KIM
acgcugauagccaau

SEQ ID NO: 4176940 - RNA, 19 nt, Yersinia pestis KIM
acgcugcaccgcugauaac

SEQ ID NO: 4176941 - RNA, 17 nt, Yersinia pestis KIM
acgcugcguuucaauug

SEQ ID NO: 4176942 - RNA, 13 nt, Yersinia pestis KIM
acgcuggcacugg

SEQ ID NO: 4176943 - RNA, 17 nt, Yersinia pestis KIM
acgcuggcacuggaugu

SEQ ID NO: 4176944 - RNA, 11 nt, Yersinia pestis KIM
acgcuggccag

SEQ ID NO: 4176945 - RNA, 13 nt, Yersinia pestis KIM
acgcugggcgaua

SEQ ID NO: 4176946 - RNA, 20 nt, Yersinia pestis KIM
acgcugguguaacggcugcu

SEQ ID NO: 4176947 - RNA, 17 nt, Yersinia pestis KIM
acgcugguuaucacagc

SEQ ID NO: 4176948 - RNA, 23 nt, Yersinia pestis KIM
acgcuuuacucuucagccuaucc

SEQ ID NO: 4176949 - RNA, 23 nt, Yersinia pestis KIM
acgcuuucagggaguaacuugac

SEQ ID NO: 4176950 - RNA, 17 nt, Yersinia pestis KIM
acgcuuugacuuuggcu

SEQ ID NO: 4176951 - RNA, 14 nt, Yersinia pestis KIM
acggaacucaucuu

SEQ ID NO: 4176952 - RNA, 20 nt, Yersinia pestis KIM
auaacacggccuauugaaua

SEQ ID NO: 4176953 - RNA, 14 nt, Yersinia pestis KIM
auaacagauauuac

SEQ ID NO: 4176954 - RNA, 21 nt, Yersinia pestis KIM
auaacagauauuacgcagcca

SEQ ID NO: 4176955 - RNA, 12 nt, Yersinia pestis KIM
auaacagcuaau

SEQ ID NO: 4176956 - RNA, 17 nt, Yersinia pestis KIM
auaacaguaucaaguau

SEQ ID NO: 4176957 - RNA, 21 nt, Yersinia pestis KIM
auaacaguaucaaguauguuu

SEQ ID NO: 4176958 - RNA, 18 nt, Yersinia pestis KIM
auaacauaauaaauuaau

SEQ ID NO: 4176959 - RNA, 20 nt, Yersinia pestis KIM
auaacauuauugaacgcuug

SEQ ID NO: 4176960 - RNA, 13 nt, Yersinia pestis KIM
auaacauuuuuuc

SEQ ID NO: 4176961 - RNA, 14 nt, Yersinia pestis KIM
auaaccaaaucacc

SEQ ID NO: 4176962 - RNA, 17 nt, Yersinia pestis KIM
auaaccaauccaugcca

SEQ ID NO: 4176963 - RNA, 18 nt, Yersinia pestis KIM
auaaccaauccaugccag

SEQ ID NO: 4176964 - RNA, 18 nt, Yersinia pestis KIM
auaaccacuucaauugcc

SEQ ID NO: 4176965 - RNA, 12 nt, Yersinia pestis KIM
auaaccagcagc

SEQ ID NO: 4176966 - RNA, 16 nt, Yersinia pestis KIM
auaaccaucaaauaca

SEQ ID NO: 4176967 - RNA, 11 nt, Yersinia pestis KIM
auaaccauuaa

SEQ ID NO: 4176968 - RNA, 23 nt, Yersinia pestis KIM
auaaccauuaauugguuuuaaua

SEQ ID NO: 4176969 - RNA, 15 nt, Yersinia pestis KIM
auaaccauugguuac

SEQ ID NO: 4176970 - RNA, 22 nt, Yersinia pestis KIM
auaacccaaugccauagcugcu

SEQ ID NO: 4176971 - RNA, 14 nt, Yersinia pestis KIM
auaacccacagcaa

SEQ ID NO: 4176972 - RNA, 18 nt, Yersinia pestis KIM
auaacccgccuagcauca

SEQ ID NO: 4176973 - RNA, 19 nt, Yersinia pestis KIM
auaacccgccuagcaucau

SEQ ID NO: 4176974 - RNA, 16 nt, Yersinia pestis KIM
auaaccgaguuuuuug

SEQ ID NO: 4176975 - RNA, 22 nt, Yersinia pestis KIM
auaaccgcgaagaggguuuuuu

SEQ ID NO: 4176976 - RNA, 20 nt, Yersinia pestis KIM
auaaccgcuaaggccaaugg

SEQ ID NO: 4176977 - RNA, 21 nt, Yersinia pestis KIM
auaaccguuaaggccagcaga

SEQ ID NO: 4176978 - RNA, 16 nt, Yersinia pestis KIM
auaaccucaaaaggau

SEQ ID NO: 4176979 - RNA, 13 nt, Yersinia pestis KIM
auaaccucagccu

SEQ ID NO: 4176980 - RNA, 21 nt, Yersinia pestis KIM
auaaccucagccucauucaug

SEQ ID NO: 4176981 - RNA, 17 nt, Yersinia pestis KIM
auaaccucagggcgucu

SEQ ID NO: 4176982 - RNA, 23 nt, Yersinia pestis KIM
auaaccucgguggcucaauccaa

SEQ ID NO: 4176983 - RNA, 21 nt, Yersinia pestis KIM
auaacgaauuucauuuuaaaa

SEQ ID NO: 4176984 - RNA, 22 nt, Yersinia pestis KIM
auaacgauuaauuaguuuuaau

SEQ ID NO: 4176985 - RNA, 20 nt, Yersinia pestis KIM
auaacgccccuguaaauaaa

SEQ ID NO: 4176986 - RNA, 14 nt, Yersinia pestis KIM
auaacgccugcaau

SEQ ID NO: 4176987 - RNA, 15 nt, Yersinia pestis KIM
auaacggcggcaaua

SEQ ID NO: 4176988 - RNA, 16 nt, Yersinia pestis KIM
auaacggcgguaccag

SEQ ID NO: 4176989 - RNA, 17 nt, Yersinia pestis KIM
auaacgguaucagucau

SEQ ID NO: 4176990 - RNA, 16 nt, Yersinia pestis KIM
auaacguuguuucuga

SEQ ID NO: 4176991 - RNA, 21 nt, Yersinia pestis KIM
auaacguuguuucugaagggc

SEQ ID NO: 4176992 - RNA, 16 nt, Yersinia pestis KIM
auaacguuucagggug

SEQ ID NO: 4176993 - RNA, 16 nt, Yersinia pestis KIM
auaacuaaaaaaguaa

SEQ ID NO: 4176994 - RNA, 20 nt, Yersinia pestis KIM
auaacuauauucucauugcc

SEQ ID NO: 4176995 - RNA, 12 nt, Yersinia pestis KIM
auaacucaucag

SEQ ID NO: 4176996 - RNA, 14 nt, Yersinia pestis KIM
auaacucaucagua

SEQ ID NO: 4176997 - RNA, 18 nt, Yersinia pestis KIM
auaacucaucaguaacgc

SEQ ID NO: 4176998 - RNA, 14 nt, Yersinia pestis KIM
auaacugaauacuu

SEQ ID NO: 4176999 - RNA, 19 nt, Yersinia pestis KIM
auaacugagguauaucgug

SEQ ID NO: 4177000 - RNA, 14 nt, Yersinia pestis KIM
auaacugccauaca

SEQ ID NO: 4177001 - RNA, 15 nt, Yersinia pestis KIM
auaacuggagaauuu

SEQ ID NO: 4177002 - RNA, 14 nt, Yersinia pestis KIM
auaacuuaaauaau

SEQ ID NO: 4177003 - RNA, 16 nt, Yersinia pestis KIM
auaagacaccacauca

SEQ ID NO: 4177004 - RNA, 14 nt, Yersinia pestis KIM
auaagacagggguu

SEQ ID NO: 4177005 - RNA, 14 nt, Yersinia pestis KIM
auaagaugggcuua

SEQ ID NO: 4177006 - RNA, 15 nt, Yersinia pestis KIM
auaagauucagcugc

SEQ ID NO: 4177007 - RNA, 23 nt, Yersinia pestis KIM
auaagauugagggcgucucuacg

SEQ ID NO: 4177008 - RNA, 16 nt, Yersinia pestis KIM
auaagcaggcaguaaa

SEQ ID NO: 4177009 - RNA, 20 nt, Yersinia pestis KIM
auaagcaggcaguaaaauau

SEQ ID NO: 4177010 - RNA, 13 nt, Yersinia pestis KIM
auaagcaucggca

SEQ ID NO: 4177011 - RNA, 23 nt, Yersinia pestis KIM
auaagccauuuuuuauaaacacu

SEQ ID NO: 4177012 - RNA, 19 nt, Yersinia pestis KIM
auaagccgcaggcaaacaa

SEQ ID NO: 4177013 - RNA, 15 nt, Yersinia pestis KIM
auaagcgcucaaaua

SEQ ID NO: 4177014 - RNA, 23 nt, Yersinia pestis KIM
auaagcgcucaaauacgguagca

SEQ ID NO: 4177015 - RNA, 21 nt, Yersinia pestis KIM
auaagcgggguuaaucccccg

SEQ ID NO: 4177016 - RNA, 17 nt, Yersinia pestis KIM
auaagcgguuuuaucaa

SEQ ID NO: 4177017 - RNA, 13 nt, Yersinia pestis KIM
auaaggaauaacu

SEQ ID NO: 4177018 - RNA, 17 nt, Yersinia pestis KIM
auaaggauaaccgccug

SEQ ID NO: 4177019 - RNA, 13 nt, Yersinia pestis KIM
auaaggccaggca

SEQ ID NO: 4177020 - RNA, 18 nt, Yersinia pestis KIM
auaaggccaggcaauaag

SEQ ID NO: 4177021 - RNA, 16 nt, Yersinia pestis KIM
auaaggcuaacaccuu

SEQ ID NO: 4177022 - RNA, 20 nt, Yersinia pestis KIM
auaaggcuagaucguuacau

SEQ ID NO: 4177023 - RNA, 13 nt, Yersinia pestis KIM
auaaggcucuguu

SEQ ID NO: 4177024 - RNA, 13 nt, Yersinia pestis KIM
auaagggccaccc

SEQ ID NO: 4177025 - RNA, 18 nt, Yersinia pestis KIM
auaagggccauuuugcug

SEQ ID NO: 4177026 - RNA, 21 nt, Yersinia pestis KIM
auaaggggauugcugccaacg

SEQ ID NO: 4177027 - RNA, 19 nt, Yersinia pestis KIM
auaaggugccacacagaau

SEQ ID NO: 4177028 - RNA, 14 nt, Yersinia pestis KIM
auaaguaagugauu

SEQ ID NO: 4177029 - RNA, 21 nt, Yersinia pestis KIM
auaagugaaacaaauacaccu

SEQ ID NO: 4177030 - RNA, 14 nt, Yersinia pestis KIM
auaagugaauaaau

SEQ ID NO: 4177031 - RNA, 22 nt, Yersinia pestis KIM
auaagugaauaacgcugaauaa

SEQ ID NO: 4177032 - RNA, 21 nt, Yersinia pestis KIM
auaagugcaaacuuaaaaauc

SEQ ID NO: 4177033 - RNA, 22 nt, Yersinia pestis KIM
auaagugcaaacuuaaaaauca

SEQ ID NO: 4177034 - RNA, 19 nt, Yersinia pestis KIM
auaagugccgggaauauag

SEQ ID NO: 4177035 - RNA, 20 nt, Yersinia pestis KIM
auaaguguguguauuuaaaa

SEQ ID NO: 4177036 - RNA, 21 nt, Yersinia pestis KIM
auaaguguguguauuuaaaag

SEQ ID NO: 4177037 - RNA, 20 nt, Yersinia pestis KIM
auaaguucagguugaaauaa

SEQ ID NO: 4177038 - RNA, 21 nt, Yersinia pestis KIM
auaaguuccggcagauaugau

SEQ ID NO: 4177039 - RNA, 23 nt, Yersinia pestis KIM
auaaguuccggcagauaugaugc

SEQ ID NO: 4177040 - RNA, 23 nt, Yersinia pestis KIM
auaaguugauaacgccggauaaa

SEQ ID NO: 4177041 - RNA, 11 nt, Yersinia pestis KIM
auaaguuuuaa

SEQ ID NO: 4177042 - RNA, 13 nt, Yersinia pestis KIM
auaauaaaaaaaa

SEQ ID NO: 4177043 - RNA, 12 nt, Yersinia pestis KIM
auaauaaauuaa

SEQ ID NO: 4177044 - RNA, 19 nt, Yersinia pestis KIM
auaauaacgaauuucauuu

SEQ ID NO: 4177045 - RNA, 13 nt, Yersinia pestis KIM
auaauaauauuga

SEQ ID NO: 4177046 - RNA, 20 nt, Yersinia pestis KIM
auaauagauaacaaacuacu

SEQ ID NO: 4177047 - RNA, 15 nt, Yersinia pestis KIM
auaauauagcugaau

SEQ ID NO: 4177048 - RNA, 23 nt, Yersinia pestis KIM
auaauaucaagucuugaagagug

SEQ ID NO: 4177049 - RNA, 14 nt, Yersinia pestis KIM
auaauaucaaugau

SEQ ID NO: 4177050 - RNA, 14 nt, Yersinia pestis KIM
auaauauuauuauc

SEQ ID NO: 4177051 - RNA, 16 nt, Yersinia pestis KIM
auaauauuggccgcca

SEQ ID NO: 4177052 - RNA, 16 nt, Yersinia pestis KIM
auaaucaacggcacca

SEQ ID NO: 4177053 - RNA, 15 nt, Yersinia pestis KIM
auaaucaauccuaca

SEQ ID NO: 4177054 - RNA, 12 nt, Yersinia pestis KIM
auaaucaaugac

SEQ ID NO: 4177055 - RNA, 14 nt, Yersinia pestis KIM
auaaucaaugccac

SEQ ID NO: 4177056 - RNA, 20 nt, Yersinia pestis KIM
auaaucacaggggcaauaau

SEQ ID NO: 4177057 - RNA, 14 nt, Yersinia pestis KIM
auaaucacauaaua

SEQ ID NO: 4177058 - RNA, 13 nt, Yersinia pestis KIM
auaaucaccagac

SEQ ID NO: 4177059 - RNA, 21 nt, Yersinia pestis KIM
auaaucaccagacaaccaaua

SEQ ID NO: 4177060 - RNA, 19 nt, Yersinia pestis KIM
auaaucacugaggccaaau

SEQ ID NO: 4177061 - RNA, 22 nt, Yersinia pestis KIM
auaaucagaggugaaaaaauau

SEQ ID NO: 4177062 - RNA, 15 nt, Yersinia pestis KIM
auaaucagccugcug

SEQ ID NO: 4177063 - RNA, 12 nt, Yersinia pestis KIM
auaaucaucuac

SEQ ID NO: 4177064 - RNA, 12 nt, Yersinia pestis KIM
auaauccaaaau

SEQ ID NO: 4177065 - RNA, 23 nt, Yersinia pestis KIM
auaauccaccugacgaaaugccg

SEQ ID NO: 4177066 - RNA, 13 nt, Yersinia pestis KIM
auaaucccugcca

SEQ ID NO: 4177067 - RNA, 20 nt, Yersinia pestis KIM
auaauccgguuagcaaaaaa

SEQ ID NO: 4177068 - RNA, 18 nt, Yersinia pestis KIM
auaauccucaaccugauc

SEQ ID NO: 4177069 - RNA, 15 nt, Yersinia pestis KIM
auaaucucuaacggc

SEQ ID NO: 4177070 - RNA, 21 nt, Yersinia pestis KIM
auaaucuugugaugaaauuaa

SEQ ID NO: 4177071 - RNA, 22 nt, Yersinia pestis KIM
auaaucuugugaugaaauuaaa

SEQ ID NO: 4177072 - RNA, 16 nt, Yersinia pestis KIM
auaaucuuuacugcau

SEQ ID NO: 4177073 - RNA, 13 nt, Yersinia pestis KIM
auaaugacauaau

SEQ ID NO: 4177074 - RNA, 14 nt, Yersinia pestis KIM
auaaugauauucau

SEQ ID NO: 4177075 - RNA, 19 nt, Yersinia pestis KIM
auaaugauguaguguguuu

SEQ ID NO: 4177076 - RNA, 15 nt, Yersinia pestis KIM
auaaugcgauuaacc

SEQ ID NO: 4177077 - RNA, 15 nt, Yersinia pestis KIM
auaauggacgaacag

SEQ ID NO: 4177078 - RNA, 13 nt, Yersinia pestis KIM
auaauggcagccc

SEQ ID NO: 4177079 - RNA, 17 nt, Yersinia pestis KIM
auaaugguauuugaaau

SEQ ID NO: 4177080 - RNA, 16 nt, Yersinia pestis KIM
auaauggugggccgug

SEQ ID NO: 4177081 - RNA, 13 nt, Yersinia pestis KIM
auaauguccuauu

SEQ ID NO: 4177082 - RNA, 19 nt, Yersinia pestis KIM
auaaugucgucaauuaaaa

SEQ ID NO: 4177083 - RNA, 19 nt, Yersinia pestis KIM
auaauguuaauauuuuacu

SEQ ID NO: 4177084 - RNA, 17 nt, Yersinia pestis KIM
auaauuaaggugguuuu

SEQ ID NO: 4177085 - RNA, 15 nt, Yersinia pestis KIM
auaauuaauuauuca

SEQ ID NO: 4177086 - RNA, 16 nt, Yersinia pestis KIM
auaauuaauuauucaa

SEQ ID NO: 4177087 - RNA, 15 nt, Yersinia pestis KIM
auaauuaauuugugu

SEQ ID NO: 4177088 - RNA, 13 nt, Yersinia pestis KIM
auaauuacuuaua

SEQ ID NO: 4177089 - RNA, 17 nt, Yersinia pestis KIM
auaauuauaccuacccu

SEQ ID NO: 4177090 - RNA, 13 nt, Yersinia pestis KIM
auaauuaugaaag

SEQ ID NO: 4177091 - RNA, 16 nt, Yersinia pestis KIM
auaauuaugaaaguaa

SEQ ID NO: 4177092 - RNA, 12 nt, Yersinia pestis KIM
auaauucagcau

SEQ ID NO: 4177093 - RNA, 13 nt, Yersinia pestis KIM
auaauucagcauc

SEQ ID NO: 4177094 - RNA, 15 nt, Yersinia pestis KIM
auaauucauaugaca

SEQ ID NO: 4177095 - RNA, 12 nt, Yersinia pestis KIM
auaauucauuuu

SEQ ID NO: 4177096 - RNA, 22 nt, Yersinia pestis KIM
auaauucccccgguuaaugcca

SEQ ID NO: 4177097 - RNA, 22 nt, Yersinia pestis KIM
auaauucgcaugguuaaaacuc

SEQ ID NO: 4177098 - RNA, 15 nt, Yersinia pestis KIM
auaauucgugaaaac

SEQ ID NO: 4177099 - RNA, 18 nt, Yersinia pestis KIM
auaauucugccgacuaau

SEQ ID NO: 4177100 - RNA, 15 nt, Yersinia pestis KIM
auaauugaagauuua

SEQ ID NO: 4177101 - RNA, 14 nt, Yersinia pestis KIM
auaauugcacccca

SEQ ID NO: 4177102 - RNA, 17 nt, Yersinia pestis KIM
auaauuggcaauaaugu

SEQ ID NO: 4177103 - RNA, 14 nt, Yersinia pestis KIM
auaauuuauacaua

SEQ ID NO: 4177104 - RNA, 14 nt, Yersinia pestis KIM
auaauuuauuucag

SEQ ID NO: 4177105 - RNA, 13 nt, Yersinia pestis KIM
auaauuucagcag

SEQ ID NO: 4177106 - RNA, 16 nt, Yersinia pestis KIM
auaauuucagcagcac

SEQ ID NO: 4177107 - RNA, 18 nt, Yersinia pestis KIM
auaauuucagcagcacgu

SEQ ID NO: 4177108 - RNA, 17 nt, Yersinia pestis KIM
auaauuugucaguaaug

SEQ ID NO: 4177109 - RNA, 24 nt, Yersinia pestis KIM
auaauuuguuuauggcaauucgcu

SEQ ID NO: 4177110 - RNA, 15 nt, Yersinia pestis KIM
auacaaauaaaauaa

SEQ ID NO: 4177111 - RNA, 21 nt, Yersinia pestis KIM
auacaaauauuacgaaugagu

SEQ ID NO: 4177112 - RNA, 16 nt, Yersinia pestis KIM
auacaaccaacaaaca

SEQ ID NO: 4177113 - RNA, 20 nt, Yersinia pestis KIM
auacaaccacugaacaccau

SEQ ID NO: 4177114 - RNA, 15 nt, Yersinia pestis KIM
auacaaccauuucaa

SEQ ID NO: 4177115 - RNA, 18 nt, Yersinia pestis KIM
auacaaggcacaucucca

SEQ ID NO: 4177116 - RNA, 20 nt, Yersinia pestis KIM
auacaauugccugauuuuua

SEQ ID NO: 4177117 - RNA, 12 nt, Yersinia pestis KIM
auacaauuuuug

SEQ ID NO: 4177118 - RNA, 23 nt, Yersinia pestis KIM
auacaauuuuuggucguauucau

SEQ ID NO: 4177119 - RNA, 23 nt, Yersinia pestis KIM
auacaccauuuccaggcuaccaa

SEQ ID NO: 4177120 - RNA, 14 nt, Yersinia pestis KIM
auacaccgcaccac

SEQ ID NO: 4177121 - RNA, 19 nt, Yersinia pestis KIM
auacaccucaacgugauau

SEQ ID NO: 4177122 - RNA, 21 nt, Yersinia pestis KIM
auacaccuucuuuaucugucc

SEQ ID NO: 4177123 - RNA, 17 nt, Yersinia pestis KIM
auacacuaauggcacgc

SEQ ID NO: 4177124 - RNA, 20 nt, Yersinia pestis KIM
auacacuccauuaauuuauu

SEQ ID NO: 4177125 - RNA, 12 nt, Yersinia pestis KIM
auacacuugcuc

SEQ ID NO: 4177126 - RNA, 18 nt, Yersinia pestis KIM
auacacuugcucuaccac

SEQ ID NO: 4177127 - RNA, 17 nt, Yersinia pestis KIM
auacagcauauaaaaaa

SEQ ID NO: 4177128 - RNA, 13 nt, Yersinia pestis KIM
auacaggugucau

SEQ ID NO: 4177129 - RNA, 18 nt, Yersinia pestis KIM
auacaggugucaucaagg

SEQ ID NO: 4177130 - RNA, 21 nt, Yersinia pestis KIM
auacaggugucaucaaggcaa

SEQ ID NO: 4177131 - RNA, 12 nt, Yersinia pestis KIM
auacaguuuuuu

SEQ ID NO: 4177132 - RNA, 20 nt, Yersinia pestis KIM
auacaguuuuuucucaauga

SEQ ID NO: 4177133 - RNA, 15 nt, Yersinia pestis KIM
auacauaauaaugau

SEQ ID NO: 4177134 - RNA, 18 nt, Yersinia pestis KIM
auacauauaaccaucaaa

SEQ ID NO: 4177135 - RNA, 20 nt, Yersinia pestis KIM
auacaucaaaucagaggcuu

SEQ ID NO: 4177136 - RNA, 20 nt, Yersinia pestis KIM
auacaucaagcuacaugugc

SEQ ID NO: 4177137 - RNA, 16 nt, Yersinia pestis KIM
auacaucaauggguuu

SEQ ID NO: 4177138 - RNA, 23 nt, Yersinia pestis KIM
auacaucaauggguuugcgggca

SEQ ID NO: 4177139 - RNA, 19 nt, Yersinia pestis KIM
auacauccauguaggcucg

SEQ ID NO: 4177140 - RNA, 16 nt, Yersinia pestis KIM
auacauccuaaauaau

SEQ ID NO: 4177141 - RNA, 21 nt, Yersinia pestis KIM
auacaucgccaguguugccau

SEQ ID NO: 4177142 - RNA, 18 nt, Yersinia pestis KIM
auacaucuuacugauauc

SEQ ID NO: 4177143 - RNA, 19 nt, Yersinia pestis KIM
auacaucuuacugauaucu

SEQ ID NO: 4177144 - RNA, 16 nt, Yersinia pestis KIM
auaccacaauccggug

SEQ ID NO: 4177145 - RNA, 16 nt, Yersinia pestis KIM
auaccacaucaaaccg

SEQ ID NO: 4177146 - RNA, 20 nt, Yersinia pestis KIM
auaccacaucaaaccggcua

SEQ ID NO: 4177147 - RNA, 21 nt, Yersinia pestis KIM
auaccacccguugcauuuuuc

SEQ ID NO: 4177148 - RNA, 22 nt, Yersinia pestis KIM
auaccagagacgugcguuuuug

SEQ ID NO: 4177149 - RNA, 16 nt, Yersinia pestis KIM
auaccagaugcauaua

SEQ ID NO: 4177150 - RNA, 21 nt, Yersinia pestis KIM
auaccagcguagguacuucuc

SEQ ID NO: 4177151 - RNA, 19 nt, Yersinia pestis KIM
auaccauaaggccaggcaa

SEQ ID NO: 4177152 - RNA, 22 nt, Yersinia pestis KIM
auaccauucucugucuuccauu

SEQ ID NO: 4177153 - RNA, 13 nt, Yersinia pestis KIM
auaccauuuugcc

SEQ ID NO: 4177154 - RNA, 13 nt, Yersinia pestis KIM
auacccaaaauaa

SEQ ID NO: 4177155 - RNA, 24 nt, Yersinia pestis KIM
auacccacuaauacucuguuacca

SEQ ID NO: 4177156 - RNA, 15 nt, Yersinia pestis KIM
auaccccccaccaau

SEQ ID NO: 4177157 - RNA, 17 nt, Yersinia pestis KIM
auacccuucaggauuau

SEQ ID NO: 4177158 - RNA, 19 nt, Yersinia pestis KIM
auacccuuuggucaauaaa

SEQ ID NO: 4177159 - RNA, 15 nt, Yersinia pestis KIM
auaccgacaucaaca

SEQ ID NO: 4177160 - RNA, 16 nt, Yersinia pestis KIM
auaccgcugcuaccag

SEQ ID NO: 4177161 - RNA, 20 nt, Yersinia pestis KIM
auaccgcugcuaccagcagu

SEQ ID NO: 4177162 - RNA, 22 nt, Yersinia pestis KIM
auaccgcuuuuaccaacccagc

SEQ ID NO: 4177163 - RNA, 21 nt, Yersinia pestis KIM
auaccggguucaaggaaacca

SEQ ID NO: 4177164 - RNA, 15 nt, Yersinia pestis KIM
auaccggucauauuu

SEQ ID NO: 4177165 - RNA, 14 nt, Yersinia pestis KIM
auaccguuuuguac

SEQ ID NO: 4177166 - RNA, 19 nt, Yersinia pestis KIM
auaccucaguuaucagggc

SEQ ID NO: 4177167 - RNA, 22 nt, Yersinia pestis KIM
auaccugaguagcauaaaaauc

SEQ ID NO: 4177168 - RNA, 22 nt, Yersinia pestis KIM
auaccugcaccaaugacuaauu

SEQ ID NO: 4177169 - RNA, 14 nt, Yersinia pestis KIM
auaccuuacugcau

SEQ ID NO: 4177170 - RNA, 17 nt, Yersinia pestis KIM
auaccuuacugcaucaa

SEQ ID NO: 4177171 - RNA, 12 nt, Yersinia pestis KIM
auaccuuacugu

SEQ ID NO: 4177172 - RNA, 14 nt, Yersinia pestis KIM
auacgaauuuuucc

SEQ ID NO: 4177173 - RNA, 19 nt, Yersinia pestis KIM
auacgaccgucaccaaaua

SEQ ID NO: 4177174 - RNA, 20 nt, Yersinia pestis KIM
auacgaccgucaccaaauag

SEQ ID NO: 4177175 - RNA, 17 nt, Yersinia pestis KIM
auacgaucaucugguga

SEQ ID NO: 4177176 - RNA, 21 nt, Yersinia pestis KIM
auacgaucuuauuaauuggua

SEQ ID NO: 4177177 - RNA, 13 nt, Yersinia pestis KIM
auacgaugucacc

SEQ ID NO: 4177178 - RNA, 14 nt, Yersinia pestis KIM
auacgcauuacccu

SEQ ID NO: 4177179 - RNA, 17 nt, Yersinia pestis KIM
auacgccauccgcaccu

SEQ ID NO: 4177180 - RNA, 23 nt, Yersinia pestis KIM
auacgcgcaccggcuaaccacag

SEQ ID NO: 4177181 - RNA, 18 nt, Yersinia pestis KIM
auacgcgcgucaucaacg

SEQ ID NO: 4177182 - RNA, 16 nt, Yersinia pestis KIM
auacggcgaaauauaa

SEQ ID NO: 4177183 - RNA, 22 nt, Yersinia pestis KIM
auacggcuucaccgcuuuucug

SEQ ID NO: 4177184 - RNA, 15 nt, Yersinia pestis KIM
auacgguagcaauac

SEQ ID NO: 4177185 - RNA, 14 nt, Yersinia pestis KIM
auacggucaaaagc

SEQ ID NO: 4177186 - RNA, 18 nt, Yersinia pestis KIM
auacgguucaaaucaguu

SEQ ID NO: 4177187 - RNA, 21 nt, Yersinia pestis KIM
auacgugccaaaaugccuacc

SEQ ID NO: 4177188 - RNA, 17 nt, Yersinia pestis KIM
auacguucguagccacg

SEQ ID NO: 4177189 - RNA, 13 nt, Yersinia pestis KIM
auacguugcaggu

SEQ ID NO: 4177190 - RNA, 14 nt, Yersinia pestis KIM
auacguuggcggcu

SEQ ID NO: 4177191 - RNA, 15 nt, Yersinia pestis KIM
auacguuggcggcuc

SEQ ID NO: 4177192 - RNA, 12 nt, Yersinia pestis KIM
auacuaaagaaa

SEQ ID NO: 4177193 - RNA, 15 nt, Yersinia pestis KIM
auacuaaagaaauaa

SEQ ID NO: 4177194 - RNA, 21 nt, Yersinia pestis KIM
auacuaauagaagagaggcaa

SEQ ID NO: 4177195 - RNA, 17 nt, Yersinia pestis KIM
auacuaauuucuaauuc

SEQ ID NO: 4177196 - RNA, 17 nt, Yersinia pestis KIM
auacucaugauggcacc

SEQ ID NO: 4177197 - RNA, 21 nt, Yersinia pestis KIM
auacuccgcugagcauauaca

SEQ ID NO: 4177198 - RNA, 18 nt, Yersinia pestis KIM
auacucuguuaccaaugg

SEQ ID NO: 4177199 - RNA, 22 nt, Yersinia pestis KIM
auacucuuccaacgcuucacca

SEQ ID NO: 4177200 - RNA, 21 nt, Yersinia pestis KIM
auacugacggggaguuuuuau

SEQ ID NO: 4177201 - RNA, 23 nt, Yersinia pestis KIM
auacugcacguuuaauuucacuu

SEQ ID NO: 4177202 - RNA, 17 nt, Yersinia pestis KIM
auacugccaaucgcucu

SEQ ID NO: 4177203 - RNA, 17 nt, Yersinia pestis KIM
auacugccgaccauauc

SEQ ID NO: 4177204 - RNA, 23 nt, Yersinia pestis KIM
auacuguguuauuuuuguuuagu

SEQ ID NO: 4177205 - RNA, 18 nt, Yersinia pestis KIM
auacuguuaacucgccaa

SEQ ID NO: 4177206 - RNA, 12 nt, Yersinia pestis KIM
auacuguuuggu

SEQ ID NO: 4177207 - RNA, 15 nt, Yersinia pestis KIM
auacuuaacaaucag

SEQ ID NO: 4177208 - RNA, 23 nt, Yersinia pestis KIM
auacuuaacaaucagugcaauaa

SEQ ID NO: 4177209 - RNA, 15 nt, Yersinia pestis KIM
auacuuaaguugagu

SEQ ID NO: 4177210 - RNA, 19 nt, Yersinia pestis KIM
auacuuucccauagcuggc

SEQ ID NO: 4177211 - RNA, 23 nt, Yersinia pestis KIM
auacuuucccauagcuggcuuca

SEQ ID NO: 4177212 - RNA, 17 nt, Yersinia pestis KIM
auagaaaagcgaaucug

SEQ ID NO: 4177213 - RNA, 19 nt, Yersinia pestis KIM
auagaaacaucagauagau

SEQ ID NO: 4177214 - RNA, 13 nt, Yersinia pestis KIM
auagaaauagcca

SEQ ID NO: 4177215 - RNA, 20 nt, Yersinia pestis KIM
auagaagguaaucagacugc

SEQ ID NO: 4177216 - RNA, 16 nt, Yersinia pestis KIM
auagaauucauucaga

SEQ ID NO: 4177217 - RNA, 23 nt, Yersinia pestis KIM
auagacaauacuacuuucucuug

SEQ ID NO: 4177218 - RNA, 14 nt, Yersinia pestis KIM
auagacaccuuccc

SEQ ID NO: 4177219 - RNA, 18 nt, Yersinia pestis KIM
auagacaccuucccuauu

SEQ ID NO: 4177220 - RNA, 14 nt, Yersinia pestis KIM
auagaccccuucuu

SEQ ID NO: 4177221 - RNA, 15 nt, Yersinia pestis KIM
auagacgaaggcacg

SEQ ID NO: 4177222 - RNA, 17 nt, Yersinia pestis KIM
auagacucaucuaauuu

SEQ ID NO: 4177223 - RNA, 20 nt, Yersinia pestis KIM
auagacuguuuuauuauaua

SEQ ID NO: 4177224 - RNA, 22 nt, Yersinia pestis KIM
auagacuguuuuauuauauauu

SEQ ID NO: 4177225 - RNA, 20 nt, Yersinia pestis KIM
auagagacggaaagagccag

SEQ ID NO: 4177226 - RNA, 23 nt, Yersinia pestis KIM
auagagacggaaagagccagcac

SEQ ID NO: 4177227 - RNA, 17 nt, Yersinia pestis KIM
auagaggaaauaaauga

SEQ ID NO: 4177228 - RNA, 20 nt, Yersinia pestis KIM
auagagugaaguaucaccac

SEQ ID NO: 4177229 - RNA, 16 nt, Yersinia pestis KIM
auagauaacaaacuac

SEQ ID NO: 4177230 - RNA, 15 nt, Yersinia pestis KIM
auagauacacuccau

SEQ ID NO: 4177231 - RNA, 17 nt, Yersinia pestis KIM
auagauaucgaaacaca

SEQ ID NO: 4177232 - RNA, 19 nt, Yersinia pestis KIM
auagaucccauacccacua

SEQ ID NO: 4177233 - RNA, 11 nt, Yersinia pestis KIM
auagauuaaga

SEQ ID NO: 4177234 - RNA, 13 nt, Yersinia pestis KIM
auagauuaagaaa

SEQ ID NO: 4177235 - RNA, 14 nt, Yersinia pestis KIM
auagauuaagaaaa

SEQ ID NO: 4177236 - RNA, 18 nt, Yersinia pestis KIM
auagauuaagaaaacauu

SEQ ID NO: 4177237 - RNA, 14 nt, Yersinia pestis KIM
auagauuuuuauag

SEQ ID NO: 4177238 - RNA, 15 nt, Yersinia pestis KIM
auagcaaaaaaaaag

SEQ ID NO: 4177239 - RNA, 18 nt, Yersinia pestis KIM
auagcaaaagaaucagua

SEQ ID NO: 4177240 - RNA, 20 nt, Yersinia pestis KIM
auagcaagcacggcaggcgg

SEQ ID NO: 4177241 - RNA, 14 nt, Yersinia pestis KIM
auagcaaucaauaa

SEQ ID NO: 4177242 - RNA, 16 nt, Yersinia pestis KIM
auagcaccgagcaugc

SEQ ID NO: 4177243 - RNA, 21 nt, Yersinia pestis KIM
auagcaccgagcaugcuaacu

SEQ ID NO: 4177244 - RNA, 20 nt, Yersinia pestis KIM
auagcagggccgguuaauug

SEQ ID NO: 4177245 - RNA, 12 nt, Yersinia pestis KIM
auagcauaaaua

SEQ ID NO: 4177246 - RNA, 18 nt, Yersinia pestis KIM
auagcauuggcacaaagu

SEQ ID NO: 4177247 - RNA, 15 nt, Yersinia pestis KIM
auagccaaaauaauu

SEQ ID NO: 4177248 - RNA, 23 nt, Yersinia pestis KIM
auagccaccgcucgucacacugg

SEQ ID NO: 4177249 - RNA, 12 nt, Yersinia pestis KIM
auagccacuaac

SEQ ID NO: 4177250 - RNA, 19 nt, Yersinia pestis KIM
auagcccucguuguuguau

SEQ ID NO: 4177251 - RNA, 15 nt, Yersinia pestis KIM
auagccgaagaaugu

SEQ ID NO: 4177252 - RNA, 13 nt, Yersinia pestis KIM
auagccggcgaca

SEQ ID NO: 4177253 - RNA, 23 nt, Yersinia pestis KIM
auagccuaggccagcacuaagug

SEQ ID NO: 4177254 - RNA, 14 nt, Yersinia pestis KIM
auagccuuccuugg

SEQ ID NO: 4177255 - RNA, 13 nt, Yersinia pestis KIM
auagccuuuuugc

SEQ ID NO: 4177256 - RNA, 14 nt, Yersinia pestis KIM
auagcgaucagcaa

SEQ ID NO: 4177257 - RNA, 15 nt, Yersinia pestis KIM
auagcgcauccaacc

SEQ ID NO: 4177258 - RNA, 19 nt, Yersinia pestis KIM
auagcgcauccaaccugca

SEQ ID NO: 4177259 - RNA, 14 nt, Yersinia pestis KIM
auagcgccugcccu

SEQ ID NO: 4177260 - RNA, 17 nt, Yersinia pestis KIM
auagcgcugcaucagca

SEQ ID NO: 4177261 - RNA, 20 nt, Yersinia pestis KIM
auagcggcguucagcaauau

SEQ ID NO: 4177262 - RNA, 22 nt, Yersinia pestis KIM
auagcgggccuuugcuuuucug

SEQ ID NO: 4177263 - RNA, 23 nt, Yersinia pestis KIM
auagcguuaucaauuaacuacac

SEQ ID NO: 4177264 - RNA, 24 nt, Yersinia pestis KIM
auagcuaacaccgcuguagcguca

SEQ ID NO: 4177265 - RNA, 20 nt, Yersinia pestis KIM
auagcuaccccuucagucag

SEQ ID NO: 4177266 - RNA, 23 nt, Yersinia pestis KIM
auagcuacgggcaaacuccucca

SEQ ID NO: 4177267 - RNA, 13 nt, Yersinia pestis KIM
auagcugauugcu

SEQ ID NO: 4177268 - RNA, 22 nt, Yersinia pestis KIM
auagcuggcggauaaaaaugca

SEQ ID NO: 4177269 - RNA, 23 nt, Yersinia pestis KIM
auagcuggcuucaaaaucaccug

SEQ ID NO: 4177270 - RNA, 15 nt, Yersinia pestis KIM
auagcuguaaaauac

SEQ ID NO: 4177271 - RNA, 16 nt, Yersinia pestis KIM
auagcuguaaaauacc

SEQ ID NO: 4177272 - RNA, 14 nt, Yersinia pestis KIM
auagcugugugacc

SEQ ID NO: 4177273 - RNA, 18 nt, Yersinia pestis KIM
auagcuuaaucaucauca

SEQ ID NO: 4177274 - RNA, 18 nt, Yersinia pestis KIM
auagcuucaggaacuugc

SEQ ID NO: 4177275 - RNA, 14 nt, Yersinia pestis KIM
auagcuuucuccuu

SEQ ID NO: 4177276 - RNA, 20 nt, Yersinia pestis KIM
auagcuuucuccuuugauuu

SEQ ID NO: 4177277 - RNA, 21 nt, Yersinia pestis KIM
auaggccuaaaccccacagcg

SEQ ID NO: 4177278 - RNA, 15 nt, Yersinia pestis KIM
auaggcgaaaggcgc

SEQ ID NO: 4177279 - RNA, 16 nt, Yersinia pestis KIM
auaggcgaaaggcgca

SEQ ID NO: 4177280 - RNA, 19 nt, Yersinia pestis KIM
auaggcguuaucggcgcag

SEQ ID NO: 4177281 - RNA, 16 nt, Yersinia pestis KIM
auaggcucuguuuuac

SEQ ID NO: 4177282 - RNA, 15 nt, Yersinia pestis KIM
auaggcugaucaacg

SEQ ID NO: 4177283 - RNA, 17 nt, Yersinia pestis KIM
auaggcuuaauaugcca

SEQ ID NO: 4177284 - RNA, 15 nt, Yersinia pestis KIM
auagggaagguguuu

SEQ ID NO: 4177285 - RNA, 17 nt, Yersinia pestis KIM
auagggagccaauagag

SEQ ID NO: 4177286 - RNA, 16 nt, Yersinia pestis KIM
auagggauuguuuuca

SEQ ID NO: 4177287 - RNA, 20 nt, Yersinia pestis KIM
auagggcugaagacccaagg

SEQ ID NO: 4177288 - RNA, 16 nt, Yersinia pestis KIM
auaggucagugguuuu

SEQ ID NO: 4177289 - RNA, 14 nt, Yersinia pestis KIM
auaggucauauaca

SEQ ID NO: 4177290 - RNA, 13 nt, Yersinia pestis KIM
auaguaaaacagg

SEQ ID NO: 4177291 - RNA, 15 nt, Yersinia pestis KIM
auaguaacaccagca

SEQ ID NO: 4177292 - RNA, 11 nt, Yersinia pestis KIM
auaguaacccu

SEQ ID NO: 4177293 - RNA, 20 nt, Yersinia pestis KIM
auaguaauuuuuagccgcaa

SEQ ID NO: 4177294 - RNA, 13 nt, Yersinia pestis KIM
auaguacuuagca

SEQ ID NO: 4177295 - RNA, 17 nt, Yersinia pestis KIM
auaguacuuagcaauaa

SEQ ID NO: 4177296 - RNA, 17 nt, Yersinia pestis KIM
auaguaguguuugauag

SEQ ID NO: 4177297 - RNA, 18 nt, Yersinia pestis KIM
auagucacgucuucacca

SEQ ID NO: 4177298 - RNA, 19 nt, Yersinia pestis KIM
auagucauauauuuuucuu

SEQ ID NO: 4177299 - RNA, 15 nt, Yersinia pestis KIM
auagucaucuuucca

SEQ ID NO: 4177300 - RNA, 21 nt, Yersinia pestis KIM
auagucaucuuuccagcgaac

SEQ ID NO: 4177301 - RNA, 13 nt, Yersinia pestis KIM
auaguccuuccau

SEQ ID NO: 4177302 - RNA, 18 nt, Yersinia pestis KIM
auagucuccaaauucauu

SEQ ID NO: 4177303 - RNA, 15 nt, Yersinia pestis KIM
auagugaguauguau

SEQ ID NO: 4177304 - RNA, 22 nt, Yersinia pestis KIM
auagugauuuucaauccgggca

SEQ ID NO: 4177305 - RNA, 16 nt, Yersinia pestis KIM
auaguggcacaaauaa

SEQ ID NO: 4177306 - RNA, 14 nt, Yersinia pestis KIM
auagugggcuaaaa

SEQ ID NO: 4177307 - RNA, 16 nt, Yersinia pestis KIM
auaguggggcgucguu

SEQ ID NO: 4177308 - RNA, 14 nt, Yersinia pestis KIM
auaguggguaaacc

SEQ ID NO: 4177309 - RNA, 18 nt, Yersinia pestis KIM
auaguguuguaagauuuc

SEQ ID NO: 4177310 - RNA, 21 nt, Yersinia pestis KIM
auaguuaugaugaguaacaua

SEQ ID NO: 4177311 - RNA, 22 nt, Yersinia pestis KIM
auaguugaucuaccugaaugcg

SEQ ID NO: 4177312 - RNA, 20 nt, Yersinia pestis KIM
auaguuuagauagaaaucac

SEQ ID NO: 4177313 - RNA, 14 nt, Yersinia pestis KIM
auaguuuuucuccu

SEQ ID NO: 4177314 - RNA, 11 nt, Yersinia pestis KIM
auauaaaaaau

SEQ ID NO: 4177315 - RNA, 15 nt, Yersinia pestis KIM
auauaaaacacgcau

SEQ ID NO: 4177316 - RNA, 19 nt, Yersinia pestis KIM
auauaaaagcacagacaaa

SEQ ID NO: 4177317 - RNA, 13 nt, Yersinia pestis KIM
auauaaaagccag

SEQ ID NO: 4177318 - RNA, 17 nt, Yersinia pestis KIM
auauaaaauaauaagau

SEQ ID NO: 4177319 - RNA, 14 nt, Yersinia pestis KIM
auauaaacauaaaa

SEQ ID NO: 4177320 - RNA, 15 nt, Yersinia pestis KIM
auauaaacauaaaaa

SEQ ID NO: 4177321 - RNA, 12 nt, Yersinia pestis KIM
auauaaauaaaa

SEQ ID NO: 4177322 - RNA, 13 nt, Yersinia pestis KIM
auauaaauaaaau

SEQ ID NO: 4177323 - RNA, 14 nt, Yersinia pestis KIM
auauaaauaaaaua

SEQ ID NO: 4177324 - RNA, 22 nt, Yersinia pestis KIM
auauaaauccagcccacuggcc

SEQ ID NO: 4177325 - RNA, 13 nt, Yersinia pestis KIM
auauaaauggcug

SEQ ID NO: 4177326 - RNA, 22 nt, Yersinia pestis KIM
auauaaaugguuauuauguaaa

SEQ ID NO: 4177327 - RNA, 18 nt, Yersinia pestis KIM
auauaacguuuaccuauu

SEQ ID NO: 4177328 - RNA, 20 nt, Yersinia pestis KIM
auauaagagaugaaauuuua

SEQ ID NO: 4177329 - RNA, 21 nt, Yersinia pestis KIM
auauaagauuccuuaccugau

SEQ ID NO: 4177330 - RNA, 22 nt, Yersinia pestis KIM
auauaagauuccuuaccugaug

SEQ ID NO: 4177331 - RNA, 14 nt, Yersinia pestis KIM
auauaauaaugcug

SEQ ID NO: 4177332 - RNA, 13 nt, Yersinia pestis KIM
auauaauucaaua

SEQ ID NO: 4177333 - RNA, 14 nt, Yersinia pestis KIM
auauaauucaauau

SEQ ID NO: 4177334 - RNA, 15 nt, Yersinia pestis KIM
auauaauucaauaua

SEQ ID NO: 4177335 - RNA, 16 nt, Yersinia pestis KIM
auauaauuucaagaau

SEQ ID NO: 4177336 - RNA, 17 nt, Yersinia pestis KIM
auauacaaggcacaucu

SEQ ID NO: 4177337 - RNA, 17 nt, Yersinia pestis KIM
auauacagucaauugag

SEQ ID NO: 4177338 - RNA, 14 nt, Yersinia pestis KIM
auauacauauucac

SEQ ID NO: 4177339 - RNA, 23 nt, Yersinia pestis KIM
auauacauauucacuauagacuc

SEQ ID NO: 4177340 - RNA, 16 nt, Yersinia pestis KIM
auauacuuuacauaua

SEQ ID NO: 4177341 - RNA, 23 nt, Yersinia pestis KIM
auauagaaauaaggaauaacuuc

SEQ ID NO: 4177342 - RNA, 21 nt, Yersinia pestis KIM
auauagcggcguucagcaaua

SEQ ID NO: 4177343 - RNA, 22 nt, Yersinia pestis KIM
auauagcggcguucagcaauau

SEQ ID NO: 4177344 - RNA, 23 nt, Yersinia pestis KIM
auauagcgugcuacauagaaaau

SEQ ID NO: 4177345 - RNA, 22 nt, Yersinia pestis KIM
auauaggaaaugucguacaucu

SEQ ID NO: 4177346 - RNA, 13 nt, Yersinia pestis KIM
auauaggcgucau

SEQ ID NO: 4177347 - RNA, 22 nt, Yersinia pestis KIM
auauauacaauccaaccuauau

SEQ ID NO: 4177348 - RNA, 13 nt, Yersinia pestis KIM
auauauagaaaua

SEQ ID NO: 4177349 - RNA, 14 nt, Yersinia pestis KIM
auauauagaaauaa

SEQ ID NO: 4177350 - RNA, 15 nt, Yersinia pestis KIM
auauauagagaaauc

SEQ ID NO: 4177351 - RNA, 17 nt, Yersinia pestis KIM
auauaucacuauuucag

SEQ ID NO: 4177352 - RNA, 17 nt, Yersinia pestis KIM
auauauccaaaauaauu

SEQ ID NO: 4177353 - RNA, 19 nt, Yersinia pestis KIM
auauauccaggcacugcca

SEQ ID NO: 4177354 - RNA, 12 nt, Yersinia pestis KIM
auauauuuuucu

SEQ ID NO: 4177355 - RNA, 13 nt, Yersinia pestis KIM
auaucaaaacuga

SEQ ID NO: 4177356 - RNA, 21 nt, Yersinia pestis KIM
auaucaaaauaaaaauucaca

SEQ ID NO: 4177357 - RNA, 23 nt, Yersinia pestis KIM
auaucaacagaacuaaacgccaa

SEQ ID NO: 4177358 - RNA, 14 nt, Yersinia pestis KIM
auaucaauaaccug

SEQ ID NO: 4177359 - RNA, 23 nt, Yersinia pestis KIM
auaucaauaagugcaaacuuaaa

SEQ ID NO: 4177360 - RNA, 14 nt, Yersinia pestis KIM
auaucaauauccgc

SEQ ID NO: 4177361 - RNA, 13 nt, Yersinia pestis KIM
auaucaccagguu

SEQ ID NO: 4177362 - RNA, 17 nt, Yersinia pestis KIM
auaucacuauaauuauu

SEQ ID NO: 4177363 - RNA, 12 nt, Yersinia pestis KIM
auaucacuauuu

SEQ ID NO: 4177364 - RNA, 21 nt, Yersinia pestis KIM
auaucagaaacaauaaauauc

SEQ ID NO: 4177365 - RNA, 18 nt, Yersinia pestis KIM
auaucagcauuaauaccg

SEQ ID NO: 4177366 - RNA, 15 nt, Yersinia pestis KIM
auaucagcgccuucu

SEQ ID NO: 4177367 - RNA, 20 nt, Yersinia pestis KIM
auaucagucgcuuuuuaaca

SEQ ID NO: 4177368 - RNA, 17 nt, Yersinia pestis KIM
auaucaucuuuuucugc

SEQ ID NO: 4177369 - RNA, 18 nt, Yersinia pestis KIM
auaucauggccauggaaa

SEQ ID NO: 4177370 - RNA, 13 nt, Yersinia pestis KIM
auaucauuauuuu

SEQ ID NO: 4177371 - RNA, 14 nt, Yersinia pestis KIM
auauccaaccaacc

SEQ ID NO: 4177372 - RNA, 18 nt, Yersinia pestis KIM
auauccaaccaaccaugc

SEQ ID NO: 4177373 - RNA, 20 nt, Yersinia pestis KIM
auauccagcaacgaauaaaa

SEQ ID NO: 4177374 - RNA, 23 nt, Yersinia pestis KIM
auauccagcaacgaauaaaaaag

SEQ ID NO: 4177375 - RNA, 18 nt, Yersinia pestis KIM
auaucccaauaauagcua

SEQ ID NO: 4177376 - RNA, 18 nt, Yersinia pestis KIM
auaucccccccaagagaa

SEQ ID NO: 4177377 - RNA, 17 nt, Yersinia pestis KIM
auaucccgagaaacaaa

SEQ ID NO: 4177378 - RNA, 22 nt, Yersinia pestis KIM
auaucccgagaaacaaaaccaa

SEQ ID NO: 4177379 - RNA, 20 nt, Yersinia pestis KIM
auauccgugauuaaccuuaa

SEQ ID NO: 4177380 - RNA, 10 nt, Yersinia pestis KIM
auauccuccg

SEQ ID NO: 4177381 - RNA, 20 nt, Yersinia pestis KIM
auauccugcgucucuaaccc

SEQ ID NO: 4177382 - RNA, 22 nt, Yersinia pestis KIM
auauccuggaagcagaauacug

SEQ ID NO: 4177383 - RNA, 23 nt, Yersinia pestis KIM
auauccuggaagcagaauacugu

SEQ ID NO: 4177384 - RNA, 16 nt, Yersinia pestis KIM
auaucgagguucgacu

SEQ ID NO: 4177385 - RNA, 15 nt, Yersinia pestis KIM
auaucgaugacagca

SEQ ID NO: 4177386 - RNA, 15 nt, Yersinia pestis KIM
auaucgauuuuuaag

SEQ ID NO: 4177387 - RNA, 22 nt, Yersinia pestis KIM
auaucgcggauacguuccaaca

SEQ ID NO: 4177388 - RNA, 16 nt, Yersinia pestis KIM
auaucgcuaaaacaca

SEQ ID NO: 4177389 - RNA, 15 nt, Yersinia pestis KIM
auaucgcucaucaug

SEQ ID NO: 4177390 - RNA, 15 nt, Yersinia pestis KIM
auaucgguaaaaaau

SEQ ID NO: 4177391 - RNA, 13 nt, Yersinia pestis KIM
auaucuaacugau

SEQ ID NO: 4177392 - RNA, 17 nt, Yersinia pestis KIM
auaucuaacugauguau

SEQ ID NO: 4177393 - RNA, 18 nt, Yersinia pestis KIM
auaucuaaguccaagaca

SEQ ID NO: 4177394 - RNA, 20 nt, Yersinia pestis KIM
auaucuagcaacacaucggu

SEQ ID NO: 4177395 - RNA, 13 nt, Yersinia pestis KIM
auaucuauuucca

SEQ ID NO: 4177396 - RNA, 18 nt, Yersinia pestis KIM
auaucucaccgccaauau

SEQ ID NO: 4177397 - RNA, 16 nt, Yersinia pestis KIM
auaucucaguugaaac

SEQ ID NO: 4177398 - RNA, 14 nt, Yersinia pestis KIM
auaucuccguugaa

SEQ ID NO: 4177399 - RNA, 16 nt, Yersinia pestis KIM
auaucuccguugaaac

SEQ ID NO: 4177400 - RNA, 13 nt, Yersinia pestis KIM
auaucucuuuauc

SEQ ID NO: 4177401 - RNA, 14 nt, Yersinia pestis KIM
auaucugcauaacu

SEQ ID NO: 4177402 - RNA, 14 nt, Yersinia pestis KIM
auaucuucaaucag

SEQ ID NO: 4177403 - RNA, 22 nt, Yersinia pestis KIM
auaucuucggcggcuaaagcug

SEQ ID NO: 4177404 - RNA, 21 nt, Yersinia pestis KIM
auaucuugaaccaauuuuucu

SEQ ID NO: 4177405 - RNA, 19 nt, Yersinia pestis KIM
auaucuugcugaaaacaau

SEQ ID NO: 4177406 - RNA, 17 nt, Yersinia pestis KIM
auaugauaguguaaaaa

SEQ ID NO: 4177407 - RNA, 14 nt, Yersinia pestis KIM
auaugcaaaaaaag

SEQ ID NO: 4177408 - RNA, 20 nt, Yersinia pestis KIM
auaugcgccuauaaggcucu

SEQ ID NO: 4177409 - RNA, 22 nt, Yersinia pestis KIM
auaugcgcuggcucuauuuucc

SEQ ID NO: 4177410 - RNA, 13 nt, Yersinia pestis KIM
auaugcuacccgc

SEQ ID NO: 4177411 - RNA, 12 nt, Yersinia pestis KIM
auaugcugaaua

SEQ ID NO: 4177412 - RNA, 22 nt, Yersinia pestis KIM
auauggauuggcauuuaaaagg

SEQ ID NO: 4177413 - RNA, 15 nt, Yersinia pestis KIM
auauggguuaaugcu

SEQ ID NO: 4177414 - RNA, 23 nt, Yersinia pestis KIM
auauguagcagcaccauacagca

SEQ ID NO: 4177415 - RNA, 14 nt, Yersinia pestis KIM
auaugucaccucca

SEQ ID NO: 4177416 - RNA, 22 nt, Yersinia pestis KIM
auauuaaaugcauuauaaggaa

SEQ ID NO: 4177417 - RNA, 12 nt, Yersinia pestis KIM
auauuaacauau

SEQ ID NO: 4177418 - RNA, 14 nt, Yersinia pestis KIM
auauuaacauauca

SEQ ID NO: 4177419 - RNA, 11 nt, Yersinia pestis KIM
auauuaacccg

SEQ ID NO: 4177420 - RNA, 18 nt, Yersinia pestis KIM
ugagcuuucgaccucagu

SEQ ID NO: 4177421 - RNA, 15 nt, Yersinia pestis KIM
ugaggaaauuucagu

SEQ ID NO: 4177422 - RNA, 17 nt, Yersinia pestis KIM
ugaggauaggcagaaga

SEQ ID NO: 4177423 - RNA, 21 nt, Yersinia pestis KIM
ugaggauuauaauucauuuuu

SEQ ID NO: 4177424 - RNA, 19 nt, Yersinia pestis KIM
ugaggcaacauuuguugca

SEQ ID NO: 4177425 - RNA, 21 nt, Yersinia pestis KIM
ugaggcccgcuagugauagcg

SEQ ID NO: 4177426 - RNA, 16 nt, Yersinia pestis KIM
ugaggcucuucugggc

SEQ ID NO: 4177427 - RNA, 12 nt, Yersinia pestis KIM
ugaggcugaggu

SEQ ID NO: 4177428 - RNA, 18 nt, Yersinia pestis KIM
ugagggacagagagauaa

SEQ ID NO: 4177429 - RNA, 16 nt, Yersinia pestis KIM
ugagggagucagggag

SEQ ID NO: 4177430 - RNA, 19 nt, Yersinia pestis KIM
ugagggcgucucuacgacg

SEQ ID NO: 4177431 - RNA, 16 nt, Yersinia pestis KIM
ugagggugaugacaau

SEQ ID NO: 4177432 - RNA, 17 nt, Yersinia pestis KIM
ugaggguugucagcagu

SEQ ID NO: 4177433 - RNA, 14 nt, Yersinia pestis KIM
ugagguaaaccaag

SEQ ID NO: 4177434 - RNA, 17 nt, Yersinia pestis KIM
ugaggucagugcugcau

SEQ ID NO: 4177435 - RNA, 16 nt, Yersinia pestis KIM
ugaggugaacugaacu

SEQ ID NO: 4177436 - RNA, 17 nt, Yersinia pestis KIM
ugagguuauugacaaag

SEQ ID NO: 4177437 - RNA, 21 nt, Yersinia pestis KIM
ugagguuauugacaaagugcc

SEQ ID NO: 4177438 - RNA, 20 nt, Yersinia pestis KIM
ugagguuuuaccaauccccg

SEQ ID NO: 4177439 - RNA, 24 nt, Yersinia pestis KIM
ugaguaaaaauucaagagagguaa

SEQ ID NO: 4177440 - RNA, 17 nt, Yersinia pestis KIM
ugaguaaaagauucaua

SEQ ID NO: 4177441 - RNA, 22 nt, Yersinia pestis KIM
ugaguaaauaccuucagacuga

SEQ ID NO: 4177442 - RNA, 16 nt, Yersinia pestis KIM
ugaguaauauuauuca

SEQ ID NO: 4177443 - RNA, 19 nt, Yersinia pestis KIM
ugaguaauucgcagacaga

SEQ ID NO: 4177444 - RNA, 19 nt, Yersinia pestis KIM
ugaguaauuucagauaaaa

SEQ ID NO: 4177445 - RNA, 22 nt, Yersinia pestis KIM
ugaguagcuaauaaaauggcua

SEQ ID NO: 4177446 - RNA, 13 nt, Yersinia pestis KIM
ugaguaguggagc

SEQ ID NO: 4177447 - RNA, 18 nt, Yersinia pestis KIM
ugaguauacuaaaacagc

SEQ ID NO: 4177448 - RNA, 19 nt, Yersinia pestis KIM
ugaguaucggccgcaaauu

SEQ ID NO: 4177449 - RNA, 18 nt, Yersinia pestis KIM
ugaguauuaccucaucau

SEQ ID NO: 4177450 - RNA, 14 nt, Yersinia pestis KIM
ugagucguaaaauu

SEQ ID NO: 4177451 - RNA, 22 nt, Yersinia pestis KIM
ugagucucagggaugaagcuca

SEQ ID NO: 4177452 - RNA, 18 nt, Yersinia pestis KIM
ugagucugcggauaaaca

SEQ ID NO: 4177453 - RNA, 22 nt, Yersinia pestis KIM
ugagucuugauauuuaagccau

SEQ ID NO: 4177454 - RNA, 23 nt, Yersinia pestis KIM
ugaguggacgauaaauucaaaua

SEQ ID NO: 4177455 - RNA, 18 nt, Yersinia pestis KIM
ugagugguuuuuacaccc

SEQ ID NO: 4177456 - RNA, 19 nt, Yersinia pestis KIM
ugaguguccacauagcugc

SEQ ID NO: 4177457 - RNA, 23 nt, Yersinia pestis KIM
ugagugugccuuggucucagaac

SEQ ID NO: 4177458 - RNA, 18 nt, Yersinia pestis KIM
ugaguguuuuucucagca

SEQ ID NO: 4177459 - RNA, 13 nt, Yersinia pestis KIM
ugaguuaucuccu

SEQ ID NO: 4177460 - RNA, 16 nt, Yersinia pestis KIM
ugaguuaucuccugua

SEQ ID NO: 4177461 - RNA, 20 nt, Yersinia pestis KIM
ugaguugcaggaauccaagu

SEQ ID NO: 4177462 - RNA, 16 nt, Yersinia pestis KIM
ugaguuggcauucuag

SEQ ID NO: 4177463 - RNA, 14 nt, Yersinia pestis KIM
ugaguuucauuagu

SEQ ID NO: 4177464 - RNA, 22 nt, Yersinia pestis KIM
ugaguuuuagcccaaaauagaa

SEQ ID NO: 4177465 - RNA, 15 nt, Yersinia pestis KIM
ugaguuuuguccuga

SEQ ID NO: 4177466 - RNA, 19 nt, Yersinia pestis KIM
ugauaaaacacucuuuuug

SEQ ID NO: 4177467 - RNA, 14 nt, Yersinia pestis KIM
ugauaaaaccgcuu

SEQ ID NO: 4177468 - RNA, 22 nt, Yersinia pestis KIM
ugauaaaacuauucugcuugga

SEQ ID NO: 4177469 - RNA, 17 nt, Yersinia pestis KIM
ugauaaaaguaauuuau

SEQ ID NO: 4177470 - RNA, 17 nt, Yersinia pestis KIM
ugauaaaagucuauaua

SEQ ID NO: 4177471 - RNA, 14 nt, Yersinia pestis KIM
ugauaaacaauaaa

SEQ ID NO: 4177472 - RNA, 22 nt, Yersinia pestis KIM
ugauaaacucaguauauuggua

SEQ ID NO: 4177473 - RNA, 15 nt, Yersinia pestis KIM
ugauaacaacccuaa

SEQ ID NO: 4177474 - RNA, 17 nt, Yersinia pestis KIM
ugauaaccguucaagag

SEQ ID NO: 4177475 - RNA, 24 nt, Yersinia pestis KIM
ugauaaccguuuuuucaacuggcu

SEQ ID NO: 4177476 - RNA, 21 nt, Yersinia pestis KIM
ugauaagucgucugauauuaa

SEQ ID NO: 4177477 - RNA, 19 nt, Yersinia pestis KIM
ugauaagugaauaaaucaa

SEQ ID NO: 4177478 - RNA, 13 nt, Yersinia pestis KIM
ugauaaguugaga

SEQ ID NO: 4177479 - RNA, 19 nt, Yersinia pestis KIM
ugauaaguuggaggcguuu

SEQ ID NO: 4177480 - RNA, 17 nt, Yersinia pestis KIM
ugauaauaguucauuuu

SEQ ID NO: 4177481 - RNA, 21 nt, Yersinia pestis KIM
ugauaaugccuuuuaaaugaa

SEQ ID NO: 4177482 - RNA, 22 nt, Yersinia pestis KIM
ugauaaugccuuuuaaaugaag

SEQ ID NO: 4177483 - RNA, 15 nt, Yersinia pestis KIM
ugauaauugcuacga

SEQ ID NO: 4177484 - RNA, 17 nt, Yersinia pestis KIM
ugauaauuuauuucaga

SEQ ID NO: 4177485 - RNA, 17 nt, Yersinia pestis KIM
ugauacaggaaacucca

SEQ ID NO: 4177486 - RNA, 13 nt, Yersinia pestis KIM
ugauacaguaauu

SEQ ID NO: 4177487 - RNA, 17 nt, Yersinia pestis KIM
ugauacaucucggcuuu

SEQ ID NO: 4177488 - RNA, 16 nt, Yersinia pestis KIM
ugauaccgauaugccc

SEQ ID NO: 4177489 - RNA, 21 nt, Yersinia pestis KIM
ugauagauucaucaccaguca

SEQ ID NO: 4177490 - RNA, 14 nt, Yersinia pestis KIM
ugauagcaaaacac

SEQ ID NO: 4177491 - RNA, 22 nt, Yersinia pestis KIM
ugauagccaacacgaccugugc

SEQ ID NO: 4177492 - RNA, 21 nt, Yersinia pestis KIM
ugauagccacaucauuaccca

SEQ ID NO: 4177493 - RNA, 23 nt, Yersinia pestis KIM
ugauagcgacacccucagaggcc

SEQ ID NO: 4177494 - RNA, 14 nt, Yersinia pestis KIM
ugauaggucauaua

SEQ ID NO: 4177495 - RNA, 19 nt, Yersinia pestis KIM
ugauagugauuuuuuucac

SEQ ID NO: 4177496 - RNA, 18 nt, Yersinia pestis KIM
ugauaguguaaaaaccau

SEQ ID NO: 4177497 - RNA, 21 nt, Yersinia pestis KIM
ugauaguuuuuuuuauggcug

SEQ ID NO: 4177498 - RNA, 16 nt, Yersinia pestis KIM
ugauauagcuguuuga

SEQ ID NO: 4177499 - RNA, 15 nt, Yersinia pestis KIM
ugauauauagaaaua

SEQ ID NO: 4177500 - RNA, 17 nt, Yersinia pestis KIM
ugauaucagccagcucc

SEQ ID NO: 4177501 - RNA, 14 nt, Yersinia pestis KIM
ugauaucuucacuc

SEQ ID NO: 4177502 - RNA, 16 nt, Yersinia pestis KIM
ugauaugcaaaucaug

SEQ ID NO: 4177503 - RNA, 15 nt, Yersinia pestis KIM
ugauaugcuuauaaa

SEQ ID NO: 4177504 - RNA, 18 nt, Yersinia pestis KIM
ugauaugcuucacaucau

SEQ ID NO: 4177505 - RNA, 16 nt, Yersinia pestis KIM
ugauaugggaacgucu

SEQ ID NO: 4177506 - RNA, 14 nt, Yersinia pestis KIM
ugauauuaacuggu

SEQ ID NO: 4177507 - RNA, 23 nt, Yersinia pestis KIM
ugauauuaaucagccuucagggu

SEQ ID NO: 4177508 - RNA, 12 nt, Yersinia pestis KIM
ugauauuagucg

SEQ ID NO: 4177509 - RNA, 15 nt, Yersinia pestis KIM
ugauauuauuauugc

SEQ ID NO: 4177510 - RNA, 16 nt, Yersinia pestis KIM
ugauauucgcccgcug

SEQ ID NO: 4177511 - RNA, 22 nt, Yersinia pestis KIM
ugauauuuaagccaugacaggu

SEQ ID NO: 4177512 - RNA, 18 nt, Yersinia pestis KIM
ugaucaacgcgcaaguaa

SEQ ID NO: 4177513 - RNA, 13 nt, Yersinia pestis KIM
ugaucaacucacg

SEQ ID NO: 4177514 - RNA, 15 nt, Yersinia pestis KIM
ugaucagcagacuca

SEQ ID NO: 4177515 - RNA, 20 nt, Yersinia pestis KIM
ugaucagcauuucggcuauu

SEQ ID NO: 4177516 - RNA, 19 nt, Yersinia pestis KIM
ugaucaguggcuuaauuga

SEQ ID NO: 4177517 - RNA, 14 nt, Yersinia pestis KIM
ugaucaucaucaau

SEQ ID NO: 4177518 - RNA, 12 nt, Yersinia pestis KIM
ugaucaucuuuu

SEQ ID NO: 4177519 - RNA, 18 nt, Yersinia pestis KIM
ugaucaugcucaccaugu

SEQ ID NO: 4177520 - RNA, 16 nt, Yersinia pestis KIM
ugaucauuucccccac

SEQ ID NO: 4177521 - RNA, 19 nt, Yersinia pestis KIM
ugauccaaauggcugcguu

SEQ ID NO: 4177522 - RNA, 14 nt, Yersinia pestis KIM
ugaucccccaaauu

SEQ ID NO: 4177523 - RNA, 17 nt, Yersinia pestis KIM
ugaucgccguacuuggu

SEQ ID NO: 4177524 - RNA, 20 nt, Yersinia pestis KIM
ugaucgguuagcuacugaug

SEQ ID NO: 4177525 - RNA, 18 nt, Yersinia pestis KIM
ugaucguuuuauggcgau

SEQ ID NO: 4177526 - RNA, 20 nt, Yersinia pestis KIM
ugaucuaacguccccugagc

SEQ ID NO: 4177527 - RNA, 23 nt, Yersinia pestis KIM
ugaucucaucauugacgugcagg

SEQ ID NO: 4177528 - RNA, 17 nt, Yersinia pestis KIM
ugaucugauauuauugc

SEQ ID NO: 4177529 - RNA, 15 nt, Yersinia pestis KIM
ugaucugccaguaaa

SEQ ID NO: 4177530 - RNA, 15 nt, Yersinia pestis KIM
ugaucugccagugcc

SEQ ID NO: 4177531 - RNA, 17 nt, Yersinia pestis KIM
ugaucuggcuuucucaa

SEQ ID NO: 4177532 - RNA, 14 nt, Yersinia pestis KIM
ugaucuugaauaau

SEQ ID NO: 4177533 - RNA, 20 nt, Yersinia pestis KIM
ugaucuugaauaauauucaa

SEQ ID NO: 4177534 - RNA, 13 nt, Yersinia pestis KIM
ugaucuuuauuau

SEQ ID NO: 4177535 - RNA, 13 nt, Yersinia pestis KIM
ugaugaaugcgaa

SEQ ID NO: 4177536 - RNA, 22 nt, Yersinia pestis KIM
ugaugaauuugauacagugaua

SEQ ID NO: 4177537 - RNA, 14 nt, Yersinia pestis KIM
ugaugacaaugcgu

SEQ ID NO: 4177538 - RNA, 22 nt, Yersinia pestis KIM
ugaugacacccguuccuucagc

SEQ ID NO: 4177539 - RNA, 21 nt, Yersinia pestis KIM
ugaugacgcuaaccaccguca

SEQ ID NO: 4177540 - RNA, 17 nt, Yersinia pestis KIM
ugaugacggugaugucc

SEQ ID NO: 4177541 - RNA, 15 nt, Yersinia pestis KIM
ugaugagaaguaaaa

SEQ ID NO: 4177542 - RNA, 21 nt, Yersinia pestis KIM
ugaugaguaugcaacagugau

SEQ ID NO: 4177543 - RNA, 15 nt, Yersinia pestis KIM
ugaugauaucaccuu

SEQ ID NO: 4177544 - RNA, 14 nt, Yersinia pestis KIM
ugaugauauuuauc

SEQ ID NO: 4177545 - RNA, 19 nt, Yersinia pestis KIM
ugaugaucaugcucaccau

SEQ ID NO: 4177546 - RNA, 21 nt, Yersinia pestis KIM
ugaugaugagaaguaaaacgu

SEQ ID NO: 4177547 - RNA, 18 nt, Yersinia pestis KIM
ugaugcaguaaauagucu

SEQ ID NO: 4177548 - RNA, 19 nt, Yersinia pestis KIM
ugaugcaguaucccuggcu

SEQ ID NO: 4177549 - RNA, 17 nt, Yersinia pestis KIM
ugaugcauauuauaaug

SEQ ID NO: 4177550 - RNA, 22 nt, Yersinia pestis KIM
ugaugcauauuauaaugaaaua

SEQ ID NO: 4177551 - RNA, 17 nt, Yersinia pestis KIM
ugaugccaguaauucac

SEQ ID NO: 4177552 - RNA, 16 nt, Yersinia pestis KIM
ugaugccgaucaucuc

SEQ ID NO: 4177553 - RNA, 16 nt, Yersinia pestis KIM
ugaugcucuucuucac

SEQ ID NO: 4177554 - RNA, 17 nt, Yersinia pestis KIM
ugaugcugccucucauu

SEQ ID NO: 4177555 - RNA, 14 nt, Yersinia pestis KIM
ugaugcuggguaua

SEQ ID NO: 4177556 - RNA, 18 nt, Yersinia pestis KIM
ugaugcuggguauauaua

SEQ ID NO: 4177557 - RNA, 15 nt, Yersinia pestis KIM
ugaugcuuuucuuuc

SEQ ID NO: 4177558 - RNA, 16 nt, Yersinia pestis KIM
ugaugcuuuucuuucc

SEQ ID NO: 4177559 - RNA, 17 nt, Yersinia pestis KIM
ugauggaguuguugcca

SEQ ID NO: 4177560 - RNA, 19 nt, Yersinia pestis KIM
ugauggaguuguugccaca

SEQ ID NO: 4177561 - RNA, 22 nt, Yersinia pestis KIM
ugauggcaccgugggcaaagaa

SEQ ID NO: 4177562 - RNA, 22 nt, Yersinia pestis KIM
ugauggcuaauuaauuuaaaca

SEQ ID NO: 4177563 - RNA, 18 nt, Yersinia pestis KIM
ugaugggaggaaacugcc

SEQ ID NO: 4177564 - RNA, 18 nt, Yersinia pestis KIM
ugaugggggauauucauu

SEQ ID NO: 4177565 - RNA, 12 nt, Yersinia pestis KIM
ugauguaggcaa

SEQ ID NO: 4177566 - RNA, 19 nt, Yersinia pestis KIM
ugauguaguguguuuucuu

SEQ ID NO: 4177567 - RNA, 20 nt, Yersinia pestis KIM
ugaugucaucuuccgucagu

SEQ ID NO: 4177568 - RNA, 20 nt, Yersinia pestis KIM
ugaugugacgucacugaugc

SEQ ID NO: 4177569 - RNA, 20 nt, Yersinia pestis KIM
ugauguggcugcuguugcca

SEQ ID NO: 4177570 - RNA, 12 nt, Yersinia pestis KIM
ugauguguacca

SEQ ID NO: 4177571 - RNA, 17 nt, Yersinia pestis KIM
ugauguuaacucagcca

SEQ ID NO: 4177572 - RNA, 13 nt, Yersinia pestis KIM
ugauguuauuaau

SEQ ID NO: 4177573 - RNA, 15 nt, Yersinia pestis KIM
ugauguuauuaauga

SEQ ID NO: 4177574 - RNA, 15 nt, Yersinia pestis KIM
ugauguuuuaggcaa

SEQ ID NO: 4177575 - RNA, 20 nt, Yersinia pestis KIM
ugauuaagcggcaauaacac

SEQ ID NO: 4177576 - RNA, 12 nt, Yersinia pestis KIM
ugauuaauauca

SEQ ID NO: 4177577 - RNA, 19 nt, Yersinia pestis KIM
ugauuaauaucaaaacuga

SEQ ID NO: 4177578 - RNA, 21 nt, Yersinia pestis KIM
ugauuaauaucaaaacugauu

SEQ ID NO: 4177579 - RNA, 14 nt, Yersinia pestis KIM
ugauuaauuuuaau

SEQ ID NO: 4177580 - RNA, 15 nt, Yersinia pestis KIM
ugauuaauuuuaaua

SEQ ID NO: 4177581 - RNA, 15 nt, Yersinia pestis KIM
ugauuacaucacuuu

SEQ ID NO: 4177582 - RNA, 17 nt, Yersinia pestis KIM
ugauuaccaauaauuaa

SEQ ID NO: 4177583 - RNA, 22 nt, Yersinia pestis KIM
ugauuacguuccacugcuuuag

SEQ ID NO: 4177584 - RNA, 16 nt, Yersinia pestis KIM
ugauuagcuggcuguu

SEQ ID NO: 4177585 - RNA, 17 nt, Yersinia pestis KIM
ugauuaggcauaaauaa

SEQ ID NO: 4177586 - RNA, 20 nt, Yersinia pestis KIM
ugauuaggcauaaauaauaa

SEQ ID NO: 4177587 - RNA, 17 nt, Yersinia pestis KIM
ugauuaggcaugauaag

SEQ ID NO: 4177588 - RNA, 18 nt, Yersinia pestis KIM
ugauuaucaaguuaaaua

SEQ ID NO: 4177589 - RNA, 22 nt, Yersinia pestis KIM
ugauuaucaaguuaaauacugc

SEQ ID NO: 4177590 - RNA, 17 nt, Yersinia pestis KIM
ugauuauuuaaacaaug

SEQ ID NO: 4177591 - RNA, 22 nt, Yersinia pestis KIM
ugauuauuuuguuuguaaauuu

SEQ ID NO: 4177592 - RNA, 17 nt, Yersinia pestis KIM
ugauucaacugccgcaa

SEQ ID NO: 4177593 - RNA, 15 nt, Yersinia pestis KIM
ugauucaauuucgac

SEQ ID NO: 4177594 - RNA, 12 nt, Yersinia pestis KIM
ugauucagaaag

SEQ ID NO: 4177595 - RNA, 17 nt, Yersinia pestis KIM
ugauucagugauaacaa

SEQ ID NO: 4177596 - RNA, 13 nt, Yersinia pestis KIM
ugauucgggcaaa

SEQ ID NO: 4177597 - RNA, 18 nt, Yersinia pestis KIM
ugauucgggugagugagc

SEQ ID NO: 4177598 - RNA, 15 nt, Yersinia pestis KIM
ugauucgucugccau

SEQ ID NO: 4177599 - RNA, 18 nt, Yersinia pestis KIM
ugauucgucugccauugc

SEQ ID NO: 4177600 - RNA, 14 nt, Yersinia pestis KIM
ugauucucuauucu

SEQ ID NO: 4177601 - RNA, 16 nt, Yersinia pestis KIM
ugauugaaaaacagag

SEQ ID NO: 4177602 - RNA, 14 nt, Yersinia pestis KIM
ugauugcaaaacau

SEQ ID NO: 4177603 - RNA, 16 nt, Yersinia pestis KIM
ugauugcaaaacauag

SEQ ID NO: 4177604 - RNA, 20 nt, Yersinia pestis KIM
ugauugcagauaaacaucau

SEQ ID NO: 4177605 - RNA, 15 nt, Yersinia pestis KIM
ugauugcaucaucag

SEQ ID NO: 4177606 - RNA, 16 nt, Yersinia pestis KIM
ugauuggacgauaacg

SEQ ID NO: 4177607 - RNA, 20 nt, Yersinia pestis KIM
ugauuggcuccuauagcuca

SEQ ID NO: 4177608 - RNA, 17 nt, Yersinia pestis KIM
ugauuguugugcauaua

SEQ ID NO: 4177609 - RNA, 18 nt, Yersinia pestis KIM
ugauuguuuuuauuacag

SEQ ID NO: 4177610 - RNA, 23 nt, Yersinia pestis KIM
ugauuguuuuuauuacagaguaa

SEQ ID NO: 4177611 - RNA, 16 nt, Yersinia pestis KIM
ugauuuaauuucugga

SEQ ID NO: 4177612 - RNA, 15 nt, Yersinia pestis KIM
ugauuuauaaauaau

SEQ ID NO: 4177613 - RNA, 19 nt, Yersinia pestis KIM
ugauuuauaaauaauuauc

SEQ ID NO: 4177614 - RNA, 16 nt, Yersinia pestis KIM
ugauuuguuaaaacag

SEQ ID NO: 4177615 - RNA, 17 nt, Yersinia pestis KIM
ugauuuuagccucugua

SEQ ID NO: 4177616 - RNA, 11 nt, Yersinia pestis KIM
ugauuuuuaac

SEQ ID NO: 4177617 - RNA, 16 nt, Yersinia pestis KIM
ugauuuuuaucaucau

SEQ ID NO: 4177618 - RNA, 18 nt, Yersinia pestis KIM
ugauuuuuaucaucauaa

SEQ ID NO: 4177619 - RNA, 14 nt, Yersinia pestis KIM
ugauuuuuuucaug

SEQ ID NO: 4177620 - RNA, 16 nt, Yersinia pestis KIM
ugcaaaaaaagacacu

SEQ ID NO: 4177621 - RNA, 13 nt, Yersinia pestis KIM
ugcaaaaccccaa

SEQ ID NO: 4177622 - RNA, 21 nt, Yersinia pestis KIM
ugcaaaauacaaaguaaacuu

SEQ ID NO: 4177623 - RNA, 18 nt, Yersinia pestis KIM
ugcaaaaugcucuucacc

SEQ ID NO: 4177624 - RNA, 21 nt, Yersinia pestis KIM
ugcaaaauuccaccauucuca

SEQ ID NO: 4177625 - RNA, 23 nt, Yersinia pestis KIM
ugcaaacagguaaauaagauagc

SEQ ID NO: 4177626 - RNA, 20 nt, Yersinia pestis KIM
ugcaaacccuaauaccaaca

SEQ ID NO: 4177627 - RNA, 17 nt, Yersinia pestis KIM
ugcaaacggauaauguu

SEQ ID NO: 4177628 - RNA, 20 nt, Yersinia pestis KIM
ugcaaacggauaauguugca

SEQ ID NO: 4177629 - RNA, 12 nt, Yersinia pestis KIM
ugcaaauaauaa

SEQ ID NO: 4177630 - RNA, 14 nt, Yersinia pestis KIM
ugcaaaucaugcuc

SEQ ID NO: 4177631 - RNA, 20 nt, Yersinia pestis KIM
ugcaaaucaugcucaaucug

SEQ ID NO: 4177632 - RNA, 14 nt, Yersinia pestis KIM
ugcaaauuuaucca

SEQ ID NO: 4177633 - RNA, 21 nt, Yersinia pestis KIM
ugcaaauuuaugcgcuuucuc

SEQ ID NO: 4177634 - RNA, 14 nt, Yersinia pestis KIM
ugcaacaacgccag

SEQ ID NO: 4177635 - RNA, 20 nt, Yersinia pestis KIM
ugcaacaacgccucaucuuc

SEQ ID NO: 4177636 - RNA, 23 nt, Yersinia pestis KIM
ugcaacagauaauuggcaauaau

SEQ ID NO: 4177637 - RNA, 11 nt, Yersinia pestis KIM
ugcaacaguga

SEQ ID NO: 4177638 - RNA, 11 nt, Yersinia pestis KIM
ugcaacauuau

SEQ ID NO: 4177639 - RNA, 18 nt, Yersinia pestis KIM
ugcaaccaguuaaagaau

SEQ ID NO: 4177640 - RNA, 13 nt, Yersinia pestis KIM
ugcaacgccuuca

SEQ ID NO: 4177641 - RNA, 13 nt, Yersinia pestis KIM
ugcaacucauuaa

SEQ ID NO: 4177642 - RNA, 17 nt, Yersinia pestis KIM
ugcaagccguaauucag

SEQ ID NO: 4177643 - RNA, 14 nt, Yersinia pestis KIM
ugcaagcguuacuc

SEQ ID NO: 4177644 - RNA, 17 nt, Yersinia pestis KIM
ugcaauaaauucaaaau

SEQ ID NO: 4177645 - RNA, 21 nt, Yersinia pestis KIM
ugcaauaaauucaaaauagag

SEQ ID NO: 4177646 - RNA, 14 nt, Yersinia pestis KIM
ugcaauaacaccag

SEQ ID NO: 4177647 - RNA, 18 nt, Yersinia pestis KIM
ugcaauaacaccagcagg

SEQ ID NO: 4177648 - RNA, 14 nt, Yersinia pestis KIM
ugcaauaagccaga

SEQ ID NO: 4177649 - RNA, 16 nt, Yersinia pestis KIM
ugcaauagcuagcccc

SEQ ID NO: 4177650 - RNA, 13 nt, Yersinia pestis KIM
ugcaauagcucau

SEQ ID NO: 4177651 - RNA, 22 nt, Yersinia pestis KIM
ugcaauagcucauuuuaaauau

SEQ ID NO: 4177652 - RNA, 18 nt, Yersinia pestis KIM
ugcaaucagaggccauca

SEQ ID NO: 4177653 - RNA, 16 nt, Yersinia pestis KIM
ugcaaucuguuauaaa

SEQ ID NO: 4177654 - RNA, 19 nt, Yersinia pestis KIM
ugcaaucuguuauaaaaaa

SEQ ID NO: 4177655 - RNA, 21 nt, Yersinia pestis KIM
ugcaaucuguuauaaaaaagc

SEQ ID NO: 4177656 - RNA, 13 nt, Yersinia pestis KIM
ugcaaugccauga

SEQ ID NO: 4177657 - RNA, 15 nt, Yersinia pestis KIM
ugcaaugcuuauuuc

SEQ ID NO: 4177658 - RNA, 23 nt, Yersinia pestis KIM
ugcaaugcuuauuucacacuguu

SEQ ID NO: 4177659 - RNA, 17 nt, Yersinia pestis KIM
ugcaauggcuggcaagg

SEQ ID NO: 4177660 - RNA, 13 nt, Yersinia pestis KIM
ugcacaccaucag

SEQ ID NO: 4177661 - RNA, 16 nt, Yersinia pestis KIM
ugcacagcauuuaugc

SEQ ID NO: 4177662 - RNA, 20 nt, Yersinia pestis KIM
ugcacagguaguaagcaugc

SEQ ID NO: 4177663 - RNA, 18 nt, Yersinia pestis KIM
ugcacaguugucugaggc

SEQ ID NO: 4177664 - RNA, 13 nt, Yersinia pestis KIM
ugcacaucaauac

SEQ ID NO: 4177665 - RNA, 15 nt, Yersinia pestis KIM
ugcacaucaauaccu

SEQ ID NO: 4177666 - RNA, 11 nt, Yersinia pestis KIM
ugcacaucauu

SEQ ID NO: 4177667 - RNA, 15 nt, Yersinia pestis KIM
ugcacaucauuuauu

SEQ ID NO: 4177668 - RNA, 22 nt, Yersinia pestis KIM
ugcaccaaugacuaauugugca

SEQ ID NO: 4177669 - RNA, 13 nt, Yersinia pestis KIM
ugcaccacacagc

SEQ ID NO: 4177670 - RNA, 23 nt, Yersinia pestis KIM
ugcaccacacagcguagacaaug

SEQ ID NO: 4177671 - RNA, 19 nt, Yersinia pestis KIM
ugcaccauauucccagcca

SEQ ID NO: 4177672 - RNA, 14 nt, Yersinia pestis KIM
ugcacccaauggca

SEQ ID NO: 4177673 - RNA, 19 nt, Yersinia pestis KIM
ugcaccccacaugccaccc

SEQ ID NO: 4177674 - RNA, 13 nt, Yersinia pestis KIM
ugcacccccuucg

SEQ ID NO: 4177675 - RNA, 14 nt, Yersinia pestis KIM
ugcacccccuucgg

SEQ ID NO: 4177676 - RNA, 14 nt, Yersinia pestis KIM
ugcaccguaacuuc

SEQ ID NO: 4177677 - RNA, 14 nt, Yersinia pestis KIM
ugcaccuuugcgag

SEQ ID NO: 4177678 - RNA, 21 nt, Yersinia pestis KIM
ugcacguaaagaguuaccgug

SEQ ID NO: 4177679 - RNA, 19 nt, Yersinia pestis KIM
ugcacgucaguuaaauaug

SEQ ID NO: 4177680 - RNA, 20 nt, Yersinia pestis KIM
ugcacgugaggauucaagaa

SEQ ID NO: 4177681 - RNA, 12 nt, Yersinia pestis KIM
ugcacugagcca

SEQ ID NO: 4177682 - RNA, 10 nt, Yersinia pestis KIM
ugcagaaaau

SEQ ID NO: 4177683 - RNA, 21 nt, Yersinia pestis KIM
ugcagaaauaaauauccuccg

SEQ ID NO: 4177684 - RNA, 23 nt, Yersinia pestis KIM
ugcagaauaucuuccacaugcuu

SEQ ID NO: 4177685 - RNA, 13 nt, Yersinia pestis KIM
ugcagaccaauca

SEQ ID NO: 4177686 - RNA, 14 nt, Yersinia pestis KIM
ugcagacucuuaua

SEQ ID NO: 4177687 - RNA, 15 nt, Yersinia pestis KIM
ugcagagaugcagag

SEQ ID NO: 4177688 - RNA, 20 nt, Yersinia pestis KIM
ugcagagaugcagugucagg

SEQ ID NO: 4177689 - RNA, 20 nt, Yersinia pestis KIM
ugcagagguacccuugcaaa

SEQ ID NO: 4177690 - RNA, 16 nt, Yersinia pestis KIM
ugcagaucaaucgcau

SEQ ID NO: 4177691 - RNA, 21 nt, Yersinia pestis KIM
ugcagaucaaucgcauuguca

SEQ ID NO: 4177692 - RNA, 20 nt, Yersinia pestis KIM
ugcagcaacaauaacuuugg

SEQ ID NO: 4177693 - RNA, 20 nt, Yersinia pestis KIM
ugcagcaacaggguauuggc

SEQ ID NO: 4177694 - RNA, 14 nt, Yersinia pestis KIM
ugcagcauuucagg

SEQ ID NO: 4177695 - RNA, 23 nt, Yersinia pestis KIM
ugcagcauuuucagcaacugacc

SEQ ID NO: 4177696 - RNA, 18 nt, Yersinia pestis KIM
ugcagccaacgcccugca

SEQ ID NO: 4177697 - RNA, 21 nt, Yersinia pestis KIM
ugcagccaacgcccugcaucu

SEQ ID NO: 4177698 - RNA, 15 nt, Yersinia pestis KIM
ugcagccaagauccc

SEQ ID NO: 4177699 - RNA, 17 nt, Yersinia pestis KIM
ugcagcgcgcagccaac

SEQ ID NO: 4177700 - RNA, 24 nt, Yersinia pestis KIM
ugcagcggaacugaugaucauugc

SEQ ID NO: 4177701 - RNA, 14 nt, Yersinia pestis KIM
ugcagcuaaacacg

SEQ ID NO: 4177702 - RNA, 22 nt, Yersinia pestis KIM
ugcagcucaaagaccacaucaa

SEQ ID NO: 4177703 - RNA, 13 nt, Yersinia pestis KIM
ugcaggcccagca

SEQ ID NO: 4177704 - RNA, 14 nt, Yersinia pestis KIM
ugcaggcuaccaga

SEQ ID NO: 4177705 - RNA, 20 nt, Yersinia pestis KIM
ugcaggugugcggauggcug

SEQ ID NO: 4177706 - RNA, 17 nt, Yersinia pestis KIM
ugcagguuuugccagau

SEQ ID NO: 4177707 - RNA, 16 nt, Yersinia pestis KIM
ugcaguaucuggguga

SEQ ID NO: 4177708 - RNA, 20 nt, Yersinia pestis KIM
ugcaguggaugauaaauauc

SEQ ID NO: 4177709 - RNA, 14 nt, Yersinia pestis KIM
ugcaguuaaggcug

SEQ ID NO: 4177710 - RNA, 17 nt, Yersinia pestis KIM
ugcaguuaaggcuggcu

SEQ ID NO: 4177711 - RNA, 18 nt, Yersinia pestis KIM
ugcaguuaaggcuggcug

SEQ ID NO: 4177712 - RNA, 15 nt, Yersinia pestis KIM
ugcauaauggacgaa

SEQ ID NO: 4177713 - RNA, 18 nt, Yersinia pestis KIM
ugcauacucaggcccuga

SEQ ID NO: 4177714 - RNA, 17 nt, Yersinia pestis KIM
ugcauagcguuguucaa

SEQ ID NO: 4177715 - RNA, 17 nt, Yersinia pestis KIM
ugcauauccucccgcua

SEQ ID NO: 4177716 - RNA, 19 nt, Yersinia pestis KIM
ugcauauuauaaugaaaua

SEQ ID NO: 4177717 - RNA, 21 nt, Yersinia pestis KIM
ugcauauuauuuugcacacga

SEQ ID NO: 4177718 - RNA, 13 nt, Yersinia pestis KIM
ugcaucaacgaca

SEQ ID NO: 4177719 - RNA, 15 nt, Yersinia pestis KIM
ugcaucaacgacagc

SEQ ID NO: 4177720 - RNA, 16 nt, Yersinia pestis KIM
ugcaucaacuuugguu

SEQ ID NO: 4177721 - RNA, 17 nt, Yersinia pestis KIM
ugcaucaauaaauagag

SEQ ID NO: 4177722 - RNA, 18 nt, Yersinia pestis KIM
ugcauccgcaaaaugggu

SEQ ID NO: 4177723 - RNA, 21 nt, Yersinia pestis KIM
ugcauccgcaaaauggguaua

SEQ ID NO: 4177724 - RNA, 15 nt, Yersinia pestis KIM
ugcauccgcuuucac

SEQ ID NO: 4177725 - RNA, 13 nt, Yersinia pestis KIM
ugcaucgcacuga

SEQ ID NO: 4177726 - RNA, 22 nt, Yersinia pestis KIM
ugcaucuauugugucaauaccu

SEQ ID NO: 4177727 - RNA, 16 nt, Yersinia pestis KIM
ugcaucucugcaucac

SEQ ID NO: 4177728 - RNA, 17 nt, Yersinia pestis KIM
ugcaucuggucaucaug

SEQ ID NO: 4177729 - RNA, 21 nt, Yersinia pestis KIM
ugcaucuuuaauuaaugguca

SEQ ID NO: 4177730 - RNA, 21 nt, Yersinia pestis KIM
ugcauuaucuuuaauuuuucc

SEQ ID NO: 4177731 - RNA, 22 nt, Yersinia pestis KIM
ugcauuaucuuuaauuuuuccc

SEQ ID NO: 4177732 - RNA, 13 nt, Yersinia pestis KIM
ugcauucugcugg

SEQ ID NO: 4177733 - RNA, 13 nt, Yersinia pestis KIM
ugcauuggaaaaa

SEQ ID NO: 4177734 - RNA, 17 nt, Yersinia pestis KIM
ugcauuuaugaugcauu

SEQ ID NO: 4177735 - RNA, 21 nt, Yersinia pestis KIM
ugcauuucaauucguucaaau

SEQ ID NO: 4177736 - RNA, 20 nt, Yersinia pestis KIM
ugccaaaaugccuaccguua

SEQ ID NO: 4177737 - RNA, 23 nt, Yersinia pestis KIM
ugccaaaaugccuaccguuagca

SEQ ID NO: 4177738 - RNA, 19 nt, Yersinia pestis KIM
ugccaaacccauuaccggu

SEQ ID NO: 4177739 - RNA, 16 nt, Yersinia pestis KIM
ugccaaauaucuuuca

SEQ ID NO: 4177740 - RNA, 16 nt, Yersinia pestis KIM
ugccaaauauugcaca

SEQ ID NO: 4177741 - RNA, 22 nt, Yersinia pestis KIM
ugccaacaacuggguggccagu

SEQ ID NO: 4177742 - RNA, 16 nt, Yersinia pestis KIM
ugccaacaauugcucc

SEQ ID NO: 4177743 - RNA, 14 nt, Yersinia pestis KIM
ugccaaccaaucgg

SEQ ID NO: 4177744 - RNA, 20 nt, Yersinia pestis KIM
ugccaaccaccaaagauaca

SEQ ID NO: 4177745 - RNA, 23 nt, Yersinia pestis KIM
ugccaaccggauaaaacaauagc

SEQ ID NO: 4177746 - RNA, 17 nt, Yersinia pestis KIM
ugccaacgucucuucca

SEQ ID NO: 4177747 - RNA, 23 nt, Yersinia pestis KIM
ugccaauaaaguccaccucgaaa

SEQ ID NO: 4177748 - RNA, 19 nt, Yersinia pestis KIM
ugccaauauguuagcagca

SEQ ID NO: 4177749 - RNA, 22 nt, Yersinia pestis KIM
ugccaauauguuagcagcacaa

SEQ ID NO: 4177750 - RNA, 13 nt, Yersinia pestis KIM
ugccaauauugcc

SEQ ID NO: 4177751 - RNA, 19 nt, Yersinia pestis KIM
ugccaauccccaccaaaag

SEQ ID NO: 4177752 - RNA, 17 nt, Yersinia pestis KIM
ugccaaucccgcagcau

SEQ ID NO: 4177753 - RNA, 13 nt, Yersinia pestis KIM
ugccaaugcugcu

SEQ ID NO: 4177754 - RNA, 22 nt, Yersinia pestis KIM
ugccaauugaguaacugauuaa

SEQ ID NO: 4177755 - RNA, 18 nt, Yersinia pestis KIM
ugccaauuuaacuuucau

SEQ ID NO: 4177756 - RNA, 20 nt, Yersinia pestis KIM
ugccacacagaaucaccaac

SEQ ID NO: 4177757 - RNA, 13 nt, Yersinia pestis KIM
ugccacacucaga

SEQ ID NO: 4177758 - RNA, 16 nt, Yersinia pestis KIM
ugccacgaugagccgc

SEQ ID NO: 4177759 - RNA, 23 nt, Yersinia pestis KIM
ugccacgccaguaaacagccagc

SEQ ID NO: 4177760 - RNA, 20 nt, Yersinia pestis KIM
ugccagacacaagauaaaua

SEQ ID NO: 4177761 - RNA, 14 nt, Yersinia pestis KIM
ugccagauaaaaau

SEQ ID NO: 4177762 - RNA, 19 nt, Yersinia pestis KIM
ugccagauagaccccuucu

SEQ ID NO: 4177763 - RNA, 17 nt, Yersinia pestis KIM
ugccagcagcaaguuag

SEQ ID NO: 4177764 - RNA, 18 nt, Yersinia pestis KIM
ugccagccggugauuggg

SEQ ID NO: 4177765 - RNA, 16 nt, Yersinia pestis KIM
ugccagccuguuuagu

SEQ ID NO: 4177766 - RNA, 18 nt, Yersinia pestis KIM
ugccagcgcaaaaggcau

SEQ ID NO: 4177767 - RNA, 14 nt, Yersinia pestis KIM
ugccaguaauucac

SEQ ID NO: 4177768 - RNA, 15 nt, Yersinia pestis KIM
ugccaguagcaauaa

SEQ ID NO: 4177769 - RNA, 16 nt, Yersinia pestis KIM
ugccagucuaaaaugg

SEQ ID NO: 4177770 - RNA, 11 nt, Yersinia pestis KIM
ugccagugaau

SEQ ID NO: 4177771 - RNA, 18 nt, Yersinia pestis KIM
ugccagugaaucagccag

SEQ ID NO: 4177772 - RNA, 13 nt, Yersinia pestis KIM
ugccagugcaauc

SEQ ID NO: 4177773 - RNA, 17 nt, Yersinia pestis KIM
ugccagugcaauccgcu

SEQ ID NO: 4177774 - RNA, 20 nt, Yersinia pestis KIM
ugccauaaccgcuaaggcca

SEQ ID NO: 4177775 - RNA, 22 nt, Yersinia pestis KIM
ugccauaagugaacaugaugaa

SEQ ID NO: 4177776 - RNA, 17 nt, Yersinia pestis KIM
ugccauaauccagaagc

SEQ ID NO: 4177777 - RNA, 14 nt, Yersinia pestis KIM
ugccauagcugcug

SEQ ID NO: 4177778 - RNA, 23 nt, Yersinia pestis KIM
ugccauagcugcugcuuucagug

SEQ ID NO: 4177779 - RNA, 23 nt, Yersinia pestis KIM
ugccauauuacucucuauugauc

SEQ ID NO: 4177780 - RNA, 21 nt, Yersinia pestis KIM
ugccauauucgcggccugcug

SEQ ID NO: 4177781 - RNA, 18 nt, Yersinia pestis KIM
ugccaucaauaccaauaa

SEQ ID NO: 4177782 - RNA, 14 nt, Yersinia pestis KIM
ugccaucaggauuu

SEQ ID NO: 4177783 - RNA, 18 nt, Yersinia pestis KIM
ugccauccauuacauccu

SEQ ID NO: 4177784 - RNA, 20 nt, Yersinia pestis KIM
ugccaucccccuuuggccgc

SEQ ID NO: 4177785 - RNA, 15 nt, Yersinia pestis KIM
ugccaucgggcaauu

SEQ ID NO: 4177786 - RNA, 22 nt, Yersinia pestis KIM
ugccaucuuguucuaauaauaa

SEQ ID NO: 4177787 - RNA, 16 nt, Yersinia pestis KIM
ugccaugcacuccacu

SEQ ID NO: 4177788 - RNA, 15 nt, Yersinia pestis KIM
ugccauggucaguuu

SEQ ID NO: 4177789 - RNA, 15 nt, Yersinia pestis KIM
ugccaugucggcagg

SEQ ID NO: 4177790 - RNA, 22 nt, Yersinia pestis KIM
ugccauguugaguuuacgcagu

SEQ ID NO: 4177791 - RNA, 12 nt, Yersinia pestis KIM
ugccauucaagc

SEQ ID NO: 4177792 - RNA, 18 nt, Yersinia pestis KIM
ugcccaauggcaaaacag

SEQ ID NO: 4177793 - RNA, 20 nt, Yersinia pestis KIM
ugcccacauaaagauagcca

SEQ ID NO: 4177794 - RNA, 14 nt, Yersinia pestis KIM
ugcccagagcgcgg

SEQ ID NO: 4177795 - RNA, 16 nt, Yersinia pestis KIM
ugcccagccucuggau

SEQ ID NO: 4177796 - RNA, 21 nt, Yersinia pestis KIM
ugcccaucacaucgcccugag

SEQ ID NO: 4177797 - RNA, 18 nt, Yersinia pestis KIM
ugcccaucuuuuaguaac

SEQ ID NO: 4177798 - RNA, 21 nt, Yersinia pestis KIM
ugccccaaugaugacuugauu

SEQ ID NO: 4177799 - RNA, 23 nt, Yersinia pestis KIM
ugccccaucagcacuccccgccc

SEQ ID NO: 4177800 - RNA, 24 nt, Yersinia pestis KIM
ugccccuaagaaucggccagugcc

SEQ ID NO: 4177801 - RNA, 18 nt, Yersinia pestis KIM
ugccccuucaaagccgcu

SEQ ID NO: 4177802 - RNA, 20 nt, Yersinia pestis KIM
ugccccuuuuuucuauuuau

SEQ ID NO: 4177803 - RNA, 14 nt, Yersinia pestis KIM
ugcccgcuuucuga

SEQ ID NO: 4177804 - RNA, 17 nt, Yersinia pestis KIM
ugcccgucaauaucauc

SEQ ID NO: 4177805 - RNA, 17 nt, Yersinia pestis KIM
ugcccguuaauauuaau

SEQ ID NO: 4177806 - RNA, 20 nt, Yersinia pestis KIM
ugcccuguucgccauaaaug

SEQ ID NO: 4177807 - RNA, 18 nt, Yersinia pestis KIM
ugcccuuacuauuuuucu

SEQ ID NO: 4177808 - RNA, 22 nt, Yersinia pestis KIM
ugcccuucagaugaauccagcc

SEQ ID NO: 4177809 - RNA, 18 nt, Yersinia pestis KIM
ugcccuuugcuauucaga

SEQ ID NO: 4177810 - RNA, 17 nt, Yersinia pestis KIM
ugcccuuuuugguuuuc

SEQ ID NO: 4177811 - RNA, 19 nt, Yersinia pestis KIM
ugccgagaacagaauguug

SEQ ID NO: 4177812 - RNA, 15 nt, Yersinia pestis KIM
ugccgaucaucucau

SEQ ID NO: 4177813 - RNA, 18 nt, Yersinia pestis KIM
ugccgaugagcuucuuca

SEQ ID NO: 4177814 - RNA, 21 nt, Yersinia pestis KIM
ugccgaugagcuucuucaaaa

SEQ ID NO: 4177815 - RNA, 21 nt, Yersinia pestis KIM
ugccgcaaacgcucaguuaaa

SEQ ID NO: 4177816 - RNA, 16 nt, Yersinia pestis KIM
ugccgcacacagcccu

SEQ ID NO: 4177817 - RNA, 17 nt, Yersinia pestis KIM
ugccgcagauaaaucug

SEQ ID NO: 4177818 - RNA, 16 nt, Yersinia pestis KIM
ugccgcaucaccgccc

SEQ ID NO: 4177819 - RNA, 13 nt, Yersinia pestis KIM
ugccgccucugcu

SEQ ID NO: 4177820 - RNA, 18 nt, Yersinia pestis KIM
ugccgcggcggccagcgg

SEQ ID NO: 4177821 - RNA, 16 nt, Yersinia pestis KIM
ugccgcucaaggagaa

SEQ ID NO: 4177822 - RNA, 15 nt, Yersinia pestis KIM
ugccgcucaugcccc

SEQ ID NO: 4177823 - RNA, 20 nt, Yersinia pestis KIM
ugccggcguuaaugccaccc

SEQ ID NO: 4177824 - RNA, 21 nt, Yersinia pestis KIM
ugccggcguuaaugccacccc

SEQ ID NO: 4177825 - RNA, 24 nt, Yersinia pestis KIM
ugccgggcggauccccugauaauu

SEQ ID NO: 4177826 - RNA, 20 nt, Yersinia pestis KIM
ugccggggagucgcuccuca

SEQ ID NO: 4177827 - RNA, 16 nt, Yersinia pestis KIM
ugccguacaacaauaa

SEQ ID NO: 4177828 - RNA, 22 nt, Yersinia pestis KIM
ugccguaucuuguaguaaccac

SEQ ID NO: 4177829 - RNA, 21 nt, Yersinia pestis KIM
ugccgucaaugccuguuauaa

SEQ ID NO: 4177830 - RNA, 22 nt, Yersinia pestis KIM
ugccgucguauagaaaauuucu

SEQ ID NO: 4177831 - RNA, 18 nt, Yersinia pestis KIM
ugccgugcuugcuauuaa

SEQ ID NO: 4177832 - RNA, 20 nt, Yersinia pestis KIM
ugccguuaauugugaucagu

SEQ ID NO: 4177833 - RNA, 19 nt, Yersinia pestis KIM
ugccguuauagaucuccug

SEQ ID NO: 4177834 - RNA, 13 nt, Yersinia pestis KIM
ugccuauccucac

SEQ ID NO: 4177835 - RNA, 23 nt, Yersinia pestis KIM
ugccuauccucaccguucaagau

SEQ ID NO: 4177836 - RNA, 21 nt, Yersinia pestis KIM
ugccuauccugacaccggaua

SEQ ID NO: 4177837 - RNA, 16 nt, Yersinia pestis KIM
ugccuaucuuaaaaau

SEQ ID NO: 4177838 - RNA, 12 nt, Yersinia pestis KIM
ugccucacuguc

SEQ ID NO: 4177839 - RNA, 15 nt, Yersinia pestis KIM
ugccucacugucuuu

SEQ ID NO: 4177840 - RNA, 15 nt, Yersinia pestis KIM
ugccuccaguugagu

SEQ ID NO: 4177841 - RNA, 13 nt, Yersinia pestis KIM
ugccucggucuga

SEQ ID NO: 4177842 - RNA, 18 nt, Yersinia pestis KIM
ugccugacgcggugacaa

SEQ ID NO: 4177843 - RNA, 22 nt, Yersinia pestis KIM
ugccugacggcaaagaaguacu

SEQ ID NO: 4177844 - RNA, 18 nt, Yersinia pestis KIM
ugccugaguaaucgccug

SEQ ID NO: 4177845 - RNA, 19 nt, Yersinia pestis KIM
ugccugauuuuuaucauca

SEQ ID NO: 4177846 - RNA, 15 nt, Yersinia pestis KIM
ugccugcaccagugc

SEQ ID NO: 4177847 - RNA, 16 nt, Yersinia pestis KIM
ugccugcaccagugcc

SEQ ID NO: 4177848 - RNA, 20 nt, Yersinia pestis KIM
ugccugcuggcaaacuuuuc

SEQ ID NO: 4177849 - RNA, 24 nt, Yersinia pestis KIM
ugccuggaucaaguuagcaggcag

SEQ ID NO: 4177850 - RNA, 15 nt, Yersinia pestis KIM
ugccuggugcaaccg

SEQ ID NO: 4177851 - RNA, 16 nt, Yersinia pestis KIM
ugccugugcggcagug

SEQ ID NO: 4177852 - RNA, 20 nt, Yersinia pestis KIM
ugccugugcggcagugaacc

SEQ ID NO: 4177853 - RNA, 18 nt, Yersinia pestis KIM
ugccuuacaaagcauuuc

SEQ ID NO: 4177854 - RNA, 22 nt, Yersinia pestis KIM
ugccuuacuuuuuugccugcuc

SEQ ID NO: 4177855 - RNA, 19 nt, Yersinia pestis KIM
ugccuuagguaagucagcg

SEQ ID NO: 4177856 - RNA, 18 nt, Yersinia pestis KIM
ugccuugaucgcauccuc

SEQ ID NO: 4177857 - RNA, 16 nt, Yersinia pestis KIM
ugccuuggucucagaa

SEQ ID NO: 4177858 - RNA, 17 nt, Yersinia pestis KIM
ugccuuggucucagaac

SEQ ID NO: 4177859 - RNA, 14 nt, Yersinia pestis KIM
ugccuuuaauggca

SEQ ID NO: 4177860 - RNA, 13 nt, Yersinia pestis KIM
ugccuuuucuucc

SEQ ID NO: 4177861 - RNA, 14 nt, Yersinia pestis KIM
ugccuuuucuuccg

SEQ ID NO: 4177862 - RNA, 17 nt, Yersinia pestis KIM
ugccuuuuuugaacgau

SEQ ID NO: 4177863 - RNA, 14 nt, Yersinia pestis KIM
ugcgaaaaaagaug

SEQ ID NO: 4177864 - RNA, 14 nt, Yersinia pestis KIM
ugcgaagcgcaccc

SEQ ID NO: 4177865 - RNA, 15 nt, Yersinia pestis KIM
ugcgaauggaaaaac

SEQ ID NO: 4177866 - RNA, 13 nt, Yersinia pestis KIM
ugcgaauuaucau

SEQ ID NO: 4177867 - RNA, 13 nt, Yersinia pestis KIM
ugcgacaauuucc

SEQ ID NO: 4177868 - RNA, 20 nt, Yersinia pestis KIM
ugcgacaccaagaggcugcg

SEQ ID NO: 4177869 - RNA, 13 nt, Yersinia pestis KIM
ugcgacaggcuca

SEQ ID NO: 4177870 - RNA, 17 nt, Yersinia pestis KIM
ugcgacgacgacaauga

SEQ ID NO: 4177871 - RNA, 14 nt, Yersinia pestis KIM
ugcgacgcagaaua

SEQ ID NO: 4177872 - RNA, 16 nt, Yersinia pestis KIM
ugcgagauauaaacua

SEQ ID NO: 4177873 - RNA, 14 nt, Yersinia pestis KIM
ugcgagcaaggcau

SEQ ID NO: 4177874 - RNA, 21 nt, Yersinia pestis KIM
ugcgauacaccauuuccaggc

SEQ ID NO: 4177875 - RNA, 14 nt, Yersinia pestis KIM
ugcgaucuauccaa

SEQ ID NO: 4177876 - RNA, 21 nt, Yersinia pestis KIM
ugcgauguuuuccaacuccau

SEQ ID NO: 4177877 - RNA, 21 nt, Yersinia pestis KIM
ugcgauuuaauguucauucaa

SEQ ID NO: 4177878 - RNA, 18 nt, Yersinia pestis KIM
ugcgcaaaauuaagacau

SEQ ID NO: 4177879 - RNA, 22 nt, Yersinia pestis KIM
ugcgcagcguccauaaacccgg

SEQ ID NO: 4177880 - RNA, 18 nt, Yersinia pestis KIM
ugcgccaaaugucaccag

SEQ ID NO: 4177881 - RNA, 12 nt, Yersinia pestis KIM
ugcgccagcagc

SEQ ID NO: 4177882 - RNA, 13 nt, Yersinia pestis KIM
ugcgccagcagca

SEQ ID NO: 4177883 - RNA, 14 nt, Yersinia pestis KIM
ugcgccauaaugcg

SEQ ID NO: 4177884 - RNA, 16 nt, Yersinia pestis KIM
ugcgccggagaggcuu

SEQ ID NO: 4177885 - RNA, 16 nt, Yersinia pestis KIM
ugcgcgaaauauugcc

SEQ ID NO: 4177886 - RNA, 17 nt, Yersinia pestis KIM
ugcgcgaccaaguuuga

SEQ ID NO: 4177887 - RNA, 12 nt, Yersinia pestis KIM
ugcgcgcagcaa

SEQ ID NO: 4177888 - RNA, 14 nt, Yersinia pestis KIM
ugcgcgcagcaagc

SEQ ID NO: 4177889 - RNA, 18 nt, Yersinia pestis KIM
ugcgcggguaacaacuca

SEQ ID NO: 4177890 - RNA, 22 nt, Yersinia pestis KIM
ugcgcggguaacaacucaccgc

SEQ ID NO: 4177891 - RNA, 19 nt, Yersinia pestis KIM
ugcgcgguugucggcauaa

SEQ ID NO: 4177892 - RNA, 19 nt, Yersinia pestis KIM
ugcgcguuaaucugcugcu

SEQ ID NO: 4177893 - RNA, 17 nt, Yersinia pestis KIM
ugcgcuacgcaugaugc

SEQ ID NO: 4177894 - RNA, 17 nt, Yersinia pestis KIM
ugcgcucacuuuuauug

SEQ ID NO: 4177895 - RNA, 20 nt, Yersinia pestis KIM
ugcgcuccacgccccaacgg

SEQ ID NO: 4177896 - RNA, 17 nt, Yersinia pestis KIM
ugcgcugagugauagug

SEQ ID NO: 4177897 - RNA, 23 nt, Yersinia pestis KIM
ugcggaagcgccgacacccagcc

SEQ ID NO: 4177898 - RNA, 14 nt, Yersinia pestis KIM
ugcggacagcgcgc

SEQ ID NO: 4177899 - RNA, 21 nt, Yersinia pestis KIM
ugcggauucacccauuaauag

SEQ ID NO: 4177900 - RNA, 19 nt, Yersinia pestis KIM
ugcggcaauaagcauuauu

SEQ ID NO: 4177901 - RNA, 12 nt, Yersinia pestis KIM
ugcggcagugaa

SEQ ID NO: 4177902 - RNA, 13 nt, Yersinia pestis KIM
ugcggccauccag

SEQ ID NO: 4177903 - RNA, 19 nt, Yersinia pestis KIM
ugcggcggagagaaauagg

SEQ ID NO: 4177904 - RNA, 13 nt, Yersinia pestis KIM
ugcgggaauagcu

SEQ ID NO: 4177905 - RNA, 19 nt, Yersinia pestis KIM
ugcgggcuaaaacuggcac

SEQ ID NO: 4177906 - RNA, 18 nt, Yersinia pestis KIM
ugcgguagaccaccaacu

SEQ ID NO: 4177907 - RNA, 13 nt, Yersinia pestis KIM
ugcgguaguucag

SEQ ID NO: 4177908 - RNA, 14 nt, Yersinia pestis KIM
ugcggucuggcaac

SEQ ID NO: 4177909 - RNA, 15 nt, Yersinia pestis KIM
ugcgguggccagagc

SEQ ID NO: 4177910 - RNA, 20 nt, Yersinia pestis KIM
ugcgguuuguuugcaucugg

SEQ ID NO: 4177911 - RNA, 15 nt, Yersinia pestis KIM
ugcguaaaugaaauu

SEQ ID NO: 4177912 - RNA, 16 nt, Yersinia pestis KIM
ugcguaaauuacguuc

SEQ ID NO: 4177913 - RNA, 18 nt, Yersinia pestis KIM
ugcguaauuacccaagau

SEQ ID NO: 4177914 - RNA, 15 nt, Yersinia pestis KIM
ugcguauuaucauca

SEQ ID NO: 4177915 - RNA, 16 nt, Yersinia pestis KIM
ugcguauuaucaucac

SEQ ID NO: 4177916 - RNA, 14 nt, Yersinia pestis KIM
ugcguuuagcuucc

SEQ ID NO: 4177917 - RNA, 19 nt, Yersinia pestis KIM
ugcguuuguaggggagguc

SEQ ID NO: 4177918 - RNA, 16 nt, Yersinia pestis KIM
ugcuaacaaaguccug

SEQ ID NO: 4177919 - RNA, 16 nt, Yersinia pestis KIM
ugcuaaccgaauaaaa

SEQ ID NO: 4177920 - RNA, 12 nt, Yersinia pestis KIM
ugcuaaccgccu

SEQ ID NO: 4177921 - RNA, 23 nt, Yersinia pestis KIM
ugcuaagggaguauacggucaaa

SEQ ID NO: 4177922 - RNA, 20 nt, Yersinia pestis KIM
ugcuaauaccaccaccacac

SEQ ID NO: 4177923 - RNA, 13 nt, Yersinia pestis KIM
ugcuacagcagca

SEQ ID NO: 4177924 - RNA, 14 nt, Yersinia pestis KIM
ugcuacagcagcag

SEQ ID NO: 4177925 - RNA, 19 nt, Yersinia pestis KIM
ugcuaccuguaacauuacu

SEQ ID NO: 4177926 - RNA, 13 nt, Yersinia pestis KIM
ugcuacugaaggu

SEQ ID NO: 4177927 - RNA, 14 nt, Yersinia pestis KIM
ugcuacuuaauauc

SEQ ID NO: 4177928 - RNA, 17 nt, Yersinia pestis KIM
ugcuacuuaauaucuaa

SEQ ID NO: 4177929 - RNA, 20 nt, Yersinia pestis KIM
ugcuagcagaggcaaauucc

SEQ ID NO: 4177930 - RNA, 19 nt, Yersinia pestis KIM
ugcuauccucuuaaugucu

SEQ ID NO: 4177931 - RNA, 18 nt, Yersinia pestis KIM
ugcuaucggcggagagaa

SEQ ID NO: 4177932 - RNA, 16 nt, Yersinia pestis KIM
ugcuauuaaacauuua

SEQ ID NO: 4177933 - RNA, 13 nt, Yersinia pestis KIM
ugcuauugaacau

SEQ ID NO: 4177934 - RNA, 11 nt, Yersinia pestis KIM
ugcucaacaua

SEQ ID NO: 4177935 - RNA, 12 nt, Yersinia pestis KIM
ugcucaacugcu

SEQ ID NO: 4177936 - RNA, 15 nt, Yersinia pestis KIM
ugcucaacugcucaa

SEQ ID NO: 4177937 - RNA, 18 nt, Yersinia pestis KIM
ugcucaccauguacaugg

SEQ ID NO: 4177938 - RNA, 23 nt, Yersinia pestis KIM
ugcucacccauuuuauccucuuc

SEQ ID NO: 4177939 - RNA, 18 nt, Yersinia pestis KIM
ugcucacgcguaaaugga

SEQ ID NO: 4177940 - RNA, 17 nt, Yersinia pestis KIM
ugcucacgguagguuuc

SEQ ID NO: 4177941 - RNA, 18 nt, Yersinia pestis KIM
ugcucagauacaucaaug

SEQ ID NO: 4177942 - RNA, 19 nt, Yersinia pestis KIM
ugcucagcgggcuaaaugc

SEQ ID NO: 4177943 - RNA, 16 nt, Yersinia pestis KIM
ugcucagcuaaagaac

SEQ ID NO: 4177944 - RNA, 14 nt, Yersinia pestis KIM
ugcucaggccuugc

SEQ ID NO: 4177945 - RNA, 15 nt, Yersinia pestis KIM
ugcucagggccacuu

SEQ ID NO: 4177946 - RNA, 20 nt, Yersinia pestis KIM
ugcucagggccacuucggug

SEQ ID NO: 4177947 - RNA, 22 nt, Yersinia pestis KIM
ugcucauaaagcaucagacugc

SEQ ID NO: 4177948 - RNA, 20 nt, Yersinia pestis KIM
ugcucauagcccugcugcuu

SEQ ID NO: 4177949 - RNA, 23 nt, Yersinia pestis KIM
ugcucauguucgcacugcucugc

SEQ ID NO: 4177950 - RNA, 18 nt, Yersinia pestis KIM
ugcuccaaagcuuccaau

SEQ ID NO: 4177951 - RNA, 22 nt, Yersinia pestis KIM
ugcuccagaggguaugacauuc

SEQ ID NO: 4177952 - RNA, 12 nt, Yersinia pestis KIM
ugcuccagcacu

SEQ ID NO: 4177953 - RNA, 21 nt, Yersinia pestis KIM
ugcuccaguugauacaggaaa

SEQ ID NO: 4177954 - RNA, 14 nt, Yersinia pestis KIM
ugcucccggcgcua

SEQ ID NO: 4177955 - RNA, 18 nt, Yersinia pestis KIM
ugcuccgcagugaucagu

SEQ ID NO: 4177956 - RNA, 19 nt, Yersinia pestis KIM
ugcuccgcagugaucaguc

SEQ ID NO: 4177957 - RNA, 12 nt, Yersinia pestis KIM
ugcuccuuacua

SEQ ID NO: 4177958 - RNA, 21 nt, Yersinia pestis KIM
ugcuccuuacuauuuucauug

SEQ ID NO: 4177959 - RNA, 22 nt, Yersinia pestis KIM
ugcucgaucagcgucagcagau

SEQ ID NO: 4177960 - RNA, 19 nt, Yersinia pestis KIM
ugcucgcccaagcggcugg

SEQ ID NO: 4177961 - RNA, 16 nt, Yersinia pestis KIM
ugcucgcuaaucaagc

SEQ ID NO: 4177962 - RNA, 16 nt, Yersinia pestis KIM
ugcucggcuaaacggu

SEQ ID NO: 4177963 - RNA, 17 nt, Yersinia pestis KIM
ugcucuaacguuaaaag

SEQ ID NO: 4177964 - RNA, 15 nt, Yersinia pestis KIM
ugcucucauuuaaua

SEQ ID NO: 4177965 - RNA, 17 nt, Yersinia pestis KIM
ugcucucuucauagcua

SEQ ID NO: 4177966 - RNA, 15 nt, Yersinia pestis KIM
ugcucugcaauacug

SEQ ID NO: 4177967 - RNA, 20 nt, Yersinia pestis KIM
ugcucuucaccaaaggaagc

SEQ ID NO: 4177968 - RNA, 16 nt, Yersinia pestis KIM
ugcucuucccugcgcu

SEQ ID NO: 4177969 - RNA, 20 nt, Yersinia pestis KIM
ugcucuugaguguccacaua

SEQ ID NO: 4177970 - RNA, 15 nt, Yersinia pestis KIM
ugcugaaaaaugagu

SEQ ID NO: 4177971 - RNA, 19 nt, Yersinia pestis KIM
ugcugaaaaucaugaaauu

SEQ ID NO: 4177972 - RNA, 16 nt, Yersinia pestis KIM
ugcugagccaaauaau

SEQ ID NO: 4177973 - RNA, 15 nt, Yersinia pestis KIM
ugcugagugaagaca

SEQ ID NO: 4177974 - RNA, 17 nt, Yersinia pestis KIM
ugcugagugaagacauc

SEQ ID NO: 4177975 - RNA, 14 nt, Yersinia pestis KIM
ugcugaugcaauaa

SEQ ID NO: 4177976 - RNA, 18 nt, Yersinia pestis KIM
ugcugaugcaauaacucc

SEQ ID NO: 4177977 - RNA, 21 nt, Yersinia pestis KIM
ugcugaugucagugcuccauc

SEQ ID NO: 4177978 - RNA, 23 nt, Yersinia pestis KIM
ugcugauucugacguuggcucug

SEQ ID NO: 4177979 - RNA, 17 nt, Yersinia pestis KIM
ugcugauuugccagauu

SEQ ID NO: 4177980 - RNA, 16 nt, Yersinia pestis KIM
ugcugcaccucugcug

SEQ ID NO: 4177981 - RNA, 17 nt, Yersinia pestis KIM
ugcugccugcaccagug

SEQ ID NO: 4177982 - RNA, 17 nt, Yersinia pestis KIM
ugcugcgaagaucacuc

SEQ ID NO: 4177983 - RNA, 20 nt, Yersinia pestis KIM
ugcugcgaagaucacucaug

SEQ ID NO: 4177984 - RNA, 19 nt, Yersinia pestis KIM
ugcugcugcccgcgaauaa

SEQ ID NO: 4177985 - RNA, 14 nt, Yersinia pestis KIM
ugcugcuuccugcu

SEQ ID NO: 4177986 - RNA, 20 nt, Yersinia pestis KIM
ugcuggaacgguugcccguu

SEQ ID NO: 4177987 - RNA, 19 nt, Yersinia pestis KIM
ugcuggaaugcagugccac

SEQ ID NO: 4177988 - RNA, 18 nt, Yersinia pestis KIM
ugcuggcauggaugguca

SEQ ID NO: 4177989 - RNA, 13 nt, Yersinia pestis KIM
ugcuggcgcaacu

SEQ ID NO: 4177990 - RNA, 14 nt, Yersinia pestis KIM
ugcuggugucacaa

SEQ ID NO: 4177991 - RNA, 14 nt, Yersinia pestis KIM
ugcuguaaugccug

SEQ ID NO: 4177992 - RNA, 14 nt, Yersinia pestis KIM
ugcuguauuuuucg

SEQ ID NO: 4177993 - RNA, 13 nt, Yersinia pestis KIM
ugcuguuccaacc

SEQ ID NO: 4177994 - RNA, 15 nt, Yersinia pestis KIM
ugcuguucuggcagg

SEQ ID NO: 4177995 - RNA, 21 nt, Yersinia pestis KIM
ugcuguuguagcgccagguaa

SEQ ID NO: 4177996 - RNA, 22 nt, Yersinia pestis KIM
ugcuguuguuauuacugucacu

SEQ ID NO: 4177997 - RNA, 24 nt, Yersinia pestis KIM
ugcuguuguuauuacugucacugu

SEQ ID NO: 4177998 - RNA, 22 nt, Yersinia pestis KIM
ugcuguuuugucacaaugcugu

SEQ ID NO: 4177999 - RNA, 12 nt, Yersinia pestis KIM
ugcuuaaaacag

SEQ ID NO: 4178000 - RNA, 23 nt, Yersinia pestis KIM
ugcuuaaaacaggcgaguuuccc

SEQ ID NO: 4178001 - RNA, 13 nt, Yersinia pestis KIM
ugcuuaccuuguu

SEQ ID NO: 4178002 - RNA, 22 nt, Yersinia pestis KIM
ugcuuaccuuguuuguuacugc

SEQ ID NO: 4178003 - RNA, 19 nt, Yersinia pestis KIM
ugcuucacggacagcaacc

SEQ ID NO: 4178004 - RNA, 19 nt, Yersinia pestis KIM
ugcuucauccaacuuaccu

SEQ ID NO: 4178005 - RNA, 18 nt, Yersinia pestis KIM
ugcuuccaacucaccuaa

SEQ ID NO: 4178006 - RNA, 16 nt, Yersinia pestis KIM
ugcuuccaggauauuc

SEQ ID NO: 4178007 - RNA, 17 nt, Yersinia pestis KIM
ugcuugaguccaaccac

SEQ ID NO: 4178008 - RNA, 15 nt, Yersinia pestis KIM
ugcuugccagcgcuu

SEQ ID NO: 4178009 - RNA, 22 nt, Yersinia pestis KIM
ugcuugccagcgcuuuaggcaa

SEQ ID NO: 4178010 - RNA, 18 nt, Yersinia pestis KIM
ugcuuggacucuggaauu

SEQ ID NO: 4178011 - RNA, 22 nt, Yersinia pestis KIM
ugcuuuaaucgccagacuguuc

SEQ ID NO: 4178012 - RNA, 18 nt, Yersinia pestis KIM
ugcuuuaucguagccaau

SEQ ID NO: 4178013 - RNA, 19 nt, Yersinia pestis KIM
ugcuuuccacgcccaacuc

SEQ ID NO: 4178014 - RNA, 22 nt, Yersinia pestis KIM
ugcuuugcgaaauaaguuaaua

SEQ ID NO: 4178015 - RNA, 15 nt, Yersinia pestis KIM
ugcuuugcuucaucc

SEQ ID NO: 4178016 - RNA, 19 nt, Yersinia pestis KIM
ugcuuugugggcuuuugcu

SEQ ID NO: 4178017 - RNA, 14 nt, Yersinia pestis KIM
ugcuuuucugccua

SEQ ID NO: 4178018 - RNA, 21 nt, Yersinia pestis KIM
ugcuuuuuauugucucuacuc

SEQ ID NO: 4178019 - RNA, 13 nt, Yersinia pestis KIM
ugcuuuuugcgcu

SEQ ID NO: 4178020 - RNA, 16 nt, Yersinia pestis KIM
ugcuuuuugcgcugcg

SEQ ID NO: 4178021 - RNA, 15 nt, Yersinia pestis KIM
ugcuuuuugcuuuuu

SEQ ID NO: 4178022 - RNA, 18 nt, Yersinia pestis KIM
ugcuuuuugcuuuuugcu

SEQ ID NO: 4178023 - RNA, 23 nt, Yersinia pestis KIM
ugcuuuuuuauaugcuguauaaa

SEQ ID NO: 4178024 - RNA, 12 nt, Yersinia pestis KIM
ugcuuuuuucac

SEQ ID NO: 4178025 - RNA, 14 nt, Yersinia pestis KIM
ugcuuuuuucacac

SEQ ID NO: 4178026 - RNA, 18 nt, Yersinia pestis KIM
uggaaaaaauaauggcca

SEQ ID NO: 4178027 - RNA, 18 nt, Yersinia pestis KIM
uggaaacucuaaggguaa

SEQ ID NO: 4178028 - RNA, 14 nt, Yersinia pestis KIM
uggaaauagaaaac

SEQ ID NO: 4178029 - RNA, 17 nt, Yersinia pestis KIM
uggaacaggauuuucaa

SEQ ID NO: 4178030 - RNA, 13 nt, Yersinia pestis KIM
uggaacgugacau

SEQ ID NO: 4178031 - RNA, 18 nt, Yersinia pestis KIM
uggaacguugcacccugc

SEQ ID NO: 4178032 - RNA, 16 nt, Yersinia pestis KIM
uggaacuguaaauauc

SEQ ID NO: 4178033 - RNA, 20 nt, Yersinia pestis KIM
uggaagaaucaccgaaagaa

SEQ ID NO: 4178034 - RNA, 14 nt, Yersinia pestis KIM
uggaagaccagaua

SEQ ID NO: 4178035 - RNA, 12 nt, Yersinia pestis KIM
uggaagagccug

SEQ ID NO: 4178036 - RNA, 18 nt, Yersinia pestis KIM
uggaagcagaauacugug

SEQ ID NO: 4178037 - RNA, 20 nt, Yersinia pestis KIM
uggaagggaguuacucagca

SEQ ID NO: 4178038 - RNA, 14 nt, Yersinia pestis KIM
uggaaguuaaaaaa

SEQ ID NO: 4178039 - RNA, 16 nt, Yersinia pestis KIM
uggaaguuaaaaaaau

SEQ ID NO: 4178040 - RNA, 16 nt, Yersinia pestis KIM
uggaauguucauucaa

SEQ ID NO: 4178041 - RNA, 17 nt, Yersinia pestis KIM
uggacaaauaaaacaga

SEQ ID NO: 4178042 - RNA, 14 nt, Yersinia pestis KIM
uggacaucugcuuu

SEQ ID NO: 4178043 - RNA, 19 nt, Yersinia pestis KIM
uggacccgucaccacaaag

SEQ ID NO: 4178044 - RNA, 18 nt, Yersinia pestis KIM
uggacgauaaauucaaau

SEQ ID NO: 4178045 - RNA, 18 nt, Yersinia pestis KIM
uggacggaacacguuuaa

SEQ ID NO: 4178046 - RNA, 17 nt, Yersinia pestis KIM
uggagaacucauuuuuu

SEQ ID NO: 4178047 - RNA, 12 nt, Yersinia pestis KIM
uggagaggcgcu

SEQ ID NO: 4178048 - RNA, 17 nt, Yersinia pestis KIM
uggagagugugcugcga

SEQ ID NO: 4178049 - RNA, 18 nt, Yersinia pestis KIM
uggagcaaaugaacgcga

SEQ ID NO: 4178050 - RNA, 18 nt, Yersinia pestis KIM
uggagccgcuagcgcagg

SEQ ID NO: 4178051 - RNA, 20 nt, Yersinia pestis KIM
uggaggaaggcgguuaucug

SEQ ID NO: 4178052 - RNA, 23 nt, Yersinia pestis KIM
uggaggaaggcgguuaucuggaa

SEQ ID NO: 4178053 - RNA, 14 nt, Yersinia pestis KIM
uggaguuguugcca

SEQ ID NO: 4178054 - RNA, 17 nt, Yersinia pestis KIM
uggauaacugaccugcg

SEQ ID NO: 4178055 - RNA, 13 nt, Yersinia pestis KIM
uggauaaugcuga

SEQ ID NO: 4178056 - RNA, 19 nt, Yersinia pestis KIM
uggauaauguccuauuuaa

SEQ ID NO: 4178057 - RNA, 14 nt, Yersinia pestis KIM
uggauaauuucagc

SEQ ID NO: 4178058 - RNA, 22 nt, Yersinia pestis KIM
uggauagggauuguuuucaaau

SEQ ID NO: 4178059 - RNA, 12 nt, Yersinia pestis KIM
uggaucagcaga

SEQ ID NO: 4178060 - RNA, 14 nt, Yersinia pestis KIM
uggaucauggcuuu

SEQ ID NO: 4178061 - RNA, 21 nt, Yersinia pestis KIM
uggaucugcacaccacacugg

SEQ ID NO: 4178062 - RNA, 16 nt, Yersinia pestis KIM
uggauguauuuacggc

SEQ ID NO: 4178063 - RNA, 22 nt, Yersinia pestis KIM
uggauuaucggcggcuugcuug

SEQ ID NO: 4178064 - RNA, 15 nt, Yersinia pestis KIM
uggauucuugcugca

SEQ ID NO: 4178065 - RNA, 14 nt, Yersinia pestis KIM
uggauuuaaugcug

SEQ ID NO: 4178066 - RNA, 18 nt, Yersinia pestis KIM
uggauuuacguuuuuuua

SEQ ID NO: 4178067 - RNA, 15 nt, Yersinia pestis KIM
uggauuuucaaauca

SEQ ID NO: 4178068 - RNA, 20 nt, Yersinia pestis KIM
uggauuuucaaaucaugcau

SEQ ID NO: 4178069 - RNA, 19 nt, Yersinia pestis KIM
uggcaaacauccguuccca

SEQ ID NO: 4178070 - RNA, 21 nt, Yersinia pestis KIM
uggcaaacgcugcacaucauu

SEQ ID NO: 4178071 - RNA, 13 nt, Yersinia pestis KIM
uggcaaaggccag

SEQ ID NO: 4178072 - RNA, 22 nt, Yersinia pestis KIM
uggcaaauaagggauaugaaua

SEQ ID NO: 4178073 - RNA, 23 nt, Yersinia pestis KIM
uggcaaauuuagccgcaacuacu

SEQ ID NO: 4178074 - RNA, 23 nt, Yersinia pestis KIM
uggcaacaaaaucgcgaccagca

SEQ ID NO: 4178075 - RNA, 16 nt, Yersinia pestis KIM
uggcaacaucaggcuu

SEQ ID NO: 4178076 - RNA, 20 nt, Yersinia pestis KIM
uggcaaccgguaacauauaa

SEQ ID NO: 4178077 - RNA, 14 nt, Yersinia pestis KIM
uggcaacgacuggg

SEQ ID NO: 4178078 - RNA, 19 nt, Yersinia pestis KIM
uggcaacucuagcgccagc

SEQ ID NO: 4178079 - RNA, 14 nt, Yersinia pestis KIM
uggcaacugcaaau

SEQ ID NO: 4178080 - RNA, 20 nt, Yersinia pestis KIM
uggcaacugcaaauguucaa

SEQ ID NO: 4178081 - RNA, 23 nt, Yersinia pestis KIM
uggcaaucacaacccccccgacc

SEQ ID NO: 4178082 - RNA, 13 nt, Yersinia pestis KIM
uggcaaucauggg

SEQ ID NO: 4178083 - RNA, 23 nt, Yersinia pestis KIM
uggcaauuaugacguucaguagu

SEQ ID NO: 4178084 - RNA, 18 nt, Yersinia pestis KIM
uggcaauuucuguuacca

SEQ ID NO: 4178085 - RNA, 12 nt, Yersinia pestis KIM
uggcacccagug

SEQ ID NO: 4178086 - RNA, 19 nt, Yersinia pestis KIM
uggcaccguggauaaacaa

SEQ ID NO: 4178087 - RNA, 17 nt, Yersinia pestis KIM
uggcacgccaguuggga

SEQ ID NO: 4178088 - RNA, 16 nt, Yersinia pestis KIM
uggcacugauuuuuuc

SEQ ID NO: 4178089 - RNA, 22 nt, Yersinia pestis KIM
uggcacugcauuugauacuaaa

SEQ ID NO: 4178090 - RNA, 23 nt, Yersinia pestis KIM
uggcacuggaaacaaaaccuaac

SEQ ID NO: 4178091 - RNA, 20 nt, Yersinia pestis KIM
uggcagccuuuauccagcca

SEQ ID NO: 4178092 - RNA, 15 nt, Yersinia pestis KIM
uggcagggccgauaa

SEQ ID NO: 4178093 - RNA, 14 nt, Yersinia pestis KIM
uggcaguauuuuaa

SEQ ID NO: 4178094 - RNA, 19 nt, Yersinia pestis KIM
uggcaguauuuuaagaaaa

SEQ ID NO: 4178095 - RNA, 18 nt, Yersinia pestis KIM
uggcauauucaccagaca

SEQ ID NO: 4178096 - RNA, 19 nt, Yersinia pestis KIM
uggcaucaauauaacgccc

SEQ ID NO: 4178097 - RNA, 17 nt, Yersinia pestis KIM
uggcaugacuuagcacg

SEQ ID NO: 4178098 - RNA, 15 nt, Yersinia pestis KIM
uggcaugccaugcac

SEQ ID NO: 4178099 - RNA, 16 nt, Yersinia pestis KIM
uggcauggauaucagc

SEQ ID NO: 4178100 - RNA, 13 nt, Yersinia pestis KIM
uggcaugugggca

SEQ ID NO: 4178101 - RNA, 23 nt, Yersinia pestis KIM
uggcauuuaaaaggcgcuggauu

SEQ ID NO: 4178102 - RNA, 22 nt, Yersinia pestis KIM
uggccaacaggcggguucuuca

SEQ ID NO: 4178103 - RNA, 16 nt, Yersinia pestis KIM
uggccacucaccucag

SEQ ID NO: 4178104 - RNA, 20 nt, Yersinia pestis KIM
uggccacugcgggcaguaac

SEQ ID NO: 4178105 - RNA, 18 nt, Yersinia pestis KIM
uggccaguugccacucau

SEQ ID NO: 4178106 - RNA, 14 nt, Yersinia pestis KIM
uggccaugaaucaa

SEQ ID NO: 4178107 - RNA, 18 nt, Yersinia pestis KIM
uggccauuaaccuaaaaa

SEQ ID NO: 4178108 - RNA, 20 nt, Yersinia pestis KIM
uggcccaaaugagcagcaau

SEQ ID NO: 4178109 - RNA, 13 nt, Yersinia pestis KIM
uggcccaagccau

SEQ ID NO: 4178110 - RNA, 19 nt, Yersinia pestis KIM
uggcccaagccauccuuuu

SEQ ID NO: 4178111 - RNA, 14 nt, Yersinia pestis KIM
uggcccaauaaaag

SEQ ID NO: 4178112 - RNA, 18 nt, Yersinia pestis KIM
uggcccauaacaauuaau

SEQ ID NO: 4178113 - RNA, 14 nt, Yersinia pestis KIM
uggcccaucuaugg

SEQ ID NO: 4178114 - RNA, 23 nt, Yersinia pestis KIM
uggccccuaaugcgcucaccaag

SEQ ID NO: 4178115 - RNA, 13 nt, Yersinia pestis KIM
uggccccugaaua

SEQ ID NO: 4178116 - RNA, 13 nt, Yersinia pestis KIM
uggcccgcugguc

SEQ ID NO: 4178117 - RNA, 19 nt, Yersinia pestis KIM
uggcccugagguuauugac

SEQ ID NO: 4178118 - RNA, 16 nt, Yersinia pestis KIM
uggcccuggaacacca

SEQ ID NO: 4178119 - RNA, 17 nt, Yersinia pestis KIM
uggccgccgcggugaag

SEQ ID NO: 4178120 - RNA, 13 nt, Yersinia pestis KIM
uggccgcuacugg

SEQ ID NO: 4178121 - RNA, 14 nt, Yersinia pestis KIM
uggccuaacaacug

SEQ ID NO: 4178122 - RNA, 20 nt, Yersinia pestis KIM
uggccucagacuaaugacaa

SEQ ID NO: 4178123 - RNA, 13 nt, Yersinia pestis KIM
uggccugaugcac

SEQ ID NO: 4178124 - RNA, 21 nt, Yersinia pestis KIM
uggccugcggcgguuacccuc

SEQ ID NO: 4178125 - RNA, 16 nt, Yersinia pestis KIM
uggccuggcugauacu

SEQ ID NO: 4178126 - RNA, 14 nt, Yersinia pestis KIM
uggcgaaaaucaag

SEQ ID NO: 4178127 - RNA, 20 nt, Yersinia pestis KIM
uggcgacgugaugccaguaa

SEQ ID NO: 4178128 - RNA, 15 nt, Yersinia pestis KIM
uggcgacguugccuc

SEQ ID NO: 4178129 - RNA, 19 nt, Yersinia pestis KIM
ucuagcaacacaucgguau

SEQ ID NO: 4178130 - RNA, 18 nt, Yersinia pestis KIM
ucuagcagugauuucagu

SEQ ID NO: 4178131 - RNA, 20 nt, Yersinia pestis KIM
ucuagcagugauuucagugu

SEQ ID NO: 4178132 - RNA, 17 nt, Yersinia pestis KIM
ucuagcccuucagcaaa

SEQ ID NO: 4178133 - RNA, 23 nt, Yersinia pestis KIM
ucuagcgacggagagucagcaag

SEQ ID NO: 4178134 - RNA, 19 nt, Yersinia pestis KIM
ucuagcuguagcaauauau

SEQ ID NO: 4178135 - RNA, 19 nt, Yersinia pestis KIM
ucuaggugcucugccuuau

SEQ ID NO: 4178136 - RNA, 20 nt, Yersinia pestis KIM
ucuaguacguaaauuuauuu

SEQ ID NO: 4178137 - RNA, 13 nt, Yersinia pestis KIM
ucuauaaaaccgu

SEQ ID NO: 4178138 - RNA, 12 nt, Yersinia pestis KIM
ucuauaauucag

SEQ ID NO: 4178139 - RNA, 17 nt, Yersinia pestis KIM
ucuauauagggaaauaa

SEQ ID NO: 4178140 - RNA, 19 nt, Yersinia pestis KIM
ucuauauuggacaguaagu

SEQ ID NO: 4178141 - RNA, 20 nt, Yersinia pestis KIM
ucuaucagaccuuuaggaaa

SEQ ID NO: 4178142 - RNA, 13 nt, Yersinia pestis KIM
ucuaucauccuug

SEQ ID NO: 4178143 - RNA, 14 nt, Yersinia pestis KIM
ucuaucccuauuuu

SEQ ID NO: 4178144 - RNA, 17 nt, Yersinia pestis KIM
ucuauccgaaaaauauu

SEQ ID NO: 4178145 - RNA, 13 nt, Yersinia pestis KIM
ucuaucucaggcu

SEQ ID NO: 4178146 - RNA, 18 nt, Yersinia pestis KIM
ucuaucucaucuuaauca

SEQ ID NO: 4178147 - RNA, 22 nt, Yersinia pestis KIM
ucuaucuucuucucagauauca

SEQ ID NO: 4178148 - RNA, 20 nt, Yersinia pestis KIM
ucuaucuugucguuauuuuc

SEQ ID NO: 4178149 - RNA, 18 nt, Yersinia pestis KIM
ucuaugccaguuauuauu

SEQ ID NO: 4178150 - RNA, 16 nt, Yersinia pestis KIM
ucuauuaccucaauac

SEQ ID NO: 4178151 - RNA, 18 nt, Yersinia pestis KIM
ucuauucugcuuuuugcu

SEQ ID NO: 4178152 - RNA, 20 nt, Yersinia pestis KIM
ucuauugaaaaaauaauguc

SEQ ID NO: 4178153 - RNA, 16 nt, Yersinia pestis KIM
ucuauugugucaauac

SEQ ID NO: 4178154 - RNA, 18 nt, Yersinia pestis KIM
ucuauuguuacuuuuaau

SEQ ID NO: 4178155 - RNA, 21 nt, Yersinia pestis KIM
ucuauuuauuuauaaaaccac

SEQ ID NO: 4178156 - RNA, 18 nt, Yersinia pestis KIM
ucuauuucaugauucucu

SEQ ID NO: 4178157 - RNA, 11 nt, Yersinia pestis KIM
ucuauuuccac

SEQ ID NO: 4178158 - RNA, 12 nt, Yersinia pestis KIM
ucuauuuccauc

SEQ ID NO: 4178159 - RNA, 13 nt, Yersinia pestis KIM
ucuauuuuuauuu

SEQ ID NO: 4178160 - RNA, 23 nt, Yersinia pestis KIM
ucuauuuuuauuucuccuuacua

SEQ ID NO: 4178161 - RNA, 13 nt, Yersinia pestis KIM
ucucaaccaaaua

SEQ ID NO: 4178162 - RNA, 15 nt, Yersinia pestis KIM
ucucaaccgcuggca

SEQ ID NO: 4178163 - RNA, 17 nt, Yersinia pestis KIM
ucucaauauauucucuu

SEQ ID NO: 4178164 - RNA, 16 nt, Yersinia pestis KIM
ucucaccgcuggaagc

SEQ ID NO: 4178165 - RNA, 20 nt, Yersinia pestis KIM
ucucacgcugaauaacaaaa

SEQ ID NO: 4178166 - RNA, 19 nt, Yersinia pestis KIM
ucucacugcuccagccaac

SEQ ID NO: 4178167 - RNA, 16 nt, Yersinia pestis KIM
ucucagaacaagacag

SEQ ID NO: 4178168 - RNA, 15 nt, Yersinia pestis KIM
ucucaggcucagcgg

SEQ ID NO: 4178169 - RNA, 21 nt, Yersinia pestis KIM
ucucaggugugagguuauuga

SEQ ID NO: 4178170 - RNA, 18 nt, Yersinia pestis KIM
ucucaguugaaacccaca

SEQ ID NO: 4178171 - RNA, 15 nt, Yersinia pestis KIM
ucucaucggcauacu

SEQ ID NO: 4178172 - RNA, 23 nt, Yersinia pestis KIM
ucucaucggcauacuccuuaauc

SEQ ID NO: 4178173 - RNA, 14 nt, Yersinia pestis KIM
ucucauuaauaaug

SEQ ID NO: 4178174 - RNA, 15 nt, Yersinia pestis KIM
ucucauuaauaauga

SEQ ID NO: 4178175 - RNA, 14 nt, Yersinia pestis KIM
ucucauuauuuauu

SEQ ID NO: 4178176 - RNA, 18 nt, Yersinia pestis KIM
ucuccagugcaaauuuau

SEQ ID NO: 4178177 - RNA, 17 nt, Yersinia pestis KIM
ucuccaguugccagcag

SEQ ID NO: 4178178 - RNA, 17 nt, Yersinia pestis KIM
ucuccaucucuaauugu

SEQ ID NO: 4178179 - RNA, 21 nt, Yersinia pestis KIM
ucuccaugauauaucagucuu

SEQ ID NO: 4178180 - RNA, 19 nt, Yersinia pestis KIM
ucucccauuaauuaaucag

SEQ ID NO: 4178181 - RNA, 14 nt, Yersinia pestis KIM
ucucccucagugag

SEQ ID NO: 4178182 - RNA, 23 nt, Yersinia pestis KIM
ucuccguugcaggcacuuuguca

SEQ ID NO: 4178183 - RNA, 23 nt, Yersinia pestis KIM
ucuccucuccccuaccucauccg

SEQ ID NO: 4178184 - RNA, 18 nt, Yersinia pestis KIM
ucucgacaaauccuuuua

SEQ ID NO: 4178185 - RNA, 20 nt, Yersinia pestis KIM
ucucgacauccaauucagua

SEQ ID NO: 4178186 - RNA, 13 nt, Yersinia pestis KIM
ucucguggcguuc

SEQ ID NO: 4178187 - RNA, 14 nt, Yersinia pestis KIM
ucucguucuuaacc

SEQ ID NO: 4178188 - RNA, 17 nt, Yersinia pestis KIM
ucucuauuguucaggga

SEQ ID NO: 4178189 - RNA, 13 nt, Yersinia pestis KIM
ucucucaauauau

SEQ ID NO: 4178190 - RNA, 16 nt, Yersinia pestis KIM
ucucucacuuuggcgc

SEQ ID NO: 4178191 - RNA, 13 nt, Yersinia pestis KIM
ucucuccaugaua

SEQ ID NO: 4178192 - RNA, 18 nt, Yersinia pestis KIM
ucucuccgcaaugccucu

SEQ ID NO: 4178193 - RNA, 23 nt, Yersinia pestis KIM
ucucuccuauaucucaguugaaa

SEQ ID NO: 4178194 - RNA, 13 nt, Yersinia pestis KIM
ucucucuaugucu

SEQ ID NO: 4178195 - RNA, 17 nt, Yersinia pestis KIM
ucucugaugguaucaga

SEQ ID NO: 4178196 - RNA, 14 nt, Yersinia pestis KIM
ucucugcaucucug

SEQ ID NO: 4178197 - RNA, 17 nt, Yersinia pestis KIM
ucucugcugcgaauauu

SEQ ID NO: 4178198 - RNA, 18 nt, Yersinia pestis KIM
ucucuggcacgcuuucug

SEQ ID NO: 4178199 - RNA, 22 nt, Yersinia pestis KIM
ucucuggcuaaugucucuauuc

SEQ ID NO: 4178200 - RNA, 23 nt, Yersinia pestis KIM
ucucuggguaagaacagagagaa

SEQ ID NO: 4178201 - RNA, 18 nt, Yersinia pestis KIM
ucucugggugcugcuccc

SEQ ID NO: 4178202 - RNA, 17 nt, Yersinia pestis KIM
ucucuuacauaaagacc

SEQ ID NO: 4178203 - RNA, 13 nt, Yersinia pestis KIM
ucucuuccuguuc

SEQ ID NO: 4178204 - RNA, 20 nt, Yersinia pestis KIM
ucucuugauuaccaauaauu

SEQ ID NO: 4178205 - RNA, 15 nt, Yersinia pestis KIM
ucucuugcaaugaag

SEQ ID NO: 4178206 - RNA, 15 nt, Yersinia pestis KIM
ucucuuguuuugcaa

SEQ ID NO: 4178207 - RNA, 15 nt, Yersinia pestis KIM
ucucuuuauauucaa

SEQ ID NO: 4178208 - RNA, 15 nt, Yersinia pestis KIM
ucucuuuccagcaaa

SEQ ID NO: 4178209 - RNA, 20 nt, Yersinia pestis KIM
ucucuuucgggcaaaaaaau

SEQ ID NO: 4178210 - RNA, 19 nt, Yersinia pestis KIM
ucucuuucuucucuucaga

SEQ ID NO: 4178211 - RNA, 21 nt, Yersinia pestis KIM
ucucuuugccuacuaccaaau

SEQ ID NO: 4178212 - RNA, 22 nt, Yersinia pestis KIM
ucucuuugcgcugauaacuucc

SEQ ID NO: 4178213 - RNA, 15 nt, Yersinia pestis KIM
ucugaaaccccuugu

SEQ ID NO: 4178214 - RNA, 14 nt, Yersinia pestis KIM
ucugaaacggugag

SEQ ID NO: 4178215 - RNA, 18 nt, Yersinia pestis KIM
ucugaaacggugaggaua

SEQ ID NO: 4178216 - RNA, 15 nt, Yersinia pestis KIM
ucugaaacuucaaaa

SEQ ID NO: 4178217 - RNA, 12 nt, Yersinia pestis KIM
ucugaacuauug

SEQ ID NO: 4178218 - RNA, 16 nt, Yersinia pestis KIM
ucugaagaauuacgca

SEQ ID NO: 4178219 - RNA, 17 nt, Yersinia pestis KIM
ucugaagaugccaauca

SEQ ID NO: 4178220 - RNA, 22 nt, Yersinia pestis KIM
ucugaaggguauugaagauacc

SEQ ID NO: 4178221 - RNA, 13 nt, Yersinia pestis KIM
ucugaauaaaaaa

SEQ ID NO: 4178222 - RNA, 12 nt, Yersinia pestis KIM
ucugaauaagag

SEQ ID NO: 4178223 - RNA, 23 nt, Yersinia pestis KIM
ucugaauaccauaacaauggccg

SEQ ID NO: 4178224 - RNA, 23 nt, Yersinia pestis KIM
ucugaaugaauucuauaaugaug

SEQ ID NO: 4178225 - RNA, 20 nt, Yersinia pestis KIM
ucugaauuuauuauuggcag

SEQ ID NO: 4178226 - RNA, 15 nt, Yersinia pestis KIM
ucugaccaaacauug

SEQ ID NO: 4178227 - RNA, 14 nt, Yersinia pestis KIM
ucugacuaacucuu

SEQ ID NO: 4178228 - RNA, 12 nt, Yersinia pestis KIM
ucugacuaagac

SEQ ID NO: 4178229 - RNA, 15 nt, Yersinia pestis KIM
ucugacucuguaaaa

SEQ ID NO: 4178230 - RNA, 12 nt, Yersinia pestis KIM
ucugacuguuga

SEQ ID NO: 4178231 - RNA, 19 nt, Yersinia pestis KIM
ucugaggcguggcacaccg

SEQ ID NO: 4178232 - RNA, 15 nt, Yersinia pestis KIM
ucugagucagucagg

SEQ ID NO: 4178233 - RNA, 19 nt, Yersinia pestis KIM
ucugagucgauagcuuucu

SEQ ID NO: 4178234 - RNA, 23 nt, Yersinia pestis KIM
ucugaguuucauuagucaauguu

SEQ ID NO: 4178235 - RNA, 12 nt, Yersinia pestis KIM
ucugauaauccc

SEQ ID NO: 4178236 - RNA, 21 nt, Yersinia pestis KIM
ucugauagugauuuuuuucac

SEQ ID NO: 4178237 - RNA, 15 nt, Yersinia pestis KIM
ucugauaucucuuua

SEQ ID NO: 4178238 - RNA, 19 nt, Yersinia pestis KIM
ucugauaucucuuuaucau

SEQ ID NO: 4178239 - RNA, 12 nt, Yersinia pestis KIM
ucugaucaaucu

SEQ ID NO: 4178240 - RNA, 15 nt, Yersinia pestis KIM
ucugaucgaguucag

SEQ ID NO: 4178241 - RNA, 20 nt, Yersinia pestis KIM
ucugaugaguguuuauucuc

SEQ ID NO: 4178242 - RNA, 17 nt, Yersinia pestis KIM
ucugauguguauauuuu

SEQ ID NO: 4178243 - RNA, 14 nt, Yersinia pestis KIM
ucugauuaccuucu

SEQ ID NO: 4178244 - RNA, 17 nt, Yersinia pestis KIM
ucugauuuuuuacuuuu

SEQ ID NO: 4178245 - RNA, 15 nt, Yersinia pestis KIM
ucugcaauagccaug

SEQ ID NO: 4178246 - RNA, 13 nt, Yersinia pestis KIM
ucugcaauagcuc

SEQ ID NO: 4178247 - RNA, 19 nt, Yersinia pestis KIM
ucugcacaccacacuggau

SEQ ID NO: 4178248 - RNA, 14 nt, Yersinia pestis KIM
ucugcagaaugaag

SEQ ID NO: 4178249 - RNA, 12 nt, Yersinia pestis KIM
ucugcauaccug

SEQ ID NO: 4178250 - RNA, 22 nt, Yersinia pestis KIM
ucugcaucgguaagauaaccca

SEQ ID NO: 4178251 - RNA, 12 nt, Yersinia pestis KIM
ucugccaaccaa

SEQ ID NO: 4178252 - RNA, 13 nt, Yersinia pestis KIM
ucugccaaccagg

SEQ ID NO: 4178253 - RNA, 18 nt, Yersinia pestis KIM
ucugccaauucaaggcca

SEQ ID NO: 4178254 - RNA, 18 nt, Yersinia pestis KIM
ucugccaauuuggggcug

SEQ ID NO: 4178255 - RNA, 18 nt, Yersinia pestis KIM
ucugccaccgcuccuuuc

SEQ ID NO: 4178256 - RNA, 16 nt, Yersinia pestis KIM
ucugccagauagucau

SEQ ID NO: 4178257 - RNA, 23 nt, Yersinia pestis KIM
ucugccagauagucaucuuucca

SEQ ID NO: 4178258 - RNA, 14 nt, Yersinia pestis KIM
ucugccaugguugg

SEQ ID NO: 4178259 - RNA, 20 nt, Yersinia pestis KIM
ucugccgucuaucugccaga

SEQ ID NO: 4178260 - RNA, 19 nt, Yersinia pestis KIM
ucugccuauucucaccguu

SEQ ID NO: 4178261 - RNA, 16 nt, Yersinia pestis KIM
ucugccuguucucucc

SEQ ID NO: 4178262 - RNA, 16 nt, Yersinia pestis KIM
ucugcgaccugaucca

SEQ ID NO: 4178263 - RNA, 21 nt, Yersinia pestis KIM
ucugcgagcguuuaaauaccc

SEQ ID NO: 4178264 - RNA, 16 nt, Yersinia pestis KIM
ucugcggauaaacacu

SEQ ID NO: 4178265 - RNA, 15 nt, Yersinia pestis KIM
ucugcguuuuucccu

SEQ ID NO: 4178266 - RNA, 16 nt, Yersinia pestis KIM
ucugcuaauuaaaccu

SEQ ID NO: 4178267 - RNA, 22 nt, Yersinia pestis KIM
ucugcuaauuaaaccugacugg

SEQ ID NO: 4178268 - RNA, 20 nt, Yersinia pestis KIM
ucugcuagcaaauuccgcuu

SEQ ID NO: 4178269 - RNA, 15 nt, Yersinia pestis KIM
ucugcucaauagccg

SEQ ID NO: 4178270 - RNA, 14 nt, Yersinia pestis KIM
ucugcucccauguc

SEQ ID NO: 4178271 - RNA, 17 nt, Yersinia pestis KIM
ucugcucccaugucaga

SEQ ID NO: 4178272 - RNA, 15 nt, Yersinia pestis KIM
ucugcucccggcgcu

SEQ ID NO: 4178273 - RNA, 14 nt, Yersinia pestis KIM
ucugcugcuuuagg

SEQ ID NO: 4178274 - RNA, 13 nt, Yersinia pestis KIM
ucuggagccauau

SEQ ID NO: 4178275 - RNA, 22 nt, Yersinia pestis KIM
ucuggcaaacgcugcacaucau

SEQ ID NO: 4178276 - RNA, 15 nt, Yersinia pestis KIM
ucuggcaauuucugu

SEQ ID NO: 4178277 - RNA, 22 nt, Yersinia pestis KIM
ucuggccagcgucuucaguggc

SEQ ID NO: 4178278 - RNA, 22 nt, Yersinia pestis KIM
ucuggccgaugcgacaauuucc

SEQ ID NO: 4178279 - RNA, 22 nt, Yersinia pestis KIM
ucuggcgcaagaguuagggcug

SEQ ID NO: 4178280 - RNA, 14 nt, Yersinia pestis KIM
ucuggcguuuugca

SEQ ID NO: 4178281 - RNA, 23 nt, Yersinia pestis KIM
ucuggcuaaacgaucagaacuaa

SEQ ID NO: 4178282 - RNA, 17 nt, Yersinia pestis KIM
ucuggcuaauagcguca

SEQ ID NO: 4178283 - RNA, 21 nt, Yersinia pestis KIM
ucuggcuuaaucgccagcaaa

SEQ ID NO: 4178284 - RNA, 21 nt, Yersinia pestis KIM
ucugggcugaacgugccuguc

SEQ ID NO: 4178285 - RNA, 13 nt, Yersinia pestis KIM
ucuggguaagaac

SEQ ID NO: 4178286 - RNA, 15 nt, Yersinia pestis KIM
ucugggugcugcucc

SEQ ID NO: 4178287 - RNA, 20 nt, Yersinia pestis KIM
ucugguaguuuugcauaauu

SEQ ID NO: 4178288 - RNA, 23 nt, Yersinia pestis KIM
ucuggucacuaaaacugaagcau

SEQ ID NO: 4178289 - RNA, 18 nt, Yersinia pestis KIM
ucugguccagaucggcaa

SEQ ID NO: 4178290 - RNA, 17 nt, Yersinia pestis KIM
ucuggugccguuuugcu

SEQ ID NO: 4178291 - RNA, 13 nt, Yersinia pestis KIM
ucugguugugcuu

SEQ ID NO: 4178292 - RNA, 14 nt, Yersinia pestis KIM
ucuguaauaaaggc

SEQ ID NO: 4178293 - RNA, 12 nt, Yersinia pestis KIM
ucuguaauaaua

SEQ ID NO: 4178294 - RNA, 17 nt, Yersinia pestis KIM
ucuguagagaaauucau

SEQ ID NO: 4178295 - RNA, 17 nt, Yersinia pestis KIM
ucuguaguucagucggu

SEQ ID NO: 4178296 - RNA, 15 nt, Yersinia pestis KIM
ucuguaucauauguu

SEQ ID NO: 4178297 - RNA, 13 nt, Yersinia pestis KIM
ucugucgggaaca

SEQ ID NO: 4178298 - RNA, 15 nt, Yersinia pestis KIM
ucugucgggaacacu

SEQ ID NO: 4178299 - RNA, 19 nt, Yersinia pestis KIM
ucugucgggaacacuuugc

SEQ ID NO: 4178300 - RNA, 14 nt, Yersinia pestis KIM
ucugucguacuuuc

SEQ ID NO: 4178301 - RNA, 14 nt, Yersinia pestis KIM
ucugucuaagugcc

SEQ ID NO: 4178302 - RNA, 13 nt, Yersinia pestis KIM
ucugucuuacuau

SEQ ID NO: 4178303 - RNA, 22 nt, Yersinia pestis KIM
ucugucuuccauuuuauuuaac

SEQ ID NO: 4178304 - RNA, 14 nt, Yersinia pestis KIM
ucugugauaaccag

SEQ ID NO: 4178305 - RNA, 18 nt, Yersinia pestis KIM
ucuguggcagggcgcuuu

SEQ ID NO: 4178306 - RNA, 17 nt, Yersinia pestis KIM
ucuguguaguggggcuu

SEQ ID NO: 4178307 - RNA, 19 nt, Yersinia pestis KIM
ucugugucaguaccugaug

SEQ ID NO: 4178308 - RNA, 14 nt, Yersinia pestis KIM
ucuguuaccaaugg

SEQ ID NO: 4178309 - RNA, 13 nt, Yersinia pestis KIM
ucuguuaccuaau

SEQ ID NO: 4178310 - RNA, 23 nt, Yersinia pestis KIM
ucuguuucaaauaaguauuucaa

SEQ ID NO: 4178311 - RNA, 22 nt, Yersinia pestis KIM
ucuguuuuacucguaacuaaga

SEQ ID NO: 4178312 - RNA, 22 nt, Yersinia pestis KIM
ucuguuuuguuuccccuaauuc

SEQ ID NO: 4178313 - RNA, 21 nt, Yersinia pestis KIM
ucuguuuuugccaccuccgca

SEQ ID NO: 4178314 - RNA, 13 nt, Yersinia pestis KIM
ucuguuuuuuauc

SEQ ID NO: 4178315 - RNA, 22 nt, Yersinia pestis KIM
ucuuaagcguacacuuucuacu

SEQ ID NO: 4178316 - RNA, 15 nt, Yersinia pestis KIM
ucuuaaggacccguu

SEQ ID NO: 4178317 - RNA, 18 nt, Yersinia pestis KIM
ucuuaaucuuuaauucau

SEQ ID NO: 4178318 - RNA, 19 nt, Yersinia pestis KIM
ucuuaaucuuuaauucauc

SEQ ID NO: 4178319 - RNA, 15 nt, Yersinia pestis KIM
ucuuaauucccagcc

SEQ ID NO: 4178320 - RNA, 22 nt, Yersinia pestis KIM
ucuuaauucccagccacucaca

SEQ ID NO: 4178321 - RNA, 15 nt, Yersinia pestis KIM
ucuuaauuuuaucac

SEQ ID NO: 4178322 - RNA, 17 nt, Yersinia pestis KIM
ucuuacauaaagaccca

SEQ ID NO: 4178323 - RNA, 18 nt, Yersinia pestis KIM
ucuuaggguaaccaaugu

SEQ ID NO: 4178324 - RNA, 17 nt, Yersinia pestis KIM
ucuuaggucaucgucac

SEQ ID NO: 4178325 - RNA, 14 nt, Yersinia pestis KIM
ucuuaggugacagg

SEQ ID NO: 4178326 - RNA, 21 nt, Yersinia pestis KIM
ucuuaggugacaggcaaagac

SEQ ID NO: 4178327 - RNA, 15 nt, Yersinia pestis KIM
ucuuauauaaaucca

SEQ ID NO: 4178328 - RNA, 17 nt, Yersinia pestis KIM
ucuuauauaaauccagc

SEQ ID NO: 4178329 - RNA, 15 nt, Yersinia pestis KIM
ucuuaucaaucaaaa

SEQ ID NO: 4178330 - RNA, 20 nt, Yersinia pestis KIM
ucuuaucaaucaaaaaauaa

SEQ ID NO: 4178331 - RNA, 22 nt, Yersinia pestis KIM
ucuuaucaaucaaaaaauaaau

SEQ ID NO: 4178332 - RNA, 17 nt, Yersinia pestis KIM
ucuuaucgauucaaaua

SEQ ID NO: 4178333 - RNA, 15 nt, Yersinia pestis KIM
ucuuaucuuuucuga

SEQ ID NO: 4178334 - RNA, 14 nt, Yersinia pestis KIM
ucuuauuacucauu

SEQ ID NO: 4178335 - RNA, 14 nt, Yersinia pestis KIM
ucuuauugcuaucu

SEQ ID NO: 4178336 - RNA, 16 nt, Yersinia pestis KIM
ucuucaaucaggugaa

SEQ ID NO: 4178337 - RNA, 19 nt, Yersinia pestis KIM
ucuucacgaagaauugcau

SEQ ID NO: 4178338 - RNA, 15 nt, Yersinia pestis KIM
ucuucagucaguguu

SEQ ID NO: 4178339 - RNA, 18 nt, Yersinia pestis KIM
ucuucauauacagaagag

SEQ ID NO: 4178340 - RNA, 20 nt, Yersinia pestis KIM
ucuucauggcgcuuuagcca

SEQ ID NO: 4178341 - RNA, 14 nt, Yersinia pestis KIM
ucuucauugccuuc

SEQ ID NO: 4178342 - RNA, 14 nt, Yersinia pestis KIM
ucuuccaaaggaag

SEQ ID NO: 4178343 - RNA, 21 nt, Yersinia pestis KIM
ucuuccgacaggcuaacaacu

SEQ ID NO: 4178344 - RNA, 13 nt, Yersinia pestis KIM
ucuuccuaacccg

SEQ ID NO: 4178345 - RNA, 20 nt, Yersinia pestis KIM
ucuuccugugcgccacgcuc

SEQ ID NO: 4178346 - RNA, 15 nt, Yersinia pestis KIM
ucuuccuugcucucu

SEQ ID NO: 4178347 - RNA, 21 nt, Yersinia pestis KIM
ucuucgaucaacgccucacaa

SEQ ID NO: 4178348 - RNA, 21 nt, Yersinia pestis KIM
ucuucgauuugcucuuuuuug

SEQ ID NO: 4178349 - RNA, 18 nt, Yersinia pestis KIM
ucuucgauuuuagcuuug

SEQ ID NO: 4178350 - RNA, 13 nt, Yersinia pestis KIM
ucuucgcaaaauu

SEQ ID NO: 4178351 - RNA, 19 nt, Yersinia pestis KIM
ucuucgcaaugauuacauc

SEQ ID NO: 4178352 - RNA, 12 nt, Yersinia pestis KIM
ucuucgccgcau

SEQ ID NO: 4178353 - RNA, 22 nt, Yersinia pestis KIM
ucuucggcaaaauaaucggcaa

SEQ ID NO: 4178354 - RNA, 18 nt, Yersinia pestis KIM
ucuucggccuaucaucac

SEQ ID NO: 4178355 - RNA, 20 nt, Yersinia pestis KIM
ucuucggccuaucaucacca

SEQ ID NO: 4178356 - RNA, 22 nt, Yersinia pestis KIM
ucuucggcggcuaaagcugcuu

SEQ ID NO: 4178357 - RNA, 16 nt, Yersinia pestis KIM
ucuucgggaggaggua

SEQ ID NO: 4178358 - RNA, 16 nt, Yersinia pestis KIM
ucuucuaacacuucau

SEQ ID NO: 4178359 - RNA, 16 nt, Yersinia pestis KIM
ucuucucguaauuauu

SEQ ID NO: 4178360 - RNA, 17 nt, Yersinia pestis KIM
ucuucugauaaaacagu

SEQ ID NO: 4178361 - RNA, 13 nt, Yersinia pestis KIM
ucuucuuuuauug

SEQ ID NO: 4178362 - RNA, 14 nt, Yersinia pestis KIM
ucuugaacggugag

SEQ ID NO: 4178363 - RNA, 12 nt, Yersinia pestis KIM
ucuugaauaaua

SEQ ID NO: 4178364 - RNA, 15 nt, Yersinia pestis KIM
ucuugaauaauauuc

SEQ ID NO: 4178365 - RNA, 19 nt, Yersinia pestis KIM
ucuugauuaccaauaauua

SEQ ID NO: 4178366 - RNA, 21 nt, Yersinia pestis KIM
ucuugauuaccaauaauuaau

SEQ ID NO: 4178367 - RNA, 15 nt, Yersinia pestis KIM
ucuugcauacucagg

SEQ ID NO: 4178368 - RNA, 17 nt, Yersinia pestis KIM
ucuugcauacucaggcc

SEQ ID NO: 4178369 - RNA, 20 nt, Yersinia pestis KIM
ucuugccagauggccagauu

SEQ ID NO: 4178370 - RNA, 18 nt, Yersinia pestis KIM
ucuugcucgucaucuuuc

SEQ ID NO: 4178371 - RNA, 23 nt, Yersinia pestis KIM
ucuugcugaaaacaauauaauaa

SEQ ID NO: 4178372 - RNA, 23 nt, Yersinia pestis KIM
ucuuggauaacagauuugguauu

SEQ ID NO: 4178373 - RNA, 21 nt, Yersinia pestis KIM
ucuugggcagcgacaaccugu

SEQ ID NO: 4178374 - RNA, 22 nt, Yersinia pestis KIM
ucuugggcgggaucuccagaag

SEQ ID NO: 4178375 - RNA, 17 nt, Yersinia pestis KIM
ucuuggggcacaauucu

SEQ ID NO: 4178376 - RNA, 13 nt, Yersinia pestis KIM
ucuuguaaaucuu

SEQ ID NO: 4178377 - RNA, 12 nt, Yersinia pestis KIM
ucuuguaaccac

SEQ ID NO: 4178378 - RNA, 21 nt, Yersinia pestis KIM
ucuugugaugcauauuauaau

SEQ ID NO: 4178379 - RNA, 15 nt, Yersinia pestis KIM
ucuuguuaauuuaaa

SEQ ID NO: 4178380 - RNA, 12 nt, Yersinia pestis KIM
ucuuuaaaaacc

SEQ ID NO: 4178381 - RNA, 14 nt, Yersinia pestis KIM
ucuuuaaagaccuc

SEQ ID NO: 4178382 - RNA, 13 nt, Yersinia pestis KIM
ucuuuaaagacuu

SEQ ID NO: 4178383 - RNA, 16 nt, Yersinia pestis KIM
ucuuuaacaacaacca

SEQ ID NO: 4178384 - RNA, 18 nt, Yersinia pestis KIM
ucuuuaacaccccuucag

SEQ ID NO: 4178385 - RNA, 14 nt, Yersinia pestis KIM
ucuuuaaccgcauu

SEQ ID NO: 4178386 - RNA, 22 nt, Yersinia pestis KIM
ucuuuaauaaauuuucuaagcu

SEQ ID NO: 4178387 - RNA, 12 nt, Yersinia pestis KIM
ucuuuaauaaua

SEQ ID NO: 4178388 - RNA, 14 nt, Yersinia pestis KIM
ucuuuaauaauaga

SEQ ID NO: 4178389 - RNA, 14 nt, Yersinia pestis KIM
ucuuuaaucacucu

SEQ ID NO: 4178390 - RNA, 14 nt, Yersinia pestis KIM
ucuuuaauuuucug

SEQ ID NO: 4178391 - RNA, 12 nt, Yersinia pestis KIM
ucuuuaauuuuu

SEQ ID NO: 4178392 - RNA, 14 nt, Yersinia pestis KIM
ucuuuacaggccac

SEQ ID NO: 4178393 - RNA, 19 nt, Yersinia pestis KIM
ucuuuacgaucugccuguu

SEQ ID NO: 4178394 - RNA, 18 nt, Yersinia pestis KIM
ucuuuacgcucugccugu

SEQ ID NO: 4178395 - RNA, 20 nt, Yersinia pestis KIM
ucuuuacgcucugccuguuc

SEQ ID NO: 4178396 - RNA, 19 nt, Yersinia pestis KIM
ucuuuacuaaauuagaaaa

SEQ ID NO: 4178397 - RNA, 18 nt, Yersinia pestis KIM
ucuuuagauuucaccuau

SEQ ID NO: 4178398 - RNA, 18 nt, Yersinia pestis KIM
ucuuuauacccaaaauaa

SEQ ID NO: 4178399 - RNA, 15 nt, Yersinia pestis KIM
ucuuuauaguucauu

SEQ ID NO: 4178400 - RNA, 15 nt, Yersinia pestis KIM
ucuuuauauucaaua

SEQ ID NO: 4178401 - RNA, 18 nt, Yersinia pestis KIM
ucuuuauauucaauauca

SEQ ID NO: 4178402 - RNA, 22 nt, Yersinia pestis KIM
ucuuuaucaauuuauacccguu

SEQ ID NO: 4178403 - RNA, 17 nt, Yersinia pestis KIM
ucuuuauuaucaauggc

SEQ ID NO: 4178404 - RNA, 23 nt, Yersinia pestis KIM
ucuuuauugcuccuuacuauuuu

SEQ ID NO: 4178405 - RNA, 18 nt, Yersinia pestis KIM
ucuuucacuaaugaggaa

SEQ ID NO: 4178406 - RNA, 15 nt, Yersinia pestis KIM
ucuuucacucggaaa

SEQ ID NO: 4178407 - RNA, 14 nt, Yersinia pestis KIM
ucuuucagcaccau

SEQ ID NO: 4178408 - RNA, 15 nt, Yersinia pestis KIM
ucuuucauaucaaaa

SEQ ID NO: 4178409 - RNA, 17 nt, Yersinia pestis KIM
ucuuucauaucaaaagg

SEQ ID NO: 4178410 - RNA, 16 nt, Yersinia pestis KIM
ucuuuccagcaaaagc

SEQ ID NO: 4178411 - RNA, 21 nt, Yersinia pestis KIM
ucuuugacaugucccucuguc

SEQ ID NO: 4178412 - RNA, 23 nt, Yersinia pestis KIM
ucuuugacaugucccucuguccc

SEQ ID NO: 4178413 - RNA, 16 nt, Yersinia pestis KIM
ucuuugccuauuucag

SEQ ID NO: 4178414 - RNA, 18 nt, Yersinia pestis KIM
ucuuugggggcagugacu

SEQ ID NO: 4178415 - RNA, 14 nt, Yersinia pestis KIM
ucuuuuacaaauuu

SEQ ID NO: 4178416 - RNA, 22 nt, Yersinia pestis KIM
ucuuuuaguaacaaaaugcggu

SEQ ID NO: 4178417 - RNA, 20 nt, Yersinia pestis KIM
ucuuuuauacagcauauaaa

SEQ ID NO: 4178418 - RNA, 14 nt, Yersinia pestis KIM
ucuuuucuuuaugu

SEQ ID NO: 4178419 - RNA, 12 nt, Yersinia pestis KIM
ucuuuuuaauuu

SEQ ID NO: 4178420 - RNA, 22 nt, Yersinia pestis KIM
ugaaaaaaaacacgguugaaaa

SEQ ID NO: 4178421 - RNA, 21 nt, Yersinia pestis KIM
ugaaaaacagagggccccgau

SEQ ID NO: 4178422 - RNA, 21 nt, Yersinia pestis KIM
ugaaaaaucugacucuguaaa

SEQ ID NO: 4178423 - RNA, 14 nt, Yersinia pestis KIM
ugaaaacaauauaa

SEQ ID NO: 4178424 - RNA, 18 nt, Yersinia pestis KIM
ugaaaacggcgaggaaga

SEQ ID NO: 4178425 - RNA, 18 nt, Yersinia pestis KIM
ugaaaacguuaacugcag

SEQ ID NO: 4178426 - RNA, 20 nt, Yersinia pestis KIM
ugaaaacuacgguaauaaac

SEQ ID NO: 4178427 - RNA, 17 nt, Yersinia pestis KIM
ugaaaagugauccacuu

SEQ ID NO: 4178428 - RNA, 20 nt, Yersinia pestis KIM
ugaaaauauucauucuuauc

SEQ ID NO: 4178429 - RNA, 15 nt, Yersinia pestis KIM
ugaaacaaccguguu

SEQ ID NO: 4178430 - RNA, 23 nt, Yersinia pestis KIM
ugaaacacaacaacggugaacag

SEQ ID NO: 4178431 - RNA, 13 nt, Yersinia pestis KIM
ugaaacacuuauu

SEQ ID NO: 4178432 - RNA, 22 nt, Yersinia pestis KIM
ugaaacacuuauuugaaauacu

SEQ ID NO: 4178433 - RNA, 20 nt, Yersinia pestis KIM
ugaaaccauugguaauaaug

SEQ ID NO: 4178434 - RNA, 21 nt, Yersinia pestis KIM
ugaaaccuacaucacacccag

SEQ ID NO: 4178435 - RNA, 18 nt, Yersinia pestis KIM
ugaaacgauaugcuccag

SEQ ID NO: 4178436 - RNA, 19 nt, Yersinia pestis KIM
ugaaacgauaugcuccaga

SEQ ID NO: 4178437 - RNA, 20 nt, Yersinia pestis KIM
ugaaacgauaugcuccagau

SEQ ID NO: 4178438 - RNA, 14 nt, Yersinia pestis KIM
ugaaacuaaaauaa

SEQ ID NO: 4178439 - RNA, 15 nt, Yersinia pestis KIM
ugaaacuaaaauaau

SEQ ID NO: 4178440 - RNA, 21 nt, Yersinia pestis KIM
ugaaacuuuucaguuuuaauu

SEQ ID NO: 4178441 - RNA, 21 nt, Yersinia pestis KIM
ugaaagccaaucucuuguuuu

SEQ ID NO: 4178442 - RNA, 20 nt, Yersinia pestis KIM
ugaaagcuucaacuuccagu

SEQ ID NO: 4178443 - RNA, 16 nt, Yersinia pestis KIM
ugaaaggcggugaaca

SEQ ID NO: 4178444 - RNA, 18 nt, Yersinia pestis KIM
ugaaaggcggugaacagu

SEQ ID NO: 4178445 - RNA, 19 nt, Yersinia pestis KIM
ugaaaguggccacucaccu

SEQ ID NO: 4178446 - RNA, 16 nt, Yersinia pestis KIM
ugaaaguuuauaugcu

SEQ ID NO: 4178447 - RNA, 16 nt, Yersinia pestis KIM
ugaaauaaacuuuuau

SEQ ID NO: 4178448 - RNA, 13 nt, Yersinia pestis KIM
ugaaauaacugcc

SEQ ID NO: 4178449 - RNA, 18 nt, Yersinia pestis KIM
ugaaauaguaauuaauua

SEQ ID NO: 4178450 - RNA, 18 nt, Yersinia pestis KIM
ugaaauagucacauuuca

SEQ ID NO: 4178451 - RNA, 19 nt, Yersinia pestis KIM
ugaaaucagaucaacagau

SEQ ID NO: 4178452 - RNA, 21 nt, Yersinia pestis KIM
ugaaaucauagcuaaaugaca

SEQ ID NO: 4178453 - RNA, 18 nt, Yersinia pestis KIM
ugaaaugauuaaacgccu

SEQ ID NO: 4178454 - RNA, 22 nt, Yersinia pestis KIM
ugaaauuagggguugcaggcug

SEQ ID NO: 4178455 - RNA, 19 nt, Yersinia pestis KIM
ugaaauugcuucaauaccg

SEQ ID NO: 4178456 - RNA, 13 nt, Yersinia pestis KIM
ugaaauuuuauuc

SEQ ID NO: 4178457 - RNA, 22 nt, Yersinia pestis KIM
ugaaauuuuauucgcguuucau

SEQ ID NO: 4178458 - RNA, 12 nt, Yersinia pestis KIM
ugaacaaauauc

SEQ ID NO: 4178459 - RNA, 20 nt, Yersinia pestis KIM
ugaacacgacgccauaaaag

SEQ ID NO: 4178460 - RNA, 23 nt, Yersinia pestis KIM
ugaacacgacgccauaaaagaau

SEQ ID NO: 4178461 - RNA, 18 nt, Yersinia pestis KIM
ugaacacucuuuuuaauu

SEQ ID NO: 4178462 - RNA, 17 nt, Yersinia pestis KIM
ugaacacuuaauuccau

SEQ ID NO: 4178463 - RNA, 17 nt, Yersinia pestis KIM
ugaacagauagauaaau

SEQ ID NO: 4178464 - RNA, 22 nt, Yersinia pestis KIM
ugaacauaacuuugccagugac

SEQ ID NO: 4178465 - RNA, 14 nt, Yersinia pestis KIM
ugaacaugaugggc

SEQ ID NO: 4178466 - RNA, 23 nt, Yersinia pestis KIM
ugaacaugggugccccauauuuu

SEQ ID NO: 4178467 - RNA, 20 nt, Yersinia pestis KIM
ugaacauuauuuuucacgag

SEQ ID NO: 4178468 - RNA, 24 nt, Yersinia pestis KIM
ugaaccaaaauucacaacuuguga

SEQ ID NO: 4178469 - RNA, 18 nt, Yersinia pestis KIM
ugaaccagauaacaacaa

SEQ ID NO: 4178470 - RNA, 18 nt, Yersinia pestis KIM
ugaaccaguugaucgucc

SEQ ID NO: 4178471 - RNA, 21 nt, Yersinia pestis KIM
ugaaccaucaacaauucgauc

SEQ ID NO: 4178472 - RNA, 19 nt, Yersinia pestis KIM
ugaacccacgacuauuuag

SEQ ID NO: 4178473 - RNA, 17 nt, Yersinia pestis KIM
ugaacccuuucagcgcu

SEQ ID NO: 4178474 - RNA, 18 nt, Yersinia pestis KIM
ugaacccuuucagcgcuu

SEQ ID NO: 4178475 - RNA, 14 nt, Yersinia pestis KIM
ugaaccgccauugc

SEQ ID NO: 4178476 - RNA, 19 nt, Yersinia pestis KIM
ugaaccgccauugcauauu

SEQ ID NO: 4178477 - RNA, 18 nt, Yersinia pestis KIM
ugaaccugacgcacagca

SEQ ID NO: 4178478 - RNA, 18 nt, Yersinia pestis KIM
ugaacgaggacuuccugc

SEQ ID NO: 4178479 - RNA, 20 nt, Yersinia pestis KIM
ugaacgaggacuuccugccc

SEQ ID NO: 4178480 - RNA, 15 nt, Yersinia pestis KIM
ugaacgauaaauugc

SEQ ID NO: 4178481 - RNA, 13 nt, Yersinia pestis KIM
ugaacgcaaaccc

SEQ ID NO: 4178482 - RNA, 15 nt, Yersinia pestis KIM
ugaacggcuggucau

SEQ ID NO: 4178483 - RNA, 22 nt, Yersinia pestis KIM
ugaacggguuaaucaguggcug

SEQ ID NO: 4178484 - RNA, 17 nt, Yersinia pestis KIM
ugaacggugaggauagg

SEQ ID NO: 4178485 - RNA, 16 nt, Yersinia pestis KIM
ugaacggugaggaugg

SEQ ID NO: 4178486 - RNA, 12 nt, Yersinia pestis KIM
ugaacguauauu

SEQ ID NO: 4178487 - RNA, 22 nt, Yersinia pestis KIM
ugaacguguuagguaauaccaa

SEQ ID NO: 4178488 - RNA, 19 nt, Yersinia pestis KIM
ugaacugaaucacaggcca

SEQ ID NO: 4178489 - RNA, 23 nt, Yersinia pestis KIM
ugaacugacacacaccagugauu

SEQ ID NO: 4178490 - RNA, 21 nt, Yersinia pestis KIM
ugaacuucaaaucgccaaacu

SEQ ID NO: 4178491 - RNA, 21 nt, Yersinia pestis KIM
ugaacuucgaaagaaauaaaa

SEQ ID NO: 4178492 - RNA, 13 nt, Yersinia pestis KIM
ugaagaaaccuaa

SEQ ID NO: 4178493 - RNA, 16 nt, Yersinia pestis KIM
ugaagacacacuuauu

SEQ ID NO: 4178494 - RNA, 15 nt, Yersinia pestis KIM
ugaagagaaauaacc

SEQ ID NO: 4178495 - RNA, 12 nt, Yersinia pestis KIM
ugaagauaacga

SEQ ID NO: 4178496 - RNA, 23 nt, Yersinia pestis KIM
ugaagauacccuucucuuuauca

SEQ ID NO: 4178497 - RNA, 15 nt, Yersinia pestis KIM
ugaagauacccuuga

SEQ ID NO: 4178498 - RNA, 18 nt, Yersinia pestis KIM
ugaagauucaaccaauua

SEQ ID NO: 4178499 - RNA, 13 nt, Yersinia pestis KIM
ugaagauuuaaau

SEQ ID NO: 4178500 - RNA, 17 nt, Yersinia pestis KIM
ugaagauuuaaauaaca

SEQ ID NO: 4178501 - RNA, 16 nt, Yersinia pestis KIM
ugaagcagauaaagaa

SEQ ID NO: 4178502 - RNA, 14 nt, Yersinia pestis KIM
ugaagccagcaccg

SEQ ID NO: 4178503 - RNA, 23 nt, Yersinia pestis KIM
ugaagccgccggagaacuugaac

SEQ ID NO: 4178504 - RNA, 20 nt, Yersinia pestis KIM
ugaagccugauggguauauu

SEQ ID NO: 4178505 - RNA, 22 nt, Yersinia pestis KIM
ugaagccuucauguuuaucaaa

SEQ ID NO: 4178506 - RNA, 16 nt, Yersinia pestis KIM
ugaagcgacacuuauu

SEQ ID NO: 4178507 - RNA, 13 nt, Yersinia pestis KIM
ugaaggaugaaua

SEQ ID NO: 4178508 - RNA, 18 nt, Yersinia pestis KIM
ugaaggaugaauaaauga

SEQ ID NO: 4178509 - RNA, 19 nt, Yersinia pestis KIM
ugaaggguauugaagauac

SEQ ID NO: 4178510 - RNA, 21 nt, Yersinia pestis KIM
ugaagguacgcaccauugagc

SEQ ID NO: 4178511 - RNA, 19 nt, Yersinia pestis KIM
ugaaguacggugccagcag

SEQ ID NO: 4178512 - RNA, 19 nt, Yersinia pestis KIM
ugaaguggcugaauaucau

SEQ ID NO: 4178513 - RNA, 14 nt, Yersinia pestis KIM
ugaaguucucauca

SEQ ID NO: 4178514 - RNA, 21 nt, Yersinia pestis KIM
ugaauaaaaaauuauuaaaua

SEQ ID NO: 4178515 - RNA, 12 nt, Yersinia pestis KIM
ugaauaaacacc

SEQ ID NO: 4178516 - RNA, 15 nt, Yersinia pestis KIM
ugaauaaacaccaua

SEQ ID NO: 4178517 - RNA, 20 nt, Yersinia pestis KIM
ugaauaaacaccauagccac

SEQ ID NO: 4178518 - RNA, 13 nt, Yersinia pestis KIM
ugaauaaaucaaa

SEQ ID NO: 4178519 - RNA, 14 nt, Yersinia pestis KIM
ugaauaaaucaaag

SEQ ID NO: 4178520 - RNA, 20 nt, Yersinia pestis KIM
ugaauaacuucgcgaacaca

SEQ ID NO: 4178521 - RNA, 21 nt, Yersinia pestis KIM
ugaauaacuucgcgaacacaa

SEQ ID NO: 4178522 - RNA, 19 nt, Yersinia pestis KIM
ugaauaagguucuuucauu

SEQ ID NO: 4178523 - RNA, 16 nt, Yersinia pestis KIM
ugaauaauacugucaa

SEQ ID NO: 4178524 - RNA, 20 nt, Yersinia pestis KIM
ugaauacgguguaaaccgca

SEQ ID NO: 4178525 - RNA, 20 nt, Yersinia pestis KIM
ugaauagagacgccauaacc

SEQ ID NO: 4178526 - RNA, 23 nt, Yersinia pestis KIM
ugaauagaggacuauucaaugac

SEQ ID NO: 4178527 - RNA, 21 nt, Yersinia pestis KIM
ugaauagcgcugcaucagcag

SEQ ID NO: 4178528 - RNA, 15 nt, Yersinia pestis KIM
ugaauaucaucuuuu

SEQ ID NO: 4178529 - RNA, 23 nt, Yersinia pestis KIM
ugaauaucccccuccggaaucag

SEQ ID NO: 4178530 - RNA, 17 nt, Yersinia pestis KIM
ugaauaugucauuaccg

SEQ ID NO: 4178531 - RNA, 17 nt, Yersinia pestis KIM
ugaauauuuuuaaucug

SEQ ID NO: 4178532 - RNA, 18 nt, Yersinia pestis KIM
ugaaucaaggcuuuaaua

SEQ ID NO: 4178533 - RNA, 19 nt, Yersinia pestis KIM
ugaaucacuaacguguccc

SEQ ID NO: 4178534 - RNA, 21 nt, Yersinia pestis KIM
ugaaucagauacggcuccaga

SEQ ID NO: 4178535 - RNA, 14 nt, Yersinia pestis KIM
ugaaucaucaauac

SEQ ID NO: 4178536 - RNA, 23 nt, Yersinia pestis KIM
ugaaucccagaaccucaacauuc

SEQ ID NO: 4178537 - RNA, 19 nt, Yersinia pestis KIM
ugaauccggauccagcgcu

SEQ ID NO: 4178538 - RNA, 20 nt, Yersinia pestis KIM
ugaaucgaguaauauuuugu

SEQ ID NO: 4178539 - RNA, 12 nt, Yersinia pestis KIM
ugaaucuguaag

SEQ ID NO: 4178540 - RNA, 14 nt, Yersinia pestis KIM
ugaaugacuggcua

SEQ ID NO: 4178541 - RNA, 17 nt, Yersinia pestis KIM
ugaaugagguuuacauu

SEQ ID NO: 4178542 - RNA, 20 nt, Yersinia pestis KIM
ugaaugaguuucaagucaau

SEQ ID NO: 4178543 - RNA, 12 nt, Yersinia pestis KIM
ugaaugauggua

SEQ ID NO: 4178544 - RNA, 15 nt, Yersinia pestis KIM
ugaauggaaguuaaa

SEQ ID NO: 4178545 - RNA, 19 nt, Yersinia pestis KIM
ugaauggcaacgcgcagug

SEQ ID NO: 4178546 - RNA, 15 nt, Yersinia pestis KIM
ugaauggcugccauc

SEQ ID NO: 4178547 - RNA, 14 nt, Yersinia pestis KIM
ugaaugugaagagc

SEQ ID NO: 4178548 - RNA, 14 nt, Yersinia pestis KIM
ugaauucaagaagg

SEQ ID NO: 4178549 - RNA, 22 nt, Yersinia pestis KIM
ugaauugauuuauuccucucug

SEQ ID NO: 4178550 - RNA, 12 nt, Yersinia pestis KIM
ugaauugccccc

SEQ ID NO: 4178551 - RNA, 12 nt, Yersinia pestis KIM
ugaauuucuucc

SEQ ID NO: 4178552 - RNA, 18 nt, Yersinia pestis KIM
ugaauuugauacagugau

SEQ ID NO: 4178553 - RNA, 19 nt, Yersinia pestis KIM
ugaauuuuagucaaaacaa

SEQ ID NO: 4178554 - RNA, 19 nt, Yersinia pestis KIM
ugaauuuuuauaauuaauu

SEQ ID NO: 4178555 - RNA, 20 nt, Yersinia pestis KIM
ugaauuuuuauaauuaauuu

SEQ ID NO: 4178556 - RNA, 22 nt, Yersinia pestis KIM
ugacaaaaacagcacuaucccc

SEQ ID NO: 4178557 - RNA, 21 nt, Yersinia pestis KIM
ugacaaaaugccagaaugcgu

SEQ ID NO: 4178558 - RNA, 18 nt, Yersinia pestis KIM
ugacaaaccccgauaacg

SEQ ID NO: 4178559 - RNA, 16 nt, Yersinia pestis KIM
ugacaaagagcccgca

SEQ ID NO: 4178560 - RNA, 19 nt, Yersinia pestis KIM
ugacaaaggguaauuaauu

SEQ ID NO: 4178561 - RNA, 15 nt, Yersinia pestis KIM
ugacaaagugcccgc

SEQ ID NO: 4178562 - RNA, 16 nt, Yersinia pestis KIM
ugacaaaguuaaauga

SEQ ID NO: 4178563 - RNA, 17 nt, Yersinia pestis KIM
ugacaaaguuaaaugaa

SEQ ID NO: 4178564 - RNA, 17 nt, Yersinia pestis KIM
ugacaacaucaaaugaa

SEQ ID NO: 4178565 - RNA, 23 nt, Yersinia pestis KIM
ugacacauaccuucgguaaucaa

SEQ ID NO: 4178566 - RNA, 18 nt, Yersinia pestis KIM
ugacacgggaucaacaug

SEQ ID NO: 4178567 - RNA, 22 nt, Yersinia pestis KIM
ugacacggguauuggcugcuug

SEQ ID NO: 4178568 - RNA, 22 nt, Yersinia pestis KIM
ugacacucggcgguuugagcca

SEQ ID NO: 4178569 - RNA, 16 nt, Yersinia pestis KIM
ugacacugcaucucug

SEQ ID NO: 4178570 - RNA, 17 nt, Yersinia pestis KIM
ugacagaaaaaucacau

SEQ ID NO: 4178571 - RNA, 21 nt, Yersinia pestis KIM
ugacagaaaaaucacaugcgg

SEQ ID NO: 4178572 - RNA, 21 nt, Yersinia pestis KIM
ugacagacgcgguuaacgacg

SEQ ID NO: 4178573 - RNA, 15 nt, Yersinia pestis KIM
ugacagcaacgacgc

SEQ ID NO: 4178574 - RNA, 23 nt, Yersinia pestis KIM
ugacagcauacauccuaaauaau

SEQ ID NO: 4178575 - RNA, 17 nt, Yersinia pestis KIM
ugacaggaucaggccag

SEQ ID NO: 4178576 - RNA, 21 nt, Yersinia pestis KIM
ugacaggggauagcaacugcc

SEQ ID NO: 4178577 - RNA, 19 nt, Yersinia pestis KIM
ugacagguugauaaguuga

SEQ ID NO: 4178578 - RNA, 22 nt, Yersinia pestis KIM
ugacaguagaauaccucacugg

SEQ ID NO: 4178579 - RNA, 17 nt, Yersinia pestis KIM
ugacaguagugaguuaa

SEQ ID NO: 4178580 - RNA, 19 nt, Yersinia pestis KIM
ugacaguauuuguagugga

SEQ ID NO: 4178581 - RNA, 13 nt, Yersinia pestis KIM
ugacauaaacacg

SEQ ID NO: 4178582 - RNA, 21 nt, Yersinia pestis KIM
ugacauaaacacgcaaucaga

SEQ ID NO: 4178583 - RNA, 22 nt, Yersinia pestis KIM
ugacaucagccauauguugcca

SEQ ID NO: 4178584 - RNA, 10 nt, Yersinia pestis KIM
ugacaucauc

SEQ ID NO: 4178585 - RNA, 13 nt, Yersinia pestis KIM
ugacauccgcuug

SEQ ID NO: 4178586 - RNA, 15 nt, Yersinia pestis KIM
ugacauccgcuugca

SEQ ID NO: 4178587 - RNA, 19 nt, Yersinia pestis KIM
ugacauccuuauuuuccgc

SEQ ID NO: 4178588 - RNA, 22 nt, Yersinia pestis KIM
ugacaucuaucggugcagugca

SEQ ID NO: 4178589 - RNA, 17 nt, Yersinia pestis KIM
ugacauucaaauacggc

SEQ ID NO: 4178590 - RNA, 13 nt, Yersinia pestis KIM
ugacauugcccgc

SEQ ID NO: 4178591 - RNA, 18 nt, Yersinia pestis KIM
ugacauuucuuuuuaugu

SEQ ID NO: 4178592 - RNA, 18 nt, Yersinia pestis KIM
ugaccaaagcaguaaaca

SEQ ID NO: 4178593 - RNA, 21 nt, Yersinia pestis KIM
ugaccaaagcaguaaacauuu

SEQ ID NO: 4178594 - RNA, 13 nt, Yersinia pestis KIM
ugaccaauacuac

SEQ ID NO: 4178595 - RNA, 18 nt, Yersinia pestis KIM
ugaccacaaaaacagugu

SEQ ID NO: 4178596 - RNA, 19 nt, Yersinia pestis KIM
ugaccacaaaaacaguguc

SEQ ID NO: 4178597 - RNA, 18 nt, Yersinia pestis KIM
ugaccacgcaucaauaau

SEQ ID NO: 4178598 - RNA, 21 nt, Yersinia pestis KIM
ugaccacgcaucaauaauaac

SEQ ID NO: 4178599 - RNA, 21 nt, Yersinia pestis KIM
ugaccacuugcugaugcccau

SEQ ID NO: 4178600 - RNA, 15 nt, Yersinia pestis KIM
ugaccagauaggcuu

SEQ ID NO: 4178601 - RNA, 21 nt, Yersinia pestis KIM
ugaccagcauacgugccaaaa

SEQ ID NO: 4178602 - RNA, 17 nt, Yersinia pestis KIM
ugaccagugaauaaguu

SEQ ID NO: 4178603 - RNA, 14 nt, Yersinia pestis KIM
ugaccauaaaagga

SEQ ID NO: 4178604 - RNA, 17 nt, Yersinia pestis KIM
ugaccaucaaccgugac

SEQ ID NO: 4178605 - RNA, 22 nt, Yersinia pestis KIM
ugaccauuuguuuuugaaucau

SEQ ID NO: 4178606 - RNA, 13 nt, Yersinia pestis KIM
ugaccccaaauuu

SEQ ID NO: 4178607 - RNA, 13 nt, Yersinia pestis KIM
ugaccgcagccuu

SEQ ID NO: 4178608 - RNA, 16 nt, Yersinia pestis KIM
ugaccgguaauaucgg

SEQ ID NO: 4178609 - RNA, 15 nt, Yersinia pestis KIM
ugaccguuguaugug

SEQ ID NO: 4178610 - RNA, 14 nt, Yersinia pestis KIM
ugaccuaaaccgcu

SEQ ID NO: 4178611 - RNA, 21 nt, Yersinia pestis KIM
ugaccuaaaccgcucucaccu

SEQ ID NO: 4178612 - RNA, 20 nt, Yersinia pestis KIM
ugaccuauugauaaaaccac

SEQ ID NO: 4178613 - RNA, 21 nt, Yersinia pestis KIM
ugaccuauugauaaaaccacu

SEQ ID NO: 4178614 - RNA, 16 nt, Yersinia pestis KIM
ugaccuguuguaacac

SEQ ID NO: 4178615 - RNA, 15 nt, Yersinia pestis KIM
ugaccuucccuucag

SEQ ID NO: 4178616 - RNA, 13 nt, Yersinia pestis KIM
ugacgaaaugccg

SEQ ID NO: 4178617 - RNA, 13 nt, Yersinia pestis KIM
ugacgaacgcccg

SEQ ID NO: 4178618 - RNA, 18 nt, Yersinia pestis KIM
ugacgaaguuuuagccua

SEQ ID NO: 4178619 - RNA, 14 nt, Yersinia pestis KIM
ugacgacaauauaa

SEQ ID NO: 4178620 - RNA, 16 nt, Yersinia pestis KIM
ugacgaccaauaucau

SEQ ID NO: 4178621 - RNA, 21 nt, Yersinia pestis KIM
ugacgagaucauuggcuauca

SEQ ID NO: 4178622 - RNA, 16 nt, Yersinia pestis KIM
ugacgccgccgcguga

SEQ ID NO: 4178623 - RNA, 22 nt, Yersinia pestis KIM
ugacgcgaaacgcccaaaucug

SEQ ID NO: 4178624 - RNA, 14 nt, Yersinia pestis KIM
ugacgcgaucgucg

SEQ ID NO: 4178625 - RNA, 17 nt, Yersinia pestis KIM
ugacgcgaucugaaacg

SEQ ID NO: 4178626 - RNA, 12 nt, Yersinia pestis KIM
ugacgcgcugcu

SEQ ID NO: 4178627 - RNA, 23 nt, Yersinia pestis KIM
ugacgcguagagccuuuacgggc

SEQ ID NO: 4178628 - RNA, 22 nt, Yersinia pestis KIM
ugacgcuaaccaccgucaccaa

SEQ ID NO: 4178629 - RNA, 16 nt, Yersinia pestis KIM
ugacgcucgcugcugg

SEQ ID NO: 4178630 - RNA, 13 nt, Yersinia pestis KIM
ugacgcugacauu

SEQ ID NO: 4178631 - RNA, 20 nt, Yersinia pestis KIM
ugacgcuggaaauaagccuc

SEQ ID NO: 4178632 - RNA, 15 nt, Yersinia pestis KIM
ugacgcuggcacugg

SEQ ID NO: 4178633 - RNA, 15 nt, Yersinia pestis KIM
ugacggagcuaucac

SEQ ID NO: 4178634 - RNA, 20 nt, Yersinia pestis KIM
ugacggcagcgagcacugcc

SEQ ID NO: 4178635 - RNA, 20 nt, Yersinia pestis KIM
ugacggcggcgagcacugcc

SEQ ID NO: 4178636 - RNA, 16 nt, Yersinia pestis KIM
ugacggguauauuuau

SEQ ID NO: 4178637 - RNA, 14 nt, Yersinia pestis KIM
ugacggugcccaca

SEQ ID NO: 4178638 - RNA, 17 nt, Yersinia pestis KIM
ugacggugcgauaaaug

SEQ ID NO: 4178639 - RNA, 20 nt, Yersinia pestis KIM
ugacgguuucaacauccagu

SEQ ID NO: 4178640 - RNA, 17 nt, Yersinia pestis KIM
ugacgugcaggcccagc

SEQ ID NO: 4178641 - RNA, 15 nt, Yersinia pestis KIM
ugacguuacagaugg

SEQ ID NO: 4178642 - RNA, 21 nt, Yersinia pestis KIM
ugacguucaggccugcaccgg

SEQ ID NO: 4178643 - RNA, 16 nt, Yersinia pestis KIM
ugacguugcagggggu

SEQ ID NO: 4178644 - RNA, 21 nt, Yersinia pestis KIM
ugacuaaaauucaaacaaaua

SEQ ID NO: 4178645 - RNA, 23 nt, Yersinia pestis KIM
ugacuaaaauucaaacaaauauu

SEQ ID NO: 4178646 - RNA, 17 nt, Yersinia pestis KIM
ugacuaauugugcagca

SEQ ID NO: 4178647 - RNA, 17 nt, Yersinia pestis KIM
ugacuaccuugcuccgc

SEQ ID NO: 4178648 - RNA, 15 nt, Yersinia pestis KIM
ugacuauucugccua

SEQ ID NO: 4178649 - RNA, 15 nt, Yersinia pestis KIM
ugacuauuuaaauac

SEQ ID NO: 4178650 - RNA, 13 nt, Yersinia pestis KIM
ugacucagcgaau

SEQ ID NO: 4178651 - RNA, 18 nt, Yersinia pestis KIM
ugacucccugacucccug

SEQ ID NO: 4178652 - RNA, 19 nt, Yersinia pestis KIM
ugacucccugacucccuga

SEQ ID NO: 4178653 - RNA, 21 nt, Yersinia pestis KIM
ugacucccugacucccugacu

SEQ ID NO: 4178654 - RNA, 15 nt, Yersinia pestis KIM
ugacucgaacugaaa

SEQ ID NO: 4178655 - RNA, 12 nt, Yersinia pestis KIM
ugacugaacauc

SEQ ID NO: 4178656 - RNA, 19 nt, Yersinia pestis KIM
ugacugaccauaaaaggau

SEQ ID NO: 4178657 - RNA, 15 nt, Yersinia pestis KIM
ugacuggcuauuaga

SEQ ID NO: 4178658 - RNA, 13 nt, Yersinia pestis KIM
ugacuguaaauau

SEQ ID NO: 4178659 - RNA, 14 nt, Yersinia pestis KIM
ugacugugcgcggc

SEQ ID NO: 4178660 - RNA, 15 nt, Yersinia pestis KIM
ugacuuacgucuuua

SEQ ID NO: 4178661 - RNA, 16 nt, Yersinia pestis KIM
ugacuuacgucuuuaa

SEQ ID NO: 4178662 - RNA, 16 nt, Yersinia pestis KIM
ugacuugcagguucaa

SEQ ID NO: 4178663 - RNA, 21 nt, Yersinia pestis KIM
ugacuuuaaaaaaauuaucau

SEQ ID NO: 4178664 - RNA, 12 nt, Yersinia pestis KIM
ugacuuucuaag

SEQ ID NO: 4178665 - RNA, 13 nt, Yersinia pestis KIM
ugacuuucuaagc

SEQ ID NO: 4178666 - RNA, 18 nt, Yersinia pestis KIM
ugacuuucuaagcugccu

SEQ ID NO: 4178667 - RNA, 17 nt, Yersinia pestis KIM
ugacuuuggauauagag

SEQ ID NO: 4178668 - RNA, 10 nt, Yersinia pestis KIM
ugagaaaaaa

SEQ ID NO: 4178669 - RNA, 18 nt, Yersinia pestis KIM
ugagaaacauccuaaaaa

SEQ ID NO: 4178670 - RNA, 22 nt, Yersinia pestis KIM
ugagaaaggauuugaagacaac

SEQ ID NO: 4178671 - RNA, 14 nt, Yersinia pestis KIM
ugagaacucgguau

SEQ ID NO: 4178672 - RNA, 19 nt, Yersinia pestis KIM
ugagaagaaaucauuuagg

SEQ ID NO: 4178673 - RNA, 18 nt, Yersinia pestis KIM
ugagaaguaaaacgugaa

SEQ ID NO: 4178674 - RNA, 18 nt, Yersinia pestis KIM
ugagaauacuucaggcca

SEQ ID NO: 4178675 - RNA, 16 nt, Yersinia pestis KIM
ugagaauaucuauaua

SEQ ID NO: 4178676 - RNA, 18 nt, Yersinia pestis KIM
ugagaaucaaaaaacaga

SEQ ID NO: 4178677 - RNA, 22 nt, Yersinia pestis KIM
ugagaaucaguggucuuccgcc

SEQ ID NO: 4178678 - RNA, 19 nt, Yersinia pestis KIM
ugagaauuauaacuauuau

SEQ ID NO: 4178679 - RNA, 19 nt, Yersinia pestis KIM
ugagaccuuccauaacuca

SEQ ID NO: 4178680 - RNA, 18 nt, Yersinia pestis KIM
ugagagugaaugugagug

SEQ ID NO: 4178681 - RNA, 16 nt, Yersinia pestis KIM
ugagauaaucacugag

SEQ ID NO: 4178682 - RNA, 15 nt, Yersinia pestis KIM
ugagauccuccauau

SEQ ID NO: 4178683 - RNA, 21 nt, Yersinia pestis KIM
ugagaucgaacugauaacugc

SEQ ID NO: 4178684 - RNA, 15 nt, Yersinia pestis KIM
ugagauggcgcaaug

SEQ ID NO: 4178685 - RNA, 14 nt, Yersinia pestis KIM
ugagauuaauucaa

SEQ ID NO: 4178686 - RNA, 16 nt, Yersinia pestis KIM
ugagauuuagaugugc

SEQ ID NO: 4178687 - RNA, 20 nt, Yersinia pestis KIM
ugagcaagggcagcuaaccc

SEQ ID NO: 4178688 - RNA, 23 nt, Yersinia pestis KIM
ugagcaaucuggcggccgcucac

SEQ ID NO: 4178689 - RNA, 16 nt, Yersinia pestis KIM
ugagcaauugcguaau

SEQ ID NO: 4178690 - RNA, 15 nt, Yersinia pestis KIM
ugagcaccacaauac

SEQ ID NO: 4178691 - RNA, 16 nt, Yersinia pestis KIM
ugagcaccgcaggaac

SEQ ID NO: 4178692 - RNA, 22 nt, Yersinia pestis KIM
ugagcacgauuaccauuacuuc

SEQ ID NO: 4178693 - RNA, 15 nt, Yersinia pestis KIM
ugagcauauucagua

SEQ ID NO: 4178694 - RNA, 21 nt, Yersinia pestis KIM
ugagcaucaacauuguccugc

SEQ ID NO: 4178695 - RNA, 20 nt, Yersinia pestis KIM
ugagccacaacgcacugaag

SEQ ID NO: 4178696 - RNA, 19 nt, Yersinia pestis KIM
ugagccaccgcauuccagc

SEQ ID NO: 4178697 - RNA, 12 nt, Yersinia pestis KIM
ugagccauuauc

SEQ ID NO: 4178698 - RNA, 22 nt, Yersinia pestis KIM
ugagccgcccuuuagccagcgg

SEQ ID NO: 4178699 - RNA, 20 nt, Yersinia pestis KIM
ugagccucaugaaugaggcu

SEQ ID NO: 4178700 - RNA, 21 nt, Yersinia pestis KIM
ugagcgccaugcgcuuucagc

SEQ ID NO: 4178701 - RNA, 23 nt, Yersinia pestis KIM
ugagcgccaugcgcuuucagcac

SEQ ID NO: 4178702 - RNA, 15 nt, Yersinia pestis KIM
ugagcgcuauuuauc

SEQ ID NO: 4178703 - RNA, 18 nt, Yersinia pestis KIM
ugagcgcuguugcaagca

SEQ ID NO: 4178704 - RNA, 18 nt, Yersinia pestis KIM
ugagcgguugaaaaguuu

SEQ ID NO: 4178705 - RNA, 21 nt, Yersinia pestis KIM
ugagcguagcugucaccuaac

SEQ ID NO: 4178706 - RNA, 18 nt, Yersinia pestis KIM
ugagcguucaaaaucaaa

SEQ ID NO: 4178707 - RNA, 17 nt, Yersinia pestis KIM
ugagcucaucuuauuuc

SEQ ID NO: 4178708 - RNA, 16 nt, Yersinia pestis KIM
ugagcuguaaauauaa

SEQ ID NO: 4178709 - RNA, 20 nt, Yersinia pestis KIM
ugagcuguaaauauaaaaua

SEQ ID NO: 4178710 - RNA, 14 nt, Yersinia pestis KIM
ugagcuugcugcug

SEQ ID NO: 4178711 - RNA, 15 nt, Yersinia pestis KIM
ugagcuugcugcuga

SEQ ID NO: 4178712 - RNA, 19 nt, Yersinia pestis KIM
gcucuacgccccaugcacc

SEQ ID NO: 4178713 - RNA, 11 nt, Yersinia pestis KIM
gcucuacuaau

SEQ ID NO: 4178714 - RNA, 21 nt, Yersinia pestis KIM
gcucuaguacguaaauuuauu

SEQ ID NO: 4178715 - RNA, 20 nt, Yersinia pestis KIM
gcucuaucgauaaagucauc

SEQ ID NO: 4178716 - RNA, 20 nt, Yersinia pestis KIM
gcucucacccaauaagauaa

SEQ ID NO: 4178717 - RNA, 19 nt, Yersinia pestis KIM
gcucucacugcuccagcca

SEQ ID NO: 4178718 - RNA, 16 nt, Yersinia pestis KIM
gcucucauaucccccc

SEQ ID NO: 4178719 - RNA, 21 nt, Yersinia pestis KIM
uaauuucacuuccauuccguu

SEQ ID NO: 4178720 - RNA, 13 nt, Yersinia pestis KIM
uaauuucuugaug

SEQ ID NO: 4178721 - RNA, 22 nt, Yersinia pestis KIM
uaauuugcuccuggcaugcauu

SEQ ID NO: 4178722 - RNA, 12 nt, Yersinia pestis KIM
uaauuuuucaua

SEQ ID NO: 4178723 - RNA, 13 nt, Yersinia pestis KIM
uaauuuuucccuu

SEQ ID NO: 4178724 - RNA, 16 nt, Yersinia pestis KIM
uacaaaaaacaaaccg

SEQ ID NO: 4178725 - RNA, 11 nt, Yersinia pestis KIM
uacaaaaagcg

SEQ ID NO: 4178726 - RNA, 22 nt, Yersinia pestis KIM
uacaaaaagcgacuaauaucag

SEQ ID NO: 4178727 - RNA, 22 nt, Yersinia pestis KIM
uacaaacagggcagccaauuac

SEQ ID NO: 4178728 - RNA, 16 nt, Yersinia pestis KIM
uacaaaccguuugccg

SEQ ID NO: 4178729 - RNA, 11 nt, Yersinia pestis KIM
uacaaauauua

SEQ ID NO: 4178730 - RNA, 19 nt, Yersinia pestis KIM
uacaaauuugacauuuccu

SEQ ID NO: 4178731 - RNA, 23 nt, Yersinia pestis KIM
uacaacacaucgaagcugucuuu

SEQ ID NO: 4178732 - RNA, 14 nt, Yersinia pestis KIM
uacaaccaacaaac

SEQ ID NO: 4178733 - RNA, 16 nt, Yersinia pestis KIM
uacaaccaacaaacaa

SEQ ID NO: 4178734 - RNA, 22 nt, Yersinia pestis KIM
uacaacuucuucauaacgcuuu

SEQ ID NO: 4178735 - RNA, 20 nt, Yersinia pestis KIM
uacaagccgugaccaaagug

SEQ ID NO: 4178736 - RNA, 20 nt, Yersinia pestis KIM
uacaagugccaaauggaaua

SEQ ID NO: 4178737 - RNA, 21 nt, Yersinia pestis KIM
uacaaucucugggugcugcuc

SEQ ID NO: 4178738 - RNA, 17 nt, Yersinia pestis KIM
uacacaaucaguaaaua

SEQ ID NO: 4178739 - RNA, 17 nt, Yersinia pestis KIM
uacacagucuuuuuccc

SEQ ID NO: 4178740 - RNA, 16 nt, Yersinia pestis KIM
uacaccaauaaucggg

SEQ ID NO: 4178741 - RNA, 23 nt, Yersinia pestis KIM
uacaccaccgccgcaacaauaaa

SEQ ID NO: 4178742 - RNA, 14 nt, Yersinia pestis KIM
uacaccauuuucaa

SEQ ID NO: 4178743 - RNA, 18 nt, Yersinia pestis KIM
uacacccgcuugcaaccu

SEQ ID NO: 4178744 - RNA, 14 nt, Yersinia pestis KIM
uacaccgcuaaccu

SEQ ID NO: 4178745 - RNA, 21 nt, Yersinia pestis KIM
uacaccugcuggugccacugu

SEQ ID NO: 4178746 - RNA, 18 nt, Yersinia pestis KIM
uacaccuuaaaacagcag

SEQ ID NO: 4178747 - RNA, 19 nt, Yersinia pestis KIM
uacaccuucuuuaucuguc

SEQ ID NO: 4178748 - RNA, 19 nt, Yersinia pestis KIM
uacacggucuggcaacgcu

SEQ ID NO: 4178749 - RNA, 16 nt, Yersinia pestis KIM
uacacgguuaauucau

SEQ ID NO: 4178750 - RNA, 23 nt, Yersinia pestis KIM
uacacgguuaauucaugugagau

SEQ ID NO: 4178751 - RNA, 21 nt, Yersinia pestis KIM
uacacgugagaauugcugcuu

SEQ ID NO: 4178752 - RNA, 19 nt, Yersinia pestis KIM
uacacuaccuucaucugca

SEQ ID NO: 4178753 - RNA, 19 nt, Yersinia pestis KIM
uacacuauuuuaccuauuu

SEQ ID NO: 4178754 - RNA, 15 nt, Yersinia pestis KIM
uacacuggcagugcc

SEQ ID NO: 4178755 - RNA, 20 nt, Yersinia pestis KIM
uacacuuucuuugaugcaua

SEQ ID NO: 4178756 - RNA, 18 nt, Yersinia pestis KIM
uacagaaaaauaggccau

SEQ ID NO: 4178757 - RNA, 14 nt, Yersinia pestis KIM
uacagcaaauaccg

SEQ ID NO: 4178758 - RNA, 14 nt, Yersinia pestis KIM
uacagcaaauaggu

SEQ ID NO: 4178759 - RNA, 15 nt, Yersinia pestis KIM
uacagcacucaguac

SEQ ID NO: 4178760 - RNA, 20 nt, Yersinia pestis KIM
uacagcagggauucugucag

SEQ ID NO: 4178761 - RNA, 15 nt, Yersinia pestis KIM
uacagcagguggcug

SEQ ID NO: 4178762 - RNA, 16 nt, Yersinia pestis KIM
uacagcagguggcuga

SEQ ID NO: 4178763 - RNA, 18 nt, Yersinia pestis KIM
uacagcauauaaaaaagc

SEQ ID NO: 4178764 - RNA, 12 nt, Yersinia pestis KIM
uacagccacgau

SEQ ID NO: 4178765 - RNA, 15 nt, Yersinia pestis KIM
uacagcccaagagaa

SEQ ID NO: 4178766 - RNA, 17 nt, Yersinia pestis KIM
uacagccggauaggcuu

SEQ ID NO: 4178767 - RNA, 22 nt, Yersinia pestis KIM
uacagccggauaggcuuaauau

SEQ ID NO: 4178768 - RNA, 16 nt, Yersinia pestis KIM
uacagccguguagcau

SEQ ID NO: 4178769 - RNA, 15 nt, Yersinia pestis KIM
uacagcucaucacca

SEQ ID NO: 4178770 - RNA, 22 nt, Yersinia pestis KIM
uacagcucaucaccaaaaugac

SEQ ID NO: 4178771 - RNA, 15 nt, Yersinia pestis KIM
uacaggauuaaauaa

SEQ ID NO: 4178772 - RNA, 17 nt, Yersinia pestis KIM
uacaggccacacaccag

SEQ ID NO: 4178773 - RNA, 13 nt, Yersinia pestis KIM
uacaggcgcaacu

SEQ ID NO: 4178774 - RNA, 13 nt, Yersinia pestis KIM
uacagggcauauc

SEQ ID NO: 4178775 - RNA, 16 nt, Yersinia pestis KIM
uacaguaaggcagcaa

SEQ ID NO: 4178776 - RNA, 18 nt, Yersinia pestis KIM
uacaguagugaagauaau

SEQ ID NO: 4178777 - RNA, 18 nt, Yersinia pestis KIM
uacagucauuuacugaug

SEQ ID NO: 4178778 - RNA, 16 nt, Yersinia pestis KIM
uacagucuagugcgcu

SEQ ID NO: 4178779 - RNA, 15 nt, Yersinia pestis KIM
uacagugaucauggg

SEQ ID NO: 4178780 - RNA, 18 nt, Yersinia pestis KIM
uacagugcgcaaguauug

SEQ ID NO: 4178781 - RNA, 23 nt, Yersinia pestis KIM
uacaguggcgagcgcagggucag

SEQ ID NO: 4178782 - RNA, 16 nt, Yersinia pestis KIM
uacaguuuuuucucaa

SEQ ID NO: 4178783 - RNA, 22 nt, Yersinia pestis KIM
uacaguuuuuucucaaugaagu

SEQ ID NO: 4178784 - RNA, 12 nt, Yersinia pestis KIM
uacauaaaauca

SEQ ID NO: 4178785 - RNA, 17 nt, Yersinia pestis KIM
uacauaaguaagugauu

SEQ ID NO: 4178786 - RNA, 16 nt, Yersinia pestis KIM
uacauagaaaauaaua

SEQ ID NO: 4178787 - RNA, 17 nt, Yersinia pestis KIM
uacauagaaaauaauau

SEQ ID NO: 4178788 - RNA, 22 nt, Yersinia pestis KIM
uacauagaaaauaauaucggca

SEQ ID NO: 4178789 - RNA, 12 nt, Yersinia pestis KIM
uacauagaugua

SEQ ID NO: 4178790 - RNA, 18 nt, Yersinia pestis KIM
uacauaggucuuuacgca

SEQ ID NO: 4178791 - RNA, 20 nt, Yersinia pestis KIM
uacauauaaccaucaaauac

SEQ ID NO: 4178792 - RNA, 12 nt, Yersinia pestis KIM
uacauauaucac

SEQ ID NO: 4178793 - RNA, 16 nt, Yersinia pestis KIM
uacaucaaaucagagg

SEQ ID NO: 4178794 - RNA, 13 nt, Yersinia pestis KIM
uacaucacaccca

SEQ ID NO: 4178795 - RNA, 13 nt, Yersinia pestis KIM
uacaucagacacg

SEQ ID NO: 4178796 - RNA, 15 nt, Yersinia pestis KIM
uacaucaucuucuau

SEQ ID NO: 4178797 - RNA, 13 nt, Yersinia pestis KIM
uacauccaacuuc

SEQ ID NO: 4178798 - RNA, 22 nt, Yersinia pestis KIM
uacauccaauuuuuucaucaua

SEQ ID NO: 4178799 - RNA, 22 nt, Yersinia pestis KIM
uacaucgaguugaugcaauggc

SEQ ID NO: 4178800 - RNA, 19 nt, Yersinia pestis KIM
uacaucgccaguguugcca

SEQ ID NO: 4178801 - RNA, 18 nt, Yersinia pestis KIM
uacaucucggcuuucagg

SEQ ID NO: 4178802 - RNA, 16 nt, Yersinia pestis KIM
uacaucuuuauaguuc

SEQ ID NO: 4178803 - RNA, 15 nt, Yersinia pestis KIM
uacaugaguaaguga

SEQ ID NO: 4178804 - RNA, 17 nt, Yersinia pestis KIM
uacaugaguaagugauu

SEQ ID NO: 4178805 - RNA, 17 nt, Yersinia pestis KIM
uacaugauugaaaaaca

SEQ ID NO: 4178806 - RNA, 19 nt, Yersinia pestis KIM
uacaugauugaaaaacaga

SEQ ID NO: 4178807 - RNA, 22 nt, Yersinia pestis KIM
uacauucgagcaacuuuuacug

SEQ ID NO: 4178808 - RNA, 18 nt, Yersinia pestis KIM
uaccaaaacgaacaaaau

SEQ ID NO: 4178809 - RNA, 12 nt, Yersinia pestis KIM
uaccaaacauuu

SEQ ID NO: 4178810 - RNA, 20 nt, Yersinia pestis KIM
uaccaaauaaaccagaugug

SEQ ID NO: 4178811 - RNA, 18 nt, Yersinia pestis KIM
uaccaaccgcuuuaucgc

SEQ ID NO: 4178812 - RNA, 20 nt, Yersinia pestis KIM
uaccaaccgcuuuaucgcca

SEQ ID NO: 4178813 - RNA, 19 nt, Yersinia pestis KIM
uaccaagacuucaugacua

SEQ ID NO: 4178814 - RNA, 24 nt, Yersinia pestis KIM
uaccaaggcaugauaggcacggca

SEQ ID NO: 4178815 - RNA, 13 nt, Yersinia pestis KIM
uaccaauaagcug

SEQ ID NO: 4178816 - RNA, 21 nt, Yersinia pestis KIM
uaccaauaagcuguaaugcau

SEQ ID NO: 4178817 - RNA, 22 nt, Yersinia pestis KIM
uaccaauaagcuguaaugcauc

SEQ ID NO: 4178818 - RNA, 15 nt, Yersinia pestis KIM
uaccaauaauuaauu

SEQ ID NO: 4178819 - RNA, 13 nt, Yersinia pestis KIM
uaccaauuaauaa

SEQ ID NO: 4178820 - RNA, 18 nt, Yersinia pestis KIM
uaccaauuucauacaggc

SEQ ID NO: 4178821 - RNA, 19 nt, Yersinia pestis KIM
uaccacggcaccuucugau

SEQ ID NO: 4178822 - RNA, 17 nt, Yersinia pestis KIM
uaccacgguaaugaaug

SEQ ID NO: 4178823 - RNA, 17 nt, Yersinia pestis KIM
uaccacgucuaauugcu

SEQ ID NO: 4178824 - RNA, 17 nt, Yersinia pestis KIM
uaccaggaagcggccag

SEQ ID NO: 4178825 - RNA, 20 nt, Yersinia pestis KIM
uaccagggcaccuaauucac

SEQ ID NO: 4178826 - RNA, 16 nt, Yersinia pestis KIM
uaccauaacaauggcc

SEQ ID NO: 4178827 - RNA, 18 nt, Yersinia pestis KIM
uaccauaguuuuucuccu

SEQ ID NO: 4178828 - RNA, 19 nt, Yersinia pestis KIM
uaccauauggaugaugcac

SEQ ID NO: 4178829 - RNA, 22 nt, Yersinia pestis KIM
uaccauauggaugaugcacagc

SEQ ID NO: 4178830 - RNA, 15 nt, Yersinia pestis KIM
uaccaucaaaauaug

SEQ ID NO: 4178831 - RNA, 13 nt, Yersinia pestis KIM
uaccaucaaccac

SEQ ID NO: 4178832 - RNA, 22 nt, Yersinia pestis KIM
uaccaucaacgcgcauugcgcc

SEQ ID NO: 4178833 - RNA, 18 nt, Yersinia pestis KIM
uaccauccagugccaacc

SEQ ID NO: 4178834 - RNA, 21 nt, Yersinia pestis KIM
uacucaggauuagcuucugcu

SEQ ID NO: 4178835 - RNA, 22 nt, Yersinia pestis KIM
uacucaggauuagcuucugcua

SEQ ID NO: 4178836 - RNA, 17 nt, Yersinia pestis KIM
uacucaggcccugagau

SEQ ID NO: 4178837 - RNA, 14 nt, Yersinia pestis KIM
uacucauccagauu

SEQ ID NO: 4178838 - RNA, 15 nt, Yersinia pestis KIM
uacucaucuauuaga

SEQ ID NO: 4178839 - RNA, 14 nt, Yersinia pestis KIM
uacucaugauggca

SEQ ID NO: 4178840 - RNA, 14 nt, Yersinia pestis KIM
uacucauuauggau

SEQ ID NO: 4178841 - RNA, 21 nt, Yersinia pestis KIM
uacucauuauggauaauuuaa

SEQ ID NO: 4178842 - RNA, 19 nt, Yersinia pestis KIM
uacuccauccccaacucuu

SEQ ID NO: 4178843 - RNA, 21 nt, Yersinia pestis KIM
uacuccauuuuuuugaugcau

SEQ ID NO: 4178844 - RNA, 17 nt, Yersinia pestis KIM
uacuccccaaagccuac

SEQ ID NO: 4178845 - RNA, 12 nt, Yersinia pestis KIM
uacuccucugcc

SEQ ID NO: 4178846 - RNA, 16 nt, Yersinia pestis KIM
uacuccucugccuauc

SEQ ID NO: 4178847 - RNA, 20 nt, Yersinia pestis KIM
uacuccuuaaucguccgguc

SEQ ID NO: 4178848 - RNA, 16 nt, Yersinia pestis KIM
uacucguauaaaaaau

SEQ ID NO: 4178849 - RNA, 14 nt, Yersinia pestis KIM
uacucguuuuacau

SEQ ID NO: 4178850 - RNA, 13 nt, Yersinia pestis KIM
uacucguuuugcu

SEQ ID NO: 4178851 - RNA, 17 nt, Yersinia pestis KIM
uacucuuccuguacguu

SEQ ID NO: 4178852 - RNA, 13 nt, Yersinia pestis KIM
uacucuucugccc

SEQ ID NO: 4178853 - RNA, 13 nt, Yersinia pestis KIM
uacugagaaucac

SEQ ID NO: 4178854 - RNA, 15 nt, Yersinia pestis KIM
uacugagaaucacuu

SEQ ID NO: 4178855 - RNA, 16 nt, Yersinia pestis KIM
uacugagucuugauau

SEQ ID NO: 4178856 - RNA, 16 nt, Yersinia pestis KIM
uacugccaaccaccaa

SEQ ID NO: 4178857 - RNA, 22 nt, Yersinia pestis KIM
uacugccaaccaccaaagauac

SEQ ID NO: 4178858 - RNA, 16 nt, Yersinia pestis KIM
uacugccgacaggguu

SEQ ID NO: 4178859 - RNA, 14 nt, Yersinia pestis KIM
uacugcgagcggca

SEQ ID NO: 4178860 - RNA, 16 nt, Yersinia pestis KIM
uacugcgguuaaucgg

SEQ ID NO: 4178861 - RNA, 18 nt, Yersinia pestis KIM
uacugcuuuucuaccuga

SEQ ID NO: 4178862 - RNA, 22 nt, Yersinia pestis KIM
uacugggcuuauuaauuaauga

SEQ ID NO: 4178863 - RNA, 18 nt, Yersinia pestis KIM
uacugguaauaaugcugu

SEQ ID NO: 4178864 - RNA, 14 nt, Yersinia pestis KIM
uacugguaccaaau

SEQ ID NO: 4178865 - RNA, 17 nt, Yersinia pestis KIM
uacuguggucaguggug

SEQ ID NO: 4178866 - RNA, 20 nt, Yersinia pestis KIM
uacuguuaccgcgcuugcau

SEQ ID NO: 4178867 - RNA, 20 nt, Yersinia pestis KIM
uacuguuaguucagacguac

SEQ ID NO: 4178868 - RNA, 14 nt, Yersinia pestis KIM
uacuguuuauuaau

SEQ ID NO: 4178869 - RNA, 17 nt, Yersinia pestis KIM
uacuguuuauuaaugga

SEQ ID NO: 4178870 - RNA, 13 nt, Yersinia pestis KIM
uacuguuuucauu

SEQ ID NO: 4178871 - RNA, 21 nt, Yersinia pestis KIM
uacuguuuucauuauuuucac

SEQ ID NO: 4178872 - RNA, 13 nt, Yersinia pestis KIM
uacuguuuugguu

SEQ ID NO: 4178873 - RNA, 18 nt, Yersinia pestis KIM
uacuuaacaaucagugca

SEQ ID NO: 4178874 - RNA, 22 nt, Yersinia pestis KIM
uacuuaacaaucagugcaauaa

SEQ ID NO: 4178875 - RNA, 21 nt, Yersinia pestis KIM
uacuuaaguugaguugaauuu

SEQ ID NO: 4178876 - RNA, 17 nt, Yersinia pestis KIM
uacuuagcaauaauaga

SEQ ID NO: 4178877 - RNA, 13 nt, Yersinia pestis KIM
uacuuauaaacac

SEQ ID NO: 4178878 - RNA, 24 nt, Yersinia pestis KIM
uacuuauugggcgcgauaaaagau

SEQ ID NO: 4178879 - RNA, 17 nt, Yersinia pestis KIM
uacuucaggccaauagc

SEQ ID NO: 4178880 - RNA, 20 nt, Yersinia pestis KIM
uacuucgaugauuauuuugu

SEQ ID NO: 4178881 - RNA, 16 nt, Yersinia pestis KIM
uacuucuuuuuaacga

SEQ ID NO: 4178882 - RNA, 21 nt, Yersinia pestis KIM
uacuugauggcuguuuuucau

SEQ ID NO: 4178883 - RNA, 13 nt, Yersinia pestis KIM
uacuuucccugcu

SEQ ID NO: 4178884 - RNA, 13 nt, Yersinia pestis KIM
uacuuuccuuccu

SEQ ID NO: 4178885 - RNA, 16 nt, Yersinia pestis KIM
uacuuuccuuccucuu

SEQ ID NO: 4178886 - RNA, 18 nt, Yersinia pestis KIM
uacuuugaaauuauauuu

SEQ ID NO: 4178887 - RNA, 18 nt, Yersinia pestis KIM
uacuuuuaauacaggcug

SEQ ID NO: 4178888 - RNA, 13 nt, Yersinia pestis KIM
uacuuuuuauuaa

SEQ ID NO: 4178889 - RNA, 17 nt, Yersinia pestis KIM
uacuuuuuuauuuuacu

SEQ ID NO: 4178890 - RNA, 18 nt, Yersinia pestis KIM
uacuuuuuuauuuuacuu

SEQ ID NO: 4178891 - RNA, 11 nt, Yersinia pestis KIM
uagaaaacagc

SEQ ID NO: 4178892 - RNA, 14 nt, Yersinia pestis KIM
uagaaaagcgaauc

SEQ ID NO: 4178893 - RNA, 16 nt, Yersinia pestis KIM
uagaaaagcgccauca

SEQ ID NO: 4178894 - RNA, 13 nt, Yersinia pestis KIM
uagaaacaucaga

SEQ ID NO: 4178895 - RNA, 12 nt, Yersinia pestis KIM
uagaaacguuca

SEQ ID NO: 4178896 - RNA, 19 nt, Yersinia pestis KIM
uagaaccggaauaaaucag

SEQ ID NO: 4178897 - RNA, 20 nt, Yersinia pestis KIM
uagaaccggaauaaaucagu

SEQ ID NO: 4178898 - RNA, 21 nt, Yersinia pestis KIM
uagaacuauuggucaaucuag

SEQ ID NO: 4178899 - RNA, 24 nt, Yersinia pestis KIM
uagaacuuaagcaauauuuuagca

SEQ ID NO: 4178900 - RNA, 13 nt, Yersinia pestis KIM
uagaagagauaga

SEQ ID NO: 4178901 - RNA, 12 nt, Yersinia pestis KIM
uagaagcccuga

SEQ ID NO: 4178902 - RNA, 13 nt, Yersinia pestis KIM
uagaagcggaaua

SEQ ID NO: 4178903 - RNA, 17 nt, Yersinia pestis KIM
uagaagcucauaugcag

SEQ ID NO: 4178904 - RNA, 21 nt, Yersinia pestis KIM
uagaagguaaucagacugcug

SEQ ID NO: 4178905 - RNA, 20 nt, Yersinia pestis KIM
uagaauaaguugaugcagua

SEQ ID NO: 4178906 - RNA, 17 nt, Yersinia pestis KIM
uagaauagaaccggaau

SEQ ID NO: 4178907 - RNA, 21 nt, Yersinia pestis KIM
uagaauguguaguugaaguuc

SEQ ID NO: 4178908 - RNA, 16 nt, Yersinia pestis KIM
uagaauuuaagauacc

SEQ ID NO: 4178909 - RNA, 19 nt, Yersinia pestis KIM
uagaauuuaagauaccagc

SEQ ID NO: 4178910 - RNA, 15 nt, Yersinia pestis KIM
uagaauuuaccucca

SEQ ID NO: 4178911 - RNA, 14 nt, Yersinia pestis KIM
uagacaagcgcagu

SEQ ID NO: 4178912 - RNA, 22 nt, Yersinia pestis KIM
uagacagaagcguaaagcaccc

SEQ ID NO: 4178913 - RNA, 19 nt, Yersinia pestis KIM
uagacagcuuaaaaucugu

SEQ ID NO: 4178914 - RNA, 20 nt, Yersinia pestis KIM
uagacagcuuaaaaucugua

SEQ ID NO: 4178915 - RNA, 13 nt, Yersinia pestis KIM
uagaccaccaacu

SEQ ID NO: 4178916 - RNA, 18 nt, Yersinia pestis KIM
uagaccugaggauaaaaa

SEQ ID NO: 4178917 - RNA, 12 nt, Yersinia pestis KIM
uagacgacacaa

SEQ ID NO: 4178918 - RNA, 19 nt, Yersinia pestis KIM
uagacgacacaaaugcugu

SEQ ID NO: 4178919 - RNA, 20 nt, Yersinia pestis KIM
uagacgacacaaaugcugug

SEQ ID NO: 4178920 - RNA, 14 nt, Yersinia pestis KIM
uagagaugaaaccc

SEQ ID NO: 4178921 - RNA, 19 nt, Yersinia pestis KIM
uagagauuaacggcgugcg

SEQ ID NO: 4178922 - RNA, 23 nt, Yersinia pestis KIM
uagagcaaagucccggcuaggag

SEQ ID NO: 4178923 - RNA, 16 nt, Yersinia pestis KIM
uagagcaccaaaucuu

SEQ ID NO: 4178924 - RNA, 20 nt, Yersinia pestis KIM
uagagcaccaaaucuuccag

SEQ ID NO: 4178925 - RNA, 17 nt, Yersinia pestis KIM
uagagccuuuacgggcu

SEQ ID NO: 4178926 - RNA, 14 nt, Yersinia pestis KIM
uagaguaaaacuga

SEQ ID NO: 4178927 - RNA, 16 nt, Yersinia pestis KIM
uagagugcauccagcg

SEQ ID NO: 4178928 - RNA, 14 nt, Yersinia pestis KIM
uagaguugauaaac

SEQ ID NO: 4178929 - RNA, 15 nt, Yersinia pestis KIM
uagaguugauaaaca

SEQ ID NO: 4178930 - RNA, 17 nt, Yersinia pestis KIM
uagaguugauaaacaau

SEQ ID NO: 4178931 - RNA, 17 nt, Yersinia pestis KIM
uagauaacugaaagauc

SEQ ID NO: 4178932 - RNA, 14 nt, Yersinia pestis KIM
uagauacaauucac

SEQ ID NO: 4178933 - RNA, 17 nt, Yersinia pestis KIM
uagauacaauucaccca

SEQ ID NO: 4178934 - RNA, 16 nt, Yersinia pestis KIM
uagauaccgcaaccau

SEQ ID NO: 4178935 - RNA, 16 nt, Yersinia pestis KIM
uagauagcaaucaaua

SEQ ID NO: 4178936 - RNA, 21 nt, Yersinia pestis KIM
uagaucacagacguuuaaaua

SEQ ID NO: 4178937 - RNA, 13 nt, Yersinia pestis KIM
uagaucagccaaa

SEQ ID NO: 4178938 - RNA, 16 nt, Yersinia pestis KIM
uagaucggccaaugcu

SEQ ID NO: 4178939 - RNA, 18 nt, Yersinia pestis KIM
uagaucuccugcaacgcc

SEQ ID NO: 4178940 - RNA, 16 nt, Yersinia pestis KIM
uagauuaagaaaacau

SEQ ID NO: 4178941 - RNA, 13 nt, Yersinia pestis KIM
uagauuauuuucu

SEQ ID NO: 4178942 - RNA, 14 nt, Yersinia pestis KIM
uagauuauuuucuu

SEQ ID NO: 4178943 - RNA, 17 nt, Yersinia pestis KIM
uagauucaucaccaguc

SEQ ID NO: 4178944 - RNA, 18 nt, Yersinia pestis KIM
uagauuuaaccccaauuc

SEQ ID NO: 4178945 - RNA, 23 nt, Yersinia pestis KIM
uagauuucaccuauaauuaacag

SEQ ID NO: 4178946 - RNA, 14 nt, Yersinia pestis KIM
uagcaaaaaaaaag

SEQ ID NO: 4178947 - RNA, 21 nt, Yersinia pestis KIM
uagcaaaacgaguaaauagca

SEQ ID NO: 4178948 - RNA, 17 nt, Yersinia pestis KIM
uagcaaaacugaggucg

SEQ ID NO: 4178949 - RNA, 15 nt, Yersinia pestis KIM
uaggucaucccagca

SEQ ID NO: 4178950 - RNA, 17 nt, Yersinia pestis KIM
uaggugccaucuggcuc

SEQ ID NO: 4178951 - RNA, 16 nt, Yersinia pestis KIM
uaggugcgcaaaccug

SEQ ID NO: 4178952 - RNA, 21 nt, Yersinia pestis KIM
uaggugcucugccuuaugaau

SEQ ID NO: 4178953 - RNA, 20 nt, Yersinia pestis KIM
uaggugguaccugcacugag

SEQ ID NO: 4178954 - RNA, 18 nt, Yersinia pestis KIM
uagguuacgucauauccc

SEQ ID NO: 4178955 - RNA, 18 nt, Yersinia pestis KIM
uaguaaaaaaucuauuga

SEQ ID NO: 4178956 - RNA, 22 nt, Yersinia pestis KIM
uaguaacuguaaggccaaaccc

SEQ ID NO: 4178957 - RNA, 15 nt, Yersinia pestis KIM
uaguaagcaugccau

SEQ ID NO: 4178958 - RNA, 20 nt, Yersinia pestis KIM
uaguaagcaugccauccugc

SEQ ID NO: 4178959 - RNA, 14 nt, Yersinia pestis KIM
uaguaauagauugu

SEQ ID NO: 4178960 - RNA, 20 nt, Yersinia pestis KIM
uaguaaugacgcuauggaua

SEQ ID NO: 4178961 - RNA, 14 nt, Yersinia pestis KIM
uaguacuugccaca

SEQ ID NO: 4178962 - RNA, 15 nt, Yersinia pestis KIM
uaguaucauugugau

SEQ ID NO: 4178963 - RNA, 15 nt, Yersinia pestis KIM
uaguauuuaacgcca

SEQ ID NO: 4178964 - RNA, 21 nt, Yersinia pestis KIM
uaguauuuaacgccaccaaug

SEQ ID NO: 4178965 - RNA, 14 nt, Yersinia pestis KIM
uaguauuuguagug

SEQ ID NO: 4178966 - RNA, 18 nt, Yersinia pestis KIM
uagucaauguucucuggg

SEQ ID NO: 4178967 - RNA, 22 nt, Yersinia pestis KIM
uagucacgcggcggcgucaaau

SEQ ID NO: 4178968 - RNA, 20 nt, Yersinia pestis KIM
uagucacgucuucaccaaug

SEQ ID NO: 4178969 - RNA, 22 nt, Yersinia pestis KIM
uagucacgucuucaccaaugau

SEQ ID NO: 4178970 - RNA, 14 nt, Yersinia pestis KIM
uagucagcuucacu

SEQ ID NO: 4178971 - RNA, 15 nt, Yersinia pestis KIM
uagucauauauuuuu

SEQ ID NO: 4178972 - RNA, 18 nt, Yersinia pestis KIM
uagucauauauuuuucuu

SEQ ID NO: 4178973 - RNA, 14 nt, Yersinia pestis KIM
uagucauuaagaau

SEQ ID NO: 4178974 - RNA, 15 nt, Yersinia pestis KIM
uagucccccuccggc

SEQ ID NO: 4178975 - RNA, 13 nt, Yersinia pestis KIM
uagucggcauuaa

SEQ ID NO: 4178976 - RNA, 18 nt, Yersinia pestis KIM
uagucucacuaaaucaaa

SEQ ID NO: 4178977 - RNA, 17 nt, Yersinia pestis KIM
uagucuccaaauucauu

SEQ ID NO: 4178978 - RNA, 14 nt, Yersinia pestis KIM
uagucuucaucauc

SEQ ID NO: 4178979 - RNA, 15 nt, Yersinia pestis KIM
uagucuucaucaucc

SEQ ID NO: 4178980 - RNA, 22 nt, Yersinia pestis KIM
uagugaaaacguuaacugcagu

SEQ ID NO: 4178981 - RNA, 19 nt, Yersinia pestis KIM
uagugaaccguacagauau

SEQ ID NO: 4178982 - RNA, 19 nt, Yersinia pestis KIM
uagugaaguaauaaaaauc

SEQ ID NO: 4178983 - RNA, 21 nt, Yersinia pestis KIM
uagugacuaauuguuugcuuu

SEQ ID NO: 4178984 - RNA, 15 nt, Yersinia pestis KIM
uagugacucaucaaa

SEQ ID NO: 4178985 - RNA, 21 nt, Yersinia pestis KIM
uagugagccgugagaauagac

SEQ ID NO: 4178986 - RNA, 15 nt, Yersinia pestis KIM
uagugaugcaguaaa

SEQ ID NO: 4178987 - RNA, 13 nt, Yersinia pestis KIM
uagugccacaaca

SEQ ID NO: 4178988 - RNA, 16 nt, Yersinia pestis KIM
uagugcuacagcagca

SEQ ID NO: 4178989 - RNA, 22 nt, Yersinia pestis KIM
uagugcuuccaacucaccuaaa

SEQ ID NO: 4178990 - RNA, 15 nt, Yersinia pestis KIM
uaguggcacaaauaa

SEQ ID NO: 4178991 - RNA, 23 nt, Yersinia pestis KIM
uaguggugagcgccaugcgcuuu

SEQ ID NO: 4178992 - RNA, 21 nt, Yersinia pestis KIM
uaguguaaaaaccaucugaug

SEQ ID NO: 4178993 - RNA, 14 nt, Yersinia pestis KIM
uaguguguuuucuu

SEQ ID NO: 4178994 - RNA, 15 nt, Yersinia pestis KIM
uaguuaacccuauuu

SEQ ID NO: 4178995 - RNA, 14 nt, Yersinia pestis KIM
uaguuauauaaggu

SEQ ID NO: 4178996 - RNA, 23 nt, Yersinia pestis KIM
uaguuaucucccauuaauuaauc

SEQ ID NO: 4178997 - RNA, 23 nt, Yersinia pestis KIM
uaguuaucugggcggauaaggau

SEQ ID NO: 4178998 - RNA, 22 nt, Yersinia pestis KIM
uaguuauugauuaauuuuucau

SEQ ID NO: 4178999 - RNA, 14 nt, Yersinia pestis KIM
uaguucaaugguca

SEQ ID NO: 4179000 - RNA, 20 nt, Yersinia pestis KIM
uaguucacgauggaaaaaau

SEQ ID NO: 4179001 - RNA, 23 nt, Yersinia pestis KIM
uaguucacgauggaaaaaauaca

SEQ ID NO: 4179002 - RNA, 11 nt, Yersinia pestis KIM
uaguucagucg

SEQ ID NO: 4179003 - RNA, 13 nt, Yersinia pestis KIM
uaguucauuuugu

SEQ ID NO: 4179004 - RNA, 19 nt, Yersinia pestis KIM
uaguucuucugauaaaaca

SEQ ID NO: 4179005 - RNA, 13 nt, Yersinia pestis KIM
uaguuuauuuuau

SEQ ID NO: 4179006 - RNA, 17 nt, Yersinia pestis KIM
uaguuuauuuuauuuaa

SEQ ID NO: 4179007 - RNA, 20 nt, Yersinia pestis KIM
uauaaaaaagcaugcagaau

SEQ ID NO: 4179008 - RNA, 18 nt, Yersinia pestis KIM
uauaaaaaagcugucaua

SEQ ID NO: 4179009 - RNA, 20 nt, Yersinia pestis KIM
uauaaaaaagcugucauaaa

SEQ ID NO: 4179010 - RNA, 12 nt, Yersinia pestis KIM
uauaaaaacccc

SEQ ID NO: 4179011 - RNA, 20 nt, Yersinia pestis KIM
uauaaaacacgcauaugaau

SEQ ID NO: 4179012 - RNA, 16 nt, Yersinia pestis KIM
uauaaaagcacagaca

SEQ ID NO: 4179013 - RNA, 16 nt, Yersinia pestis KIM
uauaaaagcaucucga

SEQ ID NO: 4179014 - RNA, 22 nt, Yersinia pestis KIM
uauaaaauaauaagauucagcu

SEQ ID NO: 4179015 - RNA, 23 nt, Yersinia pestis KIM
uauaaacacugauuuauaaauaa

SEQ ID NO: 4179016 - RNA, 18 nt, Yersinia pestis KIM
uauaaacacuuaccuaua

SEQ ID NO: 4179017 - RNA, 14 nt, Yersinia pestis KIM
uauaaacauaaaaa

SEQ ID NO: 4179018 - RNA, 17 nt, Yersinia pestis KIM
uauaaacauuuacuuau

SEQ ID NO: 4179019 - RNA, 21 nt, Yersinia pestis KIM
uauaaacauuuacuuauaaac

SEQ ID NO: 4179020 - RNA, 17 nt, Yersinia pestis KIM
uauaaacuaauaucuuu

SEQ ID NO: 4179021 - RNA, 20 nt, Yersinia pestis KIM
uauaaagauuuuaagcacug

SEQ ID NO: 4179022 - RNA, 14 nt, Yersinia pestis KIM
uauaaagcauuuau

SEQ ID NO: 4179023 - RNA, 23 nt, Yersinia pestis KIM
uauaaagccauuggucaaucuag

SEQ ID NO: 4179024 - RNA, 13 nt, Yersinia pestis KIM
uauaaauaaaaua

SEQ ID NO: 4179025 - RNA, 14 nt, Yersinia pestis KIM
uauaaauaaaauag

SEQ ID NO: 4179026 - RNA, 14 nt, Yersinia pestis KIM
uauaaauaauuaau

SEQ ID NO: 4179027 - RNA, 18 nt, Yersinia pestis KIM
uauaaaugauugcuauau

SEQ ID NO: 4179028 - RNA, 21 nt, Yersinia pestis KIM
uauaaauggcuguuauauaaa

SEQ ID NO: 4179029 - RNA, 13 nt, Yersinia pestis KIM
uauaaauuaaaaa

SEQ ID NO: 4179030 - RNA, 17 nt, Yersinia pestis KIM
uauaaauuaaaaagagu

SEQ ID NO: 4179031 - RNA, 15 nt, Yersinia pestis KIM
uauaaauuuuaaguu

SEQ ID NO: 4179032 - RNA, 18 nt, Yersinia pestis KIM
uauaacauaauaaauuaa

SEQ ID NO: 4179033 - RNA, 17 nt, Yersinia pestis KIM
uauaaccaugaugacaa

SEQ ID NO: 4179034 - RNA, 19 nt, Yersinia pestis KIM
uauaaccccccugcugaua

SEQ ID NO: 4179035 - RNA, 16 nt, Yersinia pestis KIM
uauaagcaauaccgac

SEQ ID NO: 4179036 - RNA, 14 nt, Yersinia pestis KIM
uauaaggaauauac

SEQ ID NO: 4179037 - RNA, 16 nt, Yersinia pestis KIM
uauaaggaauauacuu

SEQ ID NO: 4179038 - RNA, 17 nt, Yersinia pestis KIM
uauaaggaauauacuuu

SEQ ID NO: 4179039 - RNA, 14 nt, Yersinia pestis KIM
uauaauaacucuau

SEQ ID NO: 4179040 - RNA, 11 nt, Yersinia pestis KIM
uauaauaaugg

SEQ ID NO: 4179041 - RNA, 16 nt, Yersinia pestis KIM
uauaauaugccagcgc

SEQ ID NO: 4179042 - RNA, 15 nt, Yersinia pestis KIM
uauaaucaucuacaa

SEQ ID NO: 4179043 - RNA, 18 nt, Yersinia pestis KIM
uauaaucaucuacaacau

SEQ ID NO: 4179044 - RNA, 22 nt, Yersinia pestis KIM
uauaaucaucuacaacaucauc

SEQ ID NO: 4179045 - RNA, 21 nt, Yersinia pestis KIM
uauaauccaaaauaauauaau

SEQ ID NO: 4179046 - RNA, 16 nt, Yersinia pestis KIM
uauaaugaaauaguaa

SEQ ID NO: 4179047 - RNA, 12 nt, Yersinia pestis KIM
uauaaugaugua

SEQ ID NO: 4179048 - RNA, 15 nt, Yersinia pestis KIM
uauaauuaacagcau

SEQ ID NO: 4179049 - RNA, 13 nt, Yersinia pestis KIM
uauaauucaauau

SEQ ID NO: 4179050 - RNA, 23 nt, Yersinia pestis KIM
uauaauuucaagaauugugcccc

SEQ ID NO: 4179051 - RNA, 18 nt, Yersinia pestis KIM
uauaauuucuugucaccu

SEQ ID NO: 4179052 - RNA, 19 nt, Yersinia pestis KIM
uauacaauccaaccuauau

SEQ ID NO: 4179053 - RNA, 13 nt, Yersinia pestis KIM
uauacagaagagu

SEQ ID NO: 4179054 - RNA, 19 nt, Yersinia pestis KIM
uauacagaagaguacgcuu

SEQ ID NO: 4179055 - RNA, 18 nt, Yersinia pestis KIM
uauacagcauauaaaaaa

SEQ ID NO: 4179056 - RNA, 22 nt, Yersinia pestis KIM
uauacagcccgguaucaccuuu

SEQ ID NO: 4179057 - RNA, 23 nt, Yersinia pestis KIM
uauacauacccgucauaccguua

SEQ ID NO: 4179058 - RNA, 15 nt, Yersinia pestis KIM
uauaccaacucugaa

SEQ ID NO: 4179059 - RNA, 19 nt, Yersinia pestis KIM
uauaccaacucugaaguaa

SEQ ID NO: 4179060 - RNA, 23 nt, Yersinia pestis KIM
uauacccaccagagaccacagau

SEQ ID NO: 4179061 - RNA, 19 nt, Yersinia pestis KIM
uauacuaaaacagcucacu

SEQ ID NO: 4179062 - RNA, 23 nt, Yersinia pestis KIM
uauacuaaauagauaaaaacauu

SEQ ID NO: 4179063 - RNA, 15 nt, Yersinia pestis KIM
uaucccuguuuucua

SEQ ID NO: 4179064 - RNA, 14 nt, Yersinia pestis KIM
uaucccuuacgauc

SEQ ID NO: 4179065 - RNA, 15 nt, Yersinia pestis KIM
uauccgccaaagauu

SEQ ID NO: 4179066 - RNA, 20 nt, Yersinia pestis KIM
uauccguuuacgacaauccu

SEQ ID NO: 4179067 - RNA, 14 nt, Yersinia pestis KIM
uauccuauuuuuac

SEQ ID NO: 4179068 - RNA, 18 nt, Yersinia pestis KIM
uauccucaccguucaaga

SEQ ID NO: 4179069 - RNA, 18 nt, Yersinia pestis KIM
uauccucuggguaugcuc

SEQ ID NO: 4179070 - RNA, 15 nt, Yersinia pestis KIM
uauccugugccaaca

SEQ ID NO: 4179071 - RNA, 22 nt, Yersinia pestis KIM
uauccuugauggaaauacgcuu

SEQ ID NO: 4179072 - RNA, 15 nt, Yersinia pestis KIM
uaucgaccaugaaua

SEQ ID NO: 4179073 - RNA, 13 nt, Yersinia pestis KIM
uaucgauaagaaa

SEQ ID NO: 4179074 - RNA, 13 nt, Yersinia pestis KIM
uaucgauuucuac

SEQ ID NO: 4179075 - RNA, 19 nt, Yersinia pestis KIM
uaucgauuuuuaagucaau

SEQ ID NO: 4179076 - RNA, 17 nt, Yersinia pestis KIM
uaucgcauccgggaacc

SEQ ID NO: 4179077 - RNA, 21 nt, Yersinia pestis KIM
uaucgcgaaacucuuccuugc

SEQ ID NO: 4179078 - RNA, 20 nt, Yersinia pestis KIM
uaucgcgguuuuaaauacac

SEQ ID NO: 4179079 - RNA, 15 nt, Yersinia pestis KIM
uaucgcucaucaugg

SEQ ID NO: 4179080 - RNA, 15 nt, Yersinia pestis KIM
uaucgcuuuuagaua

SEQ ID NO: 4179081 - RNA, 15 nt, Yersinia pestis KIM
uaucggcaaauuaaa

SEQ ID NO: 4179082 - RNA, 21 nt, Yersinia pestis KIM
uaucggccauauuaccgcuga

SEQ ID NO: 4179083 - RNA, 14 nt, Yersinia pestis KIM
uaucggcggagaga

SEQ ID NO: 4179084 - RNA, 17 nt, Yersinia pestis KIM
uaucgggauucacaccg

SEQ ID NO: 4179085 - RNA, 13 nt, Yersinia pestis KIM
uaucggguaucug

SEQ ID NO: 4179086 - RNA, 18 nt, Yersinia pestis KIM
uaucguuaucaacgccca

SEQ ID NO: 4179087 - RNA, 19 nt, Yersinia pestis KIM
uaucguuuccagcggcgua

SEQ ID NO: 4179088 - RNA, 17 nt, Yersinia pestis KIM
uaucguuucuguuuugu

SEQ ID NO: 4179089 - RNA, 21 nt, Yersinia pestis KIM
uaucuaaaaggauagggagcc

SEQ ID NO: 4179090 - RNA, 22 nt, Yersinia pestis KIM
uaucuaauguauuuauucaaaa

SEQ ID NO: 4179091 - RNA, 18 nt, Yersinia pestis KIM
uaucuagcaacacaucgg

SEQ ID NO: 4179092 - RNA, 23 nt, Yersinia pestis KIM
uaucuauauagggaaauaacauc

SEQ ID NO: 4179093 - RNA, 19 nt, Yersinia pestis KIM
uaucuauuuuuauuucucc

SEQ ID NO: 4179094 - RNA, 15 nt, Yersinia pestis KIM
uaucucauccagcaa

SEQ ID NO: 4179095 - RNA, 19 nt, Yersinia pestis KIM
uaucuccaccaacggccca

SEQ ID NO: 4179096 - RNA, 20 nt, Yersinia pestis KIM
uaucucccauuaauuaauca

SEQ ID NO: 4179097 - RNA, 20 nt, Yersinia pestis KIM
uaucucguaacaacggcugg

SEQ ID NO: 4179098 - RNA, 21 nt, Yersinia pestis KIM
uaucugccaauucaaggccag

SEQ ID NO: 4179099 - RNA, 14 nt, Yersinia pestis KIM
uaucugcguuuucu

SEQ ID NO: 4179100 - RNA, 20 nt, Yersinia pestis KIM
uaucugcuaauuaaaccuga

SEQ ID NO: 4179101 - RNA, 20 nt, Yersinia pestis KIM
uaucugcugcgguauuaccc

SEQ ID NO: 4179102 - RNA, 15 nt, Yersinia pestis KIM
uaucuggcuuuccug

SEQ ID NO: 4179103 - RNA, 12 nt, Yersinia pestis KIM
uaucuuauucau

SEQ ID NO: 4179104 - RNA, 20 nt, Yersinia pestis KIM
uaucuucccuguccagccca

SEQ ID NO: 4179105 - RNA, 15 nt, Yersinia pestis KIM
uaucuugaaccaauu

SEQ ID NO: 4179106 - RNA, 21 nt, Yersinia pestis KIM
uaucuugaaccaauuuuucug

SEQ ID NO: 4179107 - RNA, 19 nt, Yersinia pestis KIM
uaucuugcugaaaacaaua

SEQ ID NO: 4179108 - RNA, 20 nt, Yersinia pestis KIM
uaucuugcugaaaacaauau

SEQ ID NO: 4179109 - RNA, 19 nt, Yersinia pestis KIM
uaucuuguaaauagucaua

SEQ ID NO: 4179110 - RNA, 15 nt, Yersinia pestis KIM
uaucuuuaaaaaccc

SEQ ID NO: 4179111 - RNA, 13 nt, Yersinia pestis KIM
uaucuuuaauuuu

SEQ ID NO: 4179112 - RNA, 16 nt, Yersinia pestis KIM
uaucuuuauugcuccu

SEQ ID NO: 4179113 - RNA, 18 nt, Yersinia pestis KIM
uaucuuuuauuuaugaua

SEQ ID NO: 4179114 - RNA, 17 nt, Yersinia pestis KIM
uaucuuuucugauuuuu

SEQ ID NO: 4179115 - RNA, 13 nt, Yersinia pestis KIM
uaugaagauaacg

SEQ ID NO: 4179116 - RNA, 14 nt, Yersinia pestis KIM
uaugaaggccauaa

SEQ ID NO: 4179117 - RNA, 10 nt, Yersinia pestis KIM
uaugaauaaa

SEQ ID NO: 4179118 - RNA, 19 nt, Yersinia pestis KIM
uaugaaugagguuuacauu

SEQ ID NO: 4179119 - RNA, 22 nt, Yersinia pestis KIM
uaugaaugaguuucaagucaau

SEQ ID NO: 4179120 - RNA, 20 nt, Yersinia pestis KIM
uaugaauggaaguuaaaaaa

SEQ ID NO: 4179121 - RNA, 22 nt, Yersinia pestis KIM
uaugaauggaaguuaaaaaaau

SEQ ID NO: 4179122 - RNA, 21 nt, Yersinia pestis KIM
uaugacaaguugucuguaaua

SEQ ID NO: 4179123 - RNA, 17 nt, Yersinia pestis KIM
uaugacaauauccguuu

SEQ ID NO: 4179124 - RNA, 19 nt, Yersinia pestis KIM
uaugacagaaaaaucacau

SEQ ID NO: 4179125 - RNA, 16 nt, Yersinia pestis KIM
uaugacagcauacauc

SEQ ID NO: 4179126 - RNA, 24 nt, Yersinia pestis KIM
uaugacgccaacuucaagccgaua

SEQ ID NO: 4179127 - RNA, 21 nt, Yersinia pestis KIM
uaugacggguauauagccauu

SEQ ID NO: 4179128 - RNA, 13 nt, Yersinia pestis KIM
uaugacuucuuau

SEQ ID NO: 4179129 - RNA, 18 nt, Yersinia pestis KIM
uaugaucuugauaaacau

SEQ ID NO: 4179130 - RNA, 13 nt, Yersinia pestis KIM
uaugcagcgauua

SEQ ID NO: 4179131 - RNA, 19 nt, Yersinia pestis KIM
uaugcaguuaagguuagcu

SEQ ID NO: 4179132 - RNA, 15 nt, Yersinia pestis KIM
uaugcaguuuuccuc

SEQ ID NO: 4179133 - RNA, 14 nt, Yersinia pestis KIM
uaugcauuauugau

SEQ ID NO: 4179134 - RNA, 15 nt, Yersinia pestis KIM
uaugcauuauugaug

SEQ ID NO: 4179135 - RNA, 22 nt, Yersinia pestis KIM
uaugcauuauugauguuauuaa

SEQ ID NO: 4179136 - RNA, 16 nt, Yersinia pestis KIM
uaugccaguuauuauu

SEQ ID NO: 4179137 - RNA, 20 nt, Yersinia pestis KIM
uaugccauauuacucucuau

SEQ ID NO: 4179138 - RNA, 19 nt, Yersinia pestis KIM
uaugccauuaucuuuaauu

SEQ ID NO: 4179139 - RNA, 14 nt, Yersinia pestis KIM
uaugccgacaacca

SEQ ID NO: 4179140 - RNA, 19 nt, Yersinia pestis KIM
uaugccgcccucuuuucuu

SEQ ID NO: 4179141 - RNA, 19 nt, Yersinia pestis KIM
uaugccggggauauuuugc

SEQ ID NO: 4179142 - RNA, 13 nt, Yersinia pestis KIM
uaugccuuuucuu

SEQ ID NO: 4179143 - RNA, 19 nt, Yersinia pestis KIM
uaugcguggguucuucaaa

SEQ ID NO: 4179144 - RNA, 23 nt, Yersinia pestis KIM
uaugcucaccgcccccaauaagg

SEQ ID NO: 4179145 - RNA, 12 nt, Yersinia pestis KIM
uaugcucugcug

SEQ ID NO: 4179146 - RNA, 20 nt, Yersinia pestis KIM
uaugcugaauaaacggcaag

SEQ ID NO: 4179147 - RNA, 14 nt, Yersinia pestis KIM
uaugcuguauaaaa

SEQ ID NO: 4179148 - RNA, 15 nt, Yersinia pestis KIM
uaugcuuaauuuggc

SEQ ID NO: 4179149 - RNA, 15 nt, Yersinia pestis KIM
uaugcuugcggcguu

SEQ ID NO: 4179150 - RNA, 20 nt, Yersinia pestis KIM
uauggacaagggcuauuuuu

SEQ ID NO: 4179151 - RNA, 21 nt, Yersinia pestis KIM
uauggagaggcgcuagccucu

SEQ ID NO: 4179152 - RNA, 22 nt, Yersinia pestis KIM
uauggagaggcgcuagccucuc

SEQ ID NO: 4179153 - RNA, 20 nt, Yersinia pestis KIM
uauggauaaauccugaacau

SEQ ID NO: 4179154 - RNA, 15 nt, Yersinia pestis KIM
uauggauaauuuaau

SEQ ID NO: 4179155 - RNA, 17 nt, Yersinia pestis KIM
uauggauaauuuaauua

SEQ ID NO: 4179156 - RNA, 15 nt, Yersinia pestis KIM
uauggauacacggcu

SEQ ID NO: 4179157 - RNA, 16 nt, Yersinia pestis KIM
uauggaugaugcacag

SEQ ID NO: 4179158 - RNA, 22 nt, Yersinia pestis KIM
uauggcgaugaugauuauuuua

SEQ ID NO: 4179159 - RNA, 15 nt, Yersinia pestis KIM
uaugggcauccaucg

SEQ ID NO: 4179160 - RNA, 19 nt, Yersinia pestis KIM
uauggggaugauuguuuua

SEQ ID NO: 4179161 - RNA, 21 nt, Yersinia pestis KIM
uaugguauagacuguuuuauu

SEQ ID NO: 4179162 - RNA, 13 nt, Yersinia pestis KIM
uauggucagcaau

SEQ ID NO: 4179163 - RNA, 13 nt, Yersinia pestis KIM
uaugguuaaucua

SEQ ID NO: 4179164 - RNA, 14 nt, Yersinia pestis KIM
uaugguuaucacau

SEQ ID NO: 4179165 - RNA, 17 nt, Yersinia pestis KIM
uauguaaauaguuacua

SEQ ID NO: 4179166 - RNA, 16 nt, Yersinia pestis KIM
uauguaaugccacacu

SEQ ID NO: 4179167 - RNA, 16 nt, Yersinia pestis KIM
uauguacacauuauuu

SEQ ID NO: 4179168 - RNA, 23 nt, Yersinia pestis KIM
uauguagggguacagcagggauu

SEQ ID NO: 4179169 - RNA, 15 nt, Yersinia pestis KIM
uauguaguuaaucua

SEQ ID NO: 4179170 - RNA, 23 nt, Yersinia pestis KIM
uaugucaccuccacuucaagccg

SEQ ID NO: 4179171 - RNA, 20 nt, Yersinia pestis KIM
uaugucagauagaccaauga

SEQ ID NO: 4179172 - RNA, 15 nt, Yersinia pestis KIM
uauguccucaccauu

SEQ ID NO: 4179173 - RNA, 16 nt, Yersinia pestis KIM
uaugugccaaaaaaag

SEQ ID NO: 4179174 - RNA, 17 nt, Yersinia pestis KIM
uauguucuuccugugcg

SEQ ID NO: 4179175 - RNA, 13 nt, Yersinia pestis KIM
uauguucuucuug

SEQ ID NO: 4179176 - RNA, 21 nt, Yersinia pestis KIM
uauguugauuccguauuauuu

SEQ ID NO: 4179177 - RNA, 20 nt, Yersinia pestis KIM
uauuaaacagauucaauauu

SEQ ID NO: 4179178 - RNA, 17 nt, Yersinia pestis KIM
uauuguggauaguaaac

SEQ ID NO: 4179179 - RNA, 14 nt, Yersinia pestis KIM
uauuguggcuacca

SEQ ID NO: 4179180 - RNA, 20 nt, Yersinia pestis KIM
uauuguggggccuuuauuca

SEQ ID NO: 4179181 - RNA, 22 nt, Yersinia pestis KIM
uauuguggggccuuuauucauu

SEQ ID NO: 4179182 - RNA, 22 nt, Yersinia pestis KIM
uauuguuauuuuggcuuucagu

SEQ ID NO: 4179183 - RNA, 17 nt, Yersinia pestis KIM
uauuguucaaaaacgca

SEQ ID NO: 4179184 - RNA, 20 nt, Yersinia pestis KIM
uauuguugccaauguugcug

SEQ ID NO: 4179185 - RNA, 19 nt, Yersinia pestis KIM
uauuguuuugacuaaaauu

SEQ ID NO: 4179186 - RNA, 18 nt, Yersinia pestis KIM
uauuuaaaauuaauaguu

SEQ ID NO: 4179187 - RNA, 19 nt, Yersinia pestis KIM
uauuuaaaauuaauaguuu

SEQ ID NO: 4179188 - RNA, 12 nt, Yersinia pestis KIM
uauuuaaauagu

SEQ ID NO: 4179189 - RNA, 18 nt, Yersinia pestis KIM
uauuuaaauuuuuauaua

SEQ ID NO: 4179190 - RNA, 19 nt, Yersinia pestis KIM
uauuuaaauuuuuauauaa

SEQ ID NO: 4179191 - RNA, 12 nt, Yersinia pestis KIM
uauuuaacuguu

SEQ ID NO: 4179192 - RNA, 22 nt, Yersinia pestis KIM
uauuuaagcaguucacucuguu

SEQ ID NO: 4179193 - RNA, 21 nt, Yersinia pestis KIM
uauuuaagcugaaauuuuuua

SEQ ID NO: 4179194 - RNA, 20 nt, Yersinia pestis KIM
uauuuaccugcucaacugcu

SEQ ID NO: 4179195 - RNA, 17 nt, Yersinia pestis KIM
uauuuacggcgucuuua

SEQ ID NO: 4179196 - RNA, 20 nt, Yersinia pestis KIM
uauuuacucaucuauuagau

SEQ ID NO: 4179197 - RNA, 20 nt, Yersinia pestis KIM
uauuuagguaguuuuauuca

SEQ ID NO: 4179198 - RNA, 15 nt, Yersinia pestis KIM
uauuuauaaaaccac

SEQ ID NO: 4179199 - RNA, 19 nt, Yersinia pestis KIM
uauuuauaugauaauaguu

SEQ ID NO: 4179200 - RNA, 15 nt, Yersinia pestis KIM
uauuuauccuauuuu

SEQ ID NO: 4179201 - RNA, 20 nt, Yersinia pestis KIM
uauuuauugccauuuuaauc

SEQ ID NO: 4179202 - RNA, 14 nt, Yersinia pestis KIM
uauuuauuguaagg

SEQ ID NO: 4179203 - RNA, 16 nt, Yersinia pestis KIM
uauuucaaauaagugu

SEQ ID NO: 4179204 - RNA, 21 nt, Yersinia pestis KIM
uauuucaaauaaguguuucaa

SEQ ID NO: 4179205 - RNA, 22 nt, Yersinia pestis KIM
uauuucaagcuacaugugcauu

SEQ ID NO: 4179206 - RNA, 19 nt, Yersinia pestis KIM
uauuucacacuguuuaguu

SEQ ID NO: 4179207 - RNA, 19 nt, Yersinia pestis KIM
uauuucacgcuaauuauuu

SEQ ID NO: 4179208 - RNA, 20 nt, Yersinia pestis KIM
uauuucacgcuaauuauuuu

SEQ ID NO: 4179209 - RNA, 22 nt, Yersinia pestis KIM
uauuucacgcuaauuauuuuau

SEQ ID NO: 4179210 - RNA, 14 nt, Yersinia pestis KIM
uauuucacuguuau

SEQ ID NO: 4179211 - RNA, 16 nt, Yersinia pestis KIM
uauuucagauuuauuu

SEQ ID NO: 4179212 - RNA, 14 nt, Yersinia pestis KIM
uauuucauuagauc

SEQ ID NO: 4179213 - RNA, 18 nt, Yersinia pestis KIM
uauuuccacgacaugagc

SEQ ID NO: 4179214 - RNA, 13 nt, Yersinia pestis KIM
uauuucuucauac

SEQ ID NO: 4179215 - RNA, 22 nt, Yersinia pestis KIM
uauuucuugcagugcuucauca

SEQ ID NO: 4179216 - RNA, 21 nt, Yersinia pestis KIM
uauuugaaauacuuauuugaa

SEQ ID NO: 4179217 - RNA, 16 nt, Yersinia pestis KIM
uauuugaacuucaaau

SEQ ID NO: 4179218 - RNA, 13 nt, Yersinia pestis KIM
uauuugcaaugcg

SEQ ID NO: 4179219 - RNA, 13 nt, Yersinia pestis KIM
uauuugcagaaag

SEQ ID NO: 4179220 - RNA, 18 nt, Yersinia pestis KIM
uauuugcagaaaguaauc

SEQ ID NO: 4179221 - RNA, 13 nt, Yersinia pestis KIM
uauuugcugccug

SEQ ID NO: 4179222 - RNA, 14 nt, Yersinia pestis KIM
uauuugcugccugu

SEQ ID NO: 4179223 - RNA, 22 nt, Yersinia pestis KIM
uauuuggauuaaguccaagaag

SEQ ID NO: 4179224 - RNA, 16 nt, Yersinia pestis KIM
uauuuggcucagcaag

SEQ ID NO: 4179225 - RNA, 19 nt, Yersinia pestis KIM
uauuuggugaguaaaugcc

SEQ ID NO: 4179226 - RNA, 16 nt, Yersinia pestis KIM
uauuuuaccuauuuau

SEQ ID NO: 4179227 - RNA, 13 nt, Yersinia pestis KIM
uauuuuauuuaau

SEQ ID NO: 4179228 - RNA, 17 nt, Yersinia pestis KIM
uauuuucgacaaaauca

SEQ ID NO: 4179229 - RNA, 14 nt, Yersinia pestis KIM
uauuuucuauacca

SEQ ID NO: 4179230 - RNA, 15 nt, Yersinia pestis KIM
uauuuucuauaccaa

SEQ ID NO: 4179231 - RNA, 21 nt, Yersinia pestis KIM
uauuuucugauguguauauuu

SEQ ID NO: 4179232 - RNA, 19 nt, Yersinia pestis KIM
uauuuugaauauuuuuaau

SEQ ID NO: 4179233 - RNA, 23 nt, Yersinia pestis KIM
uauuuugggcuaaaacucaaaua

SEQ ID NO: 4179234 - RNA, 13 nt, Yersinia pestis KIM
uauuuuguuugua

SEQ ID NO: 4179235 - RNA, 18 nt, Yersinia pestis KIM
uauuuuguuuguaaauuu

SEQ ID NO: 4179236 - RNA, 22 nt, Yersinia pestis KIM
uauuuuguuuguaaauuuuaaa

SEQ ID NO: 4179237 - RNA, 13 nt, Yersinia pestis KIM
uauuuuuauuaau

SEQ ID NO: 4179238 - RNA, 18 nt, Yersinia pestis KIM
uauuuuugcauauaaaac

SEQ ID NO: 4179239 - RNA, 14 nt, Yersinia pestis KIM
uauuuuuuaugacu

SEQ ID NO: 4179240 - RNA, 20 nt, Yersinia pestis KIM
ucaaaaacccauuaaaaaca

SEQ ID NO: 4179241 - RNA, 12 nt, Yersinia pestis KIM
ucaaaaaugaua

SEQ ID NO: 4179242 - RNA, 12 nt, Yersinia pestis KIM
ucaaaacaauau

SEQ ID NO: 4179243 - RNA, 16 nt, Yersinia pestis KIM
ucaaaacaaucacuga

SEQ ID NO: 4179244 - RNA, 24 nt, Yersinia pestis KIM
ucaaaacggcaauuaagcaaaaag

SEQ ID NO: 4179245 - RNA, 22 nt, Yersinia pestis KIM
ucaaaagaaacugucagucaaa

SEQ ID NO: 4179246 - RNA, 14 nt, Yersinia pestis KIM
ucaaaauaaaaauu

SEQ ID NO: 4179247 - RNA, 16 nt, Yersinia pestis KIM
ucaaaauagaggaaau

SEQ ID NO: 4179248 - RNA, 21 nt, Yersinia pestis KIM
ucaaaauagaggaaauaaaug

SEQ ID NO: 4179249 - RNA, 13 nt, Yersinia pestis KIM
ucaaaaucaaaaa

SEQ ID NO: 4179250 - RNA, 22 nt, Yersinia pestis KIM
ucaaaaucacuucuucaauaga

SEQ ID NO: 4179251 - RNA, 15 nt, Yersinia pestis KIM
ucaaaaucuucggca

SEQ ID NO: 4179252 - RNA, 12 nt, Yersinia pestis KIM
ucaaaauuccau

SEQ ID NO: 4179253 - RNA, 11 nt, Yersinia pestis KIM
ucaaacaaaua

SEQ ID NO: 4179254 - RNA, 23 nt, Yersinia pestis KIM
ucaaacaaaucuuaaauugaaga

SEQ ID NO: 4179255 - RNA, 13 nt, Yersinia pestis KIM
ucaaacauagaca

SEQ ID NO: 4179256 - RNA, 21 nt, Yersinia pestis KIM
ucaaaccgccagccacgcaga

SEQ ID NO: 4179257 - RNA, 21 nt, Yersinia pestis KIM
ucaaacgggugcgccaaucgc

SEQ ID NO: 4179258 - RNA, 18 nt, Yersinia pestis KIM
ucaaacgugaaauugcuu

SEQ ID NO: 4179259 - RNA, 13 nt, Yersinia pestis KIM
ucaaacuauucau

SEQ ID NO: 4179260 - RNA, 17 nt, Yersinia pestis KIM
ucaaacucagcgaauaa

SEQ ID NO: 4179261 - RNA, 19 nt, Yersinia pestis KIM
ucaaacucagcgaauaaau

SEQ ID NO: 4179262 - RNA, 16 nt, Yersinia pestis KIM
ucaaacuggcccagcu

SEQ ID NO: 4179263 - RNA, 13 nt, Yersinia pestis KIM
ucaaagauuucau

SEQ ID NO: 4179264 - RNA, 12 nt, Yersinia pestis KIM
ucaaauaaguau

SEQ ID NO: 4179265 - RNA, 17 nt, Yersinia pestis KIM
ucaaauaaguguuucaa

SEQ ID NO: 4179266 - RNA, 20 nt, Yersinia pestis KIM
ucaaauaaguguuucaaaua

SEQ ID NO: 4179267 - RNA, 20 nt, Yersinia pestis KIM
ucaaauacgaccgucaccaa

SEQ ID NO: 4179268 - RNA, 21 nt, Yersinia pestis KIM
ucaaauagauagcaaucaaua

SEQ ID NO: 4179269 - RNA, 17 nt, Yersinia pestis KIM
ucaaauaucauuauuuu

SEQ ID NO: 4179270 - RNA, 20 nt, Yersinia pestis KIM
ucaaaucgccaaacugcuca

SEQ ID NO: 4179271 - RNA, 18 nt, Yersinia pestis KIM
ucaaaugagucguaaaau

SEQ ID NO: 4179272 - RNA, 21 nt, Yersinia pestis KIM
ucaaaugauucagugauaaca

SEQ ID NO: 4179273 - RNA, 12 nt, Yersinia pestis KIM
ucaaaugucccc

SEQ ID NO: 4179274 - RNA, 21 nt, Yersinia pestis KIM
ucaaauucagguugaucagua

SEQ ID NO: 4179275 - RNA, 18 nt, Yersinia pestis KIM
ucaacaaauucaccagca

SEQ ID NO: 4179276 - RNA, 14 nt, Yersinia pestis KIM
ucaacaaguugccc

SEQ ID NO: 4179277 - RNA, 16 nt, Yersinia pestis KIM
ucaacaaucaaucacc

SEQ ID NO: 4179278 - RNA, 23 nt, Yersinia pestis KIM
ucaacaauuucgcuggucuuaau

SEQ ID NO: 4179279 - RNA, 18 nt, Yersinia pestis KIM
ucaacacggugaauaaac

SEQ ID NO: 4179280 - RNA, 12 nt, Yersinia pestis KIM
ucaacagaacua

SEQ ID NO: 4179281 - RNA, 22 nt, Yersinia pestis KIM
ucaacagaacuaauaucaacag

SEQ ID NO: 4179282 - RNA, 23 nt, Yersinia pestis KIM
ucaacagauaugcauuauugaug

SEQ ID NO: 4179283 - RNA, 16 nt, Yersinia pestis KIM
ucaacagcaucaucaa

SEQ ID NO: 4179284 - RNA, 22 nt, Yersinia pestis KIM
ucaacauuuaagugcuaaucau

SEQ ID NO: 4179285 - RNA, 22 nt, Yersinia pestis KIM
ucaaccaauuauccaucccuau

SEQ ID NO: 4179286 - RNA, 17 nt, Yersinia pestis KIM
ucaaccacgguaauagc

SEQ ID NO: 4179287 - RNA, 14 nt, Yersinia pestis KIM
ucaaccaguugaug

SEQ ID NO: 4179288 - RNA, 17 nt, Yersinia pestis KIM
ucaaccccuucuucacc

SEQ ID NO: 4179289 - RNA, 13 nt, Yersinia pestis KIM
ucaaccucagccu

SEQ ID NO: 4179290 - RNA, 14 nt, Yersinia pestis KIM
ucaaccucagccuc

SEQ ID NO: 4179291 - RNA, 15 nt, Yersinia pestis KIM
ucaaccucagccuca

SEQ ID NO: 4179292 - RNA, 20 nt, Yersinia pestis KIM
ucaaccucagccucauucau

SEQ ID NO: 4179293 - RNA, 14 nt, Yersinia pestis KIM
ucacagcauucaga

SEQ ID NO: 4179294 - RNA, 16 nt, Yersinia pestis KIM
ucacaggccacugcau

SEQ ID NO: 4179295 - RNA, 20 nt, Yersinia pestis KIM
ucacaguaaaucaggccggu

SEQ ID NO: 4179296 - RNA, 12 nt, Yersinia pestis KIM
ucacaguaaauu

SEQ ID NO: 4179297 - RNA, 15 nt, Yersinia pestis KIM
ucacauaaauaaguu

SEQ ID NO: 4179298 - RNA, 14 nt, Yersinia pestis KIM
ucacauaauauuua

SEQ ID NO: 4179299 - RNA, 16 nt, Yersinia pestis KIM
ucacauagcuguaaau

SEQ ID NO: 4179300 - RNA, 20 nt, Yersinia pestis KIM
ucacauagugcaaaauucca

SEQ ID NO: 4179301 - RNA, 16 nt, Yersinia pestis KIM
ucacaucauaaucggu

SEQ ID NO: 4179302 - RNA, 20 nt, Yersinia pestis KIM
ucacauccaauggcaaugga

SEQ ID NO: 4179303 - RNA, 19 nt, Yersinia pestis KIM
ucacaucgcccugcucuuc

SEQ ID NO: 4179304 - RNA, 17 nt, Yersinia pestis KIM
ucacaucggucaauacc

SEQ ID NO: 4179305 - RNA, 21 nt, Yersinia pestis KIM
ucacaucugggucauguggaa

SEQ ID NO: 4179306 - RNA, 24 nt, Yersinia pestis KIM
ucacaugcggauugaacugcgcua

SEQ ID NO: 4179307 - RNA, 14 nt, Yersinia pestis KIM
ucacauuuuuaaua

SEQ ID NO: 4179308 - RNA, 20 nt, Yersinia pestis KIM
ucacauuuuuaauaaugugu

SEQ ID NO: 4179309 - RNA, 14 nt, Yersinia pestis KIM
ucaccaaaauccca

SEQ ID NO: 4179310 - RNA, 19 nt, Yersinia pestis KIM
ucaccaaaaucccaaaaua

SEQ ID NO: 4179311 - RNA, 15 nt, Yersinia pestis KIM
ucaccaaaggaagcc

SEQ ID NO: 4179312 - RNA, 17 nt, Yersinia pestis KIM
ucaccaacaccaccauc

SEQ ID NO: 4179313 - RNA, 18 nt, Yersinia pestis KIM
ucaccaagaggaaaugcc

SEQ ID NO: 4179314 - RNA, 19 nt, Yersinia pestis KIM
ucaccaagaggaaaugccg

SEQ ID NO: 4179315 - RNA, 16 nt, Yersinia pestis KIM
ucaccaagcuuuuauc

SEQ ID NO: 4179316 - RNA, 23 nt, Yersinia pestis KIM
ucaccaauauguucaucagggaa

SEQ ID NO: 4179317 - RNA, 14 nt, Yersinia pestis KIM
ucaccaaucggauc

SEQ ID NO: 4179318 - RNA, 17 nt, Yersinia pestis KIM
ucaccacaauauggggu

SEQ ID NO: 4179319 - RNA, 15 nt, Yersinia pestis KIM
ucaccacaugccaua

SEQ ID NO: 4179320 - RNA, 18 nt, Yersinia pestis KIM
ucaccaccgcauuuucaa

SEQ ID NO: 4179321 - RNA, 17 nt, Yersinia pestis KIM
ucaccaccucguuggcu

SEQ ID NO: 4179322 - RNA, 21 nt, Yersinia pestis KIM
ucaccacgauuagccauaaga

SEQ ID NO: 4179323 - RNA, 16 nt, Yersinia pestis KIM
ucaccacuuuccaggu

SEQ ID NO: 4179324 - RNA, 18 nt, Yersinia pestis KIM
ucaccagacaaccaauac

SEQ ID NO: 4179325 - RNA, 17 nt, Yersinia pestis KIM
ucaccaggcucucauau

SEQ ID NO: 4179326 - RNA, 15 nt, Yersinia pestis KIM
ucaccagguccgccc

SEQ ID NO: 4179327 - RNA, 18 nt, Yersinia pestis KIM
ucaccagguuucgguacu

SEQ ID NO: 4179328 - RNA, 18 nt, Yersinia pestis KIM
ucaccaguagcccagccg

SEQ ID NO: 4179329 - RNA, 19 nt, Yersinia pestis KIM
ucaccaguagcccagccgg

SEQ ID NO: 4179330 - RNA, 14 nt, Yersinia pestis KIM
ucaccauaacugcu

SEQ ID NO: 4179331 - RNA, 16 nt, Yersinia pestis KIM
ucaccauaacugcugc

SEQ ID NO: 4179332 - RNA, 20 nt, Yersinia pestis KIM
ucaccaucugguucgguaua

SEQ ID NO: 4179333 - RNA, 15 nt, Yersinia pestis KIM
ucaccauuaauaaua

SEQ ID NO: 4179334 - RNA, 16 nt, Yersinia pestis KIM
ucaccauuuaggcguu

SEQ ID NO: 4179335 - RNA, 14 nt, Yersinia pestis KIM
ucaccauuuauugc

SEQ ID NO: 4179336 - RNA, 18 nt, Yersinia pestis KIM
ucacccaauaagauaaac

SEQ ID NO: 4179337 - RNA, 21 nt, Yersinia pestis KIM
ucacccaauaagauaaacagc

SEQ ID NO: 4179338 - RNA, 20 nt, Yersinia pestis KIM
ucacccagcaaaauagcaca

SEQ ID NO: 4179339 - RNA, 20 nt, Yersinia pestis KIM
ucaccccgcguugucagcca

SEQ ID NO: 4179340 - RNA, 17 nt, Yersinia pestis KIM
ucacccgauacaggcuc

SEQ ID NO: 4179341 - RNA, 19 nt, Yersinia pestis KIM
ucacccgcaaaacugaagc

SEQ ID NO: 4179342 - RNA, 18 nt, Yersinia pestis KIM
ucacccgcacguagcaca

SEQ ID NO: 4179343 - RNA, 15 nt, Yersinia pestis KIM
ucacccguaaacaca

SEQ ID NO: 4179344 - RNA, 12 nt, Yersinia pestis KIM
ucacccucugcg

SEQ ID NO: 4179345 - RNA, 12 nt, Yersinia pestis KIM
ucacccucuuuc

SEQ ID NO: 4179346 - RNA, 15 nt, Yersinia pestis KIM
ucacccugcguacaa

SEQ ID NO: 4179347 - RNA, 14 nt, Yersinia pestis KIM
ucacccuggcucug

SEQ ID NO: 4179348 - RNA, 16 nt, Yersinia pestis KIM
ucaccgaaagaagaca

SEQ ID NO: 4179349 - RNA, 17 nt, Yersinia pestis KIM
ucaccgagagauucaug

SEQ ID NO: 4179350 - RNA, 15 nt, Yersinia pestis KIM
ucaccgcccauaucc

SEQ ID NO: 4179351 - RNA, 23 nt, Yersinia pestis KIM
ucaccgcccccaauaagggccac

SEQ ID NO: 4179352 - RNA, 22 nt, Yersinia pestis KIM
ucaccgccgaccaguggugcuc

SEQ ID NO: 4179353 - RNA, 16 nt, Yersinia pestis KIM
ucaccgcuuuucuggu

SEQ ID NO: 4179354 - RNA, 16 nt, Yersinia pestis KIM
ucaccgguaugcagua

SEQ ID NO: 4179355 - RNA, 13 nt, Yersinia pestis KIM
ucaccguagaacg

SEQ ID NO: 4179356 - RNA, 20 nt, Yersinia pestis KIM
ucaccguauacgcugaauga

SEQ ID NO: 4179357 - RNA, 22 nt, Yersinia pestis KIM
ucaccgugacuguuaacaucca

SEQ ID NO: 4179358 - RNA, 18 nt, Yersinia pestis KIM
ucaccguucaagaucgcg

SEQ ID NO: 4179359 - RNA, 15 nt, Yersinia pestis KIM
ucaccuagauaauca

SEQ ID NO: 4179360 - RNA, 22 nt, Yersinia pestis KIM
ucaccuauaauuaacagcauca

SEQ ID NO: 4179361 - RNA, 12 nt, Yersinia pestis KIM
ucaccucaucag

SEQ ID NO: 4179362 - RNA, 13 nt, Yersinia pestis KIM
ucaccucaucagu

SEQ ID NO: 4179363 - RNA, 13 nt, Yersinia pestis KIM
ucaccucccugca

SEQ ID NO: 4179364 - RNA, 20 nt, Yersinia pestis KIM
ucaccugaaugccauucaag

SEQ ID NO: 4179365 - RNA, 23 nt, Yersinia pestis KIM
ucaccugcgggauagcauaaaua

SEQ ID NO: 4179366 - RNA, 12 nt, Yersinia pestis KIM
ucaccuggccag

SEQ ID NO: 4179367 - RNA, 22 nt, Yersinia pestis KIM
ucaccuuccgucccaagaaaag

SEQ ID NO: 4179368 - RNA, 14 nt, Yersinia pestis KIM
ucaccuucugcccg

SEQ ID NO: 4179369 - RNA, 13 nt, Yersinia pestis KIM
ucaccuuggaaaa

SEQ ID NO: 4179370 - RNA, 17 nt, Yersinia pestis KIM
ucaccuuggauggcgaa

SEQ ID NO: 4179371 - RNA, 14 nt, Yersinia pestis KIM
ucaccuuugaucau

SEQ ID NO: 4179372 - RNA, 20 nt, Yersinia pestis KIM
ucacgacaagucaugguaca

SEQ ID NO: 4179373 - RNA, 18 nt, Yersinia pestis KIM
ucacgauaaucaaugcca

SEQ ID NO: 4179374 - RNA, 17 nt, Yersinia pestis KIM
ucacgauacgacuucuu

SEQ ID NO: 4179375 - RNA, 15 nt, Yersinia pestis KIM
ucacgauagccagug

SEQ ID NO: 4179376 - RNA, 18 nt, Yersinia pestis KIM
ucacgauggaaaaaauac

SEQ ID NO: 4179377 - RNA, 15 nt, Yersinia pestis KIM
ucacgcaaugcggua

SEQ ID NO: 4179378 - RNA, 20 nt, Yersinia pestis KIM
ucacgcacgguacagagggc

SEQ ID NO: 4179379 - RNA, 23 nt, Yersinia pestis KIM
ucacgcacucgaaucacuuauug

SEQ ID NO: 4179380 - RNA, 18 nt, Yersinia pestis KIM
ucacgccaugccgguuga

SEQ ID NO: 4179381 - RNA, 21 nt, Yersinia pestis KIM
ucacgcgaagcccuguuucau

SEQ ID NO: 4179382 - RNA, 24 nt, Yersinia pestis KIM
ucacgcuggcgauaaacacccaag

SEQ ID NO: 4179383 - RNA, 13 nt, Yersinia pestis KIM
ucacggacagcaa

SEQ ID NO: 4179384 - RNA, 15 nt, Yersinia pestis KIM
ucacggccaaaaaug

SEQ ID NO: 4179385 - RNA, 17 nt, Yersinia pestis KIM
ucacggcuuugcugugc

SEQ ID NO: 4179386 - RNA, 13 nt, Yersinia pestis KIM
ucacgggcuucca

SEQ ID NO: 4179387 - RNA, 17 nt, Yersinia pestis KIM
ucacgggcuuccaucag

SEQ ID NO: 4179388 - RNA, 21 nt, Yersinia pestis KIM
ucacgggcuuccaucaggaag

SEQ ID NO: 4179389 - RNA, 18 nt, Yersinia pestis KIM
ucacgguagguuucuggg

SEQ ID NO: 4179390 - RNA, 23 nt, Yersinia pestis KIM
ucacguauuuucauuuuaacaac

SEQ ID NO: 4179391 - RNA, 15 nt, Yersinia pestis KIM
ucacgucaguaauga

SEQ ID NO: 4179392 - RNA, 20 nt, Yersinia pestis KIM
ucacguucauccgcagcaaa

SEQ ID NO: 4179393 - RNA, 16 nt, Yersinia pestis KIM
ucacguuuagcccacu

SEQ ID NO: 4179394 - RNA, 13 nt, Yersinia pestis KIM
ucacguuuuucca

SEQ ID NO: 4179395 - RNA, 14 nt, Yersinia pestis KIM
ucacuaaaacugaa

SEQ ID NO: 4179396 - RNA, 14 nt, Yersinia pestis KIM
ucacuaaaucaaaa

SEQ ID NO: 4179397 - RNA, 20 nt, Yersinia pestis KIM
ucacuaacauaaucaagaaa

SEQ ID NO: 4179398 - RNA, 14 nt, Yersinia pestis KIM
ucacuacagcauuu

SEQ ID NO: 4179399 - RNA, 18 nt, Yersinia pestis KIM
ucacuagcgggccuuuua

SEQ ID NO: 4179400 - RNA, 21 nt, Yersinia pestis KIM
ucacuagcgggccuuuuaccu

SEQ ID NO: 4179401 - RNA, 22 nt, Yersinia pestis KIM
ucacuagcgggccuuuuaccuu

SEQ ID NO: 4179402 - RNA, 13 nt, Yersinia pestis KIM
ucacuauaauuau

SEQ ID NO: 4179403 - RNA, 15 nt, Yersinia pestis KIM
ucacuauaauuauuu

SEQ ID NO: 4179404 - RNA, 22 nt, Yersinia pestis KIM
ucacuauaauuauuucucugau

SEQ ID NO: 4179405 - RNA, 16 nt, Yersinia pestis KIM
ucacuauaauuucucu

SEQ ID NO: 4179406 - RNA, 13 nt, Yersinia pestis KIM
ucacuauccuuug

SEQ ID NO: 4179407 - RNA, 15 nt, Yersinia pestis KIM
ucacuauccuuugau

SEQ ID NO: 4179408 - RNA, 15 nt, Yersinia pestis KIM
ucagcucauuaaacu

SEQ ID NO: 4179409 - RNA, 15 nt, Yersinia pestis KIM
ucagcucuucuaaca

SEQ ID NO: 4179410 - RNA, 16 nt, Yersinia pestis KIM
ucagcucuucuaacac

SEQ ID NO: 4179411 - RNA, 15 nt, Yersinia pestis KIM
ucagcugacgcagca

SEQ ID NO: 4179412 - RNA, 13 nt, Yersinia pestis KIM
ucagcugcuuuau

SEQ ID NO: 4179413 - RNA, 22 nt, Yersinia pestis KIM
ucagcugguuagagcacagcac

SEQ ID NO: 4179414 - RNA, 21 nt, Yersinia pestis KIM
ucagcuuaccgguaaguaauu

SEQ ID NO: 4179415 - RNA, 20 nt, Yersinia pestis KIM
ucagcuucagcucuucuaac

SEQ ID NO: 4179416 - RNA, 23 nt, Yersinia pestis KIM
ucagcuucuucugggucuaucag

SEQ ID NO: 4179417 - RNA, 23 nt, Yersinia pestis KIM
ucagcuuuuagggauauuucucc

SEQ ID NO: 4179418 - RNA, 18 nt, Yersinia pestis KIM
ucaggaaaugcagacucu

SEQ ID NO: 4179419 - RNA, 13 nt, Yersinia pestis KIM
ucaggaagagaaa

SEQ ID NO: 4179420 - RNA, 21 nt, Yersinia pestis KIM
ucaggaaggcggccacugagg

SEQ ID NO: 4179421 - RNA, 18 nt, Yersinia pestis KIM
ucaggauaggcaccggca

SEQ ID NO: 4179422 - RNA, 15 nt, Yersinia pestis KIM
ucaggaucaccagca

SEQ ID NO: 4179423 - RNA, 17 nt, Yersinia pestis KIM
ucaggaucaccagcaaa

SEQ ID NO: 4179424 - RNA, 11 nt, Yersinia pestis KIM
ucaggaugaac

SEQ ID NO: 4179425 - RNA, 23 nt, Yersinia pestis KIM
ucaggauuggagucaugaggcag

SEQ ID NO: 4179426 - RNA, 17 nt, Yersinia pestis KIM
ucaggcauaucacuauu

SEQ ID NO: 4179427 - RNA, 15 nt, Yersinia pestis KIM
ucaggccagagacac

SEQ ID NO: 4179428 - RNA, 17 nt, Yersinia pestis KIM
ucaggccuugauggcua

SEQ ID NO: 4179429 - RNA, 13 nt, Yersinia pestis KIM
ucaggcucaucac

SEQ ID NO: 4179430 - RNA, 15 nt, Yersinia pestis KIM
ucaggcucaucaccu

SEQ ID NO: 4179431 - RNA, 19 nt, Yersinia pestis KIM
ucaggcucaucaccuucca

SEQ ID NO: 4179432 - RNA, 21 nt, Yersinia pestis KIM
ucaggcucaucaccuuccaaa

SEQ ID NO: 4179433 - RNA, 22 nt, Yersinia pestis KIM
ucagggaaauugucgcuagcac

SEQ ID NO: 4179434 - RNA, 23 nt, Yersinia pestis KIM
ucagggagccaauagaggcuccc

SEQ ID NO: 4179435 - RNA, 12 nt, Yersinia pestis KIM
ucagggccacuu

SEQ ID NO: 4179436 - RNA, 18 nt, Yersinia pestis KIM
ucagggccagcauaguaa

SEQ ID NO: 4179437 - RNA, 21 nt, Yersinia pestis KIM
ucagggcguauaaacagagcc

SEQ ID NO: 4179438 - RNA, 18 nt, Yersinia pestis KIM
ucagggcgucucuacgac

SEQ ID NO: 4179439 - RNA, 22 nt, Yersinia pestis KIM
ucagguaagcagagaauuucaa

SEQ ID NO: 4179440 - RNA, 17 nt, Yersinia pestis KIM
ucagguaccccauaaau

SEQ ID NO: 4179441 - RNA, 11 nt, Yersinia pestis KIM
ucaggucgcaa

SEQ ID NO: 4179442 - RNA, 14 nt, Yersinia pestis KIM
ucagguggugcccg

SEQ ID NO: 4179443 - RNA, 15 nt, Yersinia pestis KIM
ucagguucaauuccc

SEQ ID NO: 4179444 - RNA, 19 nt, Yersinia pestis KIM
ucagguugaaauaaauaag

SEQ ID NO: 4179445 - RNA, 22 nt, Yersinia pestis KIM
ucagguugaaauaaauaaguuc

SEQ ID NO: 4179446 - RNA, 13 nt, Yersinia pestis KIM
ucagguuguuccg

SEQ ID NO: 4179447 - RNA, 19 nt, Yersinia pestis KIM
ucagguuuacgccauacau

SEQ ID NO: 4179448 - RNA, 23 nt, Yersinia pestis KIM
ucagguuucaguuggccaccauu

SEQ ID NO: 4179449 - RNA, 18 nt, Yersinia pestis KIM
ucaguaacuggauauuuu

SEQ ID NO: 4179450 - RNA, 19 nt, Yersinia pestis KIM
ucaguacagucccugugcg

SEQ ID NO: 4179451 - RNA, 23 nt, Yersinia pestis KIM
ucaguacgcuaaccaucaccaca

SEQ ID NO: 4179452 - RNA, 15 nt, Yersinia pestis KIM
ucaguagcaggcgca

SEQ ID NO: 4179453 - RNA, 21 nt, Yersinia pestis KIM
ucaguaucuuuccagccaaua

SEQ ID NO: 4179454 - RNA, 15 nt, Yersinia pestis KIM
ucaguauuggucuua

SEQ ID NO: 4179455 - RNA, 20 nt, Yersinia pestis KIM
ucagucacuuugggcugauc

SEQ ID NO: 4179456 - RNA, 17 nt, Yersinia pestis KIM
ucagucagggugaaagc

SEQ ID NO: 4179457 - RNA, 18 nt, Yersinia pestis KIM
ucagucagggugaaagcc

SEQ ID NO: 4179458 - RNA, 20 nt, Yersinia pestis KIM
ucagucgccuuaaaugcgua

SEQ ID NO: 4179459 - RNA, 18 nt, Yersinia pestis KIM
ucagucgcgauaaaauuc

SEQ ID NO: 4179460 - RNA, 18 nt, Yersinia pestis KIM
ucagugauaacaacccua

SEQ ID NO: 4179461 - RNA, 22 nt, Yersinia pestis KIM
ucagugauucgggugagugagc

SEQ ID NO: 4179462 - RNA, 18 nt, Yersinia pestis KIM
ucagugauuuuaaccacu

SEQ ID NO: 4179463 - RNA, 19 nt, Yersinia pestis KIM
ucagugguuuuauaaauaa

SEQ ID NO: 4179464 - RNA, 16 nt, Yersinia pestis KIM
ucaguguauuuaucaa

SEQ ID NO: 4179465 - RNA, 14 nt, Yersinia pestis KIM
ucagugucagcaaa

SEQ ID NO: 4179466 - RNA, 16 nt, Yersinia pestis KIM
ucagugucaguucgac

SEQ ID NO: 4179467 - RNA, 20 nt, Yersinia pestis KIM
ucagugucaguucgacaccu

SEQ ID NO: 4179468 - RNA, 21 nt, Yersinia pestis KIM
ucagugucaguucgacaccuu

SEQ ID NO: 4179469 - RNA, 22 nt, Yersinia pestis KIM
ucagugugugugcgcugaguga

SEQ ID NO: 4179470 - RNA, 23 nt, Yersinia pestis KIM
ucaguguuucuauuuucagcaua

SEQ ID NO: 4179471 - RNA, 22 nt, Yersinia pestis KIM
ucaguuaacggaaaugauaucu

SEQ ID NO: 4179472 - RNA, 13 nt, Yersinia pestis KIM
ucaguuauaaaaa

SEQ ID NO: 4179473 - RNA, 21 nt, Yersinia pestis KIM
ucaguuccuggcccguuaaca

SEQ ID NO: 4179474 - RNA, 20 nt, Yersinia pestis KIM
ucaguucgguugccaaaauu

SEQ ID NO: 4179475 - RNA, 13 nt, Yersinia pestis KIM
ucaguugaaaccc

SEQ ID NO: 4179476 - RNA, 16 nt, Yersinia pestis KIM
ucaguuggccaccauu

SEQ ID NO: 4179477 - RNA, 15 nt, Yersinia pestis KIM
ucaguuguucaccua

SEQ ID NO: 4179478 - RNA, 15 nt, Yersinia pestis KIM
ucaguuuacaugauu

SEQ ID NO: 4179479 - RNA, 20 nt, Yersinia pestis KIM
ucaguuuacaugauugaaaa

SEQ ID NO: 4179480 - RNA, 13 nt, Yersinia pestis KIM
ucaguuuuaauuu

SEQ ID NO: 4179481 - RNA, 17 nt, Yersinia pestis KIM
ucaguuuuaauuuauga

SEQ ID NO: 4179482 - RNA, 14 nt, Yersinia pestis KIM
ucauaaaaauacau

SEQ ID NO: 4179483 - RNA, 19 nt, Yersinia pestis KIM
ucauaaaaauacauaucaa

SEQ ID NO: 4179484 - RNA, 18 nt, Yersinia pestis KIM
ucauaaauuaaaacugaa

SEQ ID NO: 4179485 - RNA, 18 nt, Yersinia pestis KIM
ucauacacggucuggcaa

SEQ ID NO: 4179486 - RNA, 13 nt, Yersinia pestis KIM
ucauacaucauuu

SEQ ID NO: 4179487 - RNA, 19 nt, Yersinia pestis KIM
ucauaccauucucugucuu

SEQ ID NO: 4179488 - RNA, 22 nt, Yersinia pestis KIM
ucauaccggcggcacacuggau

SEQ ID NO: 4179489 - RNA, 18 nt, Yersinia pestis KIM
ucauacggcgauauuuau

SEQ ID NO: 4179490 - RNA, 12 nt, Yersinia pestis KIM
ucauacucaguc

SEQ ID NO: 4179491 - RNA, 21 nt, Yersinia pestis KIM
ucauacucagucaucgcuaac

SEQ ID NO: 4179492 - RNA, 16 nt, Yersinia pestis KIM
ucauacucccccauuu

SEQ ID NO: 4179493 - RNA, 14 nt, Yersinia pestis KIM
ucauagguugcgcc

SEQ ID NO: 4179494 - RNA, 17 nt, Yersinia pestis KIM
ucauaguuaagacaauu

SEQ ID NO: 4179495 - RNA, 16 nt, Yersinia pestis KIM
ucauauaagcaauacc

SEQ ID NO: 4179496 - RNA, 11 nt, Yersinia pestis KIM
ucauauaagcg

SEQ ID NO: 4179497 - RNA, 13 nt, Yersinia pestis KIM
ucauauaagcggc

SEQ ID NO: 4179498 - RNA, 22 nt, Yersinia pestis KIM
ucauauacaccgcaccacgauu

SEQ ID NO: 4179499 - RNA, 13 nt, Yersinia pestis KIM
ucauauauuaaau

SEQ ID NO: 4179500 - RNA, 14 nt, Yersinia pestis KIM
ucauaucaaaauaa

SEQ ID NO: 4179501 - RNA, 16 nt, Yersinia pestis KIM
ucauaucgcuaaaaca

SEQ ID NO: 4179502 - RNA, 19 nt, Yersinia pestis KIM
ucauaucgcuaaaacacag

SEQ ID NO: 4179503 - RNA, 22 nt, Yersinia pestis KIM
ucauauguucgaucaaaacaau

SEQ ID NO: 4179504 - RNA, 21 nt, Yersinia pestis KIM
ucaucaaaauugauggucugu

SEQ ID NO: 4179505 - RNA, 15 nt, Yersinia pestis KIM
ucaucaaacuauuca

SEQ ID NO: 4179506 - RNA, 17 nt, Yersinia pestis KIM
ucaucaaaggcaauacc

SEQ ID NO: 4179507 - RNA, 19 nt, Yersinia pestis KIM
ucaucaaaggcaauaccgg

SEQ ID NO: 4179508 - RNA, 15 nt, Yersinia pestis KIM
ucaucaaauucaggu

SEQ ID NO: 4179509 - RNA, 15 nt, Yersinia pestis KIM
ucaucaacgcgccuu

SEQ ID NO: 4179510 - RNA, 23 nt, Yersinia pestis KIM
ucaucaagauggucauaaauagg

SEQ ID NO: 4179511 - RNA, 23 nt, Yersinia pestis KIM
ucaucaauaccgaaaauaccgga

SEQ ID NO: 4179512 - RNA, 20 nt, Yersinia pestis KIM
ucaucaauggauucuugcug

SEQ ID NO: 4179513 - RNA, 22 nt, Yersinia pestis KIM
ucaucaauuggcagcggcaaau

SEQ ID NO: 4179514 - RNA, 20 nt, Yersinia pestis KIM
ucaucaccuuauccaauaga

SEQ ID NO: 4179515 - RNA, 15 nt, Yersinia pestis KIM
ucaucacugaaagug

SEQ ID NO: 4179516 - RNA, 21 nt, Yersinia pestis KIM
ucaucacugccgucaaugccu

SEQ ID NO: 4179517 - RNA, 18 nt, Yersinia pestis KIM
ucaucagcaagugauaga

SEQ ID NO: 4179518 - RNA, 13 nt, Yersinia pestis KIM
ucaucagcagcag

SEQ ID NO: 4179519 - RNA, 13 nt, Yersinia pestis KIM
ucaucagcccagc

SEQ ID NO: 4179520 - RNA, 13 nt, Yersinia pestis KIM
ucaucagcgccuu

SEQ ID NO: 4179521 - RNA, 14 nt, Yersinia pestis KIM
ucaucagcgcuggc

SEQ ID NO: 4179522 - RNA, 13 nt, Yersinia pestis KIM
ucauuuuaaaaaa

SEQ ID NO: 4179523 - RNA, 22 nt, Yersinia pestis KIM
ucauuuuaaaaaaauuaaaaua

SEQ ID NO: 4179524 - RNA, 19 nt, Yersinia pestis KIM
ucauuuuccugcauauuau

SEQ ID NO: 4179525 - RNA, 14 nt, Yersinia pestis KIM
ucauuuucuguuga

SEQ ID NO: 4179526 - RNA, 14 nt, Yersinia pestis KIM
ucauuuuuuaucuu

SEQ ID NO: 4179527 - RNA, 20 nt, Yersinia pestis KIM
uccaaaacaucggccagcgu

SEQ ID NO: 4179528 - RNA, 22 nt, Yersinia pestis KIM
uccaaaauaauauaauucaaua

SEQ ID NO: 4179529 - RNA, 14 nt, Yersinia pestis KIM
uccaaaauugcauu

SEQ ID NO: 4179530 - RNA, 16 nt, Yersinia pestis KIM
uccaaaauugcauuag

SEQ ID NO: 4179531 - RNA, 15 nt, Yersinia pestis KIM
uccaaacuuugugga

SEQ ID NO: 4179532 - RNA, 12 nt, Yersinia pestis KIM
uccaaaggaagg

SEQ ID NO: 4179533 - RNA, 23 nt, Yersinia pestis KIM
uccaaaggaagggguucuuccaa

SEQ ID NO: 4179534 - RNA, 20 nt, Yersinia pestis KIM
uccaaaugacagcaucaaua

SEQ ID NO: 4179535 - RNA, 17 nt, Yersinia pestis KIM
uccaaaugcccauuagu

SEQ ID NO: 4179536 - RNA, 16 nt, Yersinia pestis KIM
uccaacaucucgccaa

SEQ ID NO: 4179537 - RNA, 13 nt, Yersinia pestis KIM
uccaaccaaccau

SEQ ID NO: 4179538 - RNA, 12 nt, Yersinia pestis KIM
uccaaccaaccu

SEQ ID NO: 4179539 - RNA, 17 nt, Yersinia pestis KIM
uccaacgcacugguugc

SEQ ID NO: 4179540 - RNA, 21 nt, Yersinia pestis KIM
uccaacuaaacagggcagaaa

SEQ ID NO: 4179541 - RNA, 13 nt, Yersinia pestis KIM
uccaacucaccuu

SEQ ID NO: 4179542 - RNA, 14 nt, Yersinia pestis KIM
uccaacugacgcca

SEQ ID NO: 4179543 - RNA, 15 nt, Yersinia pestis KIM
uccaacuuaucacug

SEQ ID NO: 4179544 - RNA, 14 nt, Yersinia pestis KIM
uccaacuucuucca

SEQ ID NO: 4179545 - RNA, 18 nt, Yersinia pestis KIM
uccaacuucuuccauuaa

SEQ ID NO: 4179546 - RNA, 14 nt, Yersinia pestis KIM
uccaagaaugcaga

SEQ ID NO: 4179547 - RNA, 18 nt, Yersinia pestis KIM
uccaagcacacugguuga

SEQ ID NO: 4179548 - RNA, 23 nt, Yersinia pestis KIM
uccaauaaugccgaaugauucau

SEQ ID NO: 4179549 - RNA, 13 nt, Yersinia pestis KIM
uccaauauucccu

SEQ ID NO: 4179550 - RNA, 19 nt, Yersinia pestis KIM
uccaaucauucugucauca

SEQ ID NO: 4179551 - RNA, 22 nt, Yersinia pestis KIM
uccaaugacuauucccuuguuu

SEQ ID NO: 4179552 - RNA, 12 nt, Yersinia pestis KIM
uccaaugucagu

SEQ ID NO: 4179553 - RNA, 21 nt, Yersinia pestis KIM
uccacacaaacgcauucauau

SEQ ID NO: 4179554 - RNA, 18 nt, Yersinia pestis KIM
uccacauaaaaagaaaaa

SEQ ID NO: 4179555 - RNA, 21 nt, Yersinia pestis KIM
uccacauaaaaagaaaaaaac

SEQ ID NO: 4179556 - RNA, 23 nt, Yersinia pestis KIM
uccacauaaaauagcccagugcg

SEQ ID NO: 4179557 - RNA, 19 nt, Yersinia pestis KIM
uccacauauauagagaaau

SEQ ID NO: 4179558 - RNA, 21 nt, Yersinia pestis KIM
uccacauauauagagaaaucu

SEQ ID NO: 4179559 - RNA, 19 nt, Yersinia pestis KIM
uccacaugcuuuuuuuaag

SEQ ID NO: 4179560 - RNA, 12 nt, Yersinia pestis KIM
uccacauugauc

SEQ ID NO: 4179561 - RNA, 22 nt, Yersinia pestis KIM
uccacccggcauuguuggcccg

SEQ ID NO: 4179562 - RNA, 22 nt, Yersinia pestis KIM
uccaccguuuuacucaggauua

SEQ ID NO: 4179563 - RNA, 19 nt, Yersinia pestis KIM
uccaccugacgaaaugccg

SEQ ID NO: 4179564 - RNA, 14 nt, Yersinia pestis KIM
uccacgaaggcacc

SEQ ID NO: 4179565 - RNA, 17 nt, Yersinia pestis KIM
uccacgccccaacggua

SEQ ID NO: 4179566 - RNA, 19 nt, Yersinia pestis KIM
uccacgcugaaacuuuuca

SEQ ID NO: 4179567 - RNA, 22 nt, Yersinia pestis KIM
uccacgcugaaacuuuucaguu

SEQ ID NO: 4179568 - RNA, 21 nt, Yersinia pestis KIM
uccacgcuuuaagcuaauucu

SEQ ID NO: 4179569 - RNA, 21 nt, Yersinia pestis KIM
uccacgggcgcaauggaagaa

SEQ ID NO: 4179570 - RNA, 15 nt, Yersinia pestis KIM
uccacgggcucaugc

SEQ ID NO: 4179571 - RNA, 18 nt, Yersinia pestis KIM
uccacuacucaguugcag

SEQ ID NO: 4179572 - RNA, 20 nt, Yersinia pestis KIM
uccacuacucguaacgacga

SEQ ID NO: 4179573 - RNA, 20 nt, Yersinia pestis KIM
uccacucuuugaguagcagg

SEQ ID NO: 4179574 - RNA, 21 nt, Yersinia pestis KIM
uccacuuuaccgauuucaggu

SEQ ID NO: 4179575 - RNA, 17 nt, Yersinia pestis KIM
uccacuuuuucucuccu

SEQ ID NO: 4179576 - RNA, 14 nt, Yersinia pestis KIM
uccagaacaauacc

SEQ ID NO: 4179577 - RNA, 19 nt, Yersinia pestis KIM
uccagaauagagaaaucaa

SEQ ID NO: 4179578 - RNA, 15 nt, Yersinia pestis KIM
uccagacaaagugag

SEQ ID NO: 4179579 - RNA, 17 nt, Yersinia pestis KIM
uccagaccgcguaagcc

SEQ ID NO: 4179580 - RNA, 13 nt, Yersinia pestis KIM
uccagauaauccg

SEQ ID NO: 4179581 - RNA, 13 nt, Yersinia pestis KIM
uccagaucggcaa

SEQ ID NO: 4179582 - RNA, 17 nt, Yersinia pestis KIM
uccagauggcggucgca

SEQ ID NO: 4179583 - RNA, 20 nt, Yersinia pestis KIM
uccagauuacgcaucgucag

SEQ ID NO: 4179584 - RNA, 15 nt, Yersinia pestis KIM
uccagcaaaagccuc

SEQ ID NO: 4179585 - RNA, 22 nt, Yersinia pestis KIM
uccagcaaauuagacacgccgg

SEQ ID NO: 4179586 - RNA, 15 nt, Yersinia pestis KIM
uccagcaccccuuca

SEQ ID NO: 4179587 - RNA, 17 nt, Yersinia pestis KIM
uccagccaauacaggca

SEQ ID NO: 4179588 - RNA, 18 nt, Yersinia pestis KIM
uccagccaccccguggca

SEQ ID NO: 4179589 - RNA, 14 nt, Yersinia pestis KIM
uccagccaugcgac

SEQ ID NO: 4179590 - RNA, 16 nt, Yersinia pestis KIM
uccagcgccaucagcg

SEQ ID NO: 4179591 - RNA, 15 nt, Yersinia pestis KIM
uccagcggcaaauag

SEQ ID NO: 4179592 - RNA, 17 nt, Yersinia pestis KIM
uccagcggcaaauagag

SEQ ID NO: 4179593 - RNA, 22 nt, Yersinia pestis KIM
uccagcggcaaauagagcacca

SEQ ID NO: 4179594 - RNA, 17 nt, Yersinia pestis KIM
uccagcggcguaucaaa

SEQ ID NO: 4179595 - RNA, 13 nt, Yersinia pestis KIM
uccagcguaaaca

SEQ ID NO: 4179596 - RNA, 20 nt, Yersinia pestis KIM
uccagcguaaacaguagcag

SEQ ID NO: 4179597 - RNA, 20 nt, Yersinia pestis KIM
uccaggcaagaaacuucauu

SEQ ID NO: 4179598 - RNA, 18 nt, Yersinia pestis KIM
uccaggcaagcaaccgca

SEQ ID NO: 4179599 - RNA, 12 nt, Yersinia pestis KIM
uccaggcauuaa

SEQ ID NO: 4179600 - RNA, 14 nt, Yersinia pestis KIM
uccaggcccgcuuu

SEQ ID NO: 4179601 - RNA, 20 nt, Yersinia pestis KIM
uccaggcgcuguugcaugua

SEQ ID NO: 4179602 - RNA, 16 nt, Yersinia pestis KIM
uccaggcuaccaaggc

SEQ ID NO: 4179603 - RNA, 21 nt, Yersinia pestis KIM
uccaggcuaugcuuaauuugg

SEQ ID NO: 4179604 - RNA, 14 nt, Yersinia pestis KIM
uccaggcuggccac

SEQ ID NO: 4179605 - RNA, 16 nt, Yersinia pestis KIM
uccaggguaauaagug

SEQ ID NO: 4179606 - RNA, 15 nt, Yersinia pestis KIM
uccaggucaaugucu

SEQ ID NO: 4179607 - RNA, 20 nt, Yersinia pestis KIM
uccagguuuuggcuaccuuc

SEQ ID NO: 4179608 - RNA, 21 nt, Yersinia pestis KIM
uccagguuuuggcuaccuucg

SEQ ID NO: 4179609 - RNA, 14 nt, Yersinia pestis KIM
uccaguaaaaaaau

SEQ ID NO: 4179610 - RNA, 12 nt, Yersinia pestis KIM
uccaguaagcug

SEQ ID NO: 4179611 - RNA, 18 nt, Yersinia pestis KIM
uccaguaagcuguugacc

SEQ ID NO: 4179612 - RNA, 15 nt, Yersinia pestis KIM
uccaguauuucagua

SEQ ID NO: 4179613 - RNA, 17 nt, Yersinia pestis KIM
uccagugagcaauccaa

SEQ ID NO: 4179614 - RNA, 22 nt, Yersinia pestis KIM
uccagugauaaguuggaggcgu

SEQ ID NO: 4179615 - RNA, 14 nt, Yersinia pestis KIM
uccagugccaaaau

SEQ ID NO: 4179616 - RNA, 15 nt, Yersinia pestis KIM
uccaguuaucaucgu

SEQ ID NO: 4179617 - RNA, 21 nt, Yersinia pestis KIM
uccauaaacggaacucaucuu

SEQ ID NO: 4179618 - RNA, 23 nt, Yersinia pestis KIM
uccauaaacggaacucaucuuuc

SEQ ID NO: 4179619 - RNA, 15 nt, Yersinia pestis KIM
uccauacgaauuuuu

SEQ ID NO: 4179620 - RNA, 17 nt, Yersinia pestis KIM
uccauacgaauuuuucc

SEQ ID NO: 4179621 - RNA, 15 nt, Yersinia pestis KIM
uccauacuguugcua

SEQ ID NO: 4179622 - RNA, 15 nt, Yersinia pestis KIM
uccauagccaggcag

SEQ ID NO: 4179623 - RNA, 15 nt, Yersinia pestis KIM
uccauauagccccaa

SEQ ID NO: 4179624 - RNA, 20 nt, Yersinia pestis KIM
uccauauagccccaacacug

SEQ ID NO: 4179625 - RNA, 23 nt, Yersinia pestis KIM
uccaucaccgucgguuucucuug

SEQ ID NO: 4179626 - RNA, 21 nt, Yersinia pestis KIM
uccaucacgcagcuuuuucuc

SEQ ID NO: 4179627 - RNA, 21 nt, Yersinia pestis KIM
uccaucgccacuucuaacaag

SEQ ID NO: 4179628 - RNA, 19 nt, Yersinia pestis KIM
uccaugagcgcuauuuauc

SEQ ID NO: 4179629 - RNA, 19 nt, Yersinia pestis KIM
uccaugauauaucagucuu

SEQ ID NO: 4179630 - RNA, 14 nt, Yersinia pestis KIM
uccaugcaaaauau

SEQ ID NO: 4179631 - RNA, 23 nt, Yersinia pestis KIM
uccaugcccagcguuggcagaaa

SEQ ID NO: 4179632 - RNA, 23 nt, Yersinia pestis KIM
uccauggacgggccgagucacga

SEQ ID NO: 4179633 - RNA, 13 nt, Yersinia pestis KIM
uccauggcugaga

SEQ ID NO: 4179634 - RNA, 23 nt, Yersinia pestis KIM
uccaugggccucgcuucugcgag

SEQ ID NO: 4179635 - RNA, 13 nt, Yersinia pestis KIM
uccauguaggcuc

SEQ ID NO: 4179636 - RNA, 12 nt, Yersinia pestis KIM
uccguuaaccca

SEQ ID NO: 4179637 - RNA, 24 nt, Yersinia pestis KIM
uccguuaccaaagcguacucuucu

SEQ ID NO: 4179638 - RNA, 14 nt, Yersinia pestis KIM
uccguuuaaucagu

SEQ ID NO: 4179639 - RNA, 19 nt, Yersinia pestis KIM
uccguuuacgacaauccua

SEQ ID NO: 4179640 - RNA, 14 nt, Yersinia pestis KIM
uccuaaagauaauu

SEQ ID NO: 4179641 - RNA, 17 nt, Yersinia pestis KIM
uccuaaagauaauuaau

SEQ ID NO: 4179642 - RNA, 19 nt, Yersinia pestis KIM
uccuaagguagugagauga

SEQ ID NO: 4179643 - RNA, 19 nt, Yersinia pestis KIM
uccuacccuuugagaaagg

SEQ ID NO: 4179644 - RNA, 12 nt, Yersinia pestis KIM
uccuagaggcuu

SEQ ID NO: 4179645 - RNA, 21 nt, Yersinia pestis KIM
uccuagcguuucuacaauggc

SEQ ID NO: 4179646 - RNA, 13 nt, Yersinia pestis KIM
uccuauagcucag

SEQ ID NO: 4179647 - RNA, 19 nt, Yersinia pestis KIM
uccuauagcucagaaaaua

SEQ ID NO: 4179648 - RNA, 14 nt, Yersinia pestis KIM
uccuauucagcagc

SEQ ID NO: 4179649 - RNA, 16 nt, Yersinia pestis KIM
uccuauucagcagcau

SEQ ID NO: 4179650 - RNA, 11 nt, Yersinia pestis KIM
uccuauuuaau

SEQ ID NO: 4179651 - RNA, 19 nt, Yersinia pestis KIM
uccucaacaguacugccaa

SEQ ID NO: 4179652 - RNA, 22 nt, Yersinia pestis KIM
uccucaagaccgauuuguaagc

SEQ ID NO: 4179653 - RNA, 19 nt, Yersinia pestis KIM
uccucaccauuuauugcca

SEQ ID NO: 4179654 - RNA, 13 nt, Yersinia pestis KIM
uccucaccguuca

SEQ ID NO: 4179655 - RNA, 12 nt, Yersinia pestis KIM
uccucagccuuu

SEQ ID NO: 4179656 - RNA, 21 nt, Yersinia pestis KIM
uccuccauauccucaagaccg

SEQ ID NO: 4179657 - RNA, 14 nt, Yersinia pestis KIM
uccuccccugcguu

SEQ ID NO: 4179658 - RNA, 23 nt, Yersinia pestis KIM
uccuccgacauagccggagguuu

SEQ ID NO: 4179659 - RNA, 18 nt, Yersinia pestis KIM
uccuccggcauagccgga

SEQ ID NO: 4179660 - RNA, 18 nt, Yersinia pestis KIM
uccucgcgggucaugaaa

SEQ ID NO: 4179661 - RNA, 23 nt, Yersinia pestis KIM
uccucggguuuuauaccggggcc

SEQ ID NO: 4179662 - RNA, 22 nt, Yersinia pestis KIM
uccucugaauaaaaaauuauua

SEQ ID NO: 4179663 - RNA, 13 nt, Yersinia pestis KIM
uccucugccuauc

SEQ ID NO: 4179664 - RNA, 14 nt, Yersinia pestis KIM
uccucugccuaucc

SEQ ID NO: 4179665 - RNA, 14 nt, Yersinia pestis KIM
uccucugccuauuc

SEQ ID NO: 4179666 - RNA, 22 nt, Yersinia pestis KIM
uccucugugacucuauugucuu

SEQ ID NO: 4179667 - RNA, 12 nt, Yersinia pestis KIM
uccucuuccaau

SEQ ID NO: 4179668 - RNA, 19 nt, Yersinia pestis KIM
uccucuuucuuaauaauau

SEQ ID NO: 4179669 - RNA, 11 nt, Yersinia pestis KIM
uccugaauaau

SEQ ID NO: 4179670 - RNA, 23 nt, Yersinia pestis KIM
uccugaauaauacugucaaaauc

SEQ ID NO: 4179671 - RNA, 16 nt, Yersinia pestis KIM
uccugacgaugauaaa

SEQ ID NO: 4179672 - RNA, 20 nt, Yersinia pestis KIM
uccugacgaugauaaaucag

SEQ ID NO: 4179673 - RNA, 19 nt, Yersinia pestis KIM
uccugaucuucauugccuu

SEQ ID NO: 4179674 - RNA, 21 nt, Yersinia pestis KIM
uccugaucuucauugccuucu

SEQ ID NO: 4179675 - RNA, 17 nt, Yersinia pestis KIM
uccugaugagucuauuu

SEQ ID NO: 4179676 - RNA, 17 nt, Yersinia pestis KIM
uccugauuacucaggaa

SEQ ID NO: 4179677 - RNA, 21 nt, Yersinia pestis KIM
uccugauucgcgaccagcaga

SEQ ID NO: 4179678 - RNA, 14 nt, Yersinia pestis KIM
uccugauuuaaccu

SEQ ID NO: 4179679 - RNA, 14 nt, Yersinia pestis KIM
uccugcaacgccuu

SEQ ID NO: 4179680 - RNA, 16 nt, Yersinia pestis KIM
uccugcaauccuccca

SEQ ID NO: 4179681 - RNA, 15 nt, Yersinia pestis KIM
uccugcacaguagaa

SEQ ID NO: 4179682 - RNA, 20 nt, Yersinia pestis KIM
uccugcauauuauuuugcac

SEQ ID NO: 4179683 - RNA, 15 nt, Yersinia pestis KIM
uccugcgguggccag

SEQ ID NO: 4179684 - RNA, 20 nt, Yersinia pestis KIM
uccugcgguggccagagcau

SEQ ID NO: 4179685 - RNA, 16 nt, Yersinia pestis KIM
uccugcucaaacauga

SEQ ID NO: 4179686 - RNA, 16 nt, Yersinia pestis KIM
uccuggaaccagugaa

SEQ ID NO: 4179687 - RNA, 23 nt, Yersinia pestis KIM
uccuggaaccagugaaugcugcg

SEQ ID NO: 4179688 - RNA, 17 nt, Yersinia pestis KIM
uccuggcaaugcgcggg

SEQ ID NO: 4179689 - RNA, 18 nt, Yersinia pestis KIM
uccuggccguguuuuucc

SEQ ID NO: 4179690 - RNA, 21 nt, Yersinia pestis KIM
uccuggccguguuuuucccua

SEQ ID NO: 4179691 - RNA, 14 nt, Yersinia pestis KIM
uccugguucacucu

SEQ ID NO: 4179692 - RNA, 13 nt, Yersinia pestis KIM
uccugugccaaca

SEQ ID NO: 4179693 - RNA, 20 nt, Yersinia pestis KIM
uccuguuuuugaauagguaa

SEQ ID NO: 4179694 - RNA, 13 nt, Yersinia pestis KIM
uccuuauacuaaa

SEQ ID NO: 4179695 - RNA, 23 nt, Yersinia pestis KIM
uccuuauuuuccgcguuaccguu

SEQ ID NO: 4179696 - RNA, 16 nt, Yersinia pestis KIM
uccuucaauggcauuu

SEQ ID NO: 4179697 - RNA, 18 nt, Yersinia pestis KIM
uccuucggacgcuccuca

SEQ ID NO: 4179698 - RNA, 21 nt, Yersinia pestis KIM
uccuucggacgcuccucacuu

SEQ ID NO: 4179699 - RNA, 18 nt, Yersinia pestis KIM
uccuucucgaugccuucu

SEQ ID NO: 4179700 - RNA, 13 nt, Yersinia pestis KIM
uccuugcucucuu

SEQ ID NO: 4179701 - RNA, 16 nt, Yersinia pestis KIM
uccuuggaacuuacuc

SEQ ID NO: 4179702 - RNA, 23 nt, Yersinia pestis KIM
uccuuggcgcggacgcuuuacuc

SEQ ID NO: 4179703 - RNA, 21 nt, Yersinia pestis KIM
uccuugguaccgauuaugcca

SEQ ID NO: 4179704 - RNA, 22 nt, Yersinia pestis KIM
uccuuguggauccagcaccaca

SEQ ID NO: 4179705 - RNA, 19 nt, Yersinia pestis KIM
uccuuucguucacuuaucc

SEQ ID NO: 4179706 - RNA, 18 nt, Yersinia pestis KIM
uccuuucuguuccaugau

SEQ ID NO: 4179707 - RNA, 22 nt, Yersinia pestis KIM
uccuuucuuuucgcuauuucuc

SEQ ID NO: 4179708 - RNA, 19 nt, Yersinia pestis KIM
uccuuugcccuuacuauuu

SEQ ID NO: 4179709 - RNA, 19 nt, Yersinia pestis KIM
uccuuuggauuuaaugcug

SEQ ID NO: 4179710 - RNA, 14 nt, Yersinia pestis KIM
uccuuuuauuuaga

SEQ ID NO: 4179711 - RNA, 15 nt, Yersinia pestis KIM
uccuuuugacugguc

SEQ ID NO: 4179712 - RNA, 22 nt, Yersinia pestis KIM
uccuuuuuauuuaagcaguuca

SEQ ID NO: 4179713 - RNA, 18 nt, Yersinia pestis KIM
ucgaaaagcgccuuuuau

SEQ ID NO: 4179714 - RNA, 17 nt, Yersinia pestis KIM
ucgaaagauagcaaaag

SEQ ID NO: 4179715 - RNA, 19 nt, Yersinia pestis KIM
ucgaaagauagcaaaagaa

SEQ ID NO: 4179716 - RNA, 17 nt, Yersinia pestis KIM
ucgaaauuaaggaaaag

SEQ ID NO: 4179717 - RNA, 16 nt, Yersinia pestis KIM
ucgaacauuuucuaag

SEQ ID NO: 4179718 - RNA, 17 nt, Yersinia pestis KIM
ucgaacauuuucuaagc

SEQ ID NO: 4179719 - RNA, 21 nt, Yersinia pestis KIM
ucgaacauuuucuaagcugcc

SEQ ID NO: 4179720 - RNA, 11 nt, Yersinia pestis KIM
ucgaaccgaua

SEQ ID NO: 4179721 - RNA, 12 nt, Yersinia pestis KIM
ucgaaccugaac

SEQ ID NO: 4179722 - RNA, 14 nt, Yersinia pestis KIM
ucgaacuauugaug

SEQ ID NO: 4179723 - RNA, 21 nt, Yersinia pestis KIM
ucgaagggauaucucaccgcc

SEQ ID NO: 4179724 - RNA, 17 nt, Yersinia pestis KIM
ucgaaucacuuauugga

SEQ ID NO: 4179725 - RNA, 18 nt, Yersinia pestis KIM
ucgaaucacuuauuggaa

SEQ ID NO: 4179726 - RNA, 14 nt, Yersinia pestis KIM
ucgacaccuucaau

SEQ ID NO: 4179727 - RNA, 19 nt, Yersinia pestis KIM
ucgacaccuucaaucauug

SEQ ID NO: 4179728 - RNA, 21 nt, Yersinia pestis KIM
ucgacaccuucaaucauugag

SEQ ID NO: 4179729 - RNA, 16 nt, Yersinia pestis KIM
ucgacaggcaauuauc

SEQ ID NO: 4179730 - RNA, 15 nt, Yersinia pestis KIM
ucgacaguguaaaaa

SEQ ID NO: 4179731 - RNA, 17 nt, Yersinia pestis KIM
ucgacaguguaaaaagc

SEQ ID NO: 4179732 - RNA, 19 nt, Yersinia pestis KIM
ucgacauaaagaugcaagc

SEQ ID NO: 4179733 - RNA, 17 nt, Yersinia pestis KIM
ucgaccucaguuuugcu

SEQ ID NO: 4179734 - RNA, 18 nt, Yersinia pestis KIM
ucgaccuuaaccgcacaa

SEQ ID NO: 4179735 - RNA, 14 nt, Yersinia pestis KIM
ucgacgauauugau

SEQ ID NO: 4179736 - RNA, 17 nt, Yersinia pestis KIM
ucgacgcgccauaagcc

SEQ ID NO: 4179737 - RNA, 14 nt, Yersinia pestis KIM
ucgacuacuggcug

SEQ ID NO: 4179738 - RNA, 17 nt, Yersinia pestis KIM
ucgagaguugcucaccc

SEQ ID NO: 4179739 - RNA, 18 nt, Yersinia pestis KIM
ucgagaguugcucaccca

SEQ ID NO: 4179740 - RNA, 15 nt, Yersinia pestis KIM
ucgagauuacgguca

SEQ ID NO: 4179741 - RNA, 17 nt, Yersinia pestis KIM
ucgagcaacuuuuacug

SEQ ID NO: 4179742 - RNA, 15 nt, Yersinia pestis KIM
ucgagcuaccggcau

SEQ ID NO: 4179743 - RNA, 14 nt, Yersinia pestis KIM
ucgaggaucaccac

SEQ ID NO: 4179744 - RNA, 17 nt, Yersinia pestis KIM
ucgaguccguuaaaaaa

SEQ ID NO: 4179745 - RNA, 21 nt, Yersinia pestis KIM
ucgauaaaaggcuauuuaaau

SEQ ID NO: 4179746 - RNA, 20 nt, Yersinia pestis KIM
ucgauaaacaucaugacaaa

SEQ ID NO: 4179747 - RNA, 21 nt, Yersinia pestis KIM
ucgauaaauaauuacuuauaa

SEQ ID NO: 4179748 - RNA, 22 nt, Yersinia pestis KIM
ucgauaagcacuccacuggugg

SEQ ID NO: 4179749 - RNA, 13 nt, Yersinia pestis KIM
ucgauacaauuuu

SEQ ID NO: 4179750 - RNA, 16 nt, Yersinia pestis KIM
ucgauagcuuucuccu

SEQ ID NO: 4179751 - RNA, 19 nt, Yersinia pestis KIM
auauuaacugcagugaaaa

SEQ ID NO: 4179752 - RNA, 16 nt, Yersinia pestis KIM
auauuacaguuuaauu

SEQ ID NO: 4179753 - RNA, 18 nt, Yersinia pestis KIM
auauuaccgcugaaaaau

SEQ ID NO: 4179754 - RNA, 18 nt, Yersinia pestis KIM
auauuacggcccuccuga

SEQ ID NO: 4179755 - RNA, 14 nt, Yersinia pestis KIM
auauuacucacaca

SEQ ID NO: 4179756 - RNA, 18 nt, Yersinia pestis KIM
auauuaguuaacccuauu

SEQ ID NO: 4179757 - RNA, 17 nt, Yersinia pestis KIM
auauuauaaugaaauag

SEQ ID NO: 4179758 - RNA, 17 nt, Yersinia pestis KIM
auauuaucauucaagaa

SEQ ID NO: 4179759 - RNA, 16 nt, Yersinia pestis KIM
auauuaucuauacuaa

SEQ ID NO: 4179760 - RNA, 22 nt, Yersinia pestis KIM
auauuauuuaucaaucagcuga

SEQ ID NO: 4179761 - RNA, 19 nt, Yersinia pestis KIM
auauucaccaccauuaaca

SEQ ID NO: 4179762 - RNA, 22 nt, Yersinia pestis KIM
auauucaccaccauuaacaagc

SEQ ID NO: 4179763 - RNA, 22 nt, Yersinia pestis KIM
auauucaccaucugccugcaaa

SEQ ID NO: 4179764 - RNA, 22 nt, Yersinia pestis KIM
auauucaccguuuccagaauca

SEQ ID NO: 4179765 - RNA, 21 nt, Yersinia pestis KIM
auauucauagguagaauagca

SEQ ID NO: 4179766 - RNA, 19 nt, Yersinia pestis KIM
auauucauuaaaaaauaau

SEQ ID NO: 4179767 - RNA, 13 nt, Yersinia pestis KIM
auauucauuagag

SEQ ID NO: 4179768 - RNA, 13 nt, Yersinia pestis KIM
auauuccaaaaaa

SEQ ID NO: 4179769 - RNA, 16 nt, Yersinia pestis KIM
auauuccaaaaaauag

SEQ ID NO: 4179770 - RNA, 19 nt, Yersinia pestis KIM
auauuccaaaaaauagccg

SEQ ID NO: 4179771 - RNA, 14 nt, Yersinia pestis KIM
auauucccagccaa

SEQ ID NO: 4179772 - RNA, 12 nt, Yersinia pestis KIM
auauuccuaauu

SEQ ID NO: 4179773 - RNA, 20 nt, Yersinia pestis KIM
auauucgcagccaaaauaau

SEQ ID NO: 4179774 - RNA, 24 nt, Yersinia pestis KIM
auauucgguaaguuggcaucagcu

SEQ ID NO: 4179775 - RNA, 22 nt, Yersinia pestis KIM
auauucugauggugucaacuca

SEQ ID NO: 4179776 - RNA, 14 nt, Yersinia pestis KIM
auauucuuguugua

SEQ ID NO: 4179777 - RNA, 20 nt, Yersinia pestis KIM
auauugaauaaccuacucca

SEQ ID NO: 4179778 - RNA, 17 nt, Yersinia pestis KIM
auauugaauuaaauuuu

SEQ ID NO: 4179779 - RNA, 18 nt, Yersinia pestis KIM
auauugaauuaaauuuua

SEQ ID NO: 4179780 - RNA, 20 nt, Yersinia pestis KIM
auauugauccaaauggcugc

SEQ ID NO: 4179781 - RNA, 17 nt, Yersinia pestis KIM
auauugcacaauagcua

SEQ ID NO: 4179782 - RNA, 12 nt, Yersinia pestis KIM
auauugcucagu

SEQ ID NO: 4179783 - RNA, 16 nt, Yersinia pestis KIM
auauugcucugccgca

SEQ ID NO: 4179784 - RNA, 15 nt, Yersinia pestis KIM
auauuggauaauaac

SEQ ID NO: 4179785 - RNA, 18 nt, Yersinia pestis KIM
auauuggauaauaaccug

SEQ ID NO: 4179786 - RNA, 23 nt, Yersinia pestis KIM
auauuggcaacaacagauaaagc

SEQ ID NO: 4179787 - RNA, 21 nt, Yersinia pestis KIM
auauuggucauuuuucccuuc

SEQ ID NO: 4179788 - RNA, 15 nt, Yersinia pestis KIM
auauuguccaaagga

SEQ ID NO: 4179789 - RNA, 23 nt, Yersinia pestis KIM
auauugugcuaucccuccccacu

SEQ ID NO: 4179790 - RNA, 17 nt, Yersinia pestis KIM
auauuguuuugacuaaa

SEQ ID NO: 4179791 - RNA, 18 nt, Yersinia pestis KIM
auauuuaauugagaauua

SEQ ID NO: 4179792 - RNA, 21 nt, Yersinia pestis KIM
auauuuaauugagaauuauaa

SEQ ID NO: 4179793 - RNA, 22 nt, Yersinia pestis KIM
auauuuacggugagaauaaaua

SEQ ID NO: 4179794 - RNA, 14 nt, Yersinia pestis KIM
auauuuaucgauuu

SEQ ID NO: 4179795 - RNA, 19 nt, Yersinia pestis KIM
auauuuauuuauccuauuu

SEQ ID NO: 4179796 - RNA, 22 nt, Yersinia pestis KIM
auauuucacguucaucaauacc

SEQ ID NO: 4179797 - RNA, 21 nt, Yersinia pestis KIM
auauuucgguaggaauaaggu

SEQ ID NO: 4179798 - RNA, 15 nt, Yersinia pestis KIM
auauuucuccccacu

SEQ ID NO: 4179799 - RNA, 21 nt, Yersinia pestis KIM
auauuucuccccacuucauca

SEQ ID NO: 4179800 - RNA, 23 nt, Yersinia pestis KIM
auauuucuccccacuucaucauc

SEQ ID NO: 4179801 - RNA, 11 nt, Yersinia pestis KIM
auauuucucuu

SEQ ID NO: 4179802 - RNA, 21 nt, Yersinia pestis KIM
auauuugcugccugcaccagu

SEQ ID NO: 4179803 - RNA, 18 nt, Yersinia pestis KIM
auauuugcugucugggug

SEQ ID NO: 4179804 - RNA, 19 nt, Yersinia pestis KIM
auauuuuacuuccugccaa

SEQ ID NO: 4179805 - RNA, 20 nt, Yersinia pestis KIM
auauuuugaauauuuuuaau

SEQ ID NO: 4179806 - RNA, 18 nt, Yersinia pestis KIM
auauuuuuaaccucuugc

SEQ ID NO: 4179807 - RNA, 13 nt, Yersinia pestis KIM
auauuuuuaaucu

SEQ ID NO: 4179808 - RNA, 22 nt, Yersinia pestis KIM
auauuuuuauuaauauauuuaa

SEQ ID NO: 4179809 - RNA, 13 nt, Yersinia pestis KIM
aucaaaaaauaaa

SEQ ID NO: 4179810 - RNA, 14 nt, Yersinia pestis KIM
aucaaaaaauaaau

SEQ ID NO: 4179811 - RNA, 21 nt, Yersinia pestis KIM
aucaaaacggaugaugccgau

SEQ ID NO: 4179812 - RNA, 17 nt, Yersinia pestis KIM
aucaaaacugauuaaua

SEQ ID NO: 4179813 - RNA, 15 nt, Yersinia pestis KIM
aucaaaagcaagacc

SEQ ID NO: 4179814 - RNA, 12 nt, Yersinia pestis KIM
aucaaaaugacc

SEQ ID NO: 4179815 - RNA, 19 nt, Yersinia pestis KIM
aucaaacaccgguacugag

SEQ ID NO: 4179816 - RNA, 19 nt, Yersinia pestis KIM
aucaaacagcacaucgcca

SEQ ID NO: 4179817 - RNA, 14 nt, Yersinia pestis KIM
aucaaacauaaaaa

SEQ ID NO: 4179818 - RNA, 16 nt, Yersinia pestis KIM
aucaaacgugaaauug

SEQ ID NO: 4179819 - RNA, 20 nt, Yersinia pestis KIM
aucaaacucaccauuauguu

SEQ ID NO: 4179820 - RNA, 18 nt, Yersinia pestis KIM
aucaaaggcaauaccggu

SEQ ID NO: 4179821 - RNA, 17 nt, Yersinia pestis KIM
aucaaaggcgaccaaug

SEQ ID NO: 4179822 - RNA, 20 nt, Yersinia pestis KIM
aucaaaggcgaccaaugggg

SEQ ID NO: 4179823 - RNA, 14 nt, Yersinia pestis KIM
aucaaagugcuuaa

SEQ ID NO: 4179824 - RNA, 16 nt, Yersinia pestis KIM
aucaaaugucagcguu

SEQ ID NO: 4179825 - RNA, 21 nt, Yersinia pestis KIM
aucaacacauaaaaucagcau

SEQ ID NO: 4179826 - RNA, 13 nt, Yersinia pestis KIM
aucaacacugccu

SEQ ID NO: 4179827 - RNA, 20 nt, Yersinia pestis KIM
aucaacagaacuaaacgcca

SEQ ID NO: 4179828 - RNA, 17 nt, Yersinia pestis KIM
aucaacagauaugcauu

SEQ ID NO: 4179829 - RNA, 16 nt, Yersinia pestis KIM
aucaacagauuuucca

SEQ ID NO: 4179830 - RNA, 14 nt, Yersinia pestis KIM
aucaacaggccacc

SEQ ID NO: 4179831 - RNA, 18 nt, Yersinia pestis KIM
aucaacagugaggugaua

SEQ ID NO: 4179832 - RNA, 14 nt, Yersinia pestis KIM
aucaacauggaugu

SEQ ID NO: 4179833 - RNA, 15 nt, Yersinia pestis KIM
aucaacaugggcaag

SEQ ID NO: 4179834 - RNA, 17 nt, Yersinia pestis KIM
aucaacauuaucucgcc

SEQ ID NO: 4179835 - RNA, 18 nt, Yersinia pestis KIM
aucaacauuaucucgccu

SEQ ID NO: 4179836 - RNA, 14 nt, Yersinia pestis KIM
aucaacauuuuuag

SEQ ID NO: 4179837 - RNA, 18 nt, Yersinia pestis KIM
aucaaccaagacauaaug

SEQ ID NO: 4179838 - RNA, 14 nt, Yersinia pestis KIM
aucaaccucagccu

SEQ ID NO: 4179839 - RNA, 17 nt, Yersinia pestis KIM
aucaaccucagccucau

SEQ ID NO: 4179840 - RNA, 18 nt, Yersinia pestis KIM
aucaacgacagcagcagg

SEQ ID NO: 4179841 - RNA, 15 nt, Yersinia pestis KIM
aucaacgccaaaaua

SEQ ID NO: 4179842 - RNA, 17 nt, Yersinia pestis KIM
aucaacgccaaaauaac

SEQ ID NO: 4179843 - RNA, 16 nt, Yersinia pestis KIM
aucaacggcaccacag

SEQ ID NO: 4179844 - RNA, 22 nt, Yersinia pestis KIM
aucaacgggcugauuacccaaa

SEQ ID NO: 4179845 - RNA, 20 nt, Yersinia pestis KIM
aucaacguagcugaauugcu

SEQ ID NO: 4179846 - RNA, 21 nt, Yersinia pestis KIM
aucaacugccuguucuggcaa

SEQ ID NO: 4179847 - RNA, 16 nt, Yersinia pestis KIM
aucaacuuucaccccu

SEQ ID NO: 4179848 - RNA, 18 nt, Yersinia pestis KIM
aucaacuuucaccccuuu

SEQ ID NO: 4179849 - RNA, 14 nt, Yersinia pestis KIM
aucaacuuugguuu

SEQ ID NO: 4179850 - RNA, 17 nt, Yersinia pestis KIM
aucaacuuugguuuuug

SEQ ID NO: 4179851 - RNA, 14 nt, Yersinia pestis KIM
aucaagcaauaauu

SEQ ID NO: 4179852 - RNA, 24 nt, Yersinia pestis KIM
aucaagcauacguugccagccauc

SEQ ID NO: 4179853 - RNA, 12 nt, Yersinia pestis KIM
aucaagcccgca

SEQ ID NO: 4179854 - RNA, 19 nt, Yersinia pestis KIM
aucaagcccgcaauuuuaa

SEQ ID NO: 4179855 - RNA, 14 nt, Yersinia pestis KIM
aucaagcuacaugu

SEQ ID NO: 4179856 - RNA, 22 nt, Yersinia pestis KIM
aucaaggacgaaggguaaaaua

SEQ ID NO: 4179857 - RNA, 14 nt, Yersinia pestis KIM
aucaaggauaagca

SEQ ID NO: 4179858 - RNA, 17 nt, Yersinia pestis KIM
aucaaggcggcagagcc

SEQ ID NO: 4179859 - RNA, 19 nt, Yersinia pestis KIM
aucaaggcggcagagccaa

SEQ ID NO: 4179860 - RNA, 21 nt, Yersinia pestis KIM
aucaaggcggcagagccaauc

SEQ ID NO: 4179861 - RNA, 18 nt, Yersinia pestis KIM
aucaaggcuuuaauaucu

SEQ ID NO: 4179862 - RNA, 20 nt, Yersinia pestis KIM
aucaaguauguuuacuuuug

SEQ ID NO: 4179863 - RNA, 21 nt, Yersinia pestis KIM
aucaagucuugaagagugacc

SEQ ID NO: 4179864 - RNA, 13 nt, Yersinia pestis KIM
aucaauaaccuga

SEQ ID NO: 4179865 - RNA, 14 nt, Yersinia pestis KIM
aucaauaagcuaca

SEQ ID NO: 4179866 - RNA, 20 nt, Yersinia pestis KIM
aucaauaagugcaaacuuaa

SEQ ID NO: 4179867 - RNA, 13 nt, Yersinia pestis KIM
aucaauaccaaua

SEQ ID NO: 4179868 - RNA, 17 nt, Yersinia pestis KIM
aucaauaccaauaaaac

SEQ ID NO: 4179869 - RNA, 16 nt, Yersinia pestis KIM
aucaauacccugccac

SEQ ID NO: 4179870 - RNA, 12 nt, Yersinia pestis KIM
aucaauaccgug

SEQ ID NO: 4179871 - RNA, 20 nt, Yersinia pestis KIM
aucaauaccuuacugcauca

SEQ ID NO: 4179872 - RNA, 16 nt, Yersinia pestis KIM
aucaauacugcaaaug

SEQ ID NO: 4179873 - RNA, 17 nt, Yersinia pestis KIM
aucaauaggauuuucau

SEQ ID NO: 4179874 - RNA, 20 nt, Yersinia pestis KIM
aucaauaggauuuucaugau

SEQ ID NO: 4179875 - RNA, 13 nt, Yersinia pestis KIM
aucaauaggucag

SEQ ID NO: 4179876 - RNA, 18 nt, Yersinia pestis KIM
aucaauaggucagugguu

SEQ ID NO: 4179877 - RNA, 17 nt, Yersinia pestis KIM
aucaauagguguugccg

SEQ ID NO: 4179878 - RNA, 19 nt, Yersinia pestis KIM
aucaauauaacgcccggca

SEQ ID NO: 4179879 - RNA, 21 nt, Yersinia pestis KIM
aucaauaucccgagaaacaaa

SEQ ID NO: 4179880 - RNA, 22 nt, Yersinia pestis KIM
aucaauaucgcuaaacuuauac

SEQ ID NO: 4179881 - RNA, 16 nt, Yersinia pestis KIM
aucaaucagcggagcu

SEQ ID NO: 4179882 - RNA, 20 nt, Yersinia pestis KIM
aucaaucagcggggcauuca

SEQ ID NO: 4179883 - RNA, 14 nt, Yersinia pestis KIM
aucaaucagcugau

SEQ ID NO: 4179884 - RNA, 17 nt, Yersinia pestis KIM
aucaauccuacauucag

SEQ ID NO: 4179885 - RNA, 15 nt, Yersinia pestis KIM
aucaaucgagaagaa

SEQ ID NO: 4179886 - RNA, 16 nt, Yersinia pestis KIM
aucaaucgagaagaau

SEQ ID NO: 4179887 - RNA, 16 nt, Yersinia pestis KIM
aucaaucucaucaauc

SEQ ID NO: 4179888 - RNA, 20 nt, Yersinia pestis KIM
aucaaugaccacuaaauuaa

SEQ ID NO: 4179889 - RNA, 14 nt, Yersinia pestis KIM
aucaauguuaucgc

SEQ ID NO: 4179890 - RNA, 15 nt, Yersinia pestis KIM
aucaauguuggccca

SEQ ID NO: 4179891 - RNA, 17 nt, Yersinia pestis KIM
aucaauuccauaucggc

SEQ ID NO: 4179892 - RNA, 23 nt, Yersinia pestis KIM
aucaauuccauaucggcaaacau

SEQ ID NO: 4179893 - RNA, 18 nt, Yersinia pestis KIM
aucaauugcuggcuauca

SEQ ID NO: 4179894 - RNA, 19 nt, Yersinia pestis KIM
aucaauugcuggcuaucau

SEQ ID NO: 4179895 - RNA, 19 nt, Yersinia pestis KIM
aucaauuggcagcggcaaa

SEQ ID NO: 4179896 - RNA, 12 nt, Yersinia pestis KIM
aucaauuggccc

SEQ ID NO: 4179897 - RNA, 15 nt, Yersinia pestis KIM
aucaauuggcccuuu

SEQ ID NO: 4179898 - RNA, 17 nt, Yersinia pestis KIM
aucaauuugaacaacau

SEQ ID NO: 4179899 - RNA, 13 nt, Yersinia pestis KIM
aucacaacccccc

SEQ ID NO: 4179900 - RNA, 12 nt, Yersinia pestis KIM
aucacaauacag

SEQ ID NO: 4179901 - RNA, 16 nt, Yersinia pestis KIM
aucacaauacagcaaa

SEQ ID NO: 4179902 - RNA, 17 nt, Yersinia pestis KIM
aucacaauacagcaaau

SEQ ID NO: 4179903 - RNA, 16 nt, Yersinia pestis KIM
aucacacccagcgaac

SEQ ID NO: 4179904 - RNA, 19 nt, Yersinia pestis KIM
aucacaccgcgaucacaau

SEQ ID NO: 4179905 - RNA, 20 nt, Yersinia pestis KIM
aucacaccgcgaucacaaua

SEQ ID NO: 4179906 - RNA, 12 nt, Yersinia pestis KIM
aucacacuggcg

SEQ ID NO: 4179907 - RNA, 13 nt, Yersinia pestis KIM
aucacagcaaauu

SEQ ID NO: 4179908 - RNA, 17 nt, Yersinia pestis KIM
aucacagcucucugagc

SEQ ID NO: 4179909 - RNA, 22 nt, Yersinia pestis KIM
aucacaggccacugcauacggc

SEQ ID NO: 4179910 - RNA, 21 nt, Yersinia pestis KIM
aucacaggggcaauaauugca

SEQ ID NO: 4179911 - RNA, 16 nt, Yersinia pestis KIM
aucacaguaaauucuu

SEQ ID NO: 4179912 - RNA, 13 nt, Yersinia pestis KIM
aucacauaaauaa

SEQ ID NO: 4179913 - RNA, 15 nt, Yersinia pestis KIM
aucacauaaauaagu

SEQ ID NO: 4179914 - RNA, 22 nt, Yersinia pestis KIM
aucacaucgcccugcucuucug

SEQ ID NO: 4179915 - RNA, 17 nt, Yersinia pestis KIM
aucacaucggcgacuuu

SEQ ID NO: 4179916 - RNA, 13 nt, Yersinia pestis KIM
aucacaucuugca

SEQ ID NO: 4179917 - RNA, 17 nt, Yersinia pestis KIM
aucacaugacugaacau

SEQ ID NO: 4179918 - RNA, 14 nt, Yersinia pestis KIM
aucaccaaauccaa

SEQ ID NO: 4179919 - RNA, 18 nt, Yersinia pestis KIM
aucaccaccgcauuuuca

SEQ ID NO: 4179920 - RNA, 14 nt, Yersinia pestis KIM
aucaccagacaacc

SEQ ID NO: 4179921 - RNA, 18 nt, Yersinia pestis KIM
aucaccauaacugcugcu

SEQ ID NO: 4179922 - RNA, 16 nt, Yersinia pestis KIM
aucaccauaucagcgc

SEQ ID NO: 4179923 - RNA, 19 nt, Yersinia pestis KIM
aucaccauuaauaauaugc

SEQ ID NO: 4179924 - RNA, 20 nt, Yersinia pestis KIM
aucaccauuaauaauaugca

SEQ ID NO: 4179925 - RNA, 18 nt, Yersinia pestis KIM
aucacccaucaauaauua

SEQ ID NO: 4179926 - RNA, 20 nt, Yersinia pestis KIM
aucacccaugcgagcaguga

SEQ ID NO: 4179927 - RNA, 14 nt, Yersinia pestis KIM
aucaccccccugcc

SEQ ID NO: 4179928 - RNA, 11 nt, Yersinia pestis KIM
aucaccccuuc

SEQ ID NO: 4179929 - RNA, 15 nt, Yersinia pestis KIM
aucacccgcagugcc

SEQ ID NO: 4179930 - RNA, 16 nt, Yersinia pestis KIM
aucacccgcagugccu

SEQ ID NO: 4179931 - RNA, 19 nt, Yersinia pestis KIM
aucacccgcagugccuuau

SEQ ID NO: 4179932 - RNA, 16 nt, Yersinia pestis KIM
aucacccgccucuaaa

SEQ ID NO: 4179933 - RNA, 19 nt, Yersinia pestis KIM
aucaccgggugaaaauggc

SEQ ID NO: 4179934 - RNA, 21 nt, Yersinia pestis KIM
aucaccguucagaucacaacc

SEQ ID NO: 4179935 - RNA, 14 nt, Yersinia pestis KIM
aucaccucaccagc

SEQ ID NO: 4179936 - RNA, 15 nt, Yersinia pestis KIM
aucaccugacaccaa

SEQ ID NO: 4179937 - RNA, 19 nt, Yersinia pestis KIM
aucaccuuauccaauagaa

SEQ ID NO: 4179938 - RNA, 22 nt, Yersinia pestis KIM
aucacgauacgacuucuuauua

SEQ ID NO: 4179939 - RNA, 20 nt, Yersinia pestis KIM
aucacgcagcuuuuucucac

SEQ ID NO: 4179940 - RNA, 20 nt, Yersinia pestis KIM
aucacggauaucaauaaccu

SEQ ID NO: 4179941 - RNA, 17 nt, Yersinia pestis KIM
aucacggccaaaaaugg

SEQ ID NO: 4179942 - RNA, 18 nt, Yersinia pestis KIM
aucacgguuuaucccccu

SEQ ID NO: 4179943 - RNA, 14 nt, Yersinia pestis KIM
aucacuagcgggcc

SEQ ID NO: 4179944 - RNA, 18 nt, Yersinia pestis KIM
aucacuagcgggccucag

SEQ ID NO: 4179945 - RNA, 17 nt, Yersinia pestis KIM
aucacuagggggcaauu

SEQ ID NO: 4179946 - RNA, 15 nt, Yersinia pestis KIM
aucacuauccuuuga

SEQ ID NO: 4179947 - RNA, 14 nt, Yersinia pestis KIM
aucacuauuucaga

SEQ ID NO: 4179948 - RNA, 14 nt, Yersinia pestis KIM
aucacuauuucagg

SEQ ID NO: 4179949 - RNA, 15 nt, Yersinia pestis KIM
aucacuauuucaggc

SEQ ID NO: 4179950 - RNA, 23 nt, Yersinia pestis KIM
aucacuauuucguguauaucacu

SEQ ID NO: 4179951 - RNA, 16 nt, Yersinia pestis KIM
aucacucuguacguaa

SEQ ID NO: 4179952 - RNA, 17 nt, Yersinia pestis KIM
aucacugaccugacguu

SEQ ID NO: 4179953 - RNA, 22 nt, Yersinia pestis KIM
aucacugaggccaaaugaaaau

SEQ ID NO: 4179954 - RNA, 18 nt, Yersinia pestis KIM
aucacugaugagcuggca

SEQ ID NO: 4179955 - RNA, 15 nt, Yersinia pestis KIM
aucacugauucagaa

SEQ ID NO: 4179956 - RNA, 16 nt, Yersinia pestis KIM
aucacugauucagaaa

SEQ ID NO: 4179957 - RNA, 22 nt, Yersinia pestis KIM
aucacugauucagaaagguaug

SEQ ID NO: 4179958 - RNA, 22 nt, Yersinia pestis KIM
aucacuuauuccuuucguucac

SEQ ID NO: 4179959 - RNA, 23 nt, Yersinia pestis KIM
aucacuuauuccuuucguucacu

SEQ ID NO: 4179960 - RNA, 16 nt, Yersinia pestis KIM
aucacuuauuggaagu

SEQ ID NO: 4179961 - RNA, 23 nt, Yersinia pestis KIM
aucacuuauuggaaguacuuauu

SEQ ID NO: 4179962 - RNA, 22 nt, Yersinia pestis KIM
aucagaaacaauaaauauccuc

SEQ ID NO: 4179963 - RNA, 17 nt, Yersinia pestis KIM
aucagacacguaaaaca

SEQ ID NO: 4179964 - RNA, 15 nt, Yersinia pestis KIM
aucagacauuuuucu

SEQ ID NO: 4179965 - RNA, 15 nt, Yersinia pestis KIM
aucagaccauggccu

SEQ ID NO: 4179966 - RNA, 17 nt, Yersinia pestis KIM
aucagaccuuuacagga

SEQ ID NO: 4179967 - RNA, 15 nt, Yersinia pestis KIM
aucagaccuuuagga

SEQ ID NO: 4179968 - RNA, 16 nt, Yersinia pestis KIM
aucagacggcagcaac

SEQ ID NO: 4179969 - RNA, 19 nt, Yersinia pestis KIM
aucagacggcagcaacgaa

SEQ ID NO: 4179970 - RNA, 14 nt, Yersinia pestis KIM
aucagacugcucuu

SEQ ID NO: 4179971 - RNA, 20 nt, Yersinia pestis KIM
aucagacugcucuuucccuu

SEQ ID NO: 4179972 - RNA, 17 nt, Yersinia pestis KIM
aucagaggugaaaaaau

SEQ ID NO: 4179973 - RNA, 19 nt, Yersinia pestis KIM
aucagaucguuaaacccgg

SEQ ID NO: 4179974 - RNA, 14 nt, Yersinia pestis KIM
aucagaugaugaug

SEQ ID NO: 4179975 - RNA, 16 nt, Yersinia pestis KIM
aucagcacuccccgcc

SEQ ID NO: 4179976 - RNA, 14 nt, Yersinia pestis KIM
aucagcagugacgu

SEQ ID NO: 4179977 - RNA, 16 nt, Yersinia pestis KIM
aucagcaucaauaaaa

SEQ ID NO: 4179978 - RNA, 17 nt, Yersinia pestis KIM
aucagcaucaauaaaau

SEQ ID NO: 4179979 - RNA, 20 nt, Yersinia pestis KIM
aucagccagccacugggcua

SEQ ID NO: 4179980 - RNA, 14 nt, Yersinia pestis KIM
aucagccagcuccu

SEQ ID NO: 4179981 - RNA, 18 nt, Yersinia pestis KIM
aucagccauauguugcca

SEQ ID NO: 4179982 - RNA, 18 nt, Yersinia pestis KIM
aucagccccuuugaacug

SEQ ID NO: 4179983 - RNA, 20 nt, Yersinia pestis KIM
aucagcgaccaaauggacga

SEQ ID NO: 4179984 - RNA, 17 nt, Yersinia pestis KIM
aucagcgauuuuaaaaa

SEQ ID NO: 4179985 - RNA, 17 nt, Yersinia pestis KIM
aucagcgcacugcaugc

SEQ ID NO: 4179986 - RNA, 16 nt, Yersinia pestis KIM
aucagcgcccuugcca

SEQ ID NO: 4179987 - RNA, 15 nt, Yersinia pestis KIM
aucagcgccugcugu

SEQ ID NO: 4179988 - RNA, 17 nt, Yersinia pestis KIM
aucagcgccuuugcccc

SEQ ID NO: 4179989 - RNA, 23 nt, Yersinia pestis KIM
aucagcgccuuugccccgauuug

SEQ ID NO: 4179990 - RNA, 16 nt, Yersinia pestis KIM
aucagcgcuggcuuuu

SEQ ID NO: 4179991 - RNA, 22 nt, Yersinia pestis KIM
aucagcggggcauucauuucuu

SEQ ID NO: 4179992 - RNA, 18 nt, Yersinia pestis KIM
aucagcgguaucuagagc

SEQ ID NO: 4179993 - RNA, 16 nt, Yersinia pestis KIM
aucagcgguugaaaag

SEQ ID NO: 4179994 - RNA, 17 nt, Yersinia pestis KIM
aucagcguagauuuucu

SEQ ID NO: 4179995 - RNA, 21 nt, Yersinia pestis KIM
aucagcguauagcgccgccag

SEQ ID NO: 4179996 - RNA, 19 nt, Yersinia pestis KIM
aucagcguuuuaaucacau

SEQ ID NO: 4179997 - RNA, 15 nt, Yersinia pestis KIM
aucagcugauaugaa

SEQ ID NO: 4179998 - RNA, 12 nt, Yersinia pestis KIM
aucaggauaucu

SEQ ID NO: 4179999 - RNA, 14 nt, Yersinia pestis KIM
aucaggaucaccag

SEQ ID NO: 4180000 - RNA, 22 nt, Yersinia pestis KIM
aucaggcagggagauacccaua

SEQ ID NO: 4180001 - RNA, 23 nt, Yersinia pestis KIM
aucaggcagggagauacccauag

SEQ ID NO: 4180002 - RNA, 19 nt, Yersinia pestis KIM
aucaggccuucuuuucucc

SEQ ID NO: 4180003 - RNA, 18 nt, Yersinia pestis KIM
aucaggcgcacgaauauc

SEQ ID NO: 4180004 - RNA, 14 nt, Yersinia pestis KIM
aucaggcuguucuu

SEQ ID NO: 4180005 - RNA, 17 nt, Yersinia pestis KIM
aucaggcuuauauuuau

SEQ ID NO: 4180006 - RNA, 19 nt, Yersinia pestis KIM
aucaggcuuauauuuaugc

SEQ ID NO: 4180007 - RNA, 24 nt, Yersinia pestis KIM
aucaggucaguaaugaauucauug

SEQ ID NO: 4180008 - RNA, 21 nt, Yersinia pestis KIM
aucaggucgucaguggauggc

SEQ ID NO: 4180009 - RNA, 22 nt, Yersinia pestis KIM
aucaggugaacguuggcuucac

SEQ ID NO: 4180010 - RNA, 13 nt, Yersinia pestis KIM
aucaguagcaucc

SEQ ID NO: 4180011 - RNA, 14 nt, Yersinia pestis KIM
aucagugaagagau

SEQ ID NO: 4180012 - RNA, 15 nt, Yersinia pestis KIM
aucagugaagagaua

SEQ ID NO: 4180013 - RNA, 23 nt, Yersinia pestis KIM
aucagugcaauaaauucaaaaua

SEQ ID NO: 4180014 - RNA, 11 nt, Yersinia pestis KIM
aucaguggcac

SEQ ID NO: 4180015 - RNA, 17 nt, Yersinia pestis KIM
aucaguguauuuaucaa

SEQ ID NO: 4180016 - RNA, 16 nt, Yersinia pestis KIM
aucaguucguucccug

SEQ ID NO: 4180017 - RNA, 19 nt, Yersinia pestis KIM
aucaguucguucccuguau

SEQ ID NO: 4180018 - RNA, 16 nt, Yersinia pestis KIM
aucauaagacuaacag

SEQ ID NO: 4180019 - RNA, 17 nt, Yersinia pestis KIM
aucauaaugguaccggc

SEQ ID NO: 4180020 - RNA, 13 nt, Yersinia pestis KIM
aucauagaaggcg

SEQ ID NO: 4180021 - RNA, 11 nt, Yersinia pestis KIM
aucauauauua

SEQ ID NO: 4180022 - RNA, 14 nt, Yersinia pestis KIM
aucauaucaaaaua

SEQ ID NO: 4180023 - RNA, 19 nt, Yersinia pestis KIM
aucauaucaaaauaaaaau

SEQ ID NO: 4180024 - RNA, 17 nt, Yersinia pestis KIM
aucauauguucgaucaa

SEQ ID NO: 4180025 - RNA, 14 nt, Yersinia pestis KIM
aucauauuaacaua

SEQ ID NO: 4180026 - RNA, 16 nt, Yersinia pestis KIM
aucaucaaauucaggu

SEQ ID NO: 4180027 - RNA, 15 nt, Yersinia pestis KIM
aucaucaagccaaug

SEQ ID NO: 4180028 - RNA, 15 nt, Yersinia pestis KIM
aucaucaccaucaga

SEQ ID NO: 4180029 - RNA, 14 nt, Yersinia pestis KIM
aucaucaccauuca

SEQ ID NO: 4180030 - RNA, 15 nt, Yersinia pestis KIM
aucaucaggcaggua

SEQ ID NO: 4180031 - RNA, 17 nt, Yersinia pestis KIM
aucaucaguuuauuguu

SEQ ID NO: 4180032 - RNA, 13 nt, Yersinia pestis KIM
aucaucaucacaa

SEQ ID NO: 4180033 - RNA, 14 nt, Yersinia pestis KIM
aucaucaucccagu

SEQ ID NO: 4180034 - RNA, 15 nt, Yersinia pestis KIM
aucaucaucuuuaau

SEQ ID NO: 4180035 - RNA, 20 nt, Yersinia pestis KIM
aucauccagauauuuuacca

SEQ ID NO: 4180036 - RNA, 20 nt, Yersinia pestis KIM
aucauccaguuuggcugcca

SEQ ID NO: 4180037 - RNA, 22 nt, Yersinia pestis KIM
aucauccaguuuggcugccaug

SEQ ID NO: 4180038 - RNA, 16 nt, Yersinia pestis KIM
aucauccauaaagacg

SEQ ID NO: 4180039 - RNA, 22 nt, Yersinia pestis KIM
aucaucccagucgucuucagcu

SEQ ID NO: 4180040 - RNA, 21 nt, Yersinia pestis KIM
aucaucgcucaucgccaaagc

SEQ ID NO: 4180041 - RNA, 19 nt, Yersinia pestis KIM
aucaucgcugacaauuuac

SEQ ID NO: 4180042 - RNA, 17 nt, Yersinia pestis KIM
aucaucgguaccgccag

SEQ ID NO: 4180043 - RNA, 20 nt, Yersinia pestis KIM
aucaucugcgguaaccaaua

SEQ ID NO: 4180044 - RNA, 20 nt, Yersinia pestis KIM
aucaugaauaggauagacag

SEQ ID NO: 4180045 - RNA, 22 nt, Yersinia pestis KIM
aucaugaauaggauagacagua

SEQ ID NO: 4180046 - RNA, 15 nt, Yersinia pestis KIM
aucaugagauaaaua

SEQ ID NO: 4180047 - RNA, 16 nt, Yersinia pestis KIM
aucaugagauaaauau

SEQ ID NO: 4180048 - RNA, 19 nt, Yersinia pestis KIM
aucaugagauaaauauuua

SEQ ID NO: 4180049 - RNA, 21 nt, Yersinia pestis KIM
aucaugaguaaaagauucaua

SEQ ID NO: 4180050 - RNA, 11 nt, Yersinia pestis KIM
aucaugauuuc

SEQ ID NO: 4180051 - RNA, 17 nt, Yersinia pestis KIM
aucaugcgggauuacuc

SEQ ID NO: 4180052 - RNA, 18 nt, Yersinia pestis KIM
aucaugcucaaucugcaa

SEQ ID NO: 4180053 - RNA, 15 nt, Yersinia pestis KIM
aucaugcucaccaug

SEQ ID NO: 4180054 - RNA, 15 nt, Yersinia pestis KIM
aucaugcucugcuaa

SEQ ID NO: 4180055 - RNA, 21 nt, Yersinia pestis KIM
aucauggcuugugcagcaaua

SEQ ID NO: 4180056 - RNA, 17 nt, Yersinia pestis KIM
aucaugggccaauccaa

SEQ ID NO: 4180057 - RNA, 18 nt, Yersinia pestis KIM
aucauguaacacacagca

SEQ ID NO: 4180058 - RNA, 20 nt, Yersinia pestis KIM
aucauguaaggcaauaccaa

SEQ ID NO: 4180059 - RNA, 23 nt, Yersinia pestis KIM
aucauguaaggcaauaccaauau

SEQ ID NO: 4180060 - RNA, 17 nt, Yersinia pestis KIM
aucauuaagaugcaucc

SEQ ID NO: 4180061 - RNA, 16 nt, Yersinia pestis KIM
aucauuacaucaucuu

SEQ ID NO: 4180062 - RNA, 21 nt, Yersinia pestis KIM
aucauuacguaaucccagaaa

SEQ ID NO: 4180063 - RNA, 13 nt, Yersinia pestis KIM
aucauuauuaugu

SEQ ID NO: 4180064 - RNA, 23 nt, Yersinia pestis KIM
aucauuauuauguauuuuuaugc

SEQ ID NO: 4180065 - RNA, 13 nt, Yersinia pestis KIM
aucauucaagaaa

SEQ ID NO: 4180066 - RNA, 15 nt, Yersinia pestis KIM
aucauucauuuuaaa

SEQ ID NO: 4180067 - RNA, 19 nt, Yersinia pestis KIM
aucauugagaucaguucag

SEQ ID NO: 4180068 - RNA, 21 nt, Yersinia pestis KIM
aucauugcaaucguaccuggc

SEQ ID NO: 4180069 - RNA, 20 nt, Yersinia pestis KIM
aucauuggcuaucacacaga

SEQ ID NO: 4180070 - RNA, 13 nt, Yersinia pestis KIM
aucauuggcuuca

SEQ ID NO: 4180071 - RNA, 21 nt, Yersinia pestis KIM
aucauugguacagaaaauacu

SEQ ID NO: 4180072 - RNA, 12 nt, Yersinia pestis KIM
aucauuuuccug

SEQ ID NO: 4180073 - RNA, 16 nt, Yersinia pestis KIM
aucauuuuuuaucuug

SEQ ID NO: 4180074 - RNA, 14 nt, Yersinia pestis KIM
auccaaaaagcgcu

SEQ ID NO: 4180075 - RNA, 14 nt, Yersinia pestis KIM
auccaaaauaauuc

SEQ ID NO: 4180076 - RNA, 18 nt, Yersinia pestis KIM
auccaaaugcccauuagu

SEQ ID NO: 4180077 - RNA, 14 nt, Yersinia pestis KIM
auccaaccaaccau

SEQ ID NO: 4180078 - RNA, 21 nt, Yersinia pestis KIM
auccaacuuaccuugauccgc

SEQ ID NO: 4180079 - RNA, 23 nt, Yersinia pestis KIM
auccaacuuaccuugauccgcca

SEQ ID NO: 4180080 - RNA, 13 nt, Yersinia pestis KIM
auccaagccauca

SEQ ID NO: 4180081 - RNA, 22 nt, Yersinia pestis KIM
auccaaggcggaauagaggaag

SEQ ID NO: 4180082 - RNA, 12 nt, Yersinia pestis KIM
auccaauaggau

SEQ ID NO: 4180083 - RNA, 19 nt, Yersinia pestis KIM
auccacacagcauucugcu

SEQ ID NO: 4180084 - RNA, 19 nt, Yersinia pestis KIM
auccacacaguauucugcu

SEQ ID NO: 4180085 - RNA, 12 nt, Yersinia pestis KIM
auccacagcaug

SEQ ID NO: 4180086 - RNA, 14 nt, Yersinia pestis KIM
auccacauaaaaag

SEQ ID NO: 4180087 - RNA, 23 nt, Yersinia pestis KIM
auccacauauauagagaaaucua

SEQ ID NO: 4180088 - RNA, 14 nt, Yersinia pestis KIM
auccacauucugug

SEQ ID NO: 4180089 - RNA, 21 nt, Yersinia pestis KIM
auccaccagcgggcggcagau

SEQ ID NO: 4180090 - RNA, 23 nt, Yersinia pestis KIM
auccaccagcgggcggcagauau

SEQ ID NO: 4180091 - RNA, 22 nt, Yersinia pestis KIM
auccaccguuuuacucaggauu

SEQ ID NO: 4180092 - RNA, 17 nt, Yersinia pestis KIM
auccaccuggguuccau

SEQ ID NO: 4180093 - RNA, 17 nt, Yersinia pestis KIM
auccacuuauaucucca

SEQ ID NO: 4180094 - RNA, 16 nt, Yersinia pestis KIM
auccacuuggcuaauu

SEQ ID NO: 4180095 - RNA, 13 nt, Yersinia pestis KIM
auccagaagccau

SEQ ID NO: 4180096 - RNA, 21 nt, Yersinia pestis KIM
auccagaauagagaaaucaaa

SEQ ID NO: 4180097 - RNA, 20 nt, Yersinia pestis KIM
auccagaauuucauugugga

SEQ ID NO: 4180098 - RNA, 18 nt, Yersinia pestis KIM
auccagauccucaucacu

SEQ ID NO: 4180099 - RNA, 15 nt, Yersinia pestis KIM
auccagcgcgccugu

SEQ ID NO: 4180100 - RNA, 16 nt, Yersinia pestis KIM
auccagcuacgcaggc

SEQ ID NO: 4180101 - RNA, 17 nt, Yersinia pestis KIM
auccaguauuucaguaa

SEQ ID NO: 4180102 - RNA, 14 nt, Yersinia pestis KIM
auccagugccaacc

SEQ ID NO: 4180103 - RNA, 20 nt, Yersinia pestis KIM
auccagugucaugcgcagaa

SEQ ID NO: 4180104 - RNA, 24 nt, Yersinia pestis KIM
auccaguuucaguggcuucucuuc

SEQ ID NO: 4180105 - RNA, 12 nt, Yersinia pestis KIM
auccauauuaaa

SEQ ID NO: 4180106 - RNA, 22 nt, Yersinia pestis KIM
auccauauuuggcauguucaca

SEQ ID NO: 4180107 - RNA, 23 nt, Yersinia pestis KIM
auccaucauugcuaaauuuugua

SEQ ID NO: 4180108 - RNA, 21 nt, Yersinia pestis KIM
auccauccccgccucaaugca

SEQ ID NO: 4180109 - RNA, 17 nt, Yersinia pestis KIM
auccaugagaugauuag

SEQ ID NO: 4180110 - RNA, 23 nt, Yersinia pestis KIM
auccaugccauggcgaaaauccu

SEQ ID NO: 4180111 - RNA, 15 nt, Yersinia pestis KIM
auccaugggccucgc

SEQ ID NO: 4180112 - RNA, 23 nt, Yersinia pestis KIM
auccauguaggcucgagccgcgc

SEQ ID NO: 4180113 - RNA, 19 nt, Yersinia pestis KIM
auccauguccguguuggca

SEQ ID NO: 4180114 - RNA, 22 nt, Yersinia pestis KIM
auccauuaauuaaacuguaaua

SEQ ID NO: 4180115 - RNA, 21 nt, Yersinia pestis KIM
auccauuuaauaacuuaaaua

SEQ ID NO: 4180116 - RNA, 17 nt, Yersinia pestis KIM
auccauuuucugccaac

SEQ ID NO: 4180117 - RNA, 14 nt, Yersinia pestis KIM
aucccaauauugac

SEQ ID NO: 4180118 - RNA, 15 nt, Yersinia pestis KIM
aucccaaucaucauc

SEQ ID NO: 4180119 - RNA, 19 nt, Yersinia pestis KIM
aucccaccaaaccauuggu

SEQ ID NO: 4180120 - RNA, 23 nt, Yersinia pestis KIM
aucccacccugaaggcugauuaa

SEQ ID NO: 4180121 - RNA, 16 nt, Yersinia pestis KIM
aucccacgcagauacu

SEQ ID NO: 4180122 - RNA, 19 nt, Yersinia pestis KIM
aucccacucuguaccgccc

SEQ ID NO: 4180123 - RNA, 14 nt, Yersinia pestis KIM
aucccacugcccga

SEQ ID NO: 4180124 - RNA, 13 nt, Yersinia pestis KIM
aucccacuggacg

SEQ ID NO: 4180125 - RNA, 16 nt, Yersinia pestis KIM
aucccagaaccucaac

SEQ ID NO: 4180126 - RNA, 18 nt, Yersinia pestis KIM
auccccacuuguaccugu

SEQ ID NO: 4180127 - RNA, 20 nt, Yersinia pestis KIM
auccccaucgccaauacaau

SEQ ID NO: 4180128 - RNA, 12 nt, Yersinia pestis KIM
auccccugauaa

SEQ ID NO: 4180129 - RNA, 15 nt, Yersinia pestis KIM
auccccuuucugcuc

SEQ ID NO: 4180130 - RNA, 18 nt, Yersinia pestis KIM
auccccuuugacagcauc

SEQ ID NO: 4180131 - RNA, 12 nt, Yersinia pestis KIM
aucccgagaaac

SEQ ID NO: 4180132 - RNA, 22 nt, Yersinia pestis KIM
aucccugccagaaucagcccca

SEQ ID NO: 4180133 - RNA, 18 nt, Yersinia pestis KIM
aucccugcgguauccuua

SEQ ID NO: 4180134 - RNA, 14 nt, Yersinia pestis KIM
aucccugugcugag

SEQ ID NO: 4180135 - RNA, 15 nt, Yersinia pestis KIM
aucccuugacugacc

SEQ ID NO: 4180136 - RNA, 14 nt, Yersinia pestis KIM
auccgaauauguca

SEQ ID NO: 4180137 - RNA, 18 nt, Yersinia pestis KIM
auccgaccaccacugcau

SEQ ID NO: 4180138 - RNA, 16 nt, Yersinia pestis KIM
auccgaccacugacaa

SEQ ID NO: 4180139 - RNA, 21 nt, Yersinia pestis KIM
auccgaccacugacaaaaaca

SEQ ID NO: 4180140 - RNA, 13 nt, Yersinia pestis KIM
auccgcaggaagc

SEQ ID NO: 4180141 - RNA, 15 nt, Yersinia pestis KIM
auccgcaggaagcaa

SEQ ID NO: 4180142 - RNA, 17 nt, Yersinia pestis KIM
auccgcccuuguaagcg

SEQ ID NO: 4180143 - RNA, 23 nt, Yersinia pestis KIM
auccgcgauaacguuguuucuga

SEQ ID NO: 4180144 - RNA, 23 nt, Yersinia pestis KIM
auccgcuggcggcguugucuuau

SEQ ID NO: 4180145 - RNA, 22 nt, Yersinia pestis KIM
auccgcuucgcuggucauaauc

SEQ ID NO: 4180146 - RNA, 16 nt, Yersinia pestis KIM
auccggauuaaauucu

SEQ ID NO: 4180147 - RNA, 16 nt, Yersinia pestis KIM
auccgggaaaaaauac

SEQ ID NO: 4180148 - RNA, 17 nt, Yersinia pestis KIM
auccgggaaaaaauacg

SEQ ID NO: 4180149 - RNA, 15 nt, Yersinia pestis KIM
auccggugaagaauu

SEQ ID NO: 4180150 - RNA, 16 nt, Yersinia pestis KIM
auccggugaagaauuc

SEQ ID NO: 4180151 - RNA, 15 nt, Yersinia pestis KIM
auccguaaaaaaccu

SEQ ID NO: 4180152 - RNA, 21 nt, Yersinia pestis KIM
auccguacuuuucgccgcuuc

SEQ ID NO: 4180153 - RNA, 19 nt, Yersinia pestis KIM
auccgugcugguccuuuug

SEQ ID NO: 4180154 - RNA, 15 nt, Yersinia pestis KIM
auccguuugcaacau

SEQ ID NO: 4180155 - RNA, 17 nt, Yersinia pestis KIM
auccguuuuaacgcugc

SEQ ID NO: 4180156 - RNA, 21 nt, Yersinia pestis KIM
auccguuuucacccaaccggg

SEQ ID NO: 4180157 - RNA, 15 nt, Yersinia pestis KIM
auccuacauucagua

SEQ ID NO: 4180158 - RNA, 18 nt, Yersinia pestis KIM
auccuagcguuucuacaa

SEQ ID NO: 4180159 - RNA, 13 nt, Yersinia pestis KIM
auccuauauacaa

SEQ ID NO: 4180160 - RNA, 22 nt, Yersinia pestis KIM
auccuaucguuuauuacuacaa

SEQ ID NO: 4180161 - RNA, 13 nt, Yersinia pestis KIM
auccucaccguuc

SEQ ID NO: 4180162 - RNA, 16 nt, Yersinia pestis KIM
auccucaccguucaag

SEQ ID NO: 4180163 - RNA, 13 nt, Yersinia pestis KIM
auccucaccguuu

SEQ ID NO: 4180164 - RNA, 13 nt, Yersinia pestis KIM
auccucaguaaaa

SEQ ID NO: 4180165 - RNA, 14 nt, Yersinia pestis KIM
auccucaucacugc

SEQ ID NO: 4180166 - RNA, 15 nt, Yersinia pestis KIM
auccucaucacugcc

SEQ ID NO: 4180167 - RNA, 13 nt, Yersinia pestis KIM
auccucauugagc

SEQ ID NO: 4180168 - RNA, 19 nt, Yersinia pestis KIM
auccucggguuuuauaccg

SEQ ID NO: 4180169 - RNA, 17 nt, Yersinia pestis KIM
auccucugaauaaaaaa

SEQ ID NO: 4180170 - RNA, 12 nt, Yersinia pestis KIM
auccucuuccaa

SEQ ID NO: 4180171 - RNA, 15 nt, Yersinia pestis KIM
auccugaauccccgc

SEQ ID NO: 4180172 - RNA, 14 nt, Yersinia pestis KIM
auccugaauggcaa

SEQ ID NO: 4180173 - RNA, 16 nt, Yersinia pestis KIM
auccugaugagucuau

SEQ ID NO: 4180174 - RNA, 17 nt, Yersinia pestis KIM
auccugauuacguucca

SEQ ID NO: 4180175 - RNA, 16 nt, Yersinia pestis KIM
auccugcaacccacgc

SEQ ID NO: 4180176 - RNA, 18 nt, Yersinia pestis KIM
auccuggcccgccagcau

SEQ ID NO: 4180177 - RNA, 19 nt, Yersinia pestis KIM
auccugugccaacaucgcg

SEQ ID NO: 4180178 - RNA, 21 nt, Yersinia pestis KIM
auccuuaaagaaauaaauauc

SEQ ID NO: 4180179 - RNA, 17 nt, Yersinia pestis KIM
auccuucaagaugcagg

SEQ ID NO: 4180180 - RNA, 19 nt, Yersinia pestis KIM
auccuucaagaugcagggc

SEQ ID NO: 4180181 - RNA, 15 nt, Yersinia pestis KIM
auccuucauuucagg

SEQ ID NO: 4180182 - RNA, 17 nt, Yersinia pestis KIM
auccuucauuucaggac

SEQ ID NO: 4180183 - RNA, 15 nt, Yersinia pestis KIM
auccuugaucgccaa

SEQ ID NO: 4180184 - RNA, 17 nt, Yersinia pestis KIM
auccuuuagcgcugcau

SEQ ID NO: 4180185 - RNA, 20 nt, Yersinia pestis KIM
auccuuuagcgcugcaucug

SEQ ID NO: 4180186 - RNA, 16 nt, Yersinia pestis KIM
auccuuuggauuuaau

SEQ ID NO: 4180187 - RNA, 21 nt, Yersinia pestis KIM
auccuuuggauuuaaugcugu

SEQ ID NO: 4180188 - RNA, 19 nt, Yersinia pestis KIM
auccuuuuuauuuaagcag

SEQ ID NO: 4180189 - RNA, 11 nt, Yersinia pestis KIM
aucgaaacacc

SEQ ID NO: 4180190 - RNA, 19 nt, Yersinia pestis KIM
aucgaacccgcuaacaugc

SEQ ID NO: 4180191 - RNA, 21 nt, Yersinia pestis KIM
aucgaacccgcuaacaugcca

SEQ ID NO: 4180192 - RNA, 18 nt, Yersinia pestis KIM
aucgaauugaucugauau

SEQ ID NO: 4180193 - RNA, 13 nt, Yersinia pestis KIM
aucgacaauggcu

SEQ ID NO: 4180194 - RNA, 13 nt, Yersinia pestis KIM
aucgaccaacugg

SEQ ID NO: 4180195 - RNA, 23 nt, Yersinia pestis KIM
aucgaccacgcccuucacacugg

SEQ ID NO: 4180196 - RNA, 20 nt, Yersinia pestis KIM
aucgaccgaguguaaaaagc

SEQ ID NO: 4180197 - RNA, 23 nt, Yersinia pestis KIM
aucgaccgaguguaaaaagcagu

SEQ ID NO: 4180198 - RNA, 13 nt, Yersinia pestis KIM
aucgagaagaauu

SEQ ID NO: 4180199 - RNA, 22 nt, Yersinia pestis KIM
aucgaguaauauuuuguugcug

SEQ ID NO: 4180200 - RNA, 20 nt, Yersinia pestis KIM
aucgaguggucgauaguggc

SEQ ID NO: 4180201 - RNA, 21 nt, Yersinia pestis KIM
aucgaucucuuuauauucaau

SEQ ID NO: 4180202 - RNA, 20 nt, Yersinia pestis KIM
aucgaucuggauauauuuac

SEQ ID NO: 4180203 - RNA, 22 nt, Yersinia pestis KIM
aucgaugacagcauuauauuau

SEQ ID NO: 4180204 - RNA, 23 nt, Yersinia pestis KIM
aucgauuccgcgagcaauaccaa

SEQ ID NO: 4180205 - RNA, 14 nt, Yersinia pestis KIM
aucgauugauauau

SEQ ID NO: 4180206 - RNA, 23 nt, Yersinia pestis KIM
aucgauugauauauagaaauaag

SEQ ID NO: 4180207 - RNA, 16 nt, Yersinia pestis KIM
aucgcacugaguucug

SEQ ID NO: 4180208 - RNA, 14 nt, Yersinia pestis KIM
aucgcacugauagc

SEQ ID NO: 4180209 - RNA, 16 nt, Yersinia pestis KIM
aucgcagcgacauaaa

SEQ ID NO: 4180210 - RNA, 16 nt, Yersinia pestis KIM
aucgcaguaauagaaa

SEQ ID NO: 4180211 - RNA, 23 nt, Yersinia pestis KIM
aucgcauuggguaauaucaccau

SEQ ID NO: 4180212 - RNA, 14 nt, Yersinia pestis KIM
aucgccaaagccgu

SEQ ID NO: 4180213 - RNA, 19 nt, Yersinia pestis KIM
aucgccaauaaccgcagca

SEQ ID NO: 4180214 - RNA, 16 nt, Yersinia pestis KIM
aucgccaauagaaagg

SEQ ID NO: 4180215 - RNA, 19 nt, Yersinia pestis KIM
aucgccaauagaaaggcua

SEQ ID NO: 4180216 - RNA, 19 nt, Yersinia pestis KIM
aucgccaauuggucaugau

SEQ ID NO: 4180217 - RNA, 23 nt, Yersinia pestis KIM
aucgccagacuguucacaagcca

SEQ ID NO: 4180218 - RNA, 22 nt, Yersinia pestis KIM
aucgccagcggguacacugucg

SEQ ID NO: 4180219 - RNA, 20 nt, Yersinia pestis KIM
aucgccagcugcaauugccg

SEQ ID NO: 4180220 - RNA, 20 nt, Yersinia pestis KIM
aucgccagugaguccuuuac

SEQ ID NO: 4180221 - RNA, 19 nt, Yersinia pestis KIM
aucgccauagccgaucacc

SEQ ID NO: 4180222 - RNA, 22 nt, Yersinia pestis KIM
aucgccauagccgaucaccgca

SEQ ID NO: 4180223 - RNA, 15 nt, Yersinia pestis KIM
aucgcccugcucuuc

SEQ ID NO: 4180224 - RNA, 17 nt, Yersinia pestis KIM
aucgccgccgccagccc

SEQ ID NO: 4180225 - RNA, 18 nt, Yersinia pestis KIM
aucgccguacuuggucac

SEQ ID NO: 4180226 - RNA, 19 nt, Yersinia pestis KIM
aucgccuaccaucaaaaua

SEQ ID NO: 4180227 - RNA, 17 nt, Yersinia pestis KIM
aucgccugaugcuuuuc

SEQ ID NO: 4180228 - RNA, 22 nt, Yersinia pestis KIM
aucgcgaccagcagaauaauca

SEQ ID NO: 4180229 - RNA, 18 nt, Yersinia pestis KIM
aucgcgcauuucuucucu

SEQ ID NO: 4180230 - RNA, 19 nt, Yersinia pestis KIM
aucgcgcccauccgcagga

SEQ ID NO: 4180231 - RNA, 18 nt, Yersinia pestis KIM
aucgcgcuucaggucagg

SEQ ID NO: 4180232 - RNA, 20 nt, Yersinia pestis KIM
aucgcggcgguaaccccauu

SEQ ID NO: 4180233 - RNA, 17 nt, Yersinia pestis KIM
aucgcggguuuuuaacu

SEQ ID NO: 4180234 - RNA, 14 nt, Yersinia pestis KIM
aucgcgguaaacac

SEQ ID NO: 4180235 - RNA, 23 nt, Yersinia pestis KIM
aucgcgguaaucccgauauaaau

SEQ ID NO: 4180236 - RNA, 14 nt, Yersinia pestis KIM
aucgcgucuuuacg

SEQ ID NO: 4180237 - RNA, 13 nt, Yersinia pestis KIM
aucgcuaaaaagc

SEQ ID NO: 4180238 - RNA, 22 nt, Yersinia pestis KIM
aucgcuaaccgccaguucugga

SEQ ID NO: 4180239 - RNA, 20 nt, Yersinia pestis KIM
aucgcucugcguuuuucccu

SEQ ID NO: 4180240 - RNA, 22 nt, Yersinia pestis KIM
aucgcucuugagggugaccauc

SEQ ID NO: 4180241 - RNA, 23 nt, Yersinia pestis KIM
aucgcugccauaugcauggcaua

SEQ ID NO: 4180242 - RNA, 15 nt, Yersinia pestis KIM
aucgcugccgcaaga

SEQ ID NO: 4180243 - RNA, 17 nt, Yersinia pestis KIM
aucgcugugguaucaaa

SEQ ID NO: 4180244 - RNA, 19 nt, Yersinia pestis KIM
aucgcuucacggcaccaac

SEQ ID NO: 4180245 - RNA, 14 nt, Yersinia pestis KIM
aucggaauccauua

SEQ ID NO: 4180246 - RNA, 13 nt, Yersinia pestis KIM
aucggaguguaaa

SEQ ID NO: 4180247 - RNA, 23 nt, Yersinia pestis KIM
aucggauggucauccacaaccag

SEQ ID NO: 4180248 - RNA, 15 nt, Yersinia pestis KIM
aucggcaaaaacagu

SEQ ID NO: 4180249 - RNA, 19 nt, Yersinia pestis KIM
aucggcaaaccgaauacca

SEQ ID NO: 4180250 - RNA, 20 nt, Yersinia pestis KIM
aucggcaaaccgaauaccau

SEQ ID NO: 4180251 - RNA, 14 nt, Yersinia pestis KIM
aucggcaacgucac

SEQ ID NO: 4180252 - RNA, 17 nt, Yersinia pestis KIM
aucggccaaugcuuuuu

SEQ ID NO: 4180253 - RNA, 18 nt, Yersinia pestis KIM
aucggccaauucagcaac

SEQ ID NO: 4180254 - RNA, 16 nt, Yersinia pestis KIM
aucggccagugcgccg

SEQ ID NO: 4180255 - RNA, 18 nt, Yersinia pestis KIM
aucggcggaaaucaccaa

SEQ ID NO: 4180256 - RNA, 22 nt, Yersinia pestis KIM
aucggcgucaagguacccauua

SEQ ID NO: 4180257 - RNA, 20 nt, Yersinia pestis KIM
aucggcuguuaccaaacauu

SEQ ID NO: 4180258 - RNA, 17 nt, Yersinia pestis KIM
aucgggcaauugaaaau

SEQ ID NO: 4180259 - RNA, 22 nt, Yersinia pestis KIM
aucgggccacugagcaaacagu

SEQ ID NO: 4180260 - RNA, 21 nt, Yersinia pestis KIM
aucgggcggauagccgaagaa

SEQ ID NO: 4180261 - RNA, 15 nt, Yersinia pestis KIM
aucgggcuaucauca

SEQ ID NO: 4180262 - RNA, 12 nt, Yersinia pestis KIM
aucggguuuaau

SEQ ID NO: 4180263 - RNA, 17 nt, Yersinia pestis KIM
aucggguuuaauucagg

SEQ ID NO: 4180264 - RNA, 13 nt, Yersinia pestis KIM
aucgguaaaucgc

SEQ ID NO: 4180265 - RNA, 16 nt, Yersinia pestis KIM
aucgguaacuuacagg

SEQ ID NO: 4180266 - RNA, 18 nt, Yersinia pestis KIM
aucgguaccagaccggau

SEQ ID NO: 4180267 - RNA, 13 nt, Yersinia pestis KIM
aucgguaucggcc

SEQ ID NO: 4180268 - RNA, 15 nt, Yersinia pestis KIM
aucgguuagcuacug

SEQ ID NO: 4180269 - RNA, 15 nt, Yersinia pestis KIM
aucgguugccaaguc

SEQ ID NO: 4180270 - RNA, 16 nt, Yersinia pestis KIM
aucgguuucagcuugc

SEQ ID NO: 4180271 - RNA, 23 nt, Yersinia pestis KIM
aucgguuugccaucacgcagcag

SEQ ID NO: 4180272 - RNA, 16 nt, Yersinia pestis KIM
aucgucagaaccugca

SEQ ID NO: 4180273 - RNA, 17 nt, Yersinia pestis KIM
aucguccugcuuaaugc

SEQ ID NO: 4180274 - RNA, 17 nt, Yersinia pestis KIM
aucgucgaacauuuucu

SEQ ID NO: 4180275 - RNA, 19 nt, Yersinia pestis KIM
aucguguggagaacucauu

SEQ ID NO: 4180276 - RNA, 21 nt, Yersinia pestis KIM
aucguuaaacccggcaucaac

SEQ ID NO: 4180277 - RNA, 14 nt, Yersinia pestis KIM
aucguuacucgauu

SEQ ID NO: 4180278 - RNA, 15 nt, Yersinia pestis KIM
aucguugcaggauaa

SEQ ID NO: 4180279 - RNA, 19 nt, Yersinia pestis KIM
aucguugcggguuaacucu

SEQ ID NO: 4180280 - RNA, 12 nt, Yersinia pestis KIM
aucguuuuaugg

SEQ ID NO: 4180281 - RNA, 19 nt, Yersinia pestis KIM
aucuaaacaauugccuuug

SEQ ID NO: 4180282 - RNA, 15 nt, Yersinia pestis KIM
aucuaacuaauaaua

SEQ ID NO: 4180283 - RNA, 18 nt, Yersinia pestis KIM
aucuaacucauucauaau

SEQ ID NO: 4180284 - RNA, 21 nt, Yersinia pestis KIM
aucuaauagaauagaucccau

SEQ ID NO: 4180285 - RNA, 22 nt, Yersinia pestis KIM
aucuaaugacuacuaaucaauc

SEQ ID NO: 4180286 - RNA, 18 nt, Yersinia pestis KIM
aucuaaugguuguuaauu

SEQ ID NO: 4180287 - RNA, 22 nt, Yersinia pestis KIM
aucuaauguauuuauucaaaaa

SEQ ID NO: 4180288 - RNA, 13 nt, Yersinia pestis KIM
aucuacaacauca

SEQ ID NO: 4180289 - RNA, 19 nt, Yersinia pestis KIM
aucuaccgcagaaccuugu

SEQ ID NO: 4180290 - RNA, 14 nt, Yersinia pestis KIM
aucuaccugaaugc

SEQ ID NO: 4180291 - RNA, 12 nt, Yersinia pestis KIM
aucuacugggcc

SEQ ID NO: 4180292 - RNA, 18 nt, Yersinia pestis KIM
aucuacuuuauucaauac

SEQ ID NO: 4180293 - RNA, 20 nt, Yersinia pestis KIM
aucuagcagugauuucagug

SEQ ID NO: 4180294 - RNA, 16 nt, Yersinia pestis KIM
aucuaggccugggugu

SEQ ID NO: 4180295 - RNA, 15 nt, Yersinia pestis KIM
aucuaggugcaguaa

SEQ ID NO: 4180296 - RNA, 17 nt, Yersinia pestis KIM
aucuauaaacuucacga

SEQ ID NO: 4180297 - RNA, 18 nt, Yersinia pestis KIM
aucuauaaacuucacgag

SEQ ID NO: 4180298 - RNA, 20 nt, Yersinia pestis KIM
aucuauauagggaaauaaca

SEQ ID NO: 4180299 - RNA, 13 nt, Yersinia pestis KIM
aucuauaucggcc

SEQ ID NO: 4180300 - RNA, 14 nt, Yersinia pestis KIM
aucuaucuguucac

SEQ ID NO: 4180301 - RNA, 14 nt, Yersinia pestis KIM
aucuaugcuaucca

SEQ ID NO: 4180302 - RNA, 13 nt, Yersinia pestis KIM
aucuauuaauauc

SEQ ID NO: 4180303 - RNA, 19 nt, Yersinia pestis KIM
aucuauuagaugugaaaua

SEQ ID NO: 4180304 - RNA, 16 nt, Yersinia pestis KIM
aucuauucucuguaau

SEQ ID NO: 4180305 - RNA, 21 nt, Yersinia pestis KIM
aucuauugauugcuuaccacu

SEQ ID NO: 4180306 - RNA, 15 nt, Yersinia pestis KIM
aucuauuuuuuugaa

SEQ ID NO: 4180307 - RNA, 19 nt, Yersinia pestis KIM
aucuauuuuuuugaaauuc

SEQ ID NO: 4180308 - RNA, 17 nt, Yersinia pestis KIM
aucucaagacacuauuc

SEQ ID NO: 4180309 - RNA, 15 nt, Yersinia pestis KIM
aucucacgcugaaua

SEQ ID NO: 4180310 - RNA, 15 nt, Yersinia pestis KIM
aucucacgguaguga

SEQ ID NO: 4180311 - RNA, 20 nt, Yersinia pestis KIM
aucucagcagugaguuuauu

SEQ ID NO: 4180312 - RNA, 20 nt, Yersinia pestis KIM
aucucauccagcaacucaag

SEQ ID NO: 4180313 - RNA, 19 nt, Yersinia pestis KIM
aucucaucggcauacuccu

SEQ ID NO: 4180314 - RNA, 20 nt, Yersinia pestis KIM
aucucaucuuaaucacgaua

SEQ ID NO: 4180315 - RNA, 16 nt, Yersinia pestis KIM
aucuccagaauauaaa

SEQ ID NO: 4180316 - RNA, 17 nt, Yersinia pestis KIM
aucucccgcaaagccug

SEQ ID NO: 4180317 - RNA, 15 nt, Yersinia pestis KIM
aucuccgcggguucu

SEQ ID NO: 4180318 - RNA, 19 nt, Yersinia pestis KIM
aucuccuccggagaggaga

SEQ ID NO: 4180319 - RNA, 18 nt, Yersinia pestis KIM
aucucgacaaauccuuuu

SEQ ID NO: 4180320 - RNA, 22 nt, Yersinia pestis KIM
aucucgacaaauccuuuuaaaa

SEQ ID NO: 4180321 - RNA, 16 nt, Yersinia pestis KIM
aucucgauauuaaccc

SEQ ID NO: 4180322 - RNA, 23 nt, Yersinia pestis KIM
aucucggcguaaacaaucgucuu

SEQ ID NO: 4180323 - RNA, 14 nt, Yersinia pestis KIM
aucucguugcccug

SEQ ID NO: 4180324 - RNA, 14 nt, Yersinia pestis KIM
aucucuaacaggga

SEQ ID NO: 4180325 - RNA, 20 nt, Yersinia pestis KIM
aucucuacgcacuuaaugcc

SEQ ID NO: 4180326 - RNA, 19 nt, Yersinia pestis KIM
aucucuaucgcgguuuuaa

SEQ ID NO: 4180327 - RNA, 15 nt, Yersinia pestis KIM
aucucuccagccugc

SEQ ID NO: 4180328 - RNA, 22 nt, Yersinia pestis KIM
aucucucgaacccgcagauaaa

SEQ ID NO: 4180329 - RNA, 16 nt, Yersinia pestis KIM
aucucugcaguacaga

SEQ ID NO: 4180330 - RNA, 19 nt, Yersinia pestis KIM
aucucugccguaccaaugu

SEQ ID NO: 4180331 - RNA, 16 nt, Yersinia pestis KIM
aucucugcgacaucag

SEQ ID NO: 4180332 - RNA, 19 nt, Yersinia pestis KIM
aucucuggcaacggcacau

SEQ ID NO: 4180333 - RNA, 23 nt, Yersinia pestis KIM
aucucuggcaacggcacauccca

SEQ ID NO: 4180334 - RNA, 13 nt, Yersinia pestis KIM
aucucuuccuggg

SEQ ID NO: 4180335 - RNA, 21 nt, Yersinia pestis KIM
aucucuuuauauucaauauca

SEQ ID NO: 4180336 - RNA, 15 nt, Yersinia pestis KIM
aucugaaaauauuau

SEQ ID NO: 4180337 - RNA, 15 nt, Yersinia pestis KIM
aucugaagaugcuga

SEQ ID NO: 4180338 - RNA, 14 nt, Yersinia pestis KIM
aucugaaucagcgg

SEQ ID NO: 4180339 - RNA, 15 nt, Yersinia pestis KIM
aucugaauggcccgc

SEQ ID NO: 4180340 - RNA, 13 nt, Yersinia pestis KIM
aucugaccaaaca

SEQ ID NO: 4180341 - RNA, 21 nt, Yersinia pestis KIM
aucugaccaaacauugucacc

SEQ ID NO: 4180342 - RNA, 19 nt, Yersinia pestis KIM
aucugaccagugagccaug

SEQ ID NO: 4180343 - RNA, 19 nt, Yersinia pestis KIM
aucugacucuguaaaaauc

SEQ ID NO: 4180344 - RNA, 17 nt, Yersinia pestis KIM
aucugagcgaacugaau

SEQ ID NO: 4180345 - RNA, 18 nt, Yersinia pestis KIM
aucugauacugaacgcaa

SEQ ID NO: 4180346 - RNA, 18 nt, Yersinia pestis KIM
aucugauaucucuuuauc

SEQ ID NO: 4180347 - RNA, 19 nt, Yersinia pestis KIM
aucugauaucucuuuauca

SEQ ID NO: 4180348 - RNA, 14 nt, Yersinia pestis KIM
aucugaucaaucuc

SEQ ID NO: 4180349 - RNA, 13 nt, Yersinia pestis KIM
aucugaugagugu

SEQ ID NO: 4180350 - RNA, 21 nt, Yersinia pestis KIM
aucugauuugggaacaacagc

SEQ ID NO: 4180351 - RNA, 18 nt, Yersinia pestis KIM
aucugcaacuucagccac

SEQ ID NO: 4180352 - RNA, 13 nt, Yersinia pestis KIM
aucugcaauggcu

SEQ ID NO: 4180353 - RNA, 21 nt, Yersinia pestis KIM
aucugcaauggcuggcaaggc

SEQ ID NO: 4180354 - RNA, 22 nt, Yersinia pestis KIM
aucugcacaccacacuggaugc

SEQ ID NO: 4180355 - RNA, 12 nt, Yersinia pestis KIM
aucugcaguaga

SEQ ID NO: 4180356 - RNA, 16 nt, Yersinia pestis KIM
aucugcauugauuaaa

SEQ ID NO: 4180357 - RNA, 20 nt, Yersinia pestis KIM
aucugccaacuggccgccau

SEQ ID NO: 4180358 - RNA, 18 nt, Yersinia pestis KIM
aucugccaccgcacaguu

SEQ ID NO: 4180359 - RNA, 14 nt, Yersinia pestis KIM
aucugccaccgcuc

SEQ ID NO: 4180360 - RNA, 21 nt, Yersinia pestis KIM
aucugccaguaaacggcgguu

SEQ ID NO: 4180361 - RNA, 12 nt, Yersinia pestis KIM
aucugcccagcc

SEQ ID NO: 4180362 - RNA, 20 nt, Yersinia pestis KIM
aucugcgguaaccaauaaca

SEQ ID NO: 4180363 - RNA, 20 nt, Yersinia pestis KIM
aucugcuccaggcgcucagg

SEQ ID NO: 4180364 - RNA, 15 nt, Yersinia pestis KIM
aucugcugaccauua

SEQ ID NO: 4180365 - RNA, 22 nt, Yersinia pestis KIM
aucugcugcuuuaggugguuca

SEQ ID NO: 4180366 - RNA, 23 nt, Yersinia pestis KIM
aucugcuucuccuguaaugcauu

SEQ ID NO: 4180367 - RNA, 20 nt, Yersinia pestis KIM
aucuggguaucgugguaaac

SEQ ID NO: 4180368 - RNA, 20 nt, Yersinia pestis KIM
aucugggugagagguugcaa

SEQ ID NO: 4180369 - RNA, 17 nt, Yersinia pestis KIM
aucugguacuccugcuc

SEQ ID NO: 4180370 - RNA, 15 nt, Yersinia pestis KIM
aucuguaaucaccag

SEQ ID NO: 4180371 - RNA, 16 nt, Yersinia pestis KIM
aucuguuucaaauaag

SEQ ID NO: 4180372 - RNA, 17 nt, Yersinia pestis KIM
aucuguuuuugccaccu

SEQ ID NO: 4180373 - RNA, 16 nt, Yersinia pestis KIM
aucuuaaauugaagag

SEQ ID NO: 4180374 - RNA, 12 nt, Yersinia pestis KIM
aucuuaccggcg

SEQ ID NO: 4180375 - RNA, 16 nt, Yersinia pestis KIM
aucuuauccacagcau

SEQ ID NO: 4180376 - RNA, 23 nt, Yersinia pestis KIM
aucuuauucauaucgcucaucau

SEQ ID NO: 4180377 - RNA, 21 nt, Yersinia pestis KIM
aucuucaaugguguuaucuuc

SEQ ID NO: 4180378 - RNA, 15 nt, Yersinia pestis KIM
aucuucacucagcgc

SEQ ID NO: 4180379 - RNA, 17 nt, Yersinia pestis KIM
aucuucauugccuucua

SEQ ID NO: 4180380 - RNA, 15 nt, Yersinia pestis KIM
aucuuccaaaggaag

SEQ ID NO: 4180381 - RNA, 21 nt, Yersinia pestis KIM
aucuuccagcggcaaauagag

SEQ ID NO: 4180382 - RNA, 17 nt, Yersinia pestis KIM
aucuuccgucaguugcc

SEQ ID NO: 4180383 - RNA, 20 nt, Yersinia pestis KIM
aucuuccgucaguugcccgu

SEQ ID NO: 4180384 - RNA, 15 nt, Yersinia pestis KIM
aucuuccuuuccauu

SEQ ID NO: 4180385 - RNA, 19 nt, Yersinia pestis KIM
aucuuccuuuccauuuuca

SEQ ID NO: 4180386 - RNA, 18 nt, Yersinia pestis KIM
aucuucucguaauuauug

SEQ ID NO: 4180387 - RNA, 17 nt, Yersinia pestis KIM
aucuugaaccaauuuuu

SEQ ID NO: 4180388 - RNA, 18 nt, Yersinia pestis KIM
aucuugaacggugaggau

SEQ ID NO: 4180389 - RNA, 20 nt, Yersinia pestis KIM
aucuugaaggauggcggaua

SEQ ID NO: 4180390 - RNA, 18 nt, Yersinia pestis KIM
aucuugaauaauauucaa

SEQ ID NO: 4180391 - RNA, 22 nt, Yersinia pestis KIM
aucuugauaaacaugccacuuc

SEQ ID NO: 4180392 - RNA, 18 nt, Yersinia pestis KIM
aucuugauuagcuggcug

SEQ ID NO: 4180393 - RNA, 19 nt, Yersinia pestis KIM
aucuugauuagcuggcugu

SEQ ID NO: 4180394 - RNA, 22 nt, Yersinia pestis KIM
aucuugauucguuuucggugca

SEQ ID NO: 4180395 - RNA, 19 nt, Yersinia pestis KIM
aucuugcgccgaaauaaaa

SEQ ID NO: 4180396 - RNA, 16 nt, Yersinia pestis KIM
aucuugucguuauuuu

SEQ ID NO: 4180397 - RNA, 21 nt, Yersinia pestis KIM
aucuugugaugcauauuauaa

SEQ ID NO: 4180398 - RNA, 17 nt, Yersinia pestis KIM
aucuugugucaguauca

SEQ ID NO: 4180399 - RNA, 18 nt, Yersinia pestis KIM
aucuugugucaguaucac

SEQ ID NO: 4180400 - RNA, 19 nt, Yersinia pestis KIM
aucuugugucaguaucacc

SEQ ID NO: 4180401 - RNA, 16 nt, Yersinia pestis KIM
aucuuguuaauuuaaa

SEQ ID NO: 4180402 - RNA, 16 nt, Yersinia pestis KIM
aucuuguucuaauaau

SEQ ID NO: 4180403 - RNA, 15 nt, Yersinia pestis KIM
aucuuuaacaacaac

SEQ ID NO: 4180404 - RNA, 20 nt, Yersinia pestis KIM
aucuuuaauauugcauuuua

SEQ ID NO: 4180405 - RNA, 15 nt, Yersinia pestis KIM
aucuuuaauuuuucc

SEQ ID NO: 4180406 - RNA, 16 nt, Yersinia pestis KIM
aucuuuaauuuuuccc

SEQ ID NO: 4180407 - RNA, 14 nt, Yersinia pestis KIM
aucuuuaccagccc

SEQ ID NO: 4180408 - RNA, 13 nt, Yersinia pestis KIM
aucuuuacugcau

SEQ ID NO: 4180409 - RNA, 14 nt, Yersinia pestis KIM
aucuuuauuuauga

SEQ ID NO: 4180410 - RNA, 19 nt, Yersinia pestis KIM
aucuuucauaucaaaagga

SEQ ID NO: 4180411 - RNA, 16 nt, Yersinia pestis KIM
aucuuuccagccaaua

SEQ ID NO: 4180412 - RNA, 21 nt, Yersinia pestis KIM
aucuuucugacuaacucuucu

SEQ ID NO: 4180413 - RNA, 20 nt, Yersinia pestis KIM
aucuuuggcguuaaucaagc

SEQ ID NO: 4180414 - RNA, 21 nt, Yersinia pestis KIM
aucuuuuacaaauuugacauu

SEQ ID NO: 4180415 - RNA, 23 nt, Yersinia pestis KIM
aucuuuuaguaacaaaaugcggu

SEQ ID NO: 4180416 - RNA, 15 nt, Yersinia pestis KIM
aucuuuuauuuauga

SEQ ID NO: 4180417 - RNA, 12 nt, Yersinia pestis KIM
augaaaaacaga

SEQ ID NO: 4180418 - RNA, 20 nt, Yersinia pestis KIM
augaaaaacagauauacggc

SEQ ID NO: 4180419 - RNA, 23 nt, Yersinia pestis KIM
augaaaaacugugcaaauggcuu

SEQ ID NO: 4180420 - RNA, 14 nt, Yersinia pestis KIM
augaaaaauacaaa

SEQ ID NO: 4180421 - RNA, 19 nt, Yersinia pestis KIM
augaaaaauacaaauauaa

SEQ ID NO: 4180422 - RNA, 15 nt, Yersinia pestis KIM
augaaaauagccaac

SEQ ID NO: 4180423 - RNA, 17 nt, Yersinia pestis KIM
augaaaggcuccacaua

SEQ ID NO: 4180424 - RNA, 21 nt, Yersinia pestis KIM
augaaauaaacuuuuaugcau

SEQ ID NO: 4180425 - RNA, 15 nt, Yersinia pestis KIM
augaaaucaguguau

SEQ ID NO: 4180426 - RNA, 12 nt, Yersinia pestis KIM
augaacauuauu

SEQ ID NO: 4180427 - RNA, 14 nt, Yersinia pestis KIM
augaaccaaaauuc

SEQ ID NO: 4180428 - RNA, 18 nt, Yersinia pestis KIM
augaacccuuucagcgcu

SEQ ID NO: 4180429 - RNA, 18 nt, Yersinia pestis KIM
augaacggauacccagca

SEQ ID NO: 4180430 - RNA, 22 nt, Yersinia pestis KIM
augaacguguuagguaauacca

SEQ ID NO: 4180431 - RNA, 13 nt, Yersinia pestis KIM
augaacucaacuu

SEQ ID NO: 4180432 - RNA, 17 nt, Yersinia pestis KIM
augaagcauuaaacaga

SEQ ID NO: 4180433 - RNA, 18 nt, Yersinia pestis KIM
augaagcauuaaacagau

SEQ ID NO: 4180434 - RNA, 15 nt, Yersinia pestis KIM
augaagcucauuaau

SEQ ID NO: 4180435 - RNA, 14 nt, Yersinia pestis KIM
augaaggccauaau

SEQ ID NO: 4180436 - RNA, 22 nt, Yersinia pestis KIM
augaagggggcuuauucuaauu

SEQ ID NO: 4180437 - RNA, 12 nt, Yersinia pestis KIM
augaaguuauuu

SEQ ID NO: 4180438 - RNA, 19 nt, Yersinia pestis KIM
augaauaauaucggcggca

SEQ ID NO: 4180439 - RNA, 23 nt, Yersinia pestis KIM
augaauaggauagacaguaacua

SEQ ID NO: 4180440 - RNA, 14 nt, Yersinia pestis KIM
augaauauuauuca

SEQ ID NO: 4180441 - RNA, 15 nt, Yersinia pestis KIM
augaauauuauucag

SEQ ID NO: 4180442 - RNA, 17 nt, Yersinia pestis KIM
augaaucgaguaauauu

SEQ ID NO: 4180443 - RNA, 16 nt, Yersinia pestis KIM
augaaugaggcugagg

SEQ ID NO: 4180444 - RNA, 18 nt, Yersinia pestis KIM
augaaugaggcugagguu

SEQ ID NO: 4180445 - RNA, 16 nt, Yersinia pestis KIM
augaaugcgaacuacg

SEQ ID NO: 4180446 - RNA, 17 nt, Yersinia pestis KIM
augaauggaaguuaaaa

SEQ ID NO: 4180447 - RNA, 17 nt, Yersinia pestis KIM
augacaaaaauaagcgu

SEQ ID NO: 4180448 - RNA, 15 nt, Yersinia pestis KIM
augacaagucaugau

SEQ ID NO: 4180449 - RNA, 23 nt, Yersinia pestis KIM
augacaaguugucuguaauaaua

SEQ ID NO: 4180450 - RNA, 15 nt, Yersinia pestis KIM
augacacaauucccg

SEQ ID NO: 4180451 - RNA, 22 nt, Yersinia pestis KIM
augacacauauuucaggcuguu

SEQ ID NO: 4180452 - RNA, 16 nt, Yersinia pestis KIM
augacaccuuucaaaa

SEQ ID NO: 4180453 - RNA, 19 nt, Yersinia pestis KIM
augacagcauuauauuauu

SEQ ID NO: 4180454 - RNA, 22 nt, Yersinia pestis KIM
augacaguauuugcaguggaug

SEQ ID NO: 4180455 - RNA, 14 nt, Yersinia pestis KIM
augacauucagcgu

SEQ ID NO: 4180456 - RNA, 14 nt, Yersinia pestis KIM
augaccaaaggcua

SEQ ID NO: 4180457 - RNA, 20 nt, Yersinia pestis KIM
augaccaacuguaaaaucuu

SEQ ID NO: 4180458 - RNA, 15 nt, Yersinia pestis KIM
augaccaauagucac

SEQ ID NO: 4180459 - RNA, 14 nt, Yersinia pestis KIM
augacccaacguca

SEQ ID NO: 4180460 - RNA, 16 nt, Yersinia pestis KIM
augaccgauuauauga

SEQ ID NO: 4180461 - RNA, 18 nt, Yersinia pestis KIM
augaccgugacauuuuca

SEQ ID NO: 4180462 - RNA, 19 nt, Yersinia pestis KIM
augacgcccgcagcggcua

SEQ ID NO: 4180463 - RNA, 19 nt, Yersinia pestis KIM
augacgcgaucugaaacgg

SEQ ID NO: 4180464 - RNA, 21 nt, Yersinia pestis KIM
augacgggaauauuuacacgg

SEQ ID NO: 4180465 - RNA, 16 nt, Yersinia pestis KIM
augacggugauguccg

SEQ ID NO: 4180466 - RNA, 15 nt, Yersinia pestis KIM
augacggugcccaca

SEQ ID NO: 4180467 - RNA, 12 nt, Yersinia pestis KIM
augacuaaccaa

SEQ ID NO: 4180468 - RNA, 18 nt, Yersinia pestis KIM
augacuaaccaagccauc

SEQ ID NO: 4180469 - RNA, 18 nt, Yersinia pestis KIM
augacuaauugugcagca

SEQ ID NO: 4180470 - RNA, 21 nt, Yersinia pestis KIM
augacuaauugugcagcauca

SEQ ID NO: 4180471 - RNA, 19 nt, Yersinia pestis KIM
augacuagguuauaauucc

SEQ ID NO: 4180472 - RNA, 17 nt, Yersinia pestis KIM
augacuccugaaauaaa

SEQ ID NO: 4180473 - RNA, 14 nt, Yersinia pestis KIM
augacuggcuauua

SEQ ID NO: 4180474 - RNA, 17 nt, Yersinia pestis KIM
augacuuagcacggcau

SEQ ID NO: 4180475 - RNA, 11 nt, Yersinia pestis KIM
augacuucuua

SEQ ID NO: 4180476 - RNA, 16 nt, Yersinia pestis KIM
augacuuuuuuuaugg

SEQ ID NO: 4180477 - RNA, 13 nt, Yersinia pestis KIM
augagaaguaaaa

SEQ ID NO: 4180478 - RNA, 22 nt, Yersinia pestis KIM
augagaauaucuauauagggaa

SEQ ID NO: 4180479 - RNA, 16 nt, Yersinia pestis KIM
augagauccugaaaau

SEQ ID NO: 4180480 - RNA, 13 nt, Yersinia pestis KIM
augagauuaauuc

SEQ ID NO: 4180481 - RNA, 19 nt, Yersinia pestis KIM
augagcagcccagucucuu

SEQ ID NO: 4180482 - RNA, 14 nt, Yersinia pestis KIM
augagccacacauu

SEQ ID NO: 4180483 - RNA, 15 nt, Yersinia pestis KIM
augagcgcuguugca

SEQ ID NO: 4180484 - RNA, 16 nt, Yersinia pestis KIM
augagcugaauagccu

SEQ ID NO: 4180485 - RNA, 18 nt, Yersinia pestis KIM
augagcugaauagccuug

SEQ ID NO: 4180486 - RNA, 13 nt, Yersinia pestis KIM
augagcugaguaa

SEQ ID NO: 4180487 - RNA, 19 nt, Yersinia pestis KIM
augagcuggcaaaacucag

SEQ ID NO: 4180488 - RNA, 16 nt, Yersinia pestis KIM
augagcuuaugcgucu

SEQ ID NO: 4180489 - RNA, 13 nt, Yersinia pestis KIM
augaggcucagac

SEQ ID NO: 4180490 - RNA, 21 nt, Yersinia pestis KIM
augaggcucuucugggcugaa

SEQ ID NO: 4180491 - RNA, 13 nt, Yersinia pestis KIM
augaggcugaggu

SEQ ID NO: 4180492 - RNA, 14 nt, Yersinia pestis KIM
augaguaagugauu

SEQ ID NO: 4180493 - RNA, 13 nt, Yersinia pestis KIM
augaguacuauuu

SEQ ID NO: 4180494 - RNA, 13 nt, Yersinia pestis KIM
augaguaucggcc

SEQ ID NO: 4180495 - RNA, 18 nt, Yersinia pestis KIM
augagugaaaauauguag

SEQ ID NO: 4180496 - RNA, 21 nt, Yersinia pestis KIM
augagugaaaauauguaguug

SEQ ID NO: 4180497 - RNA, 21 nt, Yersinia pestis KIM
augagugauauccgccaaaga

SEQ ID NO: 4180498 - RNA, 18 nt, Yersinia pestis KIM
augaguguuggccucaga

SEQ ID NO: 4180499 - RNA, 20 nt, Yersinia pestis KIM
augaguguuggccucagacu

SEQ ID NO: 4180500 - RNA, 22 nt, Yersinia pestis KIM
augaguuacgucaaaacuauuu

SEQ ID NO: 4180501 - RNA, 21 nt, Yersinia pestis KIM
augaguuugaucacagcucuc

SEQ ID NO: 4180502 - RNA, 14 nt, Yersinia pestis KIM
augauaaaacuauu

SEQ ID NO: 4180503 - RNA, 14 nt, Yersinia pestis KIM
augauaaauaaccg

SEQ ID NO: 4180504 - RNA, 13 nt, Yersinia pestis KIM
augauaaugccau

SEQ ID NO: 4180505 - RNA, 18 nt, Yersinia pestis KIM
augauaccgcggucauca

SEQ ID NO: 4180506 - RNA, 17 nt, Yersinia pestis KIM
augauagcgcgagagcg

SEQ ID NO: 4180507 - RNA, 21 nt, Yersinia pestis KIM
augauaggcacggcacuaaua

SEQ ID NO: 4180508 - RNA, 13 nt, Yersinia pestis KIM
augauauagcugu

SEQ ID NO: 4180509 - RNA, 21 nt, Yersinia pestis KIM
augauauugaucuuuaauauu

SEQ ID NO: 4180510 - RNA, 12 nt, Yersinia pestis KIM
augaucaacagu

SEQ ID NO: 4180511 - RNA, 15 nt, Yersinia pestis KIM
augcuguauaaaaga

SEQ ID NO: 4180512 - RNA, 21 nt, Yersinia pestis KIM
augcuguuguagcgccaggua

SEQ ID NO: 4180513 - RNA, 23 nt, Yersinia pestis KIM
augcuguuuuuuaguuaaauaau

SEQ ID NO: 4180514 - RNA, 11 nt, Yersinia pestis KIM
augcuuauaaa

SEQ ID NO: 4180515 - RNA, 19 nt, Yersinia pestis KIM
auggaaaaaauacaggugu

SEQ ID NO: 4180516 - RNA, 20 nt, Yersinia pestis KIM
auggaaaaauuagccaagca

SEQ ID NO: 4180517 - RNA, 21 nt, Yersinia pestis KIM
auggaaaauauucuaaguaaa

SEQ ID NO: 4180518 - RNA, 23 nt, Yersinia pestis KIM
auggaacggacauuuuacucccu

SEQ ID NO: 4180519 - RNA, 12 nt, Yersinia pestis KIM
auggaacuguaa

SEQ ID NO: 4180520 - RNA, 13 nt, Yersinia pestis KIM
auggaacuguaaa

SEQ ID NO: 4180521 - RNA, 13 nt, Yersinia pestis KIM
auggaagaccaga

SEQ ID NO: 4180522 - RNA, 13 nt, Yersinia pestis KIM
auggaagauaucu

SEQ ID NO: 4180523 - RNA, 17 nt, Yersinia pestis KIM
auggaaguuaaaaaaau

SEQ ID NO: 4180524 - RNA, 13 nt, Yersinia pestis KIM
auggacgaacagc

SEQ ID NO: 4180525 - RNA, 17 nt, Yersinia pestis KIM
auggacgaacagcccca

SEQ ID NO: 4180526 - RNA, 20 nt, Yersinia pestis KIM
auggacuuacccuacccauu

SEQ ID NO: 4180527 - RNA, 12 nt, Yersinia pestis KIM
auggagaggcgc

SEQ ID NO: 4180528 - RNA, 17 nt, Yersinia pestis KIM
auggagauuuuuuaugu

SEQ ID NO: 4180529 - RNA, 19 nt, Yersinia pestis KIM
auggaguuguugccacaga

SEQ ID NO: 4180530 - RNA, 14 nt, Yersinia pestis KIM
auggauaaugcuga

SEQ ID NO: 4180531 - RNA, 16 nt, Yersinia pestis KIM
auggauacacggcugc

SEQ ID NO: 4180532 - RNA, 13 nt, Yersinia pestis KIM
auggaucacccgu

SEQ ID NO: 4180533 - RNA, 17 nt, Yersinia pestis KIM
auggaugaauauccacc

SEQ ID NO: 4180534 - RNA, 16 nt, Yersinia pestis KIM
auggaugaccaaugga

SEQ ID NO: 4180535 - RNA, 17 nt, Yersinia pestis KIM
auggauggucauaaaau

SEQ ID NO: 4180536 - RNA, 20 nt, Yersinia pestis KIM
auggauuggcauuuaaaagg

SEQ ID NO: 4180537 - RNA, 20 nt, Yersinia pestis KIM
auggcaccgugggcaaagaa

SEQ ID NO: 4180538 - RNA, 19 nt, Yersinia pestis KIM
auggcacuggaaacaaaac

SEQ ID NO: 4180539 - RNA, 17 nt, Yersinia pestis KIM
auggcagagcuuuucuc

SEQ ID NO: 4180540 - RNA, 17 nt, Yersinia pestis KIM
auggcagcccuuauuca

SEQ ID NO: 4180541 - RNA, 17 nt, Yersinia pestis KIM
auggcagguaucaauac

SEQ ID NO: 4180542 - RNA, 16 nt, Yersinia pestis KIM
auggcaucuuauuauu

SEQ ID NO: 4180543 - RNA, 14 nt, Yersinia pestis KIM
auggcauuaaaaau

SEQ ID NO: 4180544 - RNA, 15 nt, Yersinia pestis KIM
auggcauuaaaaauc

SEQ ID NO: 4180545 - RNA, 18 nt, Yersinia pestis KIM
auggcauuaaaaaucugc

SEQ ID NO: 4180546 - RNA, 13 nt, Yersinia pestis KIM
auggcauuuucag

SEQ ID NO: 4180547 - RNA, 13 nt, Yersinia pestis KIM
auggcauuuuucg

SEQ ID NO: 4180548 - RNA, 14 nt, Yersinia pestis KIM
auggccaauaccca

SEQ ID NO: 4180549 - RNA, 13 nt, Yersinia pestis KIM
auggccaccauua

SEQ ID NO: 4180550 - RNA, 21 nt, Yersinia pestis KIM
auggccaucucacauagcugu

SEQ ID NO: 4180551 - RNA, 15 nt, Yersinia pestis KIM
auggccaugaaucaa

SEQ ID NO: 4180552 - RNA, 19 nt, Yersinia pestis KIM
auggccaugaaucaaauua

SEQ ID NO: 4180553 - RNA, 16 nt, Yersinia pestis KIM
auggccgauggaacca

SEQ ID NO: 4180554 - RNA, 22 nt, Yersinia pestis KIM
auggccugcggcgguuacccuc

SEQ ID NO: 4180555 - RNA, 17 nt, Yersinia pestis KIM
auggccuugaaucaaaa

SEQ ID NO: 4180556 - RNA, 18 nt, Yersinia pestis KIM
auggcgaugaugauuauu

SEQ ID NO: 4180557 - RNA, 16 nt, Yersinia pestis KIM
auggcgcacauuacaa

SEQ ID NO: 4180558 - RNA, 20 nt, Yersinia pestis KIM
auggcgcaguguaaaaccug

SEQ ID NO: 4180559 - RNA, 13 nt, Yersinia pestis KIM
auggcgcugggca

SEQ ID NO: 4180560 - RNA, 20 nt, Yersinia pestis KIM
auggcgcuuaacugcacgac

SEQ ID NO: 4180561 - RNA, 21 nt, Yersinia pestis KIM
auggcggcuggaaaaccaauu

SEQ ID NO: 4180562 - RNA, 20 nt, Yersinia pestis KIM
auggcgguauagaccaauuc

SEQ ID NO: 4180563 - RNA, 16 nt, Yersinia pestis KIM
auggcguuguagggag

SEQ ID NO: 4180564 - RNA, 14 nt, Yersinia pestis KIM
auggcuaaaucauc

SEQ ID NO: 4180565 - RNA, 16 nt, Yersinia pestis KIM
auggcuaauuaauuua

SEQ ID NO: 4180566 - RNA, 15 nt, Yersinia pestis KIM
auggcuacguagcuc

SEQ ID NO: 4180567 - RNA, 21 nt, Yersinia pestis KIM
auggcuacguagcucagcugg

SEQ ID NO: 4180568 - RNA, 18 nt, Yersinia pestis KIM
auggcuccaccguucagg

SEQ ID NO: 4180569 - RNA, 17 nt, Yersinia pestis KIM
auggcuggcaaggcacg

SEQ ID NO: 4180570 - RNA, 15 nt, Yersinia pestis KIM
auggcugucuauuga

SEQ ID NO: 4180571 - RNA, 15 nt, Yersinia pestis KIM
auggcugucugauga

SEQ ID NO: 4180572 - RNA, 21 nt, Yersinia pestis KIM
auggcuugcucaauaccauug

SEQ ID NO: 4180573 - RNA, 18 nt, Yersinia pestis KIM
auggcuugugcagcaaua

SEQ ID NO: 4180574 - RNA, 20 nt, Yersinia pestis KIM
auggcuuuacggcucaccug

SEQ ID NO: 4180575 - RNA, 22 nt, Yersinia pestis KIM
auggcuuuagguugagaauuaa

SEQ ID NO: 4180576 - RNA, 13 nt, Yersinia pestis KIM
auggcuuucagga

SEQ ID NO: 4180577 - RNA, 14 nt, Yersinia pestis KIM
auggcuuuuuuaau

SEQ ID NO: 4180578 - RNA, 22 nt, Yersinia pestis KIM
auggcuuuuuuacgcgccugcu

SEQ ID NO: 4180579 - RNA, 18 nt, Yersinia pestis KIM
augggauauuaucgaaac

SEQ ID NO: 4180580 - RNA, 13 nt, Yersinia pestis KIM
augggcagaagag

SEQ ID NO: 4180581 - RNA, 21 nt, Yersinia pestis KIM
augggcgccgcuuuaccuguu

SEQ ID NO: 4180582 - RNA, 15 nt, Yersinia pestis KIM
auggggagcuugccu

SEQ ID NO: 4180583 - RNA, 22 nt, Yersinia pestis KIM
auggggaucugcauaccuggau

SEQ ID NO: 4180584 - RNA, 20 nt, Yersinia pestis KIM
auggggccaccuaauccaag

SEQ ID NO: 4180585 - RNA, 20 nt, Yersinia pestis KIM
auggguaauccccaccaaca

SEQ ID NO: 4180586 - RNA, 19 nt, Yersinia pestis KIM
auggguauauuuaccaaaa

SEQ ID NO: 4180587 - RNA, 14 nt, Yersinia pestis KIM
augggucguugaua

SEQ ID NO: 4180588 - RNA, 15 nt, Yersinia pestis KIM
auggguguuauuuac

SEQ ID NO: 4180589 - RNA, 18 nt, Yersinia pestis KIM
augguacaacugcggcgu

SEQ ID NO: 4180590 - RNA, 22 nt, Yersinia pestis KIM
augguacggaucagugugggcu

SEQ ID NO: 4180591 - RNA, 21 nt, Yersinia pestis KIM
augguagccauauaauaugcc

SEQ ID NO: 4180592 - RNA, 16 nt, Yersinia pestis KIM
augguauagacuguuu

SEQ ID NO: 4180593 - RNA, 13 nt, Yersinia pestis KIM
augguaucagaaa

SEQ ID NO: 4180594 - RNA, 13 nt, Yersinia pestis KIM
auggucacccuca

SEQ ID NO: 4180595 - RNA, 19 nt, Yersinia pestis KIM
auggucaggaacccauuug

SEQ ID NO: 4180596 - RNA, 22 nt, Yersinia pestis KIM
auggucaggaacccauuugcac

SEQ ID NO: 4180597 - RNA, 19 nt, Yersinia pestis KIM
auggucaguuguucaccua

SEQ ID NO: 4180598 - RNA, 18 nt, Yersinia pestis KIM
auggucauaaaaucgaua

SEQ ID NO: 4180599 - RNA, 14 nt, Yersinia pestis KIM
auggucauccacaa

SEQ ID NO: 4180600 - RNA, 15 nt, Yersinia pestis KIM
auggucauccacaac

SEQ ID NO: 4180601 - RNA, 21 nt, Yersinia pestis KIM
auggucgaucccaauauuaaa

SEQ ID NO: 4180602 - RNA, 23 nt, Yersinia pestis KIM
auggugagcucaucuuauuucac

SEQ ID NO: 4180603 - RNA, 14 nt, Yersinia pestis KIM
auggugaugaucau

SEQ ID NO: 4180604 - RNA, 20 nt, Yersinia pestis KIM
auggugaugaucaugcucac

SEQ ID NO: 4180605 - RNA, 13 nt, Yersinia pestis KIM
auggugcuauuuc

SEQ ID NO: 4180606 - RNA, 14 nt, Yersinia pestis KIM
auggugcuauuucu

SEQ ID NO: 4180607 - RNA, 12 nt, Yersinia pestis KIM
augguggcagcc

SEQ ID NO: 4180608 - RNA, 13 nt, Yersinia pestis KIM
augguggcagccu

SEQ ID NO: 4180609 - RNA, 18 nt, Yersinia pestis KIM
auggugggccgugcggga

SEQ ID NO: 4180610 - RNA, 19 nt, Yersinia pestis KIM
auggugggucgugcgggau

SEQ ID NO: 4180611 - RNA, 16 nt, Yersinia pestis KIM
auggugucuuuacugg

SEQ ID NO: 4180612 - RNA, 19 nt, Yersinia pestis KIM
augguuaaucuacccgaau

SEQ ID NO: 4180613 - RNA, 17 nt, Yersinia pestis KIM
augguugaaugaccaag

SEQ ID NO: 4180614 - RNA, 16 nt, Yersinia pestis KIM
augguuguuaauuaag

SEQ ID NO: 4180615 - RNA, 12 nt, Yersinia pestis KIM
augguuuugugu

SEQ ID NO: 4180616 - RNA, 20 nt, Yersinia pestis KIM
auguaaaacacgcaacacuu

SEQ ID NO: 4180617 - RNA, 17 nt, Yersinia pestis KIM
auguaacggucauaauc

SEQ ID NO: 4180618 - RNA, 24 nt, Yersinia pestis KIM
auguaacggucauaaucagggaug

SEQ ID NO: 4180619 - RNA, 14 nt, Yersinia pestis KIM
auguacauuauuca

SEQ ID NO: 4180620 - RNA, 20 nt, Yersinia pestis KIM
auguagggguacagcaggga

SEQ ID NO: 4180621 - RNA, 13 nt, Yersinia pestis KIM
auguaguguguuu

SEQ ID NO: 4180622 - RNA, 23 nt, Yersinia pestis KIM
auguaguguguuuucuuguauau

SEQ ID NO: 4180623 - RNA, 14 nt, Yersinia pestis KIM
auguaguucagucg

SEQ ID NO: 4180624 - RNA, 13 nt, Yersinia pestis KIM
auguauaaagaau

SEQ ID NO: 4180625 - RNA, 20 nt, Yersinia pestis KIM
auguauccaaggcagauauu

SEQ ID NO: 4180626 - RNA, 13 nt, Yersinia pestis KIM
auuaauuauaagc

SEQ ID NO: 4180627 - RNA, 16 nt, Yersinia pestis KIM
auuaauuauuuauaau

SEQ ID NO: 4180628 - RNA, 21 nt, Yersinia pestis KIM
auuaauuauuuauaaugggua

SEQ ID NO: 4180629 - RNA, 12 nt, Yersinia pestis KIM
auuaauuauuuu

SEQ ID NO: 4180630 - RNA, 14 nt, Yersinia pestis KIM
auuaauuauuuuau

SEQ ID NO: 4180631 - RNA, 20 nt, Yersinia pestis KIM
auuaauuccacgcugaaacu

SEQ ID NO: 4180632 - RNA, 15 nt, Yersinia pestis KIM
auuaauuggccggga

SEQ ID NO: 4180633 - RNA, 15 nt, Yersinia pestis KIM
auuaauugguauuuu

SEQ ID NO: 4180634 - RNA, 16 nt, Yersinia pestis KIM
auuaauugguauuuua

SEQ ID NO: 4180635 - RNA, 18 nt, Yersinia pestis KIM
auuaauugguuuuaauaa

SEQ ID NO: 4180636 - RNA, 21 nt, Yersinia pestis KIM
auuaauugguuuuaauaacca

SEQ ID NO: 4180637 - RNA, 12 nt, Yersinia pestis KIM
auuaauuuuuca

SEQ ID NO: 4180638 - RNA, 20 nt, Yersinia pestis KIM
auuacacacccucaacucaa

SEQ ID NO: 4180639 - RNA, 14 nt, Yersinia pestis KIM
auuacacgguggcc

SEQ ID NO: 4180640 - RNA, 14 nt, Yersinia pestis KIM
auuacacugaauug

SEQ ID NO: 4180641 - RNA, 16 nt, Yersinia pestis KIM
auuacagacuggccaa

SEQ ID NO: 4180642 - RNA, 23 nt, Yersinia pestis KIM
auuacagacuggccaacaggcgg

SEQ ID NO: 4180643 - RNA, 18 nt, Yersinia pestis KIM
auuacaggccccaaucca

SEQ ID NO: 4180644 - RNA, 15 nt, Yersinia pestis KIM
auuacaucaucuucu

SEQ ID NO: 4180645 - RNA, 21 nt, Yersinia pestis KIM
auuaccaauaagcuguaaugc

SEQ ID NO: 4180646 - RNA, 16 nt, Yersinia pestis KIM
auuaccaauaauuaau

SEQ ID NO: 4180647 - RNA, 13 nt, Yersinia pestis KIM
auuaccacuguua

SEQ ID NO: 4180648 - RNA, 20 nt, Yersinia pestis KIM
auuacccacuugcaacauua

SEQ ID NO: 4180649 - RNA, 20 nt, Yersinia pestis KIM
auuacccauaacuugagcac

SEQ ID NO: 4180650 - RNA, 17 nt, Yersinia pestis KIM
auuacccucauuuuacc

SEQ ID NO: 4180651 - RNA, 22 nt, Yersinia pestis KIM
auuacccuguuuuaaaugccaa

SEQ ID NO: 4180652 - RNA, 15 nt, Yersinia pestis KIM
auuaccgagcgucaa

SEQ ID NO: 4180653 - RNA, 13 nt, Yersinia pestis KIM
auuaccgcacacu

SEQ ID NO: 4180654 - RNA, 17 nt, Yersinia pestis KIM
auuaccgucagggacaa

SEQ ID NO: 4180655 - RNA, 14 nt, Yersinia pestis KIM
auuaccguuaucaa

SEQ ID NO: 4180656 - RNA, 19 nt, Yersinia pestis KIM
auuaccucaauacguuucc

SEQ ID NO: 4180657 - RNA, 17 nt, Yersinia pestis KIM
auuaccugcauauccuc

SEQ ID NO: 4180658 - RNA, 17 nt, Yersinia pestis KIM
auuacgccauccacuca

SEQ ID NO: 4180659 - RNA, 20 nt, Yersinia pestis KIM
auuacggccccagcccagca

SEQ ID NO: 4180660 - RNA, 11 nt, Yersinia pestis KIM
auuacggguau

SEQ ID NO: 4180661 - RNA, 18 nt, Yersinia pestis KIM
auuacgggucagcucacc

SEQ ID NO: 4180662 - RNA, 17 nt, Yersinia pestis KIM
auuacgugcccaaaaac

SEQ ID NO: 4180663 - RNA, 18 nt, Yersinia pestis KIM
auuacguuaaacgcauac

SEQ ID NO: 4180664 - RNA, 17 nt, Yersinia pestis KIM
auuacguuccacugcuu

SEQ ID NO: 4180665 - RNA, 19 nt, Yersinia pestis KIM
auuacguucuagcucugag

SEQ ID NO: 4180666 - RNA, 23 nt, Yersinia pestis KIM
auuacucacacagccagccuuaa

SEQ ID NO: 4180667 - RNA, 20 nt, Yersinia pestis KIM
auuacucagcacauuuuuau

SEQ ID NO: 4180668 - RNA, 19 nt, Yersinia pestis KIM
auuacucucuauugaucac

SEQ ID NO: 4180669 - RNA, 23 nt, Yersinia pestis KIM
auuacucuuauaaagauuuuaag

SEQ ID NO: 4180670 - RNA, 13 nt, Yersinia pestis KIM
auuacugcgauau

SEQ ID NO: 4180671 - RNA, 12 nt, Yersinia pestis KIM
auuacuuauaaa

SEQ ID NO: 4180672 - RNA, 20 nt, Yersinia pestis KIM
auuacuucuuuuuaacgacg

SEQ ID NO: 4180673 - RNA, 18 nt, Yersinia pestis KIM
auuacuuuauuuaaaauu

SEQ ID NO: 4180674 - RNA, 15 nt, Yersinia pestis KIM
auuacuuugaauagc

SEQ ID NO: 4180675 - RNA, 14 nt, Yersinia pestis KIM
auuagaaaacaagu

SEQ ID NO: 4180676 - RNA, 15 nt, Yersinia pestis KIM
auuagaaaacaaguu

SEQ ID NO: 4180677 - RNA, 17 nt, Yersinia pestis KIM
auuagaaguucuaaaua

SEQ ID NO: 4180678 - RNA, 17 nt, Yersinia pestis KIM
auuagaccggacauuaa

SEQ ID NO: 4180679 - RNA, 20 nt, Yersinia pestis KIM
auuagagguuauugacaaag

SEQ ID NO: 4180680 - RNA, 18 nt, Yersinia pestis KIM
auuagaugugaaauauca

SEQ ID NO: 4180681 - RNA, 17 nt, Yersinia pestis KIM
auuagcaguaacgucca

SEQ ID NO: 4180682 - RNA, 17 nt, Yersinia pestis KIM
auuagccagaaauagca

SEQ ID NO: 4180683 - RNA, 17 nt, Yersinia pestis KIM
auuagccccaaaugcca

SEQ ID NO: 4180684 - RNA, 14 nt, Yersinia pestis KIM
auuaggaugucggg

SEQ ID NO: 4180685 - RNA, 16 nt, Yersinia pestis KIM
auuaggccacauuauu

SEQ ID NO: 4180686 - RNA, 17 nt, Yersinia pestis KIM
auuaggcuuuguuggca

SEQ ID NO: 4180687 - RNA, 18 nt, Yersinia pestis KIM
auuagggcugacagagcg

SEQ ID NO: 4180688 - RNA, 18 nt, Yersinia pestis KIM
auuaguuuuaauaaccau

SEQ ID NO: 4180689 - RNA, 18 nt, Yersinia pestis KIM
auuaguuuuagaugucag

SEQ ID NO: 4180690 - RNA, 16 nt, Yersinia pestis KIM
auuauaacuauuaucu

SEQ ID NO: 4180691 - RNA, 19 nt, Yersinia pestis KIM
auuauaaggagagauuaga

SEQ ID NO: 4180692 - RNA, 13 nt, Yersinia pestis KIM
auuauauagauuu

SEQ ID NO: 4180693 - RNA, 18 nt, Yersinia pestis KIM
auuauauagauuuauuca

SEQ ID NO: 4180694 - RNA, 13 nt, Yersinia pestis KIM
auuauaugcguuu

SEQ ID NO: 4180695 - RNA, 12 nt, Yersinia pestis KIM
auuaucauguaa

SEQ ID NO: 4180696 - RNA, 19 nt, Yersinia pestis KIM
auuaucccguucaauaaua

SEQ ID NO: 4180697 - RNA, 15 nt, Yersinia pestis KIM
auuauccguuugcaa

SEQ ID NO: 4180698 - RNA, 16 nt, Yersinia pestis KIM
auuaucgauaaauaau

SEQ ID NO: 4180699 - RNA, 14 nt, Yersinia pestis KIM
auuaucgaucacau

SEQ ID NO: 4180700 - RNA, 21 nt, Yersinia pestis KIM
auuaucgaucacaugcucagu

SEQ ID NO: 4180701 - RNA, 22 nt, Yersinia pestis KIM
auuaucgccuaccaucaaaaua

SEQ ID NO: 4180702 - RNA, 17 nt, Yersinia pestis KIM
auuaucgccuggcuuga

SEQ ID NO: 4180703 - RNA, 16 nt, Yersinia pestis KIM
auuaucgcuuuuaugg

SEQ ID NO: 4180704 - RNA, 22 nt, Yersinia pestis KIM
auuaucugaaagcaaacaauua

SEQ ID NO: 4180705 - RNA, 19 nt, Yersinia pestis KIM
auuaucuucuauuacccuu

SEQ ID NO: 4180706 - RNA, 14 nt, Yersinia pestis KIM
auuaucuuuuaaaa

SEQ ID NO: 4180707 - RNA, 17 nt, Yersinia pestis KIM
auuauggauaauuuaau

SEQ ID NO: 4180708 - RNA, 16 nt, Yersinia pestis KIM
auuauggcuauacuua

SEQ ID NO: 4180709 - RNA, 22 nt, Yersinia pestis KIM
auuaugggugguuagcagauaa

SEQ ID NO: 4180710 - RNA, 15 nt, Yersinia pestis KIM
auuauuaaacugauu

SEQ ID NO: 4180711 - RNA, 20 nt, Yersinia pestis KIM
auuauuaguagcacuauuuu

SEQ ID NO: 4180712 - RNA, 14 nt, Yersinia pestis KIM
auuauuauaagugc

SEQ ID NO: 4180713 - RNA, 22 nt, Yersinia pestis KIM
auuauuaucgggaacguagcca

SEQ ID NO: 4180714 - RNA, 13 nt, Yersinia pestis KIM
auuauuauuuaua

SEQ ID NO: 4180715 - RNA, 18 nt, Yersinia pestis KIM
auuauucuucaccacgau

SEQ ID NO: 4180716 - RNA, 13 nt, Yersinia pestis KIM
auuauucuuuuac

SEQ ID NO: 4180717 - RNA, 14 nt, Yersinia pestis KIM
auuauuggcagcaa

SEQ ID NO: 4180718 - RNA, 15 nt, Yersinia pestis KIM
auuauuguacuuuau

SEQ ID NO: 4180719 - RNA, 14 nt, Yersinia pestis KIM
auuauuuaaacaau

SEQ ID NO: 4180720 - RNA, 18 nt, Yersinia pestis KIM
auuauuuucaaccaguua

SEQ ID NO: 4180721 - RNA, 19 nt, Yersinia pestis KIM
auuauuuuccagaugaaua

SEQ ID NO: 4180722 - RNA, 23 nt, Yersinia pestis KIM
auuauuuuggguauauaguuuau

SEQ ID NO: 4180723 - RNA, 22 nt, Yersinia pestis KIM
auuauuuuguuuguaaauuuua

SEQ ID NO: 4180724 - RNA, 11 nt, Yersinia pestis KIM
auuauuuuuca

SEQ ID NO: 4180725 - RNA, 22 nt, Yersinia pestis KIM
auuauuuuuggucguuuaaaua

SEQ ID NO: 4180726 - RNA, 21 nt, Yersinia pestis KIM
auucaaaauagaggaaauaaa

SEQ ID NO: 4180727 - RNA, 18 nt, Yersinia pestis KIM
auucaaacacuuaugauc

SEQ ID NO: 4180728 - RNA, 14 nt, Yersinia pestis KIM
auucaaaguugccg

SEQ ID NO: 4180729 - RNA, 22 nt, Yersinia pestis KIM
auucaaauacggcaccaauggc

SEQ ID NO: 4180730 - RNA, 20 nt, Yersinia pestis KIM
auucaaauagcguuuggcug

SEQ ID NO: 4180731 - RNA, 14 nt, Yersinia pestis KIM
auucaaauaucauu

SEQ ID NO: 4180732 - RNA, 21 nt, Yersinia pestis KIM
auucaacccacuguuggaggc

SEQ ID NO: 4180733 - RNA, 24 nt, Yersinia pestis KIM
auucaacgugacucacuacauucu

SEQ ID NO: 4180734 - RNA, 20 nt, Yersinia pestis KIM
auucaagaaaaugauuuaau

SEQ ID NO: 4180735 - RNA, 22 nt, Yersinia pestis KIM
auucaagaaaaugauuuaauuu

SEQ ID NO: 4180736 - RNA, 14 nt, Yersinia pestis KIM
auucaaguugcaga

SEQ ID NO: 4180737 - RNA, 19 nt, Yersinia pestis KIM
auucaauaggguaauacca

SEQ ID NO: 4180738 - RNA, 15 nt, Yersinia pestis KIM
auucaauauuuaucc

SEQ ID NO: 4180739 - RNA, 23 nt, Yersinia pestis KIM
auucaauccauugaucucauucc

SEQ ID NO: 4180740 - RNA, 17 nt, Yersinia pestis KIM
auucaauugaaauaaga

SEQ ID NO: 4180741 - RNA, 15 nt, Yersinia pestis KIM
uuuugcuuaaaacag

SEQ ID NO: 4180742 - RNA, 14 nt, Yersinia pestis KIM
uuuuggcugauaga

SEQ ID NO: 4180743 - RNA, 19 nt, Yersinia pestis KIM
uuuugggaugaaaaauaca

SEQ ID NO: 4180744 - RNA, 13 nt, Yersinia pestis KIM
uuuuguauuuaaa

SEQ ID NO: 4180745 - RNA, 12 nt, Yersinia pestis KIM
uuuuuaacaaac

SEQ ID NO: 4180746 - RNA, 16 nt, Yersinia pestis KIM
uuuuuaacgucagaua

SEQ ID NO: 4180747 - RNA, 13 nt, Yersinia pestis KIM
uuuuuaauuuaaa

SEQ ID NO: 4180748 - RNA, 12 nt, Yersinia pestis KIM
uuuuuacaagca

SEQ ID NO: 4180749 - RNA, 18 nt, Yersinia pestis KIM
uuuuuacaagcacucaau

SEQ ID NO: 4180750 - RNA, 22 nt, Yersinia pestis KIM
uuuuuaccgaguuggauauaca

SEQ ID NO: 4180751 - RNA, 19 nt, Yersinia pestis KIM
uuuuuacgccuauccucau

SEQ ID NO: 4180752 - RNA, 14 nt, Yersinia pestis KIM
uuuuuagcuucgcu

SEQ ID NO: 4180753 - RNA, 14 nt, Yersinia pestis KIM
uuuuuauaauuaau

SEQ ID NO: 4180754 - RNA, 22 nt, Yersinia pestis KIM
uuuuuauagacacggugaccaa

SEQ ID NO: 4180755 - RNA, 13 nt, Yersinia pestis KIM
uuuuuaucccccu

SEQ ID NO: 4180756 - RNA, 12 nt, Yersinia pestis KIM
uuuuuauuucuu

SEQ ID NO: 4180757 - RNA, 18 nt, Yersinia pestis KIM
uuuuucaacucagcggcu

SEQ ID NO: 4180758 - RNA, 12 nt, Yersinia pestis KIM
uuuuucagcuuc

SEQ ID NO: 4180759 - RNA, 16 nt, Yersinia pestis KIM
uuuuucagcuucuucu

SEQ ID NO: 4180760 - RNA, 16 nt, Yersinia pestis KIM
uuuuucauaauaauga

SEQ ID NO: 4180761 - RNA, 20 nt, Yersinia pestis KIM
uuuuucgaguaguuuggcua

SEQ ID NO: 4180762 - RNA, 11 nt, Yersinia pestis KIM
uuuuucucaau

SEQ ID NO: 4180763 - RNA, 13 nt, Yersinia pestis KIM
uuuuucucuacau

SEQ ID NO: 4180764 - RNA, 22 nt, Yersinia pestis KIM
uuuuucuguucagauuuaccau

SEQ ID NO: 4180765 - RNA, 17 nt, Yersinia pestis KIM
uuuuugagcucagccag

SEQ ID NO: 4180766 - RNA, 21 nt, Yersinia pestis KIM
uuuuugagcucagccaggcag

SEQ ID NO: 4180767 - RNA, 14 nt, Yersinia pestis KIM
uuuuugcaauuaau

SEQ ID NO: 4180768 - RNA, 19 nt, Yersinia pestis KIM
uuuuugcauauaaaacacg

SEQ ID NO: 4180769 - RNA, 21 nt, Yersinia pestis KIM
uuuuugcccggcugauauaac

SEQ ID NO: 4180770 - RNA, 23 nt, Yersinia pestis KIM
uuuuugcgggacagaaagaaguc

SEQ ID NO: 4180771 - RNA, 14 nt, Yersinia pestis KIM
uuuuugcuggaacu

SEQ ID NO: 4180772 - RNA, 15 nt, Yersinia pestis KIM
uuuuugcuuuuugcu

SEQ ID NO: 4180773 - RNA, 21 nt, Yersinia pestis KIM
uuuuuguaucuauaauucagc

SEQ ID NO: 4180774 - RNA, 20 nt, Yersinia pestis KIM
uuuuugucgcccugcgaggc

SEQ ID NO: 4180775 - RNA, 22 nt, Yersinia pestis KIM
uuuuugugcccagaaaaccccc

SEQ ID NO: 4180776 - RNA, 17 nt, Yersinia pestis KIM
uuuuuguguuuuggcua

SEQ ID NO: 4180777 - RNA, 19 nt, Yersinia pestis KIM
uuuuuuaacuuccauucau

SEQ ID NO: 4180778 - RNA, 15 nt, Yersinia pestis KIM
uuuuuuaguuaaaua

SEQ ID NO: 4180779 - RNA, 11 nt, Yersinia pestis KIM
uuuuuugccag

SEQ ID NO: 4180780 - RNA, 21 nt, Yersinia pestis KIM
auuccccaccauugcaaacau

SEQ ID NO: 4180781 - RNA, 19 nt, Yersinia pestis KIM
auucccccugagucaaauc

SEQ ID NO: 4180782 - RNA, 15 nt, Yersinia pestis KIM
auucccgccagguuu

SEQ ID NO: 4180783 - RNA, 22 nt, Yersinia pestis KIM
auucccgucagguucaauuccc

SEQ ID NO: 4180784 - RNA, 15 nt, Yersinia pestis KIM
auucccguuguuuau

SEQ ID NO: 4180785 - RNA, 14 nt, Yersinia pestis KIM
auucccucaauagc

SEQ ID NO: 4180786 - RNA, 23 nt, Yersinia pestis KIM
auucccugcgguuauuugcuauc

SEQ ID NO: 4180787 - RNA, 14 nt, Yersinia pestis KIM
auuccgaugcuugg

SEQ ID NO: 4180788 - RNA, 23 nt, Yersinia pestis KIM
auuccgcgagcaauaccaaaaau

SEQ ID NO: 4180789 - RNA, 14 nt, Yersinia pestis KIM
auuccgcgccuggg

SEQ ID NO: 4180790 - RNA, 16 nt, Yersinia pestis KIM
auuccgucgauaucua

SEQ ID NO: 4180791 - RNA, 12 nt, Yersinia pestis KIM
auuccuaagcaa

SEQ ID NO: 4180792 - RNA, 18 nt, Yersinia pestis KIM
auuccucucugaaucacu

SEQ ID NO: 4180793 - RNA, 12 nt, Yersinia pestis KIM
auuccucuguga

SEQ ID NO: 4180794 - RNA, 23 nt, Yersinia pestis KIM
auuccugguuuuaccaucaccau

SEQ ID NO: 4180795 - RNA, 13 nt, Yersinia pestis KIM
auucgaguuaacu

SEQ ID NO: 4180796 - RNA, 22 nt, Yersinia pestis KIM
auucgcaucuuccaaaggaagg

SEQ ID NO: 4180797 - RNA, 12 nt, Yersinia pestis KIM
auucgccagggc

SEQ ID NO: 4180798 - RNA, 16 nt, Yersinia pestis KIM
auucgcccucaaccaa

SEQ ID NO: 4180799 - RNA, 18 nt, Yersinia pestis KIM
auucgccggggacuacac

SEQ ID NO: 4180800 - RNA, 15 nt, Yersinia pestis KIM
auucgcgaccagcag

SEQ ID NO: 4180801 - RNA, 13 nt, Yersinia pestis KIM
auucgcgccccaa

SEQ ID NO: 4180802 - RNA, 19 nt, Yersinia pestis KIM
auucgcggaacaacgccuc

SEQ ID NO: 4180803 - RNA, 15 nt, Yersinia pestis KIM
auucgcuuaugacaa

SEQ ID NO: 4180804 - RNA, 21 nt, Yersinia pestis KIM
auucgggcaacuaauucuuag

SEQ ID NO: 4180805 - RNA, 17 nt, Yersinia pestis KIM
auucgggugagugaaca

SEQ ID NO: 4180806 - RNA, 17 nt, Yersinia pestis KIM
auucgggugagugaacg

SEQ ID NO: 4180807 - RNA, 13 nt, Yersinia pestis KIM
auucguagaaaca

SEQ ID NO: 4180808 - RNA, 13 nt, Yersinia pestis KIM
auucgucugccau

SEQ ID NO: 4180809 - RNA, 19 nt, Yersinia pestis KIM
auucgucugccauugcuca

SEQ ID NO: 4180810 - RNA, 18 nt, Yersinia pestis KIM
auucgugcucaucaaccu

SEQ ID NO: 4180811 - RNA, 20 nt, Yersinia pestis KIM
auucgugcucaucaaccuca

SEQ ID NO: 4180812 - RNA, 20 nt, Yersinia pestis KIM
auucuaccuggcucaaauuu

SEQ ID NO: 4180813 - RNA, 12 nt, Yersinia pestis KIM
auucuagcaaca

SEQ ID NO: 4180814 - RNA, 13 nt, Yersinia pestis KIM
auucuagcaacau

SEQ ID NO: 4180815 - RNA, 19 nt, Yersinia pestis KIM
auucuaggcaugaauaaua

SEQ ID NO: 4180816 - RNA, 21 nt, Yersinia pestis KIM
auucuaggcaugaauaauauc

SEQ ID NO: 4180817 - RNA, 13 nt, Yersinia pestis KIM
auucucaaaauaa

SEQ ID NO: 4180818 - RNA, 18 nt, Yersinia pestis KIM
auucucaauggcuuuuuu

SEQ ID NO: 4180819 - RNA, 21 nt, Yersinia pestis KIM
auucucauugcccccuucaau

SEQ ID NO: 4180820 - RNA, 13 nt, Yersinia pestis KIM
auucucccauuua

SEQ ID NO: 4180821 - RNA, 14 nt, Yersinia pestis KIM
auucucccauuuau

SEQ ID NO: 4180822 - RNA, 19 nt, Yersinia pestis KIM
auucucccgauacccauuu

SEQ ID NO: 4180823 - RNA, 18 nt, Yersinia pestis KIM
auucucgccccgugcuac

SEQ ID NO: 4180824 - RNA, 22 nt, Yersinia pestis KIM
auucucuauucugcuuuuugcu

SEQ ID NO: 4180825 - RNA, 17 nt, Yersinia pestis KIM
auucugaaucgcugcca

SEQ ID NO: 4180826 - RNA, 22 nt, Yersinia pestis KIM
auucugacggcacucuauuuuc

SEQ ID NO: 4180827 - RNA, 23 nt, Yersinia pestis KIM
auucugagcaccacaauaccauu

SEQ ID NO: 4180828 - RNA, 12 nt, Yersinia pestis KIM
auugguuaaguu

SEQ ID NO: 4180829 - RNA, 19 nt, Yersinia pestis KIM
auugguucacugaaccaaa

SEQ ID NO: 4180830 - RNA, 18 nt, Yersinia pestis KIM
auugguuuuaauaaccau

SEQ ID NO: 4180831 - RNA, 22 nt, Yersinia pestis KIM
auugucacccacuaauggguua

SEQ ID NO: 4180832 - RNA, 19 nt, Yersinia pestis KIM
auuguccugcaauccuccc

SEQ ID NO: 4180833 - RNA, 17 nt, Yersinia pestis KIM
auugucuuuaauaaaau

SEQ ID NO: 4180834 - RNA, 14 nt, Yersinia pestis KIM
auugugcuccagca

SEQ ID NO: 4180835 - RNA, 20 nt, Yersinia pestis KIM
auuguggggccuuuauucau

SEQ ID NO: 4180836 - RNA, 14 nt, Yersinia pestis KIM
auugugucaauacc

SEQ ID NO: 4180837 - RNA, 21 nt, Yersinia pestis KIM
auuguuaccuaaccaaacauu

SEQ ID NO: 4180838 - RNA, 23 nt, Yersinia pestis KIM
auuguuaccuaaccaaacauugu

SEQ ID NO: 4180839 - RNA, 16 nt, Yersinia pestis KIM
auuguucuuacuguuu

SEQ ID NO: 4180840 - RNA, 13 nt, Yersinia pestis KIM
auuguuuaaagcu

SEQ ID NO: 4180841 - RNA, 18 nt, Yersinia pestis KIM
auuguuugcuaucaauug

SEQ ID NO: 4180842 - RNA, 12 nt, Yersinia pestis KIM
auuguuugcuuu

SEQ ID NO: 4180843 - RNA, 16 nt, Yersinia pestis KIM
auuguuuugacuaaaa

SEQ ID NO: 4180844 - RNA, 15 nt, Yersinia pestis KIM
auuuaaaaggcgcug

SEQ ID NO: 4180845 - RNA, 12 nt, Yersinia pestis KIM
auuuaaaauacu

SEQ ID NO: 4180846 - RNA, 14 nt, Yersinia pestis KIM
auuuaaacacucaa

SEQ ID NO: 4180847 - RNA, 11 nt, Yersinia pestis KIM
auuuaaacucu

SEQ ID NO: 4180848 - RNA, 16 nt, Yersinia pestis KIM
auuuaaauaacagcua

SEQ ID NO: 4180849 - RNA, 17 nt, Yersinia pestis KIM
auuuaaauagucaccuu

SEQ ID NO: 4180850 - RNA, 21 nt, Yersinia pestis KIM
auuuaacgccaccaaugcauc

SEQ ID NO: 4180851 - RNA, 19 nt, Yersinia pestis KIM
auuuaacuuuaaauccauc

SEQ ID NO: 4180852 - RNA, 12 nt, Yersinia pestis KIM
auuuaagaaauc

SEQ ID NO: 4180853 - RNA, 19 nt, Yersinia pestis KIM
auuuaagccaauaauauaa

SEQ ID NO: 4180854 - RNA, 18 nt, Yersinia pestis KIM
auuuaagcugaaauuuuu

SEQ ID NO: 4180855 - RNA, 19 nt, Yersinia pestis KIM
auuuaagcugaaauuuuuu

SEQ ID NO: 4180856 - RNA, 14 nt, Yersinia pestis KIM
auuuaauaacuuaa

SEQ ID NO: 4180857 - RNA, 14 nt, Yersinia pestis KIM
auuuaauguucauu

SEQ ID NO: 4180858 - RNA, 22 nt, Yersinia pestis KIM
auuuaauugagaauuauaacua

SEQ ID NO: 4180859 - RNA, 13 nt, Yersinia pestis KIM
auuuacaaauaac

SEQ ID NO: 4180860 - RNA, 23 nt, Yersinia pestis KIM
auuuacaaauaaccgccaaaaua

SEQ ID NO: 4180861 - RNA, 17 nt, Yersinia pestis KIM
auuuacaagccaacauu

SEQ ID NO: 4180862 - RNA, 17 nt, Yersinia pestis KIM
auuuaccgucuuuuugg

SEQ ID NO: 4180863 - RNA, 18 nt, Yersinia pestis KIM
auuuaccugcucaacugc

SEQ ID NO: 4180864 - RNA, 19 nt, Yersinia pestis KIM
auuuaccugcucaacugcu

SEQ ID NO: 4180865 - RNA, 18 nt, Yersinia pestis KIM
auuuaccuguuugcaaca

SEQ ID NO: 4180866 - RNA, 18 nt, Yersinia pestis KIM
auuuacguuuuuugcggu

SEQ ID NO: 4180867 - RNA, 17 nt, Yersinia pestis KIM
auuuacucguuuugcua

SEQ ID NO: 4180868 - RNA, 13 nt, Yersinia pestis KIM
auuuacucucuuu

SEQ ID NO: 4180869 - RNA, 15 nt, Yersinia pestis KIM
auuuacucucuuuga

SEQ ID NO: 4180870 - RNA, 20 nt, Yersinia pestis KIM
auuuacugguaccaaauaac

SEQ ID NO: 4180871 - RNA, 21 nt, Yersinia pestis KIM
auuuacugguaccaaauaaca

SEQ ID NO: 4180872 - RNA, 17 nt, Yersinia pestis KIM
auuuagacagcuuaaaa

SEQ ID NO: 4180873 - RNA, 13 nt, Yersinia pestis KIM
auuuagacucugc

SEQ ID NO: 4180874 - RNA, 22 nt, Yersinia pestis KIM
auuuagcaaagcgauaucguua

SEQ ID NO: 4180875 - RNA, 12 nt, Yersinia pestis KIM
auuuagccgcaa

SEQ ID NO: 4180876 - RNA, 20 nt, Yersinia pestis KIM
auuuagcgugacacugucac

SEQ ID NO: 4180877 - RNA, 17 nt, Yersinia pestis KIM
auuuagcuggcugaacg

SEQ ID NO: 4180878 - RNA, 22 nt, Yersinia pestis KIM
auuuaggauuagccgcuuucau

SEQ ID NO: 4180879 - RNA, 14 nt, Yersinia pestis KIM
auuuaggcgcugag

SEQ ID NO: 4180880 - RNA, 17 nt, Yersinia pestis KIM
auuuaguaucauuguga

SEQ ID NO: 4180881 - RNA, 15 nt, Yersinia pestis KIM
auuuauaaaaccacu

SEQ ID NO: 4180882 - RNA, 16 nt, Yersinia pestis KIM
auuuauaaaaccacug

SEQ ID NO: 4180883 - RNA, 22 nt, Yersinia pestis KIM
auuuauaaaaccacugaccuau

SEQ ID NO: 4180884 - RNA, 14 nt, Yersinia pestis KIM
auuuauaaacaauc

SEQ ID NO: 4180885 - RNA, 19 nt, Yersinia pestis KIM
auuuauagguauacaccuc

SEQ ID NO: 4180886 - RNA, 22 nt, Yersinia pestis KIM
auuuauauucauauuucacugu

SEQ ID NO: 4180887 - RNA, 22 nt, Yersinia pestis KIM
auuuauccacuaauucaucucc

SEQ ID NO: 4180888 - RNA, 15 nt, Yersinia pestis KIM
auuuauccuauuuuu

SEQ ID NO: 4180889 - RNA, 19 nt, Yersinia pestis KIM
auuuaucgccaagccagua

SEQ ID NO: 4180890 - RNA, 20 nt, Yersinia pestis KIM
auuuaucgccaagccaguaa

SEQ ID NO: 4180891 - RNA, 13 nt, Yersinia pestis KIM
auuuaugaacacu

SEQ ID NO: 4180892 - RNA, 22 nt, Yersinia pestis KIM
auuuaugccagacccgcuaauu

SEQ ID NO: 4180893 - RNA, 13 nt, Yersinia pestis KIM
auuuauuccucuc

SEQ ID NO: 4180894 - RNA, 23 nt, Yersinia pestis KIM
auuuauuccucucugaaucacua

SEQ ID NO: 4180895 - RNA, 21 nt, Yersinia pestis KIM
auuuauugcggcuuagccacu

SEQ ID NO: 4180896 - RNA, 17 nt, Yersinia pestis KIM
auuuauuuauaaaacca

SEQ ID NO: 4180897 - RNA, 18 nt, Yersinia pestis KIM
auuuauuuauaaaaccac

SEQ ID NO: 4180898 - RNA, 17 nt, Yersinia pestis KIM
auuuauuuauccuauuu

SEQ ID NO: 4180899 - RNA, 20 nt, Yersinia pestis KIM
auuuauuuguagugacguaa

SEQ ID NO: 4180900 - RNA, 19 nt, Yersinia pestis KIM
auuuauuuuguaaccgcgg

SEQ ID NO: 4180901 - RNA, 22 nt, Yersinia pestis KIM
auuucaacgcaccauccagcaa

SEQ ID NO: 4180902 - RNA, 17 nt, Yersinia pestis KIM
auuucaagcaauucaga

SEQ ID NO: 4180903 - RNA, 20 nt, Yersinia pestis KIM
auuucaauauaugaaugagu

SEQ ID NO: 4180904 - RNA, 21 nt, Yersinia pestis KIM
auuucaauauaugaaugaguu

SEQ ID NO: 4180905 - RNA, 23 nt, Yersinia pestis KIM
auuucaauccgaccacugacaaa

SEQ ID NO: 4180906 - RNA, 20 nt, Yersinia pestis KIM
auuucaaugccggucaauug

SEQ ID NO: 4180907 - RNA, 19 nt, Yersinia pestis KIM
auuucaauucucccauuua

SEQ ID NO: 4180908 - RNA, 14 nt, Yersinia pestis KIM
auuucacacuguuu

SEQ ID NO: 4180909 - RNA, 19 nt, Yersinia pestis KIM
auuucaccgguaaucuggu

SEQ ID NO: 4180910 - RNA, 20 nt, Yersinia pestis KIM
auuucaccuauaauuaacag

SEQ ID NO: 4180911 - RNA, 17 nt, Yersinia pestis KIM
auuucacgcuaauuauu

SEQ ID NO: 4180912 - RNA, 21 nt, Yersinia pestis KIM
auuucacgcugguuaagcauu

SEQ ID NO: 4180913 - RNA, 19 nt, Yersinia pestis KIM
auuucacggauaucaacau

SEQ ID NO: 4180914 - RNA, 13 nt, Yersinia pestis KIM
auuucacguucau

SEQ ID NO: 4180915 - RNA, 19 nt, Yersinia pestis KIM
auuucacguucaucaauac

SEQ ID NO: 4180916 - RNA, 13 nt, Yersinia pestis KIM
auuucacuggaaa

SEQ ID NO: 4180917 - RNA, 17 nt, Yersinia pestis KIM
auuucacuggcaccgcu

SEQ ID NO: 4180918 - RNA, 15 nt, Yersinia pestis KIM
auuucacuguuauau

SEQ ID NO: 4180919 - RNA, 14 nt, Yersinia pestis KIM
auuucagacauaca

SEQ ID NO: 4180920 - RNA, 18 nt, Yersinia pestis KIM
auuucagacugcugacaa

SEQ ID NO: 4180921 - RNA, 13 nt, Yersinia pestis KIM
auuucagcagcac

SEQ ID NO: 4180922 - RNA, 14 nt, Yersinia pestis KIM
auuucagccaggcg

SEQ ID NO: 4180923 - RNA, 12 nt, Yersinia pestis KIM
auuucagcugcu

SEQ ID NO: 4180924 - RNA, 19 nt, Yersinia pestis KIM
auuucagcugcuuuaucgu

SEQ ID NO: 4180925 - RNA, 15 nt, Yersinia pestis KIM
auuucagcuuuuagg

SEQ ID NO: 4180926 - RNA, 22 nt, Yersinia pestis KIM
auuucagggcguauaaacagag

SEQ ID NO: 4180927 - RNA, 17 nt, Yersinia pestis KIM
auuucaguaaucguuua

SEQ ID NO: 4180928 - RNA, 17 nt, Yersinia pestis KIM
auuucaguagcaaauaa

SEQ ID NO: 4180929 - RNA, 23 nt, Yersinia pestis KIM
auuucaguuuuuaggucaauauc

SEQ ID NO: 4180930 - RNA, 14 nt, Yersinia pestis KIM
auuucauaccgcug

SEQ ID NO: 4180931 - RNA, 18 nt, Yersinia pestis KIM
auuucaucggcaaaaaca

SEQ ID NO: 4180932 - RNA, 14 nt, Yersinia pestis KIM
auuucaucuugauu

SEQ ID NO: 4180933 - RNA, 20 nt, Yersinia pestis KIM
auuucaugauucucuauucu

SEQ ID NO: 4180934 - RNA, 20 nt, Yersinia pestis KIM
auuucauuuuaaaaucguau

SEQ ID NO: 4180935 - RNA, 15 nt, Yersinia pestis KIM
auuuccauaucaacc

SEQ ID NO: 4180936 - RNA, 18 nt, Yersinia pestis KIM
auuuccaucuagcucaag

SEQ ID NO: 4180937 - RNA, 16 nt, Yersinia pestis KIM
auuuccguuaacccaa

SEQ ID NO: 4180938 - RNA, 21 nt, Yersinia pestis KIM
auuuccuuguggauccagcac

SEQ ID NO: 4180939 - RNA, 22 nt, Yersinia pestis KIM
auuuccuuguggauccagcacc

SEQ ID NO: 4180940 - RNA, 21 nt, Yersinia pestis KIM
auuuccuuucgcacuuuaaau

SEQ ID NO: 4180941 - RNA, 23 nt, Yersinia pestis KIM
auuuccuuucgcacuuuaaauac

SEQ ID NO: 4180942 - RNA, 14 nt, Yersinia pestis KIM
caaaaccgugacua

SEQ ID NO: 4180943 - RNA, 18 nt, Yersinia pestis KIM
caaaaccuuuaaucagau

SEQ ID NO: 4180944 - RNA, 14 nt, Yersinia pestis KIM
caaaacgacgggcu

SEQ ID NO: 4180945 - RNA, 19 nt, Yersinia pestis KIM
caaaacgaguaaauagcaa

SEQ ID NO: 4180946 - RNA, 22 nt, Yersinia pestis KIM
caaaacggcaauuaagcaaaaa

SEQ ID NO: 4180947 - RNA, 19 nt, Yersinia pestis KIM
caaaacguauaaaagcauc

SEQ ID NO: 4180948 - RNA, 16 nt, Yersinia pestis KIM
caaaacguugaggcac

SEQ ID NO: 4180949 - RNA, 19 nt, Yersinia pestis KIM
caaaacucaggugaguaaa

SEQ ID NO: 4180950 - RNA, 13 nt, Yersinia pestis KIM
caaaacugaagca

SEQ ID NO: 4180951 - RNA, 15 nt, Yersinia pestis KIM
caaaacugaagcaag

SEQ ID NO: 4180952 - RNA, 16 nt, Yersinia pestis KIM
caaaagaaaaucagga

SEQ ID NO: 4180953 - RNA, 16 nt, Yersinia pestis KIM
caaaagaaacugccag

SEQ ID NO: 4180954 - RNA, 20 nt, Yersinia pestis KIM
caaaagaaacugucagucaa

SEQ ID NO: 4180955 - RNA, 14 nt, Yersinia pestis KIM
caaaagcaucacca

SEQ ID NO: 4180956 - RNA, 16 nt, Yersinia pestis KIM
caaaagcaucaccaaa

SEQ ID NO: 4180957 - RNA, 17 nt, Yersinia pestis KIM
caaaagcaucaccaaag

SEQ ID NO: 4180958 - RNA, 20 nt, Yersinia pestis KIM
caaaagcaucaccaaagaua

SEQ ID NO: 4180959 - RNA, 23 nt, Yersinia pestis KIM
caaaagcauccaauaccaccaau

SEQ ID NO: 4180960 - RNA, 20 nt, Yersinia pestis KIM
caaaagccucuugcgcucca

SEQ ID NO: 4180961 - RNA, 18 nt, Yersinia pestis KIM
caaaaggauggcccaagc

SEQ ID NO: 4180962 - RNA, 12 nt, Yersinia pestis KIM
caaaauaaaaau

SEQ ID NO: 4180963 - RNA, 23 nt, Yersinia pestis KIM
caaaauaauguuugcgacaggcg

SEQ ID NO: 4180964 - RNA, 20 nt, Yersinia pestis KIM
caaaauacggccagucaaaa

SEQ ID NO: 4180965 - RNA, 22 nt, Yersinia pestis KIM
caaaauacggccagucaaaaga

SEQ ID NO: 4180966 - RNA, 16 nt, Yersinia pestis KIM
caaaauacuuaacaau

SEQ ID NO: 4180967 - RNA, 15 nt, Yersinia pestis KIM
caaaauagaaaacag

SEQ ID NO: 4180968 - RNA, 19 nt, Yersinia pestis KIM
caaaauagaaaacagcaau

SEQ ID NO: 4180969 - RNA, 23 nt, Yersinia pestis KIM
caaaauagaggaaauaaaugacu

SEQ ID NO: 4180970 - RNA, 17 nt, Yersinia pestis KIM
caaaauagggaaggugu

SEQ ID NO: 4180971 - RNA, 19 nt, Yersinia pestis KIM
caaaauagggaagguguuu

SEQ ID NO: 4180972 - RNA, 23 nt, Yersinia pestis KIM
caaaauagggccguuuaccuugu

SEQ ID NO: 4180973 - RNA, 20 nt, Yersinia pestis KIM
caaaauaugauaguguaaaa

SEQ ID NO: 4180974 - RNA, 13 nt, Yersinia pestis KIM
caaaaucaccggu

SEQ ID NO: 4180975 - RNA, 15 nt, Yersinia pestis KIM
caaaaucaccuggcc

SEQ ID NO: 4180976 - RNA, 18 nt, Yersinia pestis KIM
caaaaucccaaaauauga

SEQ ID NO: 4180977 - RNA, 16 nt, Yersinia pestis KIM
caaaauccgugcuggu

SEQ ID NO: 4180978 - RNA, 19 nt, Yersinia pestis KIM
caaaaucgcgaccagcaga

SEQ ID NO: 4180979 - RNA, 21 nt, Yersinia pestis KIM
caaaaucgcgaccagcagaau

SEQ ID NO: 4180980 - RNA, 14 nt, Yersinia pestis KIM
caaaaucguuaccg

SEQ ID NO: 4180981 - RNA, 14 nt, Yersinia pestis KIM
caaaaugagccugu

SEQ ID NO: 4180982 - RNA, 16 nt, Yersinia pestis KIM
caaaaugaucaucagc

SEQ ID NO: 4180983 - RNA, 15 nt, Yersinia pestis KIM
caaaaugcguaaaaa

SEQ ID NO: 4180984 - RNA, 16 nt, Yersinia pestis KIM
caaaaugcguaaaaac

SEQ ID NO: 4180985 - RNA, 23 nt, Yersinia pestis KIM
caaaauuaugccagucuuccaug

SEQ ID NO: 4180986 - RNA, 22 nt, Yersinia pestis KIM
caaaauugagauaacgcugaug

SEQ ID NO: 4180987 - RNA, 12 nt, Yersinia pestis KIM
caaacacguucg

SEQ ID NO: 4180988 - RNA, 23 nt, Yersinia pestis KIM
caaacacuuaugaucuugaauaa

SEQ ID NO: 4180989 - RNA, 17 nt, Yersinia pestis KIM
caaacagaccccagaag

SEQ ID NO: 4180990 - RNA, 14 nt, Yersinia pestis KIM
caaacagauacauc

SEQ ID NO: 4180991 - RNA, 18 nt, Yersinia pestis KIM
caaacagcuucgccacca

SEQ ID NO: 4180992 - RNA, 16 nt, Yersinia pestis KIM
caaacaguaacccagc

SEQ ID NO: 4180993 - RNA, 19 nt, Yersinia pestis KIM
caaacaguucauaucgaua

SEQ ID NO: 4180994 - RNA, 12 nt, Yersinia pestis KIM
caaacauaaccu

SEQ ID NO: 4180995 - RNA, 21 nt, Yersinia pestis KIM
caaacaucggauaauguuaau

SEQ ID NO: 4180996 - RNA, 22 nt, Yersinia pestis KIM
caaacaugagcgcaugcccggu

SEQ ID NO: 4180997 - RNA, 17 nt, Yersinia pestis KIM
caaacauugucaccuga

SEQ ID NO: 4180998 - RNA, 17 nt, Yersinia pestis KIM
caaacauuuucaucuga

SEQ ID NO: 4180999 - RNA, 15 nt, Yersinia pestis KIM
caaaccagcccuguu

SEQ ID NO: 4181000 - RNA, 16 nt, Yersinia pestis KIM
caaaccccgauaacgc

SEQ ID NO: 4181001 - RNA, 18 nt, Yersinia pestis KIM
caaaccccgaugacgcga

SEQ ID NO: 4181002 - RNA, 17 nt, Yersinia pestis KIM
caaaccccgaugacuca

SEQ ID NO: 4181003 - RNA, 18 nt, Yersinia pestis KIM
caaaccccgccucuucua

SEQ ID NO: 4181004 - RNA, 20 nt, Yersinia pestis KIM
caaaccccgccucuucuaau

SEQ ID NO: 4181005 - RNA, 16 nt, Yersinia pestis KIM
caaacccuaauaccaa

SEQ ID NO: 4181006 - RNA, 14 nt, Yersinia pestis KIM
caaaccgaauacca

SEQ ID NO: 4181007 - RNA, 22 nt, Yersinia pestis KIM
caaacgccucguuuaacucaaa

SEQ ID NO: 4181008 - RNA, 22 nt, Yersinia pestis KIM
caaacgcguuaauuaagacccu

SEQ ID NO: 4181009 - RNA, 20 nt, Yersinia pestis KIM
caaacgcugggcgauaaagu

SEQ ID NO: 4181010 - RNA, 23 nt, Yersinia pestis KIM
caaacggcgcgucgccauaacca

SEQ ID NO: 4181011 - RNA, 17 nt, Yersinia pestis KIM
caaacgggugcgccaau

SEQ ID NO: 4181012 - RNA, 21 nt, Yersinia pestis KIM
caaacggucuguuaauccuaa

SEQ ID NO: 4181013 - RNA, 16 nt, Yersinia pestis KIM
caaacggugugcaaug

SEQ ID NO: 4181014 - RNA, 15 nt, Yersinia pestis KIM
caaacguauugguaa

SEQ ID NO: 4181015 - RNA, 24 nt, Yersinia pestis KIM
caaacgugaugugcccuuguuuau

SEQ ID NO: 4181016 - RNA, 17 nt, Yersinia pestis KIM
caaacgugcuacuuaau

SEQ ID NO: 4181017 - RNA, 12 nt, Yersinia pestis KIM
caaacucagcca

SEQ ID NO: 4181018 - RNA, 14 nt, Yersinia pestis KIM
caaacucagcgaau

SEQ ID NO: 4181019 - RNA, 18 nt, Yersinia pestis KIM
caaacuggccauguugug

SEQ ID NO: 4181020 - RNA, 22 nt, Yersinia pestis KIM
caaacuguuuuuuaaagaaaaa

SEQ ID NO: 4181021 - RNA, 15 nt, Yersinia pestis KIM
caaacuuuguggaua

SEQ ID NO: 4181022 - RNA, 21 nt, Yersinia pestis KIM
caaagaauugagguaaaccaa

SEQ ID NO: 4181023 - RNA, 22 nt, Yersinia pestis KIM
caaagaauugagguaaaccaag

SEQ ID NO: 4181024 - RNA, 23 nt, Yersinia pestis KIM
caaagaauugagguaaaccaagu

SEQ ID NO: 4181025 - RNA, 15 nt, Yersinia pestis KIM
caaagacauacccca

SEQ ID NO: 4181026 - RNA, 20 nt, Yersinia pestis KIM
caaagaccacaucaaccuga

SEQ ID NO: 4181027 - RNA, 24 nt, Yersinia pestis KIM
caaagacuaaccucugcaaugccc

SEQ ID NO: 4181028 - RNA, 22 nt, Yersinia pestis KIM
caaagagaacgggcaaccugua

SEQ ID NO: 4181029 - RNA, 19 nt, Yersinia pestis KIM
caaagagucgcaaaacuuc

SEQ ID NO: 4181030 - RNA, 16 nt, Yersinia pestis KIM
caaagauacagugcgc

SEQ ID NO: 4181031 - RNA, 23 nt, Yersinia pestis KIM
caaagauuucaucggcaaaaaca

SEQ ID NO: 4181032 - RNA, 20 nt, Yersinia pestis KIM
caaagcccggaaacguccag

SEQ ID NO: 4181033 - RNA, 16 nt, Yersinia pestis KIM
caaagccgcugcucac

SEQ ID NO: 4181034 - RNA, 16 nt, Yersinia pestis KIM
caaagccuacgagaga

SEQ ID NO: 4181035 - RNA, 22 nt, Yersinia pestis KIM
caaagccuacgagagaucguag

SEQ ID NO: 4181036 - RNA, 21 nt, Yersinia pestis KIM
caaagccucuaccaaugcccc

SEQ ID NO: 4181037 - RNA, 21 nt, Yersinia pestis KIM
caaagccugccauacccgcug

SEQ ID NO: 4181038 - RNA, 15 nt, Yersinia pestis KIM
caaagcgcucagcgc

SEQ ID NO: 4181039 - RNA, 19 nt, Yersinia pestis KIM
caaagcguacucuucugua

SEQ ID NO: 4181040 - RNA, 11 nt, Yersinia pestis KIM
caaagcuucca

SEQ ID NO: 4181041 - RNA, 16 nt, Yersinia pestis KIM
caaaggaagccgagcu

SEQ ID NO: 4181042 - RNA, 21 nt, Yersinia pestis KIM
caaaggagacuucgccaaucu

SEQ ID NO: 4181043 - RNA, 19 nt, Yersinia pestis KIM
caaaggcccgcuaucacua

SEQ ID NO: 4181044 - RNA, 14 nt, Yersinia pestis KIM
caaaguaaucaggc

SEQ ID NO: 4181045 - RNA, 13 nt, Yersinia pestis KIM
caaaguaguacga

SEQ ID NO: 4181046 - RNA, 22 nt, Yersinia pestis KIM
caaagugcccgcgacggagaga

SEQ ID NO: 4181047 - RNA, 15 nt, Yersinia pestis KIM
caaaguuaaaugaag

SEQ ID NO: 4181048 - RNA, 20 nt, Yersinia pestis KIM
caaaguuuguguagcccacu

SEQ ID NO: 4181049 - RNA, 16 nt, Yersinia pestis KIM
caaauaaaaccaagaa

SEQ ID NO: 4181050 - RNA, 13 nt, Yersinia pestis KIM
caaauaaacaaaa

SEQ ID NO: 4181051 - RNA, 19 nt, Yersinia pestis KIM
caaauaaggcguuuaauuc

SEQ ID NO: 4181052 - RNA, 18 nt, Yersinia pestis KIM
caaauaaguacuuccaau

SEQ ID NO: 4181053 - RNA, 23 nt, Yersinia pestis KIM
caaauaaguacuuccaauaagug

SEQ ID NO: 4181054 - RNA, 18 nt, Yersinia pestis KIM
caaauaaguguuucaaau

SEQ ID NO: 4181055 - RNA, 21 nt, Yersinia pestis KIM
caaauaaucagcucauuaaac

SEQ ID NO: 4181056 - RNA, 19 nt, Yersinia pestis KIM
caaccccuucaagcaccca

SEQ ID NO: 4181057 - RNA, 21 nt, Yersinia pestis KIM
caacccgcccaagcccucuuc

SEQ ID NO: 4181058 - RNA, 14 nt, Yersinia pestis KIM
caacccgcugaugc

SEQ ID NO: 4181059 - RNA, 18 nt, Yersinia pestis KIM
caacccggcuguuaaauu

SEQ ID NO: 4181060 - RNA, 19 nt, Yersinia pestis KIM
caaccgcuugcauacgcuu

SEQ ID NO: 4181061 - RNA, 16 nt, Yersinia pestis KIM
caaccggcgcuccagu

SEQ ID NO: 4181062 - RNA, 17 nt, Yersinia pestis KIM
caaccguagucgcacca

SEQ ID NO: 4181063 - RNA, 23 nt, Yersinia pestis KIM
caaccguuguguaucagcaacuu

SEQ ID NO: 4181064 - RNA, 13 nt, Yersinia pestis KIM
caaccuaaaaaaa

SEQ ID NO: 4181065 - RNA, 15 nt, Yersinia pestis KIM
caaccuauauagccc

SEQ ID NO: 4181066 - RNA, 14 nt, Yersinia pestis KIM
caaccucagccuca

SEQ ID NO: 4181067 - RNA, 18 nt, Yersinia pestis KIM
caaccucagccucauuca

SEQ ID NO: 4181068 - RNA, 15 nt, Yersinia pestis KIM
caaccugcaaugccu

SEQ ID NO: 4181069 - RNA, 22 nt, Yersinia pestis KIM
caaccugcaaugccuaaagcca

SEQ ID NO: 4181070 - RNA, 16 nt, Yersinia pestis KIM
caaccugcgccaccca

SEQ ID NO: 4181071 - RNA, 23 nt, Yersinia pestis KIM
caaccuggaauggcgcaauagca

SEQ ID NO: 4181072 - RNA, 18 nt, Yersinia pestis KIM
caaccuguagcucauacu

SEQ ID NO: 4181073 - RNA, 19 nt, Yersinia pestis KIM
caaccuguagcucauacuc

SEQ ID NO: 4181074 - RNA, 22 nt, Yersinia pestis KIM
caaccuugggggaccagcacau

SEQ ID NO: 4181075 - RNA, 20 nt, Yersinia pestis KIM
caaccuuuuccgccaugaga

SEQ ID NO: 4181076 - RNA, 19 nt, Yersinia pestis KIM
caacgaaacgcauaagaau

SEQ ID NO: 4181077 - RNA, 12 nt, Yersinia pestis KIM
caacgaaaucac

SEQ ID NO: 4181078 - RNA, 17 nt, Yersinia pestis KIM
caacgaaggcaacaaca

SEQ ID NO: 4181079 - RNA, 17 nt, Yersinia pestis KIM
caacgaauaaaaaagcc

SEQ ID NO: 4181080 - RNA, 17 nt, Yersinia pestis KIM
caacgacagcaacaaca

SEQ ID NO: 4181081 - RNA, 15 nt, Yersinia pestis KIM
caacgaccaguaagu

SEQ ID NO: 4181082 - RNA, 17 nt, Yersinia pestis KIM
caacgaccucaucaccc

SEQ ID NO: 4181083 - RNA, 14 nt, Yersinia pestis KIM
caacgcacaccccc

SEQ ID NO: 4181084 - RNA, 16 nt, Yersinia pestis KIM
caacgcacaugcaacu

SEQ ID NO: 4181085 - RNA, 17 nt, Yersinia pestis KIM
caacgcaccauccagca

SEQ ID NO: 4181086 - RNA, 23 nt, Yersinia pestis KIM
caacgcacgauccgcccauugcg

SEQ ID NO: 4181087 - RNA, 14 nt, Yersinia pestis KIM
caacgcacucagca

SEQ ID NO: 4181088 - RNA, 14 nt, Yersinia pestis KIM
caacgcacugaaga

SEQ ID NO: 4181089 - RNA, 21 nt, Yersinia pestis KIM
caacgcaggcacugcagaaaa

SEQ ID NO: 4181090 - RNA, 23 nt, Yersinia pestis KIM
caacgcauuaccccguugcucua

SEQ ID NO: 4181091 - RNA, 18 nt, Yersinia pestis KIM
caacgcauuguuuaaagc

SEQ ID NO: 4181092 - RNA, 22 nt, Yersinia pestis KIM
caacgccaaaauaaccaacacc

SEQ ID NO: 4181093 - RNA, 22 nt, Yersinia pestis KIM
caacgcccgcggccaauagcaa

SEQ ID NO: 4181094 - RNA, 17 nt, Yersinia pestis KIM
caacgcccugcaucuug

SEQ ID NO: 4181095 - RNA, 16 nt, Yersinia pestis KIM
caacgccucaucuuca

SEQ ID NO: 4181096 - RNA, 18 nt, Yersinia pestis KIM
caacgcgcagugccguca

SEQ ID NO: 4181097 - RNA, 21 nt, Yersinia pestis KIM
caacgcguacgggacggguug

SEQ ID NO: 4181098 - RNA, 20 nt, Yersinia pestis KIM
caacgcucaauggcgggggc

SEQ ID NO: 4181099 - RNA, 23 nt, Yersinia pestis KIM
caacgcuccgguuuucaccccca

SEQ ID NO: 4181100 - RNA, 18 nt, Yersinia pestis KIM
caacgcucuaacgucaga

SEQ ID NO: 4181101 - RNA, 22 nt, Yersinia pestis KIM
caacgcuguuggguugugguau

SEQ ID NO: 4181102 - RNA, 14 nt, Yersinia pestis KIM
caacggacacauaa

SEQ ID NO: 4181103 - RNA, 18 nt, Yersinia pestis KIM
caacggacacauaagugu

SEQ ID NO: 4181104 - RNA, 15 nt, Yersinia pestis KIM
caacggcacauccca

SEQ ID NO: 4181105 - RNA, 19 nt, Yersinia pestis KIM
caacgguagguucaaccca

SEQ ID NO: 4181106 - RNA, 22 nt, Yersinia pestis KIM
caacguaacaugcagcccgacc

SEQ ID NO: 4181107 - RNA, 24 nt, Yersinia pestis KIM
caacguaauaucugccaccgcaca

SEQ ID NO: 4181108 - RNA, 20 nt, Yersinia pestis KIM
caacgucaucgccacacgca

SEQ ID NO: 4181109 - RNA, 15 nt, Yersinia pestis KIM
caacguuaaagauga

SEQ ID NO: 4181110 - RNA, 15 nt, Yersinia pestis KIM
caacguuuuaccugc

SEQ ID NO: 4181111 - RNA, 20 nt, Yersinia pestis KIM
caacuaaacagggcagaaaa

SEQ ID NO: 4181112 - RNA, 22 nt, Yersinia pestis KIM
caacuaaacagggcagaaaaua

SEQ ID NO: 4181113 - RNA, 16 nt, Yersinia pestis KIM
caacuaagcugccuca

SEQ ID NO: 4181114 - RNA, 18 nt, Yersinia pestis KIM
caacuauugcaucuuuaa

SEQ ID NO: 4181115 - RNA, 17 nt, Yersinia pestis KIM
caacucagugaaaccau

SEQ ID NO: 4181116 - RNA, 23 nt, Yersinia pestis KIM
caacucaucggcguuacaguaag

SEQ ID NO: 4181117 - RNA, 20 nt, Yersinia pestis KIM
caacuccaucgccacuucua

SEQ ID NO: 4181118 - RNA, 22 nt, Yersinia pestis KIM
caacuccaucgccacuucuaac

SEQ ID NO: 4181119 - RNA, 18 nt, Yersinia pestis KIM
caacuccuuaccacugcu

SEQ ID NO: 4181120 - RNA, 21 nt, Yersinia pestis KIM
caacuccuuaccacugcucac

SEQ ID NO: 4181121 - RNA, 22 nt, Yersinia pestis KIM
caacuccuuaccacugcucacu

SEQ ID NO: 4181122 - RNA, 18 nt, Yersinia pestis KIM
caacucgagcauuugacc

SEQ ID NO: 4181123 - RNA, 22 nt, Yersinia pestis KIM
caacucguuaucuucauauaca

SEQ ID NO: 4181124 - RNA, 20 nt, Yersinia pestis KIM
caacucuagcgccagcaauu

SEQ ID NO: 4181125 - RNA, 16 nt, Yersinia pestis KIM
caacucuuccggugcg

SEQ ID NO: 4181126 - RNA, 20 nt, Yersinia pestis KIM
caacugacaacaucaaauga

SEQ ID NO: 4181127 - RNA, 15 nt, Yersinia pestis KIM
caacugacagcgguc

SEQ ID NO: 4181128 - RNA, 13 nt, Yersinia pestis KIM
caacugacugaag

SEQ ID NO: 4181129 - RNA, 15 nt, Yersinia pestis KIM
caacugacugaaguu

SEQ ID NO: 4181130 - RNA, 20 nt, Yersinia pestis KIM
caacugaggcaacauuuguu

SEQ ID NO: 4181131 - RNA, 19 nt, Yersinia pestis KIM
caacugauaauucaguguc

SEQ ID NO: 4181132 - RNA, 17 nt, Yersinia pestis KIM
caacugccaauauguua

SEQ ID NO: 4181133 - RNA, 20 nt, Yersinia pestis KIM
caacugccgccaugcuggau

SEQ ID NO: 4181134 - RNA, 21 nt, Yersinia pestis KIM
caacugccgccaugcuggaug

SEQ ID NO: 4181135 - RNA, 14 nt, Yersinia pestis KIM
caacugcucaucca

SEQ ID NO: 4181136 - RNA, 14 nt, Yersinia pestis KIM
caacuguaaaaucu

SEQ ID NO: 4181137 - RNA, 16 nt, Yersinia pestis KIM
caacuguuagcguggc

SEQ ID NO: 4181138 - RNA, 13 nt, Yersinia pestis KIM
caacuucacuuca

SEQ ID NO: 4181139 - RNA, 16 nt, Yersinia pestis KIM
caacuuccacacaaac

SEQ ID NO: 4181140 - RNA, 20 nt, Yersinia pestis KIM
caacuuccagugccaauuga

SEQ ID NO: 4181141 - RNA, 13 nt, Yersinia pestis KIM
caacuugcuggca

SEQ ID NO: 4181142 - RNA, 22 nt, Yersinia pestis KIM
caacuugugacgccggagaaau

SEQ ID NO: 4181143 - RNA, 23 nt, Yersinia pestis KIM
caacuuuaauaugcaaaaaaaga

SEQ ID NO: 4181144 - RNA, 16 nt, Yersinia pestis KIM
caacuuuggccaccgc

SEQ ID NO: 4181145 - RNA, 18 nt, Yersinia pestis KIM
caacuuuuauuggcauua

SEQ ID NO: 4181146 - RNA, 19 nt, Yersinia pestis KIM
caacuuuuuucauccuaaa

SEQ ID NO: 4181147 - RNA, 23 nt, Yersinia pestis KIM
caagaaacgccccgauaaaccaa

SEQ ID NO: 4181148 - RNA, 19 nt, Yersinia pestis KIM
caagaaagaaaaauagacu

SEQ ID NO: 4181149 - RNA, 18 nt, Yersinia pestis KIM
caagaaccgaaauaucau

SEQ ID NO: 4181150 - RNA, 22 nt, Yersinia pestis KIM
caagaagcgggcggccucugcu

SEQ ID NO: 4181151 - RNA, 23 nt, Yersinia pestis KIM
caagaaugucaugguuaaacuga

SEQ ID NO: 4181152 - RNA, 23 nt, Yersinia pestis KIM
caagacaacaaacaguaacccag

SEQ ID NO: 4181153 - RNA, 14 nt, Yersinia pestis KIM
caagacagaacuua

SEQ ID NO: 4181154 - RNA, 21 nt, Yersinia pestis KIM
caagacgauaucgacgccugu

SEQ ID NO: 4181155 - RNA, 16 nt, Yersinia pestis KIM
caagagaaaugcacuu

SEQ ID NO: 4181156 - RNA, 22 nt, Yersinia pestis KIM
caagagcgauaaccgcacugag

SEQ ID NO: 4181157 - RNA, 22 nt, Yersinia pestis KIM
caagaguacuaacgucaacaga

SEQ ID NO: 4181158 - RNA, 14 nt, Yersinia pestis KIM
caagagugagucau

SEQ ID NO: 4181159 - RNA, 18 nt, Yersinia pestis KIM
caagauaccgaguucuca

SEQ ID NO: 4181160 - RNA, 21 nt, Yersinia pestis KIM
caagauaccgaguucucacca

SEQ ID NO: 4181161 - RNA, 17 nt, Yersinia pestis KIM
caagaucacaugacuga

SEQ ID NO: 4181162 - RNA, 18 nt, Yersinia pestis KIM
caagaucccaagcaggaa

SEQ ID NO: 4181163 - RNA, 20 nt, Yersinia pestis KIM
caagaugccuauuugcagaa

SEQ ID NO: 4181164 - RNA, 23 nt, Yersinia pestis KIM
caagaugccuauuugcagaaagu

SEQ ID NO: 4181165 - RNA, 23 nt, Yersinia pestis KIM
caagauugaugacucgauaguga

SEQ ID NO: 4181166 - RNA, 23 nt, Yersinia pestis KIM
caagauugggaucaacgcccgcg

SEQ ID NO: 4181167 - RNA, 19 nt, Yersinia pestis KIM
caagcaaccgcaaugccgc

SEQ ID NO: 4181168 - RNA, 20 nt, Yersinia pestis KIM
caagcaaccuuguuuuaucg

SEQ ID NO: 4181169 - RNA, 20 nt, Yersinia pestis KIM
caauagagaauagaccugau

SEQ ID NO: 4181170 - RNA, 14 nt, Yersinia pestis KIM
caauagauaacuga

SEQ ID NO: 4181171 - RNA, 19 nt, Yersinia pestis KIM
caauagcauaaauaucagu

SEQ ID NO: 4181172 - RNA, 18 nt, Yersinia pestis KIM
caauagccaagaucacau

SEQ ID NO: 4181173 - RNA, 21 nt, Yersinia pestis KIM
caauagccaugucauggggga

SEQ ID NO: 4181174 - RNA, 20 nt, Yersinia pestis KIM
caauagcgccaagugucaaa

SEQ ID NO: 4181175 - RNA, 23 nt, Yersinia pestis KIM
caauagcuagccccaaucaagca

SEQ ID NO: 4181176 - RNA, 14 nt, Yersinia pestis KIM
caauaggucagugg

SEQ ID NO: 4181177 - RNA, 15 nt, Yersinia pestis KIM
caauaggucaguggu

SEQ ID NO: 4181178 - RNA, 13 nt, Yersinia pestis KIM
caauauaagagaa

SEQ ID NO: 4181179 - RNA, 18 nt, Yersinia pestis KIM
caauauaaggcuuuauau

SEQ ID NO: 4181180 - RNA, 20 nt, Yersinia pestis KIM
caauauaaggcuuuauauug

SEQ ID NO: 4181181 - RNA, 13 nt, Yersinia pestis KIM
caauauaauaacu

SEQ ID NO: 4181182 - RNA, 18 nt, Yersinia pestis KIM
caauauaauaaugcugcc

SEQ ID NO: 4181183 - RNA, 21 nt, Yersinia pestis KIM
caauauaggcgucaucagcau

SEQ ID NO: 4181184 - RNA, 13 nt, Yersinia pestis KIM
caauauccauauu

SEQ ID NO: 4181185 - RNA, 18 nt, Yersinia pestis KIM
caauauccauauuaaaug

SEQ ID NO: 4181186 - RNA, 19 nt, Yersinia pestis KIM
caauauccgugauuaaccu

SEQ ID NO: 4181187 - RNA, 16 nt, Yersinia pestis KIM
caauaucgauuuuuaa

SEQ ID NO: 4181188 - RNA, 24 nt, Yersinia pestis KIM
caauaucgauuuuuaagucaauuu

SEQ ID NO: 4181189 - RNA, 14 nt, Yersinia pestis KIM
caauaucuuugucu

SEQ ID NO: 4181190 - RNA, 15 nt, Yersinia pestis KIM
caauaucuuugucug

SEQ ID NO: 4181191 - RNA, 22 nt, Yersinia pestis KIM
caauaugaauacgaauuuuuuc

SEQ ID NO: 4181192 - RNA, 15 nt, Yersinia pestis KIM
caauaugcaguuuuc

SEQ ID NO: 4181193 - RNA, 21 nt, Yersinia pestis KIM
caauaugcaguuuuccucccu

SEQ ID NO: 4181194 - RNA, 16 nt, Yersinia pestis KIM
caauauggguauuagg

SEQ ID NO: 4181195 - RNA, 16 nt, Yersinia pestis KIM
caauauggguauugag

SEQ ID NO: 4181196 - RNA, 16 nt, Yersinia pestis KIM
caauauguugcacuga

SEQ ID NO: 4181197 - RNA, 14 nt, Yersinia pestis KIM
caauauuaaaauag

SEQ ID NO: 4181198 - RNA, 20 nt, Yersinia pestis KIM
caauauuccaaaaaauagcc

SEQ ID NO: 4181199 - RNA, 14 nt, Yersinia pestis KIM
caauauucgcagcc

SEQ ID NO: 4181200 - RNA, 15 nt, Yersinia pestis KIM
caauauucgcagcca

SEQ ID NO: 4181201 - RNA, 22 nt, Yersinia pestis KIM
caauauucgcagccaaaauaau

SEQ ID NO: 4181202 - RNA, 14 nt, Yersinia pestis KIM
caauauuggauaau

SEQ ID NO: 4181203 - RNA, 15 nt, Yersinia pestis KIM
caaucaaaaaauaaa

SEQ ID NO: 4181204 - RNA, 17 nt, Yersinia pestis KIM
caaucaaaaauugcccc

SEQ ID NO: 4181205 - RNA, 19 nt, Yersinia pestis KIM
caaucaauguauugcucca

SEQ ID NO: 4181206 - RNA, 16 nt, Yersinia pestis KIM
caaucacaaccccccc

SEQ ID NO: 4181207 - RNA, 14 nt, Yersinia pestis KIM
caaucaccaccucc

SEQ ID NO: 4181208 - RNA, 22 nt, Yersinia pestis KIM
caaucacccccuccaaacuggc

SEQ ID NO: 4181209 - RNA, 23 nt, Yersinia pestis KIM
caaucaccggcuggcauuuuuau

SEQ ID NO: 4181210 - RNA, 20 nt, Yersinia pestis KIM
caaucacgguuuaucccccu

SEQ ID NO: 4181211 - RNA, 10 nt, Yersinia pestis KIM
caaucacugc

SEQ ID NO: 4181212 - RNA, 11 nt, Yersinia pestis KIM
caaucacugcg

SEQ ID NO: 4181213 - RNA, 19 nt, Yersinia pestis KIM
caaucagaacuauacgcgg

SEQ ID NO: 4181214 - RNA, 19 nt, Yersinia pestis KIM
caaucagccgcaucacuga

SEQ ID NO: 4181215 - RNA, 12 nt, Yersinia pestis KIM
caaucaucaucc

SEQ ID NO: 4181216 - RNA, 23 nt, Yersinia pestis KIM
caaucaucaucccagucgucuuc

SEQ ID NO: 4181217 - RNA, 21 nt, Yersinia pestis KIM
caaucauguugcaucgcacug

SEQ ID NO: 4181218 - RNA, 19 nt, Yersinia pestis KIM
caaucauuacaucaucuuc

SEQ ID NO: 4181219 - RNA, 12 nt, Yersinia pestis KIM
caaucauucugu

SEQ ID NO: 4181220 - RNA, 19 nt, Yersinia pestis KIM
caaucauugagaucaguuc

SEQ ID NO: 4181221 - RNA, 20 nt, Yersinia pestis KIM
caaucauugagaucaguuca

SEQ ID NO: 4181222 - RNA, 13 nt, Yersinia pestis KIM
caauccaaaugac

SEQ ID NO: 4181223 - RNA, 14 nt, Yersinia pestis KIM
caauccgcugacau

SEQ ID NO: 4181224 - RNA, 15 nt, Yersinia pestis KIM
caaucgaugagcugg

SEQ ID NO: 4181225 - RNA, 16 nt, Yersinia pestis KIM
caaucgaugagcuggu

SEQ ID NO: 4181226 - RNA, 14 nt, Yersinia pestis KIM
caaucgauuccugu

SEQ ID NO: 4181227 - RNA, 22 nt, Yersinia pestis KIM
caaucgcucugcguuuuucccu

SEQ ID NO: 4181228 - RNA, 23 nt, Yersinia pestis KIM
caaucgcucugcguuuuucccug

SEQ ID NO: 4181229 - RNA, 17 nt, Yersinia pestis KIM
caaucgggaaaacaggc

SEQ ID NO: 4181230 - RNA, 22 nt, Yersinia pestis KIM
caaucuaaugacuacuaaucaa

SEQ ID NO: 4181231 - RNA, 15 nt, Yersinia pestis KIM
caaucuagaacuauu

SEQ ID NO: 4181232 - RNA, 14 nt, Yersinia pestis KIM
caaucucaucaauc

SEQ ID NO: 4181233 - RNA, 19 nt, Yersinia pestis KIM
caaucuccaaugaccccgc

SEQ ID NO: 4181234 - RNA, 16 nt, Yersinia pestis KIM
caaucuccaguaaauc

SEQ ID NO: 4181235 - RNA, 21 nt, Yersinia pestis KIM
caaucucugcaguacagauaa

SEQ ID NO: 4181236 - RNA, 22 nt, Yersinia pestis KIM
caaucucugggugcugcucccg

SEQ ID NO: 4181237 - RNA, 15 nt, Yersinia pestis KIM
caaucuucuucaguc

SEQ ID NO: 4181238 - RNA, 22 nt, Yersinia pestis KIM
caaucuugguuaauagcauuug

SEQ ID NO: 4181239 - RNA, 13 nt, Yersinia pestis KIM
caaugaaaauauc

SEQ ID NO: 4181240 - RNA, 24 nt, Yersinia pestis KIM
caaugaaaauauccgagguuauug

SEQ ID NO: 4181241 - RNA, 15 nt, Yersinia pestis KIM
caaugaaguaaggau

SEQ ID NO: 4181242 - RNA, 20 nt, Yersinia pestis KIM
caaugaccacuaaauuaaau

SEQ ID NO: 4181243 - RNA, 19 nt, Yersinia pestis KIM
caaugacuccugaaauaaa

SEQ ID NO: 4181244 - RNA, 20 nt, Yersinia pestis KIM
caaugacuccugaaauaaag

SEQ ID NO: 4181245 - RNA, 21 nt, Yersinia pestis KIM
caaugacuccugaaauaaaga

SEQ ID NO: 4181246 - RNA, 14 nt, Yersinia pestis KIM
caaugacugugcgc

SEQ ID NO: 4181247 - RNA, 13 nt, Yersinia pestis KIM
caaugacuuaacu

SEQ ID NO: 4181248 - RNA, 16 nt, Yersinia pestis KIM
caaugacuuaacugaa

SEQ ID NO: 4181249 - RNA, 19 nt, Yersinia pestis KIM
caaugacuuaacugaaagc

SEQ ID NO: 4181250 - RNA, 17 nt, Yersinia pestis KIM
caaugagaucgaacuga

SEQ ID NO: 4181251 - RNA, 22 nt, Yersinia pestis KIM
caaugagaucgaacugauaacu

SEQ ID NO: 4181252 - RNA, 18 nt, Yersinia pestis KIM
caaugagggaugaaaaga

SEQ ID NO: 4181253 - RNA, 20 nt, Yersinia pestis KIM
caaugagggaugaaaagagc

SEQ ID NO: 4181254 - RNA, 21 nt, Yersinia pestis KIM
caaugagggaugaaaagagcu

SEQ ID NO: 4181255 - RNA, 17 nt, Yersinia pestis KIM
caaugagugauauccgc

SEQ ID NO: 4181256 - RNA, 21 nt, Yersinia pestis KIM
caaugagugcagccaacgccc

SEQ ID NO: 4181257 - RNA, 16 nt, Yersinia pestis KIM
caaugauaaaauccug

SEQ ID NO: 4181258 - RNA, 19 nt, Yersinia pestis KIM
caaugaugacuugauuaac

SEQ ID NO: 4181259 - RNA, 18 nt, Yersinia pestis KIM
caaugauggcggcuaaau

SEQ ID NO: 4181260 - RNA, 23 nt, Yersinia pestis KIM
caaugaugucaucuuccgucagu

SEQ ID NO: 4181261 - RNA, 13 nt, Yersinia pestis KIM
caaugauuuuuuu

SEQ ID NO: 4181262 - RNA, 16 nt, Yersinia pestis KIM
caaugauuuuuuucau

SEQ ID NO: 4181263 - RNA, 21 nt, Yersinia pestis KIM
caaugccaagaauaauuacug

SEQ ID NO: 4181264 - RNA, 22 nt, Yersinia pestis KIM
caaugccgauccacggguauua

SEQ ID NO: 4181265 - RNA, 22 nt, Yersinia pestis KIM
caaugccgcgaaggugugcuca

SEQ ID NO: 4181266 - RNA, 15 nt, Yersinia pestis KIM
caaugccuaaagcca

SEQ ID NO: 4181267 - RNA, 15 nt, Yersinia pestis KIM
caaugccucuucaau

SEQ ID NO: 4181268 - RNA, 21 nt, Yersinia pestis KIM
caaugcgauagagauagccaa

SEQ ID NO: 4181269 - RNA, 19 nt, Yersinia pestis KIM
caaugcgguacgcaggccu

SEQ ID NO: 4181270 - RNA, 15 nt, Yersinia pestis KIM
caauggaauguucau

SEQ ID NO: 4181271 - RNA, 18 nt, Yersinia pestis KIM
caauggauucuugcugca

SEQ ID NO: 4181272 - RNA, 15 nt, Yersinia pestis KIM
caauggcaaaacaga

SEQ ID NO: 4181273 - RNA, 14 nt, Yersinia pestis KIM
caauggcgggggcg

SEQ ID NO: 4181274 - RNA, 21 nt, Yersinia pestis KIM
caauggcucaccuuucaacaa

SEQ ID NO: 4181275 - RNA, 13 nt, Yersinia pestis KIM
caauggcucaggc

SEQ ID NO: 4181276 - RNA, 19 nt, Yersinia pestis KIM
caauggcugcauuggccga

SEQ ID NO: 4181277 - RNA, 16 nt, Yersinia pestis KIM
caauggucaugcacag

SEQ ID NO: 4181278 - RNA, 20 nt, Yersinia pestis KIM
caauggugcccaucacaucg

SEQ ID NO: 4181279 - RNA, 23 nt, Yersinia pestis KIM
caauguaaaacgaguaaauacaa

SEQ ID NO: 4181280 - RNA, 13 nt, Yersinia pestis KIM
caaugucaccuga

SEQ ID NO: 4181281 - RNA, 19 nt, Yersinia pestis KIM
caaugucaggaaaugcaga

SEQ ID NO: 4181282 - RNA, 15 nt, Yersinia pestis KIM
caaugucaugcaauu

SEQ ID NO: 4181283 - RNA, 19 nt, Yersinia pestis KIM
cacaugcuuuuuuuaagca

SEQ ID NO: 4181284 - RNA, 14 nt, Yersinia pestis KIM
cacauuaauuuauc

SEQ ID NO: 4181285 - RNA, 12 nt, Yersinia pestis KIM
cacauuauucug

SEQ ID NO: 4181286 - RNA, 17 nt, Yersinia pestis KIM
cacauucaaacacuuau

SEQ ID NO: 4181287 - RNA, 13 nt, Yersinia pestis KIM
cacauucaggccg

SEQ ID NO: 4181288 - RNA, 17 nt, Yersinia pestis KIM
cacauucaguacauaaa

SEQ ID NO: 4181289 - RNA, 19 nt, Yersinia pestis KIM
cacauuccaguaaaaaaau

SEQ ID NO: 4181290 - RNA, 16 nt, Yersinia pestis KIM
cacauucuguguaccc

SEQ ID NO: 4181291 - RNA, 22 nt, Yersinia pestis KIM
cacauugccgccgauaacauua

SEQ ID NO: 4181292 - RNA, 20 nt, Yersinia pestis KIM
cacauuucagcguagcagga

SEQ ID NO: 4181293 - RNA, 20 nt, Yersinia pestis KIM
caccaaaaaacggauuucca

SEQ ID NO: 4181294 - RNA, 17 nt, Yersinia pestis KIM
caccaaaaacuucaucg

SEQ ID NO: 4181295 - RNA, 18 nt, Yersinia pestis KIM
caccaaacaguguugacc

SEQ ID NO: 4181296 - RNA, 15 nt, Yersinia pestis KIM
caccaaaucuuccag

SEQ ID NO: 4181297 - RNA, 18 nt, Yersinia pestis KIM
caccaaaucuuccagcgg

SEQ ID NO: 4181298 - RNA, 19 nt, Yersinia pestis KIM
caccaaaucuuccagcggc

SEQ ID NO: 4181299 - RNA, 14 nt, Yersinia pestis KIM
caccaacagcauua

SEQ ID NO: 4181300 - RNA, 15 nt, Yersinia pestis KIM
caccaacagcauuac

SEQ ID NO: 4181301 - RNA, 18 nt, Yersinia pestis KIM
caccaacagcauuaccaa

SEQ ID NO: 4181302 - RNA, 15 nt, Yersinia pestis KIM
caccaacuccugccu

SEQ ID NO: 4181303 - RNA, 21 nt, Yersinia pestis KIM
caccaagaccaguucagguau

SEQ ID NO: 4181304 - RNA, 19 nt, Yersinia pestis KIM
caccaagaggaaaugccgc

SEQ ID NO: 4181305 - RNA, 21 nt, Yersinia pestis KIM
caccaauacaaacagggcagc

SEQ ID NO: 4181306 - RNA, 18 nt, Yersinia pestis KIM
caccaauagcgaucagca

SEQ ID NO: 4181307 - RNA, 21 nt, Yersinia pestis KIM
caccaaucauuacaucaucuu

SEQ ID NO: 4181308 - RNA, 17 nt, Yersinia pestis KIM
caccaaugcauccaagc

SEQ ID NO: 4181309 - RNA, 20 nt, Yersinia pestis KIM
caccaaugcauccaagccau

SEQ ID NO: 4181310 - RNA, 19 nt, Yersinia pestis KIM
caccaauggcuaaaucauc

SEQ ID NO: 4181311 - RNA, 21 nt, Yersinia pestis KIM
caccaauggcuaaaucaucau

SEQ ID NO: 4181312 - RNA, 16 nt, Yersinia pestis KIM
caccaauuucaucgcu

SEQ ID NO: 4181313 - RNA, 14 nt, Yersinia pestis KIM
caccacaauauggg

SEQ ID NO: 4181314 - RNA, 22 nt, Yersinia pestis KIM
caccacaccggcugcaauaagc

SEQ ID NO: 4181315 - RNA, 17 nt, Yersinia pestis KIM
caccacacugagcaccg

SEQ ID NO: 4181316 - RNA, 21 nt, Yersinia pestis KIM
caccacacuggaugcgacgca

SEQ ID NO: 4181317 - RNA, 13 nt, Yersinia pestis KIM
caccacaucaucc

SEQ ID NO: 4181318 - RNA, 12 nt, Yersinia pestis KIM
caccacaucuug

SEQ ID NO: 4181319 - RNA, 12 nt, Yersinia pestis KIM
caccaccacacc

SEQ ID NO: 4181320 - RNA, 13 nt, Yersinia pestis KIM
caccaccacaccg

SEQ ID NO: 4181321 - RNA, 23 nt, Yersinia pestis KIM
caccaccaucacuuccagcgccc

SEQ ID NO: 4181322 - RNA, 12 nt, Yersinia pestis KIM
caccacggucag

SEQ ID NO: 4181323 - RNA, 18 nt, Yersinia pestis KIM
caccacugauaggucaua

SEQ ID NO: 4181324 - RNA, 15 nt, Yersinia pestis KIM
caccagaaucaucag

SEQ ID NO: 4181325 - RNA, 16 nt, Yersinia pestis KIM
caccagaaucaucaga

SEQ ID NO: 4181326 - RNA, 22 nt, Yersinia pestis KIM
caccagacaccugauaggcaaa

SEQ ID NO: 4181327 - RNA, 21 nt, Yersinia pestis KIM
caccagacucugcuaccagga

SEQ ID NO: 4181328 - RNA, 22 nt, Yersinia pestis KIM
caccagacucugcuaccaggaa

SEQ ID NO: 4181329 - RNA, 14 nt, Yersinia pestis KIM
caccagauggcgau

SEQ ID NO: 4181330 - RNA, 16 nt, Yersinia pestis KIM
caccagauugccguca

SEQ ID NO: 4181331 - RNA, 20 nt, Yersinia pestis KIM
caccagcaggugauacauca

SEQ ID NO: 4181332 - RNA, 21 nt, Yersinia pestis KIM
caccaggcucucauauccccc

SEQ ID NO: 4181333 - RNA, 16 nt, Yersinia pestis KIM
caccagguuaccuaua

SEQ ID NO: 4181334 - RNA, 15 nt, Yersinia pestis KIM
caccaguaaacgcca

SEQ ID NO: 4181335 - RNA, 15 nt, Yersinia pestis KIM
caccaguagcccagc

SEQ ID NO: 4181336 - RNA, 23 nt, Yersinia pestis KIM
caccagugccaauccccaccaaa

SEQ ID NO: 4181337 - RNA, 14 nt, Yersinia pestis KIM
caccagugggaucc

SEQ ID NO: 4181338 - RNA, 15 nt, Yersinia pestis KIM
caccaguuuauuuuc

SEQ ID NO: 4181339 - RNA, 18 nt, Yersinia pestis KIM
caccaguuuauuuucccu

SEQ ID NO: 4181340 - RNA, 22 nt, Yersinia pestis KIM
caccauaaaaacuucagagcca

SEQ ID NO: 4181341 - RNA, 19 nt, Yersinia pestis KIM
caccauaaccaauccaugc

SEQ ID NO: 4181342 - RNA, 16 nt, Yersinia pestis KIM
caccauaucagcgccu

SEQ ID NO: 4181343 - RNA, 17 nt, Yersinia pestis KIM
caccauauucccagcca

SEQ ID NO: 4181344 - RNA, 14 nt, Yersinia pestis KIM
caccaucaauauaa

SEQ ID NO: 4181345 - RNA, 15 nt, Yersinia pestis KIM
caccaucacuuccag

SEQ ID NO: 4181346 - RNA, 23 nt, Yersinia pestis KIM
caccaucggaucacggauaucaa

SEQ ID NO: 4181347 - RNA, 15 nt, Yersinia pestis KIM
caccaucugccugca

SEQ ID NO: 4181348 - RNA, 17 nt, Yersinia pestis KIM
caccaugaugaaucugu

SEQ ID NO: 4181349 - RNA, 15 nt, Yersinia pestis KIM
caccauggaaaauau

SEQ ID NO: 4181350 - RNA, 15 nt, Yersinia pestis KIM
caccauuaucuucca

SEQ ID NO: 4181351 - RNA, 13 nt, Yersinia pestis KIM
caccauugaccag

SEQ ID NO: 4181352 - RNA, 15 nt, Yersinia pestis KIM
caccauuuccaggcu

SEQ ID NO: 4181353 - RNA, 14 nt, Yersinia pestis KIM
caccauuugcccug

SEQ ID NO: 4181354 - RNA, 11 nt, Yersinia pestis KIM
cacccaaaaua

SEQ ID NO: 4181355 - RNA, 17 nt, Yersinia pestis KIM
cacccaagaauauaauu

SEQ ID NO: 4181356 - RNA, 19 nt, Yersinia pestis KIM
cacccaagaauauaauuuc

SEQ ID NO: 4181357 - RNA, 21 nt, Yersinia pestis KIM
cacccaauaauaaaaaaaaau

SEQ ID NO: 4181358 - RNA, 14 nt, Yersinia pestis KIM
cacccaauggcaac

SEQ ID NO: 4181359 - RNA, 14 nt, Yersinia pestis KIM
cacccacuuguuca

SEQ ID NO: 4181360 - RNA, 20 nt, Yersinia pestis KIM
cacccaggcugugguggcgg

SEQ ID NO: 4181361 - RNA, 18 nt, Yersinia pestis KIM
cacccauacauaccagca

SEQ ID NO: 4181362 - RNA, 15 nt, Yersinia pestis KIM
cacccauaccaacca

SEQ ID NO: 4181363 - RNA, 15 nt, Yersinia pestis KIM
cacccaucaauaauu

SEQ ID NO: 4181364 - RNA, 20 nt, Yersinia pestis KIM
cacccauuuuauccucuucc

SEQ ID NO: 4181365 - RNA, 21 nt, Yersinia pestis KIM
cacccauuuuauccucuucca

SEQ ID NO: 4181366 - RNA, 23 nt, Yersinia pestis KIM
cacccccauaaccauugaaacca

SEQ ID NO: 4181367 - RNA, 20 nt, Yersinia pestis KIM
cacccccuccaaacuggcua

SEQ ID NO: 4181368 - RNA, 13 nt, Yersinia pestis KIM
caccccuucagcg

SEQ ID NO: 4181369 - RNA, 11 nt, Yersinia pestis KIM
cacccgccauc

SEQ ID NO: 4181370 - RNA, 18 nt, Yersinia pestis KIM
cacccgcccugauuuuga

SEQ ID NO: 4181371 - RNA, 21 nt, Yersinia pestis KIM
cacccgcuggcgcacgccggc

SEQ ID NO: 4181372 - RNA, 13 nt, Yersinia pestis KIM
cacccggccaucu

SEQ ID NO: 4181373 - RNA, 20 nt, Yersinia pestis KIM
cacccggccaucuucagaaa

SEQ ID NO: 4181374 - RNA, 23 nt, Yersinia pestis KIM
cacccugugagcgguaagcugau

SEQ ID NO: 4181375 - RNA, 20 nt, Yersinia pestis KIM
cacccuuuugaauucaccaa

SEQ ID NO: 4181376 - RNA, 20 nt, Yersinia pestis KIM
caccgagcaugcuaacuugu

SEQ ID NO: 4181377 - RNA, 17 nt, Yersinia pestis KIM
caccgagguuaucagcc

SEQ ID NO: 4181378 - RNA, 15 nt, Yersinia pestis KIM
caccgauaaaaguga

SEQ ID NO: 4181379 - RNA, 16 nt, Yersinia pestis KIM
caccgauggcaccgac

SEQ ID NO: 4181380 - RNA, 16 nt, Yersinia pestis KIM
caccgcacacugacag

SEQ ID NO: 4181381 - RNA, 14 nt, Yersinia pestis KIM
caccgcccccaaua

SEQ ID NO: 4181382 - RNA, 24 nt, Yersinia pestis KIM
caccgccggauuucaauccgacca

SEQ ID NO: 4181383 - RNA, 20 nt, Yersinia pestis KIM
caccgccgucaaaccaagcc

SEQ ID NO: 4181384 - RNA, 19 nt, Yersinia pestis KIM
caccgccuaucgugaacag

SEQ ID NO: 4181385 - RNA, 15 nt, Yersinia pestis KIM
caccgcgucgccgcu

SEQ ID NO: 4181386 - RNA, 15 nt, Yersinia pestis KIM
caccgcuaaccuuaa

SEQ ID NO: 4181387 - RNA, 16 nt, Yersinia pestis KIM
caccgcuaaccuuaac

SEQ ID NO: 4181388 - RNA, 21 nt, Yersinia pestis KIM
caccgcuaaccuuaaccaaca

SEQ ID NO: 4181389 - RNA, 14 nt, Yersinia pestis KIM
caccgcuaucacug

SEQ ID NO: 4181390 - RNA, 18 nt, Yersinia pestis KIM
caccgcuggaagccgcca

SEQ ID NO: 4181391 - RNA, 18 nt, Yersinia pestis KIM
caccgcuggucgggugca

SEQ ID NO: 4181392 - RNA, 23 nt, Yersinia pestis KIM
caccgcuggucgggugcaggcca

SEQ ID NO: 4181393 - RNA, 20 nt, Yersinia pestis KIM
caccgcuguggaaucggccu

SEQ ID NO: 4181394 - RNA, 14 nt, Yersinia pestis KIM
caccggcuaaccac

SEQ ID NO: 4181395 - RNA, 15 nt, Yersinia pestis KIM
caccggggaggaugg

SEQ ID NO: 4181396 - RNA, 16 nt, Yersinia pestis KIM
caccggggauccauag

SEQ ID NO: 4181397 - RNA, 21 nt, Yersinia pestis KIM
caccgguucacgugguuuugu

SEQ ID NO: 4181398 - RNA, 15 nt, Yersinia pestis KIM
cacucaccgccagca

SEQ ID NO: 4181399 - RNA, 15 nt, Yersinia pestis KIM
cacucagacaaucau

SEQ ID NO: 4181400 - RNA, 19 nt, Yersinia pestis KIM
cacucagcgacuccuggca

SEQ ID NO: 4181401 - RNA, 14 nt, Yersinia pestis KIM
cacucagcgcuggc

SEQ ID NO: 4181402 - RNA, 23 nt, Yersinia pestis KIM
cacucaggguuagggaugagugu

SEQ ID NO: 4181403 - RNA, 23 nt, Yersinia pestis KIM
cacucauugccuggcccaucuau

SEQ ID NO: 4181404 - RNA, 16 nt, Yersinia pestis KIM
cacuccauuaauuuau

SEQ ID NO: 4181405 - RNA, 16 nt, Yersinia pestis KIM
cacuccccgucagcau

SEQ ID NO: 4181406 - RNA, 12 nt, Yersinia pestis KIM
cacucgaaucac

SEQ ID NO: 4181407 - RNA, 18 nt, Yersinia pestis KIM
cacucgcgacuacagaaa

SEQ ID NO: 4181408 - RNA, 23 nt, Yersinia pestis KIM
cacucuagcuguguuuuaucugu

SEQ ID NO: 4181409 - RNA, 20 nt, Yersinia pestis KIM
cacucucuucaucagucacu

SEQ ID NO: 4181410 - RNA, 15 nt, Yersinia pestis KIM
cacucuguuuuaaaa

SEQ ID NO: 4181411 - RNA, 18 nt, Yersinia pestis KIM
cacucuguuuuaaaaaaa

SEQ ID NO: 4181412 - RNA, 17 nt, Yersinia pestis KIM
cacucuugaacggugag

SEQ ID NO: 4181413 - RNA, 17 nt, Yersinia pestis KIM
cacucuuuuuaauuuau

SEQ ID NO: 4181414 - RNA, 20 nt, Yersinia pestis KIM
cacugaaaguguauuucuca

SEQ ID NO: 4181415 - RNA, 14 nt, Yersinia pestis KIM
cacugaaucccaga

SEQ ID NO: 4181416 - RNA, 20 nt, Yersinia pestis KIM
cacugacagcaacgacgccc

SEQ ID NO: 4181417 - RNA, 14 nt, Yersinia pestis KIM
cacugacaucauca

SEQ ID NO: 4181418 - RNA, 13 nt, Yersinia pestis KIM
cacugagcaaaca

SEQ ID NO: 4181419 - RNA, 12 nt, Yersinia pestis KIM
cacugagcaccg

SEQ ID NO: 4181420 - RNA, 14 nt, Yersinia pestis KIM
cacugagggugaua

SEQ ID NO: 4181421 - RNA, 18 nt, Yersinia pestis KIM
cacugagggugauaucgu

SEQ ID NO: 4181422 - RNA, 13 nt, Yersinia pestis KIM
cacugaguucugc

SEQ ID NO: 4181423 - RNA, 15 nt, Yersinia pestis KIM
cacugauacccaguu

SEQ ID NO: 4181424 - RNA, 15 nt, Yersinia pestis KIM
cacugauaccgauau

SEQ ID NO: 4181425 - RNA, 21 nt, Yersinia pestis KIM
cacugauauagccuucuucac

SEQ ID NO: 4181426 - RNA, 13 nt, Yersinia pestis KIM
cacugcaucaucg

SEQ ID NO: 4181427 - RNA, 16 nt, Yersinia pestis KIM
cacugcaucucugcau

SEQ ID NO: 4181428 - RNA, 14 nt, Yersinia pestis KIM
cacugcauuugaua

SEQ ID NO: 4181429 - RNA, 17 nt, Yersinia pestis KIM
cacugcccgaacggcag

SEQ ID NO: 4181430 - RNA, 16 nt, Yersinia pestis KIM
cacugccgucaaugcc

SEQ ID NO: 4181431 - RNA, 12 nt, Yersinia pestis KIM
cacugccugcuc

SEQ ID NO: 4181432 - RNA, 16 nt, Yersinia pestis KIM
cacugcuccagccaac

SEQ ID NO: 4181433 - RNA, 13 nt, Yersinia pestis KIM
cacugcucugccc

SEQ ID NO: 4181434 - RNA, 21 nt, Yersinia pestis KIM
cacuggaggaacugagucuca

SEQ ID NO: 4181435 - RNA, 21 nt, Yersinia pestis KIM
cacuggaguuaaaucccugug

SEQ ID NO: 4181436 - RNA, 13 nt, Yersinia pestis KIM
cacuggcaccgcu

SEQ ID NO: 4181437 - RNA, 16 nt, Yersinia pestis KIM
cacuggccuauuaaga

SEQ ID NO: 4181438 - RNA, 16 nt, Yersinia pestis KIM
cacugggaucugauca

SEQ ID NO: 4181439 - RNA, 18 nt, Yersinia pestis KIM
cacugggucaucacccag

SEQ ID NO: 4181440 - RNA, 20 nt, Yersinia pestis KIM
cacuguacugggaugaagaa

SEQ ID NO: 4181441 - RNA, 20 nt, Yersinia pestis KIM
cacugugagcggcauccagu

SEQ ID NO: 4181442 - RNA, 12 nt, Yersinia pestis KIM
cacuguucagac

SEQ ID NO: 4181443 - RNA, 13 nt, Yersinia pestis KIM
cacuguucagacg

SEQ ID NO: 4181444 - RNA, 21 nt, Yersinia pestis KIM
cacuguucuugauggucaaua

SEQ ID NO: 4181445 - RNA, 15 nt, Yersinia pestis KIM
cacuguuuuucauua

SEQ ID NO: 4181446 - RNA, 17 nt, Yersinia pestis KIM
cacuguuuuucauuacg

SEQ ID NO: 4181447 - RNA, 22 nt, Yersinia pestis KIM
cacuuaacacgaaccuucucug

SEQ ID NO: 4181448 - RNA, 13 nt, Yersinia pestis KIM
cacuuacugccaa

SEQ ID NO: 4181449 - RNA, 15 nt, Yersinia pestis KIM
cacuuaguggcauug

SEQ ID NO: 4181450 - RNA, 21 nt, Yersinia pestis KIM
cacuuauuccuuucguucacu

SEQ ID NO: 4181451 - RNA, 12 nt, Yersinia pestis KIM
cacuuauuggaa

SEQ ID NO: 4181452 - RNA, 21 nt, Yersinia pestis KIM
cacuuauuugaaauacuuauu

SEQ ID NO: 4181453 - RNA, 22 nt, Yersinia pestis KIM
cacuuauuugaaauacuuauuu

SEQ ID NO: 4181454 - RNA, 23 nt, Yersinia pestis KIM
cacuuauuugaaauacuuauuug

SEQ ID NO: 4181455 - RNA, 13 nt, Yersinia pestis KIM
cacuucagaaccg

SEQ ID NO: 4181456 - RNA, 21 nt, Yersinia pestis KIM
cacuucaucauucauuuuaaa

SEQ ID NO: 4181457 - RNA, 14 nt, Yersinia pestis KIM
cacuuccagcgccc

SEQ ID NO: 4181458 - RNA, 16 nt, Yersinia pestis KIM
cacuuccgccgccaac

SEQ ID NO: 4181459 - RNA, 15 nt, Yersinia pestis KIM
cacuuccucauucau

SEQ ID NO: 4181460 - RNA, 18 nt, Yersinia pestis KIM
cacuucgauacuacaauc

SEQ ID NO: 4181461 - RNA, 16 nt, Yersinia pestis KIM
cacuucgguggcccug

SEQ ID NO: 4181462 - RNA, 22 nt, Yersinia pestis KIM
cacuucguagggcacuuucauc

SEQ ID NO: 4181463 - RNA, 13 nt, Yersinia pestis KIM
cacuucuaacaag

SEQ ID NO: 4181464 - RNA, 18 nt, Yersinia pestis KIM
cacuucuggccgcucuuu

SEQ ID NO: 4181465 - RNA, 20 nt, Yersinia pestis KIM
cacuucuggggucaucaacg

SEQ ID NO: 4181466 - RNA, 14 nt, Yersinia pestis KIM
cacuucuuucacua

SEQ ID NO: 4181467 - RNA, 11 nt, Yersinia pestis KIM
cacuugaccuu

SEQ ID NO: 4181468 - RNA, 22 nt, Yersinia pestis KIM
cacuuggguagcagcccaacac

SEQ ID NO: 4181469 - RNA, 16 nt, Yersinia pestis KIM
cacuugguauguuugu

SEQ ID NO: 4181470 - RNA, 16 nt, Yersinia pestis KIM
cacuuguaccugugcc

SEQ ID NO: 4181471 - RNA, 13 nt, Yersinia pestis KIM
cacuuguucagag

SEQ ID NO: 4181472 - RNA, 19 nt, Yersinia pestis KIM
cacuuuaaauacccagcuu

SEQ ID NO: 4181473 - RNA, 22 nt, Yersinia pestis KIM
cacuuuaaauacccagcuucuu

SEQ ID NO: 4181474 - RNA, 17 nt, Yersinia pestis KIM
cacuuuaccgauuucag

SEQ ID NO: 4181475 - RNA, 12 nt, Yersinia pestis KIM
cacuuugcauuu

SEQ ID NO: 4181476 - RNA, 15 nt, Yersinia pestis KIM
cacuuugcauuuucu

SEQ ID NO: 4181477 - RNA, 19 nt, Yersinia pestis KIM
cacuuugggcugaucaucg

SEQ ID NO: 4181478 - RNA, 20 nt, Yersinia pestis KIM
cacuuugucaauaaccucag

SEQ ID NO: 4181479 - RNA, 17 nt, Yersinia pestis KIM
cacuuuuauccagccau

SEQ ID NO: 4181480 - RNA, 18 nt, Yersinia pestis KIM
cacuuuugucgcucaagc

SEQ ID NO: 4181481 - RNA, 11 nt, Yersinia pestis KIM
cagaaaacccc

SEQ ID NO: 4181482 - RNA, 21 nt, Yersinia pestis KIM
cagaaaaccuucagcaaagag

SEQ ID NO: 4181483 - RNA, 16 nt, Yersinia pestis KIM
cagaaaagcaaaggcc

SEQ ID NO: 4181484 - RNA, 23 nt, Yersinia pestis KIM
cagaaacauugcguucaauacug

SEQ ID NO: 4181485 - RNA, 16 nt, Yersinia pestis KIM
cagaaacgauuaccca

SEQ ID NO: 4181486 - RNA, 16 nt, Yersinia pestis KIM
cagaaacggcuauuuu

SEQ ID NO: 4181487 - RNA, 19 nt, Yersinia pestis KIM
cagaaagaagucuaacaaa

SEQ ID NO: 4181488 - RNA, 12 nt, Yersinia pestis KIM
cagaaagcagca

SEQ ID NO: 4181489 - RNA, 21 nt, Yersinia pestis KIM
cagaaaguuguucaacgccau

SEQ ID NO: 4181490 - RNA, 19 nt, Yersinia pestis KIM
cagaaauaaauauccuccg

SEQ ID NO: 4181491 - RNA, 14 nt, Yersinia pestis KIM
cagaaauaaauuca

SEQ ID NO: 4181492 - RNA, 18 nt, Yersinia pestis KIM
cagaaauaaauucaucuc

SEQ ID NO: 4181493 - RNA, 16 nt, Yersinia pestis KIM
cagaaauagcaccauu

SEQ ID NO: 4181494 - RNA, 21 nt, Yersinia pestis KIM
cagaaauagcaccauuaggcu

SEQ ID NO: 4181495 - RNA, 16 nt, Yersinia pestis KIM
cagaacaaaacaagcc

SEQ ID NO: 4181496 - RNA, 21 nt, Yersinia pestis KIM
cagaacagagugugaaaucac

SEQ ID NO: 4181497 - RNA, 19 nt, Yersinia pestis KIM
cagaaccuguuacaucaga

SEQ ID NO: 4181498 - RNA, 16 nt, Yersinia pestis KIM
cagaacguuaauuuag

SEQ ID NO: 4181499 - RNA, 15 nt, Yersinia pestis KIM
cagaacuaaacgcca

SEQ ID NO: 4181500 - RNA, 19 nt, Yersinia pestis KIM
cagaacuaaacgccaacaa

SEQ ID NO: 4181501 - RNA, 19 nt, Yersinia pestis KIM
cagaacuaauaucaacaga

SEQ ID NO: 4181502 - RNA, 20 nt, Yersinia pestis KIM
cagaacugauuucaggaaug

SEQ ID NO: 4181503 - RNA, 17 nt, Yersinia pestis KIM
cagaagcauauggaugu

SEQ ID NO: 4181504 - RNA, 16 nt, Yersinia pestis KIM
cagaagcguaaagcac

SEQ ID NO: 4181505 - RNA, 18 nt, Yersinia pestis KIM
cagaagcguaaagcaccc

SEQ ID NO: 4181506 - RNA, 19 nt, Yersinia pestis KIM
cagaagggcggccagcaag

SEQ ID NO: 4181507 - RNA, 14 nt, Yersinia pestis KIM
cagaagguaagcca

SEQ ID NO: 4181508 - RNA, 16 nt, Yersinia pestis KIM
cagaagguaagccagu

SEQ ID NO: 4181509 - RNA, 21 nt, Yersinia pestis KIM
cagaauaaaagcgguaugacc

SEQ ID NO: 4181510 - RNA, 20 nt, Yersinia pestis KIM
cagaauaauaagccgugccu

SEQ ID NO: 4181511 - RNA, 15 nt, Yersinia pestis KIM
cagaauaauccaagc

SEQ ID NO: 4181512 - RNA, 18 nt, Yersinia pestis KIM
cagaauacuguguggauc

SEQ ID NO: 4181513 - RNA, 23 nt, Yersinia pestis KIM
cagaugaucugaugaucaucugg

SEQ ID NO: 4181514 - RNA, 17 nt, Yersinia pestis KIM
cagaugcuggcuuuuuu

SEQ ID NO: 4181515 - RNA, 11 nt, Yersinia pestis KIM
cagauguguac

SEQ ID NO: 4181516 - RNA, 19 nt, Yersinia pestis KIM
cagauguuauuugaauaaa

SEQ ID NO: 4181517 - RNA, 13 nt, Yersinia pestis KIM
cagauguuuaaau

SEQ ID NO: 4181518 - RNA, 17 nt, Yersinia pestis KIM
cagauucaccaguagcc

SEQ ID NO: 4181519 - RNA, 20 nt, Yersinia pestis KIM
cagauugccgucacuuuuuu

SEQ ID NO: 4181520 - RNA, 15 nt, Yersinia pestis KIM
cagauuggcuugcuu

SEQ ID NO: 4181521 - RNA, 17 nt, Yersinia pestis KIM
cagauugugcuccagca

SEQ ID NO: 4181522 - RNA, 20 nt, Yersinia pestis KIM
cagauugugcuccagcacuu

SEQ ID NO: 4181523 - RNA, 18 nt, Yersinia pestis KIM
cagauuguuuauaaauua

SEQ ID NO: 4181524 - RNA, 19 nt, Yersinia pestis KIM
cagauuguuuauaaauuaa

SEQ ID NO: 4181525 - RNA, 12 nt, Yersinia pestis KIM
cagauuuaccau

SEQ ID NO: 4181526 - RNA, 23 nt, Yersinia pestis KIM
cagauuuacuccccaaagccuac

SEQ ID NO: 4181527 - RNA, 18 nt, Yersinia pestis KIM
cagauuugcccaaucuaa

SEQ ID NO: 4181528 - RNA, 21 nt, Yersinia pestis KIM
cagauuuggccacgcugccug

SEQ ID NO: 4181529 - RNA, 12 nt, Yersinia pestis KIM
cagauuugguau

SEQ ID NO: 4181530 - RNA, 17 nt, Yersinia pestis KIM
cagauuuuccauccccu

SEQ ID NO: 4181531 - RNA, 18 nt, Yersinia pestis KIM
cagauuuuugcuuuccac

SEQ ID NO: 4181532 - RNA, 14 nt, Yersinia pestis KIM
cagcaaaagccucu

SEQ ID NO: 4181533 - RNA, 22 nt, Yersinia pestis KIM
cagcaaaagccucuugcgcucc

SEQ ID NO: 4181534 - RNA, 17 nt, Yersinia pestis KIM
cagcaaacaucgguaaa

SEQ ID NO: 4181535 - RNA, 15 nt, Yersinia pestis KIM
cagcaaaggccacca

SEQ ID NO: 4181536 - RNA, 14 nt, Yersinia pestis KIM
cagcaaaguauuua

SEQ ID NO: 4181537 - RNA, 22 nt, Yersinia pestis KIM
cagcaaauaccgggacuaccaa

SEQ ID NO: 4181538 - RNA, 14 nt, Yersinia pestis KIM
cagcaaaucacauu

SEQ ID NO: 4181539 - RNA, 14 nt, Yersinia pestis KIM
cagcaaaucauaaa

SEQ ID NO: 4181540 - RNA, 12 nt, Yersinia pestis KIM
cagcaaaucauu

SEQ ID NO: 4181541 - RNA, 15 nt, Yersinia pestis KIM
cagcaaaucauuuaa

SEQ ID NO: 4181542 - RNA, 14 nt, Yersinia pestis KIM
cagcaaauugcuga

SEQ ID NO: 4181543 - RNA, 20 nt, Yersinia pestis KIM
cagcaaauugcugaaaaaaa

SEQ ID NO: 4181544 - RNA, 14 nt, Yersinia pestis KIM
cagcaacacaaaag

SEQ ID NO: 4181545 - RNA, 22 nt, Yersinia pestis KIM
cagcaacaggguauuggcuaac

SEQ ID NO: 4181546 - RNA, 14 nt, Yersinia pestis KIM
cagcaacgaauaaa

SEQ ID NO: 4181547 - RNA, 17 nt, Yersinia pestis KIM
cagcaacucaagccacu

SEQ ID NO: 4181548 - RNA, 17 nt, Yersinia pestis KIM
cagcaagaacaauccau

SEQ ID NO: 4181549 - RNA, 23 nt, Yersinia pestis KIM
cagcaagauugggaucaacgccc

SEQ ID NO: 4181550 - RNA, 12 nt, Yersinia pestis KIM
cagcaaggcagc

SEQ ID NO: 4181551 - RNA, 18 nt, Yersinia pestis KIM
cagcaaggcggcaagcaa

SEQ ID NO: 4181552 - RNA, 18 nt, Yersinia pestis KIM
cagcaaggcgggcaaauu

SEQ ID NO: 4181553 - RNA, 20 nt, Yersinia pestis KIM
cagcaaggcgggcaaauuca

SEQ ID NO: 4181554 - RNA, 17 nt, Yersinia pestis KIM
cagcaagugaauaacag

SEQ ID NO: 4181555 - RNA, 22 nt, Yersinia pestis KIM
cagcaaguuagcgauaucugcg

SEQ ID NO: 4181556 - RNA, 15 nt, Yersinia pestis KIM
cagcaauaaaccacu

SEQ ID NO: 4181557 - RNA, 17 nt, Yersinia pestis KIM
cagcaauaaaccacugg

SEQ ID NO: 4181558 - RNA, 18 nt, Yersinia pestis KIM
cagcaauaaaccacuggu

SEQ ID NO: 4181559 - RNA, 20 nt, Yersinia pestis KIM
cagcaauaaaccacugguua

SEQ ID NO: 4181560 - RNA, 17 nt, Yersinia pestis KIM
cagcaauacgccccuga

SEQ ID NO: 4181561 - RNA, 13 nt, Yersinia pestis KIM
cagcaauauuguc

SEQ ID NO: 4181562 - RNA, 18 nt, Yersinia pestis KIM
cagcacaaacagcuuuuu

SEQ ID NO: 4181563 - RNA, 15 nt, Yersinia pestis KIM
cagcacacaggcagc

SEQ ID NO: 4181564 - RNA, 21 nt, Yersinia pestis KIM
cagcacaccggccaaaaucac

SEQ ID NO: 4181565 - RNA, 12 nt, Yersinia pestis KIM
cagcacagccug

SEQ ID NO: 4181566 - RNA, 16 nt, Yersinia pestis KIM
cagcacauaaagcgca

SEQ ID NO: 4181567 - RNA, 21 nt, Yersinia pestis KIM
cagcacauaaagcgcauuauu

SEQ ID NO: 4181568 - RNA, 16 nt, Yersinia pestis KIM
cagcacaucgccauua

SEQ ID NO: 4181569 - RNA, 14 nt, Yersinia pestis KIM
cagcacauuuuuau

SEQ ID NO: 4181570 - RNA, 16 nt, Yersinia pestis KIM
cagcacauuuuuauag

SEQ ID NO: 4181571 - RNA, 18 nt, Yersinia pestis KIM
cagcaccacaauggcaga

SEQ ID NO: 4181572 - RNA, 13 nt, Yersinia pestis KIM
cagcaccacuaag

SEQ ID NO: 4181573 - RNA, 13 nt, Yersinia pestis KIM
cagcaccauacag

SEQ ID NO: 4181574 - RNA, 14 nt, Yersinia pestis KIM
cagcaccauacagc

SEQ ID NO: 4181575 - RNA, 19 nt, Yersinia pestis KIM
cagcacgggcuaucgggua

SEQ ID NO: 4181576 - RNA, 15 nt, Yersinia pestis KIM
cagcacguucaccaa

SEQ ID NO: 4181577 - RNA, 22 nt, Yersinia pestis KIM
cagcacguucaccaaagcaaug

SEQ ID NO: 4181578 - RNA, 12 nt, Yersinia pestis KIM
cagcacucagua

SEQ ID NO: 4181579 - RNA, 15 nt, Yersinia pestis KIM
cagcacuccccgccc

SEQ ID NO: 4181580 - RNA, 17 nt, Yersinia pestis KIM
cagcacuccccgcccgu

SEQ ID NO: 4181581 - RNA, 15 nt, Yersinia pestis KIM
cagcagaacaaaaca

SEQ ID NO: 4181582 - RNA, 14 nt, Yersinia pestis KIM
cagcagcaguauua

SEQ ID NO: 4181583 - RNA, 20 nt, Yersinia pestis KIM
cagcagggcuuucacaucug

SEQ ID NO: 4181584 - RNA, 22 nt, Yersinia pestis KIM
cagcagucugaaacgccagccu

SEQ ID NO: 4181585 - RNA, 16 nt, Yersinia pestis KIM
cagcagucugacaccg

SEQ ID NO: 4181586 - RNA, 23 nt, Yersinia pestis KIM
cagcagucugacaccggggaucc

SEQ ID NO: 4181587 - RNA, 21 nt, Yersinia pestis KIM
cagcagucugacagauacuuu

SEQ ID NO: 4181588 - RNA, 16 nt, Yersinia pestis KIM
cagcagucugagggcc

SEQ ID NO: 4181589 - RNA, 20 nt, Yersinia pestis KIM
cagcagugcugcgcccagug

SEQ ID NO: 4181590 - RNA, 20 nt, Yersinia pestis KIM
cagcaguuacaguagugaag

SEQ ID NO: 4181591 - RNA, 16 nt, Yersinia pestis KIM
cagcaguuccaguacg

SEQ ID NO: 4181592 - RNA, 17 nt, Yersinia pestis KIM
cagcaguugucagcccu

SEQ ID NO: 4181593 - RNA, 14 nt, Yersinia pestis KIM
cagcauaaccagug

SEQ ID NO: 4181594 - RNA, 20 nt, Yersinia pestis KIM
cagcauaacgguuguauaca

SEQ ID NO: 4181595 - RNA, 13 nt, Yersinia pestis KIM
cagcauaaggcgu

SEQ ID NO: 4181596 - RNA, 20 nt, Yersinia pestis KIM
cagcauauuacccaguacug

SEQ ID NO: 4181597 - RNA, 14 nt, Yersinia pestis KIM
cagcauauugagca

SEQ ID NO: 4181598 - RNA, 13 nt, Yersinia pestis KIM
cagcaucaaggac

SEQ ID NO: 4181599 - RNA, 18 nt, Yersinia pestis KIM
cagcaucacccguuuucc

SEQ ID NO: 4181600 - RNA, 19 nt, Yersinia pestis KIM
cagcaucacccguuuuccc

SEQ ID NO: 4181601 - RNA, 14 nt, Yersinia pestis KIM
cagcaucacugucu

SEQ ID NO: 4181602 - RNA, 13 nt, Yersinia pestis KIM
cagcaucaucaaa

SEQ ID NO: 4181603 - RNA, 16 nt, Yersinia pestis KIM
cagcauccugcaaauu

SEQ ID NO: 4181604 - RNA, 15 nt, Yersinia pestis KIM
cagcaucuagcagug

SEQ ID NO: 4181605 - RNA, 19 nt, Yersinia pestis KIM
cagcaugaauggcuuuugc

SEQ ID NO: 4181606 - RNA, 18 nt, Yersinia pestis KIM
cagcauggcgcugggcaa

SEQ ID NO: 4181607 - RNA, 20 nt, Yersinia pestis KIM
cagcauuaccaaggaaacca

SEQ ID NO: 4181608 - RNA, 21 nt, Yersinia pestis KIM
cagcauucaggcuuuuuucua

SEQ ID NO: 4181609 - RNA, 13 nt, Yersinia pestis KIM
cagcauucugcuu

SEQ ID NO: 4181610 - RNA, 16 nt, Yersinia pestis KIM
cagcauucugcuucca

SEQ ID NO: 4181611 - RNA, 19 nt, Yersinia pestis KIM
cagcauuguuggcggugac

SEQ ID NO: 4181612 - RNA, 14 nt, Yersinia pestis KIM
cagcauuucaggau

SEQ ID NO: 4181613 - RNA, 13 nt, Yersinia pestis KIM
cagccaacuccuu

SEQ ID NO: 4181614 - RNA, 18 nt, Yersinia pestis KIM
cagccaacuggcgcaaca

SEQ ID NO: 4181615 - RNA, 13 nt, Yersinia pestis KIM
cagccaauggcca

SEQ ID NO: 4181616 - RNA, 20 nt, Yersinia pestis KIM
cagccaauggccaccauuaa

SEQ ID NO: 4181617 - RNA, 13 nt, Yersinia pestis KIM
cagccacaugauu

SEQ ID NO: 4181618 - RNA, 14 nt, Yersinia pestis KIM
cagccaccaaaaaa

SEQ ID NO: 4181619 - RNA, 15 nt, Yersinia pestis KIM
cagccacucaauggc

SEQ ID NO: 4181620 - RNA, 15 nt, Yersinia pestis KIM
cagccagagaauuau

SEQ ID NO: 4181621 - RNA, 18 nt, Yersinia pestis KIM
cagccagccuuaacugca

SEQ ID NO: 4181622 - RNA, 18 nt, Yersinia pestis KIM
cagccaguugaucggcca

SEQ ID NO: 4181623 - RNA, 15 nt, Yersinia pestis KIM
cagccaucggucauu

SEQ ID NO: 4181624 - RNA, 15 nt, Yersinia pestis KIM
cagccaugccugcga

SEQ ID NO: 4181625 - RNA, 17 nt, Yersinia pestis KIM
cagccauugagcgaaga

SEQ ID NO: 4181626 - RNA, 19 nt, Yersinia pestis KIM
cagcccagucucuuugcca

SEQ ID NO: 4181627 - RNA, 22 nt, Yersinia pestis KIM
cagcccauuuagcuggcugaac

SEQ ID NO: 4181628 - RNA, 20 nt, Yersinia pestis KIM
cagccccaaacacuuagcac

SEQ ID NO: 4181629 - RNA, 15 nt, Yersinia pestis KIM
caggcagauuauuuu

SEQ ID NO: 4181630 - RNA, 14 nt, Yersinia pestis KIM
caggcagcacggcu

SEQ ID NO: 4181631 - RNA, 17 nt, Yersinia pestis KIM
caggcaguaaaauauug

SEQ ID NO: 4181632 - RNA, 13 nt, Yersinia pestis KIM
caggcauaucacu

SEQ ID NO: 4181633 - RNA, 14 nt, Yersinia pestis KIM
caggcauaucacua

SEQ ID NO: 4181634 - RNA, 21 nt, Yersinia pestis KIM
caggcauuacagacuggccaa

SEQ ID NO: 4181635 - RNA, 18 nt, Yersinia pestis KIM
caggccaagccugugcua

SEQ ID NO: 4181636 - RNA, 11 nt, Yersinia pestis KIM
caggccaauag

SEQ ID NO: 4181637 - RNA, 14 nt, Yersinia pestis KIM
caggccaauagccc

SEQ ID NO: 4181638 - RNA, 15 nt, Yersinia pestis KIM
caggccccuuaaaua

SEQ ID NO: 4181639 - RNA, 14 nt, Yersinia pestis KIM
caggccccuucugg

SEQ ID NO: 4181640 - RNA, 19 nt, Yersinia pestis KIM
caggcccgcuaucacuagc

SEQ ID NO: 4181641 - RNA, 16 nt, Yersinia pestis KIM
caggcccuuucaccgc

SEQ ID NO: 4181642 - RNA, 18 nt, Yersinia pestis KIM
caggccgguauucagcca

SEQ ID NO: 4181643 - RNA, 20 nt, Yersinia pestis KIM
caggccgguauucagccaaa

SEQ ID NO: 4181644 - RNA, 22 nt, Yersinia pestis KIM
caggccuagcccaguaccgcug

SEQ ID NO: 4181645 - RNA, 23 nt, Yersinia pestis KIM
caggccuaucucgcgucgcguac

SEQ ID NO: 4181646 - RNA, 15 nt, Yersinia pestis KIM
caggccuucuucaau

SEQ ID NO: 4181647 - RNA, 14 nt, Yersinia pestis KIM
caggccuuuacugu

SEQ ID NO: 4181648 - RNA, 22 nt, Yersinia pestis KIM
caggcgaucucuucggcccaga

SEQ ID NO: 4181649 - RNA, 16 nt, Yersinia pestis KIM
caggcgaugcaaggaa

SEQ ID NO: 4181650 - RNA, 24 nt, Yersinia pestis KIM
caggcgugggcuaauugaauacaa

SEQ ID NO: 4181651 - RNA, 14 nt, Yersinia pestis KIM
caggcuaacaacua

SEQ ID NO: 4181652 - RNA, 15 nt, Yersinia pestis KIM
caggcucccaagggu

SEQ ID NO: 4181653 - RNA, 16 nt, Yersinia pestis KIM
caggcugccugccuga

SEQ ID NO: 4181654 - RNA, 23 nt, Yersinia pestis KIM
caggcuguaugccugagcuauug

SEQ ID NO: 4181655 - RNA, 21 nt, Yersinia pestis KIM
caggcuuagcgacacccacuu

SEQ ID NO: 4181656 - RNA, 13 nt, Yersinia pestis KIM
caggcuuauauuu

SEQ ID NO: 4181657 - RNA, 17 nt, Yersinia pestis KIM
caggcuucgacaggcaa

SEQ ID NO: 4181658 - RNA, 11 nt, Yersinia pestis KIM
cagggaaaaac

SEQ ID NO: 4181659 - RNA, 12 nt, Yersinia pestis KIM
cagggagccgcc

SEQ ID NO: 4181660 - RNA, 15 nt, Yersinia pestis KIM
cagggagccgcccug

SEQ ID NO: 4181661 - RNA, 19 nt, Yersinia pestis KIM
cagggaugggcgccgcuuu

SEQ ID NO: 4181662 - RNA, 13 nt, Yersinia pestis KIM
cagggcagccaau

SEQ ID NO: 4181663 - RNA, 14 nt, Yersinia pestis KIM
cagggcagccaauu

SEQ ID NO: 4181664 - RNA, 21 nt, Yersinia pestis KIM
cagggcaucgaaaagcgccuu

SEQ ID NO: 4181665 - RNA, 12 nt, Yersinia pestis KIM
cagggccacuuc

SEQ ID NO: 4181666 - RNA, 13 nt, Yersinia pestis KIM
cagggccacuucg

SEQ ID NO: 4181667 - RNA, 19 nt, Yersinia pestis KIM
cagggccgauaaaaaaccc

SEQ ID NO: 4181668 - RNA, 24 nt, Yersinia pestis KIM
cagggcgauagcccuacuggcuga

SEQ ID NO: 4181669 - RNA, 21 nt, Yersinia pestis KIM
cagggcgcuuucugggugacg

SEQ ID NO: 4181670 - RNA, 16 nt, Yersinia pestis KIM
cagggcggcguuagcc

SEQ ID NO: 4181671 - RNA, 22 nt, Yersinia pestis KIM
cagggcgguaacgcagauaaau

SEQ ID NO: 4181672 - RNA, 23 nt, Yersinia pestis KIM
cagggcuaauuacuucgcuuuac

SEQ ID NO: 4181673 - RNA, 14 nt, Yersinia pestis KIM
cagggcuuucacau

SEQ ID NO: 4181674 - RNA, 17 nt, Yersinia pestis KIM
caggggaguaaaggaug

SEQ ID NO: 4181675 - RNA, 16 nt, Yersinia pestis KIM
caggggcaauuaucuu

SEQ ID NO: 4181676 - RNA, 16 nt, Yersinia pestis KIM
caggggcgaugucacc

SEQ ID NO: 4181677 - RNA, 21 nt, Yersinia pestis KIM
caggggguuauccaacauuug

SEQ ID NO: 4181678 - RNA, 14 nt, Yersinia pestis KIM
caggguaauaaccg

SEQ ID NO: 4181679 - RNA, 18 nt, Yersinia pestis KIM
caggguauuccacccgca

SEQ ID NO: 4181680 - RNA, 14 nt, Yersinia pestis KIM
cagggugaaagccc

SEQ ID NO: 4181681 - RNA, 19 nt, Yersinia pestis KIM
cagggugaaagcccaacug

SEQ ID NO: 4181682 - RNA, 20 nt, Yersinia pestis KIM
cagggugaaagcccaacuga

SEQ ID NO: 4181683 - RNA, 24 nt, Yersinia pestis KIM
cagggugaaagcccaacugacuga

SEQ ID NO: 4181684 - RNA, 17 nt, Yersinia pestis KIM
cagggugcgggccagaa

SEQ ID NO: 4181685 - RNA, 23 nt, Yersinia pestis KIM
cagggugguguagagcucuucug

SEQ ID NO: 4181686 - RNA, 22 nt, Yersinia pestis KIM
cagguaaaccgguuaaaacaga

SEQ ID NO: 4181687 - RNA, 16 nt, Yersinia pestis KIM
cagguaaugcauucug

SEQ ID NO: 4181688 - RNA, 16 nt, Yersinia pestis KIM
cagguaaugucacugc

SEQ ID NO: 4181689 - RNA, 20 nt, Yersinia pestis KIM
cagguaaugucacugccauc

SEQ ID NO: 4181690 - RNA, 14 nt, Yersinia pestis KIM
cagguaauuacagu

SEQ ID NO: 4181691 - RNA, 21 nt, Yersinia pestis KIM
cagguaauuuccaacugaucu

SEQ ID NO: 4181692 - RNA, 21 nt, Yersinia pestis KIM
cagguagaucaaacauaaccu

SEQ ID NO: 4181693 - RNA, 15 nt, Yersinia pestis KIM
cagguaguuacagca

SEQ ID NO: 4181694 - RNA, 13 nt, Yersinia pestis KIM
cagguaguucauu

SEQ ID NO: 4181695 - RNA, 13 nt, Yersinia pestis KIM
cagguauuucucc

SEQ ID NO: 4181696 - RNA, 22 nt, Yersinia pestis KIM
cagguauuugggcuucagcggu

SEQ ID NO: 4181697 - RNA, 13 nt, Yersinia pestis KIM
caggucaaucaau

SEQ ID NO: 4181698 - RNA, 20 nt, Yersinia pestis KIM
caggucaaucaauucuucaa

SEQ ID NO: 4181699 - RNA, 15 nt, Yersinia pestis KIM
caggucaggaagaga

SEQ ID NO: 4181700 - RNA, 17 nt, Yersinia pestis KIM
caggucaggaagagaaa

SEQ ID NO: 4181701 - RNA, 20 nt, Yersinia pestis KIM
caggugaacguuggcuucac

SEQ ID NO: 4181702 - RNA, 13 nt, Yersinia pestis KIM
caggugacugaag

SEQ ID NO: 4181703 - RNA, 22 nt, Yersinia pestis KIM
caggugauaauggcauuuuucg

SEQ ID NO: 4181704 - RNA, 18 nt, Yersinia pestis KIM
caggugcgauuaaccuua

SEQ ID NO: 4181705 - RNA, 18 nt, Yersinia pestis KIM
caggugcguuaucuucac

SEQ ID NO: 4181706 - RNA, 15 nt, Yersinia pestis KIM
caggugcuugacuaa

SEQ ID NO: 4181707 - RNA, 23 nt, Yersinia pestis KIM
cagguggcugaggccagcggcau

SEQ ID NO: 4181708 - RNA, 17 nt, Yersinia pestis KIM
cagguguauagcggcca

SEQ ID NO: 4181709 - RNA, 13 nt, Yersinia pestis KIM
cagguguucagcc

SEQ ID NO: 4181710 - RNA, 15 nt, Yersinia pestis KIM
cagguucccaucccu

SEQ ID NO: 4181711 - RNA, 14 nt, Yersinia pestis KIM
cagguugaggcagg

SEQ ID NO: 4181712 - RNA, 23 nt, Yersinia pestis KIM
cagguuuacgccauacaucaaug

SEQ ID NO: 4181713 - RNA, 20 nt, Yersinia pestis KIM
cagguuuuuuccccauggcg

SEQ ID NO: 4181714 - RNA, 13 nt, Yersinia pestis KIM
caguaaaaaaaua

SEQ ID NO: 4181715 - RNA, 14 nt, Yersinia pestis KIM
caguaaaaaaauag

SEQ ID NO: 4181716 - RNA, 14 nt, Yersinia pestis KIM
caguaaaaccagca

SEQ ID NO: 4181717 - RNA, 17 nt, Yersinia pestis KIM
caguaaaaccagcagcg

SEQ ID NO: 4181718 - RNA, 16 nt, Yersinia pestis KIM
caguaaaauauugaua

SEQ ID NO: 4181719 - RNA, 16 nt, Yersinia pestis KIM
caguaaaaucaucagc

SEQ ID NO: 4181720 - RNA, 22 nt, Yersinia pestis KIM
caguaaaaucaucagccucuaa

SEQ ID NO: 4181721 - RNA, 15 nt, Yersinia pestis KIM
caguaaacagccagc

SEQ ID NO: 4181722 - RNA, 19 nt, Yersinia pestis KIM
caguaaacagccagcauca

SEQ ID NO: 4181723 - RNA, 16 nt, Yersinia pestis KIM
caguaaacauuuugac

SEQ ID NO: 4181724 - RNA, 18 nt, Yersinia pestis KIM
caguaaacauuuugacuu

SEQ ID NO: 4181725 - RNA, 16 nt, Yersinia pestis KIM
caguaaacgcagaguc

SEQ ID NO: 4181726 - RNA, 19 nt, Yersinia pestis KIM
caguaaacugcgcuuccag

SEQ ID NO: 4181727 - RNA, 22 nt, Yersinia pestis KIM
caguaaagauuauguagauccc

SEQ ID NO: 4181728 - RNA, 22 nt, Yersinia pestis KIM
caguaaccccuucgagcaccgc

SEQ ID NO: 4181729 - RNA, 21 nt, Yersinia pestis KIM
caguaacgccugauucaucgc

SEQ ID NO: 4181730 - RNA, 17 nt, Yersinia pestis KIM
caguaacguccaacuga

SEQ ID NO: 4181731 - RNA, 16 nt, Yersinia pestis KIM
caguaacuacuauaua

SEQ ID NO: 4181732 - RNA, 16 nt, Yersinia pestis KIM
caguaacugaucaaua

SEQ ID NO: 4181733 - RNA, 13 nt, Yersinia pestis KIM
caguaagaucuuc

SEQ ID NO: 4181734 - RNA, 12 nt, Yersinia pestis KIM
caguaagcucua

SEQ ID NO: 4181735 - RNA, 16 nt, Yersinia pestis KIM
caguaaggcagcaagu

SEQ ID NO: 4181736 - RNA, 19 nt, Yersinia pestis KIM
caguaaguuaaaaagaaaa

SEQ ID NO: 4181737 - RNA, 16 nt, Yersinia pestis KIM
caguaaugaauucauu

SEQ ID NO: 4181738 - RNA, 13 nt, Yersinia pestis KIM
caguacaaaaaac

SEQ ID NO: 4181739 - RNA, 23 nt, Yersinia pestis KIM
caguacaccgauaaaagugacca

SEQ ID NO: 4181740 - RNA, 17 nt, Yersinia pestis KIM
caguacaucacgcagug

SEQ ID NO: 4181741 - RNA, 17 nt, Yersinia pestis KIM
caguaccgacaccaaua

SEQ ID NO: 4181742 - RNA, 19 nt, Yersinia pestis KIM
caguaccgacaccaauacc

SEQ ID NO: 4181743 - RNA, 15 nt, Yersinia pestis KIM
caguaccgcuggugc

SEQ ID NO: 4181744 - RNA, 20 nt, Yersinia pestis KIM
caguucauuccccaucgcca

SEQ ID NO: 4181745 - RNA, 21 nt, Yersinia pestis KIM
caguucauuccccaucgccaa

SEQ ID NO: 4181746 - RNA, 22 nt, Yersinia pestis KIM
caguuccugauucgguuucguu

SEQ ID NO: 4181747 - RNA, 16 nt, Yersinia pestis KIM
caguucgacaccuuca

SEQ ID NO: 4181748 - RNA, 21 nt, Yersinia pestis KIM
caguucgauauuauucucuac

SEQ ID NO: 4181749 - RNA, 15 nt, Yersinia pestis KIM
caguucgcgugcgcc

SEQ ID NO: 4181750 - RNA, 13 nt, Yersinia pestis KIM
caguucuggcucu

SEQ ID NO: 4181751 - RNA, 17 nt, Yersinia pestis KIM
caguugauugcaaaaca

SEQ ID NO: 4181752 - RNA, 15 nt, Yersinia pestis KIM
caguugcacaccauc

SEQ ID NO: 4181753 - RNA, 22 nt, Yersinia pestis KIM
caguugcacaccaucaguacgg

SEQ ID NO: 4181754 - RNA, 12 nt, Yersinia pestis KIM
caguugccacuc

SEQ ID NO: 4181755 - RNA, 14 nt, Yersinia pestis KIM
caguugcugauucu

SEQ ID NO: 4181756 - RNA, 14 nt, Yersinia pestis KIM
caguuggccaccau

SEQ ID NO: 4181757 - RNA, 24 nt, Yersinia pestis KIM
caguuggcgcacguucccaggcca

SEQ ID NO: 4181758 - RNA, 16 nt, Yersinia pestis KIM
caguugguuagagcac

SEQ ID NO: 4181759 - RNA, 14 nt, Yersinia pestis KIM
caguugucuauuuu

SEQ ID NO: 4181760 - RNA, 14 nt, Yersinia pestis KIM
caguugucugaggc

SEQ ID NO: 4181761 - RNA, 15 nt, Yersinia pestis KIM
caguuguucaccuac

SEQ ID NO: 4181762 - RNA, 22 nt, Yersinia pestis KIM
caguuuacggugauuccuggcc

SEQ ID NO: 4181763 - RNA, 16 nt, Yersinia pestis KIM
caguuuauuuucccuu

SEQ ID NO: 4181764 - RNA, 22 nt, Yersinia pestis KIM
caguuuauuuucccuuucucag

SEQ ID NO: 4181765 - RNA, 17 nt, Yersinia pestis KIM
caguuucacccucugcg

SEQ ID NO: 4181766 - RNA, 17 nt, Yersinia pestis KIM
caguuuggcugccaugg

SEQ ID NO: 4181767 - RNA, 13 nt, Yersinia pestis KIM
caguuuugccgug

SEQ ID NO: 4181768 - RNA, 18 nt, Yersinia pestis KIM
caguuuuuaauuuaaacu

SEQ ID NO: 4181769 - RNA, 22 nt, Yersinia pestis KIM
caguuuuuaauuuaaacucuuu

SEQ ID NO: 4181770 - RNA, 17 nt, Yersinia pestis KIM
caguuuuuuauggcaua

SEQ ID NO: 4181771 - RNA, 23 nt, Yersinia pestis KIM
caguuuuuuauggcauaaacuga

SEQ ID NO: 4181772 - RNA, 14 nt, Yersinia pestis KIM
caguuuuuucucaa

SEQ ID NO: 4181773 - RNA, 23 nt, Yersinia pestis KIM
cauaaaaaaagaaggguuagcau

SEQ ID NO: 4181774 - RNA, 22 nt, Yersinia pestis KIM
cauaaaaacuaaggggccaaua

SEQ ID NO: 4181775 - RNA, 15 nt, Yersinia pestis KIM
cauaaaaacuucaga

SEQ ID NO: 4181776 - RNA, 13 nt, Yersinia pestis KIM
cauaaaaagaaaa

SEQ ID NO: 4181777 - RNA, 16 nt, Yersinia pestis KIM
cauaaaaagaaaaaaa

SEQ ID NO: 4181778 - RNA, 22 nt, Yersinia pestis KIM
cauaaaaagcgacacuuauugg

SEQ ID NO: 4181779 - RNA, 14 nt, Yersinia pestis KIM
cauaaaaauacaua

SEQ ID NO: 4181780 - RNA, 15 nt, Yersinia pestis KIM
cauaaaaauacauau

SEQ ID NO: 4181781 - RNA, 11 nt, Yersinia pestis KIM
cauaaaagaau

SEQ ID NO: 4181782 - RNA, 16 nt, Yersinia pestis KIM
cauaaaaggauggccc

SEQ ID NO: 4181783 - RNA, 19 nt, Yersinia pestis KIM
cauaaaauaaauaauuugu

SEQ ID NO: 4181784 - RNA, 16 nt, Yersinia pestis KIM
cauaaaauagcccagu

SEQ ID NO: 4181785 - RNA, 18 nt, Yersinia pestis KIM
cauaaacaaguugaacca

SEQ ID NO: 4181786 - RNA, 18 nt, Yersinia pestis KIM
cauaaacacgcaaucaga

SEQ ID NO: 4181787 - RNA, 17 nt, Yersinia pestis KIM
cauaaacggaacucauc

SEQ ID NO: 4181788 - RNA, 15 nt, Yersinia pestis KIM
cauaaacugaaguua

SEQ ID NO: 4181789 - RNA, 23 nt, Yersinia pestis KIM
cauaaacugaaguuaaaaagccu

SEQ ID NO: 4181790 - RNA, 12 nt, Yersinia pestis KIM
cauaaagaaaag

SEQ ID NO: 4181791 - RNA, 21 nt, Yersinia pestis KIM
cauaaagacccaauacaccac

SEQ ID NO: 4181792 - RNA, 15 nt, Yersinia pestis KIM
cauaaagauagccac

SEQ ID NO: 4181793 - RNA, 19 nt, Yersinia pestis KIM
cauaaagcaucagacugcu

SEQ ID NO: 4181794 - RNA, 20 nt, Yersinia pestis KIM
cauaaagcccgcuucaaagg

SEQ ID NO: 4181795 - RNA, 11 nt, Yersinia pestis KIM
cauaaauaaag

SEQ ID NO: 4181796 - RNA, 15 nt, Yersinia pestis KIM
cauaaauaaagauac

SEQ ID NO: 4181797 - RNA, 15 nt, Yersinia pestis KIM
cauaaauaauaaaua

SEQ ID NO: 4181798 - RNA, 20 nt, Yersinia pestis KIM
cauaaauaggugcgccagug

SEQ ID NO: 4181799 - RNA, 18 nt, Yersinia pestis KIM
cauaaauucuagcaacau

SEQ ID NO: 4181800 - RNA, 12 nt, Yersinia pestis KIM
cauaaauuuauc

SEQ ID NO: 4181801 - RNA, 17 nt, Yersinia pestis KIM
cauaacaacgacuccau

SEQ ID NO: 4181802 - RNA, 14 nt, Yersinia pestis KIM
cauaacaauggccg

SEQ ID NO: 4181803 - RNA, 18 nt, Yersinia pestis KIM
cauaacaggugcaguuuc

SEQ ID NO: 4181804 - RNA, 13 nt, Yersinia pestis KIM
cauaaccauugaa

SEQ ID NO: 4181805 - RNA, 16 nt, Yersinia pestis KIM
cauaaccgcuaaggcc

SEQ ID NO: 4181806 - RNA, 17 nt, Yersinia pestis KIM
cauaaccgcuaaggcca

SEQ ID NO: 4181807 - RNA, 18 nt, Yersinia pestis KIM
cauaaccgcuaaggccaa

SEQ ID NO: 4181808 - RNA, 16 nt, Yersinia pestis KIM
cauaacgcuuuuucau

SEQ ID NO: 4181809 - RNA, 15 nt, Yersinia pestis KIM
cauaacugaauacuu

SEQ ID NO: 4181810 - RNA, 16 nt, Yersinia pestis KIM
cauaagacaacgccgc

SEQ ID NO: 4181811 - RNA, 24 nt, Yersinia pestis KIM
cauaagacaccacaucacgcagcg

SEQ ID NO: 4181812 - RNA, 20 nt, Yersinia pestis KIM
cauaagcacgaauuuuauuc

SEQ ID NO: 4181813 - RNA, 21 nt, Yersinia pestis KIM
cauaagcccccguaucaugga

SEQ ID NO: 4181814 - RNA, 12 nt, Yersinia pestis KIM
cauaagccgcag

SEQ ID NO: 4181815 - RNA, 19 nt, Yersinia pestis KIM
cauaagcgacgacauuaau

SEQ ID NO: 4181816 - RNA, 18 nt, Yersinia pestis KIM
cauaauaaugauuauuga

SEQ ID NO: 4181817 - RNA, 23 nt, Yersinia pestis KIM
cauaauaaugauuauugaccaga

SEQ ID NO: 4181818 - RNA, 16 nt, Yersinia pestis KIM
cauaauauagcugaau

SEQ ID NO: 4181819 - RNA, 21 nt, Yersinia pestis KIM
cauaaucaacgcucaaucacg

SEQ ID NO: 4181820 - RNA, 14 nt, Yersinia pestis KIM
cauaaucagccugc

SEQ ID NO: 4181821 - RNA, 18 nt, Yersinia pestis KIM
cauaaucaguacaucaau

SEQ ID NO: 4181822 - RNA, 17 nt, Yersinia pestis KIM
cauaauccucaaccuga

SEQ ID NO: 4181823 - RNA, 16 nt, Yersinia pestis KIM
cauaaucuuuacugca

SEQ ID NO: 4181824 - RNA, 20 nt, Yersinia pestis KIM
cauaaugcauccacuuuuuc

SEQ ID NO: 4181825 - RNA, 16 nt, Yersinia pestis KIM
cauaaugccggcggcc

SEQ ID NO: 4181826 - RNA, 23 nt, Yersinia pestis KIM
cauaaugcggcucucuuucucca

SEQ ID NO: 4181827 - RNA, 16 nt, Yersinia pestis KIM
cauaauuccacauaaa

SEQ ID NO: 4181828 - RNA, 18 nt, Yersinia pestis KIM
cauaauuccacauaaaau

SEQ ID NO: 4181829 - RNA, 23 nt, Yersinia pestis KIM
cauaauucugccgacuaauauuu

SEQ ID NO: 4181830 - RNA, 18 nt, Yersinia pestis KIM
cauacagcucaucaccaa

SEQ ID NO: 4181831 - RNA, 24 nt, Yersinia pestis KIM
cauacaucgcuggacgcaucagau

SEQ ID NO: 4181832 - RNA, 16 nt, Yersinia pestis KIM
cauaccauaaggccag

SEQ ID NO: 4181833 - RNA, 17 nt, Yersinia pestis KIM
cauaccauaaggccagg

SEQ ID NO: 4181834 - RNA, 22 nt, Yersinia pestis KIM
cauacccaaauuacggcucagu

SEQ ID NO: 4181835 - RNA, 21 nt, Yersinia pestis KIM
cauacccgcugcuggaaugca

SEQ ID NO: 4181836 - RNA, 20 nt, Yersinia pestis KIM
cauacccugguagcaccaca

SEQ ID NO: 4181837 - RNA, 18 nt, Yersinia pestis KIM
cauaccggguucaaggaa

SEQ ID NO: 4181838 - RNA, 20 nt, Yersinia pestis KIM
cauaccggguucaaggaaac

SEQ ID NO: 4181839 - RNA, 12 nt, Yersinia pestis KIM
cauaccuuaauu

SEQ ID NO: 4181840 - RNA, 20 nt, Yersinia pestis KIM
cauacgcuuaaccagcacuu

SEQ ID NO: 4181841 - RNA, 17 nt, Yersinia pestis KIM
cauacggcgauauuuau

SEQ ID NO: 4181842 - RNA, 23 nt, Yersinia pestis KIM
cauacucagucaucgcuaacccu

SEQ ID NO: 4181843 - RNA, 21 nt, Yersinia pestis KIM
cauacuccauuuuuuugaugc

SEQ ID NO: 4181844 - RNA, 22 nt, Yersinia pestis KIM
cauacucccccauuuccugugu

SEQ ID NO: 4181845 - RNA, 19 nt, Yersinia pestis KIM
cauacuccgcugagcauau

SEQ ID NO: 4181846 - RNA, 21 nt, Yersinia pestis KIM
cauacuccuuaaucguccggu

SEQ ID NO: 4181847 - RNA, 12 nt, Yersinia pestis KIM
cauacucuucca

SEQ ID NO: 4181848 - RNA, 22 nt, Yersinia pestis KIM
cauacuguugugggaucuuggc

SEQ ID NO: 4181849 - RNA, 20 nt, Yersinia pestis KIM
cauacuucgaugauuauuuu

SEQ ID NO: 4181850 - RNA, 17 nt, Yersinia pestis KIM
cauacuuuucauuuccu

SEQ ID NO: 4181851 - RNA, 11 nt, Yersinia pestis KIM
cauagaauacc

SEQ ID NO: 4181852 - RNA, 12 nt, Yersinia pestis KIM
cauagaauuuaa

SEQ ID NO: 4181853 - RNA, 15 nt, Yersinia pestis KIM
cauagacaugagaca

SEQ ID NO: 4181854 - RNA, 20 nt, Yersinia pestis KIM
cauagacaugagacagcgcg

SEQ ID NO: 4181855 - RNA, 21 nt, Yersinia pestis KIM
cauagcccggcucauccgcca

SEQ ID NO: 4181856 - RNA, 18 nt, Yersinia pestis KIM
cauagcgguuuuguuguc

SEQ ID NO: 4181857 - RNA, 15 nt, Yersinia pestis KIM
cauagcgugauuuuu

SEQ ID NO: 4181858 - RNA, 22 nt, Yersinia pestis KIM
caucagaucguuaaacccggca

SEQ ID NO: 4181859 - RNA, 13 nt, Yersinia pestis KIM
caucagaugauga

SEQ ID NO: 4181860 - RNA, 18 nt, Yersinia pestis KIM
caucagcaagugauagau

SEQ ID NO: 4181861 - RNA, 11 nt, Yersinia pestis KIM
caucagcaauu

SEQ ID NO: 4181862 - RNA, 16 nt, Yersinia pestis KIM
caucagcagcaggaau

SEQ ID NO: 4181863 - RNA, 23 nt, Yersinia pestis KIM
caucagcauauuacccaguacug

SEQ ID NO: 4181864 - RNA, 17 nt, Yersinia pestis KIM
caucagcaucaauaaaa

SEQ ID NO: 4181865 - RNA, 16 nt, Yersinia pestis KIM
caucagccagccacug

SEQ ID NO: 4181866 - RNA, 16 nt, Yersinia pestis KIM
caucagcccagcggua

SEQ ID NO: 4181867 - RNA, 17 nt, Yersinia pestis KIM
caucagcccauugcugu

SEQ ID NO: 4181868 - RNA, 11 nt, Yersinia pestis KIM
caucagcgccc

SEQ ID NO: 4181869 - RNA, 18 nt, Yersinia pestis KIM
caucagcgccgccucuuc

SEQ ID NO: 4181870 - RNA, 17 nt, Yersinia pestis KIM
caucagcguuacccaga

SEQ ID NO: 4181871 - RNA, 18 nt, Yersinia pestis KIM
caucaggccuucuuuucu

SEQ ID NO: 4181872 - RNA, 11 nt, Yersinia pestis KIM
caucaggcuua

SEQ ID NO: 4181873 - RNA, 21 nt, Yersinia pestis KIM
caucagggugaccgcacugcc

SEQ ID NO: 4181874 - RNA, 15 nt, Yersinia pestis KIM
caucagguguuguau

SEQ ID NO: 4181875 - RNA, 19 nt, Yersinia pestis KIM
caucagguuguauuuugca

SEQ ID NO: 4181876 - RNA, 14 nt, Yersinia pestis KIM
caucaguaaaauac

SEQ ID NO: 4181877 - RNA, 19 nt, Yersinia pestis KIM
caucaguaauuuuuuguag

SEQ ID NO: 4181878 - RNA, 12 nt, Yersinia pestis KIM
caucaguucacu

SEQ ID NO: 4181879 - RNA, 16 nt, Yersinia pestis KIM
caucaguuuauuguua

SEQ ID NO: 4181880 - RNA, 19 nt, Yersinia pestis KIM
caucaguuuauuguuauuu

SEQ ID NO: 4181881 - RNA, 19 nt, Yersinia pestis KIM
caucauaaaaauacauauc

SEQ ID NO: 4181882 - RNA, 22 nt, Yersinia pestis KIM
caucauaaaggcuaaaccggca

SEQ ID NO: 4181883 - RNA, 13 nt, Yersinia pestis KIM
caucauaacgaau

SEQ ID NO: 4181884 - RNA, 13 nt, Yersinia pestis KIM
caucaucaaugga

SEQ ID NO: 4181885 - RNA, 15 nt, Yersinia pestis KIM
caucaucacaaauaa

SEQ ID NO: 4181886 - RNA, 16 nt, Yersinia pestis KIM
caucaucacaaauaac

SEQ ID NO: 4181887 - RNA, 18 nt, Yersinia pestis KIM
caucaucacauucaaaca

SEQ ID NO: 4181888 - RNA, 21 nt, Yersinia pestis KIM
caucaucacauucaaacacuu

SEQ ID NO: 4181889 - RNA, 12 nt, Yersinia pestis KIM
caucauccauaa

SEQ ID NO: 4181890 - RNA, 13 nt, Yersinia pestis KIM
caucauccauaaa

SEQ ID NO: 4181891 - RNA, 14 nt, Yersinia pestis KIM
caucauccaucaca

SEQ ID NO: 4181892 - RNA, 12 nt, Yersinia pestis KIM
caucaucccagu

SEQ ID NO: 4181893 - RNA, 21 nt, Yersinia pestis KIM
caucaucgguaccgccagaau

SEQ ID NO: 4181894 - RNA, 12 nt, Yersinia pestis KIM
caucaucuucuu

SEQ ID NO: 4181895 - RNA, 14 nt, Yersinia pestis KIM
caucaucuucuuca

SEQ ID NO: 4181896 - RNA, 13 nt, Yersinia pestis KIM
caucaugacaaaa

SEQ ID NO: 4181897 - RNA, 14 nt, Yersinia pestis KIM
caucaugacaaaaa

SEQ ID NO: 4181898 - RNA, 21 nt, Yersinia pestis KIM
caucaugguuucgcaggauug

SEQ ID NO: 4181899 - RNA, 21 nt, Yersinia pestis KIM
caucauuagccguaaugacuc

SEQ ID NO: 4181900 - RNA, 21 nt, Yersinia pestis KIM
caucauucauuuuaaaaaaau

SEQ ID NO: 4181901 - RNA, 16 nt, Yersinia pestis KIM
caucauuguuuacuau

SEQ ID NO: 4181902 - RNA, 14 nt, Yersinia pestis KIM
caucauuugagcug

SEQ ID NO: 4181903 - RNA, 22 nt, Yersinia pestis KIM
caucauuuuuuaucuuguaaau

SEQ ID NO: 4181904 - RNA, 17 nt, Yersinia pestis KIM
cauccaaauagccuugc

SEQ ID NO: 4181905 - RNA, 23 nt, Yersinia pestis KIM
cauccaacguaaacauuggcuuu

SEQ ID NO: 4181906 - RNA, 20 nt, Yersinia pestis KIM
cauccaauaccaccaaugcg

SEQ ID NO: 4181907 - RNA, 20 nt, Yersinia pestis KIM
cauccaauuuuuucaucaua

SEQ ID NO: 4181908 - RNA, 12 nt, Yersinia pestis KIM
cauccacaucuu

SEQ ID NO: 4181909 - RNA, 14 nt, Yersinia pestis KIM
cauccacgcaggca

SEQ ID NO: 4181910 - RNA, 15 nt, Yersinia pestis KIM
cauccacugcggcca

SEQ ID NO: 4181911 - RNA, 16 nt, Yersinia pestis KIM
cauccagauucagacg

SEQ ID NO: 4181912 - RNA, 15 nt, Yersinia pestis KIM
cauccagcucauaua

SEQ ID NO: 4181913 - RNA, 15 nt, Yersinia pestis KIM
cauccaguaagcugu

SEQ ID NO: 4181914 - RNA, 13 nt, Yersinia pestis KIM
cauccagugccaa

SEQ ID NO: 4181915 - RNA, 14 nt, Yersinia pestis KIM
cauccagugccaac

SEQ ID NO: 4181916 - RNA, 14 nt, Yersinia pestis KIM
cauccauuguauug

SEQ ID NO: 4181917 - RNA, 20 nt, Yersinia pestis KIM
cauccauuguauugcucagg

SEQ ID NO: 4181918 - RNA, 20 nt, Yersinia pestis KIM
caucccagucgucuucagcu

SEQ ID NO: 4181919 - RNA, 22 nt, Yersinia pestis KIM
cauccccaaacgcugaccaugg

SEQ ID NO: 4181920 - RNA, 16 nt, Yersinia pestis KIM
cauccccaucgccaau

SEQ ID NO: 4181921 - RNA, 22 nt, Yersinia pestis KIM
caucccgguugcgauacagcgc

SEQ ID NO: 4181922 - RNA, 18 nt, Yersinia pestis KIM
caucccuaaaaucauuga

SEQ ID NO: 4181923 - RNA, 21 nt, Yersinia pestis KIM
caucccuucgcaaaaugccaa

SEQ ID NO: 4181924 - RNA, 18 nt, Yersinia pestis KIM
caucccuugacugaccau

SEQ ID NO: 4181925 - RNA, 13 nt, Yersinia pestis KIM
cauccgaugaaau

SEQ ID NO: 4181926 - RNA, 23 nt, Yersinia pestis KIM
cauccgggaaccccuucaggcca

SEQ ID NO: 4181927 - RNA, 16 nt, Yersinia pestis KIM
cauccguucccacuuc

SEQ ID NO: 4181928 - RNA, 13 nt, Yersinia pestis KIM
cauccuaaaaagc

SEQ ID NO: 4181929 - RNA, 16 nt, Yersinia pestis KIM
cauccuaaagauaauu

SEQ ID NO: 4181930 - RNA, 22 nt, Yersinia pestis KIM
cauccuaaagauaauuaauuca

SEQ ID NO: 4181931 - RNA, 15 nt, Yersinia pestis KIM
cauccucaggaugga

SEQ ID NO: 4181932 - RNA, 23 nt, Yersinia pestis KIM
cauccuccugaucuucauugccu

SEQ ID NO: 4181933 - RNA, 19 nt, Yersinia pestis KIM
cauccugaauccccgcuuc

SEQ ID NO: 4181934 - RNA, 14 nt, Yersinia pestis KIM
cauccugcaaauuu

SEQ ID NO: 4181935 - RNA, 16 nt, Yersinia pestis KIM
caucgagaauaaauau

SEQ ID NO: 4181936 - RNA, 19 nt, Yersinia pestis KIM
caucgagcgggcuucacca

SEQ ID NO: 4181937 - RNA, 20 nt, Yersinia pestis KIM
caucgaguccguuaaaaaau

SEQ ID NO: 4181938 - RNA, 21 nt, Yersinia pestis KIM
caucgaguccguuaaaaaauu

SEQ ID NO: 4181939 - RNA, 19 nt, Yersinia pestis KIM
caucgccaaagccgucagu

SEQ ID NO: 4181940 - RNA, 13 nt, Yersinia pestis KIM
caucgccagcggg

SEQ ID NO: 4181941 - RNA, 19 nt, Yersinia pestis KIM
caucgccaguaaaaacuca

SEQ ID NO: 4181942 - RNA, 14 nt, Yersinia pestis KIM
caucgccaguguug

SEQ ID NO: 4181943 - RNA, 18 nt, Yersinia pestis KIM
caucgcccugaguaacga

SEQ ID NO: 4181944 - RNA, 21 nt, Yersinia pestis KIM
caucgccgacaaaauccccca

SEQ ID NO: 4181945 - RNA, 15 nt, Yersinia pestis KIM
caucgcgcuuuuuag

SEQ ID NO: 4181946 - RNA, 18 nt, Yersinia pestis KIM
caucgcgggcgcgcugcu

SEQ ID NO: 4181947 - RNA, 16 nt, Yersinia pestis KIM
caucgcucaucgccaa

SEQ ID NO: 4181948 - RNA, 21 nt, Yersinia pestis KIM
caucgcugcaauaaagcguca

SEQ ID NO: 4181949 - RNA, 22 nt, Yersinia pestis KIM
caucgcuugauaacacauuauu

SEQ ID NO: 4181950 - RNA, 15 nt, Yersinia pestis KIM
caucggauaauguua

SEQ ID NO: 4181951 - RNA, 22 nt, Yersinia pestis KIM
caucggauugcaacaacgccag

SEQ ID NO: 4181952 - RNA, 19 nt, Yersinia pestis KIM
caucggcguuacaguaagg

SEQ ID NO: 4181953 - RNA, 22 nt, Yersinia pestis KIM
caucgggaacaggaucugcucc

SEQ ID NO: 4181954 - RNA, 23 nt, Yersinia pestis KIM
caucgggaacaggaucugcuccu

SEQ ID NO: 4181955 - RNA, 19 nt, Yersinia pestis KIM
caucgggguuugucagcag

SEQ ID NO: 4181956 - RNA, 23 nt, Yersinia pestis KIM
caucgguaaaucgcccaauguca

SEQ ID NO: 4181957 - RNA, 18 nt, Yersinia pestis KIM
caucgguaauacucuggc

SEQ ID NO: 4181958 - RNA, 22 nt, Yersinia pestis KIM
caucggucauuuuacgccuggc

SEQ ID NO: 4181959 - RNA, 19 nt, Yersinia pestis KIM
caucgucacgaucaaccau

SEQ ID NO: 4181960 - RNA, 15 nt, Yersinia pestis KIM
caucgucagccccug

SEQ ID NO: 4181961 - RNA, 21 nt, Yersinia pestis KIM
caucgucgcuguuacccaugg

SEQ ID NO: 4181962 - RNA, 24 nt, Yersinia pestis KIM
caucgucucugcauuacaacuuga

SEQ ID NO: 4181963 - RNA, 12 nt, Yersinia pestis KIM
caucguggcuuu

SEQ ID NO: 4181964 - RNA, 21 nt, Yersinia pestis KIM
caucuaugcuauccagaucgc

SEQ ID NO: 4181965 - RNA, 15 nt, Yersinia pestis KIM
caucucacauagcug

SEQ ID NO: 4181966 - RNA, 16 nt, Yersinia pestis KIM
caucuccagaauauaa

SEQ ID NO: 4181967 - RNA, 18 nt, Yersinia pestis KIM
caucuccagaauauaaaa

SEQ ID NO: 4181968 - RNA, 19 nt, Yersinia pestis KIM
caucuccagaauauaaaag

SEQ ID NO: 4181969 - RNA, 16 nt, Yersinia pestis KIM
caucuccgcuauuuuc

SEQ ID NO: 4181970 - RNA, 13 nt, Yersinia pestis KIM
caucuccugguuc

SEQ ID NO: 4181971 - RNA, 23 nt, Yersinia pestis KIM
caucugaccagugagccaugugu

SEQ ID NO: 4181972 - RNA, 22 nt, Yersinia pestis KIM
caucugcuccaggcgcucaggu

SEQ ID NO: 4181973 - RNA, 22 nt, Yersinia pestis KIM
cauuaaugcagguucauuacac

SEQ ID NO: 4181974 - RNA, 17 nt, Yersinia pestis KIM
cauuaauuaauaagccc

SEQ ID NO: 4181975 - RNA, 17 nt, Yersinia pestis KIM
cauuaauuaaucagaca

SEQ ID NO: 4181976 - RNA, 18 nt, Yersinia pestis KIM
cauuaauuuaucugcuaa

SEQ ID NO: 4181977 - RNA, 13 nt, Yersinia pestis KIM
cauuaauuucacc

SEQ ID NO: 4181978 - RNA, 15 nt, Yersinia pestis KIM
cauuaauuucaccac

SEQ ID NO: 4181979 - RNA, 17 nt, Yersinia pestis KIM
cauuacaagugccaaau

SEQ ID NO: 4181980 - RNA, 11 nt, Yersinia pestis KIM
cauuacaccau

SEQ ID NO: 4181981 - RNA, 13 nt, Yersinia pestis KIM
cauuacaucaucu

SEQ ID NO: 4181982 - RNA, 14 nt, Yersinia pestis KIM
cauuacauccuuag

SEQ ID NO: 4181983 - RNA, 15 nt, Yersinia pestis KIM
cauuaccaauaccau

SEQ ID NO: 4181984 - RNA, 23 nt, Yersinia pestis KIM
cauuaccccguugcucuacacag

SEQ ID NO: 4181985 - RNA, 22 nt, Yersinia pestis KIM
cauuacccuguuuuaaaugcca

SEQ ID NO: 4181986 - RNA, 20 nt, Yersinia pestis KIM
cauuaccgcacacuacagcc

SEQ ID NO: 4181987 - RNA, 18 nt, Yersinia pestis KIM
cauuaccuuggugagaac

SEQ ID NO: 4181988 - RNA, 13 nt, Yersinia pestis KIM
cauuaccuuuaaa

SEQ ID NO: 4181989 - RNA, 20 nt, Yersinia pestis KIM
cauuacugaugcguugugau

SEQ ID NO: 4181990 - RNA, 20 nt, Yersinia pestis KIM
cauuacugcggaucaaccgc

SEQ ID NO: 4181991 - RNA, 21 nt, Yersinia pestis KIM
cauuacugcguucuucuugug

SEQ ID NO: 4181992 - RNA, 17 nt, Yersinia pestis KIM
cauuacugucuuuuaau

SEQ ID NO: 4181993 - RNA, 19 nt, Yersinia pestis KIM
cauuagccccaaaugccag

SEQ ID NO: 4181994 - RNA, 21 nt, Yersinia pestis KIM
cauuagcguugccgccgggca

SEQ ID NO: 4181995 - RNA, 20 nt, Yersinia pestis KIM
cauuaguaaugggaucaaau

SEQ ID NO: 4181996 - RNA, 16 nt, Yersinia pestis KIM
cauuagucugaggcca

SEQ ID NO: 4181997 - RNA, 16 nt, Yersinia pestis KIM
cauuauaaauaauuaa

SEQ ID NO: 4181998 - RNA, 22 nt, Yersinia pestis KIM
cauuauauuauuuaucaaucag

SEQ ID NO: 4181999 - RNA, 19 nt, Yersinia pestis KIM
cauuauccggccauuuuuu

SEQ ID NO: 4182000 - RNA, 19 nt, Yersinia pestis KIM
cauuauccguuugcaacau

SEQ ID NO: 4182001 - RNA, 21 nt, Yersinia pestis KIM
cauuaucuaaacaauugccuu

SEQ ID NO: 4182002 - RNA, 23 nt, Yersinia pestis KIM
cauuaucuaaacaauugccuuug

SEQ ID NO: 4182003 - RNA, 15 nt, Yersinia pestis KIM
cauuaucugaaagca

SEQ ID NO: 4182004 - RNA, 14 nt, Yersinia pestis KIM
cauuaucuuuaauu

SEQ ID NO: 4182005 - RNA, 18 nt, Yersinia pestis KIM
cauuaucuuuaauuuuuc

SEQ ID NO: 4182006 - RNA, 15 nt, Yersinia pestis KIM
cauuauuaaacugau

SEQ ID NO: 4182007 - RNA, 20 nt, Yersinia pestis KIM
cauuauucaugaugccgagu

SEQ ID NO: 4182008 - RNA, 19 nt, Yersinia pestis KIM
cauuauucuaggcaugaau

SEQ ID NO: 4182009 - RNA, 17 nt, Yersinia pestis KIM
cauuauugaacgcuugc

SEQ ID NO: 4182010 - RNA, 19 nt, Yersinia pestis KIM
cauuauugaacgcuugcaa

SEQ ID NO: 4182011 - RNA, 17 nt, Yersinia pestis KIM
cauuauuuauagguaua

SEQ ID NO: 4182012 - RNA, 12 nt, Yersinia pestis KIM
cauucaaguaaa

SEQ ID NO: 4182013 - RNA, 18 nt, Yersinia pestis KIM
cauucagcacccaacuua

SEQ ID NO: 4182014 - RNA, 18 nt, Yersinia pestis KIM
cauucagcgucuucaauu

SEQ ID NO: 4182015 - RNA, 15 nt, Yersinia pestis KIM
cauucaugaggcuca

SEQ ID NO: 4182016 - RNA, 19 nt, Yersinia pestis KIM
cauucaugaggcucagacu

SEQ ID NO: 4182017 - RNA, 16 nt, Yersinia pestis KIM
cauucaugaggcuucu

SEQ ID NO: 4182018 - RNA, 14 nt, Yersinia pestis KIM
cauucauuuuaaaa

SEQ ID NO: 4182019 - RNA, 16 nt, Yersinia pestis KIM
cauucauuuuaaaaaa

SEQ ID NO: 4182020 - RNA, 16 nt, Yersinia pestis KIM
cauuccaguaaaaaaa

SEQ ID NO: 4182021 - RNA, 16 nt, Yersinia pestis KIM
cauuccccaucgccaa

SEQ ID NO: 4182022 - RNA, 21 nt, Yersinia pestis KIM
cauucccccggauauuuuuuu

SEQ ID NO: 4182023 - RNA, 21 nt, Yersinia pestis KIM
cauuccugguuuuaccaucac

SEQ ID NO: 4182024 - RNA, 17 nt, Yersinia pestis KIM
cauucgauagaaacauc

SEQ ID NO: 4182025 - RNA, 15 nt, Yersinia pestis KIM
cauucgccugauaaa

SEQ ID NO: 4182026 - RNA, 17 nt, Yersinia pestis KIM
cauucgccugauaaaau

SEQ ID NO: 4182027 - RNA, 20 nt, Yersinia pestis KIM
cauucuaguuugugcugcua

SEQ ID NO: 4182028 - RNA, 23 nt, Yersinia pestis KIM
cauucuaguuugugcugcuaaua

SEQ ID NO: 4182029 - RNA, 16 nt, Yersinia pestis KIM
cauucuaucauccuug

SEQ ID NO: 4182030 - RNA, 23 nt, Yersinia pestis KIM
cauucucuacucgcucaccacug

SEQ ID NO: 4182031 - RNA, 14 nt, Yersinia pestis KIM
cauucucuuuuaau

SEQ ID NO: 4182032 - RNA, 19 nt, Yersinia pestis KIM
cauucugauagugauuuuu

SEQ ID NO: 4182033 - RNA, 20 nt, Yersinia pestis KIM
cauucugauagugauuuuuu

SEQ ID NO: 4182034 - RNA, 15 nt, Yersinia pestis KIM
cauucugucaucaag

SEQ ID NO: 4182035 - RNA, 19 nt, Yersinia pestis KIM
cauucuuuuuguuaaaaua

SEQ ID NO: 4182036 - RNA, 22 nt, Yersinia pestis KIM
cauugaauggugcuguauuuaa

SEQ ID NO: 4182037 - RNA, 13 nt, Yersinia pestis KIM
cauugaccagauu

SEQ ID NO: 4182038 - RNA, 13 nt, Yersinia pestis KIM
cauugaccgccaa

SEQ ID NO: 4182039 - RNA, 13 nt, Yersinia pestis KIM
cauugacguuaca

SEQ ID NO: 4182040 - RNA, 20 nt, Yersinia pestis KIM
cauugagcgccacaucggcg

SEQ ID NO: 4182041 - RNA, 22 nt, Yersinia pestis KIM
cauugagcgccacaucggcguu

SEQ ID NO: 4182042 - RNA, 16 nt, Yersinia pestis KIM
cauugaggagcgauaa

SEQ ID NO: 4182043 - RNA, 19 nt, Yersinia pestis KIM
cauugaggguugucagcag

SEQ ID NO: 4182044 - RNA, 20 nt, Yersinia pestis KIM
cauugaggguugucagcagu

SEQ ID NO: 4182045 - RNA, 19 nt, Yersinia pestis KIM
cauugauaagccauuuuuu

SEQ ID NO: 4182046 - RNA, 14 nt, Yersinia pestis KIM
cauugauaauaaua

SEQ ID NO: 4182047 - RNA, 14 nt, Yersinia pestis KIM
cauugauccucguu

SEQ ID NO: 4182048 - RNA, 18 nt, Yersinia pestis KIM
cauugauccucguuaguc

SEQ ID NO: 4182049 - RNA, 16 nt, Yersinia pestis KIM
cauugcaaacaucaca

SEQ ID NO: 4182050 - RNA, 20 nt, Yersinia pestis KIM
cauugccagugaacccgcca

SEQ ID NO: 4182051 - RNA, 16 nt, Yersinia pestis KIM
cauugccgaugucaau

SEQ ID NO: 4182052 - RNA, 17 nt, Yersinia pestis KIM
cauugcguaauuaccca

SEQ ID NO: 4182053 - RNA, 12 nt, Yersinia pestis KIM
cauugcuaaauu

SEQ ID NO: 4182054 - RNA, 20 nt, Yersinia pestis KIM
cauugcuccuguauauuguu

SEQ ID NO: 4182055 - RNA, 20 nt, Yersinia pestis KIM
cauuggauaauuugccuggc

SEQ ID NO: 4182056 - RNA, 16 nt, Yersinia pestis KIM
cauuggcaaaggccag

SEQ ID NO: 4182057 - RNA, 13 nt, Yersinia pestis KIM
cauuggcacaaag

SEQ ID NO: 4182058 - RNA, 20 nt, Yersinia pestis KIM
cauuggcugguaauucgcua

SEQ ID NO: 4182059 - RNA, 18 nt, Yersinia pestis KIM
cauuggcuugguuguuuc

SEQ ID NO: 4182060 - RNA, 21 nt, Yersinia pestis KIM
cauuggcuuuuugcuggaacu

SEQ ID NO: 4182061 - RNA, 14 nt, Yersinia pestis KIM
cauugguaauaaug

SEQ ID NO: 4182062 - RNA, 13 nt, Yersinia pestis KIM
cauugucaccuaa

SEQ ID NO: 4182063 - RNA, 23 nt, Yersinia pestis KIM
cauugucaccuaaccaaacauug

SEQ ID NO: 4182064 - RNA, 13 nt, Yersinia pestis KIM
cauugucaccuga

SEQ ID NO: 4182065 - RNA, 20 nt, Yersinia pestis KIM
cauuguccucaagauuaucc

SEQ ID NO: 4182066 - RNA, 15 nt, Yersinia pestis KIM
cauugucugcuggcc

SEQ ID NO: 4182067 - RNA, 16 nt, Yersinia pestis KIM
cauugugauauaacga

SEQ ID NO: 4182068 - RNA, 14 nt, Yersinia pestis KIM
cauugugcuuuuug

SEQ ID NO: 4182069 - RNA, 12 nt, Yersinia pestis KIM
cauuguggagga

SEQ ID NO: 4182070 - RNA, 17 nt, Yersinia pestis KIM
cauuguggcuaaaccca

SEQ ID NO: 4182071 - RNA, 19 nt, Yersinia pestis KIM
cauuuaagccaauaauaua

SEQ ID NO: 4182072 - RNA, 21 nt, Yersinia pestis KIM
cauuuaauaacuuaaauaauu

SEQ ID NO: 4182073 - RNA, 15 nt, Yersinia pestis KIM
cauuuaauucaguua

SEQ ID NO: 4182074 - RNA, 14 nt, Yersinia pestis KIM
cauuuacuuauaaa

SEQ ID NO: 4182075 - RNA, 15 nt, Yersinia pestis KIM
cauuuagcauuauuc

SEQ ID NO: 4182076 - RNA, 21 nt, Yersinia pestis KIM
cauuuagggcagacggggagg

SEQ ID NO: 4182077 - RNA, 19 nt, Yersinia pestis KIM
cauuuaucauauuaacaua

SEQ ID NO: 4182078 - RNA, 14 nt, Yersinia pestis KIM
cauuuaucuaaaac

SEQ ID NO: 4182079 - RNA, 18 nt, Yersinia pestis KIM
cauuuauuacauuuacau

SEQ ID NO: 4182080 - RNA, 12 nt, Yersinia pestis KIM
cauuuauuucca

SEQ ID NO: 4182081 - RNA, 13 nt, Yersinia pestis KIM
cauuuauuuccac

SEQ ID NO: 4182082 - RNA, 21 nt, Yersinia pestis KIM
cauuuauuuccacgacaugag

SEQ ID NO: 4182083 - RNA, 16 nt, Yersinia pestis KIM
cauuucaaccucaauu

SEQ ID NO: 4182084 - RNA, 19 nt, Yersinia pestis KIM
cauuucaaccucaauuuac

SEQ ID NO: 4182085 - RNA, 21 nt, Yersinia pestis KIM
cauuucaggacugucuucaac

SEQ ID NO: 4182086 - RNA, 21 nt, Yersinia pestis KIM
cauuucauagaacuuaagcaa

SEQ ID NO: 4182087 - RNA, 22 nt, Yersinia pestis KIM
cauuucauagaacuuaagcaau

SEQ ID NO: 4182088 - RNA, 13 nt, Yersinia pestis KIM
ccaagaaacgccc

SEQ ID NO: 4182089 - RNA, 22 nt, Yersinia pestis KIM
ccaagaaacgccccgauaaacc

SEQ ID NO: 4182090 - RNA, 18 nt, Yersinia pestis KIM
ccaagaagauaacuuuuu

SEQ ID NO: 4182091 - RNA, 12 nt, Yersinia pestis KIM
ccaagacugaag

SEQ ID NO: 4182092 - RNA, 15 nt, Yersinia pestis KIM
ccaagagaaacccau

SEQ ID NO: 4182093 - RNA, 13 nt, Yersinia pestis KIM
ccaagaggcugcg

SEQ ID NO: 4182094 - RNA, 19 nt, Yersinia pestis KIM
ccaagaguacuaacgucaa

SEQ ID NO: 4182095 - RNA, 17 nt, Yersinia pestis KIM
ccaagauaccgaguucu

SEQ ID NO: 4182096 - RNA, 24 nt, Yersinia pestis KIM
ccaagauuuuuagcgugccgcagu

SEQ ID NO: 4182097 - RNA, 14 nt, Yersinia pestis KIM
ccaagcggcagggg

SEQ ID NO: 4182098 - RNA, 14 nt, Yersinia pestis KIM
ccaagcuuaauauu

SEQ ID NO: 4182099 - RNA, 21 nt, Yersinia pestis KIM
ccaagcuuuugccacauuucc

SEQ ID NO: 4182100 - RNA, 17 nt, Yersinia pestis KIM
ccaaggagaucgcucuc

SEQ ID NO: 4182101 - RNA, 15 nt, Yersinia pestis KIM
ccaaggauggcgcgg

SEQ ID NO: 4182102 - RNA, 23 nt, Yersinia pestis KIM
ccaaggauggcgcggcucgagcc

SEQ ID NO: 4182103 - RNA, 20 nt, Yersinia pestis KIM
ccaaggcgacuuugaugcca

SEQ ID NO: 4182104 - RNA, 15 nt, Yersinia pestis KIM
ccaagguuauacacu

SEQ ID NO: 4182105 - RNA, 18 nt, Yersinia pestis KIM
ccaaguaaaaaaaaccug

SEQ ID NO: 4182106 - RNA, 19 nt, Yersinia pestis KIM
ccaaguaugauaaugccuu

SEQ ID NO: 4182107 - RNA, 20 nt, Yersinia pestis KIM
ccaaguccacgggcucaugc

SEQ ID NO: 4182108 - RNA, 15 nt, Yersinia pestis KIM
ccaaguccuccuuga

SEQ ID NO: 4182109 - RNA, 23 nt, Yersinia pestis KIM
ccaaguuuacuuuguauuuugca

SEQ ID NO: 4182110 - RNA, 13 nt, Yersinia pestis KIM
ccaauaaaaggua

SEQ ID NO: 4182111 - RNA, 19 nt, Yersinia pestis KIM
ccaauaaagcucugacaaa

SEQ ID NO: 4182112 - RNA, 23 nt, Yersinia pestis KIM
ccaauaaagcucugacaaaaugc

SEQ ID NO: 4182113 - RNA, 14 nt, Yersinia pestis KIM
ccaauaacguccug

SEQ ID NO: 4182114 - RNA, 15 nt, Yersinia pestis KIM
ccaauaagauaaaca

SEQ ID NO: 4182115 - RNA, 20 nt, Yersinia pestis KIM
ccaauaagugaaacaaauac

SEQ ID NO: 4182116 - RNA, 19 nt, Yersinia pestis KIM
ccaauaauaaaaaaaaaua

SEQ ID NO: 4182117 - RNA, 17 nt, Yersinia pestis KIM
ccaauaauaauccauaa

SEQ ID NO: 4182118 - RNA, 10 nt, Yersinia pestis KIM
ccaauaaugc

SEQ ID NO: 4182119 - RNA, 16 nt, Yersinia pestis KIM
ccaauaaugccgaaug

SEQ ID NO: 4182120 - RNA, 14 nt, Yersinia pestis KIM
ccaauacaaucguc

SEQ ID NO: 4182121 - RNA, 16 nt, Yersinia pestis KIM
ccaauagaaaaacacu

SEQ ID NO: 4182122 - RNA, 22 nt, Yersinia pestis KIM
ccaauagaaaaacacuggcagc

SEQ ID NO: 4182123 - RNA, 16 nt, Yersinia pestis KIM
ccaauagacaaaagug

SEQ ID NO: 4182124 - RNA, 15 nt, Yersinia pestis KIM
ccaauagaggcuccc

SEQ ID NO: 4182125 - RNA, 16 nt, Yersinia pestis KIM
ccaauagaggcuccca

SEQ ID NO: 4182126 - RNA, 16 nt, Yersinia pestis KIM
ccaauagaggcucccu

SEQ ID NO: 4182127 - RNA, 13 nt, Yersinia pestis KIM
ccaauauccauau

SEQ ID NO: 4182128 - RNA, 21 nt, Yersinia pestis KIM
ccaauaucuguggugacauga

SEQ ID NO: 4182129 - RNA, 14 nt, Yersinia pestis KIM
ccaauauugaguaa

SEQ ID NO: 4182130 - RNA, 13 nt, Yersinia pestis KIM
ccaaucaaaaaac

SEQ ID NO: 4182131 - RNA, 13 nt, Yersinia pestis KIM
ccaaucaucaucc

SEQ ID NO: 4182132 - RNA, 18 nt, Yersinia pestis KIM
ccaaucaucaucccaguc

SEQ ID NO: 4182133 - RNA, 20 nt, Yersinia pestis KIM
ccaaucauucugucaucaag

SEQ ID NO: 4182134 - RNA, 16 nt, Yersinia pestis KIM
ccaauccaugccagcc

SEQ ID NO: 4182135 - RNA, 14 nt, Yersinia pestis KIM
ccaauccccaccaa

SEQ ID NO: 4182136 - RNA, 16 nt, Yersinia pestis KIM
ccaaucgaaccgauac

SEQ ID NO: 4182137 - RNA, 18 nt, Yersinia pestis KIM
ccaaucgauaauauuauu

SEQ ID NO: 4182138 - RNA, 18 nt, Yersinia pestis KIM
ccaaucggccuuaaccaa

SEQ ID NO: 4182139 - RNA, 13 nt, Yersinia pestis KIM
ccaaucucaaagc

SEQ ID NO: 4182140 - RNA, 15 nt, Yersinia pestis KIM
ccaaucucaaagcaa

SEQ ID NO: 4182141 - RNA, 20 nt, Yersinia pestis KIM
ccaaugaguagcuguagcca

SEQ ID NO: 4182142 - RNA, 14 nt, Yersinia pestis KIM
ccaaugaugacuug

SEQ ID NO: 4182143 - RNA, 13 nt, Yersinia pestis KIM
ccaaugauuaacg

SEQ ID NO: 4182144 - RNA, 20 nt, Yersinia pestis KIM
ccaaugcacguaaagaguua

SEQ ID NO: 4182145 - RNA, 19 nt, Yersinia pestis KIM
ccaaugcauccaagccauc

SEQ ID NO: 4182146 - RNA, 13 nt, Yersinia pestis KIM
ccaaugccgugcg

SEQ ID NO: 4182147 - RNA, 16 nt, Yersinia pestis KIM
ccaaugccucuucaau

SEQ ID NO: 4182148 - RNA, 11 nt, Yersinia pestis KIM
ccaaugcuuuu

SEQ ID NO: 4182149 - RNA, 16 nt, Yersinia pestis KIM
ccaauggcaacaaaau

SEQ ID NO: 4182150 - RNA, 20 nt, Yersinia pestis KIM
ccaauggucaguuguucacc

SEQ ID NO: 4182151 - RNA, 15 nt, Yersinia pestis KIM
ccaauguaugaccgg

SEQ ID NO: 4182152 - RNA, 19 nt, Yersinia pestis KIM
ccaauguugcugaauaaau

SEQ ID NO: 4182153 - RNA, 18 nt, Yersinia pestis KIM
ccaauucacgcaaggcca

SEQ ID NO: 4182154 - RNA, 22 nt, Yersinia pestis KIM
ccaauucacgcagguaguuagu

SEQ ID NO: 4182155 - RNA, 21 nt, Yersinia pestis KIM
ccaauucacgccuaucucgac

SEQ ID NO: 4182156 - RNA, 18 nt, Yersinia pestis KIM
ccaauucguauuccucaa

SEQ ID NO: 4182157 - RNA, 17 nt, Yersinia pestis KIM
ccaauugacuagcaggu

SEQ ID NO: 4182158 - RNA, 19 nt, Yersinia pestis KIM
ccaauugcaggguauucca

SEQ ID NO: 4182159 - RNA, 15 nt, Yersinia pestis KIM
ccaauuggcuuaacu

SEQ ID NO: 4182160 - RNA, 16 nt, Yersinia pestis KIM
ccaauuguuucuuccc

SEQ ID NO: 4182161 - RNA, 22 nt, Yersinia pestis KIM
ccaauuucucggccaacaucuu

SEQ ID NO: 4182162 - RNA, 13 nt, Yersinia pestis KIM
ccaauuuggccaa

SEQ ID NO: 4182163 - RNA, 18 nt, Yersinia pestis KIM
ccaauuugggcauuaagu

SEQ ID NO: 4182164 - RNA, 24 nt, Yersinia pestis KIM
ccaauuugucguuuacuggcugcc

SEQ ID NO: 4182165 - RNA, 19 nt, Yersinia pestis KIM
ccacaaaggucagcauggu

SEQ ID NO: 4182166 - RNA, 20 nt, Yersinia pestis KIM
ccacaaaggucagcaugguc

SEQ ID NO: 4182167 - RNA, 22 nt, Yersinia pestis KIM
ccacaaccgccacuuuuaccgc

SEQ ID NO: 4182168 - RNA, 15 nt, Yersinia pestis KIM
ccacaaccugcgcca

SEQ ID NO: 4182169 - RNA, 12 nt, Yersinia pestis KIM
ccacaacugaau

SEQ ID NO: 4182170 - RNA, 16 nt, Yersinia pestis KIM
ccacaauaauuaggaa

SEQ ID NO: 4182171 - RNA, 22 nt, Yersinia pestis KIM
ccacaauccgguguuccacaau

SEQ ID NO: 4182172 - RNA, 20 nt, Yersinia pestis KIM
ccacaauggcagagcuuuuc

SEQ ID NO: 4182173 - RNA, 15 nt, Yersinia pestis KIM
ccacacaauacauag

SEQ ID NO: 4182174 - RNA, 21 nt, Yersinia pestis KIM
ccacacaguauucugcuucca

SEQ ID NO: 4182175 - RNA, 24 nt, Yersinia pestis KIM
ccacaccggcugcaauaagccaga

SEQ ID NO: 4182176 - RNA, 21 nt, Yersinia pestis KIM
ccacaccuccgcccucuugcu

SEQ ID NO: 4182177 - RNA, 21 nt, Yersinia pestis KIM
ccacaccuuaucacucgggau

SEQ ID NO: 4182178 - RNA, 21 nt, Yersinia pestis KIM
ccacacugagcaccgcaggaa

SEQ ID NO: 4182179 - RNA, 15 nt, Yersinia pestis KIM
ccacagacuuucuuu

SEQ ID NO: 4182180 - RNA, 18 nt, Yersinia pestis KIM
ccacagcaacaggguaau

SEQ ID NO: 4182181 - RNA, 21 nt, Yersinia pestis KIM
ccacagcaaugcaccgacaaa

SEQ ID NO: 4182182 - RNA, 19 nt, Yersinia pestis KIM
ccacagucgccgucaauuu

SEQ ID NO: 4182183 - RNA, 22 nt, Yersinia pestis KIM
ccacauaaaaagaaaaaaacag

SEQ ID NO: 4182184 - RNA, 19 nt, Yersinia pestis KIM
ccacauaaaauagcccagu

SEQ ID NO: 4182185 - RNA, 22 nt, Yersinia pestis KIM
ccacauaaaauagcccagugcg

SEQ ID NO: 4182186 - RNA, 19 nt, Yersinia pestis KIM
ccacaucaaaccggcuaau

SEQ ID NO: 4182187 - RNA, 14 nt, Yersinia pestis KIM
ccacaucaaccuga

SEQ ID NO: 4182188 - RNA, 17 nt, Yersinia pestis KIM
ccacaucacgcagcgcu

SEQ ID NO: 4182189 - RNA, 13 nt, Yersinia pestis KIM
ccacaucaggccg

SEQ ID NO: 4182190 - RNA, 17 nt, Yersinia pestis KIM
ccacaucgaguggucga

SEQ ID NO: 4182191 - RNA, 21 nt, Yersinia pestis KIM
ccacaucggccccuuaccuac

SEQ ID NO: 4182192 - RNA, 19 nt, Yersinia pestis KIM
ccacaucuugcauccccac

SEQ ID NO: 4182193 - RNA, 20 nt, Yersinia pestis KIM
ccacaugcuuuuuuuaagca

SEQ ID NO: 4182194 - RNA, 14 nt, Yersinia pestis KIM
ccacauucaggccg

SEQ ID NO: 4182195 - RNA, 20 nt, Yersinia pestis KIM
ccacauucaguacauaaacc

SEQ ID NO: 4182196 - RNA, 15 nt, Yersinia pestis KIM
ccacauugaccagau

SEQ ID NO: 4182197 - RNA, 17 nt, Yersinia pestis KIM
ccacauugaucgguuug

SEQ ID NO: 4182198 - RNA, 14 nt, Yersinia pestis KIM
ccaccaaauaaaac

SEQ ID NO: 4182199 - RNA, 16 nt, Yersinia pestis KIM
ccaccaacuccugccu

SEQ ID NO: 4182200 - RNA, 20 nt, Yersinia pestis KIM
ccaccaauagcgaucagcaa

SEQ ID NO: 4182201 - RNA, 14 nt, Yersinia pestis KIM
ccaccacaucaucc

SEQ ID NO: 4182202 - RNA, 22 nt, Yersinia pestis KIM
ccaccacgaaaaaauggcagcc

SEQ ID NO: 4182203 - RNA, 23 nt, Yersinia pestis KIM
ccauauagcggcguucagcaaua

SEQ ID NO: 4182204 - RNA, 22 nt, Yersinia pestis KIM
ccauaucagcgccuucuuguaa

SEQ ID NO: 4182205 - RNA, 17 nt, Yersinia pestis KIM
ccauauccucaagaccg

SEQ ID NO: 4182206 - RNA, 22 nt, Yersinia pestis KIM
ccauauccuggcgguaauaaau

SEQ ID NO: 4182207 - RNA, 18 nt, Yersinia pestis KIM
ccauauguugccaccagc

SEQ ID NO: 4182208 - RNA, 16 nt, Yersinia pestis KIM
ccauauuacucacaca

SEQ ID NO: 4182209 - RNA, 21 nt, Yersinia pestis KIM
ccauauucgcggccugcuguu

SEQ ID NO: 4182210 - RNA, 23 nt, Yersinia pestis KIM
ccauauucgguaaguuggcauca

SEQ ID NO: 4182211 - RNA, 19 nt, Yersinia pestis KIM
ccauauugauauagcggua

SEQ ID NO: 4182212 - RNA, 12 nt, Yersinia pestis KIM
ccaucaaaauau

SEQ ID NO: 4182213 - RNA, 13 nt, Yersinia pestis KIM
ccaucaaaggaga

SEQ ID NO: 4182214 - RNA, 21 nt, Yersinia pestis KIM
ccaucaaauacacauaaccau

SEQ ID NO: 4182215 - RNA, 12 nt, Yersinia pestis KIM
ccaucaaccacg

SEQ ID NO: 4182216 - RNA, 20 nt, Yersinia pestis KIM
ccaucaaccacgacgugcuc

SEQ ID NO: 4182217 - RNA, 21 nt, Yersinia pestis KIM
ccaucaacgcgcauugcgccg

SEQ ID NO: 4182218 - RNA, 14 nt, Yersinia pestis KIM
ccaucaagccaccg

SEQ ID NO: 4182219 - RNA, 18 nt, Yersinia pestis KIM
ccaucaagccaccgcugg

SEQ ID NO: 4182220 - RNA, 15 nt, Yersinia pestis KIM
ccaucaauaaagcug

SEQ ID NO: 4182221 - RNA, 12 nt, Yersinia pestis KIM
ccaucaauaauu

SEQ ID NO: 4182222 - RNA, 13 nt, Yersinia pestis KIM
ccaucaauaccaa

SEQ ID NO: 4182223 - RNA, 15 nt, Yersinia pestis KIM
ccaucacaaaaccuu

SEQ ID NO: 4182224 - RNA, 18 nt, Yersinia pestis KIM
ccaucacaaaaccuuuaa

SEQ ID NO: 4182225 - RNA, 18 nt, Yersinia pestis KIM
ccaucacccgcagugccu

SEQ ID NO: 4182226 - RNA, 21 nt, Yersinia pestis KIM
ccaucagacaggauaaucauc

SEQ ID NO: 4182227 - RNA, 23 nt, Yersinia pestis KIM
ccaucagacaggauaaucaucag

SEQ ID NO: 4182228 - RNA, 16 nt, Yersinia pestis KIM
ccaucagaguccaaua

SEQ ID NO: 4182229 - RNA, 18 nt, Yersinia pestis KIM
ccaucagcauauuaccca

SEQ ID NO: 4182230 - RNA, 15 nt, Yersinia pestis KIM
ccaucagccaacaaa

SEQ ID NO: 4182231 - RNA, 17 nt, Yersinia pestis KIM
ccaucagcgcacugcau

SEQ ID NO: 4182232 - RNA, 23 nt, Yersinia pestis KIM
ccaucaggcuacggcugaucugc

SEQ ID NO: 4182233 - RNA, 17 nt, Yersinia pestis KIM
ccaucaggucaguaaug

SEQ ID NO: 4182234 - RNA, 16 nt, Yersinia pestis KIM
ccaucauaaaggcuaa

SEQ ID NO: 4182235 - RNA, 23 nt, Yersinia pestis KIM
ccaucaugaauaggauagacagu

SEQ ID NO: 4182236 - RNA, 13 nt, Yersinia pestis KIM
ccaucaugaucug

SEQ ID NO: 4182237 - RNA, 20 nt, Yersinia pestis KIM
ccaucauuacgugguuuggc

SEQ ID NO: 4182238 - RNA, 20 nt, Yersinia pestis KIM
ccaucauugaguuugucacc

SEQ ID NO: 4182239 - RNA, 13 nt, Yersinia pestis KIM
ccauccacuaggu

SEQ ID NO: 4182240 - RNA, 16 nt, Yersinia pestis KIM
ccauccaguauuucag

SEQ ID NO: 4182241 - RNA, 19 nt, Yersinia pestis KIM
ccauccauauuuggcaugu

SEQ ID NO: 4182242 - RNA, 21 nt, Yersinia pestis KIM
ccauccaucggaaacagaggg

SEQ ID NO: 4182243 - RNA, 20 nt, Yersinia pestis KIM
ccauccaugggccucgcuuc

SEQ ID NO: 4182244 - RNA, 20 nt, Yersinia pestis KIM
ccauccccaacucuuucaac

SEQ ID NO: 4182245 - RNA, 21 nt, Yersinia pestis KIM
ccauccccaacucuuucaacu

SEQ ID NO: 4182246 - RNA, 18 nt, Yersinia pestis KIM
ccaucccccauggggcca

SEQ ID NO: 4182247 - RNA, 16 nt, Yersinia pestis KIM
ccauccccuguugauc

SEQ ID NO: 4182248 - RNA, 16 nt, Yersinia pestis KIM
ccauccgcaggaagca

SEQ ID NO: 4182249 - RNA, 18 nt, Yersinia pestis KIM
ccauccgguuuuaaauua

SEQ ID NO: 4182250 - RNA, 21 nt, Yersinia pestis KIM
ccauccugccaacgccccuga

SEQ ID NO: 4182251 - RNA, 19 nt, Yersinia pestis KIM
ccauccuuuugacugguca

SEQ ID NO: 4182252 - RNA, 13 nt, Yersinia pestis KIM
ccaucgccaauac

SEQ ID NO: 4182253 - RNA, 16 nt, Yersinia pestis KIM
ccaucgccacuucuaa

SEQ ID NO: 4182254 - RNA, 19 nt, Yersinia pestis KIM
ccaucgccacuucuaacaa

SEQ ID NO: 4182255 - RNA, 13 nt, Yersinia pestis KIM
ccaucgccccaaa

SEQ ID NO: 4182256 - RNA, 22 nt, Yersinia pestis KIM
ccaucgcccccuguaguucauc

SEQ ID NO: 4182257 - RNA, 16 nt, Yersinia pestis KIM
ccaucgccgacaaaau

SEQ ID NO: 4182258 - RNA, 22 nt, Yersinia pestis KIM
ccaucgccgacaaaauccccca

SEQ ID NO: 4182259 - RNA, 15 nt, Yersinia pestis KIM
ccaucgucagccccu

SEQ ID NO: 4182260 - RNA, 16 nt, Yersinia pestis KIM
ccaucgucagccccug

SEQ ID NO: 4182261 - RNA, 13 nt, Yersinia pestis KIM
ccaucgucucugc

SEQ ID NO: 4182262 - RNA, 21 nt, Yersinia pestis KIM
ccaucuaauagaauagauccc

SEQ ID NO: 4182263 - RNA, 13 nt, Yersinia pestis KIM
ccaucucaauagc

SEQ ID NO: 4182264 - RNA, 23 nt, Yersinia pestis KIM
ccaucugaugaguguuuauucuc

SEQ ID NO: 4182265 - RNA, 20 nt, Yersinia pestis KIM
ccaucuuguucuaauaauaa

SEQ ID NO: 4182266 - RNA, 19 nt, Yersinia pestis KIM
ccaucuuucggccuccccu

SEQ ID NO: 4182267 - RNA, 19 nt, Yersinia pestis KIM
ccaugacaaaauacgguuc

SEQ ID NO: 4182268 - RNA, 21 nt, Yersinia pestis KIM
ccaugacacauauuucaggcu

SEQ ID NO: 4182269 - RNA, 19 nt, Yersinia pestis KIM
ccaugacagguugauaagu

SEQ ID NO: 4182270 - RNA, 13 nt, Yersinia pestis KIM
ccaugaccgccag

SEQ ID NO: 4182271 - RNA, 12 nt, Yersinia pestis KIM
ccaugagaacca

SEQ ID NO: 4182272 - RNA, 16 nt, Yersinia pestis KIM
ccaugagugaaaauau

SEQ ID NO: 4182273 - RNA, 18 nt, Yersinia pestis KIM
ccaugcacuccacuaugc

SEQ ID NO: 4182274 - RNA, 17 nt, Yersinia pestis KIM
ccaugccagcccaucac

SEQ ID NO: 4182275 - RNA, 13 nt, Yersinia pestis KIM
ccaugcgagcagu

SEQ ID NO: 4182276 - RNA, 17 nt, Yersinia pestis KIM
ccaugcucagaaaccug

SEQ ID NO: 4182277 - RNA, 18 nt, Yersinia pestis KIM
ccaugcucuacgccccau

SEQ ID NO: 4182278 - RNA, 18 nt, Yersinia pestis KIM
ccaugcugcccgcacacu

SEQ ID NO: 4182279 - RNA, 20 nt, Yersinia pestis KIM
ccaugcuuucuaacaaaccu

SEQ ID NO: 4182280 - RNA, 19 nt, Yersinia pestis KIM
ccauggaauuuaugcacca

SEQ ID NO: 4182281 - RNA, 13 nt, Yersinia pestis KIM
ccauggccgccag

SEQ ID NO: 4182282 - RNA, 14 nt, Yersinia pestis KIM
ccauggcguaaccg

SEQ ID NO: 4182283 - RNA, 17 nt, Yersinia pestis KIM
ccauggcguaaccgccg

SEQ ID NO: 4182284 - RNA, 17 nt, Yersinia pestis KIM
ccauggcugaaauaacu

SEQ ID NO: 4182285 - RNA, 20 nt, Yersinia pestis KIM
ccauggugacuuacgucuuu

SEQ ID NO: 4182286 - RNA, 23 nt, Yersinia pestis KIM
ccauguugaguuuacgcagugcu

SEQ ID NO: 4182287 - RNA, 24 nt, Yersinia pestis KIM
ccauguuggguaaaccaaucaagc

SEQ ID NO: 4182288 - RNA, 19 nt, Yersinia pestis KIM
ccauuaaacguuugggaua

SEQ ID NO: 4182289 - RNA, 22 nt, Yersinia pestis KIM
ccauuaaacguuugggauaacu

SEQ ID NO: 4182290 - RNA, 17 nt, Yersinia pestis KIM
ccauuaaccuaaaaacg

SEQ ID NO: 4182291 - RNA, 19 nt, Yersinia pestis KIM
ccauuaaccuaaaaacguc

SEQ ID NO: 4182292 - RNA, 20 nt, Yersinia pestis KIM
ccauuaauagacgaauggcc

SEQ ID NO: 4182293 - RNA, 18 nt, Yersinia pestis KIM
ccauuaccacuguuacca

SEQ ID NO: 4182294 - RNA, 13 nt, Yersinia pestis KIM
ccauuauaaauaa

SEQ ID NO: 4182295 - RNA, 14 nt, Yersinia pestis KIM
ccauuaucuuuaau

SEQ ID NO: 4182296 - RNA, 20 nt, Yersinia pestis KIM
ccauuaucuuuaauuuucug

SEQ ID NO: 4182297 - RNA, 21 nt, Yersinia pestis KIM
ccauuaucuuuaauuuucuga

SEQ ID NO: 4182298 - RNA, 21 nt, Yersinia pestis KIM
ccauucaucaaacucugcauc

SEQ ID NO: 4182299 - RNA, 21 nt, Yersinia pestis KIM
ccauucggcacugcaucugac

SEQ ID NO: 4182300 - RNA, 14 nt, Yersinia pestis KIM
ccauucuuucccuc

SEQ ID NO: 4182301 - RNA, 18 nt, Yersinia pestis KIM
ccauugaguaaguucguc

SEQ ID NO: 4182302 - RNA, 16 nt, Yersinia pestis KIM
ccauugauaauaauau

SEQ ID NO: 4182303 - RNA, 16 nt, Yersinia pestis KIM
ccauugcaccaauaac

SEQ ID NO: 4182304 - RNA, 18 nt, Yersinia pestis KIM
ccauugcaccaauaacug

SEQ ID NO: 4182305 - RNA, 12 nt, Yersinia pestis KIM
ccauugccagaa

SEQ ID NO: 4182306 - RNA, 18 nt, Yersinia pestis KIM
ccauugcgcaacuugcuu

SEQ ID NO: 4182307 - RNA, 17 nt, Yersinia pestis KIM
ccauugcucgcgucaua

SEQ ID NO: 4182308 - RNA, 20 nt, Yersinia pestis KIM
ccauuggguauggucagcaa

SEQ ID NO: 4182309 - RNA, 16 nt, Yersinia pestis KIM
ccauugguaauaaugc

SEQ ID NO: 4182310 - RNA, 20 nt, Yersinia pestis KIM
ccauuguauugcucagggcc

SEQ ID NO: 4182311 - RNA, 21 nt, Yersinia pestis KIM
ccauuguauugcucagggcca

SEQ ID NO: 4182312 - RNA, 21 nt, Yersinia pestis KIM
ccauuuaauaacuuaaauaau

SEQ ID NO: 4182313 - RNA, 13 nt, Yersinia pestis KIM
ccauuuagcuggc

SEQ ID NO: 4182314 - RNA, 13 nt, Yersinia pestis KIM
ccauuuauuucca

SEQ ID NO: 4182315 - RNA, 18 nt, Yersinia pestis KIM
ccauuuccaggcuaccaa

SEQ ID NO: 4182316 - RNA, 20 nt, Yersinia pestis KIM
ccauuuccaggcuaccaagg

SEQ ID NO: 4182317 - RNA, 18 nt, Yersinia pestis KIM
cccgaagcucaagcuggu

SEQ ID NO: 4182318 - RNA, 11 nt, Yersinia pestis KIM
cccgaaucaag

SEQ ID NO: 4182319 - RNA, 18 nt, Yersinia pestis KIM
cccgaauuaauaaaaccu

SEQ ID NO: 4182320 - RNA, 21 nt, Yersinia pestis KIM
cccgacagaacugauuucagg

SEQ ID NO: 4182321 - RNA, 18 nt, Yersinia pestis KIM
cccgaucaucaucgguac

SEQ ID NO: 4182322 - RNA, 22 nt, Yersinia pestis KIM
cccgaucugagccauuaucguu

SEQ ID NO: 4182323 - RNA, 22 nt, Yersinia pestis KIM
cccgaugaacugacacacacca

SEQ ID NO: 4182324 - RNA, 12 nt, Yersinia pestis KIM
cccgaugacgcg

SEQ ID NO: 4182325 - RNA, 13 nt, Yersinia pestis KIM
cccgaugagucua

SEQ ID NO: 4182326 - RNA, 19 nt, Yersinia pestis KIM
cccgaugguggcagccugc

SEQ ID NO: 4182327 - RNA, 21 nt, Yersinia pestis KIM
cccgauguggauaauuucagc

SEQ ID NO: 4182328 - RNA, 20 nt, Yersinia pestis KIM
cccgauuauugugccgccuu

SEQ ID NO: 4182329 - RNA, 19 nt, Yersinia pestis KIM
cccgauuucaacgcaccau

SEQ ID NO: 4182330 - RNA, 13 nt, Yersinia pestis KIM
cccgcaaagccug

SEQ ID NO: 4182331 - RNA, 18 nt, Yersinia pestis KIM
cccgcaaccugacugcug

SEQ ID NO: 4182332 - RNA, 12 nt, Yersinia pestis KIM
cccgcaauuuua

SEQ ID NO: 4182333 - RNA, 11 nt, Yersinia pestis KIM
cccgcaggcgg

SEQ ID NO: 4182334 - RNA, 23 nt, Yersinia pestis KIM
cccgccagggguaagauccacca

SEQ ID NO: 4182335 - RNA, 20 nt, Yersinia pestis KIM
cccgccaguaaaccuggcgg

SEQ ID NO: 4182336 - RNA, 16 nt, Yersinia pestis KIM
cccgccguugccgugc

SEQ ID NO: 4182337 - RNA, 12 nt, Yersinia pestis KIM
cccgcgggggcc

SEQ ID NO: 4182338 - RNA, 17 nt, Yersinia pestis KIM
cccgcguugucagccau

SEQ ID NO: 4182339 - RNA, 18 nt, Yersinia pestis KIM
cccgcuaccacuccuuag

SEQ ID NO: 4182340 - RNA, 13 nt, Yersinia pestis KIM
cccgcuaucacua

SEQ ID NO: 4182341 - RNA, 14 nt, Yersinia pestis KIM
cccgcuaucacuag

SEQ ID NO: 4182342 - RNA, 21 nt, Yersinia pestis KIM
cccgcuuauggggacucuuua

SEQ ID NO: 4182343 - RNA, 15 nt, Yersinia pestis KIM
cccggaagguuucca

SEQ ID NO: 4182344 - RNA, 23 nt, Yersinia pestis KIM
cccggaauggagccgcuagcgca

SEQ ID NO: 4182345 - RNA, 22 nt, Yersinia pestis KIM
cccggauauuuuuuugucugac

SEQ ID NO: 4182346 - RNA, 17 nt, Yersinia pestis KIM
cccggauugcugcccgg

SEQ ID NO: 4182347 - RNA, 14 nt, Yersinia pestis KIM
cccggcaaguugau

SEQ ID NO: 4182348 - RNA, 17 nt, Yersinia pestis KIM
cccggcaccuucaacga

SEQ ID NO: 4182349 - RNA, 23 nt, Yersinia pestis KIM
cccggcauggacgagcacauggc

SEQ ID NO: 4182350 - RNA, 19 nt, Yersinia pestis KIM
cccggcgauucuccacuga

SEQ ID NO: 4182351 - RNA, 19 nt, Yersinia pestis KIM
cccggcuaggaggccagga

SEQ ID NO: 4182352 - RNA, 17 nt, Yersinia pestis KIM
cccggcugaccuguugu

SEQ ID NO: 4182353 - RNA, 22 nt, Yersinia pestis KIM
cccgguaccgaggucauucagg

SEQ ID NO: 4182354 - RNA, 15 nt, Yersinia pestis KIM
cccggugacccgugc

SEQ ID NO: 4182355 - RNA, 20 nt, Yersinia pestis KIM
cccggugaucaucgcaccau

SEQ ID NO: 4182356 - RNA, 13 nt, Yersinia pestis KIM
cccggugcggcua

SEQ ID NO: 4182357 - RNA, 15 nt, Yersinia pestis KIM
cccgguuagauaggc

SEQ ID NO: 4182358 - RNA, 15 nt, Yersinia pestis KIM
cccguaggccuuaac

SEQ ID NO: 4182359 - RNA, 10 nt, Yersinia pestis KIM
cccgugccag

SEQ ID NO: 4182360 - RNA, 13 nt, Yersinia pestis KIM
cccgugcggcagu

SEQ ID NO: 4182361 - RNA, 17 nt, Yersinia pestis KIM
cccgugcuacuccugcu

SEQ ID NO: 4182362 - RNA, 15 nt, Yersinia pestis KIM
cccguuacugcaucu

SEQ ID NO: 4182363 - RNA, 17 nt, Yersinia pestis KIM
cccguucaacaguauca

SEQ ID NO: 4182364 - RNA, 16 nt, Yersinia pestis KIM
cccguucuaguagugg

SEQ ID NO: 4182365 - RNA, 16 nt, Yersinia pestis KIM
cccguugcauuuuucu

SEQ ID NO: 4182366 - RNA, 16 nt, Yersinia pestis KIM
cccguuugcagcucaa

SEQ ID NO: 4182367 - RNA, 20 nt, Yersinia pestis KIM
cccguuugcagcucaaagac

SEQ ID NO: 4182368 - RNA, 18 nt, Yersinia pestis KIM
cccuaaacagcaacacaa

SEQ ID NO: 4182369 - RNA, 18 nt, Yersinia pestis KIM
cccuaacucuuuggaugg

SEQ ID NO: 4182370 - RNA, 13 nt, Yersinia pestis KIM
cccuaacugcuca

SEQ ID NO: 4182371 - RNA, 19 nt, Yersinia pestis KIM
cccuaaugcgcucaccaag

SEQ ID NO: 4182372 - RNA, 12 nt, Yersinia pestis KIM
cccuacagaaaa

SEQ ID NO: 4182373 - RNA, 13 nt, Yersinia pestis KIM
cccuacugagaau

SEQ ID NO: 4182374 - RNA, 13 nt, Yersinia pestis KIM
cccuacuggcuga

SEQ ID NO: 4182375 - RNA, 24 nt, Yersinia pestis KIM
cccuacuggcugaaguuaaugaca

SEQ ID NO: 4182376 - RNA, 22 nt, Yersinia pestis KIM
cccuagccagccaccgcacacu

SEQ ID NO: 4182377 - RNA, 14 nt, Yersinia pestis KIM
cccuauaauuuguu

SEQ ID NO: 4182378 - RNA, 17 nt, Yersinia pestis KIM
cccuaucgaacuauuga

SEQ ID NO: 4182379 - RNA, 20 nt, Yersinia pestis KIM
cccuauuuguacuuaacguu

SEQ ID NO: 4182380 - RNA, 12 nt, Yersinia pestis KIM
cccuauuuuugc

SEQ ID NO: 4182381 - RNA, 12 nt, Yersinia pestis KIM
cccucaauaccg

SEQ ID NO: 4182382 - RNA, 22 nt, Yersinia pestis KIM
cccucauuuucgaacuuaacua

SEQ ID NO: 4182383 - RNA, 17 nt, Yersinia pestis KIM
cccuccggcgcccuucc

SEQ ID NO: 4182384 - RNA, 18 nt, Yersinia pestis KIM
cccucgaacgaagccacg

SEQ ID NO: 4182385 - RNA, 13 nt, Yersinia pestis KIM
cccucucacacca

SEQ ID NO: 4182386 - RNA, 13 nt, Yersinia pestis KIM
cccugaaccaugg

SEQ ID NO: 4182387 - RNA, 22 nt, Yersinia pestis KIM
cccugaauuucaauaacaccgu

SEQ ID NO: 4182388 - RNA, 21 nt, Yersinia pestis KIM
cccugacgaaauuuaagaaau

SEQ ID NO: 4182389 - RNA, 11 nt, Yersinia pestis KIM
cccugacuccc

SEQ ID NO: 4182390 - RNA, 13 nt, Yersinia pestis KIM
cccugacucccug

SEQ ID NO: 4182391 - RNA, 14 nt, Yersinia pestis KIM
cccugacucccuga

SEQ ID NO: 4182392 - RNA, 18 nt, Yersinia pestis KIM
cccugacucccugacucc

SEQ ID NO: 4182393 - RNA, 20 nt, Yersinia pestis KIM
cccugacucccugacucccu

SEQ ID NO: 4182394 - RNA, 23 nt, Yersinia pestis KIM
cccugagugugccuuggucucag

SEQ ID NO: 4182395 - RNA, 20 nt, Yersinia pestis KIM
cccugauaauuuucgcgcac

SEQ ID NO: 4182396 - RNA, 20 nt, Yersinia pestis KIM
cccugauccacuacuuauuu

SEQ ID NO: 4182397 - RNA, 13 nt, Yersinia pestis KIM
cccugccaccuug

SEQ ID NO: 4182398 - RNA, 19 nt, Yersinia pestis KIM
cccugccagaaucagcccc

SEQ ID NO: 4182399 - RNA, 22 nt, Yersinia pestis KIM
cccugcuccaaagcuuccaaua

SEQ ID NO: 4182400 - RNA, 15 nt, Yersinia pestis KIM
cccugcuuauacgcu

SEQ ID NO: 4182401 - RNA, 23 nt, Yersinia pestis KIM
cccugguuagcaaccgcugcagc

SEQ ID NO: 4182402 - RNA, 20 nt, Yersinia pestis KIM
cccugguugcagcacgccag

SEQ ID NO: 4182403 - RNA, 16 nt, Yersinia pestis KIM
cccuguaaagccagua

SEQ ID NO: 4182404 - RNA, 14 nt, Yersinia pestis KIM
cccuguaacuuaau

SEQ ID NO: 4182405 - RNA, 15 nt, Yersinia pestis KIM
cccuguagaacaccu

SEQ ID NO: 4182406 - RNA, 21 nt, Yersinia pestis KIM
cccuguaguucaucauuauua

SEQ ID NO: 4182407 - RNA, 15 nt, Yersinia pestis KIM
cccuguauaaaaaua

SEQ ID NO: 4182408 - RNA, 13 nt, Yersinia pestis KIM
cccugugcgccca

SEQ ID NO: 4182409 - RNA, 19 nt, Yersinia pestis KIM
cccuuauccguuaacccaa

SEQ ID NO: 4182410 - RNA, 19 nt, Yersinia pestis KIM
cccuuaucggauuacuuca

SEQ ID NO: 4182411 - RNA, 15 nt, Yersinia pestis KIM
cccuucacacuggua

SEQ ID NO: 4182412 - RNA, 14 nt, Yersinia pestis KIM
cccuucgagcaccg

SEQ ID NO: 4182413 - RNA, 16 nt, Yersinia pestis KIM
cccuucgagcaccgcg

SEQ ID NO: 4182414 - RNA, 18 nt, Yersinia pestis KIM
cccuucggcaugcaacuu

SEQ ID NO: 4182415 - RNA, 22 nt, Yersinia pestis KIM
cccuucgggcuugguguugcaa

SEQ ID NO: 4182416 - RNA, 16 nt, Yersinia pestis KIM
cccuugauuuuaccaa

SEQ ID NO: 4182417 - RNA, 20 nt, Yersinia pestis KIM
cccuuggcucucgacaaccu

SEQ ID NO: 4182418 - RNA, 22 nt, Yersinia pestis KIM
cccuuguuuaucggucacuuua

SEQ ID NO: 4182419 - RNA, 21 nt, Yersinia pestis KIM
cccuuuaaaucuagcccuuca

SEQ ID NO: 4182420 - RNA, 12 nt, Yersinia pestis KIM
cccuuuagcguc

SEQ ID NO: 4182421 - RNA, 17 nt, Yersinia pestis KIM
cccuuucagcgcuuuuu

SEQ ID NO: 4182422 - RNA, 16 nt, Yersinia pestis KIM
cccuuucgcagcccaa

SEQ ID NO: 4182423 - RNA, 12 nt, Yersinia pestis KIM
cccuuucuuauc

SEQ ID NO: 4182424 - RNA, 16 nt, Yersinia pestis KIM
cccuuugacauacagu

SEQ ID NO: 4182425 - RNA, 13 nt, Yersinia pestis KIM
cccuuuuaccgaa

SEQ ID NO: 4182426 - RNA, 19 nt, Yersinia pestis KIM
cccuuuuccgucagcccaa

SEQ ID NO: 4182427 - RNA, 24 nt, Yersinia pestis KIM
ccgaaaaaacagcgaucuauucuc

SEQ ID NO: 4182428 - RNA, 22 nt, Yersinia pestis KIM
ccgaaagcgccugugggcggcu

SEQ ID NO: 4182429 - RNA, 19 nt, Yersinia pestis KIM
ccgaaauaaauauccuccg

SEQ ID NO: 4182430 - RNA, 14 nt, Yersinia pestis KIM
ccgaacgaacccga

SEQ ID NO: 4182431 - RNA, 17 nt, Yersinia pestis KIM
ccgaagcucaagcuggc

SEQ ID NO: 4182432 - RNA, 20 nt, Yersinia pestis KIM
ccgcuucguccagaugccaa

SEQ ID NO: 4182433 - RNA, 17 nt, Yersinia pestis KIM
ccgcuugcauacgcuua

SEQ ID NO: 4182434 - RNA, 16 nt, Yersinia pestis KIM
ccgcuuuaaucagccc

SEQ ID NO: 4182435 - RNA, 18 nt, Yersinia pestis KIM
ccgcuuuagcgaugacca

SEQ ID NO: 4182436 - RNA, 22 nt, Yersinia pestis KIM
ccgcuuuuaccaacccagcgca

SEQ ID NO: 4182437 - RNA, 16 nt, Yersinia pestis KIM
ccggagcaagggcgca

SEQ ID NO: 4182438 - RNA, 15 nt, Yersinia pestis KIM
ccggagguuuuucau

SEQ ID NO: 4182439 - RNA, 20 nt, Yersinia pestis KIM
ccggaucgcgacgaaaaccu

SEQ ID NO: 4182440 - RNA, 16 nt, Yersinia pestis KIM
ccggaugcaucgggca

SEQ ID NO: 4182441 - RNA, 17 nt, Yersinia pestis KIM
ccggauggucacccuuu

SEQ ID NO: 4182442 - RNA, 18 nt, Yersinia pestis KIM
ccggcaaaaacgccauca

SEQ ID NO: 4182443 - RNA, 22 nt, Yersinia pestis KIM
ccggcaaccaguuauagcggug

SEQ ID NO: 4182444 - RNA, 17 nt, Yersinia pestis KIM
ccggcaucaaccaagac

SEQ ID NO: 4182445 - RNA, 13 nt, Yersinia pestis KIM
ccggccugauuua

SEQ ID NO: 4182446 - RNA, 16 nt, Yersinia pestis KIM
ccggcgaagcucuuug

SEQ ID NO: 4182447 - RNA, 21 nt, Yersinia pestis KIM
ccggcgaagggcgcagccccc

SEQ ID NO: 4182448 - RNA, 19 nt, Yersinia pestis KIM
ccggcgugaguuccagccc

SEQ ID NO: 4182449 - RNA, 17 nt, Yersinia pestis KIM
ccggcuaaugccgagaa

SEQ ID NO: 4182450 - RNA, 23 nt, Yersinia pestis KIM
ccggcuaggcucagcauggaaga

SEQ ID NO: 4182451 - RNA, 14 nt, Yersinia pestis KIM
ccggcucauccgcc

SEQ ID NO: 4182452 - RNA, 12 nt, Yersinia pestis KIM
ccggcucgccca

SEQ ID NO: 4182453 - RNA, 19 nt, Yersinia pestis KIM
ccgggaaccccuucaggcc

SEQ ID NO: 4182454 - RNA, 19 nt, Yersinia pestis KIM
ccgggaucuaucagaccuu

SEQ ID NO: 4182455 - RNA, 18 nt, Yersinia pestis KIM
ccgggauucaaacaaggc

SEQ ID NO: 4182456 - RNA, 18 nt, Yersinia pestis KIM
ccgggcauaaaugcaaua

SEQ ID NO: 4182457 - RNA, 15 nt, Yersinia pestis KIM
ccgggcgaacagaaa

SEQ ID NO: 4182458 - RNA, 21 nt, Yersinia pestis KIM
ccgggggcguauuaucggauc

SEQ ID NO: 4182459 - RNA, 18 nt, Yersinia pestis KIM
ccggggugaucaacugcc

SEQ ID NO: 4182460 - RNA, 22 nt, Yersinia pestis KIM
ccggggugaucaacugccuguu

SEQ ID NO: 4182461 - RNA, 13 nt, Yersinia pestis KIM
ccggguaacgcca

SEQ ID NO: 4182462 - RNA, 18 nt, Yersinia pestis KIM
ccggguaagguaaagaaa

SEQ ID NO: 4182463 - RNA, 16 nt, Yersinia pestis KIM
ccgggucguaccggcc

SEQ ID NO: 4182464 - RNA, 17 nt, Yersinia pestis KIM
ccgggucguaccggccc

SEQ ID NO: 4182465 - RNA, 14 nt, Yersinia pestis KIM
ccgggugcagcgcc

SEQ ID NO: 4182466 - RNA, 23 nt, Yersinia pestis KIM
ccgguaaaaucacguuuccaaaa

SEQ ID NO: 4182467 - RNA, 22 nt, Yersinia pestis KIM
ccgguauucagccaaaucauca

SEQ ID NO: 4182468 - RNA, 12 nt, Yersinia pestis KIM
ccgguauuugcu

SEQ ID NO: 4182469 - RNA, 20 nt, Yersinia pestis KIM
ccggucaacgucaucgccac

SEQ ID NO: 4182470 - RNA, 21 nt, Yersinia pestis KIM
ccggucguauucagcacugcc

SEQ ID NO: 4182471 - RNA, 21 nt, Yersinia pestis KIM
ccggugcugauguugucaccu

SEQ ID NO: 4182472 - RNA, 17 nt, Yersinia pestis KIM
ccggugguucaaccacc

SEQ ID NO: 4182473 - RNA, 18 nt, Yersinia pestis KIM
ccggugguuucgccgcca

SEQ ID NO: 4182474 - RNA, 19 nt, Yersinia pestis KIM
ccgguguuuuugacacggg

SEQ ID NO: 4182475 - RNA, 15 nt, Yersinia pestis KIM
ccgguuggcccucgg

SEQ ID NO: 4182476 - RNA, 15 nt, Yersinia pestis KIM
ccgguuguucaaucg

SEQ ID NO: 4182477 - RNA, 20 nt, Yersinia pestis KIM
ccgguuuuaaauuacgguuu

SEQ ID NO: 4182478 - RNA, 20 nt, Yersinia pestis KIM
ccguaaacguucugccaauu

SEQ ID NO: 4182479 - RNA, 16 nt, Yersinia pestis KIM
ccguaaauacauccau

SEQ ID NO: 4182480 - RNA, 16 nt, Yersinia pestis KIM
ccguaacuccaguaag

SEQ ID NO: 4182481 - RNA, 20 nt, Yersinia pestis KIM
ccguaacugaccgcagccuu

SEQ ID NO: 4182482 - RNA, 13 nt, Yersinia pestis KIM
ccguaacuucuuc

SEQ ID NO: 4182483 - RNA, 14 nt, Yersinia pestis KIM
ccguaacuucuucg

SEQ ID NO: 4182484 - RNA, 23 nt, Yersinia pestis KIM
ccguaagauucgccgcaaggcaa

SEQ ID NO: 4182485 - RNA, 17 nt, Yersinia pestis KIM
ccguaauucagauaaga

SEQ ID NO: 4182486 - RNA, 12 nt, Yersinia pestis KIM
ccguacaaauau

SEQ ID NO: 4182487 - RNA, 12 nt, Yersinia pestis KIM
ccguacaacaau

SEQ ID NO: 4182488 - RNA, 12 nt, Yersinia pestis KIM
ccguacauuaaa

SEQ ID NO: 4182489 - RNA, 15 nt, Yersinia pestis KIM
ccguaccaguugucu

SEQ ID NO: 4182490 - RNA, 12 nt, Yersinia pestis KIM
ccguacccgcuc

SEQ ID NO: 4182491 - RNA, 13 nt, Yersinia pestis KIM
ccguaccuccggu

SEQ ID NO: 4182492 - RNA, 17 nt, Yersinia pestis KIM
ccguagcacacacagcc

SEQ ID NO: 4182493 - RNA, 22 nt, Yersinia pestis KIM
ccguaggccacccccauaacca

SEQ ID NO: 4182494 - RNA, 18 nt, Yersinia pestis KIM
ccguaucaccgguuuuug

SEQ ID NO: 4182495 - RNA, 13 nt, Yersinia pestis KIM
ccguaucagcccc

SEQ ID NO: 4182496 - RNA, 13 nt, Yersinia pestis KIM
ccguaugcgcaua

SEQ ID NO: 4182497 - RNA, 19 nt, Yersinia pestis KIM
ccguauuuuauaucugcgc

SEQ ID NO: 4182498 - RNA, 16 nt, Yersinia pestis KIM
ccgucaagacaacaaa

SEQ ID NO: 4182499 - RNA, 21 nt, Yersinia pestis KIM
ccgucaauaucaucaucuuua

SEQ ID NO: 4182500 - RNA, 15 nt, Yersinia pestis KIM
ccgucaaugccuguu

SEQ ID NO: 4182501 - RNA, 23 nt, Yersinia pestis KIM
ccgucacucagaaaacagccacc

SEQ ID NO: 4182502 - RNA, 14 nt, Yersinia pestis KIM
ccgucagcaucaua

SEQ ID NO: 4182503 - RNA, 15 nt, Yersinia pestis KIM
ccguccguacgcagc

SEQ ID NO: 4182504 - RNA, 16 nt, Yersinia pestis KIM
ccgucuuggauauuug

SEQ ID NO: 4182505 - RNA, 17 nt, Yersinia pestis KIM
ccgucuuggauauuuga

SEQ ID NO: 4182506 - RNA, 13 nt, Yersinia pestis KIM
ccgugacauuuuc

SEQ ID NO: 4182507 - RNA, 23 nt, Yersinia pestis KIM
ccgugacauuuucaccgaggcgg

SEQ ID NO: 4182508 - RNA, 11 nt, Yersinia pestis KIM
ccgugacuaaa

SEQ ID NO: 4182509 - RNA, 19 nt, Yersinia pestis KIM
ccgugcaaucuguuauaaa

SEQ ID NO: 4182510 - RNA, 12 nt, Yersinia pestis KIM
ccgugcagggcg

SEQ ID NO: 4182511 - RNA, 17 nt, Yersinia pestis KIM
ccgugcauagcgugauu

SEQ ID NO: 4182512 - RNA, 19 nt, Yersinia pestis KIM
ccgugcgccugaacagccu

SEQ ID NO: 4182513 - RNA, 19 nt, Yersinia pestis KIM
ccguggcauaaucaacgcu

SEQ ID NO: 4182514 - RNA, 21 nt, Yersinia pestis KIM
ccguggcgacagcuauuuauu

SEQ ID NO: 4182515 - RNA, 21 nt, Yersinia pestis KIM
ccguguucauggugaugauca

SEQ ID NO: 4182516 - RNA, 23 nt, Yersinia pestis KIM
ccguuaacacggcgaucagugua

SEQ ID NO: 4182517 - RNA, 17 nt, Yersinia pestis KIM
ccguuaauggcaccauc

SEQ ID NO: 4182518 - RNA, 18 nt, Yersinia pestis KIM
ccguuacaaccgccgccg

SEQ ID NO: 4182519 - RNA, 22 nt, Yersinia pestis KIM
ccguuagcaccggauggucacc

SEQ ID NO: 4182520 - RNA, 11 nt, Yersinia pestis KIM
ccguuagccau

SEQ ID NO: 4182521 - RNA, 13 nt, Yersinia pestis KIM
ccguucacccuuu

SEQ ID NO: 4182522 - RNA, 19 nt, Yersinia pestis KIM
ccguucacccuuuggugag

SEQ ID NO: 4182523 - RNA, 19 nt, Yersinia pestis KIM
ccguuccuucagccaccag

SEQ ID NO: 4182524 - RNA, 22 nt, Yersinia pestis KIM
ccguucgcgguaugaaacaacc

SEQ ID NO: 4182525 - RNA, 18 nt, Yersinia pestis KIM
ccguucuaguagugggca

SEQ ID NO: 4182526 - RNA, 21 nt, Yersinia pestis KIM
ccguucuugccacucugcucc

SEQ ID NO: 4182527 - RNA, 15 nt, Yersinia pestis KIM
ccguugcauuuuucu

SEQ ID NO: 4182528 - RNA, 20 nt, Yersinia pestis KIM
ccguugugaguaauucgcag

SEQ ID NO: 4182529 - RNA, 19 nt, Yersinia pestis KIM
ccguuguguaucagcaacu

SEQ ID NO: 4182530 - RNA, 10 nt, Yersinia pestis KIM
ccguuucucu

SEQ ID NO: 4182531 - RNA, 13 nt, Yersinia pestis KIM
ccguuugcaacag

SEQ ID NO: 4182532 - RNA, 23 nt, Yersinia pestis KIM
ccguuuguaaccgacuugcccaa

SEQ ID NO: 4182533 - RNA, 23 nt, Yersinia pestis KIM
ccguuuuaacgcugcccaauaaa

SEQ ID NO: 4182534 - RNA, 17 nt, Yersinia pestis KIM
ccguuuuauuucccccu

SEQ ID NO: 4182535 - RNA, 11 nt, Yersinia pestis KIM
ccuaaaaaaaa

SEQ ID NO: 4182536 - RNA, 14 nt, Yersinia pestis KIM
ccuaaaaaaaacaa

SEQ ID NO: 4182537 - RNA, 23 nt, Yersinia pestis KIM
ccuaaaaucauugacguuacaga

SEQ ID NO: 4182538 - RNA, 17 nt, Yersinia pestis KIM
ccuaaaccuuucagaca

SEQ ID NO: 4182539 - RNA, 18 nt, Yersinia pestis KIM
ccuaaagccaucgccauc

SEQ ID NO: 4182540 - RNA, 18 nt, Yersinia pestis KIM
ccuaaagcgccuuccuuu

SEQ ID NO: 4182541 - RNA, 22 nt, Yersinia pestis KIM
ccuaaauccugcaaugcauaag

SEQ ID NO: 4182542 - RNA, 15 nt, Yersinia pestis KIM
ccuaacacguuaaau

SEQ ID NO: 4182543 - RNA, 21 nt, Yersinia pestis KIM
ccuaaccaaacauugucaccu

SEQ ID NO: 4182544 - RNA, 12 nt, Yersinia pestis KIM
ccuaaccgcugu

SEQ ID NO: 4182545 - RNA, 12 nt, Yersinia pestis KIM
ccuaacggcaua

SEQ ID NO: 4182546 - RNA, 16 nt, Yersinia pestis KIM
ccuaagaaucggccag

SEQ ID NO: 4182547 - RNA, 18 nt, Yersinia pestis KIM
ccugacucccugacuccc

SEQ ID NO: 4182548 - RNA, 20 nt, Yersinia pestis KIM
ccugacugguucacaccaaa

SEQ ID NO: 4182549 - RNA, 16 nt, Yersinia pestis KIM
ccugacuguuuugcua

SEQ ID NO: 4182550 - RNA, 16 nt, Yersinia pestis KIM
ccugagauuaaccgcg

SEQ ID NO: 4182551 - RNA, 16 nt, Yersinia pestis KIM
ccugagccgccaguug

SEQ ID NO: 4182552 - RNA, 15 nt, Yersinia pestis KIM
ccugaggauaaaaac

SEQ ID NO: 4182553 - RNA, 18 nt, Yersinia pestis KIM
ccugagggugaugacaau

SEQ ID NO: 4182554 - RNA, 18 nt, Yersinia pestis KIM
ccugagguucccaacggc

SEQ ID NO: 4182555 - RNA, 17 nt, Yersinia pestis KIM
ccugagucaguaauuca

SEQ ID NO: 4182556 - RNA, 19 nt, Yersinia pestis KIM
ccugagucaguaauucacc

SEQ ID NO: 4182557 - RNA, 21 nt, Yersinia pestis KIM
ccugaguuaccuugugucacc

SEQ ID NO: 4182558 - RNA, 17 nt, Yersinia pestis KIM
ccugauagcgcacuguc

SEQ ID NO: 4182559 - RNA, 15 nt, Yersinia pestis KIM
ccugaugaugaagca

SEQ ID NO: 4182560 - RNA, 21 nt, Yersinia pestis KIM
ccugaugugguuguuuuuucc

SEQ ID NO: 4182561 - RNA, 19 nt, Yersinia pestis KIM
ccugauucgcgaccagcag

SEQ ID NO: 4182562 - RNA, 20 nt, Yersinia pestis KIM
ccugauucgcgaccagcaga

SEQ ID NO: 4182563 - RNA, 16 nt, Yersinia pestis KIM
ccugauuuaguuuauu

SEQ ID NO: 4182564 - RNA, 18 nt, Yersinia pestis KIM
ccugauuuugauugcuga

SEQ ID NO: 4182565 - RNA, 23 nt, Yersinia pestis KIM
ccugcaaauuaaccugcuggcgc

SEQ ID NO: 4182566 - RNA, 19 nt, Yersinia pestis KIM
ccugcaaugccaugacuuu

SEQ ID NO: 4182567 - RNA, 23 nt, Yersinia pestis KIM
ccugcacacgggcgguaaucugc

SEQ ID NO: 4182568 - RNA, 15 nt, Yersinia pestis KIM
ccugcaccagugcca

SEQ ID NO: 4182569 - RNA, 12 nt, Yersinia pestis KIM
ccugcaccauau

SEQ ID NO: 4182570 - RNA, 24 nt, Yersinia pestis KIM
ccugcaccauauucccagccaacu

SEQ ID NO: 4182571 - RNA, 22 nt, Yersinia pestis KIM
ccugcacuuaacgcuuuaucuc

SEQ ID NO: 4182572 - RNA, 13 nt, Yersinia pestis KIM
ccugccaaaaaau

SEQ ID NO: 4182573 - RNA, 14 nt, Yersinia pestis KIM
ccugccaaauuaaa

SEQ ID NO: 4182574 - RNA, 16 nt, Yersinia pestis KIM
ccugccagaacagcag

SEQ ID NO: 4182575 - RNA, 18 nt, Yersinia pestis KIM
ccugccagaaucagcccc

SEQ ID NO: 4182576 - RNA, 13 nt, Yersinia pestis KIM
ccugcccaugcuc

SEQ ID NO: 4182577 - RNA, 17 nt, Yersinia pestis KIM
ccugccgccucugcucc

SEQ ID NO: 4182578 - RNA, 19 nt, Yersinia pestis KIM
ccugccgugcuugcuauua

SEQ ID NO: 4182579 - RNA, 14 nt, Yersinia pestis KIM
ccugccuauccuca

SEQ ID NO: 4182580 - RNA, 18 nt, Yersinia pestis KIM
ccugcgaauuaucaucca

SEQ ID NO: 4182581 - RNA, 19 nt, Yersinia pestis KIM
ccugcgaggcacuucauug

SEQ ID NO: 4182582 - RNA, 18 nt, Yersinia pestis KIM
ccugcgauagccccauau

SEQ ID NO: 4182583 - RNA, 14 nt, Yersinia pestis KIM
ccugcgccagcagc

SEQ ID NO: 4182584 - RNA, 17 nt, Yersinia pestis KIM
ccugcggccauccagaa

SEQ ID NO: 4182585 - RNA, 19 nt, Yersinia pestis KIM
ccugcguuuguaggggagg

SEQ ID NO: 4182586 - RNA, 15 nt, Yersinia pestis KIM
ccugcucaacugcuc

SEQ ID NO: 4182587 - RNA, 21 nt, Yersinia pestis KIM
ccugcucaacugcucaacugc

SEQ ID NO: 4182588 - RNA, 14 nt, Yersinia pestis KIM
ccugcucacgcaaa

SEQ ID NO: 4182589 - RNA, 19 nt, Yersinia pestis KIM
ccugcuccaaagcuuccaa

SEQ ID NO: 4182590 - RNA, 13 nt, Yersinia pestis KIM
ccugcucuucugg

SEQ ID NO: 4182591 - RNA, 13 nt, Yersinia pestis KIM
ccugcugcaccuc

SEQ ID NO: 4182592 - RNA, 13 nt, Yersinia pestis KIM
ccugcuguuagua

SEQ ID NO: 4182593 - RNA, 22 nt, Yersinia pestis KIM
ccugcuguuaguaacuguaagg

SEQ ID NO: 4182594 - RNA, 19 nt, Yersinia pestis KIM
ccugcuuaaugcgaacagc

SEQ ID NO: 4182595 - RNA, 17 nt, Yersinia pestis KIM
ccuggaaccaagcccgc

SEQ ID NO: 4182596 - RNA, 16 nt, Yersinia pestis KIM
ccuggcaccggacaaa

SEQ ID NO: 4182597 - RNA, 15 nt, Yersinia pestis KIM
ccuggcccgccagca

SEQ ID NO: 4182598 - RNA, 20 nt, Yersinia pestis KIM
ccuggcccuggaacaccagc

SEQ ID NO: 4182599 - RNA, 20 nt, Yersinia pestis KIM
ccuggccguguuuuucccua

SEQ ID NO: 4182600 - RNA, 20 nt, Yersinia pestis KIM
ccugggccaguuuccacgaa

SEQ ID NO: 4182601 - RNA, 13 nt, Yersinia pestis KIM
ccugguggaccaa

SEQ ID NO: 4182602 - RNA, 21 nt, Yersinia pestis KIM
ccugguuuuaccaucaccaua

SEQ ID NO: 4182603 - RNA, 19 nt, Yersinia pestis KIM
ccugguuuuacgcuaucaa

SEQ ID NO: 4182604 - RNA, 20 nt, Yersinia pestis KIM
ccugguuuuuuaaaaaagug

SEQ ID NO: 4182605 - RNA, 13 nt, Yersinia pestis KIM
ccuguaaaacaag

SEQ ID NO: 4182606 - RNA, 14 nt, Yersinia pestis KIM
ccuguaaagccagu

SEQ ID NO: 4182607 - RNA, 15 nt, Yersinia pestis KIM
ccuguaaauaaauac

SEQ ID NO: 4182608 - RNA, 16 nt, Yersinia pestis KIM
ccuguaaugcauuccc

SEQ ID NO: 4182609 - RNA, 14 nt, Yersinia pestis KIM
ccuguaccaccacc

SEQ ID NO: 4182610 - RNA, 20 nt, Yersinia pestis KIM
ccuguaccaccaccaacagc

SEQ ID NO: 4182611 - RNA, 22 nt, Yersinia pestis KIM
ccuguagaagugcaggcuacca

SEQ ID NO: 4182612 - RNA, 17 nt, Yersinia pestis KIM
ccuguaggccaguuauu

SEQ ID NO: 4182613 - RNA, 15 nt, Yersinia pestis KIM
ccugugaaucaagaa

SEQ ID NO: 4182614 - RNA, 18 nt, Yersinia pestis KIM
ccugugcaccacacagcg

SEQ ID NO: 4182615 - RNA, 23 nt, Yersinia pestis KIM
ccugugcgcccacgccaacccuc

SEQ ID NO: 4182616 - RNA, 20 nt, Yersinia pestis KIM
ccuguguuuugagcaucacu

SEQ ID NO: 4182617 - RNA, 13 nt, Yersinia pestis KIM
ccuguuuaguaaa

SEQ ID NO: 4182618 - RNA, 18 nt, Yersinia pestis KIM
ccuguuuuuguuguucuu

SEQ ID NO: 4182619 - RNA, 21 nt, Yersinia pestis KIM
ccuuaaccccguagcacacac

SEQ ID NO: 4182620 - RNA, 19 nt, Yersinia pestis KIM
ccuuaacggucagauccac

SEQ ID NO: 4182621 - RNA, 22 nt, Yersinia pestis KIM
ccuuaacggucagauccacauu

SEQ ID NO: 4182622 - RNA, 14 nt, Yersinia pestis KIM
ccuuacuauuuuca

SEQ ID NO: 4182623 - RNA, 13 nt, Yersinia pestis KIM
ccuuacugcauca

SEQ ID NO: 4182624 - RNA, 22 nt, Yersinia pestis KIM
ccuuacugggcggguuuuuuau

SEQ ID NO: 4182625 - RNA, 14 nt, Yersinia pestis KIM
ccuuaucagcgaaa

SEQ ID NO: 4182626 - RNA, 19 nt, Yersinia pestis KIM
ccuuauccguuaacccaaa

SEQ ID NO: 4182627 - RNA, 13 nt, Yersinia pestis KIM
ccuuaucuacugg

SEQ ID NO: 4182628 - RNA, 15 nt, Yersinia pestis KIM
ccuuaucuggccccu

SEQ ID NO: 4182629 - RNA, 15 nt, Yersinia pestis KIM
ccuuaugguuaucac

SEQ ID NO: 4182630 - RNA, 18 nt, Yersinia pestis KIM
ccuuauucaaagaauaac

SEQ ID NO: 4182631 - RNA, 21 nt, Yersinia pestis KIM
ccuucaaacgggugauguuua

SEQ ID NO: 4182632 - RNA, 19 nt, Yersinia pestis KIM
ccuucaaagccgcuuuaau

SEQ ID NO: 4182633 - RNA, 13 nt, Yersinia pestis KIM
ccuucaacucuac

SEQ ID NO: 4182634 - RNA, 14 nt, Yersinia pestis KIM
ccuucaauugacuu

SEQ ID NO: 4182635 - RNA, 16 nt, Yersinia pestis KIM
ccuucacauuuucucc

SEQ ID NO: 4182636 - RNA, 15 nt, Yersinia pestis KIM
ccuucacccaggcug

SEQ ID NO: 4182637 - RNA, 23 nt, Yersinia pestis KIM
ccuucacgcaucacaucuugcaa

SEQ ID NO: 4182638 - RNA, 15 nt, Yersinia pestis KIM
ccuucacuuacucuc

SEQ ID NO: 4182639 - RNA, 17 nt, Yersinia pestis KIM
ccuucagacugacgcag

SEQ ID NO: 4182640 - RNA, 19 nt, Yersinia pestis KIM
ccuucagacugcugacaaa

SEQ ID NO: 4182641 - RNA, 18 nt, Yersinia pestis KIM
ccuucagaugaauccagc

SEQ ID NO: 4182642 - RNA, 22 nt, Yersinia pestis KIM
ccuucagaugaauccagccaug

SEQ ID NO: 4182643 - RNA, 14 nt, Yersinia pestis KIM
ccuucaggaauaaa

SEQ ID NO: 4182644 - RNA, 19 nt, Yersinia pestis KIM
ccuucaucgacaauggcug

SEQ ID NO: 4182645 - RNA, 21 nt, Yersinia pestis KIM
ccuucaucucugacacugaca

SEQ ID NO: 4182646 - RNA, 11 nt, Yersinia pestis KIM
ccuuccaaugu

SEQ ID NO: 4182647 - RNA, 20 nt, Yersinia pestis KIM
ccuuccaaugucaguggcgg

SEQ ID NO: 4182648 - RNA, 13 nt, Yersinia pestis KIM
ccuucccauccua

SEQ ID NO: 4182649 - RNA, 14 nt, Yersinia pestis KIM
ccuuccggcaucuu

SEQ ID NO: 4182650 - RNA, 23 nt, Yersinia pestis KIM
ccuuccugugcggaucccguuuc

SEQ ID NO: 4182651 - RNA, 13 nt, Yersinia pestis KIM
ccuucggacgcuc

SEQ ID NO: 4182652 - RNA, 22 nt, Yersinia pestis KIM
ccuucgggcuugguguugcaaa

SEQ ID NO: 4182653 - RNA, 16 nt, Yersinia pestis KIM
ccuucgguaaucaauu

SEQ ID NO: 4182654 - RNA, 20 nt, Yersinia pestis KIM
ccuucgguaaucaauuuuug

SEQ ID NO: 4182655 - RNA, 20 nt, Yersinia pestis KIM
ccuucgguauauuucccguu

SEQ ID NO: 4182656 - RNA, 18 nt, Yersinia pestis KIM
ccuucucgaugccuucuu

SEQ ID NO: 4182657 - RNA, 11 nt, Yersinia pestis KIM
ccuucuucaau

SEQ ID NO: 4182658 - RNA, 20 nt, Yersinia pestis KIM
ccuucuuguaaaucuugagc

SEQ ID NO: 4182659 - RNA, 14 nt, Yersinia pestis KIM
ccuucuuuaucugu

SEQ ID NO: 4182660 - RNA, 14 nt, Yersinia pestis KIM
ccuugauccgccaa

SEQ ID NO: 4182661 - RNA, 14 nt, Yersinia pestis KIM
ccuugaucgccaaa

SEQ ID NO: 4182662 - RNA, 15 nt, Yersinia pestis KIM
cgacgugccaacugg

SEQ ID NO: 4182663 - RNA, 23 nt, Yersinia pestis KIM
cgacgugcucgucuucgacagca

SEQ ID NO: 4182664 - RNA, 21 nt, Yersinia pestis KIM
cgacguuaucaauacugcaaa

SEQ ID NO: 4182665 - RNA, 14 nt, Yersinia pestis KIM
cgacguuggaauua

SEQ ID NO: 4182666 - RNA, 12 nt, Yersinia pestis KIM
cgacuaacugau

SEQ ID NO: 4182667 - RNA, 15 nt, Yersinia pestis KIM
cgacucaagccucua

SEQ ID NO: 4182668 - RNA, 13 nt, Yersinia pestis KIM
cgacuccuggcaa

SEQ ID NO: 4182669 - RNA, 14 nt, Yersinia pestis KIM
cgacuccuggcaau

SEQ ID NO: 4182670 - RNA, 17 nt, Yersinia pestis KIM
cgacuugaugaaguuau

SEQ ID NO: 4182671 - RNA, 18 nt, Yersinia pestis KIM
cgagaaggauugaccaau

SEQ ID NO: 4182672 - RNA, 18 nt, Yersinia pestis KIM
cgagaauucagaggcugc

SEQ ID NO: 4182673 - RNA, 22 nt, Yersinia pestis KIM
cgagagauucaugggcuguaaa

SEQ ID NO: 4182674 - RNA, 16 nt, Yersinia pestis KIM
cgagauagucagcgac

SEQ ID NO: 4182675 - RNA, 17 nt, Yersinia pestis KIM
cgagauguauccaaggc

SEQ ID NO: 4182676 - RNA, 12 nt, Yersinia pestis KIM
cgagcacugccc

SEQ ID NO: 4182677 - RNA, 13 nt, Yersinia pestis KIM
cgagcacugcccc

SEQ ID NO: 4182678 - RNA, 23 nt, Yersinia pestis KIM
cgagcacugccccgaagcucaag

SEQ ID NO: 4182679 - RNA, 17 nt, Yersinia pestis KIM
cgagccuacuacaugga

SEQ ID NO: 4182680 - RNA, 22 nt, Yersinia pestis KIM
cgagcggggcaaaaauuacagu

SEQ ID NO: 4182681 - RNA, 13 nt, Yersinia pestis KIM
cgagcguaauucc

SEQ ID NO: 4182682 - RNA, 22 nt, Yersinia pestis KIM
cgagcgugcgguagaccaccaa

SEQ ID NO: 4182683 - RNA, 16 nt, Yersinia pestis KIM
cgagcguuuaaauacc

SEQ ID NO: 4182684 - RNA, 20 nt, Yersinia pestis KIM
cgagcuguuugcuguaaaca

SEQ ID NO: 4182685 - RNA, 16 nt, Yersinia pestis KIM
cgaggaaaacgccagc

SEQ ID NO: 4182686 - RNA, 19 nt, Yersinia pestis KIM
cgaggaaaacgccagcaga

SEQ ID NO: 4182687 - RNA, 15 nt, Yersinia pestis KIM
cgaggaauagccagc

SEQ ID NO: 4182688 - RNA, 18 nt, Yersinia pestis KIM
cgagggcucaaucucugc

SEQ ID NO: 4182689 - RNA, 19 nt, Yersinia pestis KIM
cgaggguucgaaucccucc

SEQ ID NO: 4182690 - RNA, 16 nt, Yersinia pestis KIM
cgaguaaauacaaaua

SEQ ID NO: 4182691 - RNA, 20 nt, Yersinia pestis KIM
cgaguaagcgcuggcuuaau

SEQ ID NO: 4182692 - RNA, 13 nt, Yersinia pestis KIM
cgaguaaugaaau

SEQ ID NO: 4182693 - RNA, 18 nt, Yersinia pestis KIM
cgaguauuccccacugua

SEQ ID NO: 4182694 - RNA, 16 nt, Yersinia pestis KIM
cgagucacauuuuuaa

SEQ ID NO: 4182695 - RNA, 20 nt, Yersinia pestis KIM
cgagucacgaaggcaaccag

SEQ ID NO: 4182696 - RNA, 17 nt, Yersinia pestis KIM
cgaguccguuaaaaaau

SEQ ID NO: 4182697 - RNA, 18 nt, Yersinia pestis KIM
cgaguccguuaaaaaauu

SEQ ID NO: 4182698 - RNA, 15 nt, Yersinia pestis KIM
cgagucucuuggaug

SEQ ID NO: 4182699 - RNA, 15 nt, Yersinia pestis KIM
cgagugccaacucag

SEQ ID NO: 4182700 - RNA, 14 nt, Yersinia pestis KIM
cgaguguaaaaagc

SEQ ID NO: 4182701 - RNA, 23 nt, Yersinia pestis KIM
cgaguuaggaaaaauuguuugac

SEQ ID NO: 4182702 - RNA, 17 nt, Yersinia pestis KIM
cgaguuguacgugaaga

SEQ ID NO: 4182703 - RNA, 16 nt, Yersinia pestis KIM
cgaguuuccaguucaa

SEQ ID NO: 4182704 - RNA, 13 nt, Yersinia pestis KIM
cgaguuucccuuu

SEQ ID NO: 4182705 - RNA, 19 nt, Yersinia pestis KIM
cgauaaaaaccauuuuuau

SEQ ID NO: 4182706 - RNA, 11 nt, Yersinia pestis KIM
cgauaaaagau

SEQ ID NO: 4182707 - RNA, 19 nt, Yersinia pestis KIM
cgauaaaagauuuccuuuc

SEQ ID NO: 4182708 - RNA, 17 nt, Yersinia pestis KIM
cgauaaaauucagccac

SEQ ID NO: 4182709 - RNA, 21 nt, Yersinia pestis KIM
cgauaaaccaacugaaacugg

SEQ ID NO: 4182710 - RNA, 20 nt, Yersinia pestis KIM
cgauaaauaauuacuuauaa

SEQ ID NO: 4182711 - RNA, 21 nt, Yersinia pestis KIM
cgauaaauaauuacuuauaaa

SEQ ID NO: 4182712 - RNA, 17 nt, Yersinia pestis KIM
cgauaaccaaaucaccu

SEQ ID NO: 4182713 - RNA, 20 nt, Yersinia pestis KIM
cgauaacggcgguaccaguc

SEQ ID NO: 4182714 - RNA, 16 nt, Yersinia pestis KIM
cgauaacguuguuucu

SEQ ID NO: 4182715 - RNA, 17 nt, Yersinia pestis KIM
cgauaacguuguuucug

SEQ ID NO: 4182716 - RNA, 22 nt, Yersinia pestis KIM
cgauaacuuuuggcagcaccag

SEQ ID NO: 4182717 - RNA, 19 nt, Yersinia pestis KIM
cgauaauggccgccauuac

SEQ ID NO: 4182718 - RNA, 15 nt, Yersinia pestis KIM
cgauacaccauuucc

SEQ ID NO: 4182719 - RNA, 19 nt, Yersinia pestis KIM
cgauacaccauuuccaggc

SEQ ID NO: 4182720 - RNA, 14 nt, Yersinia pestis KIM
cgauacaggcucug

SEQ ID NO: 4182721 - RNA, 20 nt, Yersinia pestis KIM
cgauacauaccauaaggcca

SEQ ID NO: 4182722 - RNA, 19 nt, Yersinia pestis KIM
cgauacccauuuuaaucuc

SEQ ID NO: 4182723 - RNA, 16 nt, Yersinia pestis KIM
cgauacgaucaucugg

SEQ ID NO: 4182724 - RNA, 18 nt, Yersinia pestis KIM
cgauacgcgccgcagcag

SEQ ID NO: 4182725 - RNA, 17 nt, Yersinia pestis KIM
cgauacguugcagguca

SEQ ID NO: 4182726 - RNA, 17 nt, Yersinia pestis KIM
cgauacuaauuucuaau

SEQ ID NO: 4182727 - RNA, 15 nt, Yersinia pestis KIM
cgauagcccaucuua

SEQ ID NO: 4182728 - RNA, 20 nt, Yersinia pestis KIM
cgauagugacuucgcugcua

SEQ ID NO: 4182729 - RNA, 13 nt, Yersinia pestis KIM
cgauauaaauaaa

SEQ ID NO: 4182730 - RNA, 14 nt, Yersinia pestis KIM
cgauauacacccca

SEQ ID NO: 4182731 - RNA, 19 nt, Yersinia pestis KIM
cgauauagucuugaugaaa

SEQ ID NO: 4182732 - RNA, 13 nt, Yersinia pestis KIM
cgauaucaauaaa

SEQ ID NO: 4182733 - RNA, 13 nt, Yersinia pestis KIM
cgauaucugcaua

SEQ ID NO: 4182734 - RNA, 15 nt, Yersinia pestis KIM
cgauaugcuccagau

SEQ ID NO: 4182735 - RNA, 19 nt, Yersinia pestis KIM
cgauauggcacaggcaaaa

SEQ ID NO: 4182736 - RNA, 20 nt, Yersinia pestis KIM
cgauauucugauggugucaa

SEQ ID NO: 4182737 - RNA, 17 nt, Yersinia pestis KIM
cgaucaaaaucacuucu

SEQ ID NO: 4182738 - RNA, 16 nt, Yersinia pestis KIM
cgaucaacccccugug

SEQ ID NO: 4182739 - RNA, 18 nt, Yersinia pestis KIM
cgaucaacgccucacaac

SEQ ID NO: 4182740 - RNA, 12 nt, Yersinia pestis KIM
cgaucaauacac

SEQ ID NO: 4182741 - RNA, 18 nt, Yersinia pestis KIM
cgaucacaacgcaucagu

SEQ ID NO: 4182742 - RNA, 16 nt, Yersinia pestis KIM
cgaucacaugcucagu

SEQ ID NO: 4182743 - RNA, 18 nt, Yersinia pestis KIM
cgaucacuuauuccuuuc

SEQ ID NO: 4182744 - RNA, 20 nt, Yersinia pestis KIM
cgaucacuuucccgcgucgu

SEQ ID NO: 4182745 - RNA, 17 nt, Yersinia pestis KIM
cgaucagcaacggcuuc

SEQ ID NO: 4182746 - RNA, 19 nt, Yersinia pestis KIM
cgaucagcaauaugcugaa

SEQ ID NO: 4182747 - RNA, 16 nt, Yersinia pestis KIM
cgaucaggaagcccgu

SEQ ID NO: 4182748 - RNA, 20 nt, Yersinia pestis KIM
cgaucaguggcacacguucg

SEQ ID NO: 4182749 - RNA, 17 nt, Yersinia pestis KIM
cgaucaguguaacggcc

SEQ ID NO: 4182750 - RNA, 21 nt, Yersinia pestis KIM
cgauccaaaacaucggccagc

SEQ ID NO: 4182751 - RNA, 22 nt, Yersinia pestis KIM
cgauccaaaacaucggccagcg

SEQ ID NO: 4182752 - RNA, 20 nt, Yersinia pestis KIM
cgaucccaauauuaaaauag

SEQ ID NO: 4182753 - RNA, 15 nt, Yersinia pestis KIM
cgauccgcuuuuuag

SEQ ID NO: 4182754 - RNA, 17 nt, Yersinia pestis KIM
cgauccgggaaaaaaua

SEQ ID NO: 4182755 - RNA, 17 nt, Yersinia pestis KIM
cgaucuauccaauccuu

SEQ ID NO: 4182756 - RNA, 16 nt, Yersinia pestis KIM
cgaucuauucucugua

SEQ ID NO: 4182757 - RNA, 17 nt, Yersinia pestis KIM
cgaucugaaacggugag

SEQ ID NO: 4182758 - RNA, 20 nt, Yersinia pestis KIM
cgaucugccuguucucuccc

SEQ ID NO: 4182759 - RNA, 16 nt, Yersinia pestis KIM
cgaucuugaacgguga

SEQ ID NO: 4182760 - RNA, 14 nt, Yersinia pestis KIM
cgaugaaaaacaga

SEQ ID NO: 4182761 - RNA, 19 nt, Yersinia pestis KIM
cgaugaccauuuauuucca

SEQ ID NO: 4182762 - RNA, 20 nt, Yersinia pestis KIM
cgaugaccgugacauuuuca

SEQ ID NO: 4182763 - RNA, 16 nt, Yersinia pestis KIM
cgaugacgcgaucuug

SEQ ID NO: 4182764 - RNA, 16 nt, Yersinia pestis KIM
cgaugacucgaacuga

SEQ ID NO: 4182765 - RNA, 19 nt, Yersinia pestis KIM
cgaugaggcucuucugggc

SEQ ID NO: 4182766 - RNA, 15 nt, Yersinia pestis KIM
cgaugaugauuauuu

SEQ ID NO: 4182767 - RNA, 22 nt, Yersinia pestis KIM
cgaugcccccuacauagcgcau

SEQ ID NO: 4182768 - RNA, 13 nt, Yersinia pestis KIM
cgaugcgcugcuc

SEQ ID NO: 4182769 - RNA, 14 nt, Yersinia pestis KIM
cgaugcucaauacu

SEQ ID NO: 4182770 - RNA, 13 nt, Yersinia pestis KIM
cgaugcucaggcc

SEQ ID NO: 4182771 - RNA, 18 nt, Yersinia pestis KIM
cgaugcuuggggcuuauu

SEQ ID NO: 4182772 - RNA, 23 nt, Yersinia pestis KIM
cgauggggaguauucgugguggg

SEQ ID NO: 4182773 - RNA, 15 nt, Yersinia pestis KIM
cgaugguuucuccac

SEQ ID NO: 4182774 - RNA, 14 nt, Yersinia pestis KIM
cgauguggauaauu

SEQ ID NO: 4182775 - RNA, 16 nt, Yersinia pestis KIM
cgauguuuuccaacuc

SEQ ID NO: 4182776 - RNA, 20 nt, Yersinia pestis KIM
cgauuaaaauaaagcgaguu

SEQ ID NO: 4182777 - RNA, 14 nt, Yersinia pestis KIM
cgauuaccugcaua

SEQ ID NO: 4182778 - RNA, 18 nt, Yersinia pestis KIM
cgauuaccugcauauccu

SEQ ID NO: 4182779 - RNA, 16 nt, Yersinia pestis KIM
cgauuaggacaaauag

SEQ ID NO: 4182780 - RNA, 18 nt, Yersinia pestis KIM
cgauuauccgcaccauag

SEQ ID NO: 4182781 - RNA, 21 nt, Yersinia pestis KIM
cgauuccaucagcgcacugca

SEQ ID NO: 4182782 - RNA, 22 nt, Yersinia pestis KIM
cgauuccaucagcgcacugcau

SEQ ID NO: 4182783 - RNA, 13 nt, Yersinia pestis KIM
cgauuccucugua

SEQ ID NO: 4182784 - RNA, 17 nt, Yersinia pestis KIM
cgauuccuguugaccaa

SEQ ID NO: 4182785 - RNA, 18 nt, Yersinia pestis KIM
cgauuggacccgucacca

SEQ ID NO: 4182786 - RNA, 14 nt, Yersinia pestis KIM
cgauuuaugaaccg

SEQ ID NO: 4182787 - RNA, 13 nt, Yersinia pestis KIM
cgauuucaucagc

SEQ ID NO: 4182788 - RNA, 21 nt, Yersinia pestis KIM
cgauuucaucagcguuaccca

SEQ ID NO: 4182789 - RNA, 12 nt, Yersinia pestis KIM
cgauuucuacgg

SEQ ID NO: 4182790 - RNA, 22 nt, Yersinia pestis KIM
cgauuugcgggcuaaaacuggc

SEQ ID NO: 4182791 - RNA, 16 nt, Yersinia pestis KIM
cgauuugcucuuuuuu

SEQ ID NO: 4182792 - RNA, 13 nt, Yersinia pestis KIM
cgauuuuaaaaaa

SEQ ID NO: 4182793 - RNA, 14 nt, Yersinia pestis KIM
cgauuuuaaaaaau

SEQ ID NO: 4182794 - RNA, 15 nt, Yersinia pestis KIM
cgauuuuaaaaaauc

SEQ ID NO: 4182795 - RNA, 13 nt, Yersinia pestis KIM
cgauuuucgaaaa

SEQ ID NO: 4182796 - RNA, 14 nt, Yersinia pestis KIM
cgauuuuugaguuu

SEQ ID NO: 4182797 - RNA, 22 nt, Yersinia pestis KIM
cgcaaaaugccaacaacugggu

SEQ ID NO: 4182798 - RNA, 15 nt, Yersinia pestis KIM
cgcaaaauuuauauu

SEQ ID NO: 4182799 - RNA, 17 nt, Yersinia pestis KIM
cgcaaagggcaacaaua

SEQ ID NO: 4182800 - RNA, 14 nt, Yersinia pestis KIM
cgcaaaucaccuug

SEQ ID NO: 4182801 - RNA, 17 nt, Yersinia pestis KIM
cgcaaccaaucauucaa

SEQ ID NO: 4182802 - RNA, 15 nt, Yersinia pestis KIM
cgcaaccaccuuuac

SEQ ID NO: 4182803 - RNA, 22 nt, Yersinia pestis KIM
cgcaaccaccuuuaccaugcuc

SEQ ID NO: 4182804 - RNA, 17 nt, Yersinia pestis KIM
cgcaagaguuagggcug

SEQ ID NO: 4182805 - RNA, 12 nt, Yersinia pestis KIM
cgcaaggcaaac

SEQ ID NO: 4182806 - RNA, 21 nt, Yersinia pestis KIM
cgcaaguaaaagucagcaaau

SEQ ID NO: 4182807 - RNA, 22 nt, Yersinia pestis KIM
cgcaaguaaaagucagcaaauc

SEQ ID NO: 4182808 - RNA, 19 nt, Yersinia pestis KIM
cgcaauaaauggcauuuuu

SEQ ID NO: 4182809 - RNA, 14 nt, Yersinia pestis KIM
cgcaaucagauggu

SEQ ID NO: 4182810 - RNA, 21 nt, Yersinia pestis KIM
cgcaaucagccgcaucacuga

SEQ ID NO: 4182811 - RNA, 14 nt, Yersinia pestis KIM
cgcaaugaaccccg

SEQ ID NO: 4182812 - RNA, 15 nt, Yersinia pestis KIM
cgcaaugucaccuga

SEQ ID NO: 4182813 - RNA, 18 nt, Yersinia pestis KIM
cgcaauuugcccaucuuu

SEQ ID NO: 4182814 - RNA, 15 nt, Yersinia pestis KIM
cgcacaaacauggcu

SEQ ID NO: 4182815 - RNA, 12 nt, Yersinia pestis KIM
cgcaccaaugcc

SEQ ID NO: 4182816 - RNA, 14 nt, Yersinia pestis KIM
cgcaccauaaccaa

SEQ ID NO: 4182817 - RNA, 17 nt, Yersinia pestis KIM
cgcacccgcuacgguag

SEQ ID NO: 4182818 - RNA, 16 nt, Yersinia pestis KIM
cgcacccuccaauaau

SEQ ID NO: 4182819 - RNA, 18 nt, Yersinia pestis KIM
cgcaccgaaauagucgcg

SEQ ID NO: 4182820 - RNA, 18 nt, Yersinia pestis KIM
cgcaccggggugaucaac

SEQ ID NO: 4182821 - RNA, 15 nt, Yersinia pestis KIM
cgcaccugcccagac

SEQ ID NO: 4182822 - RNA, 18 nt, Yersinia pestis KIM
cgcacgaaaggcuggagc

SEQ ID NO: 4182823 - RNA, 23 nt, Yersinia pestis KIM
cgcacgaauaucuagcaacacau

SEQ ID NO: 4182824 - RNA, 22 nt, Yersinia pestis KIM
cgcacgggucauuaacgcacau

SEQ ID NO: 4182825 - RNA, 16 nt, Yersinia pestis KIM
cgcacguaccacggcg

SEQ ID NO: 4182826 - RNA, 23 nt, Yersinia pestis KIM
cgcacugagggugauaucgucag

SEQ ID NO: 4182827 - RNA, 14 nt, Yersinia pestis KIM
cgcacugauagcca

SEQ ID NO: 4182828 - RNA, 13 nt, Yersinia pestis KIM
cgcacugcaugcc

SEQ ID NO: 4182829 - RNA, 20 nt, Yersinia pestis KIM
cgcacugguugcuucaucaa

SEQ ID NO: 4182830 - RNA, 22 nt, Yersinia pestis KIM
cgcacuuaaugccgcugaucag

SEQ ID NO: 4182831 - RNA, 16 nt, Yersinia pestis KIM
cgcacuugcggcaaug

SEQ ID NO: 4182832 - RNA, 14 nt, Yersinia pestis KIM
cgcagaaccuuguu

SEQ ID NO: 4182833 - RNA, 18 nt, Yersinia pestis KIM
cgcagauccagaauuuca

SEQ ID NO: 4182834 - RNA, 19 nt, Yersinia pestis KIM
cgcagcaaauaaacaaaau

SEQ ID NO: 4182835 - RNA, 22 nt, Yersinia pestis KIM
cgcagccaacggagcguacacg

SEQ ID NO: 4182836 - RNA, 16 nt, Yersinia pestis KIM
cgcagcguccauaaac

SEQ ID NO: 4182837 - RNA, 23 nt, Yersinia pestis KIM
cgcaggaacgaaguuagacccaa

SEQ ID NO: 4182838 - RNA, 16 nt, Yersinia pestis KIM
cgcaggauaaagcuga

SEQ ID NO: 4182839 - RNA, 12 nt, Yersinia pestis KIM
cgcaggcggcca

SEQ ID NO: 4182840 - RNA, 14 nt, Yersinia pestis KIM
cgcaggucccucuu

SEQ ID NO: 4182841 - RNA, 20 nt, Yersinia pestis KIM
cgcaggucccucuugaauaa

SEQ ID NO: 4182842 - RNA, 20 nt, Yersinia pestis KIM
cgcaguacgugacggcagcg

SEQ ID NO: 4182843 - RNA, 24 nt, Yersinia pestis KIM
cgcaguacgugacggcggcgagca

SEQ ID NO: 4182844 - RNA, 19 nt, Yersinia pestis KIM
cgcaguacucggcauugcc

SEQ ID NO: 4182845 - RNA, 15 nt, Yersinia pestis KIM
cgcaguguaaaaccu

SEQ ID NO: 4182846 - RNA, 15 nt, Yersinia pestis KIM
cgcaguuuaucuuca

SEQ ID NO: 4182847 - RNA, 17 nt, Yersinia pestis KIM
cgcauaagacaacgccg

SEQ ID NO: 4182848 - RNA, 21 nt, Yersinia pestis KIM
cgcauaaucaguacaucaaua

SEQ ID NO: 4182849 - RNA, 22 nt, Yersinia pestis KIM
cgcauccccaucgccaauacaa

SEQ ID NO: 4182850 - RNA, 21 nt, Yersinia pestis KIM
cgcauccgggaaccccuucag

SEQ ID NO: 4182851 - RNA, 20 nt, Yersinia pestis KIM
cgcaucgccuguaaaucuug

SEQ ID NO: 4182852 - RNA, 15 nt, Yersinia pestis KIM
cgcaucuuccaaagg

SEQ ID NO: 4182853 - RNA, 13 nt, Yersinia pestis KIM
cgcaugacuagug

SEQ ID NO: 4182854 - RNA, 18 nt, Yersinia pestis KIM
cgcaugcaacagauaauu

SEQ ID NO: 4182855 - RNA, 19 nt, Yersinia pestis KIM
cgcauuaauccgccugaga

SEQ ID NO: 4182856 - RNA, 22 nt, Yersinia pestis KIM
cgcauuagguguuaacgcgccg

SEQ ID NO: 4182857 - RNA, 16 nt, Yersinia pestis KIM
cgcauucaccaccaua

SEQ ID NO: 4182858 - RNA, 20 nt, Yersinia pestis KIM
cgcauucauaucguccaaag

SEQ ID NO: 4182859 - RNA, 13 nt, Yersinia pestis KIM
cgcauuccaucag

SEQ ID NO: 4182860 - RNA, 17 nt, Yersinia pestis KIM
cgcauucgugccauaaa

SEQ ID NO: 4182861 - RNA, 14 nt, Yersinia pestis KIM
cgcauugaggucag

SEQ ID NO: 4182862 - RNA, 15 nt, Yersinia pestis KIM
cgcauugucacccac

SEQ ID NO: 4182863 - RNA, 20 nt, Yersinia pestis KIM
cgcauugucacccacuaaug

SEQ ID NO: 4182864 - RNA, 21 nt, Yersinia pestis KIM
cgcauugugcuuuuuggcaaa

SEQ ID NO: 4182865 - RNA, 20 nt, Yersinia pestis KIM
cgcauuuauuuguagugacg

SEQ ID NO: 4182866 - RNA, 17 nt, Yersinia pestis KIM
cgccaaaacgcgcgcca

SEQ ID NO: 4182867 - RNA, 22 nt, Yersinia pestis KIM
cgccaaauacaaaccguuugcc

SEQ ID NO: 4182868 - RNA, 16 nt, Yersinia pestis KIM
cgccaacacuauugug

SEQ ID NO: 4182869 - RNA, 14 nt, Yersinia pestis KIM
cgccaacugcggca

SEQ ID NO: 4182870 - RNA, 20 nt, Yersinia pestis KIM
cgccaaggaaggcuauuuuu

SEQ ID NO: 4182871 - RNA, 20 nt, Yersinia pestis KIM
cgccaauacccguucaacag

SEQ ID NO: 4182872 - RNA, 12 nt, Yersinia pestis KIM
cgccaaucgcca

SEQ ID NO: 4182873 - RNA, 22 nt, Yersinia pestis KIM
cgccaauggggccauaagugca

SEQ ID NO: 4182874 - RNA, 13 nt, Yersinia pestis KIM
cgccaauucacgc

SEQ ID NO: 4182875 - RNA, 22 nt, Yersinia pestis KIM
cgccacacaauacauagaagcu

SEQ ID NO: 4182876 - RNA, 23 nt, Yersinia pestis KIM
cgccacagcaacaggguaauaac

SEQ ID NO: 4182877 - RNA, 21 nt, Yersinia pestis KIM
cgccaccaaugcauccaagcc

SEQ ID NO: 4182878 - RNA, 20 nt, Yersinia pestis KIM
cgccacgcagugccgaugag

SEQ ID NO: 4182879 - RNA, 14 nt, Yersinia pestis KIM
cgccacgcugaugc

SEQ ID NO: 4182880 - RNA, 15 nt, Yersinia pestis KIM
cgccacggauaaggu

SEQ ID NO: 4182881 - RNA, 15 nt, Yersinia pestis KIM
cgccacuuaucccaa

SEQ ID NO: 4182882 - RNA, 23 nt, Yersinia pestis KIM
cgccacuuuuaccgcaaccaccu

SEQ ID NO: 4182883 - RNA, 18 nt, Yersinia pestis KIM
cgccagauggucacccuc

SEQ ID NO: 4182884 - RNA, 14 nt, Yersinia pestis KIM
cgccagauuaucca

SEQ ID NO: 4182885 - RNA, 16 nt, Yersinia pestis KIM
cgccagauuauccagc

SEQ ID NO: 4182886 - RNA, 23 nt, Yersinia pestis KIM
cgccagauucgcaaagcgggcca

SEQ ID NO: 4182887 - RNA, 19 nt, Yersinia pestis KIM
cgccagccccgcuaccaag

SEQ ID NO: 4182888 - RNA, 20 nt, Yersinia pestis KIM
cgccaggaaaucaugacgcu

SEQ ID NO: 4182889 - RNA, 22 nt, Yersinia pestis KIM
cgccagggguaagauccaccac

SEQ ID NO: 4182890 - RNA, 23 nt, Yersinia pestis KIM
cgccagguaagaaagagaugacc

SEQ ID NO: 4182891 - RNA, 15 nt, Yersinia pestis KIM
cgcuauaucaucagc

SEQ ID NO: 4182892 - RNA, 19 nt, Yersinia pestis KIM
cgcuaucacuagcgggccu

SEQ ID NO: 4182893 - RNA, 21 nt, Yersinia pestis KIM
cgcuauccccacggcgacguu

SEQ ID NO: 4182894 - RNA, 23 nt, Yersinia pestis KIM
cgcuaucugcugaccauuacgua

SEQ ID NO: 4182895 - RNA, 13 nt, Yersinia pestis KIM
cgcuaugcagccc

SEQ ID NO: 4182896 - RNA, 12 nt, Yersinia pestis KIM
cgcuaugcuaaa

SEQ ID NO: 4182897 - RNA, 23 nt, Yersinia pestis KIM
cgcuauucacuccuugaaguguu

SEQ ID NO: 4182898 - RNA, 14 nt, Yersinia pestis KIM
cgcuauuucucucu

SEQ ID NO: 4182899 - RNA, 15 nt, Yersinia pestis KIM
cgcucaaucacgaca

SEQ ID NO: 4182900 - RNA, 14 nt, Yersinia pestis KIM
cgcucaauuaaccu

SEQ ID NO: 4182901 - RNA, 15 nt, Yersinia pestis KIM
cgcucacuuuuauau

SEQ ID NO: 4182902 - RNA, 22 nt, Yersinia pestis KIM
cgcucacuuuuauauccgccau

SEQ ID NO: 4182903 - RNA, 19 nt, Yersinia pestis KIM
cgcucauaccaugccauca

SEQ ID NO: 4182904 - RNA, 22 nt, Yersinia pestis KIM
cgcucaucaaccgggauaucaa

SEQ ID NO: 4182905 - RNA, 16 nt, Yersinia pestis KIM
cgcucaucacggcggc

SEQ ID NO: 4182906 - RNA, 21 nt, Yersinia pestis KIM
cgcucauccaacguaaacauu

SEQ ID NO: 4182907 - RNA, 17 nt, Yersinia pestis KIM
cgcucaucgccaaagcc

SEQ ID NO: 4182908 - RNA, 15 nt, Yersinia pestis KIM
cgcucaucgguacca

SEQ ID NO: 4182909 - RNA, 14 nt, Yersinia pestis KIM
cgcuccacacaaaa

SEQ ID NO: 4182910 - RNA, 20 nt, Yersinia pestis KIM
cgcuccacacaaaaacgcuc

SEQ ID NO: 4182911 - RNA, 17 nt, Yersinia pestis KIM
cgcuccagauugucaau

SEQ ID NO: 4182912 - RNA, 13 nt, Yersinia pestis KIM
cgcuccagguuca

SEQ ID NO: 4182913 - RNA, 16 nt, Yersinia pestis KIM
cgcuccaucagguuua

SEQ ID NO: 4182914 - RNA, 18 nt, Yersinia pestis KIM
cgcuccggcaaccagcgu

SEQ ID NO: 4182915 - RNA, 12 nt, Yersinia pestis KIM
cgcuccucagcc

SEQ ID NO: 4182916 - RNA, 15 nt, Yersinia pestis KIM
cgcucgaaccgccac

SEQ ID NO: 4182917 - RNA, 18 nt, Yersinia pestis KIM
cgcucgcgugucaaacca

SEQ ID NO: 4182918 - RNA, 23 nt, Yersinia pestis KIM
cgcucggcucgaaccugaacgca

SEQ ID NO: 4182919 - RNA, 16 nt, Yersinia pestis KIM
cgcucuacaacgucca

SEQ ID NO: 4182920 - RNA, 12 nt, Yersinia pestis KIM
cgcucuccccau

SEQ ID NO: 4182921 - RNA, 21 nt, Yersinia pestis KIM
cgcucuguugacucgcggcag

SEQ ID NO: 4182922 - RNA, 15 nt, Yersinia pestis KIM
cgcucuucagcauca

SEQ ID NO: 4182923 - RNA, 17 nt, Yersinia pestis KIM
cgcugaaguggcugaau

SEQ ID NO: 4182924 - RNA, 20 nt, Yersinia pestis KIM
cgcugacagcuaucuugaaa

SEQ ID NO: 4182925 - RNA, 20 nt, Yersinia pestis KIM
cgcugagcgggcggcaauga

SEQ ID NO: 4182926 - RNA, 20 nt, Yersinia pestis KIM
cgcugagguucuccaacaac

SEQ ID NO: 4182927 - RNA, 16 nt, Yersinia pestis KIM
cgcugauaaccagcag

SEQ ID NO: 4182928 - RNA, 17 nt, Yersinia pestis KIM
cgcugauaaccagcagc

SEQ ID NO: 4182929 - RNA, 16 nt, Yersinia pestis KIM
cgcugauaacuuccuu

SEQ ID NO: 4182930 - RNA, 20 nt, Yersinia pestis KIM
cgcugauaacuuccuuugcc

SEQ ID NO: 4182931 - RNA, 16 nt, Yersinia pestis KIM
cgcugaucaucaucaa

SEQ ID NO: 4182932 - RNA, 23 nt, Yersinia pestis KIM
cgcugcaaacaggcccacugcaa

SEQ ID NO: 4182933 - RNA, 19 nt, Yersinia pestis KIM
cgcugcaacuccuuaccac

SEQ ID NO: 4182934 - RNA, 16 nt, Yersinia pestis KIM
cgcugcaagccgcguu

SEQ ID NO: 4182935 - RNA, 17 nt, Yersinia pestis KIM
cgcugcagcaucaagga

SEQ ID NO: 4182936 - RNA, 13 nt, Yersinia pestis KIM
cgcugcagcuuua

SEQ ID NO: 4182937 - RNA, 13 nt, Yersinia pestis KIM
cgcugcaucagca

SEQ ID NO: 4182938 - RNA, 15 nt, Yersinia pestis KIM
cgcugcaucagcagu

SEQ ID NO: 4182939 - RNA, 17 nt, Yersinia pestis KIM
cgcugcuaaacaggguu

SEQ ID NO: 4182940 - RNA, 13 nt, Yersinia pestis KIM
cgcugcugaauuc

SEQ ID NO: 4182941 - RNA, 13 nt, Yersinia pestis KIM
cgcuggaagccgc

SEQ ID NO: 4182942 - RNA, 21 nt, Yersinia pestis KIM
cgcuggaagccgccaaguugg

SEQ ID NO: 4182943 - RNA, 22 nt, Yersinia pestis KIM
cgcuggcaauacgugguuugau

SEQ ID NO: 4182944 - RNA, 14 nt, Yersinia pestis KIM
cgcuggcauacuga

SEQ ID NO: 4182945 - RNA, 22 nt, Yersinia pestis KIM
cgcuggccgcaacgcauuguuu

SEQ ID NO: 4182946 - RNA, 18 nt, Yersinia pestis KIM
cgcuggcgaccacuuccu

SEQ ID NO: 4182947 - RNA, 19 nt, Yersinia pestis KIM
cgcugguuaucacagcaaa

SEQ ID NO: 4182948 - RNA, 18 nt, Yersinia pestis KIM
cgcuguaggugucaccaa

SEQ ID NO: 4182949 - RNA, 17 nt, Yersinia pestis KIM
cgcugugcaacaucagg

SEQ ID NO: 4182950 - RNA, 16 nt, Yersinia pestis KIM
cgcugugccuggauca

SEQ ID NO: 4182951 - RNA, 17 nt, Yersinia pestis KIM
cgcuuagcaggcccuuu

SEQ ID NO: 4182952 - RNA, 20 nt, Yersinia pestis KIM
cgcuuaucccuccaucaagc

SEQ ID NO: 4182953 - RNA, 19 nt, Yersinia pestis KIM
cgcuucgcuggucauaauc

SEQ ID NO: 4182954 - RNA, 21 nt, Yersinia pestis KIM
cgcuucgcuggucauaaucau

SEQ ID NO: 4182955 - RNA, 21 nt, Yersinia pestis KIM
cgcuugauugauaccacaauc

SEQ ID NO: 4182956 - RNA, 12 nt, Yersinia pestis KIM
cgcuugcaucaa

SEQ ID NO: 4182957 - RNA, 17 nt, Yersinia pestis KIM
cgcuugggcgauaucca

SEQ ID NO: 4182958 - RNA, 17 nt, Yersinia pestis KIM
cgcuuuaaucagcccuu

SEQ ID NO: 4182959 - RNA, 20 nt, Yersinia pestis KIM
cgcuuuacccugguuagcaa

SEQ ID NO: 4182960 - RNA, 19 nt, Yersinia pestis KIM
cgcuuuacuccccugccua

SEQ ID NO: 4182961 - RNA, 19 nt, Yersinia pestis KIM
cgcuuuacuccucugccua

SEQ ID NO: 4182962 - RNA, 19 nt, Yersinia pestis KIM
cgcuuuacucuucugccua

SEQ ID NO: 4182963 - RNA, 23 nt, Yersinia pestis KIM
cgcuuuagugggugagcagagau

SEQ ID NO: 4182964 - RNA, 22 nt, Yersinia pestis KIM
cgcuuuaucuccgccauugagu

SEQ ID NO: 4182965 - RNA, 17 nt, Yersinia pestis KIM
cgcuuucuguucaucaa

SEQ ID NO: 4182966 - RNA, 19 nt, Yersinia pestis KIM
cgcuuucuguucaucaaua

SEQ ID NO: 4182967 - RNA, 22 nt, Yersinia pestis KIM
cgcuuuucgcuaucaauuaaug

SEQ ID NO: 4182968 - RNA, 14 nt, Yersinia pestis KIM
cgcuuuuuacccag

SEQ ID NO: 4182969 - RNA, 13 nt, Yersinia pestis KIM
cgcuuuuuacuga

SEQ ID NO: 4182970 - RNA, 17 nt, Yersinia pestis KIM
cgcuuuuuagcgaucag

SEQ ID NO: 4182971 - RNA, 13 nt, Yersinia pestis KIM
cggaaaucaccaa

SEQ ID NO: 4182972 - RNA, 20 nt, Yersinia pestis KIM
cggaaaugccgauaaaaacu

SEQ ID NO: 4182973 - RNA, 22 nt, Yersinia pestis KIM
cggaaaugccgauaaaaacuau

SEQ ID NO: 4182974 - RNA, 15 nt, Yersinia pestis KIM
cggaaauuaaaaauu

SEQ ID NO: 4182975 - RNA, 19 nt, Yersinia pestis KIM
cggaaccuuucgaguugaa

SEQ ID NO: 4182976 - RNA, 17 nt, Yersinia pestis KIM
cggaacucaucuuucuc

SEQ ID NO: 4182977 - RNA, 23 nt, Yersinia pestis KIM
cggaagagauagagcaguaaguu

SEQ ID NO: 4182978 - RNA, 16 nt, Yersinia pestis KIM
cggaagcacguaaauc

SEQ ID NO: 4182979 - RNA, 19 nt, Yersinia pestis KIM
cggaagccgugaccgcaga

SEQ ID NO: 4182980 - RNA, 22 nt, Yersinia pestis KIM
cggaagcgccgacacccagcca

SEQ ID NO: 4182981 - RNA, 21 nt, Yersinia pestis KIM
cggaagguugcccccaccaug

SEQ ID NO: 4182982 - RNA, 20 nt, Yersinia pestis KIM
cggaaucaccuuucuccaug

SEQ ID NO: 4182983 - RNA, 16 nt, Yersinia pestis KIM
cggacaccaacuggcg

SEQ ID NO: 4182984 - RNA, 15 nt, Yersinia pestis KIM
cggacagcgcgcagc

SEQ ID NO: 4182985 - RNA, 22 nt, Yersinia pestis KIM
cggacauaaugcauccacuuuu

SEQ ID NO: 4182986 - RNA, 21 nt, Yersinia pestis KIM
cggacauuuuacucccugacu

SEQ ID NO: 4182987 - RNA, 22 nt, Yersinia pestis KIM
cggacgcuuuacuccccugccu

SEQ ID NO: 4182988 - RNA, 18 nt, Yersinia pestis KIM
cggacgcuuuacuccucu

SEQ ID NO: 4182989 - RNA, 18 nt, Yersinia pestis KIM
cggacggaauccaacauc

SEQ ID NO: 4182990 - RNA, 17 nt, Yersinia pestis KIM
cggacucauuccgccug

SEQ ID NO: 4182991 - RNA, 16 nt, Yersinia pestis KIM
cggagagaacaggcag

SEQ ID NO: 4182992 - RNA, 14 nt, Yersinia pestis KIM
cggagagucagcaa

SEQ ID NO: 4182993 - RNA, 16 nt, Yersinia pestis KIM
cggagcguacacgcag

SEQ ID NO: 4182994 - RNA, 16 nt, Yersinia pestis KIM
cggaggagauuucaga

SEQ ID NO: 4182995 - RNA, 18 nt, Yersinia pestis KIM
cggauaacggcggcaaua

SEQ ID NO: 4182996 - RNA, 13 nt, Yersinia pestis KIM
cggaucagcgccu

SEQ ID NO: 4182997 - RNA, 18 nt, Yersinia pestis KIM
cggaucauaaucgauuac

SEQ ID NO: 4182998 - RNA, 15 nt, Yersinia pestis KIM
cggauccccugauaa

SEQ ID NO: 4182999 - RNA, 17 nt, Yersinia pestis KIM
cggaugccgcuccagca

SEQ ID NO: 4183000 - RNA, 19 nt, Yersinia pestis KIM
cggaugccggaaucagcca

SEQ ID NO: 4183001 - RNA, 20 nt, Yersinia pestis KIM
cggauggcgcgguucuagua

SEQ ID NO: 4183002 - RNA, 22 nt, Yersinia pestis KIM
cggauggucauccacaaccaga

SEQ ID NO: 4183003 - RNA, 23 nt, Yersinia pestis KIM
cggauucacccauuaauagacga

SEQ ID NO: 4183004 - RNA, 16 nt, Yersinia pestis KIM
cggauugcaaauccgu

SEQ ID NO: 4183005 - RNA, 16 nt, Yersinia pestis KIM
cgggugcuuuaaugag

SEQ ID NO: 4183006 - RNA, 17 nt, Yersinia pestis KIM
cggguggaccuccauca

SEQ ID NO: 4183007 - RNA, 23 nt, Yersinia pestis KIM
cggguggcccaaaugagcagcaa

SEQ ID NO: 4183008 - RNA, 17 nt, Yersinia pestis KIM
cggguggcgcugacggu

SEQ ID NO: 4183009 - RNA, 17 nt, Yersinia pestis KIM
cggguuaacucuucaac

SEQ ID NO: 4183010 - RNA, 17 nt, Yersinia pestis KIM
cggguuaacuuuuucua

SEQ ID NO: 4183011 - RNA, 15 nt, Yersinia pestis KIM
cggguucaaggaaac

SEQ ID NO: 4183012 - RNA, 17 nt, Yersinia pestis KIM
cggguucaaggaaacca

SEQ ID NO: 4183013 - RNA, 18 nt, Yersinia pestis KIM
cggguucgcgcucacgca

SEQ ID NO: 4183014 - RNA, 15 nt, Yersinia pestis KIM
cggguucuaaauccu

SEQ ID NO: 4183015 - RNA, 20 nt, Yersinia pestis KIM
cggguugcccaucagcauca

SEQ ID NO: 4183016 - RNA, 17 nt, Yersinia pestis KIM
cgguaacauauaaacca

SEQ ID NO: 4183017 - RNA, 22 nt, Yersinia pestis KIM
cgguaacgcccguugcccaccg

SEQ ID NO: 4183018 - RNA, 11 nt, Yersinia pestis KIM
cgguaauaaug

SEQ ID NO: 4183019 - RNA, 16 nt, Yersinia pestis KIM
cgguaauacucuggcc

SEQ ID NO: 4183020 - RNA, 17 nt, Yersinia pestis KIM
cgguaaucaauuuuugc

SEQ ID NO: 4183021 - RNA, 22 nt, Yersinia pestis KIM
cgguaaucccgauauaaauaaa

SEQ ID NO: 4183022 - RNA, 22 nt, Yersinia pestis KIM
cgguaaugacauauucaaccgc

SEQ ID NO: 4183023 - RNA, 14 nt, Yersinia pestis KIM
cgguacaggcaaag

SEQ ID NO: 4183024 - RNA, 14 nt, Yersinia pestis KIM
cgguaccagcaaac

SEQ ID NO: 4183025 - RNA, 16 nt, Yersinia pestis KIM
cgguaccgcaggucag

SEQ ID NO: 4183026 - RNA, 13 nt, Yersinia pestis KIM
cgguacugaggca

SEQ ID NO: 4183027 - RNA, 15 nt, Yersinia pestis KIM
cgguagcgauaaacg

SEQ ID NO: 4183028 - RNA, 20 nt, Yersinia pestis KIM
cgguagcgauaaacguucaa

SEQ ID NO: 4183029 - RNA, 18 nt, Yersinia pestis KIM
cgguagguuucugggcug

SEQ ID NO: 4183030 - RNA, 13 nt, Yersinia pestis KIM
cgguaucaaucag

SEQ ID NO: 4183031 - RNA, 19 nt, Yersinia pestis KIM
cgguaugaaacaaccgugu

SEQ ID NO: 4183032 - RNA, 23 nt, Yersinia pestis KIM
cgguauguguguacuuaucgauu

SEQ ID NO: 4183033 - RNA, 14 nt, Yersinia pestis KIM
cgguauucagccaa

SEQ ID NO: 4183034 - RNA, 14 nt, Yersinia pestis KIM
cgguauucagccgc

SEQ ID NO: 4183035 - RNA, 13 nt, Yersinia pestis KIM
cggucaacgauug

SEQ ID NO: 4183036 - RNA, 13 nt, Yersinia pestis KIM
cggucacaccaga

SEQ ID NO: 4183037 - RNA, 15 nt, Yersinia pestis KIM
cggucacacuggcac

SEQ ID NO: 4183038 - RNA, 20 nt, Yersinia pestis KIM
cggucgaacccauucaucaa

SEQ ID NO: 4183039 - RNA, 16 nt, Yersinia pestis KIM
cggucuaaugcaauuu

SEQ ID NO: 4183040 - RNA, 18 nt, Yersinia pestis KIM
cggucuggcaacugcaaa

SEQ ID NO: 4183041 - RNA, 19 nt, Yersinia pestis KIM
cggucuguuaauccuaaug

SEQ ID NO: 4183042 - RNA, 11 nt, Yersinia pestis KIM
cggugaacaga

SEQ ID NO: 4183043 - RNA, 15 nt, Yersinia pestis KIM
cggugaauacguuca

SEQ ID NO: 4183044 - RNA, 16 nt, Yersinia pestis KIM
cggugaauacguucaa

SEQ ID NO: 4183045 - RNA, 21 nt, Yersinia pestis KIM
cggugacauccgcuugcagca

SEQ ID NO: 4183046 - RNA, 17 nt, Yersinia pestis KIM
cggugacccgugcggca

SEQ ID NO: 4183047 - RNA, 18 nt, Yersinia pestis KIM
cggugaggauaggcagag

SEQ ID NO: 4183048 - RNA, 15 nt, Yersinia pestis KIM
cggugauuccaauga

SEQ ID NO: 4183049 - RNA, 16 nt, Yersinia pestis KIM
cggugcaaaaccccaa

SEQ ID NO: 4183050 - RNA, 19 nt, Yersinia pestis KIM
cggugccgcaucaccgccc

SEQ ID NO: 4183051 - RNA, 15 nt, Yersinia pestis KIM
cggugcugacaaaca

SEQ ID NO: 4183052 - RNA, 16 nt, Yersinia pestis KIM
cggugcugauguuguc

SEQ ID NO: 4183053 - RNA, 14 nt, Yersinia pestis KIM
cggugcuggugggc

SEQ ID NO: 4183054 - RNA, 13 nt, Yersinia pestis KIM
cgguggccgccuu

SEQ ID NO: 4183055 - RNA, 17 nt, Yersinia pestis KIM
cgguggcuuacgccacu

SEQ ID NO: 4183056 - RNA, 15 nt, Yersinia pestis KIM
cgguguuccacaaug

SEQ ID NO: 4183057 - RNA, 15 nt, Yersinia pestis KIM
cgguguuuggugaag

SEQ ID NO: 4183058 - RNA, 14 nt, Yersinia pestis KIM
cgguuacaccaaua

SEQ ID NO: 4183059 - RNA, 19 nt, Yersinia pestis KIM
cgguuacccucuauuaucu

SEQ ID NO: 4183060 - RNA, 18 nt, Yersinia pestis KIM
cgguuaccguauccacuu

SEQ ID NO: 4183061 - RNA, 19 nt, Yersinia pestis KIM
cgguuauaaaacagccacg

SEQ ID NO: 4183062 - RNA, 20 nt, Yersinia pestis KIM
cgguuauaaaacagccacga

SEQ ID NO: 4183063 - RNA, 19 nt, Yersinia pestis KIM
cgguuauucguggugauga

SEQ ID NO: 4183064 - RNA, 12 nt, Yersinia pestis KIM
cgguuauuuaga

SEQ ID NO: 4183065 - RNA, 12 nt, Yersinia pestis KIM
cgguuauuuucu

SEQ ID NO: 4183066 - RNA, 20 nt, Yersinia pestis KIM
cgguucccacggauuaacuu

SEQ ID NO: 4183067 - RNA, 19 nt, Yersinia pestis KIM
cgguucuaguauucaggaa

SEQ ID NO: 4183068 - RNA, 24 nt, Yersinia pestis KIM
cgguucuguaucauauguucgauc

SEQ ID NO: 4183069 - RNA, 20 nt, Yersinia pestis KIM
cgguugcuguaaugccuggu

SEQ ID NO: 4183070 - RNA, 19 nt, Yersinia pestis KIM
cgguugcuuuuaacuccuu

SEQ ID NO: 4183071 - RNA, 22 nt, Yersinia pestis KIM
cgguuggucagcacuuccaacu

SEQ ID NO: 4183072 - RNA, 21 nt, Yersinia pestis KIM
cgguugucaugcuguagcagc

SEQ ID NO: 4183073 - RNA, 18 nt, Yersinia pestis KIM
cgguuguccuucaauggc

SEQ ID NO: 4183074 - RNA, 16 nt, Yersinia pestis KIM
cgguuuaugcccagaa

SEQ ID NO: 4183075 - RNA, 19 nt, Yersinia pestis KIM
cgguuucaaauagccuggu

SEQ ID NO: 4183076 - RNA, 15 nt, Yersinia pestis KIM
cgguuucaacaucca

SEQ ID NO: 4183077 - RNA, 15 nt, Yersinia pestis KIM
cgguuucaacuucaa

SEQ ID NO: 4183078 - RNA, 16 nt, Yersinia pestis KIM
cgguuucacccucuuu

SEQ ID NO: 4183079 - RNA, 16 nt, Yersinia pestis KIM
cgguuuccggcucuua

SEQ ID NO: 4183080 - RNA, 23 nt, Yersinia pestis KIM
cgguuuccugcggggaucgggcu

SEQ ID NO: 4183081 - RNA, 15 nt, Yersinia pestis KIM
cgguuugagcuugcu

SEQ ID NO: 4183082 - RNA, 13 nt, Yersinia pestis KIM
cgguuuguugcua

SEQ ID NO: 4183083 - RNA, 12 nt, Yersinia pestis KIM
cgguuuuaaaua

SEQ ID NO: 4183084 - RNA, 17 nt, Yersinia pestis KIM
cgguuuuaucaauaggu

SEQ ID NO: 4183085 - RNA, 20 nt, Yersinia pestis KIM
cgguuuuuucuuucuucagc

SEQ ID NO: 4183086 - RNA, 14 nt, Yersinia pestis KIM
cguaaaaaacccuc

SEQ ID NO: 4183087 - RNA, 21 nt, Yersinia pestis KIM
cguaaaaaggcagugacagua

SEQ ID NO: 4183088 - RNA, 12 nt, Yersinia pestis KIM
cguaaacacaaa

SEQ ID NO: 4183089 - RNA, 13 nt, Yersinia pestis KIM
cguaaacauuggc

SEQ ID NO: 4183090 - RNA, 17 nt, Yersinia pestis KIM
cguaaacguucugccaa

SEQ ID NO: 4183091 - RNA, 18 nt, Yersinia pestis KIM
cguaaacugccguaaaca

SEQ ID NO: 4183092 - RNA, 14 nt, Yersinia pestis KIM
cguaaagacgccgu

SEQ ID NO: 4183093 - RNA, 19 nt, Yersinia pestis KIM
cguaaauaaaagcgccggu

SEQ ID NO: 4183094 - RNA, 15 nt, Yersinia pestis KIM
cguaaauacauccau

SEQ ID NO: 4183095 - RNA, 16 nt, Yersinia pestis KIM
cguaaauacauccaug

SEQ ID NO: 4183096 - RNA, 17 nt, Yersinia pestis KIM
cguaaaucgguugccau

SEQ ID NO: 4183097 - RNA, 20 nt, Yersinia pestis KIM
cguaacccagauuaggggcu

SEQ ID NO: 4183098 - RNA, 17 nt, Yersinia pestis KIM
cguaacccuaaugauua

SEQ ID NO: 4183099 - RNA, 16 nt, Yersinia pestis KIM
cguaacucaccgucug

SEQ ID NO: 4183100 - RNA, 23 nt, Yersinia pestis KIM
cguaacuccuuuguuauuucugg

SEQ ID NO: 4183101 - RNA, 13 nt, Yersinia pestis KIM
cguaacuguugca

SEQ ID NO: 4183102 - RNA, 14 nt, Yersinia pestis KIM
cguaacuguugcaa

SEQ ID NO: 4183103 - RNA, 11 nt, Yersinia pestis KIM
cguaacuucuu

SEQ ID NO: 4183104 - RNA, 12 nt, Yersinia pestis KIM
cguaagauuggg

SEQ ID NO: 4183105 - RNA, 21 nt, Yersinia pestis KIM
cguaauacccucgacaccaaa

SEQ ID NO: 4183106 - RNA, 23 nt, Yersinia pestis KIM
cguaauaguuaaucgcagcagag

SEQ ID NO: 4183107 - RNA, 23 nt, Yersinia pestis KIM
cguaauaucugccaccgcacagu

SEQ ID NO: 4183108 - RNA, 15 nt, Yersinia pestis KIM
cguaaucaccauuaa

SEQ ID NO: 4183109 - RNA, 14 nt, Yersinia pestis KIM
cguaaucagccgcg

SEQ ID NO: 4183110 - RNA, 19 nt, Yersinia pestis KIM
cguaauucagauaagaucu

SEQ ID NO: 4183111 - RNA, 15 nt, Yersinia pestis KIM
cguaauucagcacgg

SEQ ID NO: 4183112 - RNA, 18 nt, Yersinia pestis KIM
cguaauucccaccacuug

SEQ ID NO: 4183113 - RNA, 21 nt, Yersinia pestis KIM
cguacaaaaauaaacgggcuu

SEQ ID NO: 4183114 - RNA, 21 nt, Yersinia pestis KIM
cguacauauaucacuauuuca

SEQ ID NO: 4183115 - RNA, 11 nt, Yersinia pestis KIM
cguacauuaaa

SEQ ID NO: 4183116 - RNA, 13 nt, Yersinia pestis KIM
cguaccacaagcc

SEQ ID NO: 4183117 - RNA, 12 nt, Yersinia pestis KIM
cguacucuucug

SEQ ID NO: 4183118 - RNA, 18 nt, Yersinia pestis KIM
cguacuggcgcgcuuugg

SEQ ID NO: 4183119 - RNA, 15 nt, Yersinia pestis KIM
cguagccuucaaggu

SEQ ID NO: 4183120 - RNA, 13 nt, Yersinia pestis KIM
cguagcuaacacc

SEQ ID NO: 4183121 - RNA, 17 nt, Yersinia pestis KIM
cguuacucggcccaucc

SEQ ID NO: 4183122 - RNA, 23 nt, Yersinia pestis KIM
cguuacucgguccaucugaaauu

SEQ ID NO: 4183123 - RNA, 19 nt, Yersinia pestis KIM
cguuagaucaacauuaucu

SEQ ID NO: 4183124 - RNA, 15 nt, Yersinia pestis KIM
cguuagccuacuggc

SEQ ID NO: 4183125 - RNA, 16 nt, Yersinia pestis KIM
cguuagccuacuggcg

SEQ ID NO: 4183126 - RNA, 15 nt, Yersinia pestis KIM
cguuagcucuucacg

SEQ ID NO: 4183127 - RNA, 16 nt, Yersinia pestis KIM
cguuauacuucaagcu

SEQ ID NO: 4183128 - RNA, 20 nt, Yersinia pestis KIM
cguuaucaauacugcaaaug

SEQ ID NO: 4183129 - RNA, 16 nt, Yersinia pestis KIM
cguuauucucaauuga

SEQ ID NO: 4183130 - RNA, 17 nt, Yersinia pestis KIM
cguuauugcgacauaaa

SEQ ID NO: 4183131 - RNA, 14 nt, Yersinia pestis KIM
cguucaaaaucaaa

SEQ ID NO: 4183132 - RNA, 16 nt, Yersinia pestis KIM
cguucaaaucugcucc

SEQ ID NO: 4183133 - RNA, 16 nt, Yersinia pestis KIM
cguucaacaccacaac

SEQ ID NO: 4183134 - RNA, 16 nt, Yersinia pestis KIM
cguucaacaguaucaa

SEQ ID NO: 4183135 - RNA, 23 nt, Yersinia pestis KIM
cguucaacaguaucaaccaccgc

SEQ ID NO: 4183136 - RNA, 20 nt, Yersinia pestis KIM
cguucaaccuuuuccgccau

SEQ ID NO: 4183137 - RNA, 22 nt, Yersinia pestis KIM
cguucaaucgugcacccccuuc

SEQ ID NO: 4183138 - RNA, 20 nt, Yersinia pestis KIM
cguucacacgauuccucugu

SEQ ID NO: 4183139 - RNA, 21 nt, Yersinia pestis KIM
cguucacugaccgauugaauc

SEQ ID NO: 4183140 - RNA, 22 nt, Yersinia pestis KIM
cguucagauuaacggucacugg

SEQ ID NO: 4183141 - RNA, 14 nt, Yersinia pestis KIM
cguucaucaauacc

SEQ ID NO: 4183142 - RNA, 13 nt, Yersinia pestis KIM
cguucaucaccca

SEQ ID NO: 4183143 - RNA, 15 nt, Yersinia pestis KIM
cguuccucuugagcg

SEQ ID NO: 4183144 - RNA, 16 nt, Yersinia pestis KIM
cguucguuuacugccu

SEQ ID NO: 4183145 - RNA, 18 nt, Yersinia pestis KIM
cguucguuuacugccuug

SEQ ID NO: 4183146 - RNA, 23 nt, Yersinia pestis KIM
cguucguuuacugccuuguugcc

SEQ ID NO: 4183147 - RNA, 15 nt, Yersinia pestis KIM
cguucuacugcgucc

SEQ ID NO: 4183148 - RNA, 14 nt, Yersinia pestis KIM
cguucugucacaau

SEQ ID NO: 4183149 - RNA, 20 nt, Yersinia pestis KIM
cguugacuuucuaagcugcc

SEQ ID NO: 4183150 - RNA, 15 nt, Yersinia pestis KIM
cguugcacccugcuu

SEQ ID NO: 4183151 - RNA, 21 nt, Yersinia pestis KIM
cguugcaggggguuagcugca

SEQ ID NO: 4183152 - RNA, 16 nt, Yersinia pestis KIM
cguugccccaucagca

SEQ ID NO: 4183153 - RNA, 20 nt, Yersinia pestis KIM
cguugccccaucagcacucc

SEQ ID NO: 4183154 - RNA, 17 nt, Yersinia pestis KIM
cguugcccugagaauca

SEQ ID NO: 4183155 - RNA, 21 nt, Yersinia pestis KIM
cguuggaucaucgggaacagg

SEQ ID NO: 4183156 - RNA, 20 nt, Yersinia pestis KIM
cguuggcagaaagugaccca

SEQ ID NO: 4183157 - RNA, 18 nt, Yersinia pestis KIM
cguuggcagcaaaucuug

SEQ ID NO: 4183158 - RNA, 13 nt, Yersinia pestis KIM
cguugucuguaac

SEQ ID NO: 4183159 - RNA, 14 nt, Yersinia pestis KIM
cguuguucaagcac

SEQ ID NO: 4183160 - RNA, 17 nt, Yersinia pestis KIM
cguuguucacccacuug

SEQ ID NO: 4183161 - RNA, 17 nt, Yersinia pestis KIM
cguuguuguaugacaag

SEQ ID NO: 4183162 - RNA, 20 nt, Yersinia pestis KIM
cguuguuuucccucagccaa

SEQ ID NO: 4183163 - RNA, 15 nt, Yersinia pestis KIM
cguuuaaaguaaauc

SEQ ID NO: 4183164 - RNA, 12 nt, Yersinia pestis KIM
cguuuaaauaaa

SEQ ID NO: 4183165 - RNA, 14 nt, Yersinia pestis KIM
cguuuacugccuug

SEQ ID NO: 4183166 - RNA, 16 nt, Yersinia pestis KIM
cguuuacuggcugccu

SEQ ID NO: 4183167 - RNA, 19 nt, Yersinia pestis KIM
cguuuauacggcuauuuuu

SEQ ID NO: 4183168 - RNA, 21 nt, Yersinia pestis KIM
cguuucagauaaaaagccagu

SEQ ID NO: 4183169 - RNA, 16 nt, Yersinia pestis KIM
cguuucagcuccgauu

SEQ ID NO: 4183170 - RNA, 16 nt, Yersinia pestis KIM
cguuucaguaaaacca

SEQ ID NO: 4183171 - RNA, 18 nt, Yersinia pestis KIM
cguuucaguaaaaccagc

SEQ ID NO: 4183172 - RNA, 20 nt, Yersinia pestis KIM
cguuucaguaaaaccagcag

SEQ ID NO: 4183173 - RNA, 24 nt, Yersinia pestis KIM
cguuucauuuuaacaauuuuauug

SEQ ID NO: 4183174 - RNA, 14 nt, Yersinia pestis KIM
cguuuccaaaacuc

SEQ ID NO: 4183175 - RNA, 20 nt, Yersinia pestis KIM
cguuuccaaaacucaugucc

SEQ ID NO: 4183176 - RNA, 21 nt, Yersinia pestis KIM
cguuuccaaaacucaugucca

SEQ ID NO: 4183177 - RNA, 16 nt, Yersinia pestis KIM
cguuuccagaaucaau

SEQ ID NO: 4183178 - RNA, 20 nt, Yersinia pestis KIM
cguuuccagcggcguaucaa

SEQ ID NO: 4183179 - RNA, 22 nt, Yersinia pestis KIM
cguuuccagugcggcauguaca

SEQ ID NO: 4183180 - RNA, 21 nt, Yersinia pestis KIM
cguuucccccuguaaaacaag

SEQ ID NO: 4183181 - RNA, 22 nt, Yersinia pestis KIM
cguuucccgauggaacaggauu

SEQ ID NO: 4183182 - RNA, 21 nt, Yersinia pestis KIM
cguuuccgguaaugucacguu

SEQ ID NO: 4183183 - RNA, 16 nt, Yersinia pestis KIM
cguuucuacaauggcc

SEQ ID NO: 4183184 - RNA, 13 nt, Yersinia pestis KIM
cguuucucuuuca

SEQ ID NO: 4183185 - RNA, 18 nt, Yersinia pestis KIM
cguuuuaucgcauuacuc

SEQ ID NO: 4183186 - RNA, 21 nt, Yersinia pestis KIM
cguuuucggugcauguaacug

SEQ ID NO: 4183187 - RNA, 19 nt, Yersinia pestis KIM
cguuuugcagaucaaucgc

SEQ ID NO: 4183188 - RNA, 13 nt, Yersinia pestis KIM
cguuuugcaucaa

SEQ ID NO: 4183189 - RNA, 14 nt, Yersinia pestis KIM
cguuuugcaucaac

SEQ ID NO: 4183190 - RNA, 18 nt, Yersinia pestis KIM
cguuuuuucguuuacuug

SEQ ID NO: 4183191 - RNA, 17 nt, Yersinia pestis KIM
cguuuuuuuaucaaugg

SEQ ID NO: 4183192 - RNA, 13 nt, Yersinia pestis KIM
cuaaaaaaaacaa

SEQ ID NO: 4183193 - RNA, 14 nt, Yersinia pestis KIM
cuaaaaaaugauuu

SEQ ID NO: 4183194 - RNA, 19 nt, Yersinia pestis KIM
cuaaaaaccauccccagaa

SEQ ID NO: 4183195 - RNA, 12 nt, Yersinia pestis KIM
cuaaaacuggca

SEQ ID NO: 4183196 - RNA, 20 nt, Yersinia pestis KIM
cuaaaagggaguucaucaaa

SEQ ID NO: 4183197 - RNA, 13 nt, Yersinia pestis KIM
cuaaaaugacgau

SEQ ID NO: 4183198 - RNA, 18 nt, Yersinia pestis KIM
cuaaaauucaaacaaaua

SEQ ID NO: 4183199 - RNA, 12 nt, Yersinia pestis KIM
cuaaacacggcg

SEQ ID NO: 4183200 - RNA, 14 nt, Yersinia pestis KIM
cuaaaccaucagag

SEQ ID NO: 4183201 - RNA, 21 nt, Yersinia pestis KIM
cuaaacccaaccccaucagca

SEQ ID NO: 4183202 - RNA, 22 nt, Yersinia pestis KIM
cuaaacgaccaauuucaauaau

SEQ ID NO: 4183203 - RNA, 19 nt, Yersinia pestis KIM
cuaaacgccgcgucaauaa

SEQ ID NO: 4183204 - RNA, 22 nt, Yersinia pestis KIM
cuaaagcgccuuccuuuuauuu

SEQ ID NO: 4183205 - RNA, 22 nt, Yersinia pestis KIM
cuaaagcggaauuugccucugc

SEQ ID NO: 4183206 - RNA, 17 nt, Yersinia pestis KIM
cuaaagcugucagucca

SEQ ID NO: 4183207 - RNA, 17 nt, Yersinia pestis KIM
cuaaagggcugagcgga

SEQ ID NO: 4183208 - RNA, 12 nt, Yersinia pestis KIM
cuaaauacugcu

SEQ ID NO: 4183209 - RNA, 17 nt, Yersinia pestis KIM
cuaaauagauaaaaaca

SEQ ID NO: 4183210 - RNA, 23 nt, Yersinia pestis KIM
cuaaauguugauacaccgucuca

SEQ ID NO: 4183211 - RNA, 24 nt, Yersinia pestis KIM
cuaaauuagaaaacaaguuucacu

SEQ ID NO: 4183212 - RNA, 22 nt, Yersinia pestis KIM
cuaaauucuccuugagcggcau

SEQ ID NO: 4183213 - RNA, 18 nt, Yersinia pestis KIM
cuaaauugcuuaaaaaaa

SEQ ID NO: 4183214 - RNA, 14 nt, Yersinia pestis KIM
cuaacaacuuccac

SEQ ID NO: 4183215 - RNA, 16 nt, Yersinia pestis KIM
cuaacaacuuccacac

SEQ ID NO: 4183216 - RNA, 13 nt, Yersinia pestis KIM
cuaacaccgcugu

SEQ ID NO: 4183217 - RNA, 18 nt, Yersinia pestis KIM
cuaacagggaugaauaua

SEQ ID NO: 4183218 - RNA, 17 nt, Yersinia pestis KIM
cuaacaguuguuucaau

SEQ ID NO: 4183219 - RNA, 17 nt, Yersinia pestis KIM
cuaacauaaucaagaaa

SEQ ID NO: 4183220 - RNA, 21 nt, Yersinia pestis KIM
cuaacauaaucaagaaaacag

SEQ ID NO: 4183221 - RNA, 16 nt, Yersinia pestis KIM
cuaacaugccacauag

SEQ ID NO: 4183222 - RNA, 12 nt, Yersinia pestis KIM
cuaacaugguau

SEQ ID NO: 4183223 - RNA, 17 nt, Yersinia pestis KIM
cuaacauugagcggcga

SEQ ID NO: 4183224 - RNA, 17 nt, Yersinia pestis KIM
cuaaccaaacauuguca

SEQ ID NO: 4183225 - RNA, 14 nt, Yersinia pestis KIM
cuaaccacagcaau

SEQ ID NO: 4183226 - RNA, 17 nt, Yersinia pestis KIM
cuaaccccugcaucuug

SEQ ID NO: 4183227 - RNA, 17 nt, Yersinia pestis KIM
cuaaccuuaacugcaua

SEQ ID NO: 4183228 - RNA, 22 nt, Yersinia pestis KIM
cuaacgccgcguuagcuauauu

SEQ ID NO: 4183229 - RNA, 18 nt, Yersinia pestis KIM
cuaacgcuucggcgcggu

SEQ ID NO: 4183230 - RNA, 15 nt, Yersinia pestis KIM
cuaacgucaacagaa

SEQ ID NO: 4183231 - RNA, 12 nt, Yersinia pestis KIM
cuaacguccccu

SEQ ID NO: 4183232 - RNA, 17 nt, Yersinia pestis KIM
cuaacgucgcuguuacu

SEQ ID NO: 4183233 - RNA, 20 nt, Yersinia pestis KIM
cuaacgucgcuguuacucag

SEQ ID NO: 4183234 - RNA, 23 nt, Yersinia pestis KIM
cuaacuaauaauaaucuuaagua

SEQ ID NO: 4183235 - RNA, 14 nt, Yersinia pestis KIM
cuagcguuuacuuu

SEQ ID NO: 4183236 - RNA, 23 nt, Yersinia pestis KIM
cuagcucacggaagguugccccc

SEQ ID NO: 4183237 - RNA, 15 nt, Yersinia pestis KIM
cuagcucugaggcuu

SEQ ID NO: 4183238 - RNA, 12 nt, Yersinia pestis KIM
cuagcuguguuu

SEQ ID NO: 4183239 - RNA, 18 nt, Yersinia pestis KIM
cuagcuguguuuuaucug

SEQ ID NO: 4183240 - RNA, 21 nt, Yersinia pestis KIM
cuagcuguguuuuaucuguga

SEQ ID NO: 4183241 - RNA, 19 nt, Yersinia pestis KIM
cuagcuguuguuguugauu

SEQ ID NO: 4183242 - RNA, 16 nt, Yersinia pestis KIM
cuaggcuauugacaaa

SEQ ID NO: 4183243 - RNA, 19 nt, Yersinia pestis KIM
cuaggcucagcauggaaga

SEQ ID NO: 4183244 - RNA, 19 nt, Yersinia pestis KIM
cuagggauuuuaagcagcc

SEQ ID NO: 4183245 - RNA, 22 nt, Yersinia pestis KIM
cuagggauuuuaagcagccgcc

SEQ ID NO: 4183246 - RNA, 20 nt, Yersinia pestis KIM
cuaguacguaaauuuauuua

SEQ ID NO: 4183247 - RNA, 12 nt, Yersinia pestis KIM
cuagugaugggg

SEQ ID NO: 4183248 - RNA, 21 nt, Yersinia pestis KIM
cuaguuuuaaacgucagauua

SEQ ID NO: 4183249 - RNA, 15 nt, Yersinia pestis KIM
cuauaaacauuuacu

SEQ ID NO: 4183250 - RNA, 17 nt, Yersinia pestis KIM
cuauaaauaaauuuauc

SEQ ID NO: 4183251 - RNA, 22 nt, Yersinia pestis KIM
cuauaaauuuuaaguuaauguu

SEQ ID NO: 4183252 - RNA, 14 nt, Yersinia pestis KIM
cuauaaggcucugu

SEQ ID NO: 4183253 - RNA, 22 nt, Yersinia pestis KIM
cuauaaggcucuguuaccagcc

SEQ ID NO: 4183254 - RNA, 23 nt, Yersinia pestis KIM
cuauaaggcucuguuaccagccg

SEQ ID NO: 4183255 - RNA, 15 nt, Yersinia pestis KIM
cuauaauuauuucuc

SEQ ID NO: 4183256 - RNA, 21 nt, Yersinia pestis KIM
cuauagauacccacuuuauuu

SEQ ID NO: 4183257 - RNA, 14 nt, Yersinia pestis KIM
cuauauaaaugauu

SEQ ID NO: 4183258 - RNA, 18 nt, Yersinia pestis KIM
cuauauaacugcccaauu

SEQ ID NO: 4183259 - RNA, 16 nt, Yersinia pestis KIM
cuauaucaucagcaga

SEQ ID NO: 4183260 - RNA, 13 nt, Yersinia pestis KIM
cuauaucucaguu

SEQ ID NO: 4183261 - RNA, 19 nt, Yersinia pestis KIM
cuauaugguaacgaaugcu

SEQ ID NO: 4183262 - RNA, 17 nt, Yersinia pestis KIM
cuauauucucauugccc

SEQ ID NO: 4183263 - RNA, 23 nt, Yersinia pestis KIM
cuauauucucauugcccccuuca

SEQ ID NO: 4183264 - RNA, 11 nt, Yersinia pestis KIM
cuauauuuggc

SEQ ID NO: 4183265 - RNA, 12 nt, Yersinia pestis KIM
cuauauuuuuac

SEQ ID NO: 4183266 - RNA, 15 nt, Yersinia pestis KIM
cuaucaauaaaccca

SEQ ID NO: 4183267 - RNA, 19 nt, Yersinia pestis KIM
cuaucaucccaccgaaagc

SEQ ID NO: 4183268 - RNA, 18 nt, Yersinia pestis KIM
cuaucauuguccucaaga

SEQ ID NO: 4183269 - RNA, 15 nt, Yersinia pestis KIM
cuauccgaaaaauau

SEQ ID NO: 4183270 - RNA, 19 nt, Yersinia pestis KIM
cuauccgcgccgagcgcua

SEQ ID NO: 4183271 - RNA, 16 nt, Yersinia pestis KIM
cuauccucuuaauguc

SEQ ID NO: 4183272 - RNA, 20 nt, Yersinia pestis KIM
cuauccuuugauagaaauag

SEQ ID NO: 4183273 - RNA, 14 nt, Yersinia pestis KIM
cuaucgaaacaccc

SEQ ID NO: 4183274 - RNA, 16 nt, Yersinia pestis KIM
cuaucgcgaaacucuu

SEQ ID NO: 4183275 - RNA, 17 nt, Yersinia pestis KIM
cuaucgcuguaugguau

SEQ ID NO: 4183276 - RNA, 16 nt, Yersinia pestis KIM
cuaucggugcagugca

SEQ ID NO: 4183277 - RNA, 18 nt, Yersinia pestis KIM
cuaucguuuguaccuguu

SEQ ID NO: 4183278 - RNA, 19 nt, Yersinia pestis KIM
cuaucuauuuuuauuucuc

SEQ ID NO: 4183279 - RNA, 14 nt, Yersinia pestis KIM
cuaucucagugagg

SEQ ID NO: 4183280 - RNA, 16 nt, Yersinia pestis KIM
cuaucucaucuuaauc

SEQ ID NO: 4183281 - RNA, 21 nt, Yersinia pestis KIM
cuaucucgacaaauccuuuua

SEQ ID NO: 4183282 - RNA, 20 nt, Yersinia pestis KIM
cuaucugaaacugagauuug

SEQ ID NO: 4183283 - RNA, 15 nt, Yersinia pestis KIM
cuaucugaaugaauu

SEQ ID NO: 4183284 - RNA, 15 nt, Yersinia pestis KIM
cuaucugcugcggua

SEQ ID NO: 4183285 - RNA, 19 nt, Yersinia pestis KIM
cuaucugguuuaaauucua

SEQ ID NO: 4183286 - RNA, 12 nt, Yersinia pestis KIM
cuaucuucuucu

SEQ ID NO: 4183287 - RNA, 15 nt, Yersinia pestis KIM
cuaucuuuauugcuc

SEQ ID NO: 4183288 - RNA, 15 nt, Yersinia pestis KIM
cuaugcaguuaaggc

SEQ ID NO: 4183289 - RNA, 19 nt, Yersinia pestis KIM
cuaugcaguuaaggcuggc

SEQ ID NO: 4183290 - RNA, 18 nt, Yersinia pestis KIM
cuauguucacguaaauga

SEQ ID NO: 4183291 - RNA, 17 nt, Yersinia pestis KIM
cuauguuggcaaauaau

SEQ ID NO: 4183292 - RNA, 21 nt, Yersinia pestis KIM
cuauuaaugggcgauauauuu

SEQ ID NO: 4183293 - RNA, 22 nt, Yersinia pestis KIM
cuauuagccagaaauagcacca

SEQ ID NO: 4183294 - RNA, 12 nt, Yersinia pestis KIM
cuauuccaguuu

SEQ ID NO: 4183295 - RNA, 15 nt, Yersinia pestis KIM
cuauucccuuguuug

SEQ ID NO: 4183296 - RNA, 14 nt, Yersinia pestis KIM
cuauucugccuauc

SEQ ID NO: 4183297 - RNA, 20 nt, Yersinia pestis KIM
cuauucugccuauccucacc

SEQ ID NO: 4183298 - RNA, 15 nt, Yersinia pestis KIM
cuauugaaaaaauaa

SEQ ID NO: 4183299 - RNA, 15 nt, Yersinia pestis KIM
cuauugauaaaacca

SEQ ID NO: 4183300 - RNA, 14 nt, Yersinia pestis KIM
cuauugaucacagu

SEQ ID NO: 4183301 - RNA, 19 nt, Yersinia pestis KIM
cuauugauuacaaaauaua

SEQ ID NO: 4183302 - RNA, 20 nt, Yersinia pestis KIM
cuauugguggcucaaagaaa

SEQ ID NO: 4183303 - RNA, 22 nt, Yersinia pestis KIM
cuauuuacugcauucugagcac

SEQ ID NO: 4183304 - RNA, 15 nt, Yersinia pestis KIM
cuauuucucucuacu

SEQ ID NO: 4183305 - RNA, 18 nt, Yersinia pestis KIM
cuauuuuuauuucuccuu

SEQ ID NO: 4183306 - RNA, 19 nt, Yersinia pestis KIM
cuauuuuugccaaugcugc

SEQ ID NO: 4183307 - RNA, 12 nt, Yersinia pestis KIM
cuauuuuuuccg

SEQ ID NO: 4183308 - RNA, 16 nt, Yersinia pestis KIM
cucaaaaggauggccc

SEQ ID NO: 4183309 - RNA, 15 nt, Yersinia pestis KIM
cucaaaauuaucuaa

SEQ ID NO: 4183310 - RNA, 18 nt, Yersinia pestis KIM
cucaaacugacuuuacuu

SEQ ID NO: 4183311 - RNA, 13 nt, Yersinia pestis KIM
cucaaagaaaaau

SEQ ID NO: 4183312 - RNA, 17 nt, Yersinia pestis KIM
cucaaagaccacaucaa

SEQ ID NO: 4183313 - RNA, 22 nt, Yersinia pestis KIM
cucaaagaccacaucaaccuga

SEQ ID NO: 4183314 - RNA, 23 nt, Yersinia pestis KIM
cucaaagaccacaucaaccugau

SEQ ID NO: 4183315 - RNA, 21 nt, Yersinia pestis KIM
cucaaaggagacuucgccaau

SEQ ID NO: 4183316 - RNA, 13 nt, Yersinia pestis KIM
cucaacacagguu

SEQ ID NO: 4183317 - RNA, 16 nt, Yersinia pestis KIM
cucaacagcaucauca

SEQ ID NO: 4183318 - RNA, 19 nt, Yersinia pestis KIM
cucaacaguacugccaacc

SEQ ID NO: 4183319 - RNA, 14 nt, Yersinia pestis KIM
cucaacauucuuua

SEQ ID NO: 4183320 - RNA, 23 nt, Yersinia pestis KIM
cucaaccugaucacgcugaauuu

SEQ ID NO: 4183321 - RNA, 21 nt, Yersinia pestis KIM
cucaacguauucccgcuaccg

SEQ ID NO: 4183322 - RNA, 15 nt, Yersinia pestis KIM
cucaacucaaaacaa

SEQ ID NO: 4183323 - RNA, 18 nt, Yersinia pestis KIM
cucaacugcucaacugcu

SEQ ID NO: 4183324 - RNA, 21 nt, Yersinia pestis KIM
cucaacugcucaacugcucaa

SEQ ID NO: 4183325 - RNA, 14 nt, Yersinia pestis KIM
cucaagaaauuuaa

SEQ ID NO: 4183326 - RNA, 22 nt, Yersinia pestis KIM
cucaagaaauuuaaaaacccuc

SEQ ID NO: 4183327 - RNA, 16 nt, Yersinia pestis KIM
cucaaggagaauuuag

SEQ ID NO: 4183328 - RNA, 16 nt, Yersinia pestis KIM
cucaagggcacaguuu

SEQ ID NO: 4183329 - RNA, 17 nt, Yersinia pestis KIM
cucaagggcacaguuua

SEQ ID NO: 4183330 - RNA, 17 nt, Yersinia pestis KIM
cucaauagcuaauaauu

SEQ ID NO: 4183331 - RNA, 12 nt, Yersinia pestis KIM
cucaauauuaau

SEQ ID NO: 4183332 - RNA, 14 nt, Yersinia pestis KIM
cucaauauuaauaa

SEQ ID NO: 4183333 - RNA, 16 nt, Yersinia pestis KIM
cucaauauuaauaaug

SEQ ID NO: 4183334 - RNA, 17 nt, Yersinia pestis KIM
cucaauauuaauaaugc

SEQ ID NO: 4183335 - RNA, 20 nt, Yersinia pestis KIM
cucaaucaccgaaucaccga

SEQ ID NO: 4183336 - RNA, 13 nt, Yersinia pestis KIM
cucaaugauaaaa

SEQ ID NO: 4183337 - RNA, 18 nt, Yersinia pestis KIM
cucaaugucaugcaauua

SEQ ID NO: 4183338 - RNA, 15 nt, Yersinia pestis KIM
cucacauaagaaagu

SEQ ID NO: 4183339 - RNA, 23 nt, Yersinia pestis KIM
cucaccaagaggaaaugccgcgc

SEQ ID NO: 4183340 - RNA, 14 nt, Yersinia pestis KIM
cucaccacugaguu

SEQ ID NO: 4183341 - RNA, 15 nt, Yersinia pestis KIM
cucaccauguacaug

SEQ ID NO: 4183342 - RNA, 18 nt, Yersinia pestis KIM
cucaccauguacauggcc

SEQ ID NO: 4183343 - RNA, 12 nt, Yersinia pestis KIM
cucacccauuuu

SEQ ID NO: 4183344 - RNA, 19 nt, Yersinia pestis KIM
cucaccccuauuagggaac

SEQ ID NO: 4183345 - RNA, 21 nt, Yersinia pestis KIM
cucacccgaaucacugaccug

SEQ ID NO: 4183346 - RNA, 21 nt, Yersinia pestis KIM
cucacccugcgugguauaccc

SEQ ID NO: 4183347 - RNA, 19 nt, Yersinia pestis KIM
cucaccgcccccaauaagg

SEQ ID NO: 4183348 - RNA, 18 nt, Yersinia pestis KIM
cucaccgcugcuccgccc

SEQ ID NO: 4183349 - RNA, 13 nt, Yersinia pestis KIM
cucaccgcuggaa

SEQ ID NO: 4183350 - RNA, 23 nt, Yersinia pestis KIM
cuccgauuaaguccgguuguggc

SEQ ID NO: 4183351 - RNA, 16 nt, Yersinia pestis KIM
cuccgcauccggcggu

SEQ ID NO: 4183352 - RNA, 22 nt, Yersinia pestis KIM
cuccgccgauagcauuuuguca

SEQ ID NO: 4183353 - RNA, 19 nt, Yersinia pestis KIM
cuccgcgcaaccuggccaa

SEQ ID NO: 4183354 - RNA, 12 nt, Yersinia pestis KIM
cuccggaaucag

SEQ ID NO: 4183355 - RNA, 16 nt, Yersinia pestis KIM
cuccggcaucauccuc

SEQ ID NO: 4183356 - RNA, 19 nt, Yersinia pestis KIM
cuccggcgacuaagacugu

SEQ ID NO: 4183357 - RNA, 12 nt, Yersinia pestis KIM
cuccggcggcuu

SEQ ID NO: 4183358 - RNA, 20 nt, Yersinia pestis KIM
cuccggcgugaguuccagcc

SEQ ID NO: 4183359 - RNA, 22 nt, Yersinia pestis KIM
cuccgguucuugcgcgcuggga

SEQ ID NO: 4183360 - RNA, 15 nt, Yersinia pestis KIM
cuccgucgcgggcac

SEQ ID NO: 4183361 - RNA, 22 nt, Yersinia pestis KIM
cuccgucgcgggcacuuuguca

SEQ ID NO: 4183362 - RNA, 19 nt, Yersinia pestis KIM
cuccguguaguuauugauu

SEQ ID NO: 4183363 - RNA, 13 nt, Yersinia pestis KIM
cuccguugaaacc

SEQ ID NO: 4183364 - RNA, 22 nt, Yersinia pestis KIM
cuccuagccgggacuuugcucu

SEQ ID NO: 4183365 - RNA, 23 nt, Yersinia pestis KIM
cuccuccuuggggccucacucug

SEQ ID NO: 4183366 - RNA, 13 nt, Yersinia pestis KIM
cuccucugccuau

SEQ ID NO: 4183367 - RNA, 15 nt, Yersinia pestis KIM
cuccucuuucuuaau

SEQ ID NO: 4183368 - RNA, 20 nt, Yersinia pestis KIM
cuccugaaauaaagaacuga

SEQ ID NO: 4183369 - RNA, 13 nt, Yersinia pestis KIM
cuccugaugacuc

SEQ ID NO: 4183370 - RNA, 19 nt, Yersinia pestis KIM
cuccugcaacgccuucaca

SEQ ID NO: 4183371 - RNA, 21 nt, Yersinia pestis KIM
cuccugcaacgccuucacauu

SEQ ID NO: 4183372 - RNA, 15 nt, Yersinia pestis KIM
cuccuggcaugcauu

SEQ ID NO: 4183373 - RNA, 18 nt, Yersinia pestis KIM
cuccuguggagguggugg

SEQ ID NO: 4183374 - RNA, 21 nt, Yersinia pestis KIM
cuccuuaccacugcucacuuu

SEQ ID NO: 4183375 - RNA, 16 nt, Yersinia pestis KIM
cuccuuacuaucuuua

SEQ ID NO: 4183376 - RNA, 22 nt, Yersinia pestis KIM
cuccuuuaccuacaaccuggug

SEQ ID NO: 4183377 - RNA, 23 nt, Yersinia pestis KIM
cuccuuucuuuucgcuauuucuc

SEQ ID NO: 4183378 - RNA, 19 nt, Yersinia pestis KIM
cuccuuuguuauuucuggg

SEQ ID NO: 4183379 - RNA, 22 nt, Yersinia pestis KIM
cucgaaaauacaauauggguau

SEQ ID NO: 4183380 - RNA, 20 nt, Yersinia pestis KIM
cucgaaaucauccgcggcaa

SEQ ID NO: 4183381 - RNA, 21 nt, Yersinia pestis KIM
cucgaaaucauccgcggcaaa

SEQ ID NO: 4183382 - RNA, 14 nt, Yersinia pestis KIM
cucgaaccgccacu

SEQ ID NO: 4183383 - RNA, 16 nt, Yersinia pestis KIM
cucgaacgauuuucuu

SEQ ID NO: 4183384 - RNA, 21 nt, Yersinia pestis KIM
cucgaacgcuuguggaaauag

SEQ ID NO: 4183385 - RNA, 18 nt, Yersinia pestis KIM
cucgaagcgcgcccuccc

SEQ ID NO: 4183386 - RNA, 17 nt, Yersinia pestis KIM
cucgaauaaacggauuu

SEQ ID NO: 4183387 - RNA, 20 nt, Yersinia pestis KIM
cucgacaccaaaacucccug

SEQ ID NO: 4183388 - RNA, 16 nt, Yersinia pestis KIM
cucgagccgcgcccuc

SEQ ID NO: 4183389 - RNA, 18 nt, Yersinia pestis KIM
cucgagccgcgcccuccc

SEQ ID NO: 4183390 - RNA, 22 nt, Yersinia pestis KIM
cucgagccgcgcccucccuggc

SEQ ID NO: 4183391 - RNA, 22 nt, Yersinia pestis KIM
cucgagccuacuacauggaugu

SEQ ID NO: 4183392 - RNA, 19 nt, Yersinia pestis KIM
cucgaucagcgucagcaga

SEQ ID NO: 4183393 - RNA, 17 nt, Yersinia pestis KIM
cucgcccaugaccacuu

SEQ ID NO: 4183394 - RNA, 16 nt, Yersinia pestis KIM
cucgccgacaacuuca

SEQ ID NO: 4183395 - RNA, 19 nt, Yersinia pestis KIM
cucgccguggcauaaucaa

SEQ ID NO: 4183396 - RNA, 17 nt, Yersinia pestis KIM
cucgccguggcgacagc

SEQ ID NO: 4183397 - RNA, 13 nt, Yersinia pestis KIM
cucgcgcccugcc

SEQ ID NO: 4183398 - RNA, 16 nt, Yersinia pestis KIM
cucgcgccugaaauca

SEQ ID NO: 4183399 - RNA, 20 nt, Yersinia pestis KIM
cucgcgggucaugaaaucag

SEQ ID NO: 4183400 - RNA, 17 nt, Yersinia pestis KIM
cucgcuaaucaagccuu

SEQ ID NO: 4183401 - RNA, 15 nt, Yersinia pestis KIM
cucgcugugcccuuu

SEQ ID NO: 4183402 - RNA, 20 nt, Yersinia pestis KIM
cucgcuuaacugugcagccc

SEQ ID NO: 4183403 - RNA, 21 nt, Yersinia pestis KIM
cucggaugguuguucugcugg

SEQ ID NO: 4183404 - RNA, 22 nt, Yersinia pestis KIM
cucggcgcgcuugccacgccag

SEQ ID NO: 4183405 - RNA, 21 nt, Yersinia pestis KIM
cucggcgguuugagccaccgc

SEQ ID NO: 4183406 - RNA, 14 nt, Yersinia pestis KIM
cucggcgucagccg

SEQ ID NO: 4183407 - RNA, 15 nt, Yersinia pestis KIM
cucggcucgaaccug

SEQ ID NO: 4183408 - RNA, 22 nt, Yersinia pestis KIM
cucggcucgaaccugaacgcag

SEQ ID NO: 4183409 - RNA, 21 nt, Yersinia pestis KIM
cucggcuuucaggugacugaa

SEQ ID NO: 4183410 - RNA, 22 nt, Yersinia pestis KIM
cucgggauaugacuaaacugau

SEQ ID NO: 4183411 - RNA, 16 nt, Yersinia pestis KIM
cucgguaaugagccgc

SEQ ID NO: 4183412 - RNA, 20 nt, Yersinia pestis KIM
cucgguauguacacauuauu

SEQ ID NO: 4183413 - RNA, 22 nt, Yersinia pestis KIM
cucggucugaauaagagagacg

SEQ ID NO: 4183414 - RNA, 17 nt, Yersinia pestis KIM
cucgguuguucagcacc

SEQ ID NO: 4183415 - RNA, 14 nt, Yersinia pestis KIM
cucguauaaaaaau

SEQ ID NO: 4183416 - RNA, 14 nt, Yersinia pestis KIM
cucgucacacuggu

SEQ ID NO: 4183417 - RNA, 22 nt, Yersinia pestis KIM
cucgugcuuuuugcgacaggcu

SEQ ID NO: 4183418 - RNA, 13 nt, Yersinia pestis KIM
cucguuaucuuca

SEQ ID NO: 4183419 - RNA, 22 nt, Yersinia pestis KIM
cucguuggaucaucgggaacag

SEQ ID NO: 4183420 - RNA, 17 nt, Yersinia pestis KIM
cucuacauugacuaauu

SEQ ID NO: 4183421 - RNA, 23 nt, Yersinia pestis KIM
cucuacgacgcccgcagacugcu

SEQ ID NO: 4183422 - RNA, 23 nt, Yersinia pestis KIM
cucuagaauuugaucagccagaa

SEQ ID NO: 4183423 - RNA, 14 nt, Yersinia pestis KIM
cucuagcuaacagu

SEQ ID NO: 4183424 - RNA, 18 nt, Yersinia pestis KIM
cucuaucgcgguuuuaaa

SEQ ID NO: 4183425 - RNA, 17 nt, Yersinia pestis KIM
cucuauucugcuuuuug

SEQ ID NO: 4183426 - RNA, 13 nt, Yersinia pestis KIM
cucucacccugcg

SEQ ID NO: 4183427 - RNA, 23 nt, Yersinia pestis KIM
cucucacugcuccagccaacugg

SEQ ID NO: 4183428 - RNA, 12 nt, Yersinia pestis KIM
cucucauauccc

SEQ ID NO: 4183429 - RNA, 16 nt, Yersinia pestis KIM
cucucauauccccccc

SEQ ID NO: 4183430 - RNA, 17 nt, Yersinia pestis KIM
cucucauauccccccca

SEQ ID NO: 4183431 - RNA, 18 nt, Yersinia pestis KIM
cucucaucugaacuauug

SEQ ID NO: 4183432 - RNA, 17 nt, Yersinia pestis KIM
cucuccagugcaaauuu

SEQ ID NO: 4183433 - RNA, 14 nt, Yersinia pestis KIM
cucuccgcaaugcc

SEQ ID NO: 4183434 - RNA, 19 nt, Yersinia pestis KIM
cucuccgucgcgggcacuu

SEQ ID NO: 4183435 - RNA, 18 nt, Yersinia pestis KIM
cucuccguugcaggcacu

SEQ ID NO: 4183436 - RNA, 18 nt, Yersinia pestis KIM
cucuccuauaucucaguu

SEQ ID NO: 4183437 - RNA, 12 nt, Yersinia pestis KIM
cucucucaauuc

SEQ ID NO: 4183438 - RNA, 23 nt, Yersinia pestis KIM
cucucucaauucaauacgcaggc

SEQ ID NO: 4183439 - RNA, 16 nt, Yersinia pestis KIM
cucucuccgcaaugcc

SEQ ID NO: 4183440 - RNA, 16 nt, Yersinia pestis KIM
cucucugagccaucca

SEQ ID NO: 4183441 - RNA, 15 nt, Yersinia pestis KIM
cucucugcugcgaau

SEQ ID NO: 4183442 - RNA, 16 nt, Yersinia pestis KIM
cucucuggggagggcc

SEQ ID NO: 4183443 - RNA, 14 nt, Yersinia pestis KIM
cucucuuuccagca

SEQ ID NO: 4183444 - RNA, 15 nt, Yersinia pestis KIM
cucucuuuuuucucu

SEQ ID NO: 4183445 - RNA, 14 nt, Yersinia pestis KIM
cucugacaaaaugc

SEQ ID NO: 4183446 - RNA, 18 nt, Yersinia pestis KIM
cucugacacugacauuua

SEQ ID NO: 4183447 - RNA, 16 nt, Yersinia pestis KIM
cucugaugaacggaga

SEQ ID NO: 4183448 - RNA, 15 nt, Yersinia pestis KIM
cucugccaacgugau

SEQ ID NO: 4183449 - RNA, 13 nt, Yersinia pestis KIM
cucugccgcugaa

SEQ ID NO: 4183450 - RNA, 17 nt, Yersinia pestis KIM
cucugccguaccaaugu

SEQ ID NO: 4183451 - RNA, 15 nt, Yersinia pestis KIM
cucugccuauccuca

SEQ ID NO: 4183452 - RNA, 14 nt, Yersinia pestis KIM
cucugcgacaucag

SEQ ID NO: 4183453 - RNA, 16 nt, Yersinia pestis KIM
cucugcgacaucagcg

SEQ ID NO: 4183454 - RNA, 17 nt, Yersinia pestis KIM
cucugcgcucauacuca

SEQ ID NO: 4183455 - RNA, 13 nt, Yersinia pestis KIM
cucugcguagcca

SEQ ID NO: 4183456 - RNA, 19 nt, Yersinia pestis KIM
cucugcuaauacgcuauca

SEQ ID NO: 4183457 - RNA, 19 nt, Yersinia pestis KIM
cucuggacguuugcugcuu

SEQ ID NO: 4183458 - RNA, 14 nt, Yersinia pestis KIM
cucuggagcuucug

SEQ ID NO: 4183459 - RNA, 22 nt, Yersinia pestis KIM
cucuggcaacggcacaucccaa

SEQ ID NO: 4183460 - RNA, 16 nt, Yersinia pestis KIM
cucuggcaauggcuag

SEQ ID NO: 4183461 - RNA, 16 nt, Yersinia pestis KIM
cucuggcagugaggca

SEQ ID NO: 4183462 - RNA, 19 nt, Yersinia pestis KIM
cucuggcgcggacguuuua

SEQ ID NO: 4183463 - RNA, 15 nt, Yersinia pestis KIM
cucugggaaaccauu

SEQ ID NO: 4183464 - RNA, 20 nt, Yersinia pestis KIM
cugaccgauugaaucaaggc

SEQ ID NO: 4183465 - RNA, 15 nt, Yersinia pestis KIM
cugaccgcagccuuc

SEQ ID NO: 4183466 - RNA, 18 nt, Yersinia pestis KIM
cugaccggaagcaaucag

SEQ ID NO: 4183467 - RNA, 14 nt, Yersinia pestis KIM
cugaccuauugaua

SEQ ID NO: 4183468 - RNA, 22 nt, Yersinia pestis KIM
cugaccuauugauaaaaccacu

SEQ ID NO: 4183469 - RNA, 22 nt, Yersinia pestis KIM
cugaccuauugauaaaaccgcu

SEQ ID NO: 4183470 - RNA, 14 nt, Yersinia pestis KIM
cugacgaaaugccg

SEQ ID NO: 4183471 - RNA, 21 nt, Yersinia pestis KIM
cugacgaaauuuaagaaaucu

SEQ ID NO: 4183472 - RNA, 18 nt, Yersinia pestis KIM
cugacgaauagcaucagg

SEQ ID NO: 4183473 - RNA, 14 nt, Yersinia pestis KIM
cugacgaaugacuc

SEQ ID NO: 4183474 - RNA, 15 nt, Yersinia pestis KIM
cugacgauaacuuuu

SEQ ID NO: 4183475 - RNA, 13 nt, Yersinia pestis KIM
cugacgaugacuc

SEQ ID NO: 4183476 - RNA, 16 nt, Yersinia pestis KIM
cugacgaugauaaauc

SEQ ID NO: 4183477 - RNA, 18 nt, Yersinia pestis KIM
cugacgaugauaaaucag

SEQ ID NO: 4183478 - RNA, 19 nt, Yersinia pestis KIM
cugacgcacagcacgguaa

SEQ ID NO: 4183479 - RNA, 14 nt, Yersinia pestis KIM
cugacgcagaagua

SEQ ID NO: 4183480 - RNA, 16 nt, Yersinia pestis KIM
cugacgccaugcucag

SEQ ID NO: 4183481 - RNA, 17 nt, Yersinia pestis KIM
cugacgcugacauucaa

SEQ ID NO: 4183482 - RNA, 13 nt, Yersinia pestis KIM
cugacggcagaca

SEQ ID NO: 4183483 - RNA, 17 nt, Yersinia pestis KIM
cugacggccagcaaccu

SEQ ID NO: 4183484 - RNA, 13 nt, Yersinia pestis KIM
cugacgucagauc

SEQ ID NO: 4183485 - RNA, 18 nt, Yersinia pestis KIM
cugacucccugacucccu

SEQ ID NO: 4183486 - RNA, 20 nt, Yersinia pestis KIM
cugacugccauaauccagaa

SEQ ID NO: 4183487 - RNA, 13 nt, Yersinia pestis KIM
cugacugcuggca

SEQ ID NO: 4183488 - RNA, 14 nt, Yersinia pestis KIM
cugacugcuggcag

SEQ ID NO: 4183489 - RNA, 15 nt, Yersinia pestis KIM
cugacuguggcugcu

SEQ ID NO: 4183490 - RNA, 22 nt, Yersinia pestis KIM
cugacuuacaauaaucuggaug

SEQ ID NO: 4183491 - RNA, 19 nt, Yersinia pestis KIM
cugagaagcggaauuugcu

SEQ ID NO: 4183492 - RNA, 14 nt, Yersinia pestis KIM
cugagauaagccuc

SEQ ID NO: 4183493 - RNA, 15 nt, Yersinia pestis KIM
cugagauaagccucg

SEQ ID NO: 4183494 - RNA, 22 nt, Yersinia pestis KIM
cugagaucaucgggcauucacu

SEQ ID NO: 4183495 - RNA, 16 nt, Yersinia pestis KIM
cugagcagcaacuguu

SEQ ID NO: 4183496 - RNA, 19 nt, Yersinia pestis KIM
cugagcauucgaguuaacu

SEQ ID NO: 4183497 - RNA, 21 nt, Yersinia pestis KIM
cugagccgccaguugggaauc

SEQ ID NO: 4183498 - RNA, 19 nt, Yersinia pestis KIM
cugagccucaugaaugagg

SEQ ID NO: 4183499 - RNA, 23 nt, Yersinia pestis KIM
cugagccucaugaaugaggcuga

SEQ ID NO: 4183500 - RNA, 21 nt, Yersinia pestis KIM
cugagcgacauuucggccacc

SEQ ID NO: 4183501 - RNA, 14 nt, Yersinia pestis KIM
cugagcgaucaaua

SEQ ID NO: 4183502 - RNA, 21 nt, Yersinia pestis KIM
cugagcgaucaauacaccaga

SEQ ID NO: 4183503 - RNA, 22 nt, Yersinia pestis KIM
cugagcgaucaauacaccagac

SEQ ID NO: 4183504 - RNA, 15 nt, Yersinia pestis KIM
cugagcgggcggcaa

SEQ ID NO: 4183505 - RNA, 18 nt, Yersinia pestis KIM
cugagcuggcuaauguuc

SEQ ID NO: 4183506 - RNA, 20 nt, Yersinia pestis KIM
cugagcuuauagaacggcag

SEQ ID NO: 4183507 - RNA, 23 nt, Yersinia pestis KIM
cugaggagccauugauuggcucc

SEQ ID NO: 4183508 - RNA, 18 nt, Yersinia pestis KIM
cugaggccuuauucgcca

SEQ ID NO: 4183509 - RNA, 19 nt, Yersinia pestis KIM
cugagggugauaucgucag

SEQ ID NO: 4183510 - RNA, 12 nt, Yersinia pestis KIM
cugagggugaug

SEQ ID NO: 4183511 - RNA, 15 nt, Yersinia pestis KIM
cugagguugaugagc

SEQ ID NO: 4183512 - RNA, 17 nt, Yersinia pestis KIM
cugagguugcucagcgg

SEQ ID NO: 4183513 - RNA, 18 nt, Yersinia pestis KIM
cugaguaacgaacgucgc

SEQ ID NO: 4183514 - RNA, 12 nt, Yersinia pestis KIM
cugaguaauauu

SEQ ID NO: 4183515 - RNA, 14 nt, Yersinia pestis KIM
cugaguaauauuau

SEQ ID NO: 4183516 - RNA, 16 nt, Yersinia pestis KIM
cugaguaauauuauuc

SEQ ID NO: 4183517 - RNA, 17 nt, Yersinia pestis KIM
cugaguagcauaaaaau

SEQ ID NO: 4183518 - RNA, 20 nt, Yersinia pestis KIM
cugaguauuacgguaauaaa

SEQ ID NO: 4183519 - RNA, 20 nt, Yersinia pestis KIM
cugagucaaaucgauuugcu

SEQ ID NO: 4183520 - RNA, 13 nt, Yersinia pestis KIM
cugagucagucag

SEQ ID NO: 4183521 - RNA, 17 nt, Yersinia pestis KIM
cugagucagucagggug

SEQ ID NO: 4183522 - RNA, 15 nt, Yersinia pestis KIM
cugagucgucugucg

SEQ ID NO: 4183523 - RNA, 20 nt, Yersinia pestis KIM
cugagugaagacaucgccag

SEQ ID NO: 4183524 - RNA, 20 nt, Yersinia pestis KIM
cugagugggggcgauuaauu

SEQ ID NO: 4183525 - RNA, 18 nt, Yersinia pestis KIM
cugaguuaucuguuucaa

SEQ ID NO: 4183526 - RNA, 16 nt, Yersinia pestis KIM
cugaguucugcugcca

SEQ ID NO: 4183527 - RNA, 13 nt, Yersinia pestis KIM
cugauaaaacagu

SEQ ID NO: 4183528 - RNA, 18 nt, Yersinia pestis KIM
cugauaaggagagaggcc

SEQ ID NO: 4183529 - RNA, 22 nt, Yersinia pestis KIM
cugauagcgcacugucugagca

SEQ ID NO: 4183530 - RNA, 18 nt, Yersinia pestis KIM
cugauagugauuuuuuuc

SEQ ID NO: 4183531 - RNA, 20 nt, Yersinia pestis KIM
cugauagugauuuuuuucac

SEQ ID NO: 4183532 - RNA, 17 nt, Yersinia pestis KIM
cugauaucucuuuauca

SEQ ID NO: 4183533 - RNA, 18 nt, Yersinia pestis KIM
cugauaucuucacucagc

SEQ ID NO: 4183534 - RNA, 22 nt, Yersinia pestis KIM
cugauaucuucacucagcgcug

SEQ ID NO: 4183535 - RNA, 20 nt, Yersinia pestis KIM
cugauauuccggugaucuug

SEQ ID NO: 4183536 - RNA, 22 nt, Yersinia pestis KIM
cugaucaauaucccgagaaaca

SEQ ID NO: 4183537 - RNA, 19 nt, Yersinia pestis KIM
cugaucaaucucaucaauc

SEQ ID NO: 4183538 - RNA, 20 nt, Yersinia pestis KIM
cugaucacgcugaauuugug

SEQ ID NO: 4183539 - RNA, 14 nt, Yersinia pestis KIM
cugaucagcauuuc

SEQ ID NO: 4183540 - RNA, 13 nt, Yersinia pestis KIM
cugaucaugccac

SEQ ID NO: 4183541 - RNA, 21 nt, Yersinia pestis KIM
cugauccacuacuuauuuccg

SEQ ID NO: 4183542 - RNA, 14 nt, Yersinia pestis KIM
cugauccaguuuca

SEQ ID NO: 4183543 - RNA, 11 nt, Yersinia pestis KIM
cugaucgagca

SEQ ID NO: 4183544 - RNA, 14 nt, Yersinia pestis KIM
cugaucgcugugca

SEQ ID NO: 4183545 - RNA, 14 nt, Yersinia pestis KIM
cugaucucaucauu

SEQ ID NO: 4183546 - RNA, 21 nt, Yersinia pestis KIM
cugaucugccccuggcucagu

SEQ ID NO: 4183547 - RNA, 18 nt, Yersinia pestis KIM
cugaucuucauugccuuc

SEQ ID NO: 4183548 - RNA, 18 nt, Yersinia pestis KIM
cugaugaauagaggacua

SEQ ID NO: 4183549 - RNA, 14 nt, Yersinia pestis KIM
cugaugacucaucu

SEQ ID NO: 4183550 - RNA, 16 nt, Yersinia pestis KIM
cugaugacucaucugg

SEQ ID NO: 4183551 - RNA, 19 nt, Yersinia pestis KIM
cugaugcgguagugaugca

SEQ ID NO: 4183552 - RNA, 14 nt, Yersinia pestis KIM
cugaugcuuuucuu

SEQ ID NO: 4183553 - RNA, 15 nt, Yersinia pestis KIM
cugaugcuuuucuuu

SEQ ID NO: 4183554 - RNA, 14 nt, Yersinia pestis KIM
cugauggucaugga

SEQ ID NO: 4183555 - RNA, 15 nt, Yersinia pestis KIM
cugauguucugccaa

SEQ ID NO: 4183556 - RNA, 17 nt, Yersinia pestis KIM
cugauguucugccaacc

SEQ ID NO: 4183557 - RNA, 17 nt, Yersinia pestis KIM
cugauguugucaccugg

SEQ ID NO: 4183558 - RNA, 15 nt, Yersinia pestis KIM
cugauuaauuuuaau

SEQ ID NO: 4183559 - RNA, 22 nt, Yersinia pestis KIM
cugauuagcagggcaguaaaau

SEQ ID NO: 4183560 - RNA, 17 nt, Yersinia pestis KIM
cugauucagauuuacuc

SEQ ID NO: 4183561 - RNA, 15 nt, Yersinia pestis KIM
cugauucuucagaau

SEQ ID NO: 4183562 - RNA, 15 nt, Yersinia pestis KIM
cugauugaccaucaa

SEQ ID NO: 4183563 - RNA, 16 nt, Yersinia pestis KIM
cugauuuauaaauaau

SEQ ID NO: 4183564 - RNA, 17 nt, Yersinia pestis KIM
cugauuugccagcaccg

SEQ ID NO: 4183565 - RNA, 13 nt, Yersinia pestis KIM
cugauuuuuauca

SEQ ID NO: 4183566 - RNA, 19 nt, Yersinia pestis KIM
cugauuuuuuacuuuuucc

SEQ ID NO: 4183567 - RNA, 23 nt, Yersinia pestis KIM
cugauuuuuucgaguaguuuggc

SEQ ID NO: 4183568 - RNA, 19 nt, Yersinia pestis KIM
cugauuuuuuguucuuaau

SEQ ID NO: 4183569 - RNA, 17 nt, Yersinia pestis KIM
cugcaaacuggcaggga

SEQ ID NO: 4183570 - RNA, 19 nt, Yersinia pestis KIM
cugcaaauuuauccaaucu

SEQ ID NO: 4183571 - RNA, 15 nt, Yersinia pestis KIM
cugcaacccacgccc

SEQ ID NO: 4183572 - RNA, 14 nt, Yersinia pestis KIM
cugcaacgccuuca

SEQ ID NO: 4183573 - RNA, 15 nt, Yersinia pestis KIM
cugcaacgcggaaua

SEQ ID NO: 4183574 - RNA, 15 nt, Yersinia pestis KIM
cugcaacucauuaac

SEQ ID NO: 4183575 - RNA, 16 nt, Yersinia pestis KIM
cugcaauaacaccagc

SEQ ID NO: 4183576 - RNA, 16 nt, Yersinia pestis KIM
cugcaauuauaagcac

SEQ ID NO: 4183577 - RNA, 16 nt, Yersinia pestis KIM
cugcaauucggcuaau

SEQ ID NO: 4183578 - RNA, 20 nt, Yersinia pestis KIM
cugcaauucggcuaaugagc

SEQ ID NO: 4183579 - RNA, 22 nt, Yersinia pestis KIM
cugcuguuuaccuaucucagug

SEQ ID NO: 4183580 - RNA, 11 nt, Yersinia pestis KIM
cugcuuaaucc

SEQ ID NO: 4183581 - RNA, 13 nt, Yersinia pestis KIM
cugcuuaccuugu

SEQ ID NO: 4183582 - RNA, 16 nt, Yersinia pestis KIM
cugcuuauuuuuucaa

SEQ ID NO: 4183583 - RNA, 18 nt, Yersinia pestis KIM
cugcuucuacccuggcgg

SEQ ID NO: 4183584 - RNA, 12 nt, Yersinia pestis KIM
cugcuuuaucgu

SEQ ID NO: 4183585 - RNA, 21 nt, Yersinia pestis KIM
cugcuuugugggcuuuugcug

SEQ ID NO: 4183586 - RNA, 17 nt, Yersinia pestis KIM
cugcuuuguuuuugugg

SEQ ID NO: 4183587 - RNA, 16 nt, Yersinia pestis KIM
cugcuuuuugcuuuuu

SEQ ID NO: 4183588 - RNA, 12 nt, Yersinia pestis KIM
cuggaaaaccaa

SEQ ID NO: 4183589 - RNA, 17 nt, Yersinia pestis KIM
cuggaaacaaaaccuaa

SEQ ID NO: 4183590 - RNA, 20 nt, Yersinia pestis KIM
cuggaaacugacauaagcua

SEQ ID NO: 4183591 - RNA, 21 nt, Yersinia pestis KIM
cuggaaaggaauaucugugau

SEQ ID NO: 4183592 - RNA, 13 nt, Yersinia pestis KIM
cuggaaauaagcc

SEQ ID NO: 4183593 - RNA, 17 nt, Yersinia pestis KIM
cuggaacaagagaucuc

SEQ ID NO: 4183594 - RNA, 17 nt, Yersinia pestis KIM
cuggaagcagaauacug

SEQ ID NO: 4183595 - RNA, 22 nt, Yersinia pestis KIM
cuggaagccgacgaucuugccc

SEQ ID NO: 4183596 - RNA, 18 nt, Yersinia pestis KIM
cuggaauggcgcaauagc

SEQ ID NO: 4183597 - RNA, 17 nt, Yersinia pestis KIM
cuggacaauguugaucg

SEQ ID NO: 4183598 - RNA, 16 nt, Yersinia pestis KIM
cuggaccuuaucauca

SEQ ID NO: 4183599 - RNA, 14 nt, Yersinia pestis KIM
cuggacgcaucaga

SEQ ID NO: 4183600 - RNA, 16 nt, Yersinia pestis KIM
cuggacgcaucagauc

SEQ ID NO: 4183601 - RNA, 23 nt, Yersinia pestis KIM
cuggacgcuggcagccuuuaucc

SEQ ID NO: 4183602 - RNA, 14 nt, Yersinia pestis KIM
cuggacugguugcu

SEQ ID NO: 4183603 - RNA, 21 nt, Yersinia pestis KIM
cuggacugguugcugguuaau

SEQ ID NO: 4183604 - RNA, 20 nt, Yersinia pestis KIM
cuggagcaagauuuuguagc

SEQ ID NO: 4183605 - RNA, 13 nt, Yersinia pestis KIM
cuggagccauauc

SEQ ID NO: 4183606 - RNA, 11 nt, Yersinia pestis KIM
cuggauaaacu

SEQ ID NO: 4183607 - RNA, 21 nt, Yersinia pestis KIM
cuggauaagugaauaacgcug

SEQ ID NO: 4183608 - RNA, 14 nt, Yersinia pestis KIM
cuggauauuuuuaa

SEQ ID NO: 4183609 - RNA, 22 nt, Yersinia pestis KIM
cuggauguguggcagucacugc

SEQ ID NO: 4183610 - RNA, 18 nt, Yersinia pestis KIM
cuggcaaaacucagguga

SEQ ID NO: 4183611 - RNA, 23 nt, Yersinia pestis KIM
cuggcaaacgcugcacaucauuu

SEQ ID NO: 4183612 - RNA, 18 nt, Yersinia pestis KIM
cuggcaaaguuauugacc

SEQ ID NO: 4183613 - RNA, 21 nt, Yersinia pestis KIM
cuggcaaauaagggauaugaa

SEQ ID NO: 4183614 - RNA, 17 nt, Yersinia pestis KIM
cuggcaaggcacgagcg

SEQ ID NO: 4183615 - RNA, 21 nt, Yersinia pestis KIM
cuggcaaugcgcggguaacaa

SEQ ID NO: 4183616 - RNA, 16 nt, Yersinia pestis KIM
cuggcaauggcuagcu

SEQ ID NO: 4183617 - RNA, 15 nt, Yersinia pestis KIM
cuggcaccggacaaa

SEQ ID NO: 4183618 - RNA, 14 nt, Yersinia pestis KIM
cuggcacuggaugu

SEQ ID NO: 4183619 - RNA, 19 nt, Yersinia pestis KIM
cuggcaguaaaacccgccc

SEQ ID NO: 4183620 - RNA, 19 nt, Yersinia pestis KIM
cuggcauacaguuuugccg

SEQ ID NO: 4183621 - RNA, 15 nt, Yersinia pestis KIM
cuggccacagagugg

SEQ ID NO: 4183622 - RNA, 21 nt, Yersinia pestis KIM
cuggccagaagguaagccagu

SEQ ID NO: 4183623 - RNA, 22 nt, Yersinia pestis KIM
cuggcccuggaacaccagcaca

SEQ ID NO: 4183624 - RNA, 20 nt, Yersinia pestis KIM
cuggccucuuuacgcucugc

SEQ ID NO: 4183625 - RNA, 16 nt, Yersinia pestis KIM
cuggccugagaaccca

SEQ ID NO: 4183626 - RNA, 22 nt, Yersinia pestis KIM
cuggcgauaaacacccaagaau

SEQ ID NO: 4183627 - RNA, 18 nt, Yersinia pestis KIM
cuggcgcaacagcgccuc

SEQ ID NO: 4183628 - RNA, 15 nt, Yersinia pestis KIM
cuggcgcagaguauc

SEQ ID NO: 4183629 - RNA, 21 nt, Yersinia pestis KIM
cuggcgcugaucaucaucaau

SEQ ID NO: 4183630 - RNA, 14 nt, Yersinia pestis KIM
cuggcggcgagcuc

SEQ ID NO: 4183631 - RNA, 19 nt, Yersinia pestis KIM
cuggcgguuucaccuaucg

SEQ ID NO: 4183632 - RNA, 18 nt, Yersinia pestis KIM
cuggcgugcgggcaaaac

SEQ ID NO: 4183633 - RNA, 16 nt, Yersinia pestis KIM
cuggcuaauuuuauua

SEQ ID NO: 4183634 - RNA, 15 nt, Yersinia pestis KIM
cuggcucaaauuugg

SEQ ID NO: 4183635 - RNA, 14 nt, Yersinia pestis KIM
cuggcucuauuuuc

SEQ ID NO: 4183636 - RNA, 20 nt, Yersinia pestis KIM
cuggcucugcgaccaaggcu

SEQ ID NO: 4183637 - RNA, 22 nt, Yersinia pestis KIM
cuggcuggcuuuggaacgcuca

SEQ ID NO: 4183638 - RNA, 22 nt, Yersinia pestis KIM
cuggcuuagaucuuuggccccg

SEQ ID NO: 4183639 - RNA, 23 nt, Yersinia pestis KIM
cuggcuuuuucacacgcccaggc

SEQ ID NO: 4183640 - RNA, 20 nt, Yersinia pestis KIM
cugggauaugccguauacgu

SEQ ID NO: 4183641 - RNA, 17 nt, Yersinia pestis KIM
cugggauccauaggauc

SEQ ID NO: 4183642 - RNA, 23 nt, Yersinia pestis KIM
cugggcaaaacguauaaaagcau

SEQ ID NO: 4183643 - RNA, 20 nt, Yersinia pestis KIM
cugggccacgaugugaagca

SEQ ID NO: 4183644 - RNA, 13 nt, Yersinia pestis KIM
cugggccgaugcc

SEQ ID NO: 4183645 - RNA, 19 nt, Yersinia pestis KIM
cugggcugaacgugccugu

SEQ ID NO: 4183646 - RNA, 16 nt, Yersinia pestis KIM
cugggcugauggucau

SEQ ID NO: 4183647 - RNA, 21 nt, Yersinia pestis KIM
cuggguaauucauuauuacuc

SEQ ID NO: 4183648 - RNA, 16 nt, Yersinia pestis KIM
cuggguacaacacaaa

SEQ ID NO: 4183649 - RNA, 20 nt, Yersinia pestis KIM
cugggucgugagucaggugg

SEQ ID NO: 4183650 - RNA, 21 nt, Yersinia pestis KIM
cugggucgugagucagguggc

SEQ ID NO: 4183651 - RNA, 19 nt, Yersinia pestis KIM
cuggguggcugaaauacca

SEQ ID NO: 4183652 - RNA, 15 nt, Yersinia pestis KIM
cugggugugcguaca

SEQ ID NO: 4183653 - RNA, 22 nt, Yersinia pestis KIM
cugguaagcuggcgcacucauc

SEQ ID NO: 4183654 - RNA, 14 nt, Yersinia pestis KIM
cugguaccaaucuc

SEQ ID NO: 4183655 - RNA, 20 nt, Yersinia pestis KIM
cugguaccguuuuauuuccc

SEQ ID NO: 4183656 - RNA, 15 nt, Yersinia pestis KIM
cugguagccugcacu

SEQ ID NO: 4183657 - RNA, 21 nt, Yersinia pestis KIM
cuggucacuaaaacugaagca

SEQ ID NO: 4183658 - RNA, 17 nt, Yersinia pestis KIM
cuggucagguaaaccgg

SEQ ID NO: 4183659 - RNA, 21 nt, Yersinia pestis KIM
cuggucauaaucaucugcucc

SEQ ID NO: 4183660 - RNA, 18 nt, Yersinia pestis KIM
cugguccaacuaaacagg

SEQ ID NO: 4183661 - RNA, 18 nt, Yersinia pestis KIM
cuggucccgacaaauacu

SEQ ID NO: 4183662 - RNA, 14 nt, Yersinia pestis KIM
cuggucgauaagca

SEQ ID NO: 4183663 - RNA, 13 nt, Yersinia pestis KIM
cuggugaacgaaa

SEQ ID NO: 4183664 - RNA, 22 nt, Yersinia pestis KIM
cuggugacccgucagcguccug

SEQ ID NO: 4183665 - RNA, 13 nt, Yersinia pestis KIM
cuggugacccuca

SEQ ID NO: 4183666 - RNA, 12 nt, Yersinia pestis KIM
cuggugccguuu

SEQ ID NO: 4183667 - RNA, 18 nt, Yersinia pestis KIM
cuggugcuggugaauggu

SEQ ID NO: 4183668 - RNA, 13 nt, Yersinia pestis KIM
cugguggcugaga

SEQ ID NO: 4183669 - RNA, 23 nt, Yersinia pestis KIM
cuggugucacaaucucuggcaac

SEQ ID NO: 4183670 - RNA, 16 nt, Yersinia pestis KIM
cuggugugagcgagga

SEQ ID NO: 4183671 - RNA, 20 nt, Yersinia pestis KIM
cugguuagagcacagcacuc

SEQ ID NO: 4183672 - RNA, 19 nt, Yersinia pestis KIM
cugguucacaccaaaccgg

SEQ ID NO: 4183673 - RNA, 13 nt, Yersinia pestis KIM
cugguugaaaccu

SEQ ID NO: 4183674 - RNA, 14 nt, Yersinia pestis KIM
cugguugagauaac

SEQ ID NO: 4183675 - RNA, 14 nt, Yersinia pestis KIM
cugguugcuguucu

SEQ ID NO: 4183676 - RNA, 14 nt, Yersinia pestis KIM
cugguuggauuggu

SEQ ID NO: 4183677 - RNA, 15 nt, Yersinia pestis KIM
cugguugugcuucag

SEQ ID NO: 4183678 - RNA, 17 nt, Yersinia pestis KIM
cugguuuuaccaucacc

SEQ ID NO: 4183679 - RNA, 18 nt, Yersinia pestis KIM
cugguuuuaccaucacca

SEQ ID NO: 4183680 - RNA, 13 nt, Yersinia pestis KIM
cugguuuuuuaaa

SEQ ID NO: 4183681 - RNA, 16 nt, Yersinia pestis KIM
cuguaaaaaucaccuc

SEQ ID NO: 4183682 - RNA, 12 nt, Yersinia pestis KIM
cuguaaaacaag

SEQ ID NO: 4183683 - RNA, 23 nt, Yersinia pestis KIM
cuguaaaauaccaauuaauaaga

SEQ ID NO: 4183684 - RNA, 13 nt, Yersinia pestis KIM
cuguaaaaucuuu

SEQ ID NO: 4183685 - RNA, 13 nt, Yersinia pestis KIM
cuguaaaggcaaa

SEQ ID NO: 4183686 - RNA, 14 nt, Yersinia pestis KIM
cuguaaaggcaaag

SEQ ID NO: 4183687 - RNA, 17 nt, Yersinia pestis KIM
cuguaaaggcaaagaag

SEQ ID NO: 4183688 - RNA, 14 nt, Yersinia pestis KIM
cuguaaauaaauaa

SEQ ID NO: 4183689 - RNA, 18 nt, Yersinia pestis KIM
cuguaaauaaauaaucau

SEQ ID NO: 4183690 - RNA, 15 nt, Yersinia pestis KIM
cuguaaccgcaagga

SEQ ID NO: 4183691 - RNA, 19 nt, Yersinia pestis KIM
cuguaacucaaauuauuuu

SEQ ID NO: 4183692 - RNA, 15 nt, Yersinia pestis KIM
cuguaacuuuauuga

SEQ ID NO: 4183693 - RNA, 16 nt, Yersinia pestis KIM
cuguaaggcccgcagu

SEQ ID NO: 4183694 - RNA, 16 nt, Yersinia pestis KIM
cuuaacuacaccgcua

SEQ ID NO: 4183695 - RNA, 13 nt, Yersinia pestis KIM
cuuaacugaaagc

SEQ ID NO: 4183696 - RNA, 16 nt, Yersinia pestis KIM
cuuaagagagaugcaa

SEQ ID NO: 4183697 - RNA, 17 nt, Yersinia pestis KIM
cuuaagcaauauuuuag

SEQ ID NO: 4183698 - RNA, 21 nt, Yersinia pestis KIM
cuuaagcauuggcaaaucauc

SEQ ID NO: 4183699 - RNA, 14 nt, Yersinia pestis KIM
cuuaauaauaucaa

SEQ ID NO: 4183700 - RNA, 15 nt, Yersinia pestis KIM
cuuaauaauaucaaa

SEQ ID NO: 4183701 - RNA, 19 nt, Yersinia pestis KIM
cuuaauaauaucaaauguc

SEQ ID NO: 4183702 - RNA, 12 nt, Yersinia pestis KIM
cuuaauaaugac

SEQ ID NO: 4183703 - RNA, 16 nt, Yersinia pestis KIM
cuuaaucuuuaauuca

SEQ ID NO: 4183704 - RNA, 14 nt, Yersinia pestis KIM
cuuaaugaaugagu

SEQ ID NO: 4183705 - RNA, 23 nt, Yersinia pestis KIM
cuuaauggcaccguggauaaaca

SEQ ID NO: 4183706 - RNA, 16 nt, Yersinia pestis KIM
cuuaauggucuucuuu

SEQ ID NO: 4183707 - RNA, 21 nt, Yersinia pestis KIM
cuuaauucccguuguuuaucc

SEQ ID NO: 4183708 - RNA, 16 nt, Yersinia pestis KIM
cuuaauuuaaauaaga

SEQ ID NO: 4183709 - RNA, 11 nt, Yersinia pestis KIM
cuuaauuuuau

SEQ ID NO: 4183710 - RNA, 15 nt, Yersinia pestis KIM
cuuacauaaguaagu

SEQ ID NO: 4183711 - RNA, 19 nt, Yersinia pestis KIM
cuuacaugaguaagugauu

SEQ ID NO: 4183712 - RNA, 23 nt, Yersinia pestis KIM
cuuacauuucaucuugauuagcg

SEQ ID NO: 4183713 - RNA, 21 nt, Yersinia pestis KIM
cuuaccuauaaacauuuacuu

SEQ ID NO: 4183714 - RNA, 19 nt, Yersinia pestis KIM
cuuaccuucaguuuauuua

SEQ ID NO: 4183715 - RNA, 17 nt, Yersinia pestis KIM
cuuaccuugauccgcca

SEQ ID NO: 4183716 - RNA, 18 nt, Yersinia pestis KIM
cuuaccuugauccgccaa

SEQ ID NO: 4183717 - RNA, 16 nt, Yersinia pestis KIM
cuuacgaucacuuacc

SEQ ID NO: 4183718 - RNA, 18 nt, Yersinia pestis KIM
cuuacuaaaauaucacua

SEQ ID NO: 4183719 - RNA, 14 nt, Yersinia pestis KIM
cuuacuauuuuucu

SEQ ID NO: 4183720 - RNA, 18 nt, Yersinia pestis KIM
cuuacucccuuguugccu

SEQ ID NO: 4183721 - RNA, 14 nt, Yersinia pestis KIM
cuuacuguucaccg

SEQ ID NO: 4183722 - RNA, 23 nt, Yersinia pestis KIM
cuuacuuuuuacggcuuaucaau

SEQ ID NO: 4183723 - RNA, 18 nt, Yersinia pestis KIM
cuuacuuuuuugccugcu

SEQ ID NO: 4183724 - RNA, 23 nt, Yersinia pestis KIM
cuuacuuuuuugccugcucagcu

SEQ ID NO: 4183725 - RNA, 22 nt, Yersinia pestis KIM
cuuagagucacgguaugugugu

SEQ ID NO: 4183726 - RNA, 17 nt, Yersinia pestis KIM
cuuagauugcaaaucac

SEQ ID NO: 4183727 - RNA, 22 nt, Yersinia pestis KIM
cuuagauugcaaaucacgcaau

SEQ ID NO: 4183728 - RNA, 16 nt, Yersinia pestis KIM
cuuagcaauaccagcc

SEQ ID NO: 4183729 - RNA, 19 nt, Yersinia pestis KIM
cuuagcacguuuuucagcu

SEQ ID NO: 4183730 - RNA, 21 nt, Yersinia pestis KIM
cuuagcacguuuuucagcuuc

SEQ ID NO: 4183731 - RNA, 13 nt, Yersinia pestis KIM
cuuagcaggcccu

SEQ ID NO: 4183732 - RNA, 20 nt, Yersinia pestis KIM
cuuagcuguaaaggcaaaga

SEQ ID NO: 4183733 - RNA, 23 nt, Yersinia pestis KIM
cuuaguauccgcgccagacuggc

SEQ ID NO: 4183734 - RNA, 16 nt, Yersinia pestis KIM
cuuagucauuaagaau

SEQ ID NO: 4183735 - RNA, 23 nt, Yersinia pestis KIM
cuuaguuacaauaaaucaauucu

SEQ ID NO: 4183736 - RNA, 14 nt, Yersinia pestis KIM
cuuaguuucuacgg

SEQ ID NO: 4183737 - RNA, 13 nt, Yersinia pestis KIM
cuuauaaacacug

SEQ ID NO: 4183738 - RNA, 12 nt, Yersinia pestis KIM
cuuauaaaccuc

SEQ ID NO: 4183739 - RNA, 18 nt, Yersinia pestis KIM
cuuauacuaaagaaauaa

SEQ ID NO: 4183740 - RNA, 14 nt, Yersinia pestis KIM
cuuauauaaaucca

SEQ ID NO: 4183741 - RNA, 20 nt, Yersinia pestis KIM
cuuaucagcgguaucuagag

SEQ ID NO: 4183742 - RNA, 18 nt, Yersinia pestis KIM
cuuaucauaauccaacuc

SEQ ID NO: 4183743 - RNA, 19 nt, Yersinia pestis KIM
cuuauccagcgccaucagc

SEQ ID NO: 4183744 - RNA, 18 nt, Yersinia pestis KIM
cuuauccccugagaaaca

SEQ ID NO: 4183745 - RNA, 21 nt, Yersinia pestis KIM
cuuauccccugagaaacaucc

SEQ ID NO: 4183746 - RNA, 20 nt, Yersinia pestis KIM
cuuaucgaccaacuggcaau

SEQ ID NO: 4183747 - RNA, 18 nt, Yersinia pestis KIM
cuuaucgucaaguucaua

SEQ ID NO: 4183748 - RNA, 19 nt, Yersinia pestis KIM
cuuaugagcagcccagucu

SEQ ID NO: 4183749 - RNA, 18 nt, Yersinia pestis KIM
cuuauggucgguuuccgc

SEQ ID NO: 4183750 - RNA, 19 nt, Yersinia pestis KIM
cuuauggucgguuuccgcc

SEQ ID NO: 4183751 - RNA, 20 nt, Yersinia pestis KIM
cuuauuaauugguauuuuac

SEQ ID NO: 4183752 - RNA, 18 nt, Yersinia pestis KIM
cuuauuggaaguacuuau

SEQ ID NO: 4183753 - RNA, 14 nt, Yersinia pestis KIM
cuuauuggucgcuu

SEQ ID NO: 4183754 - RNA, 19 nt, Yersinia pestis KIM
cuuauuuaccuguuugcaa

SEQ ID NO: 4183755 - RNA, 22 nt, Yersinia pestis KIM
cuuauuuaccuguuugcaacau

SEQ ID NO: 4183756 - RNA, 23 nt, Yersinia pestis KIM
cuuauuucacgcuaauuauuuua

SEQ ID NO: 4183757 - RNA, 13 nt, Yersinia pestis KIM
cuuauuucuuacu

SEQ ID NO: 4183758 - RNA, 17 nt, Yersinia pestis KIM
cuuauuugaaauacuua

SEQ ID NO: 4183759 - RNA, 18 nt, Yersinia pestis KIM
cuuauuugaaauacuuau

SEQ ID NO: 4183760 - RNA, 12 nt, Yersinia pestis KIM
cuuauuuuagcu

SEQ ID NO: 4183761 - RNA, 18 nt, Yersinia pestis KIM
cuucaaaaucaccuggcc

SEQ ID NO: 4183762 - RNA, 18 nt, Yersinia pestis KIM
cuucaacguggaaguuca

SEQ ID NO: 4183763 - RNA, 13 nt, Yersinia pestis KIM
cuucaagaugcag

SEQ ID NO: 4183764 - RNA, 15 nt, Yersinia pestis KIM
cuucaagcacccauu

SEQ ID NO: 4183765 - RNA, 11 nt, Yersinia pestis KIM
cuucaagcccg

SEQ ID NO: 4183766 - RNA, 20 nt, Yersinia pestis KIM
cuucaagcccgaaauucagu

SEQ ID NO: 4183767 - RNA, 14 nt, Yersinia pestis KIM
cuucaagguacuga

SEQ ID NO: 4183768 - RNA, 23 nt, Yersinia pestis KIM
cuucaauaagaaugacuuuccuu

SEQ ID NO: 4183769 - RNA, 17 nt, Yersinia pestis KIM
cuucaauaccaaauuua

SEQ ID NO: 4183770 - RNA, 16 nt, Yersinia pestis KIM
cuucaaucauugagau

SEQ ID NO: 4183771 - RNA, 12 nt, Yersinia pestis KIM
cuucacacuggu

SEQ ID NO: 4183772 - RNA, 12 nt, Yersinia pestis KIM
cuucacaucaua

SEQ ID NO: 4183773 - RNA, 12 nt, Yersinia pestis KIM
cuucaccaauac

SEQ ID NO: 4183774 - RNA, 22 nt, Yersinia pestis KIM
cuucaccacugugauaaacccc

SEQ ID NO: 4183775 - RNA, 16 nt, Yersinia pestis KIM
cuucacccuggcucug

SEQ ID NO: 4183776 - RNA, 16 nt, Yersinia pestis KIM
cuucaccgcuuuucug

SEQ ID NO: 4183777 - RNA, 19 nt, Yersinia pestis KIM
cuucaccgcuuuucuggua

SEQ ID NO: 4183778 - RNA, 19 nt, Yersinia pestis KIM
cuucacggacagcaaccac

SEQ ID NO: 4183779 - RNA, 20 nt, Yersinia pestis KIM
cuucacggacagcaaccacu

SEQ ID NO: 4183780 - RNA, 22 nt, Yersinia pestis KIM
cuucacuucagaaccgacaggu

SEQ ID NO: 4183781 - RNA, 22 nt, Yersinia pestis KIM
cuucagacaguaaauccugaug

SEQ ID NO: 4183782 - RNA, 13 nt, Yersinia pestis KIM
cuucagacugaaa

SEQ ID NO: 4183783 - RNA, 15 nt, Yersinia pestis KIM
cuucagacugaaagu

SEQ ID NO: 4183784 - RNA, 16 nt, Yersinia pestis KIM
cuucagagccauagau

SEQ ID NO: 4183785 - RNA, 20 nt, Yersinia pestis KIM
cuucagaugaauccagccau

SEQ ID NO: 4183786 - RNA, 22 nt, Yersinia pestis KIM
cuucagaugaauccagccaugc

SEQ ID NO: 4183787 - RNA, 15 nt, Yersinia pestis KIM
cuucagccaccagau

SEQ ID NO: 4183788 - RNA, 19 nt, Yersinia pestis KIM
cuucagcccauggcugaaa

SEQ ID NO: 4183789 - RNA, 18 nt, Yersinia pestis KIM
cuucagccuauccucacc

SEQ ID NO: 4183790 - RNA, 15 nt, Yersinia pestis KIM
cuucagccuucauau

SEQ ID NO: 4183791 - RNA, 19 nt, Yersinia pestis KIM
cuucagcgguagagaucuc

SEQ ID NO: 4183792 - RNA, 22 nt, Yersinia pestis KIM
cuucagcucuucuaacacuuca

SEQ ID NO: 4183793 - RNA, 20 nt, Yersinia pestis KIM
cuucaggaauaaacagcagu

SEQ ID NO: 4183794 - RNA, 11 nt, Yersinia pestis KIM
cuucaggccaa

SEQ ID NO: 4183795 - RNA, 19 nt, Yersinia pestis KIM
cuucaggccaagccugugc

SEQ ID NO: 4183796 - RNA, 20 nt, Yersinia pestis KIM
cuucaggccaagccugugcu

SEQ ID NO: 4183797 - RNA, 23 nt, Yersinia pestis KIM
cuucaguggcuggaaaggaauau

SEQ ID NO: 4183798 - RNA, 17 nt, Yersinia pestis KIM
cuucaguuuugcgggug

SEQ ID NO: 4183799 - RNA, 20 nt, Yersinia pestis KIM
cuucauauauugcauuuaug

SEQ ID NO: 4183800 - RNA, 18 nt, Yersinia pestis KIM
cuucauaucggccaaguu

SEQ ID NO: 4183801 - RNA, 15 nt, Yersinia pestis KIM
cuucaucaucaacaa

SEQ ID NO: 4183802 - RNA, 17 nt, Yersinia pestis KIM
cuucaucccaaucauca

SEQ ID NO: 4183803 - RNA, 14 nt, Yersinia pestis KIM
cuucauguuuauca

SEQ ID NO: 4183804 - RNA, 17 nt, Yersinia pestis KIM
cuucauugccuucuauc

SEQ ID NO: 4183805 - RNA, 12 nt, Yersinia pestis KIM
cuucauugcugc

SEQ ID NO: 4183806 - RNA, 23 nt, Yersinia pestis KIM
cuucauuggcuugguuguuucuu

SEQ ID NO: 4183807 - RNA, 15 nt, Yersinia pestis KIM
cuucauuucaggacu

SEQ ID NO: 4183808 - RNA, 13 nt, Yersinia pestis KIM
cuugcgcgccugu

SEQ ID NO: 4183809 - RNA, 20 nt, Yersinia pestis KIM
cuugcgcgcugggacgcuua

SEQ ID NO: 4183810 - RNA, 22 nt, Yersinia pestis KIM
cuugcgcgcugggacgcuuaau

SEQ ID NO: 4183811 - RNA, 15 nt, Yersinia pestis KIM
cuugcgcuccacgcc

SEQ ID NO: 4183812 - RNA, 16 nt, Yersinia pestis KIM
cuugcucgucaucuuu

SEQ ID NO: 4183813 - RNA, 22 nt, Yersinia pestis KIM
cuugcugaaaacaauauaauaa

SEQ ID NO: 4183814 - RNA, 13 nt, Yersinia pestis KIM
cuugcugcaaccg

SEQ ID NO: 4183815 - RNA, 22 nt, Yersinia pestis KIM
cuugcugguauucaucagcaau

SEQ ID NO: 4183816 - RNA, 22 nt, Yersinia pestis KIM
cuugcuuaucaccccuucacuc

SEQ ID NO: 4183817 - RNA, 21 nt, Yersinia pestis KIM
cuugcuucugaacgaccagaa

SEQ ID NO: 4183818 - RNA, 19 nt, Yersinia pestis KIM
cuuggaacuuacucccuug

SEQ ID NO: 4183819 - RNA, 18 nt, Yersinia pestis KIM
cuuggacaucugcuuuac

SEQ ID NO: 4183820 - RNA, 16 nt, Yersinia pestis KIM
cuuggcaaagagacug

SEQ ID NO: 4183821 - RNA, 16 nt, Yersinia pestis KIM
cuuggcauugucugcu

SEQ ID NO: 4183822 - RNA, 21 nt, Yersinia pestis KIM
cuuggcauugucugcuggccu

SEQ ID NO: 4183823 - RNA, 18 nt, Yersinia pestis KIM
cuuggccggucguauuca

SEQ ID NO: 4183824 - RNA, 15 nt, Yersinia pestis KIM
cuuggcguaacugca

SEQ ID NO: 4183825 - RNA, 18 nt, Yersinia pestis KIM
cuuggcucuggagcucuc

SEQ ID NO: 4183826 - RNA, 23 nt, Yersinia pestis KIM
cuugggaucagccaucagcgccc

SEQ ID NO: 4183827 - RNA, 18 nt, Yersinia pestis KIM
cuugggccgacucugcau

SEQ ID NO: 4183828 - RNA, 22 nt, Yersinia pestis KIM
cuugggcuucacauccaauggc

SEQ ID NO: 4183829 - RNA, 16 nt, Yersinia pestis KIM
cuuggggccucacucu

SEQ ID NO: 4183830 - RNA, 23 nt, Yersinia pestis KIM
cuugggucaguuuuauuaccaua

SEQ ID NO: 4183831 - RNA, 14 nt, Yersinia pestis KIM
cuugggugaagaca

SEQ ID NO: 4183832 - RNA, 16 nt, Yersinia pestis KIM
cuuggguggucagcau

SEQ ID NO: 4183833 - RNA, 19 nt, Yersinia pestis KIM
cuuggucauaccggcggca

SEQ ID NO: 4183834 - RNA, 18 nt, Yersinia pestis KIM
cuugguggagccuguaca

SEQ ID NO: 4183835 - RNA, 13 nt, Yersinia pestis KIM
cuugguuaguucu

SEQ ID NO: 4183836 - RNA, 15 nt, Yersinia pestis KIM
cuuguaccugugcca

SEQ ID NO: 4183837 - RNA, 17 nt, Yersinia pestis KIM
cuuguauauaaaaaaug

SEQ ID NO: 4183838 - RNA, 14 nt, Yersinia pestis KIM
cuuguauccuggcc

SEQ ID NO: 4183839 - RNA, 15 nt, Yersinia pestis KIM
cuugucaggauuuac

SEQ ID NO: 4183840 - RNA, 11 nt, Yersinia pestis KIM
cuugugaugaa

SEQ ID NO: 4183841 - RNA, 17 nt, Yersinia pestis KIM
cuugugcucacgucacc

SEQ ID NO: 4183842 - RNA, 16 nt, Yersinia pestis KIM
cuuguggauccagcac

SEQ ID NO: 4183843 - RNA, 21 nt, Yersinia pestis KIM
cuuguguucuucaucuaaaua

SEQ ID NO: 4183844 - RNA, 19 nt, Yersinia pestis KIM
cuuguguugggcaguaacg

SEQ ID NO: 4183845 - RNA, 16 nt, Yersinia pestis KIM
cuuguucacggcuuug

SEQ ID NO: 4183846 - RNA, 19 nt, Yersinia pestis KIM
cuuguuucuggcacaagaa

SEQ ID NO: 4183847 - RNA, 20 nt, Yersinia pestis KIM
cuuguuugcgccguaaacug

SEQ ID NO: 4183848 - RNA, 18 nt, Yersinia pestis KIM
cuuuaaaaaaauuaucau

SEQ ID NO: 4183849 - RNA, 16 nt, Yersinia pestis KIM
cuuuaaaaacccgccu

SEQ ID NO: 4183850 - RNA, 19 nt, Yersinia pestis KIM
cuuuaaaccccgugcgcuc

SEQ ID NO: 4183851 - RNA, 21 nt, Yersinia pestis KIM
cuuuaaauaacgcaaaaauca

SEQ ID NO: 4183852 - RNA, 13 nt, Yersinia pestis KIM
cuuuaaauccauc

SEQ ID NO: 4183853 - RNA, 13 nt, Yersinia pestis KIM
cuuuaacaacaac

SEQ ID NO: 4183854 - RNA, 24 nt, Yersinia pestis KIM
cuuuaagauccaguucaguccagc

SEQ ID NO: 4183855 - RNA, 16 nt, Yersinia pestis KIM
cuuuaauaaaaucaaa

SEQ ID NO: 4183856 - RNA, 20 nt, Yersinia pestis KIM
cuuuaauagccaaaauaauu

SEQ ID NO: 4183857 - RNA, 20 nt, Yersinia pestis KIM
cuuuaauccauucacgcccu

SEQ ID NO: 4183858 - RNA, 15 nt, Yersinia pestis KIM
cuuuaauuuuucccu

SEQ ID NO: 4183859 - RNA, 14 nt, Yersinia pestis KIM
cuuuaccagccccg

SEQ ID NO: 4183860 - RNA, 22 nt, Yersinia pestis KIM
cuuuaccagccccgguuaaauu

SEQ ID NO: 4183861 - RNA, 16 nt, Yersinia pestis KIM
cuuuaccccauugcac

SEQ ID NO: 4183862 - RNA, 13 nt, Yersinia pestis KIM
cuuuacgaucugc

SEQ ID NO: 4183863 - RNA, 18 nt, Yersinia pestis KIM
cuuuacgaucugccuguu

SEQ ID NO: 4183864 - RNA, 22 nt, Yersinia pestis KIM
cuuuacgaucugccuguucucu

SEQ ID NO: 4183865 - RNA, 20 nt, Yersinia pestis KIM
cuuuacuccccugccuaucc

SEQ ID NO: 4183866 - RNA, 15 nt, Yersinia pestis KIM
cuuuacuccucugcc

SEQ ID NO: 4183867 - RNA, 20 nt, Yersinia pestis KIM
cuuuacuccucugccuaucc

SEQ ID NO: 4183868 - RNA, 19 nt, Yersinia pestis KIM
cuuuacucuucagccuauc

SEQ ID NO: 4183869 - RNA, 20 nt, Yersinia pestis KIM
cuuuacucuucugcccaucc

SEQ ID NO: 4183870 - RNA, 21 nt, Yersinia pestis KIM
cuuuacucuucugcccauccu

SEQ ID NO: 4183871 - RNA, 16 nt, Yersinia pestis KIM
cuuuacugcauugaga

SEQ ID NO: 4183872 - RNA, 15 nt, Yersinia pestis KIM
cuuuagcuauuacua

SEQ ID NO: 4183873 - RNA, 21 nt, Yersinia pestis KIM
cuuuaggauuuauuucucuga

SEQ ID NO: 4183874 - RNA, 13 nt, Yersinia pestis KIM
cuuuaguggguga

SEQ ID NO: 4183875 - RNA, 17 nt, Yersinia pestis KIM
cuuuauacccaaaauaa

SEQ ID NO: 4183876 - RNA, 13 nt, Yersinia pestis KIM
cuuuauauucaau

SEQ ID NO: 4183877 - RNA, 14 nt, Yersinia pestis KIM
cuuuauauucaaua

SEQ ID NO: 4183878 - RNA, 21 nt, Yersinia pestis KIM
cuuuaucgccagcugcaauug

SEQ ID NO: 4183879 - RNA, 12 nt, Yersinia pestis KIM
cuuuaucugcca

SEQ ID NO: 4183880 - RNA, 14 nt, Yersinia pestis KIM
cuuuaugucuuuuu

SEQ ID NO: 4183881 - RNA, 20 nt, Yersinia pestis KIM
cuuuauuccucugccuauuc

SEQ ID NO: 4183882 - RNA, 14 nt, Yersinia pestis KIM
cuuuauugcuccuu

SEQ ID NO: 4183883 - RNA, 17 nt, Yersinia pestis KIM
cuuuauugcuccuuacu

SEQ ID NO: 4183884 - RNA, 19 nt, Yersinia pestis KIM
cuuuauugcuccuuacuau

SEQ ID NO: 4183885 - RNA, 11 nt, Yersinia pestis KIM
cuuucaacgca

SEQ ID NO: 4183886 - RNA, 23 nt, Yersinia pestis KIM
cuuucaacuauugcaucuuuaau

SEQ ID NO: 4183887 - RNA, 19 nt, Yersinia pestis KIM
cuuucagaauugugccccu

SEQ ID NO: 4183888 - RNA, 21 nt, Yersinia pestis KIM
cuuucagacaagccagugacu

SEQ ID NO: 4183889 - RNA, 12 nt, Yersinia pestis KIM
cuuucaguaauc

SEQ ID NO: 4183890 - RNA, 15 nt, Yersinia pestis KIM
cuuucauacaucauu

SEQ ID NO: 4183891 - RNA, 23 nt, Yersinia pestis KIM
cuuucauaucaaaaggauaaccu

SEQ ID NO: 4183892 - RNA, 22 nt, Yersinia pestis KIM
cuuucauuuguuggcaaauuaa

SEQ ID NO: 4183893 - RNA, 18 nt, Yersinia pestis KIM
cuuuccacgcccaacucu

SEQ ID NO: 4183894 - RNA, 20 nt, Yersinia pestis KIM
cuuuccagcgguuuuuucuu

SEQ ID NO: 4183895 - RNA, 23 nt, Yersinia pestis KIM
cuuuccagguuuuggcuaccuuc

SEQ ID NO: 4183896 - RNA, 22 nt, Yersinia pestis KIM
cuuuccccauuuuuuuauaauc

SEQ ID NO: 4183897 - RNA, 16 nt, Yersinia pestis KIM
cuuucccucgguguca

SEQ ID NO: 4183898 - RNA, 14 nt, Yersinia pestis KIM
cuuuccuuccucuu

SEQ ID NO: 4183899 - RNA, 14 nt, Yersinia pestis KIM
cuuucgacacauuu

SEQ ID NO: 4183900 - RNA, 20 nt, Yersinia pestis KIM
cuuucgaccucaguuuugcu

SEQ ID NO: 4183901 - RNA, 21 nt, Yersinia pestis KIM
cuuucgaccucaguuuugcua

SEQ ID NO: 4183902 - RNA, 20 nt, Yersinia pestis KIM
cuuucgaguuuauauugcca

SEQ ID NO: 4183903 - RNA, 15 nt, Yersinia pestis KIM
cuuucgcacuuuaaa

SEQ ID NO: 4183904 - RNA, 14 nt, Yersinia pestis KIM
cuuucguucacuua

SEQ ID NO: 4183905 - RNA, 15 nt, Yersinia pestis KIM
cuuucuaagcugccu

SEQ ID NO: 4183906 - RNA, 16 nt, Yersinia pestis KIM
cuuucuaagcugccug

SEQ ID NO: 4183907 - RNA, 16 nt, Yersinia pestis KIM
cuuucuaauuauuaaa

SEQ ID NO: 4183908 - RNA, 16 nt, Yersinia pestis KIM
cuuucucauuagcguc

SEQ ID NO: 4183909 - RNA, 19 nt, Yersinia pestis KIM
cuuucucgauacaauuuuu

SEQ ID NO: 4183910 - RNA, 15 nt, Yersinia pestis KIM
cuuucucggugugcu

SEQ ID NO: 4183911 - RNA, 22 nt, Yersinia pestis KIM
cuuucucuggcacgcuuucugc

SEQ ID NO: 4183912 - RNA, 18 nt, Yersinia pestis KIM
cuuucugggguauguaau

SEQ ID NO: 4183913 - RNA, 16 nt, Yersinia pestis KIM
cuuucuuaauaauauc

SEQ ID NO: 4183914 - RNA, 19 nt, Yersinia pestis KIM
cuuucuuaauaauaucaaa

SEQ ID NO: 4183915 - RNA, 21 nt, Yersinia pestis KIM
cuuucuuuucgcuauuucucu

SEQ ID NO: 4183916 - RNA, 19 nt, Yersinia pestis KIM
cuuugacaugucccucugu

SEQ ID NO: 4183917 - RNA, 17 nt, Yersinia pestis KIM
cuuugaccauuuguuuu

SEQ ID NO: 4183918 - RNA, 22 nt, Yersinia pestis KIM
cuuugacuaauacugcgguccu

SEQ ID NO: 4183919 - RNA, 21 nt, Yersinia pestis KIM
cuuugagaaaggauuugaaga

SEQ ID NO: 4183920 - RNA, 18 nt, Yersinia pestis KIM
cuuugauagaaauagcca

SEQ ID NO: 4183921 - RNA, 14 nt, Yersinia pestis KIM
cuuugaugccuaau

SEQ ID NO: 4183922 - RNA, 20 nt, Yersinia pestis KIM
gaaaccuacgccuaaaaaug

SEQ ID NO: 4183923 - RNA, 16 nt, Yersinia pestis KIM
gaaacgauuacccacc

SEQ ID NO: 4183924 - RNA, 17 nt, Yersinia pestis KIM
gaaacgauuacccacca

SEQ ID NO: 4183925 - RNA, 14 nt, Yersinia pestis KIM
gaaacgccagccuc

SEQ ID NO: 4183926 - RNA, 19 nt, Yersinia pestis KIM
gaaacgccuccucuuggau

SEQ ID NO: 4183927 - RNA, 17 nt, Yersinia pestis KIM
gaaacggugaggauagg

SEQ ID NO: 4183928 - RNA, 13 nt, Yersinia pestis KIM
gaaacuaacgcgu

SEQ ID NO: 4183929 - RNA, 19 nt, Yersinia pestis KIM
gaaacuccagucacuggcc

SEQ ID NO: 4183930 - RNA, 23 nt, Yersinia pestis KIM
gaaacuggagaucugcuguaggu

SEQ ID NO: 4183931 - RNA, 14 nt, Yersinia pestis KIM
gaaacuucaaaauc

SEQ ID NO: 4183932 - RNA, 14 nt, Yersinia pestis KIM
gaaacuuugcuuug

SEQ ID NO: 4183933 - RNA, 13 nt, Yersinia pestis KIM
gaaagaaaaauag

SEQ ID NO: 4183934 - RNA, 15 nt, Yersinia pestis KIM
gaaagaaaaauagac

SEQ ID NO: 4183935 - RNA, 14 nt, Yersinia pestis KIM
gaaagaagacauau

SEQ ID NO: 4183936 - RNA, 14 nt, Yersinia pestis KIM
gaaagcaggucgcc

SEQ ID NO: 4183937 - RNA, 14 nt, Yersinia pestis KIM
gaaagcgccugugg

SEQ ID NO: 4183938 - RNA, 13 nt, Yersinia pestis KIM
gaaagcuucaacu

SEQ ID NO: 4183939 - RNA, 17 nt, Yersinia pestis KIM
gaaaggaacaaaagaga

SEQ ID NO: 4183940 - RNA, 16 nt, Yersinia pestis KIM
gaaaggaauaucugug

SEQ ID NO: 4183941 - RNA, 15 nt, Yersinia pestis KIM
gaaaguugagcagca

SEQ ID NO: 4183942 - RNA, 15 nt, Yersinia pestis KIM
gaaaguuuauaugcu

SEQ ID NO: 4183943 - RNA, 18 nt, Yersinia pestis KIM
gaaauaaaaaccgcagca

SEQ ID NO: 4183944 - RNA, 19 nt, Yersinia pestis KIM
gaaauaaagucguucuuug

SEQ ID NO: 4183945 - RNA, 13 nt, Yersinia pestis KIM
gaaauaaauaagu

SEQ ID NO: 4183946 - RNA, 18 nt, Yersinia pestis KIM
gaaauaaauaaguucaga

SEQ ID NO: 4183947 - RNA, 17 nt, Yersinia pestis KIM
gaaauaaauucaucuca

SEQ ID NO: 4183948 - RNA, 17 nt, Yersinia pestis KIM
gaaauaacugccagggc

SEQ ID NO: 4183949 - RNA, 22 nt, Yersinia pestis KIM
gaaauaauaucaagucuugaag

SEQ ID NO: 4183950 - RNA, 20 nt, Yersinia pestis KIM
gaaauaaucauaucaaaaua

SEQ ID NO: 4183951 - RNA, 20 nt, Yersinia pestis KIM
gaaauacaggcuauauugcu

SEQ ID NO: 4183952 - RNA, 15 nt, Yersinia pestis KIM
gaaauaccacggcac

SEQ ID NO: 4183953 - RNA, 13 nt, Yersinia pestis KIM
gaaauacccccca

SEQ ID NO: 4183954 - RNA, 13 nt, Yersinia pestis KIM
gaaauacuuauuu

SEQ ID NO: 4183955 - RNA, 13 nt, Yersinia pestis KIM
gaaauagaaaacc

SEQ ID NO: 4183956 - RNA, 12 nt, Yersinia pestis KIM
gaaauagcacca

SEQ ID NO: 4183957 - RNA, 17 nt, Yersinia pestis KIM
gaaauagcgccugcccu

SEQ ID NO: 4183958 - RNA, 21 nt, Yersinia pestis KIM
gaaauagucacauuucagcgu

SEQ ID NO: 4183959 - RNA, 16 nt, Yersinia pestis KIM
gaaauagucgcgcugu

SEQ ID NO: 4183960 - RNA, 14 nt, Yersinia pestis KIM
gaaauauucgcauu

SEQ ID NO: 4183961 - RNA, 18 nt, Yersinia pestis KIM
gaaaucagaucaacagau

SEQ ID NO: 4183962 - RNA, 15 nt, Yersinia pestis KIM
gaaaucgaaauuaag

SEQ ID NO: 4183963 - RNA, 12 nt, Yersinia pestis KIM
gaaaugaucacc

SEQ ID NO: 4183964 - RNA, 21 nt, Yersinia pestis KIM
gaaaugccgccugacugcccg

SEQ ID NO: 4183965 - RNA, 14 nt, Yersinia pestis KIM
gaaauuaaggaaaa

SEQ ID NO: 4183966 - RNA, 17 nt, Yersinia pestis KIM
gaaauucauaccuuaau

SEQ ID NO: 4183967 - RNA, 21 nt, Yersinia pestis KIM
gaaauucuguagaguaaaacu

SEQ ID NO: 4183968 - RNA, 15 nt, Yersinia pestis KIM
gaaauugucgcuagc

SEQ ID NO: 4183969 - RNA, 17 nt, Yersinia pestis KIM
gaacaaaacaagcccca

SEQ ID NO: 4183970 - RNA, 16 nt, Yersinia pestis KIM
gaacaaagagcauuac

SEQ ID NO: 4183971 - RNA, 15 nt, Yersinia pestis KIM
gaacaacagcauccg

SEQ ID NO: 4183972 - RNA, 16 nt, Yersinia pestis KIM
gaacaacagcauccgc

SEQ ID NO: 4183973 - RNA, 15 nt, Yersinia pestis KIM
gaacaacgaaacaca

SEQ ID NO: 4183974 - RNA, 19 nt, Yersinia pestis KIM
gaacaauaccgccaauauc

SEQ ID NO: 4183975 - RNA, 16 nt, Yersinia pestis KIM
gaacaccaacaccaca

SEQ ID NO: 4183976 - RNA, 15 nt, Yersinia pestis KIM
gaacagcagaauaau

SEQ ID NO: 4183977 - RNA, 16 nt, Yersinia pestis KIM
gaacagcagaauaauu

SEQ ID NO: 4183978 - RNA, 15 nt, Yersinia pestis KIM
gaacagcccuccagc

SEQ ID NO: 4183979 - RNA, 21 nt, Yersinia pestis KIM
gaacagcggcuuaaugauggc

SEQ ID NO: 4183980 - RNA, 17 nt, Yersinia pestis KIM
gaacagugccaacagcg

SEQ ID NO: 4183981 - RNA, 20 nt, Yersinia pestis KIM
gaacaguuacaggucaacac

SEQ ID NO: 4183982 - RNA, 18 nt, Yersinia pestis KIM
gaacauagcuaacaccgc

SEQ ID NO: 4183983 - RNA, 23 nt, Yersinia pestis KIM
gaacauagcuauuggcugauuca

SEQ ID NO: 4183984 - RNA, 14 nt, Yersinia pestis KIM
gaacauuauuuuuc

SEQ ID NO: 4183985 - RNA, 16 nt, Yersinia pestis KIM
gaacauuauuuuucac

SEQ ID NO: 4183986 - RNA, 21 nt, Yersinia pestis KIM
gaacauucaucuuuugcuauu

SEQ ID NO: 4183987 - RNA, 18 nt, Yersinia pestis KIM
gaacauuuaucuaucugu

SEQ ID NO: 4183988 - RNA, 20 nt, Yersinia pestis KIM
gaacauuuaucuaucuguuc

SEQ ID NO: 4183989 - RNA, 21 nt, Yersinia pestis KIM
gaaccaaaauucacaacuugu

SEQ ID NO: 4183990 - RNA, 12 nt, Yersinia pestis KIM
gaaccaagcaau

SEQ ID NO: 4183991 - RNA, 15 nt, Yersinia pestis KIM
gaaccaaggugguau

SEQ ID NO: 4183992 - RNA, 15 nt, Yersinia pestis KIM
gaaccaauuuuucug

SEQ ID NO: 4183993 - RNA, 20 nt, Yersinia pestis KIM
gaaccacaucgaguggucga

SEQ ID NO: 4183994 - RNA, 23 nt, Yersinia pestis KIM
gaaccaccaagaacgccaaauga

SEQ ID NO: 4183995 - RNA, 12 nt, Yersinia pestis KIM
gaaccagauaac

SEQ ID NO: 4183996 - RNA, 16 nt, Yersinia pestis KIM
gaaccagugaaugcug

SEQ ID NO: 4183997 - RNA, 15 nt, Yersinia pestis KIM
gaacccauucaucaa

SEQ ID NO: 4183998 - RNA, 17 nt, Yersinia pestis KIM
gaaccccuagccagcca

SEQ ID NO: 4183999 - RNA, 20 nt, Yersinia pestis KIM
gaaccccuucaggccaucca

SEQ ID NO: 4184000 - RNA, 20 nt, Yersinia pestis KIM
gaacccgauaacccacagca

SEQ ID NO: 4184001 - RNA, 19 nt, Yersinia pestis KIM
gaacccgcagauaaacccg

SEQ ID NO: 4184002 - RNA, 13 nt, Yersinia pestis KIM
gaacccuucagca

SEQ ID NO: 4184003 - RNA, 17 nt, Yersinia pestis KIM
gaacccuucagcaucga

SEQ ID NO: 4184004 - RNA, 19 nt, Yersinia pestis KIM
gaaccgcagacauaucuga

SEQ ID NO: 4184005 - RNA, 16 nt, Yersinia pestis KIM
gaaccgcuaucugcug

SEQ ID NO: 4184006 - RNA, 18 nt, Yersinia pestis KIM
gaaccucgacuaaacgcc

SEQ ID NO: 4184007 - RNA, 18 nt, Yersinia pestis KIM
gaaccugaaauacaaaua

SEQ ID NO: 4184008 - RNA, 20 nt, Yersinia pestis KIM
gaaccugaaauacaaauaaa

SEQ ID NO: 4184009 - RNA, 16 nt, Yersinia pestis KIM
gaaccugacgcacagc

SEQ ID NO: 4184010 - RNA, 16 nt, Yersinia pestis KIM
gaaccugagcgaucaa

SEQ ID NO: 4184011 - RNA, 23 nt, Yersinia pestis KIM
gaaccugcauccccggcauccca

SEQ ID NO: 4184012 - RNA, 14 nt, Yersinia pestis KIM
gaaccuucucugca

SEQ ID NO: 4184013 - RNA, 23 nt, Yersinia pestis KIM
gaaccuuggcauugucugcuggc

SEQ ID NO: 4184014 - RNA, 15 nt, Yersinia pestis KIM
gaaccuuguuuuacc

SEQ ID NO: 4184015 - RNA, 18 nt, Yersinia pestis KIM
gaacgaggacuuccugcc

SEQ ID NO: 4184016 - RNA, 19 nt, Yersinia pestis KIM
gaacgaggcccgauaaacu

SEQ ID NO: 4184017 - RNA, 21 nt, Yersinia pestis KIM
gaacgaguaaaaagauggccu

SEQ ID NO: 4184018 - RNA, 23 nt, Yersinia pestis KIM
gaacgauuuucuuucaccacugc

SEQ ID NO: 4184019 - RNA, 14 nt, Yersinia pestis KIM
gaacgcuggcggca

SEQ ID NO: 4184020 - RNA, 18 nt, Yersinia pestis KIM
gaacgcuugcgccaaauc

SEQ ID NO: 4184021 - RNA, 22 nt, Yersinia pestis KIM
gaacggacauuuuacucccuga

SEQ ID NO: 4184022 - RNA, 23 nt, Yersinia pestis KIM
gaacggauacccagcacaaugac

SEQ ID NO: 4184023 - RNA, 23 nt, Yersinia pestis KIM
gaacggccugccagaacagcagg

SEQ ID NO: 4184024 - RNA, 14 nt, Yersinia pestis KIM
gaacggucagggaa

SEQ ID NO: 4184025 - RNA, 15 nt, Yersinia pestis KIM
gaacguagcuaacac

SEQ ID NO: 4184026 - RNA, 18 nt, Yersinia pestis KIM
gaacguagcuaacaccgc

SEQ ID NO: 4184027 - RNA, 17 nt, Yersinia pestis KIM
gaacguuugaucccacu

SEQ ID NO: 4184028 - RNA, 18 nt, Yersinia pestis KIM
gaacuaacacuaucuccg

SEQ ID NO: 4184029 - RNA, 16 nt, Yersinia pestis KIM
gaacuaacaugccagc

SEQ ID NO: 4184030 - RNA, 14 nt, Yersinia pestis KIM
gaacuaauaucaac

SEQ ID NO: 4184031 - RNA, 20 nt, Yersinia pestis KIM
gaacuaauaucaacagaacu

SEQ ID NO: 4184032 - RNA, 22 nt, Yersinia pestis KIM
gaacuaauaucaacagaacuaa

SEQ ID NO: 4184033 - RNA, 21 nt, Yersinia pestis KIM
gaacuacuccauccccaacuc

SEQ ID NO: 4184034 - RNA, 16 nt, Yersinia pestis KIM
gaacuagguuaaaauc

SEQ ID NO: 4184035 - RNA, 12 nt, Yersinia pestis KIM
gaacuauugaug

SEQ ID NO: 4184036 - RNA, 16 nt, Yersinia pestis KIM
gaacucaacaauuucg

SEQ ID NO: 4184037 - RNA, 18 nt, Yersinia pestis KIM
gaccagcgccgauauaca

SEQ ID NO: 4184038 - RNA, 13 nt, Yersinia pestis KIM
gaccaguaaguga

SEQ ID NO: 4184039 - RNA, 17 nt, Yersinia pestis KIM
gaccaguggugcucccg

SEQ ID NO: 4184040 - RNA, 14 nt, Yersinia pestis KIM
gaccauaaaaggau

SEQ ID NO: 4184041 - RNA, 23 nt, Yersinia pestis KIM
gaccaucccccauggggccaccu

SEQ ID NO: 4184042 - RNA, 12 nt, Yersinia pestis KIM
gaccaucugcuu

SEQ ID NO: 4184043 - RNA, 16 nt, Yersinia pestis KIM
gaccauggcgaugcgu

SEQ ID NO: 4184044 - RNA, 12 nt, Yersinia pestis KIM
gaccauuucucu

SEQ ID NO: 4184045 - RNA, 14 nt, Yersinia pestis KIM
gacccacaucggcc

SEQ ID NO: 4184046 - RNA, 14 nt, Yersinia pestis KIM
gacccauuauauag

SEQ ID NO: 4184047 - RNA, 20 nt, Yersinia pestis KIM
gaccccuucuuccagcauca

SEQ ID NO: 4184048 - RNA, 16 nt, Yersinia pestis KIM
gacccggcaaauaaau

SEQ ID NO: 4184049 - RNA, 19 nt, Yersinia pestis KIM
gacccggcaaauaaauacc

SEQ ID NO: 4184050 - RNA, 14 nt, Yersinia pestis KIM
gacccguuuauaaa

SEQ ID NO: 4184051 - RNA, 17 nt, Yersinia pestis KIM
gacccucuuaaugaaug

SEQ ID NO: 4184052 - RNA, 23 nt, Yersinia pestis KIM
gaccgccaaauccaagccaccac

SEQ ID NO: 4184053 - RNA, 14 nt, Yersinia pestis KIM
gaccgccagugccg

SEQ ID NO: 4184054 - RNA, 21 nt, Yersinia pestis KIM
gaccgcgacacaagccauuuc

SEQ ID NO: 4184055 - RNA, 23 nt, Yersinia pestis KIM
gaccgcuguuugauuaaaacccc

SEQ ID NO: 4184056 - RNA, 12 nt, Yersinia pestis KIM
gaccggccgcuu

SEQ ID NO: 4184057 - RNA, 22 nt, Yersinia pestis KIM
gaccggggaucaauaaacgcuu

SEQ ID NO: 4184058 - RNA, 16 nt, Yersinia pestis KIM
gaccgucaccaaauag

SEQ ID NO: 4184059 - RNA, 18 nt, Yersinia pestis KIM
gaccuauugauaaaaccg

SEQ ID NO: 4184060 - RNA, 16 nt, Yersinia pestis KIM
gaccuccguaggccaa

SEQ ID NO: 4184061 - RNA, 16 nt, Yersinia pestis KIM
gaccuggaagaacagc

SEQ ID NO: 4184062 - RNA, 19 nt, Yersinia pestis KIM
gaccuguagcuuuuuaaau

SEQ ID NO: 4184063 - RNA, 16 nt, Yersinia pestis KIM
gaccugugcaccacac

SEQ ID NO: 4184064 - RNA, 15 nt, Yersinia pestis KIM
gaccuuaauaccgug

SEQ ID NO: 4184065 - RNA, 20 nt, Yersinia pestis KIM
gaccuuagauaaauagacuc

SEQ ID NO: 4184066 - RNA, 21 nt, Yersinia pestis KIM
gaccuuaucaucacugaaagu

SEQ ID NO: 4184067 - RNA, 18 nt, Yersinia pestis KIM
gacgaaaaccuaauacuu

SEQ ID NO: 4184068 - RNA, 19 nt, Yersinia pestis KIM
gacgaaauagcgccugccc

SEQ ID NO: 4184069 - RNA, 13 nt, Yersinia pestis KIM
gacgaacagcccc

SEQ ID NO: 4184070 - RNA, 17 nt, Yersinia pestis KIM
gacgaacagugccaaca

SEQ ID NO: 4184071 - RNA, 16 nt, Yersinia pestis KIM
gacgacacaaaugcug

SEQ ID NO: 4184072 - RNA, 23 nt, Yersinia pestis KIM
gacgacacaaaugcugugccaug

SEQ ID NO: 4184073 - RNA, 14 nt, Yersinia pestis KIM
gacgaccaauauca

SEQ ID NO: 4184074 - RNA, 20 nt, Yersinia pestis KIM
gacgagaucauuggcuauca

SEQ ID NO: 4184075 - RNA, 16 nt, Yersinia pestis KIM
gacgagcccaggcgac

SEQ ID NO: 4184076 - RNA, 14 nt, Yersinia pestis KIM
gacgauaaauucaa

SEQ ID NO: 4184077 - RNA, 20 nt, Yersinia pestis KIM
gacgauaaauucaaauauca

SEQ ID NO: 4184078 - RNA, 13 nt, Yersinia pestis KIM
gacgauaacgcgg

SEQ ID NO: 4184079 - RNA, 23 nt, Yersinia pestis KIM
gacgauaacuuuuggcagcacca

SEQ ID NO: 4184080 - RNA, 12 nt, Yersinia pestis KIM
gacgaucuugcc

SEQ ID NO: 4184081 - RNA, 21 nt, Yersinia pestis KIM
gacgcagcaggcguagcgugu

SEQ ID NO: 4184082 - RNA, 21 nt, Yersinia pestis KIM
gacgcaguaaguuaguggugu

SEQ ID NO: 4184083 - RNA, 14 nt, Yersinia pestis KIM
gacgcccccgccag

SEQ ID NO: 4184084 - RNA, 23 nt, Yersinia pestis KIM
gacgccccgaaccauuuaccauc

SEQ ID NO: 4184085 - RNA, 14 nt, Yersinia pestis KIM
gacgccggccgguu

SEQ ID NO: 4184086 - RNA, 18 nt, Yersinia pestis KIM
gacgccguaaauacaucc

SEQ ID NO: 4184087 - RNA, 20 nt, Yersinia pestis KIM
gacgccguaaauacauccau

SEQ ID NO: 4184088 - RNA, 16 nt, Yersinia pestis KIM
gacgccguacaaauau

SEQ ID NO: 4184089 - RNA, 20 nt, Yersinia pestis KIM
gacgccuguuucggcaggca

SEQ ID NO: 4184090 - RNA, 15 nt, Yersinia pestis KIM
gacgcggugacaaug

SEQ ID NO: 4184091 - RNA, 15 nt, Yersinia pestis KIM
gacgcucgcugcugg

SEQ ID NO: 4184092 - RNA, 13 nt, Yersinia pestis KIM
gacgcuuauccug

SEQ ID NO: 4184093 - RNA, 22 nt, Yersinia pestis KIM
gacgcuuuacuccucugccuau

SEQ ID NO: 4184094 - RNA, 12 nt, Yersinia pestis KIM
gacggcggcgga

SEQ ID NO: 4184095 - RNA, 13 nt, Yersinia pestis KIM
gacggcugacaaa

SEQ ID NO: 4184096 - RNA, 20 nt, Yersinia pestis KIM
gacgggacaaucuguuccug

SEQ ID NO: 4184097 - RNA, 15 nt, Yersinia pestis KIM
gacggguauaucacu

SEQ ID NO: 4184098 - RNA, 16 nt, Yersinia pestis KIM
gacgguacugaaaucc

SEQ ID NO: 4184099 - RNA, 16 nt, Yersinia pestis KIM
gacggucagccaacga

SEQ ID NO: 4184100 - RNA, 21 nt, Yersinia pestis KIM
gacgguugugguauggauauu

SEQ ID NO: 4184101 - RNA, 20 nt, Yersinia pestis KIM
gacguaaaaaggcagugaca

SEQ ID NO: 4184102 - RNA, 21 nt, Yersinia pestis KIM
gacguaaaaaggcagugacag

SEQ ID NO: 4184103 - RNA, 19 nt, Yersinia pestis KIM
gacguaauuuuaagccgca

SEQ ID NO: 4184104 - RNA, 13 nt, Yersinia pestis KIM
gacguccaaccca

SEQ ID NO: 4184105 - RNA, 23 nt, Yersinia pestis KIM
gacgugcucgucuucgacagcag

SEQ ID NO: 4184106 - RNA, 20 nt, Yersinia pestis KIM
gacgugugcuguaagaaaaa

SEQ ID NO: 4184107 - RNA, 21 nt, Yersinia pestis KIM
gacgugugcuguaagaaaaag

SEQ ID NO: 4184108 - RNA, 13 nt, Yersinia pestis KIM
gacguugcagggg

SEQ ID NO: 4184109 - RNA, 18 nt, Yersinia pestis KIM
gacuaaaaaccgccacag

SEQ ID NO: 4184110 - RNA, 16 nt, Yersinia pestis KIM
gacuaaaauucaaaca

SEQ ID NO: 4184111 - RNA, 16 nt, Yersinia pestis KIM
gacuaaacgcccagcu

SEQ ID NO: 4184112 - RNA, 17 nt, Yersinia pestis KIM
gacuaaacugaucauca

SEQ ID NO: 4184113 - RNA, 16 nt, Yersinia pestis KIM
gacuaaccaagccauc

SEQ ID NO: 4184114 - RNA, 17 nt, Yersinia pestis KIM
gacuaaccaagccaucg

SEQ ID NO: 4184115 - RNA, 14 nt, Yersinia pestis KIM
gacuaaccucugca

SEQ ID NO: 4184116 - RNA, 10 nt, Yersinia pestis KIM
gacuaacucu

SEQ ID NO: 4184117 - RNA, 14 nt, Yersinia pestis KIM
gacuaaggcaaccu

SEQ ID NO: 4184118 - RNA, 17 nt, Yersinia pestis KIM
gacuaaggcaaccugag

SEQ ID NO: 4184119 - RNA, 21 nt, Yersinia pestis KIM
gacuaauauuucaggcuguga

SEQ ID NO: 4184120 - RNA, 21 nt, Yersinia pestis KIM
gacuaauugugcagcaucacc

SEQ ID NO: 4184121 - RNA, 17 nt, Yersinia pestis KIM
gacuacugucuuuuuug

SEQ ID NO: 4184122 - RNA, 22 nt, Yersinia pestis KIM
gacuaucucuuccugggccagu

SEQ ID NO: 4184123 - RNA, 15 nt, Yersinia pestis KIM
gacuauuuaaauaca

SEQ ID NO: 4184124 - RNA, 12 nt, Yersinia pestis KIM
gacucaagccuc

SEQ ID NO: 4184125 - RNA, 17 nt, Yersinia pestis KIM
gacucacguauuuucau

SEQ ID NO: 4184126 - RNA, 14 nt, Yersinia pestis KIM
gacucacgucagua

SEQ ID NO: 4184127 - RNA, 16 nt, Yersinia pestis KIM
gacucacgucaguaau

SEQ ID NO: 4184128 - RNA, 15 nt, Yersinia pestis KIM
gacucaucaaaacaa

SEQ ID NO: 4184129 - RNA, 22 nt, Yersinia pestis KIM
gacucauuaaauccaauauucc

SEQ ID NO: 4184130 - RNA, 18 nt, Yersinia pestis KIM
gacucccucaccgccuag

SEQ ID NO: 4184131 - RNA, 15 nt, Yersinia pestis KIM
gacucgaucuugaac

SEQ ID NO: 4184132 - RNA, 16 nt, Yersinia pestis KIM
gacucgaucuugaacg

SEQ ID NO: 4184133 - RNA, 17 nt, Yersinia pestis KIM
gacucuccgggcauaaa

SEQ ID NO: 4184134 - RNA, 21 nt, Yersinia pestis KIM
gacucugcgcucauacucagu

SEQ ID NO: 4184135 - RNA, 21 nt, Yersinia pestis KIM
gacucuuuauuuauggcgggu

SEQ ID NO: 4184136 - RNA, 23 nt, Yersinia pestis KIM
gacugaaaguagaaauaaaaacc

SEQ ID NO: 4184137 - RNA, 18 nt, Yersinia pestis KIM
gacugauaccggaaaaug

SEQ ID NO: 4184138 - RNA, 22 nt, Yersinia pestis KIM
gacugauaccggaaaaugcgcc

SEQ ID NO: 4184139 - RNA, 18 nt, Yersinia pestis KIM
gacugauagcaaacaaac

SEQ ID NO: 4184140 - RNA, 19 nt, Yersinia pestis KIM
gacugcauuaccuuuaaaa

SEQ ID NO: 4184141 - RNA, 18 nt, Yersinia pestis KIM
gacugcauucacauagcc

SEQ ID NO: 4184142 - RNA, 21 nt, Yersinia pestis KIM
gacugcccaaaauaauguuug

SEQ ID NO: 4184143 - RNA, 16 nt, Yersinia pestis KIM
gacugcccgccugcuu

SEQ ID NO: 4184144 - RNA, 19 nt, Yersinia pestis KIM
gacugcuaauaccaccacc

SEQ ID NO: 4184145 - RNA, 14 nt, Yersinia pestis KIM
gacugcucuuuccc

SEQ ID NO: 4184146 - RNA, 17 nt, Yersinia pestis KIM
gacuggaaacugacaua

SEQ ID NO: 4184147 - RNA, 15 nt, Yersinia pestis KIM
gacuggacaaauaaa

SEQ ID NO: 4184148 - RNA, 23 nt, Yersinia pestis KIM
gacuggcgauauggcacaggcaa

SEQ ID NO: 4184149 - RNA, 13 nt, Yersinia pestis KIM
gacugguugcugg

SEQ ID NO: 4184150 - RNA, 14 nt, Yersinia pestis KIM
gacugguugcuggu

SEQ ID NO: 4184151 - RNA, 15 nt, Yersinia pestis KIM
gacugguugcugguu

SEQ ID NO: 4184152 - RNA, 19 nt, Yersinia pestis KIM
gagggacgcgaaucccccc

SEQ ID NO: 4184153 - RNA, 17 nt, Yersinia pestis KIM
gagggagucagggaguc

SEQ ID NO: 4184154 - RNA, 22 nt, Yersinia pestis KIM
gagggcgguuaaauacagcacc

SEQ ID NO: 4184155 - RNA, 21 nt, Yersinia pestis KIM
gagggcuauuuuuaugcaggg

SEQ ID NO: 4184156 - RNA, 17 nt, Yersinia pestis KIM
gagggcuucuggcgugu

SEQ ID NO: 4184157 - RNA, 15 nt, Yersinia pestis KIM
gagggugaugacaau

SEQ ID NO: 4184158 - RNA, 16 nt, Yersinia pestis KIM
gagggugaugacaaug

SEQ ID NO: 4184159 - RNA, 15 nt, Yersinia pestis KIM
gaggguugucagcag

SEQ ID NO: 4184160 - RNA, 17 nt, Yersinia pestis KIM
gaggguugucagcaguc

SEQ ID NO: 4184161 - RNA, 19 nt, Yersinia pestis KIM
gaggguugucagcagucug

SEQ ID NO: 4184162 - RNA, 16 nt, Yersinia pestis KIM
gagguacggccagcaa

SEQ ID NO: 4184163 - RNA, 17 nt, Yersinia pestis KIM
gagguagacguaucaug

SEQ ID NO: 4184164 - RNA, 16 nt, Yersinia pestis KIM
gaggucauucagguuu

SEQ ID NO: 4184165 - RNA, 23 nt, Yersinia pestis KIM
gagguuuugggcuaaaagggagu

SEQ ID NO: 4184166 - RNA, 20 nt, Yersinia pestis KIM
gagguuuuucauaugcgccu

SEQ ID NO: 4184167 - RNA, 12 nt, Yersinia pestis KIM
gaguaaacagag

SEQ ID NO: 4184168 - RNA, 13 nt, Yersinia pestis KIM
gaguaaaccguac

SEQ ID NO: 4184169 - RNA, 21 nt, Yersinia pestis KIM
gaguaaagcaggccuucuaac

SEQ ID NO: 4184170 - RNA, 15 nt, Yersinia pestis KIM
gaguaaagcguccgc

SEQ ID NO: 4184171 - RNA, 11 nt, Yersinia pestis KIM
gaguaaauaca

SEQ ID NO: 4184172 - RNA, 20 nt, Yersinia pestis KIM
gaguaaauucgggcuuuaau

SEQ ID NO: 4184173 - RNA, 22 nt, Yersinia pestis KIM
gaguaaguucgucagugaugac

SEQ ID NO: 4184174 - RNA, 23 nt, Yersinia pestis KIM
gaguaaucgccugcugagccaaa

SEQ ID NO: 4184175 - RNA, 14 nt, Yersinia pestis KIM
gaguaaugaaaucu

SEQ ID NO: 4184176 - RNA, 22 nt, Yersinia pestis KIM
gaguaauuucagauaaaaauaa

SEQ ID NO: 4184177 - RNA, 20 nt, Yersinia pestis KIM
gaguacgaacaguagccccu

SEQ ID NO: 4184178 - RNA, 20 nt, Yersinia pestis KIM
gaguagcaggccgacaauac

SEQ ID NO: 4184179 - RNA, 14 nt, Yersinia pestis KIM
gaguaggaaauaca

SEQ ID NO: 4184180 - RNA, 19 nt, Yersinia pestis KIM
gaguauacggucaaaagcu

SEQ ID NO: 4184181 - RNA, 14 nt, Yersinia pestis KIM
gaguauacuaaaac

SEQ ID NO: 4184182 - RNA, 22 nt, Yersinia pestis KIM
gaguauacuaaaacagcucacu

SEQ ID NO: 4184183 - RNA, 22 nt, Yersinia pestis KIM
gaguauguauccaucugaugag

SEQ ID NO: 4184184 - RNA, 15 nt, Yersinia pestis KIM
gagucacugggguga

SEQ ID NO: 4184185 - RNA, 23 nt, Yersinia pestis KIM
gagucacuggggugaaucaaaac

SEQ ID NO: 4184186 - RNA, 23 nt, Yersinia pestis KIM
gagucacuuauauugaagcuguu

SEQ ID NO: 4184187 - RNA, 21 nt, Yersinia pestis KIM
gagucagcaaggugagcacuu

SEQ ID NO: 4184188 - RNA, 17 nt, Yersinia pestis KIM
gagucagggagucaggg

SEQ ID NO: 4184189 - RNA, 18 nt, Yersinia pestis KIM
gagucagggagucaggga

SEQ ID NO: 4184190 - RNA, 20 nt, Yersinia pestis KIM
gagucagggagucagggagu

SEQ ID NO: 4184191 - RNA, 19 nt, Yersinia pestis KIM
gagucaguaauucacccuu

SEQ ID NO: 4184192 - RNA, 21 nt, Yersinia pestis KIM
gagucaguacggagaauauag

SEQ ID NO: 4184193 - RNA, 21 nt, Yersinia pestis KIM
gagucagucagggugaaagcc

SEQ ID NO: 4184194 - RNA, 13 nt, Yersinia pestis KIM
gagucagucuuug

SEQ ID NO: 4184195 - RNA, 15 nt, Yersinia pestis KIM
gagucaucgggguuu

SEQ ID NO: 4184196 - RNA, 19 nt, Yersinia pestis KIM
gaguccaaccaccaaaaac

SEQ ID NO: 4184197 - RNA, 22 nt, Yersinia pestis KIM
gagucgauagcuuucuccuuug

SEQ ID NO: 4184198 - RNA, 14 nt, Yersinia pestis KIM
gagucgaugaaaca

SEQ ID NO: 4184199 - RNA, 14 nt, Yersinia pestis KIM
gagucgcaaaacuu

SEQ ID NO: 4184200 - RNA, 15 nt, Yersinia pestis KIM
gagucgcaaaacuuc

SEQ ID NO: 4184201 - RNA, 22 nt, Yersinia pestis KIM
gagucgcaaaacuucacuuucu

SEQ ID NO: 4184202 - RNA, 15 nt, Yersinia pestis KIM
gagucgcuccucagc

SEQ ID NO: 4184203 - RNA, 19 nt, Yersinia pestis KIM
gagucgcuccucagccuuu

SEQ ID NO: 4184204 - RNA, 21 nt, Yersinia pestis KIM
gagucgguguacguauggcau

SEQ ID NO: 4184205 - RNA, 21 nt, Yersinia pestis KIM
gagucuaucugcaguauuugc

SEQ ID NO: 4184206 - RNA, 17 nt, Yersinia pestis KIM
gagucuauugaaaaaau

SEQ ID NO: 4184207 - RNA, 18 nt, Yersinia pestis KIM
gagucuauugaaaaaaua

SEQ ID NO: 4184208 - RNA, 23 nt, Yersinia pestis KIM
gagugaaaucuccuguggcacau

SEQ ID NO: 4184209 - RNA, 19 nt, Yersinia pestis KIM
gagugaaggguugaccgca

SEQ ID NO: 4184210 - RNA, 22 nt, Yersinia pestis KIM
gagugaaguaucaccacguuga

SEQ ID NO: 4184211 - RNA, 17 nt, Yersinia pestis KIM
gagugaaucgccguuac

SEQ ID NO: 4184212 - RNA, 18 nt, Yersinia pestis KIM
gagugacggcuucuguaa

SEQ ID NO: 4184213 - RNA, 14 nt, Yersinia pestis KIM
gagugagcgcgggu

SEQ ID NO: 4184214 - RNA, 13 nt, Yersinia pestis KIM
gagugauuauucu

SEQ ID NO: 4184215 - RNA, 14 nt, Yersinia pestis KIM
gagugcggccacac

SEQ ID NO: 4184216 - RNA, 18 nt, Yersinia pestis KIM
gagugcuggcaagcccug

SEQ ID NO: 4184217 - RNA, 18 nt, Yersinia pestis KIM
gaguggacgauaaauuca

SEQ ID NO: 4184218 - RNA, 13 nt, Yersinia pestis KIM
gagugguuuauaa

SEQ ID NO: 4184219 - RNA, 15 nt, Yersinia pestis KIM
gaguguaaaaagcag

SEQ ID NO: 4184220 - RNA, 15 nt, Yersinia pestis KIM
gaguuacgucaaaac

SEQ ID NO: 4184221 - RNA, 13 nt, Yersinia pestis KIM
gaguucucaccaa

SEQ ID NO: 4184222 - RNA, 14 nt, Yersinia pestis KIM
gaguucucaccaag

SEQ ID NO: 4184223 - RNA, 18 nt, Yersinia pestis KIM
gaguuggauauacauauu

SEQ ID NO: 4184224 - RNA, 15 nt, Yersinia pestis KIM
gaguuguugccacag

SEQ ID NO: 4184225 - RNA, 13 nt, Yersinia pestis KIM
gaguuucaggaag

SEQ ID NO: 4184226 - RNA, 14 nt, Yersinia pestis KIM
gaguuuccaguuca

SEQ ID NO: 4184227 - RNA, 18 nt, Yersinia pestis KIM
gaguuucccuuuuccauc

SEQ ID NO: 4184228 - RNA, 14 nt, Yersinia pestis KIM
gaguuuguggggag

SEQ ID NO: 4184229 - RNA, 18 nt, Yersinia pestis KIM
gaguuuuuugcgccacaa

SEQ ID NO: 4184230 - RNA, 15 nt, Yersinia pestis KIM
gauaaaaacauugaa

SEQ ID NO: 4184231 - RNA, 20 nt, Yersinia pestis KIM
gauaaaaagagggucacaag

SEQ ID NO: 4184232 - RNA, 18 nt, Yersinia pestis KIM
gauaaaaauaaucaauga

SEQ ID NO: 4184233 - RNA, 16 nt, Yersinia pestis KIM
gauaaaaaucuuuuaa

SEQ ID NO: 4184234 - RNA, 14 nt, Yersinia pestis KIM
gauaaaaccacuga

SEQ ID NO: 4184235 - RNA, 17 nt, Yersinia pestis KIM
gauaaaacuauucugcu

SEQ ID NO: 4184236 - RNA, 18 nt, Yersinia pestis KIM
gauaaaagaaagggcaac

SEQ ID NO: 4184237 - RNA, 22 nt, Yersinia pestis KIM
gauaaacaauaaacagacuaaa

SEQ ID NO: 4184238 - RNA, 16 nt, Yersinia pestis KIM
gauaaacaucaugaga

SEQ ID NO: 4184239 - RNA, 14 nt, Yersinia pestis KIM
gauaaaccaaucac

SEQ ID NO: 4184240 - RNA, 19 nt, Yersinia pestis KIM
gauaaaccgcuauaucauc

SEQ ID NO: 4184241 - RNA, 22 nt, Yersinia pestis KIM
gauaaacuguuuaagcuuuuua

SEQ ID NO: 4184242 - RNA, 18 nt, Yersinia pestis KIM
gauaaagaugaaggucac

SEQ ID NO: 4184243 - RNA, 23 nt, Yersinia pestis KIM
gauaaaggcaaaagcaucaccaa

SEQ ID NO: 4184244 - RNA, 18 nt, Yersinia pestis KIM
gauaaaggccgcagauaa

SEQ ID NO: 4184245 - RNA, 13 nt, Yersinia pestis KIM
gauaaauaaaaua

SEQ ID NO: 4184246 - RNA, 15 nt, Yersinia pestis KIM
gauaaauaaccgagc

SEQ ID NO: 4184247 - RNA, 21 nt, Yersinia pestis KIM
gauaaauacggucaacgauug

SEQ ID NO: 4184248 - RNA, 19 nt, Yersinia pestis KIM
gauaaauauuuaauaugua

SEQ ID NO: 4184249 - RNA, 13 nt, Yersinia pestis KIM
gauaaaucgccca

SEQ ID NO: 4184250 - RNA, 18 nt, Yersinia pestis KIM
gauaaauucgauaaaagg

SEQ ID NO: 4184251 - RNA, 14 nt, Yersinia pestis KIM
gauaacaguuuacg

SEQ ID NO: 4184252 - RNA, 21 nt, Yersinia pestis KIM
gauaacauuauugaacgcuug

SEQ ID NO: 4184253 - RNA, 19 nt, Yersinia pestis KIM
gauaacauuuuuucuuuua

SEQ ID NO: 4184254 - RNA, 14 nt, Yersinia pestis KIM
gauaaccacuucaa

SEQ ID NO: 4184255 - RNA, 12 nt, Yersinia pestis KIM
gauaaccagcag

SEQ ID NO: 4184256 - RNA, 16 nt, Yersinia pestis KIM
gauaacccacagcaag

SEQ ID NO: 4184257 - RNA, 14 nt, Yersinia pestis KIM
gauaacccacguuc

SEQ ID NO: 4184258 - RNA, 22 nt, Yersinia pestis KIM
gauaacccuaucgucagugcgg

SEQ ID NO: 4184259 - RNA, 16 nt, Yersinia pestis KIM
gauaacgcgaucugaa

SEQ ID NO: 4184260 - RNA, 23 nt, Yersinia pestis KIM
gauaacggcuggucgcuggguuc

SEQ ID NO: 4184261 - RNA, 21 nt, Yersinia pestis KIM
gauaacgggcagguuuuucaa

SEQ ID NO: 4184262 - RNA, 18 nt, Yersinia pestis KIM
gauaacucgcgcuauuua

SEQ ID NO: 4184263 - RNA, 21 nt, Yersinia pestis KIM
gauaacuuccuuugcccuuac

SEQ ID NO: 4184264 - RNA, 23 nt, Yersinia pestis KIM
gauaagaaucuugggaucagcca

SEQ ID NO: 4184265 - RNA, 23 nt, Yersinia pestis KIM
gauaagccauuuuuuauaaacac

SEQ ID NO: 4184266 - RNA, 17 nt, Yersinia pestis KIM
gauccucguuagucacu

SEQ ID NO: 4184267 - RNA, 22 nt, Yersinia pestis KIM
gauccugaaaauagagcauacc

SEQ ID NO: 4184268 - RNA, 13 nt, Yersinia pestis KIM
gauccugcaauaa

SEQ ID NO: 4184269 - RNA, 20 nt, Yersinia pestis KIM
gauccuuuagcgcugcaucu

SEQ ID NO: 4184270 - RNA, 20 nt, Yersinia pestis KIM
gaucgauaguaacaccagca

SEQ ID NO: 4184271 - RNA, 17 nt, Yersinia pestis KIM
gaucgaucucuuuauau

SEQ ID NO: 4184272 - RNA, 21 nt, Yersinia pestis KIM
gaucgaucucuuuauauucaa

SEQ ID NO: 4184273 - RNA, 22 nt, Yersinia pestis KIM
gaucgauggaaccucgcgugcg

SEQ ID NO: 4184274 - RNA, 14 nt, Yersinia pestis KIM
gaucgcacuucaac

SEQ ID NO: 4184275 - RNA, 20 nt, Yersinia pestis KIM
gaucgcccugaauagccuga

SEQ ID NO: 4184276 - RNA, 16 nt, Yersinia pestis KIM
gaucggauaguuaucu

SEQ ID NO: 4184277 - RNA, 16 nt, Yersinia pestis KIM
gaucggccaauaugau

SEQ ID NO: 4184278 - RNA, 23 nt, Yersinia pestis KIM
gaucgguuugccaucacgcagca

SEQ ID NO: 4184279 - RNA, 16 nt, Yersinia pestis KIM
gaucguaaagacgccg

SEQ ID NO: 4184280 - RNA, 12 nt, Yersinia pestis KIM
gaucguaggcuu

SEQ ID NO: 4184281 - RNA, 17 nt, Yersinia pestis KIM
gaucguccggcagggug

SEQ ID NO: 4184282 - RNA, 15 nt, Yersinia pestis KIM
gaucucaucauugac

SEQ ID NO: 4184283 - RNA, 14 nt, Yersinia pestis KIM
gaucucauuuagca

SEQ ID NO: 4184284 - RNA, 15 nt, Yersinia pestis KIM
gaucucuccagccug

SEQ ID NO: 4184285 - RNA, 19 nt, Yersinia pestis KIM
gaucucucgaacccgcaga

SEQ ID NO: 4184286 - RNA, 16 nt, Yersinia pestis KIM
gaucucuuuauauuca

SEQ ID NO: 4184287 - RNA, 17 nt, Yersinia pestis KIM
gaucucuuuauauucaa

SEQ ID NO: 4184288 - RNA, 22 nt, Yersinia pestis KIM
gaucucuuuauauucaauauca

SEQ ID NO: 4184289 - RNA, 13 nt, Yersinia pestis KIM
gaucugaagaugc

SEQ ID NO: 4184290 - RNA, 20 nt, Yersinia pestis KIM
gaucugacauuugcaucuau

SEQ ID NO: 4184291 - RNA, 20 nt, Yersinia pestis KIM
gaucugccccuggcucagua

SEQ ID NO: 4184292 - RNA, 18 nt, Yersinia pestis KIM
gaucugccuguucucucc

SEQ ID NO: 4184293 - RNA, 21 nt, Yersinia pestis KIM
gaucuggcuuucucaacagca

SEQ ID NO: 4184294 - RNA, 16 nt, Yersinia pestis KIM
gaucuucauugccuuc

SEQ ID NO: 4184295 - RNA, 17 nt, Yersinia pestis KIM
gaucuucauugccuucu

SEQ ID NO: 4184296 - RNA, 19 nt, Yersinia pestis KIM
gaucuugaacggugaggau

SEQ ID NO: 4184297 - RNA, 15 nt, Yersinia pestis KIM
gaucuugauaaacau

SEQ ID NO: 4184298 - RNA, 22 nt, Yersinia pestis KIM
gaucuuuggccccgcgcuaacc

SEQ ID NO: 4184299 - RNA, 13 nt, Yersinia pestis KIM
gaugaaaaacugu

SEQ ID NO: 4184300 - RNA, 19 nt, Yersinia pestis KIM
gaugaaacccagaauggaa

SEQ ID NO: 4184301 - RNA, 15 nt, Yersinia pestis KIM
gaugaaacuaaaaua

SEQ ID NO: 4184302 - RNA, 12 nt, Yersinia pestis KIM
gaugaaauaaac

SEQ ID NO: 4184303 - RNA, 18 nt, Yersinia pestis KIM
gaugaagcauuaaacaga

SEQ ID NO: 4184304 - RNA, 19 nt, Yersinia pestis KIM
gaugaagcauuaaacagau

SEQ ID NO: 4184305 - RNA, 19 nt, Yersinia pestis KIM
gaugaauguuccggacuuc

SEQ ID NO: 4184306 - RNA, 18 nt, Yersinia pestis KIM
gaugacaggggauagcaa

SEQ ID NO: 4184307 - RNA, 22 nt, Yersinia pestis KIM
gaugacaucgacggcagugacg

SEQ ID NO: 4184308 - RNA, 19 nt, Yersinia pestis KIM
gaugaccauuuauuuccac

SEQ ID NO: 4184309 - RNA, 18 nt, Yersinia pestis KIM
gaugaccgauuauaugaa

SEQ ID NO: 4184310 - RNA, 17 nt, Yersinia pestis KIM
gaugacgcgaucugaaa

SEQ ID NO: 4184311 - RNA, 16 nt, Yersinia pestis KIM
gaugacuacugucuuu

SEQ ID NO: 4184312 - RNA, 14 nt, Yersinia pestis KIM
gaugagaaguaaaa

SEQ ID NO: 4184313 - RNA, 15 nt, Yersinia pestis KIM
gaugaguauuaccuc

SEQ ID NO: 4184314 - RNA, 13 nt, Yersinia pestis KIM
gaugauaucaccu

SEQ ID NO: 4184315 - RNA, 11 nt, Yersinia pestis KIM
gaugaucaugc

SEQ ID NO: 4184316 - RNA, 21 nt, Yersinia pestis KIM
gaugaugaagcauuaaacaga

SEQ ID NO: 4184317 - RNA, 15 nt, Yersinia pestis KIM
gaugcauauuauaau

SEQ ID NO: 4184318 - RNA, 18 nt, Yersinia pestis KIM
gaugcauauuauaaugaa

SEQ ID NO: 4184319 - RNA, 20 nt, Yersinia pestis KIM
gaugcauauuauaaugaaau

SEQ ID NO: 4184320 - RNA, 21 nt, Yersinia pestis KIM
gaugcauguuauuggcuaaag

SEQ ID NO: 4184321 - RNA, 17 nt, Yersinia pestis KIM
gaugccaaauuaaucuu

SEQ ID NO: 4184322 - RNA, 19 nt, Yersinia pestis KIM
gaugccaaauuaaucuugu

SEQ ID NO: 4184323 - RNA, 16 nt, Yersinia pestis KIM
gaugccaucaauacca

SEQ ID NO: 4184324 - RNA, 13 nt, Yersinia pestis KIM
gaugccauuuacc

SEQ ID NO: 4184325 - RNA, 14 nt, Yersinia pestis KIM
gaugccuaauaauu

SEQ ID NO: 4184326 - RNA, 20 nt, Yersinia pestis KIM
gaugccuucuuucaaaguga

SEQ ID NO: 4184327 - RNA, 14 nt, Yersinia pestis KIM
gaugccuuguuucu

SEQ ID NO: 4184328 - RNA, 14 nt, Yersinia pestis KIM
gaugcgcuccgcca

SEQ ID NO: 4184329 - RNA, 17 nt, Yersinia pestis KIM
gaugcguugugaucguu

SEQ ID NO: 4184330 - RNA, 17 nt, Yersinia pestis KIM
gaugcuaacaacuucca

SEQ ID NO: 4184331 - RNA, 17 nt, Yersinia pestis KIM
gaugcuaaccgaauaaa

SEQ ID NO: 4184332 - RNA, 18 nt, Yersinia pestis KIM
gaugcuaaccgaauaaaa

SEQ ID NO: 4184333 - RNA, 18 nt, Yersinia pestis KIM
gaugcugcacaucaacgg

SEQ ID NO: 4184334 - RNA, 19 nt, Yersinia pestis KIM
gauggaacaggauuuucaa

SEQ ID NO: 4184335 - RNA, 20 nt, Yersinia pestis KIM
gauggaaccucgcgugcggg

SEQ ID NO: 4184336 - RNA, 14 nt, Yersinia pestis KIM
gauggaguaaucau

SEQ ID NO: 4184337 - RNA, 13 nt, Yersinia pestis KIM
gauggagugguca

SEQ ID NO: 4184338 - RNA, 20 nt, Yersinia pestis KIM
gauggauccccguucuagua

SEQ ID NO: 4184339 - RNA, 20 nt, Yersinia pestis KIM
gauggauuugcacauagccc

SEQ ID NO: 4184340 - RNA, 16 nt, Yersinia pestis KIM
gauggcauucguggug

SEQ ID NO: 4184341 - RNA, 13 nt, Yersinia pestis KIM
gauggccgggcug

SEQ ID NO: 4184342 - RNA, 21 nt, Yersinia pestis KIM
gauggccuugaaucaaaauac

SEQ ID NO: 4184343 - RNA, 10 nt, Yersinia pestis KIM
gauggcuguu

SEQ ID NO: 4184344 - RNA, 14 nt, Yersinia pestis KIM
gauggucaacuaaa

SEQ ID NO: 4184345 - RNA, 13 nt, Yersinia pestis KIM
gauggucacccuc

SEQ ID NO: 4184346 - RNA, 23 nt, Yersinia pestis KIM
gaugguggcucugccaauaaagu

SEQ ID NO: 4184347 - RNA, 20 nt, Yersinia pestis KIM
gaugguuaacucauuuaucu

SEQ ID NO: 4184348 - RNA, 12 nt, Yersinia pestis KIM
gauguaaaacac

SEQ ID NO: 4184349 - RNA, 22 nt, Yersinia pestis KIM
gauguagucccccuccggcgcc

SEQ ID NO: 4184350 - RNA, 13 nt, Yersinia pestis KIM
gauguauccaagg

SEQ ID NO: 4184351 - RNA, 19 nt, Yersinia pestis KIM
gaugucagauuaguuuuag

SEQ ID NO: 4184352 - RNA, 17 nt, Yersinia pestis KIM
gaugugauccacacagu

SEQ ID NO: 4184353 - RNA, 13 nt, Yersinia pestis KIM
gaugugcuccgca

SEQ ID NO: 4184354 - RNA, 23 nt, Yersinia pestis KIM
gauguggauaauuucagcagcac

SEQ ID NO: 4184355 - RNA, 21 nt, Yersinia pestis KIM
gauguuaaaccaaagauaaua

SEQ ID NO: 4184356 - RNA, 14 nt, Yersinia pestis KIM
gauguuaacuggcu

SEQ ID NO: 4184357 - RNA, 18 nt, Yersinia pestis KIM
gauguuauuugaauaaga

SEQ ID NO: 4184358 - RNA, 15 nt, Yersinia pestis KIM
gauguuuaacccaau

SEQ ID NO: 4184359 - RNA, 16 nt, Yersinia pestis KIM
gauguuuaacccaaug

SEQ ID NO: 4184360 - RNA, 12 nt, Yersinia pestis KIM
gauuaaccuuau

SEQ ID NO: 4184361 - RNA, 20 nt, Yersinia pestis KIM
gauuaaccuuaucaccaacg

SEQ ID NO: 4184362 - RNA, 18 nt, Yersinia pestis KIM
gauuaacuucuauuuuuc

SEQ ID NO: 4184363 - RNA, 17 nt, Yersinia pestis KIM
gauuaagaaaacauuaa

SEQ ID NO: 4184364 - RNA, 19 nt, Yersinia pestis KIM
gauuaaguccgguuguggc

SEQ ID NO: 4184365 - RNA, 13 nt, Yersinia pestis KIM
gauuacaaaauau

SEQ ID NO: 4184366 - RNA, 15 nt, Yersinia pestis KIM
gauuacaaaauauac

SEQ ID NO: 4184367 - RNA, 12 nt, Yersinia pestis KIM
gauuaccggcac

SEQ ID NO: 4184368 - RNA, 19 nt, Yersinia pestis KIM
gauuacguuccacugcuuu

SEQ ID NO: 4184369 - RNA, 19 nt, Yersinia pestis KIM
gauuagcagggcaguaaaa

SEQ ID NO: 4184370 - RNA, 16 nt, Yersinia pestis KIM
gauuagcgagguuuug

SEQ ID NO: 4184371 - RNA, 14 nt, Yersinia pestis KIM
gauuagcuucugcu

SEQ ID NO: 4184372 - RNA, 13 nt, Yersinia pestis KIM
gauuaugcugacc

SEQ ID NO: 4184373 - RNA, 17 nt, Yersinia pestis KIM
gauuauuuauuuacagc

SEQ ID NO: 4184374 - RNA, 15 nt, Yersinia pestis KIM
gauuauuucagcuuc

SEQ ID NO: 4184375 - RNA, 18 nt, Yersinia pestis KIM
gauuauuuuguuuguaaa

SEQ ID NO: 4184376 - RNA, 23 nt, Yersinia pestis KIM
gauucaaacaaggccaccacggg

SEQ ID NO: 4184377 - RNA, 20 nt, Yersinia pestis KIM
gauucacaggcgaguuggcu

SEQ ID NO: 4184378 - RNA, 19 nt, Yersinia pestis KIM
gauucaccaguagcccagc

SEQ ID NO: 4184379 - RNA, 18 nt, Yersinia pestis KIM
gauucaccgauagcccau

SEQ ID NO: 4184380 - RNA, 19 nt, Yersinia pestis KIM
gauucagaaagguaugugc

SEQ ID NO: 4184381 - RNA, 20 nt, Yersinia pestis KIM
gcaagaacaauccauccggu

SEQ ID NO: 4184382 - RNA, 16 nt, Yersinia pestis KIM
gcaagacgguauuuag

SEQ ID NO: 4184383 - RNA, 15 nt, Yersinia pestis KIM
gcaagaguuagggcu

SEQ ID NO: 4184384 - RNA, 16 nt, Yersinia pestis KIM
gcaagcaaccgcaaug

SEQ ID NO: 4184385 - RNA, 17 nt, Yersinia pestis KIM
gcaagcagcucaaaauc

SEQ ID NO: 4184386 - RNA, 13 nt, Yersinia pestis KIM
gcaaggaagucca

SEQ ID NO: 4184387 - RNA, 20 nt, Yersinia pestis KIM
gcaaggauuccccccaguca

SEQ ID NO: 4184388 - RNA, 11 nt, Yersinia pestis KIM
gcaaggccagg

SEQ ID NO: 4184389 - RNA, 13 nt, Yersinia pestis KIM
gcaagguucucgc

SEQ ID NO: 4184390 - RNA, 21 nt, Yersinia pestis KIM
gcaaguggguaauguugcaaa

SEQ ID NO: 4184391 - RNA, 23 nt, Yersinia pestis KIM
gcaaguuaaucauuggcaacuua

SEQ ID NO: 4184392 - RNA, 20 nt, Yersinia pestis KIM
gcaauaaagcgucagaugcu

SEQ ID NO: 4184393 - RNA, 23 nt, Yersinia pestis KIM
gcaauaaaggcaagauuucucuu

SEQ ID NO: 4184394 - RNA, 20 nt, Yersinia pestis KIM
gcaauaacaaacacauccag

SEQ ID NO: 4184395 - RNA, 22 nt, Yersinia pestis KIM
gcaauaacaaacacauccagga

SEQ ID NO: 4184396 - RNA, 18 nt, Yersinia pestis KIM
gcaauaacaccagcaggu

SEQ ID NO: 4184397 - RNA, 15 nt, Yersinia pestis KIM
gcaauaaccaacggg

SEQ ID NO: 4184398 - RNA, 19 nt, Yersinia pestis KIM
gcaauaaccaacgggcaca

SEQ ID NO: 4184399 - RNA, 18 nt, Yersinia pestis KIM
gcaauaaccagaauaauc

SEQ ID NO: 4184400 - RNA, 17 nt, Yersinia pestis KIM
gcaauaauugcacccca

SEQ ID NO: 4184401 - RNA, 19 nt, Yersinia pestis KIM
gcaauacaccgccaguaug

SEQ ID NO: 4184402 - RNA, 13 nt, Yersinia pestis KIM
gcaauagccaugg

SEQ ID NO: 4184403 - RNA, 20 nt, Yersinia pestis KIM
gcaauagcgaucacggguuu

SEQ ID NO: 4184404 - RNA, 22 nt, Yersinia pestis KIM
gcaauagcgaucacggguuuuu

SEQ ID NO: 4184405 - RNA, 15 nt, Yersinia pestis KIM
gcaauagucuggccu

SEQ ID NO: 4184406 - RNA, 17 nt, Yersinia pestis KIM
gcaauauaauaaucuau

SEQ ID NO: 4184407 - RNA, 23 nt, Yersinia pestis KIM
gcaauauccgugauuaaccuuaa

SEQ ID NO: 4184408 - RNA, 21 nt, Yersinia pestis KIM
gcaauaugaaggccauaaucu

SEQ ID NO: 4184409 - RNA, 21 nt, Yersinia pestis KIM
gcaauauugucuuaugauaua

SEQ ID NO: 4184410 - RNA, 21 nt, Yersinia pestis KIM
gcaaucaauguauugcuccag

SEQ ID NO: 4184411 - RNA, 14 nt, Yersinia pestis KIM
gcaauccaaacaua

SEQ ID NO: 4184412 - RNA, 19 nt, Yersinia pestis KIM
gcaaucucugcaguacaga

SEQ ID NO: 4184413 - RNA, 12 nt, Yersinia pestis KIM
gcaaugaaagug

SEQ ID NO: 4184414 - RNA, 22 nt, Yersinia pestis KIM
gcaaugagugcagccaacgccc

SEQ ID NO: 4184415 - RNA, 15 nt, Yersinia pestis KIM
gcaaugccaugacuu

SEQ ID NO: 4184416 - RNA, 20 nt, Yersinia pestis KIM
gcaaugcgguacgcaggccu

SEQ ID NO: 4184417 - RNA, 17 nt, Yersinia pestis KIM
gcaauguguuugcgagc

SEQ ID NO: 4184418 - RNA, 18 nt, Yersinia pestis KIM
gcaauguguuugcgagcc

SEQ ID NO: 4184419 - RNA, 16 nt, Yersinia pestis KIM
gcaauuaagcaaaaag

SEQ ID NO: 4184420 - RNA, 18 nt, Yersinia pestis KIM
gcaauuaagcaaaaaggc

SEQ ID NO: 4184421 - RNA, 20 nt, Yersinia pestis KIM
gcaauuaagcaaaaaggcug

SEQ ID NO: 4184422 - RNA, 18 nt, Yersinia pestis KIM
gcaauuagcacauaugca

SEQ ID NO: 4184423 - RNA, 18 nt, Yersinia pestis KIM
gcaauuaugacguucagu

SEQ ID NO: 4184424 - RNA, 18 nt, Yersinia pestis KIM
gcaauucagccucauaca

SEQ ID NO: 4184425 - RNA, 16 nt, Yersinia pestis KIM
gcaauucagccugugc

SEQ ID NO: 4184426 - RNA, 20 nt, Yersinia pestis KIM
gcaauucgcuuaugacaaua

SEQ ID NO: 4184427 - RNA, 19 nt, Yersinia pestis KIM
gcaauucggccauauacgc

SEQ ID NO: 4184428 - RNA, 18 nt, Yersinia pestis KIM
gcaauuuaucaaacauac

SEQ ID NO: 4184429 - RNA, 12 nt, Yersinia pestis KIM
gcaauuucucug

SEQ ID NO: 4184430 - RNA, 21 nt, Yersinia pestis KIM
gcaauuucucuguauuuucaa

SEQ ID NO: 4184431 - RNA, 20 nt, Yersinia pestis KIM
gcaauuugcuugaaguacgg

SEQ ID NO: 4184432 - RNA, 17 nt, Yersinia pestis KIM
gcacaaacauggcuguc

SEQ ID NO: 4184433 - RNA, 18 nt, Yersinia pestis KIM
gcacaaagcuuacuguuc

SEQ ID NO: 4184434 - RNA, 19 nt, Yersinia pestis KIM
gcacaaagcuuacuguuca

SEQ ID NO: 4184435 - RNA, 14 nt, Yersinia pestis KIM
gcacaacggaaggc

SEQ ID NO: 4184436 - RNA, 10 nt, Yersinia pestis KIM
gcacaaggcc

SEQ ID NO: 4184437 - RNA, 14 nt, Yersinia pestis KIM
gcacaaucagggca

SEQ ID NO: 4184438 - RNA, 15 nt, Yersinia pestis KIM
gcacaaucagggcac

SEQ ID NO: 4184439 - RNA, 22 nt, Yersinia pestis KIM
gcacaaucgcgcuguacaacaa

SEQ ID NO: 4184440 - RNA, 14 nt, Yersinia pestis KIM
gcacaaugcauuca

SEQ ID NO: 4184441 - RNA, 13 nt, Yersinia pestis KIM
gcacaaugccuaa

SEQ ID NO: 4184442 - RNA, 16 nt, Yersinia pestis KIM
gcacacacagccuacg

SEQ ID NO: 4184443 - RNA, 19 nt, Yersinia pestis KIM
gcacacagaugcuggcuuu

SEQ ID NO: 4184444 - RNA, 14 nt, Yersinia pestis KIM
gcacacagcccugc

SEQ ID NO: 4184445 - RNA, 20 nt, Yersinia pestis KIM
gcacacaguuauuaggcauu

SEQ ID NO: 4184446 - RNA, 14 nt, Yersinia pestis KIM
gcacaccacacugg

SEQ ID NO: 4184447 - RNA, 19 nt, Yersinia pestis KIM
gcacacccauacauaccag

SEQ ID NO: 4184448 - RNA, 12 nt, Yersinia pestis KIM
gcacacccccau

SEQ ID NO: 4184449 - RNA, 19 nt, Yersinia pestis KIM
gcacaccgcuacaggcgca

SEQ ID NO: 4184450 - RNA, 18 nt, Yersinia pestis KIM
gcacaccggccaaaauca

SEQ ID NO: 4184451 - RNA, 17 nt, Yersinia pestis KIM
gcacacuuuucacuccg

SEQ ID NO: 4184452 - RNA, 12 nt, Yersinia pestis KIM
gcacagacgccc

SEQ ID NO: 4184453 - RNA, 19 nt, Yersinia pestis KIM
gcacagcacucguggacau

SEQ ID NO: 4184454 - RNA, 21 nt, Yersinia pestis KIM
gcacaggcaaaaagagucagu

SEQ ID NO: 4184455 - RNA, 18 nt, Yersinia pestis KIM
gcacaguuaauuuucacc

SEQ ID NO: 4184456 - RNA, 23 nt, Yersinia pestis KIM
gcacaguuuaucucgcugugccc

SEQ ID NO: 4184457 - RNA, 13 nt, Yersinia pestis KIM
gcacaguuuucuu

SEQ ID NO: 4184458 - RNA, 16 nt, Yersinia pestis KIM
gcacauacuaauagaa

SEQ ID NO: 4184459 - RNA, 18 nt, Yersinia pestis KIM
gcacauacuaauagaaga

SEQ ID NO: 4184460 - RNA, 11 nt, Yersinia pestis KIM
gcacaucaaua

SEQ ID NO: 4184461 - RNA, 19 nt, Yersinia pestis KIM
gcacaucauuuauuuccaa

SEQ ID NO: 4184462 - RNA, 23 nt, Yersinia pestis KIM
gcacaugccgucaccucaucagu

SEQ ID NO: 4184463 - RNA, 14 nt, Yersinia pestis KIM
gcacauuaacacau

SEQ ID NO: 4184464 - RNA, 15 nt, Yersinia pestis KIM
gcaccaaaucuucca

SEQ ID NO: 4184465 - RNA, 16 nt, Yersinia pestis KIM
gcaccaaaucuuccag

SEQ ID NO: 4184466 - RNA, 17 nt, Yersinia pestis KIM
gcaccaaauucagaaug

SEQ ID NO: 4184467 - RNA, 16 nt, Yersinia pestis KIM
gcaccaagaaaaccca

SEQ ID NO: 4184468 - RNA, 20 nt, Yersinia pestis KIM
gcaccaaucauuacaucauc

SEQ ID NO: 4184469 - RNA, 22 nt, Yersinia pestis KIM
gcaccaaucauuacaucaucuu

SEQ ID NO: 4184470 - RNA, 16 nt, Yersinia pestis KIM
gcaccacaauggcaga

SEQ ID NO: 4184471 - RNA, 13 nt, Yersinia pestis KIM
gcaccacacagcg

SEQ ID NO: 4184472 - RNA, 13 nt, Yersinia pestis KIM
gcaccacggucag

SEQ ID NO: 4184473 - RNA, 14 nt, Yersinia pestis KIM
gcaccacggucaga

SEQ ID NO: 4184474 - RNA, 14 nt, Yersinia pestis KIM
gcaccagugccaau

SEQ ID NO: 4184475 - RNA, 18 nt, Yersinia pestis KIM
gcaccauagauuaagaaa

SEQ ID NO: 4184476 - RNA, 15 nt, Yersinia pestis KIM
gcaccauggaaaaua

SEQ ID NO: 4184477 - RNA, 14 nt, Yersinia pestis KIM
gcaccauuugcccu

SEQ ID NO: 4184478 - RNA, 13 nt, Yersinia pestis KIM
gcacccaauggca

SEQ ID NO: 4184479 - RNA, 23 nt, Yersinia pestis KIM
gcacccggcuggcaccaagcagc

SEQ ID NO: 4184480 - RNA, 13 nt, Yersinia pestis KIM
gcaccgcgcuaua

SEQ ID NO: 4184481 - RNA, 14 nt, Yersinia pestis KIM
gcaccgcugauaac

SEQ ID NO: 4184482 - RNA, 23 nt, Yersinia pestis KIM
gcaccgcuggucgggugcaggcc

SEQ ID NO: 4184483 - RNA, 15 nt, Yersinia pestis KIM
gcaccggacaaacca

SEQ ID NO: 4184484 - RNA, 17 nt, Yersinia pestis KIM
gcaccgguguucacucg

SEQ ID NO: 4184485 - RNA, 23 nt, Yersinia pestis KIM
gcaccgguguucacucgcgugcc

SEQ ID NO: 4184486 - RNA, 13 nt, Yersinia pestis KIM
gcaccucaggguu

SEQ ID NO: 4184487 - RNA, 15 nt, Yersinia pestis KIM
gcaccucggggcacu

SEQ ID NO: 4184488 - RNA, 22 nt, Yersinia pestis KIM
gcaccuucaacgauauagagcu

SEQ ID NO: 4184489 - RNA, 12 nt, Yersinia pestis KIM
gcaccuucacgc

SEQ ID NO: 4184490 - RNA, 15 nt, Yersinia pestis KIM
gcaccuuugucauug

SEQ ID NO: 4184491 - RNA, 17 nt, Yersinia pestis KIM
gcaccuuugucauugag

SEQ ID NO: 4184492 - RNA, 23 nt, Yersinia pestis KIM
gcaccuuugucauugaggagcga

SEQ ID NO: 4184493 - RNA, 22 nt, Yersinia pestis KIM
gcacgaaccguggcgcggaugc

SEQ ID NO: 4184494 - RNA, 22 nt, Yersinia pestis KIM
gcacgaaccugagcgaucaaua

SEQ ID NO: 4184495 - RNA, 16 nt, Yersinia pestis KIM
gcacgacaacaaagcc

SEQ ID NO: 4184496 - RNA, 21 nt, Yersinia pestis KIM
gcagguggguuuauugauugg

SEQ ID NO: 4184497 - RNA, 13 nt, Yersinia pestis KIM
gcagguuaaacag

SEQ ID NO: 4184498 - RNA, 14 nt, Yersinia pestis KIM
gcagguuaaacagc

SEQ ID NO: 4184499 - RNA, 23 nt, Yersinia pestis KIM
gcagguucaacgggugacgcugg

SEQ ID NO: 4184500 - RNA, 14 nt, Yersinia pestis KIM
gcaguaacgccaua

SEQ ID NO: 4184501 - RNA, 15 nt, Yersinia pestis KIM
gcaguaacgccauaa

SEQ ID NO: 4184502 - RNA, 18 nt, Yersinia pestis KIM
gcaguaaguuaaaaagaa

SEQ ID NO: 4184503 - RNA, 15 nt, Yersinia pestis KIM
gcaguaauagcaaaa

SEQ ID NO: 4184504 - RNA, 20 nt, Yersinia pestis KIM
gcaguacucggcauugccag

SEQ ID NO: 4184505 - RNA, 18 nt, Yersinia pestis KIM
gcaguaucccuggcucau

SEQ ID NO: 4184506 - RNA, 19 nt, Yersinia pestis KIM
gcaguauuuuaagaaaacu

SEQ ID NO: 4184507 - RNA, 21 nt, Yersinia pestis KIM
gcagucagcaugguagccugc

SEQ ID NO: 4184508 - RNA, 15 nt, Yersinia pestis KIM
gcagucgauaaacau

SEQ ID NO: 4184509 - RNA, 22 nt, Yersinia pestis KIM
gcagucgauaaacaucaugaca

SEQ ID NO: 4184510 - RNA, 21 nt, Yersinia pestis KIM
gcagucugaaacgccagccuc

SEQ ID NO: 4184511 - RNA, 23 nt, Yersinia pestis KIM
gcagucugacagauacuuucggg

SEQ ID NO: 4184512 - RNA, 16 nt, Yersinia pestis KIM
gcagucugagccucau

SEQ ID NO: 4184513 - RNA, 20 nt, Yersinia pestis KIM
gcagucugagccucaugaau

SEQ ID NO: 4184514 - RNA, 17 nt, Yersinia pestis KIM
gcagucugaggagccau

SEQ ID NO: 4184515 - RNA, 15 nt, Yersinia pestis KIM
gcagucugagggcca

SEQ ID NO: 4184516 - RNA, 16 nt, Yersinia pestis KIM
gcagucugagggccac

SEQ ID NO: 4184517 - RNA, 12 nt, Yersinia pestis KIM
gcagugacugaa

SEQ ID NO: 4184518 - RNA, 21 nt, Yersinia pestis KIM
gcagugaucaguccuuagcau

SEQ ID NO: 4184519 - RNA, 17 nt, Yersinia pestis KIM
gcagugcagccaagauc

SEQ ID NO: 4184520 - RNA, 23 nt, Yersinia pestis KIM
gcagugcaucuuccaauucauaa

SEQ ID NO: 4184521 - RNA, 20 nt, Yersinia pestis KIM
gcagugccacggauauccaa

SEQ ID NO: 4184522 - RNA, 20 nt, Yersinia pestis KIM
gcagugcguaaucagccgcg

SEQ ID NO: 4184523 - RNA, 14 nt, Yersinia pestis KIM
gcagugcuucauca

SEQ ID NO: 4184524 - RNA, 15 nt, Yersinia pestis KIM
gcaguggaugauaaa

SEQ ID NO: 4184525 - RNA, 21 nt, Yersinia pestis KIM
gcagugucagggcaauaacaa

SEQ ID NO: 4184526 - RNA, 22 nt, Yersinia pestis KIM
gcaguuaagguuagcuaugcag

SEQ ID NO: 4184527 - RNA, 21 nt, Yersinia pestis KIM
gcaguuagugccuaucugaau
